United States Patent 9,029,523 (PROMOTER, PROMOTER CONTROL ELEMENTS, AND COMBINATIONS, AND USES THEREOF) - sequence listing, part 24

SEQ ID NO: 88218 - DNA, 8 bp, Unknown
  misc_feature (1)..( 8): Result.001 file - promoters70/5664703
tctgaatt

SEQ ID NO: 88219 - DNA, 8 bp, Unknown
  misc_feature (1)..( 8): Result.001 file - promoters70/5664873
tctgaaca

SEQ ID NO: 88220 - DNA, 7 bp, Unknown
  misc_feature (1)..( 7): Result.001 file - promoters70/5664873
aaataaa

SEQ ID NO: 88221 - DNA, 7 bp, Unknown
  misc_feature (1)..( 7): Result.001 file - promoters70/5664873
aaataaa

SEQ ID NO: 88222 - DNA, 7 bp, Unknown
  misc_feature (1)..( 7): Result.001 file - promoters70/5664873
aaataaa

SEQ ID NO: 88223 - DNA, 7 bp, Unknown
  misc_feature (1)..( 7): Result.001 file - promoters70/5664873
aaagaaa

SEQ ID NO: 88224 - DNA, 8 bp, Unknown
  misc_feature (1)..( 8): Result.001 file - promoters70/5664873
taaaattt

SEQ ID NO: 88225 - DNA, 8 bp, Unknown
  misc_feature (1)..( 8): Result.001 file - promoters70/5664873
taaaataa

SEQ ID NO: 88226 - DNA, 8 bp, Unknown
  misc_feature (1)..( 8): Result.001 file - promoters70/5664873
gaaacttt

SEQ ID NO: 88227 - DNA, 7 bp, Unknown
  misc_feature (1)..( 7): Result.001 file - promoters70/5664873
aaataaa

SEQ ID NO: 88228 - DNA, 7 bp, Unknown
  misc_feature (1)..( 7): Result.001 file - promoters70/5664873
aaataac

SEQ ID NO: 88229 - DNA, 7 bp, Unknown
  misc_feature (1)..( 7): Result.001 file - promoters70/5664873
aaagaaa

SEQ ID NO: 88230 - DNA, 7 bp, Unknown
  misc_feature (1)..( 7): Result.001 file - promoters70/5664873
aaattta

SEQ ID NO: 88231 - DNA, 7 bp, Unknown
  misc_feature (1)..( 7): Result.001 file - promoters70/5664873
caattta

SEQ ID NO: 88232 - DNA, 7 bp, Unknown
  misc_feature (1)..( 7): Result.001 file - promoters70/5664873
aaatttc

SEQ ID NO: 88233 - DNA, 9 bp, Unknown
  misc_feature (1)..( 9): Result.001 file - promoters70/5664873
aaaattaaa

SEQ ID NO: 88234 - DNA, 9 bp, Unknown
  misc_feature (1)..( 9): Result.001 file - promoters70/5664873
aaacttaat

SEQ ID NO: 88235 - DNA, 9 bp, Unknown
  misc_feature (1)..( 9): Result.001 file - promoters70/5664873
tgccttaat

SEQ ID NO: 88236 - DNA, 11 bp, Unknown
  misc_feature (1)..( 11): Result.001 file - promoters70/5664873
gtagtgacttt

SEQ ID NO: 88237 - DNA, 11 bp, Unknown
  misc_feature (1)..( 11): Result.001 file - promoters70/5664873
tttttgacttt

SEQ ID NO: 88238 - DNA, 11 bp, Unknown
  misc_feature (1)..( 11): Result.001 file - promoters70/5664873
ttttttacttg

SEQ ID NO: 88239 - DNA, 13 bp, Unknown
  misc_feature (1)..( 13): Result.001 file - promoters70/5664873
ttttactaaaaaa

SEQ ID NO: 88240 - DNA, 13 bp, Unknown
  misc_feature (1)..( 13): Result.001 file - promoters70/5664873
ctttaataagaaa

SEQ ID NO: 88241 - DNA, 13 bp, Unknown
  misc_feature (1)..( 13): Result.001 file - promoters70/5664873
ttttacttgatct

SEQ ID NO: 88242 - DNA, 10 bp, Unknown
  misc_feature (1)..( 10): Result.001 file - promoters70/5664873
taatgtctcg

SEQ ID NO: 88243 - DNA, 10 bp, Unknown
  misc_feature (1)..( 10): Result.001 file - promoters70/5664873
taatatctca

SEQ ID NO: 88244 - DNA, 10 bp, Unknown
  misc_feature (1)..( 10): Result.001 file - promoters70/5664873
tgatggctcg

SEQ ID NO: 88245 - DNA, 9 bp, Unknown
  misc_feature (1)..( 9): Result.001 file - promoters70/5664873
ctcttttat

SEQ ID NO: 88246 - DNA, 9 bp, Unknown
  misc_feature (1)..( 9): Result.001 file - promoters70/5664873
aaattttat

SEQ ID NO: 88247 - DNA, 9 bp, Unknown
  misc_feature (1)..( 9): Result.001 file - promoters70/5664885
aaaatttac

SEQ ID NO: 88248 - DNA, 12 bp, Unknown
  misc_feature (1)..( 12): Result.001 file - promoters70/5664885
aaagaaattata

SEQ ID NO: 88249 - DNA, 12 bp, Unknown
  misc_feature (1)..( 12): Result.001 file - promoters70/5664885
taaaaaataata

SEQ ID NO: 88250 - DNA, 12 bp, Unknown
  misc_feature (1)..( 12): Result.001 file - promoters70/5664885
atcaaaattaga

SEQ ID NO: 88251 - DNA, 12 bp, Unknown
  misc_feature (1)..( 12): Result.001 file - promoters70/5664885
ctagaaattcta

SEQ ID NO: 88252 - DNA, 12 bp, Unknown
  misc_feature (1)..( 12): Result.001 file - promoters70/5665140
ctacaaagacca

SEQ ID NO: 88253 - DNA, 7 bp, Unknown
  misc_feature (1)..( 7): Result.001 file - promoters70/5665140
aaaacaa

SEQ ID NO: 88254 - DNA, 7 bp, Unknown
  misc_feature (1)..( 7): Result.001 file - promoters70/5665140
aaaacat

SEQ ID NO: 88255 - DNA, 7 bp, Unknown
  misc_feature (1)..( 7): Result.001 file - promoters70/5665140
aaatcaa

SEQ ID NO: 88256 - DNA, 8 bp, Unknown
  misc_feature (1)..( 8): Result.001 file - promoters70/5665140
aatctttt

SEQ ID NO: 88257 - DNA, 8 bp, Unknown
  misc_feature (1)..( 8): Result.001 file - promoters70/5665140
catcgttt

SEQ ID NO: 88258 - DNA, 8 bp, Unknown
  misc_feature (1)..( 8): Result.001 file - promoters70/5665140
catcgtcg

SEQ ID NO: 88259 - DNA, 8 bp, Unknown
  misc_feature (1)..( 8): Result.001 file - promoters70/5665140
tattattt

SEQ ID NO: 88260 - DNA, 8 bp, Unknown
  misc_feature (1)..( 8): Result.001 file - promoters70/5665140
gattcttt

SEQ ID NO: 88261 - DNA, 8 bp, Unknown
  misc_feature (1)..( 8): Result.001 file - promoters70/5665347
gattctct

SEQ ID NO: 88262 - DNA, 11 bp, Unknown
  misc_feature (1)..( 11): Result.001 file - promoters70/5665347
agttataaatc

SEQ ID NO: 88263 - DNA, 11 bp, Unknown
  misc_feature (1)..( 11): Result.001 file - promoters70/5665347
agttatgaatc

SEQ ID NO: 88264 - DNA, 11 bp, Unknown
  misc_feature (1)..( 11): Result.001 file - promoters70/5665347
tgttatttatt

SEQ ID NO: 88265 - DNA, 11 bp, Unknown
  misc_feature (1)..( 11): Result.001 file - promoters70/5665347
gaaaatgaatt

SEQ ID NO: 88266 - DNA, 11 bp, Unknown
  misc_feature (1)..( 11): Result.001 file - promoters70/5665347
gattataaatc

SEQ ID NO: 88267 - DNA, 12 bp, Unknown
  misc_feature (1)..( 12): Result.001 file - promoters70/5665351
taaaatggtatt

SEQ ID NO: 88268 - DNA, 7 bp, Unknown
  misc_feature (1)..( 7): Result.001 file - promoters70/5665351
ccatttc

SEQ ID NO: 88269 - DNA, 7 bp, Unknown
  misc_feature (1)..( 7): Result.001 file - promoters70/5665351
gcatttc

SEQ ID NO: 88270 - DNA, 7 bp, Unknown
  misc_feature (1)..( 7): Result.001 file - promoters70/5665351
gcatttg

SEQ ID NO: 88271 - DNA, 8 bp, Unknown
  misc_feature (1)..( 8): Result.001 file - promoters70/5665351
caaatgaa

SEQ ID NO: 88272 - DNA, 8 bp, Unknown
  misc_feature (1)..( 8): Result.001 file - promoters70/5665351
caaatggt

SEQ ID NO: 88273 - DNA, 8 bp, Unknown
  misc_feature (1)..( 8): Result.001 file - promoters70/5665351
aaaaggaa

SEQ ID NO: 88274 - DNA, 9 bp, Unknown
  misc_feature (1)..( 9): Result.001 file - promoters70/5665351
cttcttctc

SEQ ID NO: 88275 - DNA, 9 bp, Unknown
  misc_feature (1)..( 9): Result.001 file - promoters70/5665351
tttcttctt

SEQ ID NO: 88276 - DNA, 9 bp, Unknown
  misc_feature (1)..( 9): Result.001 file - promoters70/5665359
cttattctc

SEQ ID NO: 88277 - DNA, 7 bp, Unknown
  misc_feature (1)..( 7): Result.001 file - promoters70/5665359
aaaaatt

SEQ ID NO: 88278 - DNA, 7 bp, Unknown
  misc_feature (1)..( 7): Result.001 file - promoters70/5665359
caaaatt

SEQ ID NO: 88279 - DNA, 7 bp, Unknown
  misc_feature (1)..( 7): Result.001 file - promoters70/5665359
aaaaata

SEQ ID NO: 88280 - DNA, 7 bp, Unknown
  misc_feature (1)..( 7): Result.001 file - promoters70/5665359
gttattt

SEQ ID NO: 88281 - DNA, 7 bp, Unknown
  misc_feature (1)..( 7): Result.001 file - promoters70/5665359
gttgttt

SEQ ID NO: 88282 - DNA, 8 bp, Unknown
  misc_feature (1)..( 8): Result.001 file - promoters70/5665359
tttaattt

SEQ ID NO: 88283 - DNA, 6 bp, Unknown
  misc_feature (1)..( 6): Result.001 file - promoters70/5665359
tattgt

SEQ ID NO: 88284 - DNA, 6 bp, Unknown
  misc_feature (1)..( 6): Result.001 file - promoters70/5665359
tattgt

SEQ ID NO: 88285 - DNA, 6 bp, Unknown
  misc_feature (1)..( 6): Result.001 file - promoters70/5665359
tattgt

SEQ ID NO: 88286 - DNA, 9 bp, Unknown
  misc_feature (1)..( 9): Result.001 file - promoters70/5665359
attgttttg

SEQ ID NO: 88287 - DNA, 9 bp, Unknown
  misc_feature (1)..( 9): Result.001 file - promoters70/5665359
aaagttttg

SEQ ID NO: 88288 - DNA, 9 bp, Unknown
  misc_feature (1)..( 9): Result.001 file - promoters70/5665404
ttggtttat

SEQ ID NO: 88289 - DNA, 9 bp, Unknown
  misc_feature (1)..( 9): Result.001 file - promoters70/5665404
ttcgtcctt

SEQ ID NO: 88290 - DNA, 9 bp, Unknown
  misc_feature (1)..( 9): Result.001 file - promoters70/5665404
aacgttctt

SEQ ID NO: 88291 - DNA, 9 bp, Unknown
  misc_feature (1)..( 9): Result.001 file - promoters70/5665404
ttcgtccaa

SEQ ID NO: 88292 - DNA, 7 bp, Unknown
  misc_feature (1)..( 7): Result.001 file - promoters70/5665404
ttgcttt

SEQ ID NO: 88293 - DNA, 7 bp, Unknown
  misc_feature (1)..( 7): Result.001 file - promoters70/5665404
atgcttt

SEQ ID NO: 88294 - DNA, 7 bp, Unknown
  misc_feature (1)..( 7): Result.001 file - promoters70/5665404
ttgtttt

SEQ ID NO: 88295 - DNA, 10 bp, Unknown
  misc_feature (1)..( 10): Result.001 file - promoters70/5665404
ttttaaaatt

SEQ ID NO: 88296 - DNA, 10 bp, Unknown
  misc_feature (1)..( 10): Result.001 file - promoters70/5665404
aaataaaata

SEQ ID NO: 88297 - DNA, 10 bp, Unknown
  misc_feature (1)..( 10): Result.001 file - promoters70/5665507
aaatgaaata

SEQ ID NO: 88298 - DNA, 10 bp, Unknown
  misc_feature (1)..( 10): Result.001 file - promoters70/5665507
atttttcttt

SEQ ID NO: 88299 - DNA, 10 bp, Unknown
  misc_feature (1)..( 10): Result.001 file - promoters70/5665507
attttttttt

SEQ ID NO: 88300 - DNA, 10 bp, Unknown
  misc_feature (1)..( 10): Result.001 file - promoters70/5665507
ctttctctga

SEQ ID NO: 88301 - DNA, 7 bp, Unknown
  misc_feature (1)..( 7): Result.001 file - promoters70/5665507
atgtttg

SEQ ID NO: 88302 - DNA, 7 bp, Unknown
  misc_feature (1)..( 7): Result.001 file - promoters70/5665507
atgtttc

SEQ ID NO: 88303 - DNA, 7 bp, Unknown
  misc_feature (1)..( 7): Result.001 file - promoters70/5665507
atggttg

SEQ ID NO: 88304 - DNA, 7 bp, Unknown
  misc_feature (1)..( 7): Result.001 file - promoters70/5665507
aaaaatt

SEQ ID NO: 88305 - DNA, 7 bp, Unknown
  misc_feature (1)..( 7): Result.001 file - promoters70/5665507
gaaaatt

SEQ ID NO: 88306 - DNA, 8 bp, Unknown
  misc_feature (1)..( 8): Result.001 file - promoters70/5665507
aaaacatt

SEQ ID NO: 88307 - DNA, 7 bp, Unknown
  misc_feature (1)..( 7): Result.001 file - promoters70/5665507
aattttc

SEQ ID NO: 88308 - DNA, 7 bp, Unknown
  misc_feature (1)..( 7): Result.001 file - promoters70/5665507
tattttc

SEQ ID NO: 88309 - DNA, 7 bp, Unknown
  misc_feature (1)..( 7): Result.001 file - promoters70/5665507
tatttta

SEQ ID NO: 88310 - DNA, 8 bp, Unknown
  misc_feature (1)..( 8): Result.001 file - promoters70/5665507
tttcgtac

SEQ ID NO: 88311 - DNA, 8 bp, Unknown
  misc_feature (1)..( 8): Result.001 file - promoters70/5665507
ttttgtac

SEQ ID NO: 88312 - DNA, 8 bp, Unknown
  misc_feature (1)..( 8): Result.001 file - promoters70/5665507
ttttgttg

SEQ ID NO: 88313 - DNA, 7 bp, Unknown
  misc_feature (1)..( 7): Result.001 file - promoters70/5665507
aaatatt

SEQ ID NO: 88314 - DNA, 7 bp, Unknown
  misc_feature (1)..( 7): Result.001 file - promoters70/5665507
aaatatc

SEQ ID NO: 88315 - DNA, 7 bp, Unknown
  misc_feature (1)..( 7): Result.001 file - promoters70/5665507
caatatc

SEQ ID NO: 88316 - DNA, 8 bp, Unknown
  misc_feature (1)..( 8): Result.001 file - promoters70/5665507
tatatctt

SEQ ID NO: 88317 - DNA, 8 bp, Unknown
  misc_feature (1)..( 8): Result.001 file - promoters70/5665507
aatatctt

SEQ ID NO: 88318 - DNA, 8 bp, Unknown
  misc_feature (1)..( 8): Result.001 file - promoters70/5665796
aatatccc

SEQ ID NO: 88319 - DNA, 10 bp, Unknown
  misc_feature (1)..( 10): Result.001 file - promoters70/5665796
agcatccaca

SEQ ID NO: 88320 - DNA, 10 bp, Unknown
  misc_feature (1)..( 10): Result.001 file - promoters70/5665796
tttatccacc

SEQ ID NO: 88321 - DNA, 10 bp, Unknown
  misc_feature (1)..( 10): Result.001 file - promoters70/5665796
agcaaccaca

SEQ ID NO: 88322 - DNA, 10 bp, Unknown
  misc_feature (1)..( 10): Result.001 file - promoters70/5665796
acaatgtgaa

SEQ ID NO: 88323 - DNA, 10 bp, Unknown
  misc_feature (1)..( 10): Result.001 file - promoters70/5665796
aaaatgtgaa

SEQ ID NO: 88324 - DNA, 10 bp, Unknown
  misc_feature (1)..( 10): Result.001 file - promoters70/5667720
aaaatgttat

SEQ ID NO: 88325 - DNA, 7 bp, Unknown
  misc_feature (1)..( 7): Result.001 file - promoters70/5667720
aatgata

SEQ ID NO: 88326 - DNA, 7 bp, Unknown
  misc_feature (1)..( 7): Result.001 file - promoters70/5667720
aatcata

SEQ ID NO: 88327 - DNA, 7 bp, Unknown
  misc_feature (1)..( 7): Result.001 file - promoters70/5667720
aatgatg

SEQ ID NO: 88328 - DNA, 7 bp, Unknown
  misc_feature (1)..( 7): Result.001 file - promoters70/5667720
aaaaatt

SEQ ID NO: 88329 - DNA, 7 bp, Unknown
  misc_feature (1)..( 7): Result.001 file - promoters70/5667720
aaacatt

SEQ ID NO: 88330 - DNA, 7 bp, Unknown
  misc_feature (1)..( 7): Result.001 file - promoters70/5667720
aaaaaag

SEQ ID NO: 88331 - DNA, 9 bp, Unknown
  misc_feature (1)..( 9): Result.001 file - promoters70/5667720
aaacaaaaa

SEQ ID NO: 88332 - DNA, 9 bp, Unknown
  misc_feature (1)..( 9): Result.001 file - promoters70/5667720
aaagaaata

SEQ ID NO: 88333 - DNA, 9 bp, Unknown
  misc_feature (1)..( 9): Result.001 file - promoters70/5667720
taagaaata

SEQ ID NO: 88334 - DNA, 9 bp, Unknown
  misc_feature (1)..( 9): Result.001 file - promoters70/5667720
ggaacaaat

SEQ ID NO: 88335 - DNA, 9 bp, Unknown
  misc_feature (1)..( 9): Result.001 file - promoters70/5667720
aaaacaaat

SEQ ID NO: 88336 - DNA, 9 bp, Unknown
  misc_feature (1)..( 9): Result.001 file - promoters70/5667720
aaaacaaga

SEQ ID NO: 88337 - DNA, 9 bp, Unknown
  misc_feature (1)..( 9): Result.001 file - promoters70/5667720
taaccaaaa

SEQ ID NO: 88338 - DNA, 9 bp, Unknown
  misc_feature (1)..( 9): Result.001 file - promoters70/5667720
taaccaaaa

SEQ ID NO: 88339 - DNA, 9 bp, Unknown
  misc_feature (1)..( 9): Result.001 file - promoters70/5667720
aaactaaac

SEQ ID NO: 88340 - DNA, 12 bp, Unknown
  misc_feature (1)..( 12): Result.001 file - promoters70/5667720
aaaataaaataa

SEQ ID NO: 88341 - DNA, 12 bp, Unknown
  misc_feature (1)..( 12): Result.001 file - promoters70/5667720
aaaataatagta

SEQ ID NO: 88342 - DNA, 12 bp, Unknown
  misc_feature (1)..( 12): Result.001 file - promoters70/5667737
aaaataaactaa

SEQ ID NO: 88343 - DNA, 8 bp, Unknown
  misc_feature (1)..( 8): Result.001 file - promoters70/5667737
ctacaaca

SEQ ID NO: 88344 - DNA, 8 bp, Unknown
  misc_feature (1)..( 8): Result.001 file - promoters70/5667737
ctacaaag

SEQ ID NO: 88345 - DNA, 8 bp, Unknown
  misc_feature (1)..( 8): Result.001 file - promoters70/5667737
ctagaaat

SEQ ID NO: 88346 - DNA, 8 bp, Unknown
  misc_feature (1)..( 8): Result.001 file - promoters70/5667737
ctaaaaag

SEQ ID NO: 88347 - DNA, 14 bp, Unknown
  misc_feature (1)..( 14): Result.001 file - promoters70/5667737
caacaaaaaccaaa

SEQ ID NO: 88348 - DNA, 14 bp, Unknown
  misc_feature (1)..( 14): Result.001 file - promoters70/5667737
ctacaaagaccaaa

SEQ ID NO: 88349 - DNA, 14 bp, Unknown
  misc_feature (1)..( 14): Result.001 file - promoters70/5667737
ctagaaattctatt

SEQ ID NO: 88350 - DNA, 14 bp, Unknown
  misc_feature (1)..( 14): Result.001 file - promoters70/5667812
ctaaaaagtatttt

SEQ ID NO: 88351 - DNA, 15 bp, Unknown
  misc_feature (1)..( 15): Result.001 file - promoters70/5667812
gattgttttttttcc

SEQ ID NO: 88352 - DNA, 15 bp, Unknown
  misc_feature (1)..( 15): Result.001 file - promoters70/5667812
aaaagtttttgtaat

SEQ ID NO: 88353 - DNA, 15 bp, Unknown
  misc_feature (1)..( 15): Result.001 file - promoters70/5667812
tagggttttttcttg

SEQ ID NO: 88354 - DNA, 15 bp, Unknown
  misc_feature (1)..( 15): Result.001 file - promoters70/5667812
ggatgtttttgttaa

SEQ ID NO: 88355 - DNA, 15 bp, Unknown
  misc_feature (1)..( 15): Result.001 file - promoters70/5667812
caaacttttattttt

SEQ ID NO: 88356 - DNA, 15 bp, Unknown
  misc_feature (1)..( 15): Result.001 file - promoters70/5667812
gaaaggtttcttctc

SEQ ID NO: 88357 - DNA, 15 bp, Unknown
  misc_feature (1)..( 15): Result.001 file - promoters70/5667812
caaatttttactttt

SEQ ID NO: 88358 - DNA, 10 bp, Unknown
  misc_feature (1)..( 10): Result.001 file - promoters70/5667812
aaaggaattc

SEQ ID NO: 88359 - DNA, 10 bp, Unknown
  misc_feature (1)..( 10): Result.001 file - promoters70/5667812
aaagaaattc

SEQ ID NO: 88360 - DNA, 10 bp, Unknown
  misc_feature (1)..( 10): Result.001 file - promoters70/5667812
aaagaaaatc

SEQ ID NO: 88361 - DNA, 10 bp, Unknown
  misc_feature (1)..( 10): Result.001 file - promoters70/5667812
taagaaaaaa

SEQ ID NO: 88362 - DNA, 10 bp, Unknown
  misc_feature (1)..( 10): Result.001 file - promoters70/5667812
gaagaaacaa

SEQ ID NO: 88363 - DNA, 10 bp, Unknown
  misc_feature (1)..( 10): Result.001 file - promoters70/5667812
gtttaaattc

SEQ ID NO: 88364 - DNA, 9 bp, Unknown
  misc_feature (1)..( 9): Result.001 file - promoters70/5667812
gaaagaaaa

SEQ ID NO: 88365 - DNA, 9 bp, Unknown
  misc_feature (1)..( 9): Result.001 file - promoters70/5667812
gtaagaaaa

SEQ ID NO: 88366 - DNA, 9 bp, Unknown
  misc_feature (1)..( 9): Result.001 file - promoters70/5667812
gaaacaaag

SEQ ID NO: 88367 - DNA, 9 bp, Unknown
  misc_feature (1)..( 9): Result.001 file - promoters70/5667812
caaagaaat

SEQ ID NO: 88368 - DNA, 9 bp, Unknown
  misc_feature (1)..( 9): Result.001 file - promoters70/5667812
aaaaccaag

SEQ ID NO: 88369 - DNA, 9 bp, Unknown
  misc_feature (1)..( 9): Result.001 file - promoters70/5667812
cgaaccaat

SEQ ID NO: 88370 - DNA, 14 bp, Unknown
  misc_feature (1)..( 14): Result.001 file - promoters70/5667812
acaagtagaagaaa

SEQ ID NO: 88371 - DNA, 14 bp, Unknown
  misc_feature (1)..( 14): Result.001 file - promoters70/5667812
ccaagaagaaaaaa

SEQ ID NO: 88372 - DNA, 14 bp, Unknown
  misc_feature (1)..( 14): Result.001 file - promoters70/5667812
acaagtcttcttct

SEQ ID NO: 88373 - DNA, 14 bp, Unknown
  misc_feature (1)..( 14): Result.001 file - promoters70/5667812
gtaaataattaatc

SEQ ID NO: 88374 - DNA, 14 bp, Unknown
  misc_feature (1)..( 14): Result.001 file - promoters70/5667812
cctgatacttaaca

SEQ ID NO: 88375 - DNA, 14 bp, Unknown
  misc_feature (1)..( 14): Result.001 file - promoters70/5667822
aaaaatacttacaa

SEQ ID NO: 88376 - DNA, 8 bp, Unknown
  misc_feature (1)..( 8): Result.001 file - promoters70/5667822
tttaccag

SEQ ID NO: 88377 - DNA, 8 bp, Unknown
  misc_feature (1)..( 8): Result.001 file - promoters70/5667822
tttgccag

SEQ ID NO: 88378 - DNA, 8 bp, Unknown
  misc_feature (1)..( 8): Result.001 file - promoters70/5667822
tttgtacg

SEQ ID NO: 88379 - DNA, 10 bp, Unknown
  misc_feature (1)..( 10): Result.001 file - promoters70/5667822
ggaaaaaaat

SEQ ID NO: 88380 - DNA, 10 bp, Unknown
  misc_feature (1)..( 10): Result.001 file - promoters70/5667822
tataaaaaat

SEQ ID NO: 88381 - DNA, 10 bp, Unknown
  misc_feature (1)..( 10): Result.001 file - promoters70/5667822
tatacaaaag

SEQ ID NO: 88382 - DNA, 7 bp, Unknown
  misc_feature (1)..( 7): Result.001 file - promoters70/5667822
cataaaa

SEQ ID NO: 88383 - DNA, 7 bp, Unknown
  misc_feature (1)..( 7): Result.001 file - promoters70/5667822
tataaaa

SEQ ID NO: 88384 - DNA, 7 bp, Unknown
  misc_feature (1)..( 7): Result.001 file - promoters70/5667849
tatcaaa

SEQ ID NO: 88385 - DNA, 9 bp, Unknown
  misc_feature (1)..( 9): Result.001 file - promoters70/5667849
gtgaaggat

SEQ ID NO: 88386 - DNA, 9 bp, Unknown
  misc_feature (1)..( 9): Result.001 file - promoters70/5667849
gtgaatgat

SEQ ID NO: 88387 - DNA, 9 bp, Unknown
  misc_feature (1)..( 9): Result.001 file - promoters70/5667849
gtgaatgat

SEQ ID NO: 88388 - DNA, 8 bp, Unknown
  misc_feature (1)..( 8): Result.001 file - promoters70/5667849
cattgtgt

SEQ ID NO: 88389 - DNA, 8 bp, Unknown
  misc_feature (1)..( 8): Result.001 file - promoters70/5667849
cattttgt

SEQ ID NO: 88390 - DNA, 8 bp, Unknown
  misc_feature (1)..( 8): Result.001 file - promoters70/5668294
cattttgt

SEQ ID NO: 88391 - DNA, 8 bp, Unknown
  misc_feature (1)..( 8): Result.001 file - promoters70/5668294
attctttt

SEQ ID NO: 88392 - DNA, 8 bp, Unknown
  misc_feature (1)..( 8): Result.001 file - promoters70/5668294
tttctttc

SEQ ID NO: 88393 - DNA, 8 bp, Unknown
  misc_feature (1)..( 8): Result.001 file - promoters70/5668294
attatttt

SEQ ID NO: 88394 - DNA, 9 bp, Unknown
  misc_feature (1)..( 9): Result.001 file - promoters70/5668294
attaatttt

SEQ ID NO: 88395 - DNA, 9 bp, Unknown
  misc_feature (1)..( 9): Result.001 file - promoters70/5668359
ttgaatttt

SEQ ID NO: 88396 - DNA, 8 bp, Unknown
  misc_feature (1)..( 8): Result.001 file - promoters70/5668359
atggatgt

SEQ ID NO: 88397 - DNA, 8 bp, Unknown
  misc_feature (1)..( 8): Result.001 file - promoters70/5668359
atggattt

SEQ ID NO: 88398 - DNA, 8 bp, Unknown
  misc_feature (1)..( 8): Result.001 file - promoters70/5668435
ttggattt

SEQ ID NO: 88399 - DNA, 12 bp, Unknown
  misc_feature (1)..( 12): Result.001 file - promoters70/5668435
ggtgataaatat

SEQ ID NO: 88400 - DNA, 12 bp, Unknown
  misc_feature (1)..( 12): Result.001 file - promoters70/5668435
tataaaaaatat

SEQ ID NO: 88401 - DNA, 13 bp, Unknown
  misc_feature (1)..( 13): Result.001 file - promoters70/5668435
aaacaaaacatat

SEQ ID NO: 88402 - DNA, 13 bp, Unknown
  misc_feature (1)..( 13): Result.001 file - promoters70/5668435
agatacaaaaccc

SEQ ID NO: 88403 - DNA, 13 bp, Unknown
  misc_feature (1)..( 13): Result.001 file - promoters70/5668435
ctatataaaacca

SEQ ID NO: 88404 - DNA, 13 bp, Unknown
  misc_feature (1)..( 13): Result.001 file - promoters70/5668435
agagacaaataga

SEQ ID NO: 88405 - DNA, 12 bp, Unknown
  misc_feature (1)..( 12): Result.001 file - promoters70/5668435
attgttacaaat

SEQ ID NO: 88406 - DNA, 12 bp, Unknown
  misc_feature (1)..( 12): Result.001 file - promoters70/5668435
tttgttagttca

SEQ ID NO: 88407 - DNA, 12 bp, Unknown
  misc_feature (1)..( 12): Result.001 file - promoters70/5668435
atttttactttt

SEQ ID NO: 88408 - DNA, 12 bp, Unknown
  misc_feature (1)..( 12): Result.001 file - promoters70/5668435
gactttagtttt

SEQ ID NO: 88409 - DNA, 12 bp, Unknown
  misc_feature (1)..( 12): Result.001 file - promoters70/5668435
tttgttctatat

SEQ ID NO: 88410 - DNA, 12 bp, Unknown
  misc_feature (1)..( 12): Result.001 file - promoters70/5668435
ctttttgtatca

SEQ ID NO: 88411 - DNA, 11 bp, Unknown
  misc_feature (1)..( 11): Result.001 file - promoters70/5668435
acatataaaat

SEQ ID NO: 88412 - DNA, 11 bp, Unknown
  misc_feature (1)..( 11): Result.001 file - promoters70/5668435
ctataaaaaat

SEQ ID NO: 88413 - DNA, 11 bp, Unknown
  misc_feature (1)..( 11): Result.001 file - promoters70/5668435
gaataaaaaca

SEQ ID NO: 88414 - DNA, 11 bp, Unknown
  misc_feature (1)..( 11): Result.001 file - promoters70/5668435
taagaaaaaaa

SEQ ID NO: 88415 - DNA, 11 bp, Unknown
  misc_feature (1)..( 11): Result.001 file - promoters70/5668435
ctatataaaac

SEQ ID NO: 88416 - DNA, 11 bp, Unknown
  misc_feature (1)..( 11): Result.001 file - promoters70/5668435
atagaagaaac

SEQ ID NO: 88417 - DNA, 12 bp, Unknown
  misc_feature (1)..( 12): Result.001 file - promoters70/5668435
cactatataaag

SEQ ID NO: 88418 - DNA, 12 bp, Unknown
  misc_feature (1)..( 12): Result.001 file - promoters70/5668435
tgtcttataaat

SEQ ID NO: 88419 - DNA, 12 bp, Unknown
  misc_feature (1)..( 12): Result.001 file - promoters70/5668435
cactatttaaag

SEQ ID NO: 88420 - DNA, 12 bp, Unknown
  misc_feature (1)..( 12): Result.001 file - promoters70/5668435
tactattaaagc

SEQ ID NO: 88421 - DNA, 12 bp, Unknown
  misc_feature (1)..( 12): Result.001 file - promoters70/5668435
tttaattaaaac

SEQ ID NO: 88422 - DNA, 12 bp, Unknown
  misc_feature (1)..( 12): Result.001 file - promoters70/5668454
gcttatttatga

SEQ ID NO: 88423 - DNA, 9 bp, Unknown
  misc_feature (1)..( 9): Result.001 file - promoters70/5668454
tcttaatta

SEQ ID NO: 88424 - DNA, 9 bp, Unknown
  misc_feature (1)..( 9): Result.001 file - promoters70/5668454
tcttaatct

SEQ ID NO: 88425 - DNA, 9 bp, Unknown
  misc_feature (1)..( 9): Result.001 file - promoters70/5668454
atttattta

SEQ ID NO: 88426 - DNA, 6 bp, Unknown
  misc_feature (1)..( 6): Result.001 file - promoters70/5668454
tctaaa

SEQ ID NO: 88427 - DNA, 6 bp, Unknown
  misc_feature (1)..( 6): Result.001 file - promoters70/5668454
tctaaa

SEQ ID NO: 88428 - DNA, 6 bp, Unknown
  misc_feature (1)..( 6): Result.001 file - promoters70/5668454
tctaaa

SEQ ID NO: 88429 - DNA, 8 bp, Unknown
  misc_feature (1)..( 8): Result.001 file - promoters70/5668454
aaaaataa

SEQ ID NO: 88430 - DNA, 8 bp, Unknown
  misc_feature (1)..( 8): Result.001 file - promoters70/5668454
aaaaattc

SEQ ID NO: 88431 - DNA, 8 bp, Unknown
  misc_feature (1)..( 8): Result.001 file - promoters70/5668469
taaaataa

SEQ ID NO: 88432 - DNA, 8 bp, Unknown
  misc_feature (1)..( 8): Result.001 file - promoters70/5668469
ataaaata

SEQ ID NO: 88433 - DNA, 8 bp, Unknown
  misc_feature (1)..( 8): Result.001 file - promoters70/5668469
atacaatt

SEQ ID NO: 88434 - DNA, 8 bp, Unknown
  misc_feature (1)..( 8): Result.001 file - promoters70/5668469
gtaaaata

SEQ ID NO: 88435 - DNA, 7 bp, Unknown
  misc_feature (1)..( 7): Result.001 file - promoters70/5668469
tttctta

SEQ ID NO: 88436 - DNA, 7 bp, Unknown
  misc_feature (1)..( 7): Result.001 file - promoters70/5668469
tttgtta

SEQ ID NO: 88437 - DNA, 7 bp, Unknown
  misc_feature (1)..( 7): Result.001 file - promoters70/5668493
tttatta

SEQ ID NO: 88438 - DNA, 9 bp, Unknown
  misc_feature (1)..( 9): Result.001 file - promoters70/5668493
aatcaatca

SEQ ID NO: 88439 - DNA, 9 bp, Unknown
  misc_feature (1)..( 9): Result.001 file - promoters70/5668493
aataaatgt

SEQ ID NO: 88440 - DNA, 9 bp, Unknown
  misc_feature (1)..( 9): Result.001 file - promoters70/5668493
catcaattt

SEQ ID NO: 88441 - DNA, 9 bp, Unknown
  misc_feature (1)..( 9): Result.001 file - promoters70/5668493
attaaatgt

SEQ ID NO: 88442 - DNA, 9 bp, Unknown
  misc_feature (1)..( 9): Result.001 file - promoters70/5668493
gtttgttta

SEQ ID NO: 88443 - DNA, 9 bp, Unknown
  misc_feature (1)..( 9): Result.001 file - promoters70/5668493
ttttatttg

SEQ ID NO: 88444 - DNA, 9 bp, Unknown
  misc_feature (1)..( 9): Result.001 file - promoters70/5668493
gtttgatta

SEQ ID NO: 88445 - DNA, 9 bp, Unknown
  misc_feature (1)..( 9): Result.001 file - promoters70/5668493
atttattta

SEQ ID NO: 88446 - DNA, 9 bp, Unknown
  misc_feature (1)..( 9): Result.001 file - promoters70/5668493
tacaataaa

SEQ ID NO: 88447 - DNA, 9 bp, Unknown
  misc_feature (1)..( 9): Result.001 file - promoters70/5668493
tacaatatt

SEQ ID NO: 88448 - DNA, 9 bp, Unknown
  misc_feature (1)..( 9): Result.001 file - promoters70/5668493
ttcaaaatt

SEQ ID NO: 88449 - DNA, 9 bp, Unknown
  misc_feature (1)..( 9): Result.001 file - promoters70/5668509
atcaatatg

SEQ ID NO: 88450 - DNA, 10 bp, Unknown
  misc_feature (1)..( 10): Result.001 file - promoters70/5668509
ttaaaaaaag

SEQ ID NO: 88451 - DNA, 10 bp, Unknown
  misc_feature (1)..( 10): Result.001 file - promoters70/5668509
ttaagaaaag

SEQ ID NO: 88452 - DNA, 10 bp, Unknown
  misc_feature (1)..( 10): Result.001 file - promoters70/5668509
agtagagaag

SEQ ID NO: 88453 - DNA, 8 bp, Unknown
  misc_feature (1)..( 8): Result.001 file - promoters70/5668509
ccacaaac

SEQ ID NO: 88454 - DNA, 8 bp, Unknown
  misc_feature (1)..( 8): Result.001 file - promoters70/5668509
ccaaaaaa

SEQ ID NO: 88455 - DNA, 9 bp, Unknown
  misc_feature (1)..( 9): Result.001 file - promoters70/5668509
gaaaataag

SEQ ID NO: 88456 - DNA, 7 bp, Unknown
  misc_feature (1)..( 7): Result.001 file - promoters70/5668509
agaagaa

SEQ ID NO: 88457 - DNA, 7 bp, Unknown
  misc_feature (1)..( 7): Result.001 file - promoters70/5668509
agaagat

SEQ ID NO: 88458 - DNA, 7 bp, Unknown
  misc_feature (1)..( 7): Result.001 file - promoters70/5668509
agaaaag

SEQ ID NO: 88459 - DNA, 7 bp, Unknown
  misc_feature (1)..( 7): Result.001 file - promoters70/5668509
agaggag

SEQ ID NO: 88460 - DNA, 7 bp, Unknown
  misc_feature (1)..( 7): Result.001 file - promoters70/5668509
tgaggag

SEQ ID NO: 88461 - DNA, 7 bp, Unknown
  misc_feature (1)..( 7): Result.001 file - promoters70/5668529
agaggat

SEQ ID NO: 88462 - DNA, 7 bp, Unknown
  misc_feature (1)..( 7): Result.001 file - promoters70/5668529
gttgact

SEQ ID NO: 88463 - DNA, 7 bp, Unknown
  misc_feature (1)..( 7): Result.001 file - promoters70/5668529
gttgact

SEQ ID NO: 88464 - DNA, 7 bp, Unknown
  misc_feature (1)..( 7): Result.001 file - promoters70/5668547
attgact

SEQ ID NO: 88465 - DNA, 7 bp, Unknown
  misc_feature (1)..( 7): Result.001 file - promoters70/5668547
gctaaaa

SEQ ID NO: 88466 - DNA, 7 bp, Unknown
  misc_feature (1)..( 7): Result.001 file - promoters70/5668547
gctgaaa

SEQ ID NO: 88467 - DNA, 7 bp, Unknown
  misc_feature (1)..( 7): Result.001 file - promoters70/5668720
tctgaaa

SEQ ID NO: 88468 - DNA, 11 bp, Unknown
  misc_feature (1)..( 11): Result.001 file - promoters70/5668720
acagacaccaa

SEQ ID NO: 88469 - DNA, 11 bp, Unknown
  misc_feature (1)..( 11): Result.001 file - promoters70/5668720
aaagaaacctg

SEQ ID NO: 88470 - DNA, 11 bp, Unknown
  misc_feature (1)..( 11): Result.001 file - promoters70/5668720
taagaaaaaaa

SEQ ID NO: 88471 - DNA, 11 bp, Unknown
  misc_feature (1)..( 11): Result.001 file - promoters70/5668720
gaagaaacaaa

SEQ ID NO: 88472 - DNA, 11 bp, Unknown
  misc_feature (1)..( 11): Result.001 file - promoters70/5668720
taagataaaat

SEQ ID NO: 88473 - DNA, 11 bp, Unknown
  misc_feature (1)..( 11): Result.001 file - promoters70/5668720
gatgaaatatt

SEQ ID NO: 88474 - DNA, 9 bp, Unknown
  misc_feature (1)..( 9): Result.001 file - promoters70/5668720
gcaaagttg

SEQ ID NO: 88475 - DNA, 9 bp, Unknown
  misc_feature (1)..( 9): Result.001 file - promoters70/5668720
aaaaagttt

SEQ ID NO: 88476 - DNA, 10 bp, Unknown
  misc_feature (1)..( 10): Result.001 file - promoters70/5668720
aaaatagttt

SEQ ID NO: 88477 - DNA, 10 bp, Unknown
  misc_feature (1)..( 10): Result.001 file - promoters70/5668720
aaaaaagtgt

SEQ ID NO: 88478 - DNA, 10 bp, Unknown
  misc_feature (1)..( 10): Result.001 file - promoters70/5668720
tgaaatgttt

SEQ ID NO: 88479 - DNA, 10 bp, Unknown
  misc_feature (1)..( 10): Result.001 file - promoters70/5668720
acaaattttt

SEQ ID NO: 88480 - DNA, 13 bp, Unknown
  misc_feature (1)..( 13): Result.001 file - promoters70/5668720
acttttgtttttg

SEQ ID NO: 88481 - DNA, 13 bp, Unknown
  misc_feature (1)..( 13): Result.001 file - promoters70/5668720
acttttttttttt

SEQ ID NO: 88482 - DNA, 13 bp, Unknown
  misc_feature (1)..( 13): Result.001 file - promoters70/5668720
gtttttgtctatc

SEQ ID NO: 88483 - DNA, 13 bp, Unknown
  misc_feature (1)..( 13): Result.001 file - promoters70/5668720
gaaattgtttcga

SEQ ID NO: 88484 - DNA, 13 bp, Unknown
  misc_feature (1)..( 13): Result.001 file - promoters70/5668720
ttccatgtttttg

SEQ ID NO: 88485 - DNA, 13 bp, Unknown
  misc_feature (1)..( 13): Result.001 file - promoters70/5668897
tgatttgtatttg

SEQ ID NO: 88486 - DNA, 9 bp, Unknown
  misc_feature (1)..( 9): Result.001 file - promoters70/5668897
ctgtgtttt

SEQ ID NO: 88487 - DNA, 9 bp, Unknown
  misc_feature (1)..( 9): Result.001 file - promoters70/5668897
atgtttttt

SEQ ID NO: 88488 - DNA, 9 bp, Unknown
  misc_feature (1)..( 9): Result.001 file - promoters70/5668903
atgttttag

SEQ ID NO: 88489 - DNA, 8 bp, Unknown
  misc_feature (1)..( 8): Result.001 file - promoters70/5668903
agacttta

SEQ ID NO: 88490 - DNA, 8 bp, Unknown
  misc_feature (1)..( 8): Result.001 file - promoters70/5668903
agaatttg

SEQ ID NO: 88491 - DNA, 8 bp, Unknown
  misc_feature (1)..( 8): Result.001 file - promoters70/5668903
cgaatttg

SEQ ID NO: 88492 - DNA, 9 bp, Unknown
  misc_feature (1)..( 9): Result.001 file - promoters70/5668903
tttaatttg

SEQ ID NO: 88493 - DNA, 9 bp, Unknown
  misc_feature (1)..( 9): Result.001 file - promoters70/5668903
tttgattgt

SEQ ID NO: 88494 - DNA, 9 bp, Unknown
  misc_feature (1)..( 9): Result.001 file - promoters70/5668926
tttcatttg

SEQ ID NO: 88495 - DNA, 8 bp, Unknown
  misc_feature (1)..( 8): Result.001 file - promoters70/5668926
catttaaa

SEQ ID NO: 88496 - DNA, 8 bp, Unknown
  misc_feature (1)..( 8): Result.001 file - promoters70/5668926
gatttaat

SEQ ID NO: 88497 - DNA, 8 bp, Unknown
  misc_feature (1)..( 8): Result.001 file - promoters70/5668926
cattaaaa

SEQ ID NO: 88498 - DNA, 12 bp, Unknown
  misc_feature (1)..( 12): Result.001 file - promoters70/5668926
caaactgtgaaa

SEQ ID NO: 88499 - DNA, 12 bp, Unknown
  misc_feature (1)..( 12): Result.001 file - promoters70/5668926
aaaaatgtgaaa

SEQ ID NO: 88500 - DNA, 12 bp, Unknown
  misc_feature (1)..( 12): Result.001 file - promoters70/5668926
aaaaataatttt

SEQ ID NO: 88501 - DNA, 11 bp, Unknown
  misc_feature (1)..( 11): Result.001 file - promoters70/5668926
ccaaatttggt

SEQ ID NO: 88502 - DNA, 11 bp, Unknown
  misc_feature (1)..( 11): Result.001 file - promoters70/5668926
ccaattttaag

SEQ ID NO: 88503 - DNA, 11 bp, Unknown
  misc_feature (1)..( 11): Result.001 file - promoters70/5668974
attattctaag

SEQ ID NO: 88504 - DNA, 8 bp, Unknown
  misc_feature (1)..( 8): Result.001 file - promoters70/5668974
aaaactaa

SEQ ID NO: 88505 - DNA, 8 bp, Unknown
  misc_feature (1)..( 8): Result.001 file - promoters70/5668974
aaaattaa

SEQ ID NO: 88506 - DNA, 9 bp, Unknown
  misc_feature (1)..( 9): Result.001 file - promoters70/5668974
aaaacctac

SEQ ID NO: 88507 - DNA, 10 bp, Unknown
  misc_feature (1)..( 10): Result.001 file - promoters70/5668974
caatattttg

SEQ ID NO: 88508 - DNA, 10 bp, Unknown
  misc_feature (1)..( 10): Result.001 file - promoters70/5668974
caattttttt

SEQ ID NO: 88509 - DNA, 10 bp, Unknown
  misc_feature (1)..( 10): Result.001 file - promoters70/5668974
tgtttttttt

SEQ ID NO: 88510 - DNA, 9 bp, Unknown
  misc_feature (1)..( 9): Result.001 file - promoters70/5668974
gatatatta

SEQ ID NO: 88511 - DNA, 9 bp, Unknown
  misc_feature (1)..( 9): Result.001 file - promoters70/5668974
aatatttta

SEQ ID NO: 88512 - DNA, 9 bp, Unknown
  misc_feature (1)..( 9): Result.001 file - promoters70/5668974
aatattttc

SEQ ID NO: 88513 - DNA, 11 bp, Unknown
  misc_feature (1)..( 11): Result.001 file - promoters70/5668974
aactaaaccag

SEQ ID NO: 88514 - DNA, 11 bp, Unknown
  misc_feature (1)..( 11): Result.001 file - promoters70/5668974
cactaaaacag

SEQ ID NO: 88515 - DNA, 11 bp, Unknown
  misc_feature (1)..( 11): Result.001 file - promoters70/5668990
cacaaaaaaga

SEQ ID NO: 88516 - DNA, 8 bp, Unknown
  misc_feature (1)..( 8): Result.001 file - promoters70/5668990
cgtagtat

SEQ ID NO: 88517 - DNA, 8 bp, Unknown
  misc_feature (1)..( 8): Result.001 file - promoters70/5668990
tgtagtat

SEQ ID NO: 88518 - DNA, 8 bp, Unknown
  misc_feature (1)..( 8): Result.001 file - promoters70/5669025
cgtggtag

SEQ ID NO: 88519 - DNA, 8 bp, Unknown
  misc_feature (1)..( 8): Result.001 file - promoters70/5669025
taagttta

SEQ ID NO: 88520 - DNA, 8 bp, Unknown
  misc_feature (1)..( 8): Result.001 file - promoters70/5669025
gaagtttc

SEQ ID NO: 88521 - DNA, 8 bp, Unknown
  misc_feature (1)..( 8): Result.001 file - promoters70/5669025
taatttta

SEQ ID NO: 88522 - DNA, 8 bp, Unknown
  misc_feature (1)..( 8): Result.001 file - promoters70/5669025
atagttta

SEQ ID NO: 88523 - DNA, 8 bp, Unknown
  misc_feature (1)..( 8): Result.001 file - promoters70/5669025
aaaggttc

SEQ ID NO: 88524 - DNA, 8 bp, Unknown
  misc_feature (1)..( 8): Result.001 file - promoters70/5669025
atattttt

SEQ ID NO: 88525 - DNA, 16 bp, Unknown
  misc_feature (1)..( 16): Result.001 file - promoters70/5669025
gtacataaaacaaaaa

SEQ ID NO: 88526 - DNA, 16 bp, Unknown
  misc_feature (1)..( 16): Result.001 file - promoters70/5669025
ttacaaaaaaaaaaaa

SEQ ID NO: 88527 - DNA, 16 bp, Unknown
  misc_feature (1)..( 16): Result.001 file - promoters70/5669025
atcacaagaactaaac

SEQ ID NO: 88528 - DNA, 16 bp, Unknown
  misc_feature (1)..( 16): Result.001 file - promoters70/5669025
aatggtaacacacaag

SEQ ID NO: 88529 - DNA, 16 bp, Unknown
  misc_feature (1)..( 16): Result.001 file - promoters70/5669025
tgacataaagatgaca

SEQ ID NO: 88530 - DNA, 16 bp, Unknown
  misc_feature (1)..( 16): Result.001 file - promoters70/5669025
ttactaaaagttttac

SEQ ID NO: 88531 - DNA, 16 bp, Unknown
  misc_feature (1)..( 16): Result.001 file - promoters70/5669250
ttactaaggtgtgttt

SEQ ID NO: 88532 - DNA, 12 bp, Unknown
  misc_feature (1)..( 12): Result.001 file - promoters70/5669250
aaataaatatct

SEQ ID NO: 88533 - DNA, 12 bp, Unknown
  misc_feature (1)..( 12): Result.001 file - promoters70/5669250
aaaaaaattcca

SEQ ID NO: 88534 - DNA, 12 bp, Unknown
  misc_feature (1)..( 12): Result.001 file - promoters70/5669250
aattaaattaat

SEQ ID NO: 88535 - DNA, 11 bp, Unknown
  misc_feature (1)..( 11): Result.001 file - promoters70/5669250
aaatatctata

SEQ ID NO: 88536 - DNA, 11 bp, Unknown
  misc_feature (1)..( 11): Result.001 file - promoters70/5669250
ccatagctaga

SEQ ID NO: 88537 - DNA, 11 bp, Unknown
  misc_feature (1)..( 11): Result.001 file - promoters70/5669250
aaatttctaga

SEQ ID NO: 88538 - DNA, 11 bp, Unknown
  misc_feature (1)..( 11): Result.001 file - promoters70/5669250
gattttataga

SEQ ID NO: 88539 - DNA, 9 bp, Unknown
  misc_feature (1)..( 9): Result.001 file - promoters70/5669250
aaggcccaa

SEQ ID NO: 88540 - DNA, 9 bp, Unknown
  misc_feature (1)..( 9): Result.001 file - promoters70/5669250
aaggcccaa

SEQ ID NO: 88541 - DNA, 9 bp, Unknown
  misc_feature (1)..( 9): Result.001 file - promoters70/5669250
tcggcccat

SEQ ID NO: 88542 - DNA, 8 bp, Unknown
  misc_feature (1)..( 8): Result.001 file - promoters70/5669250
agtataaa

SEQ ID NO: 88543 - DNA, 8 bp, Unknown
  misc_feature (1)..( 8): Result.001 file - promoters70/5669250
actataaa

SEQ ID NO: 88544 - DNA, 8 bp, Unknown
  misc_feature (1)..( 8): Result.001 file - promoters70/5669508
tatataaa

SEQ ID NO: 88545 - DNA, 8 bp, Unknown
  misc_feature (1)..( 8): Result.001 file - promoters70/5669508
gaaagaaa

SEQ ID NO: 88546 - DNA, 8 bp, Unknown
  misc_feature (1)..( 8): Result.001 file - promoters70/5669508
aaaacaaa

SEQ ID NO: 88547 - DNA, 8 bp, Unknown
  misc_feature (1)..( 8): Result.001 file - promoters70/5669508
gagagaga

SEQ ID NO: 88548 - DNA, 8 bp, Unknown
  misc_feature (1)..( 8): Result.001 file - promoters70/5669508
taaataaa

SEQ ID NO: 88549 - DNA, 8 bp, Unknown
  misc_feature (1)..( 8): Result.001 file - promoters70/5669508
ttaacaaa

SEQ ID NO: 88550 - DNA, 8 bp, Unknown
  misc_feature (1)..( 8): Result.001 file - promoters70/5669508
ctaacaac

SEQ ID NO: 88551 - DNA, 8 bp, Unknown
  misc_feature (1)..( 8): Result.001 file - promoters70/5669546
taaataat

SEQ ID NO: 88552 - DNA, 8 bp, Unknown
  misc_feature (1)..( 8): Result.001 file - promoters70/5669546
cgacatgt

SEQ ID NO: 88553 - DNA, 8 bp, Unknown
  misc_feature (1)..( 8): Result.001 file - promoters70/5669546
cgacatgt

SEQ ID NO: 88554 - DNA, 8 bp, Unknown
  misc_feature (1)..( 8): Result.001 file - promoters70/5670592
acacatgt

SEQ ID NO: 88555 - DNA, 11 bp, Unknown
  misc_feature (1)..( 11): Result.001 file - promoters70/5670592
tatacagactt

SEQ ID NO: 88556 - DNA, 11 bp, Unknown
  misc_feature (1)..( 11): Result.001 file - promoters70/5670592
aatacaaactt

SEQ ID NO: 88557 - DNA, 11 bp, Unknown
  misc_feature (1)..( 11): Result.001 file - promoters70/5670592
aatagagaact

SEQ ID NO: 88558 - DNA, 11 bp, Unknown
  misc_feature (1)..( 11): Result.001 file - promoters70/5670592
gttacaaatct

SEQ ID NO: 88559 - DNA, 11 bp, Unknown
  misc_feature (1)..( 11): Result.001 file - promoters70/5670592
tataaaaacac

SEQ ID NO: 88560 - DNA, 11 bp, Unknown
  misc_feature (1)..( 11): Result.001 file - promoters70/5670592
ctaccaaactg

SEQ ID NO: 88561 - DNA, 11 bp, Unknown
  misc_feature (1)..( 11): Result.001 file - promoters70/5670592
aatagtgaaat

SEQ ID NO: 88562 - DNA, 12 bp, Unknown
  misc_feature (1)..( 12): Result.001 file - promoters70/5670592
agaaatataaat

SEQ ID NO: 88563 - DNA, 12 bp, Unknown
  misc_feature (1)..( 12): Result.001 file - promoters70/5670592
ataaatatcttt

SEQ ID NO: 88564 - DNA, 12 bp, Unknown
  misc_feature (1)..( 12): Result.001 file - promoters70/5670592
agagatataaat

SEQ ID NO: 88565 - DNA, 12 bp, Unknown
  misc_feature (1)..( 12): Result.001 file - promoters70/5670592
tttgatatacag

SEQ ID NO: 88566 - DNA, 12 bp, Unknown
  misc_feature (1)..( 12): Result.001 file - promoters70/5670592
agacatatatac

SEQ ID NO: 88567 - DNA, 12 bp, Unknown
  misc_feature (1)..( 12): Result.001 file - promoters70/5670592
gctactataaat

SEQ ID NO: 88568 - DNA, 10 bp, Unknown
  misc_feature (1)..( 10): Result.001 file - promoters70/5670592
tgacaaaaac

SEQ ID NO: 88569 - DNA, 10 bp, Unknown
  misc_feature (1)..( 10): Result.001 file - promoters70/5670592
tgacataaag

SEQ ID NO: 88570 - DNA, 10 bp, Unknown
  misc_feature (1)..( 10): Result.001 file - promoters70/5670592
aaacataaca

SEQ ID NO: 88571 - DNA, 10 bp, Unknown
  misc_feature (1)..( 10): Result.001 file - promoters70/5670592
tcgaataaag

SEQ ID NO: 88572 - DNA, 10 bp, Unknown
  misc_feature (1)..( 10): Result.001 file - promoters70/5670592
atccatgaag

SEQ ID NO: 88573 - DNA, 10 bp, Unknown
  misc_feature (1)..( 10): Result.001 file - promoters70/5671204
atatatgaag

SEQ ID NO: 88574 - DNA, 11 bp, Unknown
  misc_feature (1)..( 11): Result.001 file - promoters70/5671204
gtatatatata

SEQ ID NO: 88575 - DNA, 11 bp, Unknown
  misc_feature (1)..( 11): Result.001 file - promoters70/5671204
atatttatata

SEQ ID NO: 88576 - DNA, 11 bp, Unknown
  misc_feature (1)..( 11): Result.001 file - promoters70/5671204
gaccctatata

SEQ ID NO: 88577 - DNA, 11 bp, Unknown
  misc_feature (1)..( 11): Result.001 file - promoters70/5671204
ctatttaaagc

SEQ ID NO: 88578 - DNA, 11 bp, Unknown
  misc_feature (1)..( 11): Result.001 file - promoters70/5671204
atatttgtatc

SEQ ID NO: 88579 - DNA, 11 bp, Unknown
  misc_feature (1)..( 11): Result.001 file - promoters70/5671204
taatataaagg

SEQ ID NO: 88580 - DNA, 11 bp, Unknown
  misc_feature (1)..( 11): Result.001 file - promoters70/5671204
ccatataaatt

SEQ ID NO: 88581 - DNA, 10 bp, Unknown
  misc_feature (1)..( 10): Result.001 file - promoters70/5671204
aaactaaaac

SEQ ID NO: 88582 - DNA, 10 bp, Unknown
  misc_feature (1)..( 10): Result.001 file - promoters70/5671204
gaacaaaaaa

SEQ ID NO: 88583 - DNA, 10 bp, Unknown
  misc_feature (1)..( 10): Result.001 file - promoters70/5671204
aaaccaaact

SEQ ID NO: 88584 - DNA, 10 bp, Unknown
  misc_feature (1)..( 10): Result.001 file - promoters70/5671204
tcactaaaaa

SEQ ID NO: 88585 - DNA, 10 bp, Unknown
  misc_feature (1)..( 10): Result.001 file - promoters70/5671204
tgaccaaaca

SEQ ID NO: 88586 - DNA, 10 bp, Unknown
  misc_feature (1)..( 10): Result.001 file - promoters70/5671204
acacacaaag

SEQ ID NO: 88587 - DNA, 9 bp, Unknown
  misc_feature (1)..( 9): Result.001 file - promoters70/5671318
tctcaaacc

SEQ ID NO: 88588 - DNA, 11 bp, Unknown
  misc_feature (1)..( 11): Result.001 file - promoters70/5671318
ttttaaattat

SEQ ID NO: 88589 - DNA, 11 bp, Unknown
  misc_feature (1)..( 11): Result.001 file - promoters70/5671318
ccttatatttc

SEQ ID NO: 88590 - DNA, 11 bp, Unknown
  misc_feature (1)..( 11): Result.001 file - promoters70/5671318
aattaaataaa

SEQ ID NO: 88591 - DNA, 11 bp, Unknown
  misc_feature (1)..( 11): Result.001 file - promoters70/5671318
ctttaaaatag

SEQ ID NO: 88592 - DNA, 11 bp, Unknown
  misc_feature (1)..( 11): Result.001 file - promoters70/5671318
ttataaaattg

SEQ ID NO: 88593 - DNA, 11 bp, Unknown
  misc_feature (1)..( 11): Result.001 file - promoters70/5671318
gactaaagaaa

SEQ ID NO: 88594 - DNA, 11 bp, Unknown
  misc_feature (1)..( 11): Result.001 file - promoters70/5671318
acggataattc

SEQ ID NO: 88595 - DNA, 11 bp, Unknown
  misc_feature (1)..( 11): Result.001 file - promoters70/5671318
acgtataattt

SEQ ID NO: 88596 - DNA, 11 bp, Unknown
  misc_feature (1)..( 11): Result.001 file - promoters70/5671318
ttggaaaattt

SEQ ID NO: 88597 - DNA, 11 bp, Unknown
  misc_feature (1)..( 11): Result.001 file - promoters70/5671318
ctgcatatttt

SEQ ID NO: 88598 - DNA, 11 bp, Unknown
  misc_feature (1)..( 11): Result.001 file - promoters70/5671318
caaaaaaattc

SEQ ID NO: 88599 - DNA, 11 bp, Unknown
  misc_feature (1)..( 11): Result.001 file - promoters70/5671318
aaacaaaaaat

SEQ ID NO: 88600 - DNA, 11 bp, Unknown
  misc_feature (1)..( 11): Result.001 file - promoters70/5671318
gaattaaaatc

SEQ ID NO: 88601 - DNA, 11 bp, Unknown
  misc_feature (1)..( 11): Result.001 file - promoters70/5671318
gagttataatg

SEQ ID NO: 88602 - DNA, 11 bp, Unknown
  misc_feature (1)..( 11): Result.001 file - promoters70/5671318
tgattaaattt

SEQ ID NO: 88603 - DNA, 11 bp, Unknown
  misc_feature (1)..( 11): Result.001 file - promoters70/5671318
ttgttacaatg

SEQ ID NO: 88604 - DNA, 11 bp, Unknown
  misc_feature (1)..( 11): Result.001 file - promoters70/5671318
tgattaatttc

SEQ ID NO: 88605 - DNA, 11 bp, Unknown
  misc_feature (1)..( 11): Result.001 file - promoters70/5671318
ttattaatacc

SEQ ID NO: 88606 - DNA, 11 bp, Unknown
  misc_feature (1)..( 11): Result.001 file - promoters70/5671318
aaaatttaaat

SEQ ID NO: 88607 - DNA, 11 bp, Unknown
  misc_feature (1)..( 11): Result.001 file - promoters70/5671318
ataatctaata

SEQ ID NO: 88608 - DNA, 11 bp, Unknown
  misc_feature (1)..( 11): Result.001 file - promoters70/5671318
ggaatttatgt

SEQ ID NO: 88609 - DNA, 11 bp, Unknown
  misc_feature (1)..( 11): Result.001 file - promoters70/5671318
cgaatttaata

SEQ ID NO: 88610 - DNA, 11 bp, Unknown
  misc_feature (1)..( 11): Result.001 file - promoters70/5671318
atagtcttaaa

SEQ ID NO: 88611 - DNA, 11 bp, Unknown
  misc_feature (1)..( 11): Result.001 file - promoters70/5671318
actatttgata

SEQ ID NO: 88612 - DNA, 11 bp, Unknown
  misc_feature (1)..( 11): Result.001 file - promoters70/5672093
ttcatttatcc

SEQ ID NO: 88613 - DNA, 10 bp, Unknown
  misc_feature (1)..( 10): Result.001 file - promoters70/5672093
ttttcttcac

SEQ ID NO: 88614 - DNA, 10 bp, Unknown
  misc_feature (1)..( 10): Result.001 file - promoters70/5672093
tttgcttctt

SEQ ID NO: 88615 - DNA, 10 bp, Unknown
  misc_feature (1)..( 10): Result.001 file - promoters70/5672093
tttgctgatg

SEQ ID NO: 88616 - DNA, 10 bp, Unknown
  misc_feature (1)..( 10): Result.001 file - promoters70/5672093
tttgatgatt

SEQ ID NO: 88617 - DNA, 10 bp, Unknown
  misc_feature (1)..( 10): Result.001 file - promoters70/5672842
atggattatt

SEQ ID NO: 88618 - DNA, 12 bp, Unknown
  misc_feature (1)..( 12): Result.001 file - promoters70/5672842
ctaaattacttt

SEQ ID NO: 88619 - DNA, 12 bp, Unknown
  misc_feature (1)..( 12): Result.001 file - promoters70/5672842
atcaaatacttt

SEQ ID NO: 88620 - DNA, 12 bp, Unknown
  misc_feature (1)..( 12): Result.001 file - promoters70/5672842
aaaaaaaacttt

SEQ ID NO: 88621 - DNA, 12 bp, Unknown
  misc_feature (1)..( 12): Result.001 file - promoters70/5672842
aaaagaaacgaa

SEQ ID NO: 88622 - DNA, 11 bp, Unknown
  misc_feature (1)..( 11): Result.001 file - promoters70/5672842
tttgccactct

SEQ ID NO: 88623 - DNA, 11 bp, Unknown
  misc_feature (1)..( 11): Result.001 file - promoters70/5672842
tttaccacacg

SEQ ID NO: 88624 - DNA, 11 bp, Unknown
  misc_feature (1)..( 11): Result.001 file - promoters70/5672842
attggcactct

SEQ ID NO: 88625 - DNA, 11 bp, Unknown
  misc_feature (1)..( 11): Result.001 file - promoters70/5672842
aactagtgacg

SEQ ID NO: 88626 - DNA, 11 bp, Unknown
  misc_feature (1)..( 11): Result.001 file - promoters70/5672842
gcctaatgaat

SEQ ID NO: 88627 - DNA, 11 bp, Unknown
  misc_feature (1)..( 11): Result.001 file - promoters70/5672842
gcccaataaat

SEQ ID NO: 88628 - DNA, 11 bp, Unknown
  misc_feature (1)..( 11): Result.001 file - promoters70/5673124
gcccaatttca

SEQ ID NO: 88629 - DNA, 10 bp, Unknown
  misc_feature (1)..( 10): Result.001 file - promoters70/5673124
ggtttatttt

SEQ ID NO: 88630 - DNA, 10 bp, Unknown
  misc_feature (1)..( 10): Result.001 file - promoters70/5673124
ggtttattca

SEQ ID NO: 88631 - DNA, 10 bp, Unknown
  misc_feature (1)..( 10): Result.001 file - promoters70/5674194
attttatttt

SEQ ID NO: 88632 - DNA, 12 bp, Unknown
  misc_feature (1)..( 12): Result.001 file - promoters70/5674194
taagtttaagtt

SEQ ID NO: 88633 - DNA, 12 bp, Unknown
  misc_feature (1)..( 12): Result.001 file - promoters70/5674194
gaagtttctggt

SEQ ID NO: 88634 - DNA, 12 bp, Unknown
  misc_feature (1)..( 12): Result.001 file - promoters70/5674194
aaagtttgatat

SEQ ID NO: 88635 - DNA, 12 bp, Unknown
  misc_feature (1)..( 12): Result.001 file - promoters70/5674194
taattttatata

SEQ ID NO: 88636 - DNA, 12 bp, Unknown
  misc_feature (1)..( 12): Result.001 file - promoters70/5674194
tctttttgatat

SEQ ID NO: 88637 - DNA, 12 bp, Unknown
  misc_feature (1)..( 12): Result.001 file - promoters70/5674194
aaagttgattaa

SEQ ID NO: 88638 - DNA, 12 bp, Unknown
  misc_feature (1)..( 12): Result.001 file - promoters70/5674194
cctttttgtatc

SEQ ID NO: 88639 - DNA, 12 bp, Unknown
  misc_feature (1)..( 12): Result.001 file - promoters70/5674194
catattgagagg

SEQ ID NO: 88640 - DNA, 12 bp, Unknown
  misc_feature (1)..( 12): Result.001 file - promoters70/5674194
ttgattgatagg

SEQ ID NO: 88641 - DNA, 12 bp, Unknown
  misc_feature (1)..( 12): Result.001 file - promoters70/5674194
gtctttgttagt

SEQ ID NO: 88642 - DNA, 12 bp, Unknown
  misc_feature (1)..( 12): Result.001 file - promoters70/5674194
ctttttgttcta

SEQ ID NO: 88643 - DNA, 12 bp, Unknown
  misc_feature (1)..( 12): Result.001 file - promoters70/5674194
ctttttgtatca

SEQ ID NO: 88644 - DNA, 12 bp, Unknown
  misc_feature (1)..( 12): Result.001 file - promoters70/5674194
acatttggtaca

SEQ ID NO: 88645 - DNA, 17 bp, Unknown
  misc_feature (1)..( 17): Result.001 file - promoters70/5674194
cagacatatatacttag

SEQ ID NO: 88646 - DNA, 17 bp, Unknown
  misc_feature (1)..( 17): Result.001 file - promoters70/5674194
tatatttatatagataa

SEQ ID NO: 88647 - DNA, 17 bp, Unknown
  misc_feature (1)..( 17): Result.001 file - promoters70/5674194
aaaaaaaatatttgtat

SEQ ID NO: 88648 - DNA, 17 bp, Unknown
  misc_feature (1)..( 17): Result.001 file - promoters70/5674194
accctatataaagataa

SEQ ID NO: 88649 - DNA, 17 bp, Unknown
  misc_feature (1)..( 17): Result.001 file - promoters70/5674194
gtataatataaaggtcc

SEQ ID NO: 88650 - DNA, 17 bp, Unknown
  misc_feature (1)..( 17): Result.001 file - promoters70/5674194
agagaataaaaggtctt

SEQ ID NO: 88651 - DNA, 10 bp, Unknown
  misc_feature (1)..( 10): Result.001 file - promoters70/5674194
taatcttttg

SEQ ID NO: 88652 - DNA, 10 bp, Unknown
  misc_feature (1)..( 10): Result.001 file - promoters70/5674194
taattttttt

SEQ ID NO: 88653 - DNA, 10 bp, Unknown
  misc_feature (1)..( 10): Result.001 file - promoters70/5674194
taatgttttt

SEQ ID NO: 88654 - DNA, 10 bp, Unknown
  misc_feature (1)..( 10): Result.001 file - promoters70/5674194
aactcttttg

SEQ ID NO: 88655 - DNA, 10 bp, Unknown
  misc_feature (1)..( 10): Result.001 file - promoters70/5674194
tcatttttct

SEQ ID NO: 88656 - DNA, 10 bp, Unknown
  misc_feature (1)..( 10): Result.001 file - promoters70/5674194
ggatgttttt

SEQ ID NO: 88657 - DNA, 8 bp, Unknown
  misc_feature (1)..( 8): Result.001 file - promoters70/5674194
aaatattc

SEQ ID NO: 88658 - DNA, 8 bp, Unknown
  misc_feature (1)..( 8): Result.001 file - promoters70/5674194
aaatatcg

SEQ ID NO: 88659 - DNA, 8 bp, Unknown
  misc_feature (1)..( 8): Result.001 file - promoters70/5674194
aaatattt

SEQ ID NO: 88660 - DNA, 8 bp, Unknown
  misc_feature (1)..( 8): Result.001 file - promoters70/5674194
aaaaatta

SEQ ID NO: 88661 - DNA, 8 bp, Unknown
  misc_feature (1)..( 8): Result.001 file - promoters70/5674194
aaaaaaaa

SEQ ID NO: 88662 - DNA, 8 bp, Unknown
  misc_feature (1)..( 8): Result.001 file - promoters70/5674194
aaagaaaa

SEQ ID NO: 88663 - DNA, 11 bp, Unknown
  misc_feature (1)..( 11): Result.001 file - promoters70/5674194
cgatttgttag

SEQ ID NO: 88664 - DNA, 11 bp, Unknown
  misc_feature (1)..( 11): Result.001 file - promoters70/5674194
agtttttttag

SEQ ID NO: 88665 - DNA, 11 bp, Unknown
  misc_feature (1)..( 11): Result.001 file - promoters70/5674194
ctttttgttgt

SEQ ID NO: 88666 - DNA, 11 bp, Unknown
  misc_feature (1)..( 11): Result.001 file - promoters70/5674194
gtttttgtcta

SEQ ID NO: 88667 - DNA, 11 bp, Unknown
  misc_feature (1)..( 11): Result.001 file - promoters70/5674194
ttttatgtttc

SEQ ID NO: 88668 - DNA, 12 bp, Unknown
  misc_feature (1)..( 12): Result.001 file - promoters70/5674194
ttttactttttt

SEQ ID NO: 88669 - DNA, 11 bp, Unknown
  misc_feature (1)..( 11): Result.001 file - promoters70/5674194
tttattgttac

SEQ ID NO: 88670 - DNA, 11 bp, Unknown
  misc_feature (1)..( 11): Result.001 file - promoters70/5674194
gtctttgttag

SEQ ID NO: 88671 - DNA, 11 bp, Unknown
  misc_feature (1)..( 11): Result.001 file - promoters70/5674194
ttgattgatag

SEQ ID NO: 88672 - DNA, 11 bp, Unknown
  misc_feature (1)..( 11): Result.001 file - promoters70/5674194
ctttttgttct

SEQ ID NO: 88673 - DNA, 11 bp, Unknown
  misc_feature (1)..( 11): Result.001 file - promoters70/5674194
ctttttgtatc

SEQ ID NO: 88674 - DNA, 11 bp, Unknown
  misc_feature (1)..( 11): Result.001 file - promoters70/5674634
acatttggtac

SEQ ID NO: 88675 - DNA, 12 bp, Unknown
  misc_feature (1)..( 12): Result.001 file - promoters70/5674634
gggaaaatgaat

SEQ ID NO: 88676 - DNA, 12 bp, Unknown
  misc_feature (1)..( 12): Result.001 file - promoters70/5674634
aaaaaaacgaat

SEQ ID NO: 88677 - DNA, 12 bp, Unknown
  misc_feature (1)..( 12): Result.001 file - promoters70/5674634
attaaaatggta

SEQ ID NO: 88678 - DNA, 12 bp, Unknown
  misc_feature (1)..( 12): Result.001 file - promoters70/5674634
tatcaaacaaat

SEQ ID NO: 88679 - DNA, 12 bp, Unknown
  misc_feature (1)..( 12): Result.001 file - promoters70/5674634
gagaaaaaaagt

SEQ ID NO: 88680 - DNA, 12 bp, Unknown
  misc_feature (1)..( 12): Result.001 file - promoters70/5674666
gagaaaaagagg

SEQ ID NO: 88681 - DNA, 9 bp, Unknown
  misc_feature (1)..( 9): Result.001 file - promoters70/5674666
aaaaattat

SEQ ID NO: 88682 - DNA, 9 bp, Unknown
  misc_feature (1)..( 9): Result.001 file - promoters70/5674666
aaagattgt

SEQ ID NO: 88683 - DNA, 9 bp, Unknown
  misc_feature (1)..( 9): Result.001 file - promoters70/5674666
gtaaattag

SEQ ID NO: 88684 - DNA, 9 bp, Unknown
  misc_feature (1)..( 9): Result.001 file - promoters70/5674666
ggagagtgt

SEQ ID NO: 88685 - DNA, 9 bp, Unknown
  misc_feature (1)..( 9): Result.001 file - promoters70/5674666
aaaaattca

SEQ ID NO: 88686 - DNA, 9 bp, Unknown
  misc_feature (1)..( 9): Result.001 file - promoters70/5674666
aaatatttt

SEQ ID NO: 88687 - DNA, 10 bp, Unknown
  misc_feature (1)..( 10): Result.001 file - promoters70/5674666
attctttcaa

SEQ ID NO: 88688 - DNA, 10 bp, Unknown
  misc_feature (1)..( 10): Result.001 file - promoters70/5674666
attcttacaa

SEQ ID NO: 88689 - DNA, 10 bp, Unknown
  misc_feature (1)..( 10): Result.001 file - promoters70/5674666
attgttttgg

SEQ ID NO: 88690 - DNA, 10 bp, Unknown
  misc_feature (1)..( 10): Result.001 file - promoters70/5674666
agttttacaa

SEQ ID NO: 88691 - DNA, 10 bp, Unknown
  misc_feature (1)..( 10): Result.001 file - promoters70/5674666
gattttacat

SEQ ID NO: 88692 - DNA, 10 bp, Unknown
  misc_feature (1)..( 10): Result.001 file - promoters70/5674666
aagcttacac

SEQ ID NO: 88693 - DNA, 10 bp, Unknown
  misc_feature (1)..( 10): Result.001 file - promoters70/5675661
attttaaata

SEQ ID NO: 88694 - DNA, 9 bp, Unknown
  misc_feature (1)..( 9): Result.001 file - promoters70/5675661
ggttaattc

SEQ ID NO: 88695 - DNA, 9 bp, Unknown
  misc_feature (1)..( 9): Result.001 file - promoters70/5675661
ggttgattt

SEQ ID NO: 88696 - DNA, 9 bp, Unknown
  misc_feature (1)..( 9): Result.001 file - promoters70/5675661
atttgattt

SEQ ID NO: 88697 - DNA, 9 bp, Unknown
  misc_feature (1)..( 9): Result.001 file - promoters70/5675661
ttttgatgg

SEQ ID NO: 88698 - DNA, 8 bp, Unknown
  misc_feature (1)..( 8): Result.001 file - promoters70/5675661
aaaagttt

SEQ ID NO: 88699 - DNA, 8 bp, Unknown
  misc_feature (1)..( 8): Result.001 file - promoters70/5675661
caaagttg

SEQ ID NO: 88700 - DNA, 8 bp, Unknown
  misc_feature (1)..( 8): Result.001 file - promoters70/5675661
caaatttg

SEQ ID NO: 88701 - DNA, 8 bp, Unknown
  misc_feature (1)..( 8): Result.001 file - promoters70/5675661
caattttt

SEQ ID NO: 88702 - DNA, 8 bp, Unknown
  misc_feature (1)..( 8): Result.001 file - promoters70/5675661
gaaagatt

SEQ ID NO: 88703 - DNA, 8 bp, Unknown
  misc_feature (1)..( 8): Result.001 file - promoters70/5675661
aaaagatt

SEQ ID NO: 88704 - DNA, 8 bp, Unknown
  misc_feature (1)..( 8): Result.001 file - promoters70/5675661
aaaagaga

SEQ ID NO: 88705 - DNA, 8 bp, Unknown
  misc_feature (1)..( 8): Result.001 file - promoters70/5675661
aaaagaaa

SEQ ID NO: 88706 - DNA, 8 bp, Unknown
  misc_feature (1)..( 8): Result.001 file - promoters70/5675661
tagaataa

SEQ ID NO: 88707 - DNA, 8 bp, Unknown
  misc_feature (1)..( 8): Result.001 file - promoters70/5675661
cagagtaa

SEQ ID NO: 88708 - DNA, 8 bp, Unknown
  misc_feature (1)..( 8): Result.001 file - promoters70/5675661
gagagtat

SEQ ID NO: 88709 - DNA, 8 bp, Unknown
  misc_feature (1)..( 8): Result.001 file - promoters70/5677230
gagggtac

SEQ ID NO: 88710 - DNA, 7 bp, Unknown
  misc_feature (1)..( 7): Result.001 file - promoters70/5677230
aaggaaa

SEQ ID NO: 88711 - DNA, 7 bp, Unknown
  misc_feature (1)..( 7): Result.001 file - promoters70/5677230
aagtaaa

SEQ ID NO: 88712 - DNA, 7 bp, Unknown
  misc_feature (1)..( 7): Result.001 file - promoters70/5677230
gagtaaa

SEQ ID NO: 88713 - DNA, 7 bp, Unknown
  misc_feature (1)..( 7): Result.001 file - promoters70/5677230
aaaatat

SEQ ID NO: 88714 - DNA, 7 bp, Unknown
  misc_feature (1)..( 7): Result.001 file - promoters70/5677230
aaaataa

SEQ ID NO: 88715 - DNA, 7 bp, Unknown
  misc_feature (1)..( 7): Result.001 file - promoters70/5677274
gaaatat

SEQ ID NO: 88716 - DNA, 8 bp, Unknown
  misc_feature (1)..( 8): Result.001 file - promoters70/5677274
tcatatag

SEQ ID NO: 88717 - DNA, 8 bp, Unknown
  misc_feature (1)..( 8): Result.001 file - promoters70/5677274
acatttag

SEQ ID NO: 88718 - DNA, 8 bp, Unknown
  misc_feature (1)..( 8): Result.001 file - promoters70/5677274
acagttac

SEQ ID NO: 88719 - DNA, 11 bp, Unknown
  misc_feature (1)..( 11): Result.001 file - promoters70/5677274
atggtaatctc

SEQ ID NO: 88720 - DNA, 11 bp, Unknown
  misc_feature (1)..( 11): Result.001 file - promoters70/5677274
atgataataat

SEQ ID NO: 88721 - DNA, 11 bp, Unknown
  misc_feature (1)..( 11): Result.001 file - promoters70/5677298
atgttaaaaat

SEQ ID NO: 88722 - DNA, 8 bp, Unknown
  misc_feature (1)..( 8): Result.001 file - promoters70/5677298
taagtaaa

SEQ ID NO: 88723 - DNA, 8 bp, Unknown
  misc_feature (1)..( 8): Result.001 file - promoters70/5677298
taagaaaa

SEQ ID NO: 88724 - DNA, 8 bp, Unknown
  misc_feature (1)..( 8): Result.001 file - promoters70/5677298
gtagaaaa

SEQ ID NO: 88725 - DNA, 8 bp, Unknown
  misc_feature (1)..( 8): Result.001 file - promoters70/5677298
cttcgatg

SEQ ID NO: 88726 - DNA, 8 bp, Unknown
  misc_feature (1)..( 8): Result.001 file - promoters70/5677298
cttcaatg

SEQ ID NO: 88727 - DNA, 8 bp, Unknown
  misc_feature (1)..( 8): Result.001 file - promoters70/5677298
cttcaatg

SEQ ID NO: 88728 - DNA, 8 bp, Unknown
  misc_feature (1)..( 8): Result.001 file - promoters70/5677298
agagaact

SEQ ID NO: 88729 - DNA, 8 bp, Unknown
  misc_feature (1)..( 8): Result.001 file - promoters70/5677298
agaaaacc

SEQ ID NO: 88730 - DNA, 8 bp, Unknown
  misc_feature (1)..( 8): Result.001 file - promoters70/5681068
ataaaaaa

SEQ ID NO: 88731 - DNA, 7 bp, Unknown
  misc_feature (1)..( 7): Result.001 file - promoters70/5681068
gctaaaa

SEQ ID NO: 88732 - DNA, 7 bp, Unknown
  misc_feature (1)..( 7): Result.001 file - promoters70/5681068
gctgaaa

SEQ ID NO: 88733 - DNA, 7 bp, Unknown
  misc_feature (1)..( 7): Result.001 file - promoters70/5681157
tctgaaa

SEQ ID NO: 88734 - DNA, 10 bp, Unknown
  misc_feature (1)..( 10): Result.001 file - promoters70/5681157
accttaaaaa

SEQ ID NO: 88735 - DNA, 10 bp, Unknown
  misc_feature (1)..( 10): Result.001 file - promoters70/5681157
catttaaaat

SEQ ID NO: 88736 - DNA, 10 bp, Unknown
  misc_feature (1)..( 10): Result.001 file - promoters70/5681157
accttaaaaa

SEQ ID NO: 88737 - DNA, 7 bp, Unknown
  misc_feature (1)..( 7): Result.001 file - promoters70/5681157
aaataaa

SEQ ID NO: 88738 - DNA, 7 bp, Unknown
  misc_feature (1)..( 7): Result.001 file - promoters70/5681157
aaataac

SEQ ID NO: 88739 - DNA, 8 bp, Unknown
  misc_feature (1)..( 8): Result.001 file - promoters70/5681157
aaattaaa

SEQ ID NO: 88740 - DNA, 6 bp, Unknown
  misc_feature (1)..( 6): Result.001 file - promoters70/5681157
ttaaaa

SEQ ID NO: 88741 - DNA, 6 bp, Unknown
  misc_feature (1)..( 6): Result.001 file - promoters70/5681157
ttaaaa

SEQ ID NO: 88742 - DNA, 6 bp, Unknown
  misc_feature (1)..( 6): Result.001 file - promoters70/5681157
ttaaaa

SEQ ID NO: 88743 - DNA, 8 bp, Unknown
  misc_feature (1)..( 8): Result.001 file - promoters70/5681157
aaaaccat

SEQ ID NO: 88744 - DNA, 8 bp, Unknown
  misc_feature (1)..( 8): Result.001 file - promoters70/5681157
taaaccat

SEQ ID NO: 88745 - DNA, 8 bp, Unknown
  misc_feature (1)..( 8): Result.001 file - promoters70/5681157
taaaccta

SEQ ID NO: 88746 - DNA, 12 bp, Unknown
  misc_feature (1)..( 12): Result.001 file - promoters70/5681157
ataaaccaaaaa

SEQ ID NO: 88747 - DNA, 12 bp, Unknown
  misc_feature (1)..( 12): Result.001 file - promoters70/5681157
accattcaaaaa

SEQ ID NO: 88748 - DNA, 12 bp, Unknown
  misc_feature (1)..( 12): Result.001 file - promoters70/5681157
ataaacctaaat

SEQ ID NO: 88749 - DNA, 6 bp, Unknown
  misc_feature (1)..( 6): Result.001 file - promoters70/5681157
ttaaaa

SEQ ID NO: 88750 - DNA, 6 bp, Unknown
  misc_feature (1)..( 6): Result.001 file - promoters70/5681157
ttaaaa

SEQ ID NO: 88751 - DNA, 6 bp, Unknown
  misc_feature (1)..( 6): Result.001 file - promoters70/5681157
ttaaaa

SEQ ID NO: 88752 - DNA, 9 bp, Unknown
  misc_feature (1)..( 9): Result.001 file - promoters70/5681157
aaaatatga

SEQ ID NO: 88753 - DNA, 9 bp, Unknown
  misc_feature (1)..( 9): Result.001 file - promoters70/5681157
aaaataaac

SEQ ID NO: 88754 - DNA, 9 bp, Unknown
  misc_feature (1)..( 9): Result.001 file - promoters70/5681157
aaattaaac

SEQ ID NO: 88755 - DNA, 10 bp, Unknown
  misc_feature (1)..( 10): Result.001 file - promoters70/5681157
aatgtattat

SEQ ID NO: 88756 - DNA, 10 bp, Unknown
  misc_feature (1)..( 10): Result.001 file - promoters70/5681157
tttgtaatat

SEQ ID NO: 88757 - DNA, 10 bp, Unknown
  misc_feature (1)..( 10): Result.001 file - promoters70/5753942
tttttaaaaa

SEQ ID NO: 88758 - DNA, 9 bp, Unknown
  misc_feature (1)..( 9): Result.001 file - promoters70/5753942
acaattgta

SEQ ID NO: 88759 - DNA, 9 bp, Unknown
  misc_feature (1)..( 9): Result.001 file - promoters70/5753942
tacattgta

SEQ ID NO: 88760 - DNA, 9 bp, Unknown
  misc_feature (1)..( 9): Result.001 file - promoters70/5753942
taccttgtt

SEQ ID NO: 88761 - DNA, 9 bp, Unknown
  misc_feature (1)..( 9): Result.001 file - promoters70/5753942
caaacaaaa

SEQ ID NO: 88762 - DNA, 9 bp, Unknown
  misc_feature (1)..( 9): Result.001 file - promoters70/5753942
gaaacaaag

SEQ ID NO: 88763 - DNA, 9 bp, Unknown
  misc_feature (1)..( 9): Result.001 file - promoters70/5753942
taaagaaaa

SEQ ID NO: 88764 - DNA, 9 bp, Unknown
  misc_feature (1)..( 9): Result.001 file - promoters70/5753942
caatcaaat

SEQ ID NO: 88765 - DNA, 8 bp, Unknown
  misc_feature (1)..( 8): Result.001 file - promoters70/5753942
tgttcaaa

SEQ ID NO: 88766 - DNA, 8 bp, Unknown
  misc_feature (1)..( 8): Result.001 file - promoters70/5753942
tgtccaat

SEQ ID NO: 88767 - DNA, 9 bp, Unknown
  misc_feature (1)..( 9): Result.001 file - promoters70/5753942
cgttcgaaa

SEQ ID NO: 88768 - DNA, 13 bp, Unknown
  misc_feature (1)..( 13): Result.001 file - promoters70/5753942
aaacaaattaggg

SEQ ID NO: 88769 - DNA, 13 bp, Unknown
  misc_feature (1)..( 13): Result.001 file - promoters70/5753942
gcccaaattaaaa

SEQ ID NO: 88770 - DNA, 13 bp, Unknown
  misc_feature (1)..( 13): Result.001 file - promoters70/5753942
gcccatattaaaa

SEQ ID NO: 88771 - DNA, 11 bp, Unknown
  misc_feature (1)..( 11): Result.001 file - promoters70/5753942
tttgtgttttt

SEQ ID NO: 88772 - DNA, 11 bp, Unknown
  misc_feature (1)..( 11): Result.001 file - promoters70/5753942
gatgtcttttt

SEQ ID NO: 88773 - DNA, 11 bp, Unknown
  misc_feature (1)..( 11): Result.001 file - promoters70/5753942
tttgggttcct

SEQ ID NO: 88774 - DNA, 7 bp, Unknown
  misc_feature (1)..( 7): Result.001 file - promoters70/5753942
aatattt

SEQ ID NO: 88775 - DNA, 7 bp, Unknown
  misc_feature (1)..( 7): Result.001 file - promoters70/5753942
catattt

SEQ ID NO: 88776 - DNA, 7 bp, Unknown
  misc_feature (1)..( 7): Result.001 file - promoters70/5753942
catatta

SEQ ID NO: 88777 - DNA, 10 bp, Unknown
  misc_feature (1)..( 10): Result.001 file - promoters70/5753942
attcgtagca

SEQ ID NO: 88778 - DNA, 10 bp, Unknown
  misc_feature (1)..( 10): Result.001 file - promoters70/5753942
tttcgtacat

SEQ ID NO: 88779 - DNA, 10 bp, Unknown
  misc_feature (1)..( 10): Result.001 file - promoters70/5753942
tttggtacat

SEQ ID NO: 88780 - DNA, 8 bp, Unknown
  misc_feature (1)..( 8): Result.001 file - promoters70/5753942
aggctata

SEQ ID NO: 88781 - DNA, 8 bp, Unknown
  misc_feature (1)..( 8): Result.001 file - promoters70/5753942
gggccata

SEQ ID NO: 88782 - DNA, 8 bp, Unknown
  misc_feature (1)..( 8): Result.001 file - promoters70/5754134
gggccaag

SEQ ID NO: 88783 - DNA, 12 bp, Unknown
  misc_feature (1)..( 12): Result.001 file - promoters70/5754134
gcaatctggatg

SEQ ID NO: 88784 - DNA, 12 bp, Unknown
  misc_feature (1)..( 12): Result.001 file - promoters70/5754134
tgggcctgcatg

SEQ ID NO: 88785 - DNA, 12 bp, Unknown
  misc_feature (1)..( 12): Result.001 file - promoters70/5754134
gaaatatggata

SEQ ID NO: 88786 - DNA, 12 bp, Unknown
  misc_feature (1)..( 12): Result.001 file - promoters70/5754134
gaggtcttgatt

SEQ ID NO: 88787 - DNA, 12 bp, Unknown
  misc_feature (1)..( 12): Result.001 file - promoters70/5756166
gaaatatgacac

SEQ ID NO: 88788 - DNA, 8 bp, Unknown
  misc_feature (1)..( 8): Result.001 file - promoters70/5756166
ttacaatg

SEQ ID NO: 88789 - DNA, 8 bp, Unknown
  misc_feature (1)..( 8): Result.001 file - promoters70/5756166
atacaatg

SEQ ID NO: 88790 - DNA, 8 bp, Unknown
  misc_feature (1)..( 8): Result.001 file - promoters70/5756166
ttaaaatt

SEQ ID NO: 88791 - DNA, 7 bp, Unknown
  misc_feature (1)..( 7): Result.001 file - promoters70/5756166
tctaaaa

SEQ ID NO: 88792 - DNA, 7 bp, Unknown
  misc_feature (1)..( 7): Result.001 file - promoters70/5756166
tcttaaa

SEQ ID NO: 88793 - DNA, 7 bp, Unknown
  misc_feature (1)..( 7): Result.001 file - promoters70/5759467
tcttaat

SEQ ID NO: 88794 - DNA, 8 bp, Unknown
  misc_feature (1)..( 8): Result.001 file - promoters70/5759467
gcaataag

SEQ ID NO: 88795 - DNA, 8 bp, Unknown
  misc_feature (1)..( 8): Result.001 file - promoters70/5759467
acaataag

SEQ ID NO: 88796 - DNA, 8 bp, Unknown
  misc_feature (1)..( 8): Result.001 file - promoters70/5759467
gcaataaa

SEQ ID NO: 88797 - DNA, 7 bp, Unknown
  misc_feature (1)..( 7): Result.001 file - promoters70/5759467
catttac

SEQ ID NO: 88798 - DNA, 7 bp, Unknown
  misc_feature (1)..( 7): Result.001 file - promoters70/5759467
gatttac

SEQ ID NO: 88799 - DNA, 7 bp, Unknown
  misc_feature (1)..( 7): Result.001 file - promoters70/5773091
gatttaa

SEQ ID NO: 88800 - DNA, 9 bp, Unknown
  misc_feature (1)..( 9): Result.001 file - promoters70/5773091
ccaaagtaa

SEQ ID NO: 88801 - DNA, 9 bp, Unknown
  misc_feature (1)..( 9): Result.001 file - promoters70/5773091
acaaaataa

SEQ ID NO: 88802 - DNA, 9 bp, Unknown
  misc_feature (1)..( 9): Result.001 file - promoters70/5776417
acaaaaata

SEQ ID NO: 88803 - DNA, 8 bp, Unknown
  misc_feature (1)..( 8): Result.001 file - promoters70/5776417
agttttgt

SEQ ID NO: 88804 - DNA, 8 bp, Unknown
  misc_feature (1)..( 8): Result.001 file - promoters70/5776417
agtttttg

SEQ ID NO: 88805 - DNA, 8 bp, Unknown
  misc_feature (1)..( 8): Result.001 file - promoters70/5776417
ggtttttt

SEQ ID NO: 88806 - DNA, 8 bp, Unknown
  misc_feature (1)..( 8): Result.001 file - promoters60/1006957
tgttgttg

SEQ ID NO: 88807 - DNA, 8 bp, Unknown
  misc_feature (1)..( 8): Result.001 file - promoters60/1006957
aaaaggaa

SEQ ID NO: 88808 - DNA, 8 bp, Unknown
  misc_feature (1)..( 8): Result.001 file - promoters60/1006957
gaaaggag

SEQ ID NO: 88809 - DNA, 8 bp, Unknown
  misc_feature (1)..( 8): Result.001 file - promoters60/1006957
gaaaagag

SEQ ID NO: 88810 - DNA, 7 bp, Unknown
  misc_feature (1)..( 7): Result.001 file - promoters60/1006957
gatcaat

SEQ ID NO: 88811 - DNA, 7 bp, Unknown
  misc_feature (1)..( 7): Result.001 file - promoters60/1006957
gataaat

SEQ ID NO: 88812 - DNA, 6 bp, Unknown
  misc_feature (1)..( 6): Result.001 file - promoters60/1006957
atcata

SEQ ID NO: 88813 - DNA, 6 bp, Unknown
  misc_feature (1)..( 6): Result.001 file - promoters60/1006957
atcata

SEQ ID NO: 88814 - DNA, 6 bp, Unknown
  misc_feature (1)..( 6): Result.001 file - promoters60/1006957
aaaaat

SEQ ID NO: 88815 - DNA, 6 bp, Unknown
  misc_feature (1)..( 6): Result.001 file - promoters60/1006957
aaaaat

SEQ ID NO: 88816 - DNA, 7 bp, Unknown
  misc_feature (1)..( 7): Result.001 file - promoters60/1006957
attcaaa

SEQ ID NO: 88817 - DNA, 7 bp, Unknown
  misc_feature (1)..( 7): Result.001 file - promoters60/1006957
attgaaa

SEQ ID NO: 88818 - DNA, 10 bp, Unknown
  misc_feature (1)..( 10): Result.001 file - promoters60/1006957
caaagtagag

SEQ ID NO: 88819 - DNA, 10 bp, Unknown
  misc_feature (1)..( 10): Result.001 file - promoters60/1006957
caaactaggc

SEQ ID NO: 88820 - DNA, 10 bp, Unknown
  misc_feature (1)..( 10): Result.001 file - promoters60/1006957
aaaacaaggc

SEQ ID NO: 88821 - DNA, 10 bp, Unknown
  misc_feature (1)..( 10): Result.001 file - promoters60/1006957
tgagtgtttt

SEQ ID NO: 88822 - DNA, 10 bp, Unknown
  misc_feature (1)..( 10): Result.001 file - promoters60/1006957
tgagggtttt

SEQ ID NO: 88823 - DNA, 7 bp, Unknown
  misc_feature (1)..( 7): Result.001 file - promoters60/1006957
tggcttc

SEQ ID NO: 88824 - DNA, 7 bp, Unknown
  misc_feature (1)..( 7): Result.001 file - promoters60/1006957
tgggttc

SEQ ID NO: 88825 - DNA, 6 bp, Unknown
  misc_feature (1)..( 6): Result.001 file - promoters60/1006957
gagtga

SEQ ID NO: 88826 - DNA, 6 bp, Unknown
  misc_feature (1)..( 6): Result.001 file - promoters60/1006957
gagtga

SEQ ID NO: 88827 - DNA, 9 bp, Unknown
  misc_feature (1)..( 9): Result.001 file - promoters60/1006957
ggagagaaa

SEQ ID NO: 88828 - DNA, 9 bp, Unknown
  misc_feature (1)..( 9): Result.001 file - promoters60/1006957
ggagtgaaa

SEQ ID NO: 88829 - DNA, 9 bp, Unknown
  misc_feature (1)..( 9): Result.001 file - promoters60/1006957
agaaaaagt

SEQ ID NO: 88830 - DNA, 9 bp, Unknown
  misc_feature (1)..( 9): Result.001 file - promoters60/1006957
agagaaagt

SEQ ID NO: 88831 - DNA, 8 bp, Unknown
  misc_feature (1)..( 8): Result.001 file - promoters60/1006957
tttcgctt

SEQ ID NO: 88832 - DNA, 8 bp, Unknown
  misc_feature (1)..( 8): Result.001 file - promoters60/1007030
tttagctt

SEQ ID NO: 88833 - DNA, 10 bp, Unknown
  misc_feature (1)..( 10): Result.001 file - promoters60/1007030
aaataataaa

SEQ ID NO: 88834 - DNA, 10 bp, Unknown
  misc_feature (1)..( 10): Result.001 file - promoters60/1007030
ttataatata

SEQ ID NO: 88835 - DNA, 10 bp, Unknown
  misc_feature (1)..( 10): Result.001 file - promoters60/1007030
aaatagtaaa

SEQ ID NO: 88836 - DNA, 10 bp, Unknown
  misc_feature (1)..( 10): Result.001 file - promoters60/1007030
ggataaaata

SEQ ID NO: 88837 - DNA, 10 bp, Unknown
  misc_feature (1)..( 10): Result.001 file - promoters60/1007030
agatagtact

SEQ ID NO: 88838 - DNA, 12 bp, Unknown
  misc_feature (1)..( 12): Result.001 file - promoters60/1007030
ataaatagcggg

SEQ ID NO: 88839 - DNA, 12 bp, Unknown
  misc_feature (1)..( 12): Result.001 file - promoters60/1007030
ataaataattat

SEQ ID NO: 88840 - DNA, 12 bp, Unknown
  misc_feature (1)..( 12): Result.001 file - promoters60/1007030
ataaatagtaaa

SEQ ID NO: 88841 - DNA, 12 bp, Unknown
  misc_feature (1)..( 12): Result.001 file - promoters60/1007030
tgagatagtact

SEQ ID NO: 88842 - DNA, 8 bp, Unknown
  misc_feature (1)..( 8): Result.001 file - promoters60/1007030
aaaacaat

SEQ ID NO: 88843 - DNA, 8 bp, Unknown
  misc_feature (1)..( 8): Result.001 file - promoters60/1007030
aaaacaat

SEQ ID NO: 88844 - DNA, 8 bp, Unknown
  misc_feature (1)..( 8): Result.001 file - promoters60/1007030
aaaagaat

SEQ ID NO: 88845 - DNA, 8 bp, Unknown
  misc_feature (1)..( 8): Result.001 file - promoters60/1007030
tgaagaat

SEQ ID NO: 88846 - DNA, 8 bp, Unknown
  misc_feature (1)..( 8): Result.001 file - promoters60/1007030
aaatgaaa

SEQ ID NO: 88847 - DNA, 8 bp, Unknown
  misc_feature (1)..( 8): Result.001 file - promoters60/1007030
aaacgaat

SEQ ID NO: 88848 - DNA, 8 bp, Unknown
  misc_feature (1)..( 8): Result.001 file - promoters60/1007030
gaaccaat

SEQ ID NO: 88849 - DNA, 8 bp, Unknown
  misc_feature (1)..( 8): Result.001 file - promoters60/1007030
aaacgatt

SEQ ID NO: 88850 - DNA, 13 bp, Unknown
  misc_feature (1)..( 13): Result.001 file - promoters60/1007030
gggaagataaaca

SEQ ID NO: 88851 - DNA, 13 bp, Unknown
  misc_feature (1)..( 13): Result.001 file - promoters60/1007030
tcgaaaatataca

SEQ ID NO: 88852 - DNA, 13 bp, Unknown
  misc_feature (1)..( 13): Result.001 file - promoters60/1007030
tataaagtattta

SEQ ID NO: 88853 - DNA, 13 bp, Unknown
  misc_feature (1)..( 13): Result.001 file - promoters60/1007030
tcgataatgaaga

SEQ ID NO: 88854 - DNA, 11 bp, Unknown
  misc_feature (1)..( 11): Result.001 file - promoters60/1007030
aattaacccaa

SEQ ID NO: 88855 - DNA, 11 bp, Unknown
  misc_feature (1)..( 11): Result.001 file - promoters60/1007030
tattaacctac

SEQ ID NO: 88856 - DNA, 11 bp, Unknown
  misc_feature (1)..( 11): Result.001 file - promoters60/1007030
aattaaaaaag

SEQ ID NO: 88857 - DNA, 11 bp, Unknown
  misc_feature (1)..( 11): Result.001 file - promoters60/1007030
cagtaatccaa

SEQ ID NO: 88858 - DNA, 10 bp, Unknown
  misc_feature (1)..( 10): Result.001 file - promoters60/1007030
aatctgcttc

SEQ ID NO: 88859 - DNA, 10 bp, Unknown
  misc_feature (1)..( 10): Result.001 file - promoters60/1007030
aatcttcttc

SEQ ID NO: 88860 - DNA, 10 bp, Unknown
  misc_feature (1)..( 10): Result.001 file - promoters60/1007030
aatctgatgt

SEQ ID NO: 88861 - DNA, 10 bp, Unknown
  misc_feature (1)..( 10): Result.001 file - promoters60/1007030
aatttgaaaa

SEQ ID NO: 88862 - DNA, 7 bp, Unknown
  misc_feature (1)..( 7): Result.001 file - promoters60/1007030
gaaataa

SEQ ID NO: 88863 - DNA, 7 bp, Unknown
  misc_feature (1)..( 7): Result.001 file - promoters60/1007030
aaaataa

SEQ ID NO: 88864 - DNA, 7 bp, Unknown
  misc_feature (1)..( 7): Result.001 file - promoters60/1007030
aaaatac

SEQ ID NO: 88865 - DNA, 7 bp, Unknown
  misc_feature (1)..( 7): Result.001 file - promoters60/1007030
aaagtaa

SEQ ID NO: 88866 - DNA, 13 bp, Unknown
  misc_feature (1)..( 13): Result.001 file - promoters60/1007030
cataaaaaaagat

SEQ ID NO: 88867 - DNA, 13 bp, Unknown
  misc_feature (1)..( 13): Result.001 file - promoters60/1007030
atatgaaaaggat

SEQ ID NO: 88868 - DNA, 13 bp, Unknown
  misc_feature (1)..( 13): Result.001 file - promoters60/1007030
tgaagaaaaagca

SEQ ID NO: 88869 - DNA, 13 bp, Unknown
  misc_feature (1)..( 13): Result.001 file - promoters60/1007030
tgatgaaaaatta

SEQ ID NO: 88870 - DNA, 7 bp, Unknown
  misc_feature (1)..( 7): Result.001 file - promoters60/1007030
taaaaat

SEQ ID NO: 88871 - DNA, 7 bp, Unknown
  misc_feature (1)..( 7): Result.001 file - promoters60/1007030
taaaaaa

SEQ ID NO: 88872 - DNA, 7 bp, Unknown
  misc_feature (1)..( 7): Result.001 file - promoters60/1007030
taaaaaa

SEQ ID NO: 88873 - DNA, 7 bp, Unknown
  misc_feature (1)..( 7): Result.001 file - promoters60/1007030
caaaaaa

SEQ ID NO: 88874 - DNA, 10 bp, Unknown
  misc_feature (1)..( 10): Result.001 file - promoters60/1007030
attgagatag

SEQ ID NO: 88875 - DNA, 10 bp, Unknown
  misc_feature (1)..( 10): Result.001 file - promoters60/1007030
actgaaatat

SEQ ID NO: 88876 - DNA, 10 bp, Unknown
  misc_feature (1)..( 10): Result.001 file - promoters60/1007030
attgacatat

SEQ ID NO: 88877 - DNA, 10 bp, Unknown
  misc_feature (1)..( 10): Result.001 file - promoters60/1007056
attaaaatat

SEQ ID NO: 88878 - DNA, 8 bp, Unknown
  misc_feature (1)..( 8): Result.001 file - promoters60/1007056
aaggctga

SEQ ID NO: 88879 - DNA, 8 bp, Unknown
  misc_feature (1)..( 8): Result.001 file - promoters60/1007056
aaggatga

SEQ ID NO: 88880 - DNA, 7 bp, Unknown
  misc_feature (1)..( 7): Result.001 file - promoters60/1007056
gttttgg

SEQ ID NO: 88881 - DNA, 7 bp, Unknown
  misc_feature (1)..( 7): Result.001 file - promoters60/1007056
gttctgg

SEQ ID NO: 88882 - DNA, 7 bp, Unknown
  misc_feature (1)..( 7): Result.001 file - promoters60/1007056
gttttgt

SEQ ID NO: 88883 - DNA, 6 bp, Unknown
  misc_feature (1)..( 6): Result.001 file - promoters60/1007056
ggtgat

SEQ ID NO: 88884 - DNA, 6 bp, Unknown
  misc_feature (1)..( 6): Result.001 file - promoters60/1007056
ggtgat

SEQ ID NO: 88885 - DNA, 11 bp, Unknown
  misc_feature (1)..( 11): Result.001 file - promoters60/1007056
accttctgtga

SEQ ID NO: 88886 - DNA, 11 bp, Unknown
  misc_feature (1)..( 11): Result.001 file - promoters60/1007056
accttctctga

SEQ ID NO: 88887 - DNA, 6 bp, Unknown
  misc_feature (1)..( 6): Result.001 file - promoters60/1007056
aaggct

SEQ ID NO: 88888 - DNA, 6 bp, Unknown
  misc_feature (1)..( 6): Result.001 file - promoters60/1007056
aaggct

SEQ ID NO: 88889 - DNA, 6 bp, Unknown
  misc_feature (1)..( 6): Result.001 file - promoters60/1007056
gatgca

SEQ ID NO: 88890 - DNA, 6 bp, Unknown
  misc_feature (1)..( 6): Result.001 file - promoters60/1007056
gatgca

SEQ ID NO: 88891 - DNA, 7 bp, Unknown
  misc_feature (1)..( 7): Result.001 file - promoters60/1007056
aacatct

SEQ ID NO: 88892 - DNA, 7 bp, Unknown
  misc_feature (1)..( 7): Result.001 file - promoters60/1007056
aacttct

SEQ ID NO: 88893 - DNA, 10 bp, Unknown
  misc_feature (1)..( 10): Result.001 file - promoters60/1007056
atcttttcta

SEQ ID NO: 88894 - DNA, 10 bp, Unknown
  misc_feature (1)..( 10): Result.001 file - promoters60/1007056
aagttttcta

SEQ ID NO: 88895 - DNA, 10 bp, Unknown
  misc_feature (1)..( 10): Result.001 file - promoters60/1007056
aagttctctg

SEQ ID NO: 88896 - DNA, 7 bp, Unknown
  misc_feature (1)..( 7): Result.001 file - promoters60/1007056
ctattca

SEQ ID NO: 88897 - DNA, 7 bp, Unknown
  misc_feature (1)..( 7): Result.001 file - promoters60/1007056
ctaatca

SEQ ID NO: 88898 - DNA, 6 bp, Unknown
  misc_feature (1)..( 6): Result.001 file - promoters60/1007056
ggtttt

SEQ ID NO: 88899 - DNA, 6 bp, Unknown
  misc_feature (1)..( 6): Result.001 file - promoters60/1007056
ggtttt

SEQ ID NO: 88900 - DNA, 6 bp, Unknown
  misc_feature (1)..( 6): Result.001 file - promoters60/1007056
ttttgt

SEQ ID NO: 88901 - DNA, 6 bp, Unknown
  misc_feature (1)..( 6): Result.001 file - promoters60/1007056
ttttgt

SEQ ID NO: 88902 - DNA, 6 bp, Unknown
  misc_feature (1)..( 6): Result.001 file - promoters60/1007056
ttgttt

SEQ ID NO: 88903 - DNA, 6 bp, Unknown
  misc_feature (1)..( 6): Result.001 file - promoters60/1007056
ttgttt

SEQ ID NO: 88904 - DNA, 6 bp, Unknown
  misc_feature (1)..( 6): Result.001 file - promoters60/1007056
atccaa

SEQ ID NO: 88905 - DNA, 6 bp, Unknown
  misc_feature (1)..( 6): Result.001 file - promoters60/1007056
atccaa

SEQ ID NO: 88906 - DNA, 7 bp, Unknown
  misc_feature (1)..( 7): Result.001 file - promoters60/1007056
tgccaag

SEQ ID NO: 88907 - DNA, 7 bp, Unknown
  misc_feature (1)..( 7): Result.001 file - promoters60/1007056
tgctaag

SEQ ID NO: 88908 - DNA, 7 bp, Unknown
  misc_feature (1)..( 7): Result.001 file - promoters60/1007056
tcatgaa

SEQ ID NO: 88909 - DNA, 7 bp, Unknown
  misc_feature (1)..( 7): Result.001 file - promoters60/1007056
tcaagaa

SEQ ID NO: 88910 - DNA, 6 bp, Unknown
  misc_feature (1)..( 6): Result.001 file - promoters60/1007056
agtcct

SEQ ID NO: 88911 - DNA, 6 bp, Unknown
  misc_feature (1)..( 6): Result.001 file - promoters60/1007056
agtcct

SEQ ID NO: 88912 - DNA, 6 bp, Unknown
  misc_feature (1)..( 6): Result.001 file - promoters60/1007056
gaggca

SEQ ID NO: 88913 - DNA, 6 bp, Unknown
  misc_feature (1)..( 6): Result.001 file - promoters60/1007056
gaggca

SEQ ID NO: 88914 - DNA, 7 bp, Unknown
  misc_feature (1)..( 7): Result.001 file - promoters60/1007056
tcaagaa

SEQ ID NO: 88915 - DNA, 7 bp, Unknown
  misc_feature (1)..( 7): Result.001 file - promoters60/1007139
tcatgaa

SEQ ID NO: 88916 - DNA, 11 bp, Unknown
  misc_feature (1)..( 11): Result.001 file - promoters60/1007139
cccccacaaaa

SEQ ID NO: 88917 - DNA, 11 bp, Unknown
  misc_feature (1)..( 11): Result.001 file - promoters60/1007139
ttttaacaaaa

SEQ ID NO: 88918 - DNA, 11 bp, Unknown
  misc_feature (1)..( 11): Result.001 file - promoters60/1007139
gtataataaag

SEQ ID NO: 88919 - DNA, 12 bp, Unknown
  misc_feature (1)..( 12): Result.001 file - promoters60/1007139
tttcaaccaaaa

SEQ ID NO: 88920 - DNA, 9 bp, Unknown
  misc_feature (1)..( 9): Result.001 file - promoters60/1007139
aaagttttg

SEQ ID NO: 88921 - DNA, 9 bp, Unknown
  misc_feature (1)..( 9): Result.001 file - promoters60/1007139
aaagttcaa

SEQ ID NO: 88922 - DNA, 9 bp, Unknown
  misc_feature (1)..( 9): Result.001 file - promoters60/1007139
caagttttg

SEQ ID NO: 88923 - DNA, 9 bp, Unknown
  misc_feature (1)..( 9): Result.001 file - promoters60/1007139
caagatcat

SEQ ID NO: 88924 - DNA, 10 bp, Unknown
  misc_feature (1)..( 10): Result.001 file - promoters60/1007139
aaatatatgt

SEQ ID NO: 88925 - DNA, 10 bp, Unknown
  misc_feature (1)..( 10): Result.001 file - promoters60/1007139
taatttatca

SEQ ID NO: 88926 - DNA, 11 bp, Unknown
  misc_feature (1)..( 11): Result.001 file - promoters60/1007139
ttgatatatac

SEQ ID NO: 88927 - DNA, 11 bp, Unknown
  misc_feature (1)..( 11): Result.001 file - promoters60/1007187
gaattatatgt

SEQ ID NO: 88928 - DNA, 9 bp, Unknown
  misc_feature (1)..( 9): Result.001 file - promoters60/1007187
aatttattt

SEQ ID NO: 88929 - DNA, 9 bp, Unknown
  misc_feature (1)..( 9): Result.001 file - promoters60/1007187
gatttatta

SEQ ID NO: 88930 - DNA, 9 bp, Unknown
  misc_feature (1)..( 9): Result.001 file - promoters60/1007187
aatttattt

SEQ ID NO: 88931 - DNA, 9 bp, Unknown
  misc_feature (1)..( 9): Result.001 file - promoters60/1007187
aaaatatta

SEQ ID NO: 88932 - DNA, 9 bp, Unknown
  misc_feature (1)..( 9): Result.001 file - promoters60/1007187
aaaagatta

SEQ ID NO: 88933 - DNA, 9 bp, Unknown
  misc_feature (1)..( 9): Result.001 file - promoters60/1007187
ttaatattt

SEQ ID NO: 88934 - DNA, 9 bp, Unknown
  misc_feature (1)..( 9): Result.001 file - promoters60/1007187
tgttaatct

SEQ ID NO: 88935 - DNA, 9 bp, Unknown
  misc_feature (1)..( 9): Result.001 file - promoters60/1007187
tgttaatag

SEQ ID NO: 88936 - DNA, 9 bp, Unknown
  misc_feature (1)..( 9): Result.001 file - promoters60/1007187
acttaatct

SEQ ID NO: 88937 - DNA, 7 bp, Unknown
  misc_feature (1)..( 7): Result.001 file - promoters60/1007187
aaatgat

SEQ ID NO: 88938 - DNA, 7 bp, Unknown
  misc_feature (1)..( 7): Result.001 file - promoters60/1007187
aaaagat

SEQ ID NO: 88939 - DNA, 9 bp, Unknown
  misc_feature (1)..( 9): Result.001 file - promoters60/1007187
ttttgtttt

SEQ ID NO: 88940 - DNA, 9 bp, Unknown
  misc_feature (1)..( 9): Result.001 file - promoters60/1007187
tttggtttt

SEQ ID NO: 88941 - DNA, 12 bp, Unknown
  misc_feature (1)..( 12): Result.001 file - promoters60/1007187
tttttaacaatt

SEQ ID NO: 88942 - DNA, 12 bp, Unknown
  misc_feature (1)..( 12): Result.001 file - promoters60/1007187
ttttctacaatt

SEQ ID NO: 88943 - DNA, 12 bp, Unknown
  misc_feature (1)..( 12): Result.001 file - promoters60/1007187
ttttctaaaata

SEQ ID NO: 88944 - DNA, 7 bp, Unknown
  misc_feature (1)..( 7): Result.001 file - promoters60/1007187
tttttct

SEQ ID NO: 88945 - DNA, 7 bp, Unknown
  misc_feature (1)..( 7): Result.001 file - promoters60/1007187
gttttct

SEQ ID NO: 88946 - DNA, 7 bp, Unknown
  misc_feature (1)..( 7): Result.001 file - promoters60/1007187
tttttct

SEQ ID NO: 88947 - DNA, 8 bp, Unknown
  misc_feature (1)..( 8): Result.001 file - promoters60/1007187
tgaggaat

SEQ ID NO: 88948 - DNA, 8 bp, Unknown
  misc_feature (1)..( 8): Result.001 file - promoters60/1007187
tgatgaat

SEQ ID NO: 88949 - DNA, 7 bp, Unknown
  misc_feature (1)..( 7): Result.001 file - promoters60/1007187
caaacgc

SEQ ID NO: 88950 - DNA, 7 bp, Unknown
  misc_feature (1)..( 7): Result.001 file - promoters60/1007187
caatcgc

SEQ ID NO: 88951 - DNA, 6 bp, Unknown
  misc_feature (1)..( 6): Result.001 file - promoters60/1007187
aatttt

SEQ ID NO: 88952 - DNA, 6 bp, Unknown
  misc_feature (1)..( 6): Result.001 file - promoters60/1007187
aatttt

SEQ ID NO: 88953 - DNA, 6 bp, Unknown
  misc_feature (1)..( 6): Result.001 file - promoters60/1007187
aatttt

SEQ ID NO: 88954 - DNA, 9 bp, Unknown
  misc_feature (1)..( 9): Result.001 file - promoters60/1007187
tattttgga

SEQ ID NO: 88955 - DNA, 9 bp, Unknown
  misc_feature (1)..( 9): Result.001 file - promoters60/1007187
tatttttac

SEQ ID NO: 88956 - DNA, 9 bp, Unknown
  misc_feature (1)..( 9): Result.001 file - promoters60/1007187
aattttttt

SEQ ID NO: 88957 - DNA, 9 bp, Unknown
  misc_feature (1)..( 9): Result.001 file - promoters60/1007187
aatattgca

SEQ ID NO: 88958 - DNA, 9 bp, Unknown
  misc_feature (1)..( 9): Result.001 file - promoters60/1007187
aatattttt

SEQ ID NO: 88959 - DNA, 9 bp, Unknown
  misc_feature (1)..( 9): Result.001 file - promoters60/1007187
aattttttt

SEQ ID NO: 88960 - DNA, 8 bp, Unknown
  misc_feature (1)..( 8): Result.001 file - promoters60/1007187
ttttaaat

SEQ ID NO: 88961 - DNA, 8 bp, Unknown
  misc_feature (1)..( 8): Result.001 file - promoters60/1007187
atttaaaa

SEQ ID NO: 88962 - DNA, 7 bp, Unknown
  misc_feature (1)..( 7): Result.001 file - promoters60/1007187
taaataa

SEQ ID NO: 88963 - DNA, 7 bp, Unknown
  misc_feature (1)..( 7): Result.001 file - promoters60/1007187
taattaa

SEQ ID NO: 88964 - DNA, 7 bp, Unknown
  misc_feature (1)..( 7): Result.001 file - promoters60/1007187
ttgtttt

SEQ ID NO: 88965 - DNA, 7 bp, Unknown
  misc_feature (1)..( 7): Result.001 file - promoters60/1007187
ttgtttt

SEQ ID NO: 88966 - DNA, 8 bp, Unknown
  misc_feature (1)..( 8): Result.001 file - promoters60/1007187
attggatg

SEQ ID NO: 88967 - DNA, 8 bp, Unknown
  misc_feature (1)..( 8): Result.001 file - promoters60/1007187
attgtatg

SEQ ID NO: 88968 - DNA, 6 bp, Unknown
  misc_feature (1)..( 6): Result.001 file - promoters60/1007187
tccaaa

SEQ ID NO: 88969 - DNA, 6 bp, Unknown
  misc_feature (1)..( 6): Result.001 file - promoters60/1007187
tccaaa

SEQ ID NO: 88970 - DNA, 6 bp, Unknown
  misc_feature (1)..( 6): Result.001 file - promoters60/1007187
tatttt

SEQ ID NO: 88971 - DNA, 6 bp, Unknown
  misc_feature (1)..( 6): Result.001 file - promoters60/1007187
tatttt

SEQ ID NO: 88972 - DNA, 6 bp, Unknown
  misc_feature (1)..( 6): Result.001 file - promoters60/1007187
ttaaaa

SEQ ID NO: 88973 - DNA, 6 bp, Unknown
  misc_feature (1)..( 6): Result.001 file - promoters60/1007187
ttaaaa

SEQ ID NO: 88974 - DNA, 9 bp, Unknown
  misc_feature (1)..( 9): Result.001 file - promoters60/1007187
ataagaaaa

SEQ ID NO: 88975 - DNA, 9 bp, Unknown
  misc_feature (1)..( 9): Result.001 file - promoters60/1007187
ataacaaaa

SEQ ID NO: 88976 - DNA, 7 bp, Unknown
  misc_feature (1)..( 7): Result.001 file - promoters60/1007187
taataat

SEQ ID NO: 88977 - DNA, 7 bp, Unknown
  misc_feature (1)..( 7): Result.001 file - promoters60/1007187
taataat

SEQ ID NO: 88978 - DNA, 6 bp, Unknown
  misc_feature (1)..( 6): Result.001 file - promoters60/1007187
atattt

SEQ ID NO: 88979 - DNA, 6 bp, Unknown
  misc_feature (1)..( 6): Result.001 file - promoters60/1007187
atattt

SEQ ID NO: 88980 - DNA, 7 bp, Unknown
  misc_feature (1)..( 7): Result.001 file - promoters60/1007187
tatccaa

SEQ ID NO: 88981 - DNA, 7 bp, Unknown
  misc_feature (1)..( 7): Result.001 file - promoters60/1007187
tatacaa

SEQ ID NO: 88982 - DNA, 7 bp, Unknown
  misc_feature (1)..( 7): Result.001 file - promoters60/1007187
tataatt

SEQ ID NO: 88983 - DNA, 7 bp, Unknown
  misc_feature (1)..( 7): Result.001 file - promoters60/1007187
tatgatt

SEQ ID NO: 88984 - DNA, 6 bp, Unknown
  misc_feature (1)..( 6): Result.001 file - promoters60/1007187
aaaaaa

SEQ ID NO: 88985 - DNA, 6 bp, Unknown
  misc_feature (1)..( 6): Result.001 file - promoters60/1007187
aaaaaa

SEQ ID NO: 88986 - DNA, 8 bp, Unknown
  misc_feature (1)..( 8): Result.001 file - promoters60/1007187
taaatttc

SEQ ID NO: 88987 - DNA, 8 bp, Unknown
  misc_feature (1)..( 8): Result.001 file - promoters60/1007187
taactttc

SEQ ID NO: 88988 - DNA, 7 bp, Unknown
  misc_feature (1)..( 7): Result.001 file - promoters60/1007187
aagagaa

SEQ ID NO: 88989 - DNA, 7 bp, Unknown
  misc_feature (1)..( 7): Result.001 file - promoters60/1007187
aagtgaa

SEQ ID NO: 88990 - DNA, 8 bp, Unknown
  misc_feature (1)..( 8): Result.001 file - promoters60/1007187
atggcttg

SEQ ID NO: 88991 - DNA, 8 bp, Unknown
  misc_feature (1)..( 8): Result.001 file - promoters60/1007269
atgggttg

SEQ ID NO: 88992 - DNA, 12 bp, Unknown
  misc_feature (1)..( 12): Result.001 file - promoters60/1007269
cccaaacaaatt

SEQ ID NO: 88993 - DNA, 12 bp, Unknown
  misc_feature (1)..( 12): Result.001 file - promoters60/1007269
tggaaacgaatt

SEQ ID NO: 88994 - DNA, 12 bp, Unknown
  misc_feature (1)..( 12): Result.001 file - promoters60/1007269
tggaaacggtga

SEQ ID NO: 88995 - DNA, 10 bp, Unknown
  misc_feature (1)..( 10): Result.001 file - promoters60/1007269
gaaacgtttt

SEQ ID NO: 88996 - DNA, 10 bp, Unknown
  misc_feature (1)..( 10): Result.001 file - promoters60/1007269
tattcgtttt

SEQ ID NO: 88997 - DNA, 10 bp, Unknown
  misc_feature (1)..( 10): Result.001 file - promoters60/1007269
tatttgtttt

SEQ ID NO: 88998 - DNA, 10 bp, Unknown
  misc_feature (1)..( 10): Result.001 file - promoters60/1007269
taaaaaagat

SEQ ID NO: 88999 - DNA, 10 bp, Unknown
  misc_feature (1)..( 10): Result.001 file - promoters60/1007269
taaaatagat

SEQ ID NO: 89000 - DNA, 10 bp, Unknown
  misc_feature (1)..( 10): Result.001 file - promoters60/1007269
gttaatagac

SEQ ID NO: 89001 - DNA, 9 bp, Unknown
  misc_feature (1)..( 9): Result.001 file - promoters60/1007269
ttaaaacaa

SEQ ID NO: 89002 - DNA, 9 bp, Unknown
  misc_feature (1)..( 9): Result.001 file - promoters60/1007269
ataaaacct

SEQ ID NO: 89003 - DNA, 9 bp, Unknown
  misc_feature (1)..( 9): Result.001 file - promoters60/1007289
ataaaccct

SEQ ID NO: 89004 - DNA, 8 bp, Unknown
  misc_feature (1)..( 8): Result.001 file - promoters60/1007289
ttttctta

SEQ ID NO: 89005 - DNA, 8 bp, Unknown
  misc_feature (1)..( 8): Result.001 file - promoters60/1007289
tttacttt

SEQ ID NO: 89006 - DNA, 8 bp, Unknown
  misc_feature (1)..( 8): Result.001 file - promoters60/1007289
atttgtta

SEQ ID NO: 89007 - DNA, 8 bp, Unknown
  misc_feature (1)..( 8): Result.001 file - promoters60/1007289
atttgtat

SEQ ID NO: 89008 - DNA, 11 bp, Unknown
  misc_feature (1)..( 11): Result.001 file - promoters60/1007289
ttcaatgataa

SEQ ID NO: 89009 - DNA, 11 bp, Unknown
  misc_feature (1)..( 11): Result.001 file - promoters60/1007289
aataattataa

SEQ ID NO: 89010 - DNA, 11 bp, Unknown
  misc_feature (1)..( 11): Result.001 file - promoters60/1007289
ttcaatgactc

SEQ ID NO: 89011 - DNA, 11 bp, Unknown
  misc_feature (1)..( 11): Result.001 file - promoters60/1007289
gtgaattattc

SEQ ID NO: 89012 - DNA, 12 bp, Unknown
  misc_feature (1)..( 12): Result.001 file - promoters60/1007289
taaacagaagat

SEQ ID NO: 89013 - DNA, 12 bp, Unknown
  misc_feature (1)..( 12): Result.001 file - promoters60/1007289
ggtttagaagaa

SEQ ID NO: 89014 - DNA, 12 bp, Unknown
  misc_feature (1)..( 12): Result.001 file - promoters60/1007289
gacgaagaagat

SEQ ID NO: 89015 - DNA, 12 bp, Unknown
  misc_feature (1)..( 12): Result.001 file - promoters60/1007289
ttataagaagaa

SEQ ID NO: 89016 - DNA, 7 bp, Unknown
  misc_feature (1)..( 7): Result.001 file - promoters60/1007289
ataaagc

SEQ ID NO: 89017 - DNA, 7 bp, Unknown
  misc_feature (1)..( 7): Result.001 file - promoters60/1007289
ataaagt

SEQ ID NO: 89018 - DNA, 7 bp, Unknown
  misc_feature (1)..( 7): Result.001 file - promoters60/1007289
aaaaaaa

SEQ ID NO: 89019 - DNA, 7 bp, Unknown
  misc_feature (1)..( 7): Result.001 file - promoters60/1007348
aaaaaaa

SEQ ID NO: 89020 - DNA, 7 bp, Unknown
  misc_feature (1)..( 7): Result.001 file - promoters60/1007348
tgtaatt

SEQ ID NO: 89021 - DNA, 7 bp, Unknown
  misc_feature (1)..( 7): Result.001 file - promoters60/1007348
tgttatt

SEQ ID NO: 89022 - DNA, 6 bp, Unknown
  misc_feature (1)..( 6): Result.001 file - promoters60/1007348
gatctt

SEQ ID NO: 89023 - DNA, 6 bp, Unknown
  misc_feature (1)..( 6): Result.001 file - promoters60/1007348
gatctt

SEQ ID NO: 89024 - DNA, 8 bp, Unknown
  misc_feature (1)..( 8): Result.001 file - promoters60/1007348
tatgtttt

SEQ ID NO: 89025 - DNA, 8 bp, Unknown
  misc_feature (1)..( 8): Result.001 file - promoters60/1007348
tatgtttt

SEQ ID NO: 89026 - DNA, 7 bp, Unknown
  misc_feature (1)..( 7): Result.001 file - promoters60/1007348
ttataac

SEQ ID NO: 89027 - DNA, 7 bp, Unknown
  misc_feature (1)..( 7): Result.001 file - promoters60/1007348
ttaaaac

SEQ ID NO: 89028 - DNA, 7 bp, Unknown
  misc_feature (1)..( 7): Result.001 file - promoters60/1007348
attgttt

SEQ ID NO: 89029 - DNA, 7 bp, Unknown
  misc_feature (1)..( 7): Result.001 file - promoters60/1007348
attgttt

SEQ ID NO: 89030 - DNA, 7 bp, Unknown
  misc_feature (1)..( 7): Result.001 file - promoters60/1007348
atccaca

SEQ ID NO: 89031 - DNA, 7 bp, Unknown
  misc_feature (1)..( 7): Result.001 file - promoters60/1007348
atccaca

SEQ ID NO: 89032 - DNA, 8 bp, Unknown
  misc_feature (1)..( 8): Result.001 file - promoters60/1007348
tatttttc

SEQ ID NO: 89033 - DNA, 8 bp, Unknown
  misc_feature (1)..( 8): Result.001 file - promoters60/1007348
tatttttc

SEQ ID NO: 89034 - DNA, 8 bp, Unknown
  misc_feature (1)..( 8): Result.001 file - promoters60/1007348
atatttaa

SEQ ID NO: 89035 - DNA, 8 bp, Unknown
  misc_feature (1)..( 8): Result.001 file - promoters60/1007348
atatgtaa

SEQ ID NO: 89036 - DNA, 6 bp, Unknown
  misc_feature (1)..( 6): Result.001 file - promoters60/1007348
gtttaa

SEQ ID NO: 89037 - DNA, 6 bp, Unknown
  misc_feature (1)..( 6): Result.001 file - promoters60/1007348
gtttaa

SEQ ID NO: 89038 - DNA, 7 bp, Unknown
  misc_feature (1)..( 7): Result.001 file - promoters60/1007348
ctctttt

SEQ ID NO: 89039 - DNA, 7 bp, Unknown
  misc_feature (1)..( 7): Result.001 file - promoters60/1007348
ctctttt

SEQ ID NO: 89040 - DNA, 8 bp, Unknown
  misc_feature (1)..( 8): Result.001 file - promoters60/1007348
ataacatc

SEQ ID NO: 89041 - DNA, 8 bp, Unknown
  misc_feature (1)..( 8): Result.001 file - promoters60/1007348
atatcatc

SEQ ID NO: 89042 - DNA, 8 bp, Unknown
  misc_feature (1)..( 8): Result.001 file - promoters60/1007348
cacataga

SEQ ID NO: 89043 - DNA, 8 bp, Unknown
  misc_feature (1)..( 8): Result.001 file - promoters60/1007348
cacaaaga

SEQ ID NO: 89044 - DNA, 11 bp, Unknown
  misc_feature (1)..( 11): Result.001 file - promoters60/1007348
accaataagaa

SEQ ID NO: 89045 - DNA, 11 bp, Unknown
  misc_feature (1)..( 11): Result.001 file - promoters60/1007348
accaatcagaa

SEQ ID NO: 89046 - DNA, 8 bp, Unknown
  misc_feature (1)..( 8): Result.001 file - promoters60/1007348
aaaataag

SEQ ID NO: 89047 - DNA, 8 bp, Unknown
  misc_feature (1)..( 8): Result.001 file - promoters60/1007348
aaactaag

SEQ ID NO: 89048 - DNA, 8 bp, Unknown
  misc_feature (1)..( 8): Result.001 file - promoters60/1007348
taagttgt

SEQ ID NO: 89049 - DNA, 8 bp, Unknown
  misc_feature (1)..( 8): Result.001 file - promoters60/1007348
taaattgt

SEQ ID NO: 89050 - DNA, 6 bp, Unknown
  misc_feature (1)..( 6): Result.001 file - promoters60/1007348
atagat

SEQ ID NO: 89051 - DNA, 6 bp, Unknown
  misc_feature (1)..( 6): Result.001 file - promoters60/1007348
atagat

SEQ ID NO: 89052 - DNA, 7 bp, Unknown
  misc_feature (1)..( 7): Result.001 file - promoters60/1007348
agatata

SEQ ID NO: 89053 - DNA, 7 bp, Unknown
  misc_feature (1)..( 7): Result.001 file - promoters60/1007348
agagata

SEQ ID NO: 89054 - DNA, 6 bp, Unknown
  misc_feature (1)..( 6): Result.001 file - promoters60/1007348
ttttgg

SEQ ID NO: 89055 - DNA, 6 bp, Unknown
  misc_feature (1)..( 6): Result.001 file - promoters60/1007348
ttttgg

SEQ ID NO: 89056 - DNA, 6 bp, Unknown
  misc_feature (1)..( 6): Result.001 file - promoters60/1007348
taagat

SEQ ID NO: 89057 - DNA, 6 bp, Unknown
  misc_feature (1)..( 6): Result.001 file - promoters60/1007348
taagat

SEQ ID NO: 89058 - DNA, 6 bp, Unknown
  misc_feature (1)..( 6): Result.001 file - promoters60/1007348
aaagaa

SEQ ID NO: 89059 - DNA, 6 bp, Unknown
  misc_feature (1)..( 6): Result.001 file - promoters60/1007348
aaagaa

SEQ ID NO: 89060 - DNA, 12 bp, Unknown
  misc_feature (1)..( 12): Result.001 file - promoters60/1007348
aaaaacaaaaca

SEQ ID NO: 89061 - DNA, 12 bp, Unknown
  misc_feature (1)..( 12): Result.001 file - promoters60/1007348
aaacacaataca

SEQ ID NO: 89062 - DNA, 6 bp, Unknown
  misc_feature (1)..( 6): Result.001 file - promoters60/1007348
aaaaat

SEQ ID NO: 89063 - DNA, 6 bp, Unknown
  misc_feature (1)..( 6): Result.001 file - promoters60/1007348
aaaaat

SEQ ID NO: 89064 - DNA, 6 bp, Unknown
  misc_feature (1)..( 6): Result.001 file - promoters60/1007348
taaccc

SEQ ID NO: 89065 - DNA, 6 bp, Unknown
  misc_feature (1)..( 6): Result.001 file - promoters60/1007370
taaccc

SEQ ID NO: 89066 - DNA, 13 bp, Unknown
  misc_feature (1)..( 13): Result.001 file - promoters60/1007370
caacaatgtacaa

SEQ ID NO: 89067 - DNA, 13 bp, Unknown
  misc_feature (1)..( 13): Result.001 file - promoters60/1007370
caataatttacat

SEQ ID NO: 89068 - DNA, 13 bp, Unknown
  misc_feature (1)..( 13): Result.001 file - promoters60/1007370
ttacaatttacaa

SEQ ID NO: 89069 - DNA, 13 bp, Unknown
  misc_feature (1)..( 13): Result.001 file - promoters60/1007370
gaataataaaatg

SEQ ID NO: 89070 - DNA, 13 bp, Unknown
  misc_feature (1)..( 13): Result.001 file - promoters60/1007370
attttattaaaat

SEQ ID NO: 89071 - DNA, 13 bp, Unknown
  misc_feature (1)..( 13): Result.001 file - promoters60/1007370
gtataatttaatg

SEQ ID NO: 89072 - DNA, 11 bp, Unknown
  misc_feature (1)..( 11): Result.001 file - promoters60/1007370
aatttatctca

SEQ ID NO: 89073 - DNA, 11 bp, Unknown
  misc_feature (1)..( 11): Result.001 file - promoters60/1007370
attttttcttt

SEQ ID NO: 89074 - DNA, 11 bp, Unknown
  misc_feature (1)..( 11): Result.001 file - promoters60/1007370
aatttctctac

SEQ ID NO: 89075 - DNA, 11 bp, Unknown
  misc_feature (1)..( 11): Result.001 file - promoters60/1007370
tatttatgaaa

SEQ ID NO: 89076 - DNA, 11 bp, Unknown
  misc_feature (1)..( 11): Result.001 file - promoters60/1007370
tcattttgttt

SEQ ID NO: 89077 - DNA, 11 bp, Unknown
  misc_feature (1)..( 11): Result.001 file - promoters60/1007370
gattttgatgg

SEQ ID NO: 89078 - DNA, 12 bp, Unknown
  misc_feature (1)..( 12): Result.001 file - promoters60/1007370
agaatttttgta

SEQ ID NO: 89079 - DNA, 12 bp, Unknown
  misc_feature (1)..( 12): Result.001 file - promoters60/1007370
tgcatttttatt

SEQ ID NO: 89080 - DNA, 12 bp, Unknown
  misc_feature (1)..( 12): Result.001 file - promoters60/1007370
agaattttctgg

SEQ ID NO: 89081 - DNA, 12 bp, Unknown
  misc_feature (1)..( 12): Result.001 file - promoters60/1007370
atattttatatt

SEQ ID NO: 89082 - DNA, 12 bp, Unknown
  misc_feature (1)..( 12): Result.001 file - promoters60/1007370
actatttgataa

SEQ ID NO: 89083 - DNA, 12 bp, Unknown
  misc_feature (1)..( 12): Result.001 file - promoters60/1007524
tctaattgaaga

SEQ ID NO: 89084 - DNA, 9 bp, Unknown
  misc_feature (1)..( 9): Result.001 file - promoters60/1007524
tcttgtaaa

SEQ ID NO: 89085 - DNA, 9 bp, Unknown
  misc_feature (1)..( 9): Result.001 file - promoters60/1007524
tcttttaac

SEQ ID NO: 89086 - DNA, 10 bp, Unknown
  misc_feature (1)..( 10): Result.001 file - promoters60/1007524
cgatgtgaaa

SEQ ID NO: 89087 - DNA, 10 bp, Unknown
  misc_feature (1)..( 10): Result.001 file - promoters60/1007554
ggggtttaac

SEQ ID NO: 89088 - DNA, 9 bp, Unknown
  misc_feature (1)..( 9): Result.001 file - promoters60/1007554
atttgttag

SEQ ID NO: 89089 - DNA, 9 bp, Unknown
  misc_feature (1)..( 9): Result.001 file - promoters60/1007554
atttgtgta

SEQ ID NO: 89090 - DNA, 9 bp, Unknown
  misc_feature (1)..( 9): Result.001 file - promoters60/1007554
atttatgta

SEQ ID NO: 89091 - DNA, 9 bp, Unknown
  misc_feature (1)..( 9): Result.001 file - promoters60/1007554
atttattta

SEQ ID NO: 89092 - DNA, 8 bp, Unknown
  misc_feature (1)..( 8): Result.001 file - promoters60/1007554
aaaaataa

SEQ ID NO: 89093 - DNA, 8 bp, Unknown
  misc_feature (1)..( 8): Result.001 file - promoters60/1007554
taaagtaa

SEQ ID NO: 89094 - DNA, 8 bp, Unknown
  misc_feature (1)..( 8): Result.001 file - promoters60/1007554
aaaaattg

SEQ ID NO: 89095 - DNA, 8 bp, Unknown
  misc_feature (1)..( 8): Result.001 file - promoters60/1007554
caaaatat

SEQ ID NO: 89096 - DNA, 11 bp, Unknown
  misc_feature (1)..( 11): Result.001 file - promoters60/1007554
tataattttaa

SEQ ID NO: 89097 - DNA, 11 bp, Unknown
  misc_feature (1)..( 11): Result.001 file - promoters60/1007554
tttaattttat

SEQ ID NO: 89098 - DNA, 11 bp, Unknown
  misc_feature (1)..( 11): Result.001 file - promoters60/1007554
tttgattgaat

SEQ ID NO: 89099 - DNA, 11 bp, Unknown
  misc_feature (1)..( 11): Result.001 file - promoters60/1007576
tggctttttat

SEQ ID NO: 89100 - DNA, 7 bp, Unknown
  misc_feature (1)..( 7): Result.001 file - promoters60/1007576
aaacaaa

SEQ ID NO: 89101 - DNA, 7 bp, Unknown
  misc_feature (1)..( 7): Result.001 file - promoters60/1007576
aaagaaa

SEQ ID NO: 89102 - DNA, 10 bp, Unknown
  misc_feature (1)..( 10): Result.001 file - promoters60/1007576
ctggaatatg

SEQ ID NO: 89103 - DNA, 10 bp, Unknown
  misc_feature (1)..( 10): Result.001 file - promoters60/1007576
ctggaaaatg

SEQ ID NO: 89104 - DNA, 10 bp, Unknown
  misc_feature (1)..( 10): Result.001 file - promoters60/1007576
agggaaaagg

SEQ ID NO: 89105 - DNA, 6 bp, Unknown
  misc_feature (1)..( 6): Result.001 file - promoters60/1007576
aatgat

SEQ ID NO: 89106 - DNA, 6 bp, Unknown
  misc_feature (1)..( 6): Result.001 file - promoters60/1007576
aatgat

SEQ ID NO: 89107 - DNA, 8 bp, Unknown
  misc_feature (1)..( 8): Result.001 file - promoters60/1007576
cttctata

SEQ ID NO: 89108 - DNA, 8 bp, Unknown
  misc_feature (1)..( 8): Result.001 file - promoters60/1007576
cttcgata

SEQ ID NO: 89109 - DNA, 7 bp, Unknown
  misc_feature (1)..( 7): Result.001 file - promoters60/1007576
tcaggaa

SEQ ID NO: 89110 - DNA, 7 bp, Unknown
  misc_feature (1)..( 7): Result.001 file - promoters60/1007576
tcaggaa

SEQ ID NO: 89111 - DNA, 6 bp, Unknown
  misc_feature (1)..( 6): Result.001 file - promoters60/1007576
ttttct

SEQ ID NO: 89112 - DNA, 6 bp, Unknown
  misc_feature (1)..( 6): Result.001 file - promoters60/1007576
ttttct

SEQ ID NO: 89113 - DNA, 6 bp, Unknown
  misc_feature (1)..( 6): Result.001 file - promoters60/1007576
tgaaat

SEQ ID NO: 89114 - DNA, 6 bp, Unknown
  misc_feature (1)..( 6): Result.001 file - promoters60/1007576
tgaaat

SEQ ID NO: 89115 - DNA, 8 bp, Unknown
  misc_feature (1)..( 8): Result.001 file - promoters60/1007576
gtttctca

SEQ ID NO: 89116 - DNA, 8 bp, Unknown
  misc_feature (1)..( 8): Result.001 file - promoters60/1007576
gtttctca

SEQ ID NO: 89117 - DNA, 6 bp, Unknown
  misc_feature (1)..( 6): Result.001 file - promoters60/1007576
tatatt

SEQ ID NO: 89118 - DNA, 6 bp, Unknown
  misc_feature (1)..( 6): Result.001 file - promoters60/1007576
tatatt

SEQ ID NO: 89119 - DNA, 6 bp, Unknown
  misc_feature (1)..( 6): Result.001 file - promoters60/1007576
gatggt

SEQ ID NO: 89120 - DNA, 6 bp, Unknown
  misc_feature (1)..( 6): Result.001 file - promoters60/1007576
gatggt

SEQ ID NO: 89121 - DNA, 7 bp, Unknown
  misc_feature (1)..( 7): Result.001 file - promoters60/1007576
tctgttg

SEQ ID NO: 89122 - DNA, 7 bp, Unknown
  misc_feature (1)..( 7): Result.001 file - promoters60/1007576
tctcttg

SEQ ID NO: 89123 - DNA, 7 bp, Unknown
  misc_feature (1)..( 7): Result.001 file - promoters60/1007576
tttactc

SEQ ID NO: 89124 - DNA, 7 bp, Unknown
  misc_feature (1)..( 7): Result.001 file - promoters60/1007576
tttgctc

SEQ ID NO: 89125 - DNA, 7 bp, Unknown
  misc_feature (1)..( 7): Result.001 file - promoters60/1007576
ctgaaac

SEQ ID NO: 89126 - DNA, 7 bp, Unknown
  misc_feature (1)..( 7): Result.001 file - promoters60/1007639
ctgcaac

SEQ ID NO: 89127 - DNA, 10 bp, Unknown
  misc_feature (1)..( 10): Result.001 file - promoters60/1007639
cacaaaacat

SEQ ID NO: 89128 - DNA, 10 bp, Unknown
  misc_feature (1)..( 10): Result.001 file - promoters60/1007639
cacaaagact

SEQ ID NO: 89129 - DNA, 10 bp, Unknown
  misc_feature (1)..( 10): Result.001 file - promoters60/1007639
tacaaaaact

SEQ ID NO: 89130 - DNA, 10 bp, Unknown
  misc_feature (1)..( 10): Result.001 file - promoters60/1007639
tacaaatttg

SEQ ID NO: 89131 - DNA, 10 bp, Unknown
  misc_feature (1)..( 10): Result.001 file - promoters60/1007639
ccgaaaacta

SEQ ID NO: 89132 - DNA, 10 bp, Unknown
  misc_feature (1)..( 10): Result.001 file - promoters60/1007639
actaaaaact

SEQ ID NO: 89133 - DNA, 12 bp, Unknown
  misc_feature (1)..( 12): Result.001 file - promoters60/1007639
tataatatttcc

SEQ ID NO: 89134 - DNA, 12 bp, Unknown
  misc_feature (1)..( 12): Result.001 file - promoters60/1007639
tataatctttta

SEQ ID NO: 89135 - DNA, 12 bp, Unknown
  misc_feature (1)..( 12): Result.001 file - promoters60/1007639
tcgaaattttaa

SEQ ID NO: 89136 - DNA, 12 bp, Unknown
  misc_feature (1)..( 12): Result.001 file - promoters60/1007639
atgggtcttttt

SEQ ID NO: 89137 - DNA, 11 bp, Unknown
  misc_feature (1)..( 11): Result.001 file - promoters60/1007639
ccgaagtttct

SEQ ID NO: 89138 - DNA, 9 bp, Unknown
  misc_feature (1)..( 9): Result.001 file - promoters60/1007639
taaatttct

SEQ ID NO: 89139 - DNA, 16 bp, Unknown
  misc_feature (1)..( 16): Result.001 file - promoters60/1007639
tagaagaaagaaacct

SEQ ID NO: 89140 - DNA, 16 bp, Unknown
  misc_feature (1)..( 16): Result.001 file - promoters60/1007639
tagaagaaaaaaattt

SEQ ID NO: 89141 - DNA, 16 bp, Unknown
  misc_feature (1)..( 16): Result.001 file - promoters60/1007639
aatacaaaacaaaata

SEQ ID NO: 89142 - DNA, 16 bp, Unknown
  misc_feature (1)..( 16): Result.001 file - promoters60/1007639
tgacaaaaacaaattt

SEQ ID NO: 89143 - DNA, 16 bp, Unknown
  misc_feature (1)..( 16): Result.001 file - promoters60/1007639
tgacaaaaacaaattt

SEQ ID NO: 89144 - DNA, 16 bp, Unknown
  misc_feature (1)..( 16): Result.001 file - promoters60/1007639
caaattaaacaagtaa

SEQ ID NO: 89145 - DNA, 17 bp, Unknown
  misc_feature (1)..( 17): Result.001 file - promoters60/1007639
ttgatcaaatcaaatct

SEQ ID NO: 89146 - DNA, 9 bp, Unknown
  misc_feature (1)..( 9): Result.001 file - promoters60/1007639
atacattca

SEQ ID NO: 89147 - DNA, 9 bp, Unknown
  misc_feature (1)..( 9): Result.001 file - promoters60/1007639
ataaattta

SEQ ID NO: 89148 - DNA, 9 bp, Unknown
  misc_feature (1)..( 9): Result.001 file - promoters60/1007639
gaaaattta

SEQ ID NO: 89149 - DNA, 9 bp, Unknown
  misc_feature (1)..( 9): Result.001 file - promoters60/1007639
acaaatttg

SEQ ID NO: 89150 - DNA, 9 bp, Unknown
  misc_feature (1)..( 9): Result.001 file - promoters60/1007639
aaaaacttg

SEQ ID NO: 89151 - DNA, 9 bp, Unknown
  misc_feature (1)..( 9): Result.001 file - promoters60/1007639
gaaaactac

SEQ ID NO: 89152 - DNA, 9 bp, Unknown
  misc_feature (1)..( 9): Result.001 file - promoters60/1007639
aaaaactct

SEQ ID NO: 89153 - DNA, 9 bp, Unknown
  misc_feature (1)..( 9): Result.001 file - promoters60/1007639
ataacttta

SEQ ID NO: 89154 - DNA, 10 bp, Unknown
  misc_feature (1)..( 10): Result.001 file - promoters60/1007639
gaaaatttat

SEQ ID NO: 89155 - DNA, 10 bp, Unknown
  misc_feature (1)..( 10): Result.001 file - promoters60/1007639
acaaatttgt

SEQ ID NO: 89156 - DNA, 10 bp, Unknown
  misc_feature (1)..( 10): Result.001 file - promoters60/1007639
ataaatttag

SEQ ID NO: 89157 - DNA, 10 bp, Unknown
  misc_feature (1)..( 10): Result.001 file - promoters60/1007639
aaaaacttgg

SEQ ID NO: 89158 - DNA, 10 bp, Unknown
  misc_feature (1)..( 10): Result.001 file - promoters60/1007639
gaaaactact

SEQ ID NO: 89159 - DNA, 10 bp, Unknown
  misc_feature (1)..( 10): Result.001 file - promoters60/1007639
aaaaactcta

SEQ ID NO: 89160 - DNA, 10 bp, Unknown
  misc_feature (1)..( 10): Result.001 file - promoters60/1007639
aataacttta

SEQ ID NO: 89161 - DNA, 12 bp, Unknown
  misc_feature (1)..( 12): Result.001 file - promoters60/1007639
gttttctgtttg

SEQ ID NO: 89162 - DNA, 12 bp, Unknown
  misc_feature (1)..( 12): Result.001 file - promoters60/1007639
aatttttgtaga

SEQ ID NO: 89163 - DNA, 12 bp, Unknown
  misc_feature (1)..( 12): Result.001 file - promoters60/1007639
tttttctatcca

SEQ ID NO: 89164 - DNA, 12 bp, Unknown
  misc_feature (1)..( 12): Result.001 file - promoters60/1007639
tctttttacatt

SEQ ID NO: 89165 - DNA, 12 bp, Unknown
  misc_feature (1)..( 12): Result.001 file - promoters60/1007639
tgtttatataaa

SEQ ID NO: 89166 - DNA, 12 bp, Unknown
  misc_feature (1)..( 12): Result.001 file - promoters60/1007639
tggttatatagt

SEQ ID NO: 89167 - DNA, 12 bp, Unknown
  misc_feature (1)..( 12): Result.001 file - promoters60/1007675
atattacatagt

SEQ ID NO: 89168 - DNA, 8 bp, Unknown
  misc_feature (1)..( 8): Result.001 file - promoters60/1007675
ctataaag

SEQ ID NO: 89169 - DNA, 8 bp, Unknown
  misc_feature (1)..( 8): Result.001 file - promoters60/1007675
ctagaaag

SEQ ID NO: 89170 - DNA, 6 bp, Unknown
  misc_feature (1)..( 6): Result.001 file - promoters60/1007675
gagata

SEQ ID NO: 89171 - DNA, 6 bp, Unknown
  misc_feature (1)..( 6): Result.001 file - promoters60/1007675
gagata

SEQ ID NO: 89172 - DNA, 6 bp, Unknown
  misc_feature (1)..( 6): Result.001 file - promoters60/1007675
caagac

SEQ ID NO: 89173 - DNA, 6 bp, Unknown
  misc_feature (1)..( 6): Result.001 file - promoters60/1007675
caagac

SEQ ID NO: 89174 - DNA, 7 bp, Unknown
  misc_feature (1)..( 7): Result.001 file - promoters60/1007675
taatatt

SEQ ID NO: 89175 - DNA, 7 bp, Unknown
  misc_feature (1)..( 7): Result.001 file - promoters60/1007675
taatatt

SEQ ID NO: 89176 - DNA, 7 bp, Unknown
  misc_feature (1)..( 7): Result.001 file - promoters60/1007675
aaaggga

SEQ ID NO: 89177 - DNA, 7 bp, Unknown
  misc_feature (1)..( 7): Result.001 file - promoters60/1007675
aaatgga

SEQ ID NO: 89178 - DNA, 6 bp, Unknown
  misc_feature (1)..( 6): Result.001 file - promoters60/1007675
tacaaa

SEQ ID NO: 89179 - DNA, 6 bp, Unknown
  misc_feature (1)..( 6): Result.001 file - promoters60/1007675
tacaaa

SEQ ID NO: 89180 - DNA, 7 bp, Unknown
  misc_feature (1)..( 7): Result.001 file - promoters60/1007675
aaagaaa

SEQ ID NO: 89181 - DNA, 7 bp, Unknown
  misc_feature (1)..( 7): Result.001 file - promoters60/1007675
aaaaaaa

SEQ ID NO: 89182 - DNA, 8 bp, Unknown
  misc_feature (1)..( 8): Result.001 file - promoters60/1007675
aaatcaac

SEQ ID NO: 89183 - DNA, 8 bp, Unknown
  misc_feature (1)..( 8): Result.001 file - promoters60/1007675
aaatcaac

SEQ ID NO: 89184 - DNA, 6 bp, Unknown
  misc_feature (1)..( 6): Result.001 file - promoters60/1007675
aagtcc

SEQ ID NO: 89185 - DNA, 6 bp, Unknown
  misc_feature (1)..( 6): Result.001 file - promoters60/1007675
aagtcc

SEQ ID NO: 89186 - DNA, 7 bp, Unknown
  misc_feature (1)..( 7): Result.001 file - promoters60/1007675
tcacttg

SEQ ID NO: 89187 - DNA, 7 bp, Unknown
  misc_feature (1)..( 7): Result.001 file - promoters60/1007675
tcaattg

SEQ ID NO: 89188 - DNA, 7 bp, Unknown
  misc_feature (1)..( 7): Result.001 file - promoters60/1007675
tatgatt

SEQ ID NO: 89189 - DNA, 7 bp, Unknown
  misc_feature (1)..( 7): Result.001 file - promoters60/1007675
tattatt

SEQ ID NO: 89190 - DNA, 6 bp, Unknown
  misc_feature (1)..( 6): Result.001 file - promoters60/1007675
atatat

SEQ ID NO: 89191 - DNA, 6 bp, Unknown
  misc_feature (1)..( 6): Result.001 file - promoters60/1007675
atatat

SEQ ID NO: 89192 - DNA, 6 bp, Unknown
  misc_feature (1)..( 6): Result.001 file - promoters60/1007675
gaagac

SEQ ID NO: 89193 - DNA, 6 bp, Unknown
  misc_feature (1)..( 6): Result.001 file - promoters60/1007675
gaagac

SEQ ID NO: 89194 - DNA, 10 bp, Unknown
  misc_feature (1)..( 10): Result.001 file - promoters60/1007675
tattattgaa

SEQ ID NO: 89195 - DNA, 10 bp, Unknown
  misc_feature (1)..( 10): Result.001 file - promoters60/1007675
tattaatgaa

SEQ ID NO: 89196 - DNA, 7 bp, Unknown
  misc_feature (1)..( 7): Result.001 file - promoters60/1007675
tttagaa

SEQ ID NO: 89197 - DNA, 7 bp, Unknown
  misc_feature (1)..( 7): Result.001 file - promoters60/1007675
tttggaa

SEQ ID NO: 89198 - DNA, 6 bp, Unknown
  misc_feature (1)..( 6): Result.001 file - promoters60/1007675
aaataa

SEQ ID NO: 89199 - DNA, 6 bp, Unknown
  misc_feature (1)..( 6): Result.001 file - promoters60/1007675
aaataa

SEQ ID NO: 89200 - DNA, 9 bp, Unknown
  misc_feature (1)..( 9): Result.001 file - promoters60/1007675
tcccaaagt

SEQ ID NO: 89201 - DNA, 9 bp, Unknown
  misc_feature (1)..( 9): Result.001 file - promoters60/1007675
tccaaaagt

SEQ ID NO: 89202 - DNA, 8 bp, Unknown
  misc_feature (1)..( 8): Result.001 file - promoters60/1007675
tccatatg

SEQ ID NO: 89203 - DNA, 8 bp, Unknown
  misc_feature (1)..( 8): Result.001 file - promoters60/1007675
tccaaatg

SEQ ID NO: 89204 - DNA, 7 bp, Unknown
  misc_feature (1)..( 7): Result.001 file - promoters60/1007675
aaagaaa

SEQ ID NO: 89205 - DNA, 7 bp, Unknown
  misc_feature (1)..( 7): Result.001 file - promoters60/1007675
aaataaa

SEQ ID NO: 89206 - DNA, 6 bp, Unknown
  misc_feature (1)..( 6): Result.001 file - promoters60/1007675
ggaaat

SEQ ID NO: 89207 - DNA, 6 bp, Unknown
  misc_feature (1)..( 6): Result.001 file - promoters60/1007675
ggaaat

SEQ ID NO: 89208 - DNA, 7 bp, Unknown
  misc_feature (1)..( 7): Result.001 file - promoters60/1007675
atataaa

SEQ ID NO: 89209 - DNA, 7 bp, Unknown
  misc_feature (1)..( 7): Result.001 file - promoters60/1007731
ataaaaa

SEQ ID NO: 89210 - DNA, 6 bp, Unknown
  misc_feature (1)..( 6): Result.001 file - promoters60/1007731
ttttta

SEQ ID NO: 89211 - DNA, 6 bp, Unknown
  misc_feature (1)..( 6): Result.001 file - promoters60/1007731
ttttta

SEQ ID NO: 89212 - DNA, 6 bp, Unknown
  misc_feature (1)..( 6): Result.001 file - promoters60/1007731
atttac

SEQ ID NO: 89213 - DNA, 6 bp, Unknown
  misc_feature (1)..( 6): Result.001 file - promoters60/1007731
atttac

SEQ ID NO: 89214 - DNA, 6 bp, Unknown
  misc_feature (1)..( 6): Result.001 file - promoters60/1007731
atttac

SEQ ID NO: 89215 - DNA, 6 bp, Unknown
  misc_feature (1)..( 6): Result.001 file - promoters60/1007731
ctgttg

SEQ ID NO: 89216 - DNA, 6 bp, Unknown
  misc_feature (1)..( 6): Result.001 file - promoters60/1007731
ctgttg

SEQ ID NO: 89217 - DNA, 6 bp, Unknown
  misc_feature (1)..( 6): Result.001 file - promoters60/1007731
aaacta

SEQ ID NO: 89218 - DNA, 6 bp, Unknown
  misc_feature (1)..( 6): Result.001 file - promoters60/1007731
aaacta

SEQ ID NO: 89219 - DNA, 7 bp, Unknown
  misc_feature (1)..( 7): Result.001 file - promoters60/1007731
atttgag

SEQ ID NO: 89220 - DNA, 7 bp, Unknown
  misc_feature (1)..( 7): Result.001 file - promoters60/1007731
attcgag

SEQ ID NO: 89221 - DNA, 7 bp, Unknown
  misc_feature (1)..( 7): Result.001 file - promoters60/1007731
tttcctt

SEQ ID NO: 89222 - DNA, 7 bp, Unknown
  misc_feature (1)..( 7): Result.001 file - promoters60/1007731
ttttctt

SEQ ID NO: 89223 - DNA, 6 bp, Unknown
  misc_feature (1)..( 6): Result.001 file - promoters60/1007731
tatttt

SEQ ID NO: 89224 - DNA, 6 bp, Unknown
  misc_feature (1)..( 6): Result.001 file - promoters60/1007731
tatttt

SEQ ID NO: 89225 - DNA, 6 bp, Unknown
  misc_feature (1)..( 6): Result.001 file - promoters60/1007731
ttgaat

SEQ ID NO: 89226 - DNA, 6 bp, Unknown
  misc_feature (1)..( 6): Result.001 file - promoters60/1007731
ttgaat

SEQ ID NO: 89227 - DNA, 6 bp, Unknown
  misc_feature (1)..( 6): Result.001 file - promoters60/1007731
attgaa

SEQ ID NO: 89228 - DNA, 6 bp, Unknown
  misc_feature (1)..( 6): Result.001 file - promoters60/1007731
attgaa

SEQ ID NO: 89229 - DNA, 7 bp, Unknown
  misc_feature (1)..( 7): Result.001 file - promoters60/1007731
tgagatt

SEQ ID NO: 89230 - DNA, 7 bp, Unknown
  misc_feature (1)..( 7): Result.001 file - promoters60/1007731
tgacatt

SEQ ID NO: 89231 - DNA, 10 bp, Unknown
  misc_feature (1)..( 10): Result.001 file - promoters60/1007731
aaattagttg

SEQ ID NO: 89232 - DNA, 10 bp, Unknown
  misc_feature (1)..( 10): Result.001 file - promoters60/1007731
aaattacttg

SEQ ID NO: 89233 - DNA, 7 bp, Unknown
  misc_feature (1)..( 7): Result.001 file - promoters60/1007731
atgtgac

SEQ ID NO: 89234 - DNA, 7 bp, Unknown
  misc_feature (1)..( 7): Result.001 file - promoters60/1007731
atgtgac

SEQ ID NO: 89235 - DNA, 9 bp, Unknown
  misc_feature (1)..( 9): Result.001 file - promoters60/1007731
tgactccat

SEQ ID NO: 89236 - DNA, 9 bp, Unknown
  misc_feature (1)..( 9): Result.001 file - promoters60/1007731
tgacttcat

SEQ ID NO: 89237 - DNA, 7 bp, Unknown
  misc_feature (1)..( 7): Result.001 file - promoters60/1007731
acgttta

SEQ ID NO: 89238 - DNA, 7 bp, Unknown
  misc_feature (1)..( 7): Result.001 file - promoters60/1007731
acgatta

SEQ ID NO: 89239 - DNA, 8 bp, Unknown
  misc_feature (1)..( 8): Result.001 file - promoters60/1007731
agaaaatt

SEQ ID NO: 89240 - DNA, 8 bp, Unknown
  misc_feature (1)..( 8): Result.001 file - promoters60/1007731
agaatatt

SEQ ID NO: 89241 - DNA, 6 bp, Unknown
  misc_feature (1)..( 6): Result.001 file - promoters60/1007731
aaaatt

SEQ ID NO: 89242 - DNA, 6 bp, Unknown
  misc_feature (1)..( 6): Result.001 file - promoters60/1007731
aaaatt

SEQ ID NO: 89243 - DNA, 7 bp, Unknown
  misc_feature (1)..( 7): Result.001 file - promoters60/1007731
caaaatg

SEQ ID NO: 89244 - DNA, 7 bp, Unknown
  misc_feature (1)..( 7): Result.001 file - promoters60/1007731
caacatg

SEQ ID NO: 89245 - DNA, 6 bp, Unknown
  misc_feature (1)..( 6): Result.001 file - promoters60/1007731
gtttac

SEQ ID NO: 89246 - DNA, 6 bp, Unknown
  misc_feature (1)..( 6): Result.001 file - promoters60/1007731
gtttac

SEQ ID NO: 89247 - DNA, 6 bp, Unknown
  misc_feature (1)..( 6): Result.001 file - promoters60/1007731
ccaaat

SEQ ID NO: 89248 - DNA, 6 bp, Unknown
  misc_feature (1)..( 6): Result.001 file - promoters60/1007756
ccaaat

SEQ ID NO: 89249 - DNA, 7 bp, Unknown
  misc_feature (1)..( 7): Result.001 file - promoters60/1007756
cttctag

SEQ ID NO: 89250 - DNA, 7 bp, Unknown
  misc_feature (1)..( 7): Result.001 file - promoters60/1007756
cttgtag

SEQ ID NO: 89251 - DNA, 6 bp, Unknown
  misc_feature (1)..( 6): Result.001 file - promoters60/1007756
attcac

SEQ ID NO: 89252 - DNA, 6 bp, Unknown
  misc_feature (1)..( 6): Result.001 file - promoters60/1007756
attcac

SEQ ID NO: 89253 - DNA, 8 bp, Unknown
  misc_feature (1)..( 8): Result.001 file - promoters60/1007756
tcacgtta

SEQ ID NO: 89254 - DNA, 8 bp, Unknown
  misc_feature (1)..( 8): Result.001 file - promoters60/1007756
tcacatta

SEQ ID NO: 89255 - DNA, 13 bp, Unknown
  misc_feature (1)..( 13): Result.001 file - promoters60/1007756
aaccggttaaatc

SEQ ID NO: 89256 - DNA, 13 bp, Unknown
  misc_feature (1)..( 13): Result.001 file - promoters60/1007756
aacctgtttgttg

SEQ ID NO: 89257 - DNA, 13 bp, Unknown
  misc_feature (1)..( 13): Result.001 file - promoters60/1007756
actctgtttcttg

SEQ ID NO: 89258 - DNA, 6 bp, Unknown
  misc_feature (1)..( 6): Result.001 file - promoters60/1007756
tattta

SEQ ID NO: 89259 - DNA, 6 bp, Unknown
  misc_feature (1)..( 6): Result.001 file - promoters60/1007756
tattta

SEQ ID NO: 89260 - DNA, 9 bp, Unknown
  misc_feature (1)..( 9): Result.001 file - promoters60/1007756
cggtttata

SEQ ID NO: 89261 - DNA, 9 bp, Unknown
  misc_feature (1)..( 9): Result.001 file - promoters60/1007756
cggtttata

SEQ ID NO: 89262 - DNA, 6 bp, Unknown
  misc_feature (1)..( 6): Result.001 file - promoters60/1007756
gatgat

SEQ ID NO: 89263 - DNA, 6 bp, Unknown
  misc_feature (1)..( 6): Result.001 file - promoters60/1007756
gatgat

SEQ ID NO: 89264 - DNA, 6 bp, Unknown
  misc_feature (1)..( 6): Result.001 file - promoters60/1007756
acccgg

SEQ ID NO: 89265 - DNA, 6 bp, Unknown
  misc_feature (1)..( 6): Result.001 file - promoters60/1007756
acccgg

SEQ ID NO: 89266 - DNA, 8 bp, Unknown
  misc_feature (1)..( 8): Result.001 file - promoters60/1007756
aatggtaa

SEQ ID NO: 89267 - DNA, 8 bp, Unknown
  misc_feature (1)..( 8): Result.001 file - promoters60/1007756
aatagtaa

SEQ ID NO: 89268 - DNA, 9 bp, Unknown
  misc_feature (1)..( 9): Result.001 file - promoters60/1007756
attctgaaa

SEQ ID NO: 89269 - DNA, 9 bp, Unknown
  misc_feature (1)..( 9): Result.001 file - promoters60/1007759
attttgaaa

SEQ ID NO: 89270 - DNA, 12 bp, Unknown
  misc_feature (1)..( 12): Result.001 file - promoters60/1007759
aaactacgtcaa

SEQ ID NO: 89271 - DNA, 12 bp, Unknown
  misc_feature (1)..( 12): Result.001 file - promoters60/1007759
aaactacacata

SEQ ID NO: 89272 - DNA, 12 bp, Unknown
  misc_feature (1)..( 12): Result.001 file - promoters60/1007759
aaattactctta

SEQ ID NO: 89273 - DNA, 12 bp, Unknown
  misc_feature (1)..( 12): Result.001 file - promoters60/1007759
aaacaacatata

SEQ ID NO: 89274 - DNA, 12 bp, Unknown
  misc_feature (1)..( 12): Result.001 file - promoters60/1007759
aaacaaatcaaa

SEQ ID NO: 89275 - DNA, 12 bp, Unknown
  misc_feature (1)..( 12): Result.001 file - promoters60/1007759
aaaaaaagttat

SEQ ID NO: 89276 - DNA, 12 bp, Unknown
  misc_feature (1)..( 12): Result.001 file - promoters60/1007795
agataaagaagt

SEQ ID NO: 89277 - DNA, 10 bp, Unknown
  misc_feature (1)..( 10): Result.001 file - promoters60/1007795
actatttaaa

SEQ ID NO: 89278 - DNA, 10 bp, Unknown
  misc_feature (1)..( 10): Result.001 file - promoters60/1007795
actttttttt

SEQ ID NO: 89279 - DNA, 10 bp, Unknown
  misc_feature (1)..( 10): Result.001 file - promoters60/1007795
catatataaa

SEQ ID NO: 89280 - DNA, 10 bp, Unknown
  misc_feature (1)..( 10): Result.001 file - promoters60/1007795
tctttttgtt

SEQ ID NO: 89281 - DNA, 10 bp, Unknown
  misc_feature (1)..( 10): Result.001 file - promoters60/1007795
catttttttc

SEQ ID NO: 89282 - DNA, 15 bp, Unknown
  misc_feature (1)..( 15): Result.001 file - promoters60/1007795
aatttatattgattt

SEQ ID NO: 89283 - DNA, 15 bp, Unknown
  misc_feature (1)..( 15): Result.001 file - promoters60/1007795
gttttgtattatcaa

SEQ ID NO: 89284 - DNA, 15 bp, Unknown
  misc_feature (1)..( 15): Result.001 file - promoters60/1007795
atactatatttattt

SEQ ID NO: 89285 - DNA, 16 bp, Unknown
  misc_feature (1)..( 16): Result.001 file - promoters60/1007795
agtttggtatttgatt

SEQ ID NO: 89286 - DNA, 9 bp, Unknown
  misc_feature (1)..( 9): Result.001 file - promoters60/1007795
ttagttttg

SEQ ID NO: 89287 - DNA, 9 bp, Unknown
  misc_feature (1)..( 9): Result.001 file - promoters60/1007795
aaagttttt

SEQ ID NO: 89288 - DNA, 10 bp, Unknown
  misc_feature (1)..( 10): Result.001 file - promoters60/1007795
aacgttgttg

SEQ ID NO: 89289 - DNA, 10 bp, Unknown
  misc_feature (1)..( 10): Result.001 file - promoters60/1007802
aaaatttcag

SEQ ID NO: 89290 - DNA, 9 bp, Unknown
  misc_feature (1)..( 9): Result.001 file - promoters60/1007802
agattttct

SEQ ID NO: 89291 - DNA, 9 bp, Unknown
  misc_feature (1)..( 9): Result.001 file - promoters60/1007802
tcattatct

SEQ ID NO: 89292 - DNA, 9 bp, Unknown
  misc_feature (1)..( 9): Result.001 file - promoters60/1007802
agattttaa

SEQ ID NO: 89293 - DNA, 6 bp, Unknown
  misc_feature (1)..( 6): Result.001 file - promoters60/1007802
aaaaac

SEQ ID NO: 89294 - DNA, 6 bp, Unknown
  misc_feature (1)..( 6): Result.001 file - promoters60/1007802
aaaaac

SEQ ID NO: 89295 - DNA, 6 bp, Unknown
  misc_feature (1)..( 6): Result.001 file - promoters60/1007802
aaaaac

SEQ ID NO: 89296 - DNA, 9 bp, Unknown
  misc_feature (1)..( 9): Result.001 file - promoters60/1007802
tgaaaaagt

SEQ ID NO: 89297 - DNA, 9 bp, Unknown
  misc_feature (1)..( 9): Result.001 file - promoters60/1007802
tgaaaaaaa

SEQ ID NO: 89298 - DNA, 9 bp, Unknown
  misc_feature (1)..( 9): Result.001 file - promoters60/1007802
ttaaaaaaa

SEQ ID NO: 89299 - DNA, 11 bp, Unknown
  misc_feature (1)..( 11): Result.001 file - promoters60/1007802
gtttacttgct

SEQ ID NO: 89300 - DNA, 11 bp, Unknown
  misc_feature (1)..( 11): Result.001 file - promoters60/1007802
atttatttgtg

SEQ ID NO: 89301 - DNA, 11 bp, Unknown
  misc_feature (1)..( 11): Result.001 file - promoters60/1007802
atttattagtg

SEQ ID NO: 89302 - DNA, 8 bp, Unknown
  misc_feature (1)..( 8): Result.001 file - promoters60/1007802
tagtacta

SEQ ID NO: 89303 - DNA, 8 bp, Unknown
  misc_feature (1)..( 8): Result.001 file - promoters60/1007802
atgtacta

SEQ ID NO: 89304 - DNA, 8 bp, Unknown
  misc_feature (1)..( 8): Result.001 file - promoters60/1007802
atgaactc

SEQ ID NO: 89305 - DNA, 9 bp, Unknown
  misc_feature (1)..( 9): Result.001 file - promoters60/1007802
aaaatttgt

SEQ ID NO: 89306 - DNA, 9 bp, Unknown
  misc_feature (1)..( 9): Result.001 file - promoters60/1007802
aaaatgtgt

SEQ ID NO: 89307 - DNA, 9 bp, Unknown
  misc_feature (1)..( 9): Result.001 file - promoters60/1007967
aaaatttga

SEQ ID NO: 89308 - DNA, 6 bp, Unknown
  misc_feature (1)..( 6): Result.001 file - promoters60/1007967
gtttta

SEQ ID NO: 89309 - DNA, 6 bp, Unknown
  misc_feature (1)..( 6): Result.001 file - promoters60/1007967
gtttta

SEQ ID NO: 89310 - DNA, 8 bp, Unknown
  misc_feature (1)..( 8): Result.001 file - promoters60/1007967
attcttaa

SEQ ID NO: 89311 - DNA, 8 bp, Unknown
  misc_feature (1)..( 8): Result.001 file - promoters60/1007967
attgttat

SEQ ID NO: 89312 - DNA, 8 bp, Unknown
  misc_feature (1)..( 8): Result.001 file - promoters60/1007967
gttcataa

SEQ ID NO: 89313 - DNA, 9 bp, Unknown
  misc_feature (1)..( 9): Result.001 file - promoters60/1007967
aatttcaac

SEQ ID NO: 89314 - DNA, 9 bp, Unknown
  misc_feature (1)..( 9): Result.001 file - promoters60/1007967
aatttgaac

SEQ ID NO: 89315 - DNA, 9 bp, Unknown
  misc_feature (1)..( 9): Result.001 file - promoters60/1007967
aatgtgaaa

SEQ ID NO: 89316 - DNA, 6 bp, Unknown
  misc_feature (1)..( 6): Result.001 file - promoters60/1007967
attcat

SEQ ID NO: 89317 - DNA, 6 bp, Unknown
  misc_feature (1)..( 6): Result.001 file - promoters60/1007967
attcat

SEQ ID NO: 89318 - DNA, 6 bp, Unknown
  misc_feature (1)..( 6): Result.001 file - promoters60/1007967
ttttaa

SEQ ID NO: 89319 - DNA, 6 bp, Unknown
  misc_feature (1)..( 6): Result.001 file - promoters60/1007967
ttttaa

SEQ ID NO: 89320 - DNA, 6 bp, Unknown
  misc_feature (1)..( 6): Result.001 file - promoters60/1007967
gtgtaa

SEQ ID NO: 89321 - DNA, 6 bp, Unknown
  misc_feature (1)..( 6): Result.001 file - promoters60/1007967
gtgtaa

SEQ ID NO: 89322 - DNA, 9 bp, Unknown
  misc_feature (1)..( 9): Result.001 file - promoters60/1007967
cataagtgt

SEQ ID NO: 89323 - DNA, 9 bp, Unknown
  misc_feature (1)..( 9): Result.001 file - promoters60/1007967
cataactgt

SEQ ID NO: 89324 - DNA, 7 bp, Unknown
  misc_feature (1)..( 7): Result.001 file - promoters60/1007967
ttattga

SEQ ID NO: 89325 - DNA, 7 bp, Unknown
  misc_feature (1)..( 7): Result.001 file - promoters60/1007967
ttactga

SEQ ID NO: 89326 - DNA, 6 bp, Unknown
  misc_feature (1)..( 6): Result.001 file - promoters60/1007967
aaccaa

SEQ ID NO: 89327 - DNA, 6 bp, Unknown
  misc_feature (1)..( 6): Result.001 file - promoters60/1007967
aaccaa

SEQ ID NO: 89328 - DNA, 6 bp, Unknown
  misc_feature (1)..( 6): Result.001 file - promoters60/1007967
tttcac

SEQ ID NO: 89329 - DNA, 6 bp, Unknown
  misc_feature (1)..( 6): Result.001 file - promoters60/1007967
tttcac

SEQ ID NO: 89330 - DNA, 6 bp, Unknown
  misc_feature (1)..( 6): Result.001 file - promoters60/1007967
aaactc

SEQ ID NO: 89331 - DNA, 6 bp, Unknown
  misc_feature (1)..( 6): Result.001 file - promoters60/1007967
aaactc

SEQ ID NO: 89332 - DNA, 8 bp, Unknown
  misc_feature (1)..( 8): Result.001 file - promoters60/1007967
tcatatgt

SEQ ID NO: 89333 - DNA, 8 bp, Unknown
  misc_feature (1)..( 8): Result.001 file - promoters60/1007967
tcatgtgt

SEQ ID NO: 89334 - DNA, 7 bp, Unknown
  misc_feature (1)..( 7): Result.001 file - promoters60/1007967
aaacaga

SEQ ID NO: 89335 - DNA, 7 bp, Unknown
  misc_feature (1)..( 7): Result.001 file - promoters60/1007967
aaacaga

SEQ ID NO: 89336 - DNA, 9 bp, Unknown
  misc_feature (1)..( 9): Result.001 file - promoters60/1007967
ataacataa

SEQ ID NO: 89337 - DNA, 9 bp, Unknown
  misc_feature (1)..( 9): Result.001 file - promoters60/1007967
ataaaataa

SEQ ID NO: 89338 - DNA, 9 bp, Unknown
  misc_feature (1)..( 9): Result.001 file - promoters60/1007967
ttatccaac

SEQ ID NO: 89339 - DNA, 9 bp, Unknown
  misc_feature (1)..( 9): Result.001 file - promoters60/1008070
ttatccaac

SEQ ID NO: 89340 - DNA, 9 bp, Unknown
  misc_feature (1)..( 9): Result.001 file - promoters60/1008070
caacaaagt

SEQ ID NO: 89341 - DNA, 9 bp, Unknown
  misc_feature (1)..( 9): Result.001 file - promoters60/1008070
aaacaaacg

SEQ ID NO: 89342 - DNA, 9 bp, Unknown
  misc_feature (1)..( 9): Result.001 file - promoters60/1008070
gaaaaaaaa

SEQ ID NO: 89343 - DNA, 9 bp, Unknown
  misc_feature (1)..( 9): Result.001 file - promoters60/1008070
taaaaaaag

SEQ ID NO: 89344 - DNA, 9 bp, Unknown
  misc_feature (1)..( 9): Result.001 file - promoters60/1008070
aaacaaatg

SEQ ID NO: 89345 - DNA, 9 bp, Unknown
  misc_feature (1)..( 9): Result.001 file - promoters60/1008070
taaaaaata

SEQ ID NO: 89346 - DNA, 11 bp, Unknown
  misc_feature (1)..( 11): Result.001 file - promoters60/1008070
ccactatataa

SEQ ID NO: 89347 - DNA, 11 bp, Unknown
  misc_feature (1)..( 11): Result.001 file - promoters60/1008070
ccattatatat

SEQ ID NO: 89348 - DNA, 11 bp, Unknown
  misc_feature (1)..( 11): Result.001 file - promoters60/1008070
cttttatatat

SEQ ID NO: 89349 - DNA, 11 bp, Unknown
  misc_feature (1)..( 11): Result.001 file - promoters60/1008070
cgcctatatat

SEQ ID NO: 89350 - DNA, 11 bp, Unknown
  misc_feature (1)..( 11): Result.001 file - promoters60/1008070
gtgagatataa

SEQ ID NO: 89351 - DNA, 11 bp, Unknown
  misc_feature (1)..( 11): Result.001 file - promoters60/1008070
tccctataaat

SEQ ID NO: 89352 - DNA, 9 bp, Unknown
  misc_feature (1)..( 9): Result.001 file - promoters60/1008070
ggaataaga

SEQ ID NO: 89353 - DNA, 9 bp, Unknown
  misc_feature (1)..( 9): Result.001 file - promoters60/1008070
gcaataaga

SEQ ID NO: 89354 - DNA, 9 bp, Unknown
  misc_feature (1)..( 9): Result.001 file - promoters60/1008070
gcaaaaagt

SEQ ID NO: 89355 - DNA, 9 bp, Unknown
  misc_feature (1)..( 9): Result.001 file - promoters60/1008070
ttaaaaaag

SEQ ID NO: 89356 - DNA, 9 bp, Unknown
  misc_feature (1)..( 9): Result.001 file - promoters60/1008070
ttaaaataa

SEQ ID NO: 89357 - DNA, 9 bp, Unknown
  misc_feature (1)..( 9): Result.001 file - promoters60/1008070
ttaaaataa

SEQ ID NO: 89358 - DNA, 10 bp, Unknown
  misc_feature (1)..( 10): Result.001 file - promoters60/1008070
tgtttgattg

SEQ ID NO: 89359 - DNA, 10 bp, Unknown
  misc_feature (1)..( 10): Result.001 file - promoters60/1008070
tatttcattt

SEQ ID NO: 89360 - DNA, 10 bp, Unknown
  misc_feature (1)..( 10): Result.001 file - promoters60/1008070
atttttattc

SEQ ID NO: 89361 - DNA, 10 bp, Unknown
  misc_feature (1)..( 10): Result.001 file - promoters60/1008070
agatttattt

SEQ ID NO: 89362 - DNA, 10 bp, Unknown
  misc_feature (1)..( 10): Result.001 file - promoters60/1008070
atttttacca

SEQ ID NO: 89363 - DNA, 10 bp, Unknown
  misc_feature (1)..( 10): Result.001 file - promoters60/1008148
tagtatatca

SEQ ID NO: 89364 - DNA, 19 bp, Unknown
  misc_feature (1)..( 19): Result.001 file - promoters60/1008148
tacatttatctctcaaaga

SEQ ID NO: 89365 - DNA, 19 bp, Unknown
  misc_feature (1)..( 19): Result.001 file - promoters60/1008148
aaatgaattctttcaaaat

SEQ ID NO: 89366 - DNA, 19 bp, Unknown
  misc_feature (1)..( 19): Result.001 file - promoters60/1008148
caaaccaaactctcattcc

SEQ ID NO: 89367 - DNA, 19 bp, Unknown
  misc_feature (1)..( 19): Result.001 file - promoters60/1008148
aaataaattattttctttt

SEQ ID NO: 89368 - DNA, 19 bp, Unknown
  misc_feature (1)..( 19): Result.001 file - promoters60/1008148
taaaattagcagtcaaata

SEQ ID NO: 89369 - DNA, 19 bp, Unknown
  misc_feature (1)..( 19): Result.001 file - promoters60/1008218
ggtgagaatcattaatcct

SEQ ID NO: 89370 - DNA, 13 bp, Unknown
  misc_feature (1)..( 13): Result.001 file - promoters60/1008218
tgattgaaataaa

SEQ ID NO: 89371 - DNA, 13 bp, Unknown
  misc_feature (1)..( 13): Result.001 file - promoters60/1008218
agattaaaaaaag

SEQ ID NO: 89372 - DNA, 13 bp, Unknown
  misc_feature (1)..( 13): Result.001 file - promoters60/1008218
tgaatgatgttcc

SEQ ID NO: 89373 - DNA, 13 bp, Unknown
  misc_feature (1)..( 13): Result.001 file - promoters60/1008218
gacttaaaatcta

SEQ ID NO: 89374 - DNA, 13 bp, Unknown
  misc_feature (1)..( 13): Result.001 file - promoters60/1008218
atcttaaatgctt

SEQ ID NO: 89375 - DNA, 13 bp, Unknown
  misc_feature (1)..( 13): Result.001 file - promoters60/1008218
gctctaaaatcta

SEQ ID NO: 89376 - DNA, 16 bp, Unknown
  misc_feature (1)..( 16): Result.001 file - promoters60/1008218
ttttggtgagaagatt

SEQ ID NO: 89377 - DNA, 16 bp, Unknown
  misc_feature (1)..( 16): Result.001 file - promoters60/1008218
gacacaagagaagaag

SEQ ID NO: 89378 - DNA, 16 bp, Unknown
  misc_feature (1)..( 16): Result.001 file - promoters60/1008218
tttgggtgagaatcat

SEQ ID NO: 89379 - DNA, 16 bp, Unknown
  misc_feature (1)..( 16): Result.001 file - promoters60/1008218
gaaaagaaagaagaac

SEQ ID NO: 89380 - DNA, 16 bp, Unknown
  misc_feature (1)..( 16): Result.001 file - promoters60/1008218
ccaaattctgaacatt

SEQ ID NO: 89381 - DNA, 16 bp, Unknown
  misc_feature (1)..( 16): Result.001 file - promoters60/1008218
ctcaaaagagaaaggt

SEQ ID NO: 89382 - DNA, 9 bp, Unknown
  misc_feature (1)..( 9): Result.001 file - promoters60/1008218
caaacacaa

SEQ ID NO: 89383 - DNA, 9 bp, Unknown
  misc_feature (1)..( 9): Result.001 file - promoters60/1008218
caaacaaat

SEQ ID NO: 89384 - DNA, 9 bp, Unknown
  misc_feature (1)..( 9): Result.001 file - promoters60/1008218
gaaacacaa

SEQ ID NO: 89385 - DNA, 9 bp, Unknown
  misc_feature (1)..( 9): Result.001 file - promoters60/1008218
caaagaaag

SEQ ID NO: 89386 - DNA, 9 bp, Unknown
  misc_feature (1)..( 9): Result.001 file - promoters60/1008218
aaaagaaag

SEQ ID NO: 89387 - DNA, 9 bp, Unknown
  misc_feature (1)..( 9): Result.001 file - promoters60/1008319
caaggaaag

SEQ ID NO: 89388 - DNA, 9 bp, Unknown
  misc_feature (1)..( 9): Result.001 file - promoters60/1008319
ggacaaggc

SEQ ID NO: 89389 - DNA, 9 bp, Unknown
  misc_feature (1)..( 9): Result.001 file - promoters60/1008319
ggacaacag

SEQ ID NO: 89390 - DNA, 9 bp, Unknown
  misc_feature (1)..( 9): Result.001 file - promoters60/1008319
agacaagta

SEQ ID NO: 89391 - DNA, 9 bp, Unknown
  misc_feature (1)..( 9): Result.001 file - promoters60/1008319
tgaaaacaa

SEQ ID NO: 89392 - DNA, 14 bp, Unknown
  misc_feature (1)..( 14): Result.001 file - promoters60/1008319
tttattttaacaga

SEQ ID NO: 89393 - DNA, 14 bp, Unknown
  misc_feature (1)..( 14): Result.001 file - promoters60/1008319
tttcttttccggtt

SEQ ID NO: 89394 - DNA, 14 bp, Unknown
  misc_feature (1)..( 14): Result.001 file - promoters60/1008319
tctattttaagcaa

SEQ ID NO: 89395 - DNA, 14 bp, Unknown
  misc_feature (1)..( 14): Result.001 file - promoters60/1008319
tttctttcttctcc

SEQ ID NO: 89396 - DNA, 15 bp, Unknown
  misc_feature (1)..( 15): Result.001 file - promoters60/1008319
gatcttctttctctc

SEQ ID NO: 89397 - DNA, 10 bp, Unknown
  misc_feature (1)..( 10): Result.001 file - promoters60/1008319
aaaaacatta

SEQ ID NO: 89398 - DNA, 10 bp, Unknown
  misc_feature (1)..( 10): Result.001 file - promoters60/1008319
aaagacaaag

SEQ ID NO: 89399 - DNA, 10 bp, Unknown
  misc_feature (1)..( 10): Result.001 file - promoters60/1008319
aaaaaccgtt

SEQ ID NO: 89400 - DNA, 10 bp, Unknown
  misc_feature (1)..( 10): Result.001 file - promoters60/1008319
aagaacaaat

SEQ ID NO: 89401 - DNA, 10 bp, Unknown
  misc_feature (1)..( 10): Result.001 file - promoters60/1008319
gaagacgaag

SEQ ID NO: 89402 - DNA, 8 bp, Unknown
  misc_feature (1)..( 8): Result.001 file - promoters60/1008319
tttttatt

SEQ ID NO: 89403 - DNA, 8 bp, Unknown
  misc_feature (1)..( 8): Result.001 file - promoters60/1008319
tttatatt

SEQ ID NO: 89404 - DNA, 8 bp, Unknown
  misc_feature (1)..( 8): Result.001 file - promoters60/1008319
attacttt

SEQ ID NO: 89405 - DNA, 8 bp, Unknown
  misc_feature (1)..( 8): Result.001 file - promoters60/1008324
cttaaatt

SEQ ID NO: 89406 - DNA, 11 bp, Unknown
  misc_feature (1)..( 11): Result.001 file - promoters60/1008324
gatatgttcgc

SEQ ID NO: 89407 - DNA, 11 bp, Unknown
  misc_feature (1)..( 11): Result.001 file - promoters60/1008324
gatatgttttg

SEQ ID NO: 89408 - DNA, 12 bp, Unknown
  misc_feature (1)..( 12): Result.001 file - promoters60/1008324
tctatgctttgg

SEQ ID NO: 89409 - DNA, 11 bp, Unknown
  misc_feature (1)..( 11): Result.001 file - promoters60/1008324
gagcattggtc

SEQ ID NO: 89410 - DNA, 11 bp, Unknown
  misc_feature (1)..( 11): Result.001 file - promoters60/1008324
gataatttgtc

SEQ ID NO: 89411 - DNA, 11 bp, Unknown
  misc_feature (1)..( 11): Result.001 file - promoters60/1008324
gatgatttgag

SEQ ID NO: 89412 - DNA, 9 bp, Unknown
  misc_feature (1)..( 9): Result.001 file - promoters60/1008324
tggctcaac

SEQ ID NO: 89413 - DNA, 9 bp, Unknown
  misc_feature (1)..( 9): Result.001 file - promoters60/1008324
aggcccaat

SEQ ID NO: 89414 - DNA, 9 bp, Unknown
  misc_feature (1)..( 9): Result.001 file - promoters60/1008324
aggcccaat

SEQ ID NO: 89415 - DNA, 10 bp, Unknown
  misc_feature (1)..( 10): Result.001 file - promoters60/1008324
acacgatatt

SEQ ID NO: 89416 - DNA, 10 bp, Unknown
  misc_feature (1)..( 10): Result.001 file - promoters60/1008324
acacggtatt

SEQ ID NO: 89417 - DNA, 10 bp, Unknown
  misc_feature (1)..( 10): Result.001 file - promoters60/1008400
agacggtagt

SEQ ID NO: 89418 - DNA, 8 bp, Unknown
  misc_feature (1)..( 8): Result.001 file - promoters60/1008400
gaaggtga

SEQ ID NO: 89419 - DNA, 8 bp, Unknown
  misc_feature (1)..( 8): Result.001 file - promoters60/1008400
gaacgtga

SEQ ID NO: 89420 - DNA, 7 bp, Unknown
  misc_feature (1)..( 7): Result.001 file - promoters60/1008400
gtaagaa

SEQ ID NO: 89421 - DNA, 7 bp, Unknown
  misc_feature (1)..( 7): Result.001 file - promoters60/1008400
gtacgaa

SEQ ID NO: 89422 - DNA, 8 bp, Unknown
  misc_feature (1)..( 8): Result.001 file - promoters60/1008400
aaaaaaat

SEQ ID NO: 89423 - DNA, 8 bp, Unknown
  misc_feature (1)..( 8): Result.001 file - promoters60/1008400
aaaaaaat

SEQ ID NO: 89424 - DNA, 6 bp, Unknown
  misc_feature (1)..( 6): Result.001 file - promoters60/1008400
ttgatt

SEQ ID NO: 89425 - DNA, 6 bp, Unknown
  misc_feature (1)..( 6): Result.001 file - promoters60/1008400
ttgatt

SEQ ID NO: 89426 - DNA, 6 bp, Unknown
  misc_feature (1)..( 6): Result.001 file - promoters60/1008400
aattgt

SEQ ID NO: 89427 - DNA, 6 bp, Unknown
  misc_feature (1)..( 6): Result.001 file - promoters60/1008400
aattgt

SEQ ID NO: 89428 - DNA, 7 bp, Unknown
  misc_feature (1)..( 7): Result.001 file - promoters60/1008400
ctttgag

SEQ ID NO: 89429 - DNA, 7 bp, Unknown
  misc_feature (1)..( 7): Result.001 file - promoters60/1008400
ctttgag

SEQ ID NO: 89430 - DNA, 7 bp, Unknown
  misc_feature (1)..( 7): Result.001 file - promoters60/1008400
tatcatt

SEQ ID NO: 89431 - DNA, 7 bp, Unknown
  misc_feature (1)..( 7): Result.001 file - promoters60/1008400
tatgatt

SEQ ID NO: 89432 - DNA, 7 bp, Unknown
  misc_feature (1)..( 7): Result.001 file - promoters60/1008400
gaatttg

SEQ ID NO: 89433 - DNA, 7 bp, Unknown
  misc_feature (1)..( 7): Result.001 file - promoters60/1008400
gaatttg

SEQ ID NO: 89434 - DNA, 7 bp, Unknown
  misc_feature (1)..( 7): Result.001 file - promoters60/1008400
tttgatt

SEQ ID NO: 89435 - DNA, 7 bp, Unknown
  misc_feature (1)..( 7): Result.001 file - promoters60/1008400
tttgatt

SEQ ID NO: 89436 - DNA, 7 bp, Unknown
  misc_feature (1)..( 7): Result.001 file - promoters60/1008400
ttagatc

SEQ ID NO: 89437 - DNA, 7 bp, Unknown
  misc_feature (1)..( 7): Result.001 file - promoters60/1008400
ttatatc

SEQ ID NO: 89438 - DNA, 6 bp, Unknown
  misc_feature (1)..( 6): Result.001 file - promoters60/1008400
catttg

SEQ ID NO: 89439 - DNA, 6 bp, Unknown
  misc_feature (1)..( 6): Result.001 file - promoters60/1008425
catttg

SEQ ID NO: 89440 - DNA, 7 bp, Unknown
  misc_feature (1)..( 7): Result.001 file - promoters60/1008425
tttggaa

SEQ ID NO: 89441 - DNA, 7 bp, Unknown
  misc_feature (1)..( 7): Result.001 file - promoters60/1008425
ttttgaa

SEQ ID NO: 89442 - DNA, 6 bp, Unknown
  misc_feature (1)..( 6): Result.001 file - promoters60/1008425
agaaaa

SEQ ID NO: 89443 - DNA, 6 bp, Unknown
  misc_feature (1)..( 6): Result.001 file - promoters60/1008425
agaaaa

SEQ ID NO: 89444 - DNA, 10 bp, Unknown
  misc_feature (1)..( 10): Result.001 file - promoters60/1008425
caaatacatt

SEQ ID NO: 89445 - DNA, 10 bp, Unknown
  misc_feature (1)..( 10): Result.001 file - promoters60/1008425
caaaaacaac

SEQ ID NO: 89446 - DNA, 10 bp, Unknown
  misc_feature (1)..( 10): Result.001 file - promoters60/1008425
taaatacatt

SEQ ID NO: 89447 - DNA, 8 bp, Unknown
  misc_feature (1)..( 8): Result.001 file - promoters60/1008425
tgtaaatt

SEQ ID NO: 89448 - DNA, 8 bp, Unknown
  misc_feature (1)..( 8): Result.001 file - promoters60/1008425
tgtatatt

SEQ ID NO: 89449 - DNA, 7 bp, Unknown
  misc_feature (1)..( 7): Result.001 file - promoters60/1008425
caaataa

SEQ ID NO: 89450 - DNA, 7 bp, Unknown
  misc_feature (1)..( 7): Result.001 file - promoters60/1008425
caaataa

SEQ ID NO: 89451 - DNA, 7 bp, Unknown
  misc_feature (1)..( 7): Result.001 file - promoters60/1008425
ttttttt

SEQ ID NO: 89452 - DNA, 7 bp, Unknown
  misc_feature (1)..( 7): Result.001 file - promoters60/1008425
ttttttt

SEQ ID NO: 89453 - DNA, 6 bp, Unknown
  misc_feature (1)..( 6): Result.001 file - promoters60/1008425
aatatt

SEQ ID NO: 89454 - DNA, 6 bp, Unknown
  misc_feature (1)..( 6): Result.001 file - promoters60/1008425
aatatt

SEQ ID NO: 89455 - DNA, 8 bp, Unknown
  misc_feature (1)..( 8): Result.001 file - promoters60/1008425
cttctgaa

SEQ ID NO: 89456 - DNA, 8 bp, Unknown
  misc_feature (1)..( 8): Result.001 file - promoters60/1008425
cttttgaa

SEQ ID NO: 89457 - DNA, 8 bp, Unknown
  misc_feature (1)..( 8): Result.001 file - promoters60/1008425
attttgag

SEQ ID NO: 89458 - DNA, 6 bp, Unknown
  misc_feature (1)..( 6): Result.001 file - promoters60/1008425
tttttt

SEQ ID NO: 89459 - DNA, 6 bp, Unknown
  misc_feature (1)..( 6): Result.001 file - promoters60/1008425
tttttt

SEQ ID NO: 89460 - DNA, 9 bp, Unknown
  misc_feature (1)..( 9): Result.001 file - promoters60/1008425
aatatatta

SEQ ID NO: 89461 - DNA, 9 bp, Unknown
  misc_feature (1)..( 9): Result.001 file - promoters60/1008425
aatttatta

SEQ ID NO: 89462 - DNA, 8 bp, Unknown
  misc_feature (1)..( 8): Result.001 file - promoters60/1008425
gaaaactt

SEQ ID NO: 89463 - DNA, 8 bp, Unknown
  misc_feature (1)..( 8): Result.001 file - promoters60/1008425
gaatactt

SEQ ID NO: 89464 - DNA, 8 bp, Unknown
  misc_feature (1)..( 8): Result.001 file - promoters60/1008425
acttttat

SEQ ID NO: 89465 - DNA, 8 bp, Unknown
  misc_feature (1)..( 8): Result.001 file - promoters60/1008425
acttttat

SEQ ID NO: 89466 - DNA, 7 bp, Unknown
  misc_feature (1)..( 7): Result.001 file - promoters60/1008425
tttatta

SEQ ID NO: 89467 - DNA, 7 bp, Unknown
  misc_feature (1)..( 7): Result.001 file - promoters60/1008425
tttgtta

SEQ ID NO: 89468 - DNA, 8 bp, Unknown
  misc_feature (1)..( 8): Result.001 file - promoters60/1008425
tttcaatt

SEQ ID NO: 89469 - DNA, 8 bp, Unknown
  misc_feature (1)..( 8): Result.001 file - promoters60/1008425
tttctatt

SEQ ID NO: 89470 - DNA, 7 bp, Unknown
  misc_feature (1)..( 7): Result.001 file - promoters60/1008425
cataaaa

SEQ ID NO: 89471 - DNA, 7 bp, Unknown
  misc_feature (1)..( 7): Result.001 file - promoters60/1008425
cataaaa

SEQ ID NO: 89472 - DNA, 7 bp, Unknown
  misc_feature (1)..( 7): Result.001 file - promoters60/1008425
aaattga

SEQ ID NO: 89473 - DNA, 7 bp, Unknown
  misc_feature (1)..( 7): Result.001 file - promoters60/1008425
aaaatga

SEQ ID NO: 89474 - DNA, 6 bp, Unknown
  misc_feature (1)..( 6): Result.001 file - promoters60/1008425
acttgt

SEQ ID NO: 89475 - DNA, 6 bp, Unknown
  misc_feature (1)..( 6): Result.001 file - promoters60/1008425
acttgt

SEQ ID NO: 89476 - DNA, 7 bp, Unknown
  misc_feature (1)..( 7): Result.001 file - promoters60/1008425
tcacgtt

SEQ ID NO: 89477 - DNA, 7 bp, Unknown
  misc_feature (1)..( 7): Result.001 file - promoters60/1008425
tcaagtt

SEQ ID NO: 89478 - DNA, 6 bp, Unknown
  misc_feature (1)..( 6): Result.001 file - promoters60/1008425
attaaa

SEQ ID NO: 89479 - DNA, 6 bp, Unknown
  misc_feature (1)..( 6): Result.001 file - promoters60/1008425
attaaa

SEQ ID NO: 89480 - DNA, 6 bp, Unknown
  misc_feature (1)..( 6): Result.001 file - promoters60/1008425
tcaaca

SEQ ID NO: 89481 - DNA, 6 bp, Unknown
  misc_feature (1)..( 6): Result.001 file - promoters60/1008425
tcaaca

SEQ ID NO: 89482 - DNA, 9 bp, Unknown
  misc_feature (1)..( 9): Result.001 file - promoters60/1008425
aactattta

SEQ ID NO: 89483 - DNA, 9 bp, Unknown
  misc_feature (1)..( 9): Result.001 file - promoters60/1008432
aaccattta

SEQ ID NO: 89484 - DNA, 6 bp, Unknown
  misc_feature (1)..( 6): Result.001 file - promoters60/1008432
tataat

SEQ ID NO: 89485 - DNA, 6 bp, Unknown
  misc_feature (1)..( 6): Result.001 file - promoters60/1008432
tataat

SEQ ID NO: 89486 - DNA, 6 bp, Unknown
  misc_feature (1)..( 6): Result.001 file - promoters60/1008432
ccacca

SEQ ID NO: 89487 - DNA, 6 bp, Unknown
  misc_feature (1)..( 6): Result.001 file - promoters60/1008432
ccacca

SEQ ID NO: 89488 - DNA, 9 bp, Unknown
  misc_feature (1)..( 9): Result.001 file - promoters60/1008432
gtatatatt

SEQ ID NO: 89489 - DNA, 9 bp, Unknown
  misc_feature (1)..( 9): Result.001 file - promoters60/1008432
gtagatatt

SEQ ID NO: 89490 - DNA, 6 bp, Unknown
  misc_feature (1)..( 6): Result.001 file - promoters60/1008432
aacatt

SEQ ID NO: 89491 - DNA, 6 bp, Unknown
  misc_feature (1)..( 6): Result.001 file - promoters60/1008432
aacatt

SEQ ID NO: 89492 - DNA, 7 bp, Unknown
  misc_feature (1)..( 7): Result.001 file - promoters60/1008432
ttgatga

SEQ ID NO: 89493 - DNA, 7 bp, Unknown
  misc_feature (1)..( 7): Result.001 file - promoters60/1008432
ttgatga

SEQ ID NO: 89494 - DNA, 8 bp, Unknown
  misc_feature (1)..( 8): Result.001 file - promoters60/1008432
ttagtcaa

SEQ ID NO: 89495 - DNA, 8 bp, Unknown
  misc_feature (1)..( 8): Result.001 file - promoters60/1008432
ttaatcaa

SEQ ID NO: 89496 - DNA, 8 bp, Unknown
  misc_feature (1)..( 8): Result.001 file - promoters60/1008432
aaaaggta

SEQ ID NO: 89497 - DNA, 8 bp, Unknown
  misc_feature (1)..( 8): Result.001 file - promoters60/1008432
aaatggtt

SEQ ID NO: 89498 - DNA, 8 bp, Unknown
  misc_feature (1)..( 8): Result.001 file - promoters60/1008432
taattgtt

SEQ ID NO: 89499 - DNA, 7 bp, Unknown
  misc_feature (1)..( 7): Result.001 file - promoters60/1008432
aatctct

SEQ ID NO: 89500 - DNA, 7 bp, Unknown
  misc_feature (1)..( 7): Result.001 file - promoters60/1008432
aatctct

SEQ ID NO: 89501 - DNA, 6 bp, Unknown
  misc_feature (1)..( 6): Result.001 file - promoters60/1008432
caaatt

SEQ ID NO: 89502 - DNA, 6 bp, Unknown
  misc_feature (1)..( 6): Result.001 file - promoters60/1008432
caaatt

SEQ ID NO: 89503 - DNA, 9 bp, Unknown
  misc_feature (1)..( 9): Result.001 file - promoters60/1008432
aatcataaa

SEQ ID NO: 89504 - DNA, 9 bp, Unknown
  misc_feature (1)..( 9): Result.001 file - promoters60/1008432
aatcaaaaa

SEQ ID NO: 89505 - DNA, 8 bp, Unknown
  misc_feature (1)..( 8): Result.001 file - promoters60/1008432
tatagtaa

SEQ ID NO: 89506 - DNA, 8 bp, Unknown
  misc_feature (1)..( 8): Result.001 file - promoters60/1008432
tattgtaa

SEQ ID NO: 89507 - DNA, 8 bp, Unknown
  misc_feature (1)..( 8): Result.001 file - promoters60/1008432
attgtttt

SEQ ID NO: 89508 - DNA, 8 bp, Unknown
  misc_feature (1)..( 8): Result.001 file - promoters60/1008432
attttttt

SEQ ID NO: 89509 - DNA, 8 bp, Unknown
  misc_feature (1)..( 8): Result.001 file - promoters60/1008432
atttttat

SEQ ID NO: 89510 - DNA, 6 bp, Unknown
  misc_feature (1)..( 6): Result.001 file - promoters60/1008432
tttgtt

SEQ ID NO: 89511 - DNA, 6 bp, Unknown
  misc_feature (1)..( 6): Result.001 file - promoters60/1008432
tttgtt

SEQ ID NO: 89512 - DNA, 6 bp, Unknown
  misc_feature (1)..( 6): Result.001 file - promoters60/1008432
tataac

SEQ ID NO: 89513 - DNA, 6 bp, Unknown
  misc_feature (1)..( 6): Result.001 file - promoters60/1008432
tataac

SEQ ID NO: 89514 - DNA, 8 bp, Unknown
  misc_feature (1)..( 8): Result.001 file - promoters60/1008432
gaagaaag

SEQ ID NO: 89515 - DNA, 8 bp, Unknown
  misc_feature (1)..( 8): Result.001 file - promoters60/1008432
gaacaaag

SEQ ID NO: 89516 - DNA, 8 bp, Unknown
  misc_feature (1)..( 8): Result.001 file - promoters60/1008432
tttaaatg

SEQ ID NO: 89517 - DNA, 8 bp, Unknown
  misc_feature (1)..( 8): Result.001 file - promoters60/1008432
tttatatg

SEQ ID NO: 89518 - DNA, 7 bp, Unknown
  misc_feature (1)..( 7): Result.001 file - promoters60/1008432
ccaaaca

SEQ ID NO: 89519 - DNA, 7 bp, Unknown
  misc_feature (1)..( 7): Result.001 file - promoters60/1008432
ccataca

SEQ ID NO: 89520 - DNA, 8 bp, Unknown
  misc_feature (1)..( 8): Result.001 file - promoters60/1008432
tacaaaaa

SEQ ID NO: 89521 - DNA, 8 bp, Unknown
  misc_feature (1)..( 8): Result.001 file - promoters60/1008432
tacaaaaa

SEQ ID NO: 89522 - DNA, 8 bp, Unknown
  misc_feature (1)..( 8): Result.001 file - promoters60/1008432
aaaaaaag

SEQ ID NO: 89523 - DNA, 8 bp, Unknown
  misc_feature (1)..( 8): Result.001 file - promoters60/1008432
aaacaaag

SEQ ID NO: 89524 - DNA, 8 bp, Unknown
  misc_feature (1)..( 8): Result.001 file - promoters60/1008432
aaccacct

SEQ ID NO: 89525 - DNA, 8 bp, Unknown
  misc_feature (1)..( 8): Result.001 file - promoters60/1008443
aacaacct

SEQ ID NO: 89526 - DNA, 17 bp, Unknown
  misc_feature (1)..( 17): Result.001 file - promoters60/1008443
acaatgggctgggccta

SEQ ID NO: 89527 - DNA, 17 bp, Unknown
  misc_feature (1)..( 17): Result.001 file - promoters60/1008443
gaaataggcccaacaaa

SEQ ID NO: 89528 - DNA, 17 bp, Unknown
  misc_feature (1)..( 17): Result.001 file - promoters60/1008443
ctgttgggcttttaatg

SEQ ID NO: 89529 - DNA, 17 bp, Unknown
  misc_feature (1)..( 17): Result.001 file - promoters60/1008443
taattgggctttttaag

SEQ ID NO: 89530 - DNA, 17 bp, Unknown
  misc_feature (1)..( 17): Result.001 file - promoters60/1008443
taaaaaggcccattata

SEQ ID NO: 89531 - DNA, 17 bp, Unknown
  misc_feature (1)..( 17): Result.001 file - promoters60/1008443
aaataaagcccattata

SEQ ID NO: 89532 - DNA, 17 bp, Unknown
  misc_feature (1)..( 17): Result.001 file - promoters60/1008534
taaaaaatatctgaaac

SEQ ID NO: 89533 - DNA, 12 bp, Unknown
  misc_feature (1)..( 12): Result.001 file - promoters60/1008534
attaacataaat

SEQ ID NO: 89534 - DNA, 12 bp, Unknown
  misc_feature (1)..( 12): Result.001 file - promoters60/1008534
tataatataaag

SEQ ID NO: 89535 - DNA, 12 bp, Unknown
  misc_feature (1)..( 12): Result.001 file - promoters60/1008534
cagtatataaat

SEQ ID NO: 89536 - DNA, 12 bp, Unknown
  misc_feature (1)..( 12): Result.001 file - promoters60/1008534
ccctttataaaa

SEQ ID NO: 89537 - DNA, 12 bp, Unknown
  misc_feature (1)..( 12): Result.001 file - promoters60/1008534
ccctatataaag

SEQ ID NO: 89538 - DNA, 12 bp, Unknown
  misc_feature (1)..( 12): Result.001 file - promoters60/1008534
ttatatattatt

SEQ ID NO: 89539 - DNA, 11 bp, Unknown
  misc_feature (1)..( 11): Result.001 file - promoters60/1008534
ctttctgtctc

SEQ ID NO: 89540 - DNA, 11 bp, Unknown
  misc_feature (1)..( 11): Result.001 file - promoters60/1008534
atttttgttaa

SEQ ID NO: 89541 - DNA, 11 bp, Unknown
  misc_feature (1)..( 11): Result.001 file - promoters60/1008534
cttcctgagaa

SEQ ID NO: 89542 - DNA, 11 bp, Unknown
  misc_feature (1)..( 11): Result.001 file - promoters60/1008534
aatccagagaa

SEQ ID NO: 89543 - DNA, 11 bp, Unknown
  misc_feature (1)..( 11): Result.001 file - promoters60/1008534
tttttttttac

SEQ ID NO: 89544 - DNA, 11 bp, Unknown
  misc_feature (1)..( 11): Result.001 file - promoters60/1008534
gtttttgtcta

SEQ ID NO: 89545 - DNA, 13 bp, Unknown
  misc_feature (1)..( 13): Result.001 file - promoters60/1008534
ccctttataaaac

SEQ ID NO: 89546 - DNA, 13 bp, Unknown
  misc_feature (1)..( 13): Result.001 file - promoters60/1008534
attactattaaag

SEQ ID NO: 89547 - DNA, 13 bp, Unknown
  misc_feature (1)..( 13): Result.001 file - promoters60/1008534
tataatataaagg

SEQ ID NO: 89548 - DNA, 13 bp, Unknown
  misc_feature (1)..( 13): Result.001 file - promoters60/1008534
ccctatataaaga

SEQ ID NO: 89549 - DNA, 13 bp, Unknown
  misc_feature (1)..( 13): Result.001 file - promoters60/1008534
tatattatttaag

SEQ ID NO: 89550 - DNA, 13 bp, Unknown
  misc_feature (1)..( 13): Result.001 file - promoters60/1008573
ctcagtatataaa

SEQ ID NO: 89551 - DNA, 15 bp, Unknown
  misc_feature (1)..( 15): Result.001 file - promoters60/1008573
ttagcatatcctttc

SEQ ID NO: 89552 - DNA, 15 bp, Unknown
  misc_feature (1)..( 15): Result.001 file - promoters60/1008573
agaatgtattcttca

SEQ ID NO: 89553 - DNA, 15 bp, Unknown
  misc_feature (1)..( 15): Result.001 file - promoters60/1008573
atgaaatatccggta

SEQ ID NO: 89554 - DNA, 15 bp, Unknown
  misc_feature (1)..( 15): Result.001 file - promoters60/1008573
aaaaattattctgat

SEQ ID NO: 89555 - DNA, 15 bp, Unknown
  misc_feature (1)..( 15): Result.001 file - promoters60/1008573
gtatatcattctttt

SEQ ID NO: 89556 - DNA, 15 bp, Unknown
  misc_feature (1)..( 15): Result.001 file - promoters60/1008573
aaggtttactctata

SEQ ID NO: 89557 - DNA, 15 bp, Unknown
  misc_feature (1)..( 15): Result.001 file - promoters60/1008573
gtatttcactctttt

SEQ ID NO: 89558 - DNA, 13 bp, Unknown
  misc_feature (1)..( 13): Result.001 file - promoters60/1008573
ttacaatttcact

SEQ ID NO: 89559 - DNA, 13 bp, Unknown
  misc_feature (1)..( 13): Result.001 file - promoters60/1008573
tttttttttcact

SEQ ID NO: 89560 - DNA, 13 bp, Unknown
  misc_feature (1)..( 13): Result.001 file - promoters60/1008573
ttttcttttcata

SEQ ID NO: 89561 - DNA, 13 bp, Unknown
  misc_feature (1)..( 13): Result.001 file - promoters60/1008573
ctgatttttaata

SEQ ID NO: 89562 - DNA, 13 bp, Unknown
  misc_feature (1)..( 13): Result.001 file - promoters60/1008573
ttcatgtttaatc

SEQ ID NO: 89563 - DNA, 13 bp, Unknown
  misc_feature (1)..( 13): Result.001 file - promoters60/1008573
taaaaagttaaat

SEQ ID NO: 89564 - DNA, 13 bp, Unknown
  misc_feature (1)..( 13): Result.001 file - promoters60/1008573
tatactttttagt

SEQ ID NO: 89565 - DNA, 14 bp, Unknown
  misc_feature (1)..( 14): Result.001 file - promoters60/1008573
gattaaaaatccaa

SEQ ID NO: 89566 - DNA, 14 bp, Unknown
  misc_feature (1)..( 14): Result.001 file - promoters60/1008573
gaataaatatcctc

SEQ ID NO: 89567 - DNA, 14 bp, Unknown
  misc_feature (1)..( 14): Result.001 file - promoters60/1008573
gaaacaaaatccaa

SEQ ID NO: 89568 - DNA, 14 bp, Unknown
  misc_feature (1)..( 14): Result.001 file - promoters60/1008573
atttaaagcccaat

SEQ ID NO: 89569 - DNA, 14 bp, Unknown
  misc_feature (1)..( 14): Result.001 file - promoters60/1008573
acttaaaaacattt

SEQ ID NO: 89570 - DNA, 14 bp, Unknown
  misc_feature (1)..( 14): Result.001 file - promoters60/1008573
tcatgaatatataa

SEQ ID NO: 89571 - DNA, 12 bp, Unknown
  misc_feature (1)..( 12): Result.001 file - promoters60/1008573
caacaatgtaca

SEQ ID NO: 89572 - DNA, 12 bp, Unknown
  misc_feature (1)..( 12): Result.001 file - promoters60/1008573
caataatttaca

SEQ ID NO: 89573 - DNA, 12 bp, Unknown
  misc_feature (1)..( 12): Result.001 file - promoters60/1008573
gaataataaaat

SEQ ID NO: 89574 - DNA, 12 bp, Unknown
  misc_feature (1)..( 12): Result.001 file - promoters60/1008573
atttaatttaat

SEQ ID NO: 89575 - DNA, 12 bp, Unknown
  misc_feature (1)..( 12): Result.001 file - promoters60/1008573
gattaaatataa

SEQ ID NO: 89576 - DNA, 12 bp, Unknown
  misc_feature (1)..( 12): Result.001 file - promoters60/1008573
tgaaaatttata

SEQ ID NO: 89577 - DNA, 10 bp, Unknown
  misc_feature (1)..( 10): Result.001 file - promoters60/1008573
agaatgtatt

SEQ ID NO: 89578 - DNA, 10 bp, Unknown
  misc_feature (1)..( 10): Result.001 file - promoters60/1008573
aaaatatatt

SEQ ID NO: 89579 - DNA, 10 bp, Unknown
  misc_feature (1)..( 10): Result.001 file - promoters60/1008573
agagtgtaca

SEQ ID NO: 89580 - DNA, 10 bp, Unknown
  misc_feature (1)..( 10): Result.001 file - promoters60/1008573
aaaatttata

SEQ ID NO: 89581 - DNA, 10 bp, Unknown
  misc_feature (1)..( 10): Result.001 file - promoters60/1008573
attatgtata

SEQ ID NO: 89582 - DNA, 10 bp, Unknown
  misc_feature (1)..( 10): Result.001 file - promoters60/1008573
aaaacataac

SEQ ID NO: 89583 - DNA, 10 bp, Unknown
  misc_feature (1)..( 10): Result.001 file - promoters60/1008573
caaatttttg

SEQ ID NO: 89584 - DNA, 7 bp, Unknown
  misc_feature (1)..( 7): Result.001 file - promoters60/1008573
gataaaa

SEQ ID NO: 89585 - DNA, 7 bp, Unknown
  misc_feature (1)..( 7): Result.001 file - promoters60/1008573
tataaaa

SEQ ID NO: 89586 - DNA, 7 bp, Unknown
  misc_feature (1)..( 7): Result.001 file - promoters60/1008573
gattaaa

SEQ ID NO: 89587 - DNA, 7 bp, Unknown
  misc_feature (1)..( 7): Result.001 file - promoters60/1008573
gatgaaa

SEQ ID NO: 89588 - DNA, 7 bp, Unknown
  misc_feature (1)..( 7): Result.001 file - promoters60/1008573
aataaaa

SEQ ID NO: 89589 - DNA, 7 bp, Unknown
  misc_feature (1)..( 7): Result.001 file - promoters60/1008573
gattaat

SEQ ID NO: 89590 - DNA, 12 bp, Unknown
  misc_feature (1)..( 12): Result.001 file - promoters60/1008573
agattttttatt

SEQ ID NO: 89591 - DNA, 12 bp, Unknown
  misc_feature (1)..( 12): Result.001 file - promoters60/1008573
agaatttttgta

SEQ ID NO: 89592 - DNA, 12 bp, Unknown
  misc_feature (1)..( 12): Result.001 file - promoters60/1008573
atattttatatt

SEQ ID NO: 89593 - DNA, 12 bp, Unknown
  misc_feature (1)..( 12): Result.001 file - promoters60/1008573
ctgtttcttagg

SEQ ID NO: 89594 - DNA, 12 bp, Unknown
  misc_feature (1)..( 12): Result.001 file - promoters60/1008573
ataattttaaac

SEQ ID NO: 89595 - DNA, 12 bp, Unknown
  misc_feature (1)..( 12): Result.001 file - promoters60/1008573
tcatatgagtga

SEQ ID NO: 89596 - DNA, 9 bp, Unknown
  misc_feature (1)..( 9): Result.001 file - promoters60/1008573
tatttataa

SEQ ID NO: 89597 - DNA, 9 bp, Unknown
  misc_feature (1)..( 9): Result.001 file - promoters60/1008573
tttttttaa

SEQ ID NO: 89598 - DNA, 9 bp, Unknown
  misc_feature (1)..( 9): Result.001 file - promoters60/1008573
gattaatac

SEQ ID NO: 89599 - DNA, 9 bp, Unknown
  misc_feature (1)..( 9): Result.001 file - promoters60/1008573
gattaaatt

SEQ ID NO: 89600 - DNA, 9 bp, Unknown
  misc_feature (1)..( 9): Result.001 file - promoters60/1008573
atttaataa

SEQ ID NO: 89601 - DNA, 9 bp, Unknown
  misc_feature (1)..( 9): Result.001 file - promoters60/1008673
catttttat

SEQ ID NO: 89602 - DNA, 6 bp, Unknown
  misc_feature (1)..( 6): Result.001 file - promoters60/1008673
atagat

SEQ ID NO: 89603 - DNA, 6 bp, Unknown
  misc_feature (1)..( 6): Result.001 file - promoters60/1008673
atagat

SEQ ID NO: 89604 - DNA, 9 bp, Unknown
  misc_feature (1)..( 9): Result.001 file - promoters60/1008673
tatgtaatt

SEQ ID NO: 89605 - DNA, 9 bp, Unknown
  misc_feature (1)..( 9): Result.001 file - promoters60/1008673
tatgtaatt

SEQ ID NO: 89606 - DNA, 7 bp, Unknown
  misc_feature (1)..( 7): Result.001 file - promoters60/1008673
attgaaa

SEQ ID NO: 89607 - DNA, 7 bp, Unknown
  misc_feature (1)..( 7): Result.001 file - promoters60/1008673
atttaaa

SEQ ID NO: 89608 - DNA, 12 bp, Unknown
  misc_feature (1)..( 12): Result.001 file - promoters60/1008673
aactcaattgtt

SEQ ID NO: 89609 - DNA, 12 bp, Unknown
  misc_feature (1)..( 12): Result.001 file - promoters60/1008673
aacttaatagtt

SEQ ID NO: 89610 - DNA, 6 bp, Unknown
  misc_feature (1)..( 6): Result.001 file - promoters60/1008673
gtttgt

SEQ ID NO: 89611 - DNA, 6 bp, Unknown
  misc_feature (1)..( 6): Result.001 file - promoters60/1008673
gtttgt

SEQ ID NO: 89612 - DNA, 7 bp, Unknown
  misc_feature (1)..( 7): Result.001 file - promoters60/1008673
attcatt

SEQ ID NO: 89613 - DNA, 7 bp, Unknown
  misc_feature (1)..( 7): Result.001 file - promoters60/1008673
attgatt

SEQ ID NO: 89614 - DNA, 6 bp, Unknown
  misc_feature (1)..( 6): Result.001 file - promoters60/1008673
tgtttg

SEQ ID NO: 89615 - DNA, 6 bp, Unknown
  misc_feature (1)..( 6): Result.001 file - promoters60/1008673
tgtttg

SEQ ID NO: 89616 - DNA, 8 bp, Unknown
  misc_feature (1)..( 8): Result.001 file - promoters60/1008673
cgttacca

SEQ ID NO: 89617 - DNA, 8 bp, Unknown
  misc_feature (1)..( 8): Result.001 file - promoters60/1008673
cgttacca

SEQ ID NO: 89618 - DNA, 7 bp, Unknown
  misc_feature (1)..( 7): Result.001 file - promoters60/1008673
aaacgaa

SEQ ID NO: 89619 - DNA, 7 bp, Unknown
  misc_feature (1)..( 7): Result.001 file - promoters60/1008673
aaaagaa

SEQ ID NO: 89620 - DNA, 6 bp, Unknown
  misc_feature (1)..( 6): Result.001 file - promoters60/1008673
actgaa

SEQ ID NO: 89621 - DNA, 6 bp, Unknown
  misc_feature (1)..( 6): Result.001 file - promoters60/1008673
actgaa

SEQ ID NO: 89622 - DNA, 6 bp, Unknown
  misc_feature (1)..( 6): Result.001 file - promoters60/1008673
tagata

SEQ ID NO: 89623 - DNA, 6 bp, Unknown
  misc_feature (1)..( 6): Result.001 file - promoters60/1008673
tagata

SEQ ID NO: 89624 - DNA, 8 bp, Unknown
  misc_feature (1)..( 8): Result.001 file - promoters60/1008673
atgaaatg

SEQ ID NO: 89625 - DNA, 8 bp, Unknown
  misc_feature (1)..( 8): Result.001 file - promoters60/1008673
atgaaatg

SEQ ID NO: 89626 - DNA, 8 bp, Unknown
  misc_feature (1)..( 8): Result.001 file - promoters60/1008673
tttttaat

SEQ ID NO: 89627 - DNA, 8 bp, Unknown
  misc_feature (1)..( 8): Result.001 file - promoters60/1008673
tttttaat

SEQ ID NO: 89628 - DNA, 7 bp, Unknown
  misc_feature (1)..( 7): Result.001 file - promoters60/1008673
aaatctt

SEQ ID NO: 89629 - DNA, 7 bp, Unknown
  misc_feature (1)..( 7): Result.001 file - promoters60/1008732
aaatctt

SEQ ID NO: 89630 - DNA, 10 bp, Unknown
  misc_feature (1)..( 10): Result.001 file - promoters60/1008732
taaattttaa

SEQ ID NO: 89631 - DNA, 10 bp, Unknown
  misc_feature (1)..( 10): Result.001 file - promoters60/1008732
caaatttgtt

SEQ ID NO: 89632 - DNA, 10 bp, Unknown
  misc_feature (1)..( 10): Result.001 file - promoters60/1008732
ataattttgt

SEQ ID NO: 89633 - DNA, 10 bp, Unknown
  misc_feature (1)..( 10): Result.001 file - promoters60/1008732
tgaattctaa

SEQ ID NO: 89634 - DNA, 10 bp, Unknown
  misc_feature (1)..( 10): Result.001 file - promoters60/1008732
taaatatgtt

SEQ ID NO: 89635 - DNA, 10 bp, Unknown
  misc_feature (1)..( 10): Result.001 file - promoters60/1008732
taaataacat

SEQ ID NO: 89636 - DNA, 14 bp, Unknown
  misc_feature (1)..( 14): Result.001 file - promoters60/1008732
tcaattgtacttat

SEQ ID NO: 89637 - DNA, 14 bp, Unknown
  misc_feature (1)..( 14): Result.001 file - promoters60/1008732
caacttgtacacgc

SEQ ID NO: 89638 - DNA, 14 bp, Unknown
  misc_feature (1)..( 14): Result.001 file - promoters60/1008732
ttaattgtataatt

SEQ ID NO: 89639 - DNA, 14 bp, Unknown
  misc_feature (1)..( 14): Result.001 file - promoters60/1008732
ttctttgaacttat

SEQ ID NO: 89640 - DNA, 14 bp, Unknown
  misc_feature (1)..( 14): Result.001 file - promoters60/1008732
ttatttgagttatg

SEQ ID NO: 89641 - DNA, 14 bp, Unknown
  misc_feature (1)..( 14): Result.001 file - promoters60/1008732
ttaattgtctccgg

SEQ ID NO: 89642 - DNA, 12 bp, Unknown
  misc_feature (1)..( 12): Result.001 file - promoters60/1008732
aattttaatctc

SEQ ID NO: 89643 - DNA, 12 bp, Unknown
  misc_feature (1)..( 12): Result.001 file - promoters60/1008732
atttttattcta

SEQ ID NO: 89644 - DNA, 12 bp, Unknown
  misc_feature (1)..( 12): Result.001 file - promoters60/1008732
aattctaaaatc

SEQ ID NO: 89645 - DNA, 12 bp, Unknown
  misc_feature (1)..( 12): Result.001 file - promoters60/1008732
tgttgtattcta

SEQ ID NO: 89646 - DNA, 12 bp, Unknown
  misc_feature (1)..( 12): Result.001 file - promoters60/1008732
ctttttacggcg

SEQ ID NO: 89647 - DNA, 12 bp, Unknown
  misc_feature (1)..( 12): Result.001 file - promoters60/1008732
ggttttatttat

SEQ ID NO: 89648 - DNA, 10 bp, Unknown
  misc_feature (1)..( 10): Result.001 file - promoters60/1008732
atatatctta

SEQ ID NO: 89649 - DNA, 10 bp, Unknown
  misc_feature (1)..( 10): Result.001 file - promoters60/1008732
ataaatcttt

SEQ ID NO: 89650 - DNA, 11 bp, Unknown
  misc_feature (1)..( 11): Result.001 file - promoters60/1008732
ttatcatatta

SEQ ID NO: 89651 - DNA, 11 bp, Unknown
  misc_feature (1)..( 11): Result.001 file - promoters60/1008732
ataaaacttga

SEQ ID NO: 89652 - DNA, 11 bp, Unknown
  misc_feature (1)..( 11): Result.001 file - promoters60/1008732
ttgaaatttga

SEQ ID NO: 89653 - DNA, 11 bp, Unknown
  misc_feature (1)..( 11): Result.001 file - promoters60/1008787
aacaaagttgt

SEQ ID NO: 89654 - DNA, 7 bp, Unknown
  misc_feature (1)..( 7): Result.001 file - promoters60/1008787
taacgtt

SEQ ID NO: 89655 - DNA, 7 bp, Unknown
  misc_feature (1)..( 7): Result.001 file - promoters60/1008787
taaggtt

SEQ ID NO: 89656 - DNA, 15 bp, Unknown
  misc_feature (1)..( 15): Result.001 file - promoters60/1008787
aaaagcatacaaata

SEQ ID NO: 89657 - DNA, 15 bp, Unknown
  misc_feature (1)..( 15): Result.001 file - promoters60/1008787
aaaagaatagcttct

SEQ ID NO: 89658 - DNA, 15 bp, Unknown
  misc_feature (1)..( 15): Result.001 file - promoters60/1008787
gaaggcatacagata

SEQ ID NO: 89659 - DNA, 6 bp, Unknown
  misc_feature (1)..( 6): Result.001 file - promoters60/1008787
tcaact

SEQ ID NO: 89660 - DNA, 6 bp, Unknown
  misc_feature (1)..( 6): Result.001 file - promoters60/1008787
tcaact

SEQ ID NO: 89661 - DNA, 7 bp, Unknown
  misc_feature (1)..( 7): Result.001 file - promoters60/1008787
aacttcg

SEQ ID NO: 89662 - DNA, 7 bp, Unknown
  misc_feature (1)..( 7): Result.001 file - promoters60/1008787
aacgtcg

SEQ ID NO: 89663 - DNA, 7 bp, Unknown
  misc_feature (1)..( 7): Result.001 file - promoters60/1008787
ctattat

SEQ ID NO: 89664 - DNA, 7 bp, Unknown
  misc_feature (1)..( 7): Result.001 file - promoters60/1008787
ctagtat

SEQ ID NO: 89665 - DNA, 7 bp, Unknown
  misc_feature (1)..( 7): Result.001 file - promoters60/1008787
ctattac

SEQ ID NO: 89666 - DNA, 8 bp, Unknown
  misc_feature (1)..( 8): Result.001 file - promoters60/1008787
attgtatt

SEQ ID NO: 89667 - DNA, 8 bp, Unknown
  misc_feature (1)..( 8): Result.001 file - promoters60/1008787
attatatt

SEQ ID NO: 89668 - DNA, 9 bp, Unknown
  misc_feature (1)..( 9): Result.001 file - promoters60/1008787
aaatatcaa

SEQ ID NO: 89669 - DNA, 9 bp, Unknown
  misc_feature (1)..( 9): Result.001 file - promoters60/1008787
aaataacaa

SEQ ID NO: 89670 - DNA, 7 bp, Unknown
  misc_feature (1)..( 7): Result.001 file - promoters60/1008787
ttaatca

SEQ ID NO: 89671 - DNA, 7 bp, Unknown
  misc_feature (1)..( 7): Result.001 file - promoters60/1008787
ttattca

SEQ ID NO: 89672 - DNA, 6 bp, Unknown
  misc_feature (1)..( 6): Result.001 file - promoters60/1008787
tttctt

SEQ ID NO: 89673 - DNA, 6 bp, Unknown
  misc_feature (1)..( 6): Result.001 file - promoters60/1008787
tttctt

SEQ ID NO: 89674 - DNA, 6 bp, Unknown
  misc_feature (1)..( 6): Result.001 file - promoters60/1008787
caagaa

SEQ ID NO: 89675 - DNA, 6 bp, Unknown
  misc_feature (1)..( 6): Result.001 file - promoters60/1008787
caagaa

SEQ ID NO: 89676 - DNA, 8 bp, Unknown
  misc_feature (1)..( 8): Result.001 file - promoters60/1008787
acgttatt

SEQ ID NO: 89677 - DNA, 8 bp, Unknown
  misc_feature (1)..( 8): Result.001 file - promoters60/1008787
tggttatt

SEQ ID NO: 89678 - DNA, 8 bp, Unknown
  misc_feature (1)..( 8): Result.001 file - promoters60/1008787
tgggtata

SEQ ID NO: 89679 - DNA, 6 bp, Unknown
  misc_feature (1)..( 6): Result.001 file - promoters60/1008787
ctttgt

SEQ ID NO: 89680 - DNA, 6 bp, Unknown
  misc_feature (1)..( 6): Result.001 file - promoters60/1008787
ctttgt

SEQ ID NO: 89681 - DNA, 7 bp, Unknown
  misc_feature (1)..( 7): Result.001 file - promoters60/1008787
tttcaac

SEQ ID NO: 89682 - DNA, 7 bp, Unknown
  misc_feature (1)..( 7): Result.001 file - promoters60/1008787
ttttaac

SEQ ID NO: 89683 - DNA, 6 bp, Unknown
  misc_feature (1)..( 6): Result.001 file - promoters60/1008787
attaaa

SEQ ID NO: 89684 - DNA, 6 bp, Unknown
  misc_feature (1)..( 6): Result.001 file - promoters60/1008787
attaaa

SEQ ID NO: 89685 - DNA, 7 bp, Unknown
  misc_feature (1)..( 7): Result.001 file - promoters60/1008787
tacgtaa

SEQ ID NO: 89686 - DNA, 7 bp, Unknown
  misc_feature (1)..( 7): Result.001 file - promoters60/1008787
tacataa

SEQ ID NO: 89687 - DNA, 6 bp, Unknown
  misc_feature (1)..( 6): Result.001 file - promoters60/1008787
gtaaaa

SEQ ID NO: 89688 - DNA, 6 bp, Unknown
  misc_feature (1)..( 6): Result.001 file - promoters60/1008787
gtaaaa

SEQ ID NO: 89689 - DNA, 9 bp, Unknown
  misc_feature (1)..( 9): Result.001 file - promoters60/1008787
aaatagtta

SEQ ID NO: 89690 - DNA, 9 bp, Unknown
  misc_feature (1)..( 9): Result.001 file - promoters60/1008787
aaatattta

SEQ ID NO: 89691 - DNA, 8 bp, Unknown
  misc_feature (1)..( 8): Result.001 file - promoters60/1008787
caatactt

SEQ ID NO: 89692 - DNA, 8 bp, Unknown
  misc_feature (1)..( 8): Result.001 file - promoters60/1008787
caaaactt

SEQ ID NO: 89693 - DNA, 6 bp, Unknown
  misc_feature (1)..( 6): Result.001 file - promoters60/1008787
gttcta

SEQ ID NO: 89694 - DNA, 6 bp, Unknown
  misc_feature (1)..( 6): Result.001 file - promoters60/1008787
gttcta

SEQ ID NO: 89695 - DNA, 7 bp, Unknown
  misc_feature (1)..( 7): Result.001 file - promoters60/1008787
atatttt

SEQ ID NO: 89696 - DNA, 7 bp, Unknown
  misc_feature (1)..( 7): Result.001 file - promoters60/1008808
atacttt

SEQ ID NO: 89697 - DNA, 9 bp, Unknown
  misc_feature (1)..( 9): Result.001 file - promoters60/1008808
tacttcctt

SEQ ID NO: 89698 - DNA, 9 bp, Unknown
  misc_feature (1)..( 9): Result.001 file - promoters60/1008808
agcttactt

SEQ ID NO: 89699 - DNA, 9 bp, Unknown
  misc_feature (1)..( 9): Result.001 file - promoters60/1008808
gacttccgc

SEQ ID NO: 89700 - DNA, 9 bp, Unknown
  misc_feature (1)..( 9): Result.001 file - promoters60/1008808
tctttactt

SEQ ID NO: 89701 - DNA, 9 bp, Unknown
  misc_feature (1)..( 9): Result.001 file - promoters60/1008808
tcttttctt

SEQ ID NO: 89702 - DNA, 11 bp, Unknown
  misc_feature (1)..( 11): Result.001 file - promoters60/1008808
gcctatggtta

SEQ ID NO: 89703 - DNA, 11 bp, Unknown
  misc_feature (1)..( 11): Result.001 file - promoters60/1008808
agaaatgatta

SEQ ID NO: 89704 - DNA, 11 bp, Unknown
  misc_feature (1)..( 11): Result.001 file - promoters60/1008808
ttaaaggatta

SEQ ID NO: 89705 - DNA, 11 bp, Unknown
  misc_feature (1)..( 11): Result.001 file - promoters60/1008808
gaaaaagatgg

SEQ ID NO: 89706 - DNA, 11 bp, Unknown
  misc_feature (1)..( 11): Result.001 file - promoters60/1008808
aaaaatgtgaa

SEQ ID NO: 89707 - DNA, 11 bp, Unknown
  misc_feature (1)..( 11): Result.001 file - promoters60/1008808
caaaatgttat

SEQ ID NO: 89708 - DNA, 9 bp, Unknown
  misc_feature (1)..( 9): Result.001 file - promoters60/1008808
ataagtttg

SEQ ID NO: 89709 - DNA, 9 bp, Unknown
  misc_feature (1)..( 9): Result.001 file - promoters60/1008808
ataagtctg

SEQ ID NO: 89710 - DNA, 9 bp, Unknown
  misc_feature (1)..( 9): Result.001 file - promoters60/1008808
ttaagttct

SEQ ID NO: 89711 - DNA, 9 bp, Unknown
  misc_feature (1)..( 9): Result.001 file - promoters60/1008808
ttatgtttc

SEQ ID NO: 89712 - DNA, 9 bp, Unknown
  misc_feature (1)..( 9): Result.001 file - promoters60/1008816
aaaagttct

SEQ ID NO: 89713 - DNA, 9 bp, Unknown
  misc_feature (1)..( 9): Result.001 file - promoters60/1008816
tcataacac

SEQ ID NO: 89714 - DNA, 9 bp, Unknown
  misc_feature (1)..( 9): Result.001 file - promoters60/1008816
tcatatcac

SEQ ID NO: 89715 - DNA, 7 bp, Unknown
  misc_feature (1)..( 7): Result.001 file - promoters60/1008816
gataaaa

SEQ ID NO: 89716 - DNA, 7 bp, Unknown
  misc_feature (1)..( 7): Result.001 file - promoters60/1008816
gattaaa

SEQ ID NO: 89717 - DNA, 6 bp, Unknown
  misc_feature (1)..( 6): Result.001 file - promoters60/1008816
ttcaac

SEQ ID NO: 89718 - DNA, 6 bp, Unknown
  misc_feature (1)..( 6): Result.001 file - promoters60/1008816
ttcaac

SEQ ID NO: 89719 - DNA, 6 bp, Unknown
  misc_feature (1)..( 6): Result.001 file - promoters60/1008816
taaaac

SEQ ID NO: 89720 - DNA, 6 bp, Unknown
  misc_feature (1)..( 6): Result.001 file - promoters60/1008816
taaaac

SEQ ID NO: 89721 - DNA, 6 bp, Unknown
  misc_feature (1)..( 6): Result.001 file - promoters60/1008816
aaagtt

SEQ ID NO: 89722 - DNA, 6 bp, Unknown
  misc_feature (1)..( 6): Result.001 file - promoters60/1008816
aaagtt

SEQ ID NO: 89723 - DNA, 6 bp, Unknown
  misc_feature (1)..( 6): Result.001 file - promoters60/1008816
atattt

SEQ ID NO: 89724 - DNA, 6 bp, Unknown
  misc_feature (1)..( 6): Result.001 file - promoters60/1008816
atattt

SEQ ID NO: 89725 - DNA, 6 bp, Unknown
  misc_feature (1)..( 6): Result.001 file - promoters60/1008816
gaaaaa

SEQ ID NO: 89726 - DNA, 6 bp, Unknown
  misc_feature (1)..( 6): Result.001 file - promoters60/1008816
gaaaaa

SEQ ID NO: 89727 - DNA, 8 bp, Unknown
  misc_feature (1)..( 8): Result.001 file - promoters60/1008816
aggataaa

SEQ ID NO: 89728 - DNA, 8 bp, Unknown
  misc_feature (1)..( 8): Result.001 file - promoters60/1008816
aggagaaa

SEQ ID NO: 89729 - DNA, 6 bp, Unknown
  misc_feature (1)..( 6): Result.001 file - promoters60/1008816
tctaaa

SEQ ID NO: 89730 - DNA, 6 bp, Unknown
  misc_feature (1)..( 6): Result.001 file - promoters60/1008816
tctaaa

SEQ ID NO: 89731 - DNA, 9 bp, Unknown
  misc_feature (1)..( 9): Result.001 file - promoters60/1008816
atcataact

SEQ ID NO: 89732 - DNA, 9 bp, Unknown
  misc_feature (1)..( 9): Result.001 file - promoters60/1008816
atcttaact

SEQ ID NO: 89733 - DNA, 6 bp, Unknown
  misc_feature (1)..( 6): Result.001 file - promoters60/1008816
ctctac

SEQ ID NO: 89734 - DNA, 6 bp, Unknown
  misc_feature (1)..( 6): Result.001 file - promoters60/1008816
ctctac

SEQ ID NO: 89735 - DNA, 8 bp, Unknown
  misc_feature (1)..( 8): Result.001 file - promoters60/1008816
taaagcaa

SEQ ID NO: 89736 - DNA, 8 bp, Unknown
  misc_feature (1)..( 8): Result.001 file - promoters60/1008816
taaaccaa

SEQ ID NO: 89737 - DNA, 13 bp, Unknown
  misc_feature (1)..( 13): Result.001 file - promoters60/1008816
cgaataaaaaaaa

SEQ ID NO: 89738 - DNA, 13 bp, Unknown
  misc_feature (1)..( 13): Result.001 file - promoters60/1008816
cgattaataaaaa

SEQ ID NO: 89739 - DNA, 6 bp, Unknown
  misc_feature (1)..( 6): Result.001 file - promoters60/1008816
agtaaa

SEQ ID NO: 89740 - DNA, 6 bp, Unknown
  misc_feature (1)..( 6): Result.001 file - promoters60/1008816
agtaaa

SEQ ID NO: 89741 - DNA, 7 bp, Unknown
  misc_feature (1)..( 7): Result.001 file - promoters60/1008816
aatcggg

SEQ ID NO: 89742 - DNA, 7 bp, Unknown
  misc_feature (1)..( 7): Result.001 file - promoters60/1008816
aattggg

SEQ ID NO: 89743 - DNA, 8 bp, Unknown
  misc_feature (1)..( 8): Result.001 file - promoters60/1008816
gaaagaaa

SEQ ID NO: 89744 - DNA, 8 bp, Unknown
  misc_feature (1)..( 8): Result.001 file - promoters60/1008816
gaaacaaa

SEQ ID NO: 89745 - DNA, 10 bp, Unknown
  misc_feature (1)..( 10): Result.001 file - promoters60/1008816
ggaaaagaaa

SEQ ID NO: 89746 - DNA, 10 bp, Unknown
  misc_feature (1)..( 10): Result.001 file - promoters60/1008816
ggaaatgaaa

SEQ ID NO: 89747 - DNA, 7 bp, Unknown
  misc_feature (1)..( 7): Result.001 file - promoters60/1008816
cccacta

SEQ ID NO: 89748 - DNA, 7 bp, Unknown
  misc_feature (1)..( 7): Result.001 file - promoters60/1008816
cccacta

SEQ ID NO: 89749 - DNA, 9 bp, Unknown
  misc_feature (1)..( 9): Result.001 file - promoters60/1008816
aaagaaaag

SEQ ID NO: 89750 - DNA, 9 bp, Unknown
  misc_feature (1)..( 9): Result.001 file - promoters60/1008816
aaagtaaag

SEQ ID NO: 89751 - DNA, 7 bp, Unknown
  misc_feature (1)..( 7): Result.001 file - promoters60/1008816
gtatata

SEQ ID NO: 89752 - DNA, 7 bp, Unknown
  misc_feature (1)..( 7): Result.001 file - promoters60/1008836
gtatata

SEQ ID NO: 89753 - DNA, 11 bp, Unknown
  misc_feature (1)..( 11): Result.001 file - promoters60/1008836
atatttttatg

SEQ ID NO: 89754 - DNA, 11 bp, Unknown
  misc_feature (1)..( 11): Result.001 file - promoters60/1008836
gaaattttatg

SEQ ID NO: 89755 - DNA, 11 bp, Unknown
  misc_feature (1)..( 11): Result.001 file - promoters60/1008836
ttttttttaac

SEQ ID NO: 89756 - DNA, 11 bp, Unknown
  misc_feature (1)..( 11): Result.001 file - promoters60/1008836
atatttttata

SEQ ID NO: 89757 - DNA, 11 bp, Unknown
  misc_feature (1)..( 11): Result.001 file - promoters60/1008836
caaattttatt

SEQ ID NO: 89758 - DNA, 11 bp, Unknown
  misc_feature (1)..( 11): Result.001 file - promoters60/1008836
acatttttttc

SEQ ID NO: 89759 - DNA, 10 bp, Unknown
  misc_feature (1)..( 10): Result.001 file - promoters60/1008836
atttatatga

SEQ ID NO: 89760 - DNA, 10 bp, Unknown
  misc_feature (1)..( 10): Result.001 file - promoters60/1008836
atttttattt

SEQ ID NO: 89761 - DNA, 10 bp, Unknown
  misc_feature (1)..( 10): Result.001 file - promoters60/1008836
cttttttttt

SEQ ID NO: 89762 - DNA, 10 bp, Unknown
  misc_feature (1)..( 10): Result.001 file - promoters60/1008836
atttttttca

SEQ ID NO: 89763 - DNA, 10 bp, Unknown
  misc_feature (1)..( 10): Result.001 file - promoters60/1008836
cgtttcattg

SEQ ID NO: 89764 - DNA, 12 bp, Unknown
  misc_feature (1)..( 12): Result.001 file - promoters60/1008836
tcaaaagattta

SEQ ID NO: 89765 - DNA, 12 bp, Unknown
  misc_feature (1)..( 12): Result.001 file - promoters60/1008836
acaaaagaaaaa

SEQ ID NO: 89766 - DNA, 12 bp, Unknown
  misc_feature (1)..( 12): Result.001 file - promoters60/1008836
tcaaaaaaagaa

SEQ ID NO: 89767 - DNA, 12 bp, Unknown
  misc_feature (1)..( 12): Result.001 file - promoters60/1008836
ggaaaaaaaaaa

SEQ ID NO: 89768 - DNA, 9 bp, Unknown
  misc_feature (1)..( 9): Result.001 file - promoters60/1008836
taaaatttg

SEQ ID NO: 89769 - DNA, 9 bp, Unknown
  misc_feature (1)..( 9): Result.001 file - promoters60/1008836
aaaacttta

SEQ ID NO: 89770 - DNA, 9 bp, Unknown
  misc_feature (1)..( 9): Result.001 file - promoters60/1008836
gttaatttg

SEQ ID NO: 89771 - DNA, 9 bp, Unknown
  misc_feature (1)..( 9): Result.001 file - promoters60/1008836
aaaacgtta

SEQ ID NO: 89772 - DNA, 13 bp, Unknown
  misc_feature (1)..( 13): Result.001 file - promoters60/1008836
gactaattaaatg

SEQ ID NO: 89773 - DNA, 13 bp, Unknown
  misc_feature (1)..( 13): Result.001 file - promoters60/1008836
taaaaattaataa

SEQ ID NO: 89774 - DNA, 13 bp, Unknown
  misc_feature (1)..( 13): Result.001 file - promoters60/1008836
ttgtaaataattg

SEQ ID NO: 89775 - DNA, 13 bp, Unknown
  misc_feature (1)..( 13): Result.001 file - promoters60/1008836
aaacgattaaatg

SEQ ID NO: 89776 - DNA, 13 bp, Unknown
  misc_feature (1)..( 13): Result.001 file - promoters60/1008836
cttaaatttagat

SEQ ID NO: 89777 - DNA, 13 bp, Unknown
  misc_feature (1)..( 13): Result.001 file - promoters60/1008836
tgtgaatctaaga

SEQ ID NO: 89778 - DNA, 12 bp, Unknown
  misc_feature (1)..( 12): Result.001 file - promoters60/1008836
aacattgtccat

SEQ ID NO: 89779 - DNA, 12 bp, Unknown
  misc_feature (1)..( 12): Result.001 file - promoters60/1008836
catattatccat

SEQ ID NO: 89780 - DNA, 12 bp, Unknown
  misc_feature (1)..( 12): Result.001 file - promoters60/1008836
ataattatccaa

SEQ ID NO: 89781 - DNA, 12 bp, Unknown
  misc_feature (1)..( 12): Result.001 file - promoters60/1008836
ttaaatattttt

SEQ ID NO: 89782 - DNA, 12 bp, Unknown
  misc_feature (1)..( 12): Result.001 file - promoters60/1008836
atcaatattctt

SEQ ID NO: 89783 - DNA, 6 bp, Unknown
  misc_feature (1)..( 6): Result.001 file - promoters60/1008836
tataaa

SEQ ID NO: 89784 - DNA, 6 bp, Unknown
  misc_feature (1)..( 6): Result.001 file - promoters60/1008836
tataaa

SEQ ID NO: 89785 - DNA, 6 bp, Unknown
  misc_feature (1)..( 6): Result.001 file - promoters60/1008836
tataaa

SEQ ID NO: 89786 - DNA, 6 bp, Unknown
  misc_feature (1)..( 6): Result.001 file - promoters60/1008836
tataaa

SEQ ID NO: 89787 - DNA, 13 bp, Unknown
  misc_feature (1)..( 13): Result.001 file - promoters60/1008836
atatttttatgtg

SEQ ID NO: 89788 - DNA, 13 bp, Unknown
  misc_feature (1)..( 13): Result.001 file - promoters60/1008836
acatttttttcac

SEQ ID NO: 89789 - DNA, 13 bp, Unknown
  misc_feature (1)..( 13): Result.001 file - promoters60/1008836
atatttttataaa

SEQ ID NO: 89790 - DNA, 13 bp, Unknown
  misc_feature (1)..( 13): Result.001 file - promoters60/1008836
atatttttatttt

SEQ ID NO: 89791 - DNA, 13 bp, Unknown
  misc_feature (1)..( 13): Result.001 file - promoters60/1008836
atgtatttagaaa

SEQ ID NO: 89792 - DNA, 11 bp, Unknown
  misc_feature (1)..( 11): Result.001 file - promoters60/1008836
gttttgaaatt

SEQ ID NO: 89793 - DNA, 11 bp, Unknown
  misc_feature (1)..( 11): Result.001 file - promoters60/1008836
attttgacatc

SEQ ID NO: 89794 - DNA, 11 bp, Unknown
  misc_feature (1)..( 11): Result.001 file - promoters60/1008836
tttttgatatt

SEQ ID NO: 89795 - DNA, 12 bp, Unknown
  misc_feature (1)..( 12): Result.001 file - promoters60/1008836
gttgttgcttct

SEQ ID NO: 89796 - DNA, 10 bp, Unknown
  misc_feature (1)..( 10): Result.001 file - promoters60/1008836
ttttaaagtt

SEQ ID NO: 89797 - DNA, 10 bp, Unknown
  misc_feature (1)..( 10): Result.001 file - promoters60/1008836
ttttaacatc

SEQ ID NO: 89798 - DNA, 10 bp, Unknown
  misc_feature (1)..( 10): Result.001 file - promoters60/1008836
ttttaacaaa

SEQ ID NO: 89799 - DNA, 10 bp, Unknown
  misc_feature (1)..( 10): Result.001 file - promoters60/1008836
tagtaaaaaa

SEQ ID NO: 89800 - DNA, 8 bp, Unknown
  misc_feature (1)..( 8): Result.001 file - promoters60/1008836
taaatatt

SEQ ID NO: 89801 - DNA, 8 bp, Unknown
  misc_feature (1)..( 8): Result.001 file - promoters60/1008836
tcaatatt

SEQ ID NO: 89802 - DNA, 9 bp, Unknown
  misc_feature (1)..( 9): Result.001 file - promoters60/1008836
ataattatc

SEQ ID NO: 89803 - DNA, 9 bp, Unknown
  misc_feature (1)..( 9): Result.001 file - promoters60/1008836
atccatata

SEQ ID NO: 89804 - DNA, 12 bp, Unknown
  misc_feature (1)..( 12): Result.001 file - promoters60/1008836
ttgattaaaaaa

SEQ ID NO: 89805 - DNA, 12 bp, Unknown
  misc_feature (1)..( 12): Result.001 file - promoters60/1008836
ttgaataaaaaa

SEQ ID NO: 89806 - DNA, 12 bp, Unknown
  misc_feature (1)..( 12): Result.001 file - promoters60/1008836
caaagtaaaaaa

SEQ ID NO: 89807 - DNA, 12 bp, Unknown
  misc_feature (1)..( 12): Result.001 file - promoters60/1008889
ctagataaaagt

SEQ ID NO: 89808 - DNA, 8 bp, Unknown
  misc_feature (1)..( 8): Result.001 file - promoters60/1008889
attcattg

SEQ ID NO: 89809 - DNA, 8 bp, Unknown
  misc_feature (1)..( 8): Result.001 file - promoters60/1008889
atttattg

SEQ ID NO: 89810 - DNA, 8 bp, Unknown
  misc_feature (1)..( 8): Result.001 file - promoters60/1008889
ctgatatt

SEQ ID NO: 89811 - DNA, 8 bp, Unknown
  misc_feature (1)..( 8): Result.001 file - promoters60/1008889
ctgatatt

SEQ ID NO: 89812 - DNA, 10 bp, Unknown
  misc_feature (1)..( 10): Result.001 file - promoters60/1008889
atttataaat

SEQ ID NO: 89813 - DNA, 10 bp, Unknown
  misc_feature (1)..( 10): Result.001 file - promoters60/1008889
atttataaat

SEQ ID NO: 89814 - DNA, 7 bp, Unknown
  misc_feature (1)..( 7): Result.001 file - promoters60/1008889
gttgttt

SEQ ID NO: 89815 - DNA, 7 bp, Unknown
  misc_feature (1)..( 7): Result.001 file - promoters60/1008889
gttattt

SEQ ID NO: 89816 - DNA, 8 bp, Unknown
  misc_feature (1)..( 8): Result.001 file - promoters60/1008889
aaaattaa

SEQ ID NO: 89817 - DNA, 8 bp, Unknown
  misc_feature (1)..( 8): Result.001 file - promoters60/1008889
taaattat

SEQ ID NO: 89818 - DNA, 8 bp, Unknown
  misc_feature (1)..( 8): Result.001 file - promoters60/1008889
taaaatat

SEQ ID NO: 89819 - DNA, 8 bp, Unknown
  misc_feature (1)..( 8): Result.001 file - promoters60/1008889
gtcaaaaa

SEQ ID NO: 89820 - DNA, 8 bp, Unknown
  misc_feature (1)..( 8): Result.001 file - promoters60/1008889
gtcaaaaa

SEQ ID NO: 89821 - DNA, 6 bp, Unknown
  misc_feature (1)..( 6): Result.001 file - promoters60/1008889
agtttg

SEQ ID NO: 89822 - DNA, 6 bp, Unknown
  misc_feature (1)..( 6): Result.001 file - promoters60/1008889
agtttg

SEQ ID NO: 89823 - DNA, 8 bp, Unknown
  misc_feature (1)..( 8): Result.001 file - promoters60/1008889
aaagacat

SEQ ID NO: 89824 - DNA, 8 bp, Unknown
  misc_feature (1)..( 8): Result.001 file - promoters60/1008889
aaagccat

SEQ ID NO: 89825 - DNA, 6 bp, Unknown
  misc_feature (1)..( 6): Result.001 file - promoters60/1008889
ctctcc

SEQ ID NO: 89826 - DNA, 6 bp, Unknown
  misc_feature (1)..( 6): Result.001 file - promoters60/1008889
ctctcc

SEQ ID NO: 89827 - DNA, 7 bp, Unknown
  misc_feature (1)..( 7): Result.001 file - promoters60/1008889
caatctt

SEQ ID NO: 89828 - DNA, 7 bp, Unknown
  misc_feature (1)..( 7): Result.001 file - promoters60/1008889
caacctt

SEQ ID NO: 89829 - DNA, 8 bp, Unknown
  misc_feature (1)..( 8): Result.001 file - promoters60/1008889
aagaagat

SEQ ID NO: 89830 - DNA, 8 bp, Unknown
  misc_feature (1)..( 8): Result.001 file - promoters60/1008889
aagaggat

SEQ ID NO: 89831 - DNA, 8 bp, Unknown
  misc_feature (1)..( 8): Result.001 file - promoters60/1008889
caataaga

SEQ ID NO: 89832 - DNA, 8 bp, Unknown
  misc_feature (1)..( 8): Result.001 file - promoters60/1008889
caatcaga

SEQ ID NO: 89833 - DNA, 6 bp, Unknown
  misc_feature (1)..( 6): Result.001 file - promoters60/1008889
aaaaaa

SEQ ID NO: 89834 - DNA, 6 bp, Unknown
  misc_feature (1)..( 6): Result.001 file - promoters60/1008889
aaaaaa

SEQ ID NO: 89835 - DNA, 13 bp, Unknown
  misc_feature (1)..( 13): Result.001 file - promoters60/1008889
aaataaaaaaatt

SEQ ID NO: 89836 - DNA, 13 bp, Unknown
  misc_feature (1)..( 13): Result.001 file - promoters60/1008889
aaagaaaataatt

SEQ ID NO: 89837 - DNA, 8 bp, Unknown
  misc_feature (1)..( 8): Result.001 file - promoters60/1008889
atttgttt

SEQ ID NO: 89838 - DNA, 8 bp, Unknown
  misc_feature (1)..( 8): Result.001 file - promoters60/1008889
attttttt

SEQ ID NO: 89839 - DNA, 8 bp, Unknown
  misc_feature (1)..( 8): Result.001 file - promoters60/1008889
atttttag

SEQ ID NO: 89840 - DNA, 6 bp, Unknown
  misc_feature (1)..( 6): Result.001 file - promoters60/1008889
caatat

SEQ ID NO: 89841 - DNA, 6 bp, Unknown
  misc_feature (1)..( 6): Result.001 file - promoters60/1008889
caatat

SEQ ID NO: 89842 - DNA, 6 bp, Unknown
  misc_feature (1)..( 6): Result.001 file - promoters60/1008889
aataaa

SEQ ID NO: 89843 - DNA, 6 bp, Unknown
  misc_feature (1)..( 6): Result.001 file - promoters60/1008983
aataaa

SEQ ID NO: 89844 - DNA, 7 bp, Unknown
  misc_feature (1)..( 7): Result.001 file - promoters60/1008983
ttaattg

SEQ ID NO: 89845 - DNA, 7 bp, Unknown
  misc_feature (1)..( 7): Result.001 file - promoters60/1008983
ttatttg

SEQ ID NO: 89846 - DNA, 7 bp, Unknown
  misc_feature (1)..( 7): Result.001 file - promoters60/1008983
gtccaga

SEQ ID NO: 89847 - DNA, 7 bp, Unknown
  misc_feature (1)..( 7): Result.001 file - promoters60/1008983
gtctaga

SEQ ID NO: 89848 - DNA, 6 bp, Unknown
  misc_feature (1)..( 6): Result.001 file - promoters60/1008983
tgaaaa

SEQ ID NO: 89849 - DNA, 6 bp, Unknown
  misc_feature (1)..( 6): Result.001 file - promoters60/1008983
tgaaaa

SEQ ID NO: 89850 - DNA, 6 bp, Unknown
  misc_feature (1)..( 6): Result.001 file - promoters60/1008983
atttgg

SEQ ID NO: 89851 - DNA, 6 bp, Unknown
  misc_feature (1)..( 6): Result.001 file - promoters60/1008983
atttgg

SEQ ID NO: 89852 - DNA, 9 bp, Unknown
  misc_feature (1)..( 9): Result.001 file - promoters60/1008983
ggttttggt

SEQ ID NO: 89853 - DNA, 9 bp, Unknown
  misc_feature (1)..( 9): Result.001 file - promoters60/1008983
ggtgttggt

SEQ ID NO: 89854 - DNA, 7 bp, Unknown
  misc_feature (1)..( 7): Result.001 file - promoters60/1008983
atttttg

SEQ ID NO: 89855 - DNA, 7 bp, Unknown
  misc_feature (1)..( 7): Result.001 file - promoters60/1008983
atttttg

SEQ ID NO: 89856 - DNA, 6 bp, Unknown
  misc_feature (1)..( 6): Result.001 file - promoters60/1008983
gctttt

SEQ ID NO: 89857 - DNA, 6 bp, Unknown
  misc_feature (1)..( 6): Result.001 file - promoters60/1008983
gctttt

SEQ ID NO: 89858 - DNA, 7 bp, Unknown
  misc_feature (1)..( 7): Result.001 file - promoters60/1008983
tcttgtg

SEQ ID NO: 89859 - DNA, 7 bp, Unknown
  misc_feature (1)..( 7): Result.001 file - promoters60/1008983
tctggtg

SEQ ID NO: 89860 - DNA, 6 bp, Unknown
  misc_feature (1)..( 6): Result.001 file - promoters60/1008983
tcttgt

SEQ ID NO: 89861 - DNA, 6 bp, Unknown
  misc_feature (1)..( 6): Result.001 file - promoters60/1008983
tcttgt

SEQ ID NO: 89862 - DNA, 6 bp, Unknown
  misc_feature (1)..( 6): Result.001 file - promoters60/1008983
tctatc

SEQ ID NO: 89863 - DNA, 6 bp, Unknown
  misc_feature (1)..( 6): Result.001 file - promoters60/1008983
tctatc

SEQ ID NO: 89864 - DNA, 7 bp, Unknown
  misc_feature (1)..( 7): Result.001 file - promoters60/1008983
aatatct

SEQ ID NO: 89865 - DNA, 7 bp, Unknown
  misc_feature (1)..( 7): Result.001 file - promoters60/1008983
aatatct

SEQ ID NO: 89866 - DNA, 7 bp, Unknown
  misc_feature (1)..( 7): Result.001 file - promoters60/1008983
ttagccc

SEQ ID NO: 89867 - DNA, 7 bp, Unknown
  misc_feature (1)..( 7): Result.001 file - promoters60/1008983
ttaaccc

SEQ ID NO: 89868 - DNA, 6 bp, Unknown
  misc_feature (1)..( 6): Result.001 file - promoters60/1008983
ttctta

SEQ ID NO: 89869 - DNA, 6 bp, Unknown
  misc_feature (1)..( 6): Result.001 file - promoters60/1008983
ttctta

SEQ ID NO: 89870 - DNA, 8 bp, Unknown
  misc_feature (1)..( 8): Result.001 file - promoters60/1008983
atgatttc

SEQ ID NO: 89871 - DNA, 8 bp, Unknown
  misc_feature (1)..( 8): Result.001 file - promoters60/1008983
atgttttc

SEQ ID NO: 89872 - DNA, 7 bp, Unknown
  misc_feature (1)..( 7): Result.001 file - promoters60/1008983
atttttc

SEQ ID NO: 89873 - DNA, 7 bp, Unknown
  misc_feature (1)..( 7): Result.001 file - promoters60/1008983
atttttc

SEQ ID NO: 89874 - DNA, 8 bp, Unknown
  misc_feature (1)..( 8): Result.001 file - promoters60/1008983
agaagagg

SEQ ID NO: 89875 - DNA, 8 bp, Unknown
  misc_feature (1)..( 8): Result.001 file - promoters60/1008983
agaacagg

SEQ ID NO: 89876 - DNA, 6 bp, Unknown
  misc_feature (1)..( 6): Result.001 file - promoters60/1008983
tgatcg

SEQ ID NO: 89877 - DNA, 6 bp, Unknown
  misc_feature (1)..( 6): Result.001 file - promoters60/1008983
tgatcg

SEQ ID NO: 89878 - DNA, 6 bp, Unknown
  misc_feature (1)..( 6): Result.001 file - promoters60/1008983
aatgcc

SEQ ID NO: 89879 - DNA, 6 bp, Unknown
  misc_feature (1)..( 6): Result.001 file - promoters60/1008983
aatgcc

SEQ ID NO: 89880 - DNA, 6 bp, Unknown
  misc_feature (1)..( 6): Result.001 file - promoters60/1008983
tgctga

SEQ ID NO: 89881 - DNA, 6 bp, Unknown
  misc_feature (1)..( 6): Result.001 file - promoters60/1008983
tgctga

SEQ ID NO: 89882 - DNA, 7 bp, Unknown
  misc_feature (1)..( 7): Result.001 file - promoters60/1008983
ccgtgtt

SEQ ID NO: 89883 - DNA, 7 bp, Unknown
  misc_feature (1)..( 7): Result.001 file - promoters60/1009030
ccgagtt

SEQ ID NO: 89884 - DNA, 11 bp, Unknown
  misc_feature (1)..( 11): Result.001 file - promoters60/1009030
ttaaagcaaaa

SEQ ID NO: 89885 - DNA, 11 bp, Unknown
  misc_feature (1)..( 11): Result.001 file - promoters60/1009030
atggagcaaat

SEQ ID NO: 89886 - DNA, 11 bp, Unknown
  misc_feature (1)..( 11): Result.001 file - promoters60/1009030
ataaaacaaaa

SEQ ID NO: 89887 - DNA, 11 bp, Unknown
  misc_feature (1)..( 11): Result.001 file - promoters60/1009030
ttgaaataaaa

SEQ ID NO: 89888 - DNA, 11 bp, Unknown
  misc_feature (1)..( 11): Result.001 file - promoters60/1009030
acaaaacatcc

SEQ ID NO: 89889 - DNA, 11 bp, Unknown
  misc_feature (1)..( 11): Result.001 file - promoters60/1009030
ataagacagta

SEQ ID NO: 89890 - DNA, 11 bp, Unknown
  misc_feature (1)..( 11): Result.001 file - promoters60/1009030
gcaatcatggt

SEQ ID NO: 89891 - DNA, 11 bp, Unknown
  misc_feature (1)..( 11): Result.001 file - promoters60/1009030
ataataatgtc

SEQ ID NO: 89892 - DNA, 11 bp, Unknown
  misc_feature (1)..( 11): Result.001 file - promoters60/1009030
gcagtcaaaag

SEQ ID NO: 89893 - DNA, 11 bp, Unknown
  misc_feature (1)..( 11): Result.001 file - promoters60/1009030
ataatcatagc

SEQ ID NO: 89894 - DNA, 11 bp, Unknown
  misc_feature (1)..( 11): Result.001 file - promoters60/1009030
ttaataaaaat

SEQ ID NO: 89895 - DNA, 11 bp, Unknown
  misc_feature (1)..( 11): Result.001 file - promoters60/1009030
atattaatcga

SEQ ID NO: 89896 - DNA, 11 bp, Unknown
  misc_feature (1)..( 11): Result.001 file - promoters60/1009030
gcaaaacacat

SEQ ID NO: 89897 - DNA, 11 bp, Unknown
  misc_feature (1)..( 11): Result.001 file - promoters60/1009030
acaaaacatcc

SEQ ID NO: 89898 - DNA, 11 bp, Unknown
  misc_feature (1)..( 11): Result.001 file - promoters60/1009030
ataaaacaaaa

SEQ ID NO: 89899 - DNA, 11 bp, Unknown
  misc_feature (1)..( 11): Result.001 file - promoters60/1009030
agcaaataaat

SEQ ID NO: 89900 - DNA, 11 bp, Unknown
  misc_feature (1)..( 11): Result.001 file - promoters60/1009030
ataaaattaat

SEQ ID NO: 89901 - DNA, 11 bp, Unknown
  misc_feature (1)..( 11): Result.001 file - promoters60/1009053
ataagacagta

SEQ ID NO: 89902 - DNA, 8 bp, Unknown
  misc_feature (1)..( 8): Result.001 file - promoters60/1009053
atattact

SEQ ID NO: 89903 - DNA, 8 bp, Unknown
  misc_feature (1)..( 8): Result.001 file - promoters60/1009053
atactact

SEQ ID NO: 89904 - DNA, 7 bp, Unknown
  misc_feature (1)..( 7): Result.001 file - promoters60/1009053
caaatac

SEQ ID NO: 89905 - DNA, 7 bp, Unknown
  misc_feature (1)..( 7): Result.001 file - promoters60/1009053
caattac

SEQ ID NO: 89906 - DNA, 11 bp, Unknown
  misc_feature (1)..( 11): Result.001 file - promoters60/1009053
tatattaaata

SEQ ID NO: 89907 - DNA, 11 bp, Unknown
  misc_feature (1)..( 11): Result.001 file - promoters60/1009053
tatattttttt

SEQ ID NO: 89908 - DNA, 11 bp, Unknown
  misc_feature (1)..( 11): Result.001 file - promoters60/1009053
gatattttttt

SEQ ID NO: 89909 - DNA, 6 bp, Unknown
  misc_feature (1)..( 6): Result.001 file - promoters60/1009053
tatatg

SEQ ID NO: 89910 - DNA, 6 bp, Unknown
  misc_feature (1)..( 6): Result.001 file - promoters60/1009053
tatatg

SEQ ID NO: 89911 - DNA, 6 bp, Unknown
  misc_feature (1)..( 6): Result.001 file - promoters60/1009053
ttcaaa

SEQ ID NO: 89912 - DNA, 6 bp, Unknown
  misc_feature (1)..( 6): Result.001 file - promoters60/1009053
ttcaaa

SEQ ID NO: 89913 - DNA, 9 bp, Unknown
  misc_feature (1)..( 9): Result.001 file - promoters60/1009053
atactctca

SEQ ID NO: 89914 - DNA, 9 bp, Unknown
  misc_feature (1)..( 9): Result.001 file - promoters60/1009053
atattctca

SEQ ID NO: 89915 - DNA, 6 bp, Unknown
  misc_feature (1)..( 6): Result.001 file - promoters60/1009053
tcaaac

SEQ ID NO: 89916 - DNA, 6 bp, Unknown
  misc_feature (1)..( 6): Result.001 file - promoters60/1009053
tcaaac

SEQ ID NO: 89917 - DNA, 6 bp, Unknown
  misc_feature (1)..( 6): Result.001 file - promoters60/1009053
ttttct

SEQ ID NO: 89918 - DNA, 6 bp, Unknown
  misc_feature (1)..( 6): Result.001 file - promoters60/1009053
ttttct

SEQ ID NO: 89919 - DNA, 7 bp, Unknown
  misc_feature (1)..( 7): Result.001 file - promoters60/1009053
gaattca

SEQ ID NO: 89920 - DNA, 7 bp, Unknown
  misc_feature (1)..( 7): Result.001 file - promoters60/1009053
gaaatca

SEQ ID NO: 89921 - DNA, 6 bp, Unknown
  misc_feature (1)..( 6): Result.001 file - promoters60/1009053
atcttg

SEQ ID NO: 89922 - DNA, 6 bp, Unknown
  misc_feature (1)..( 6): Result.001 file - promoters60/1009053
atcttg

SEQ ID NO: 89923 - DNA, 6 bp, Unknown
  misc_feature (1)..( 6): Result.001 file - promoters60/1009053
acacaa

SEQ ID NO: 89924 - DNA, 6 bp, Unknown
  misc_feature (1)..( 6): Result.001 file - promoters60/1009053
acacaa

SEQ ID NO: 89925 - DNA, 12 bp, Unknown
  misc_feature (1)..( 12): Result.001 file - promoters60/1009053
atgttttcaata

SEQ ID NO: 89926 - DNA, 12 bp, Unknown
  misc_feature (1)..( 12): Result.001 file - promoters60/1009053
atttttttaata

SEQ ID NO: 89927 - DNA, 12 bp, Unknown
  misc_feature (1)..( 12): Result.001 file - promoters60/1009053
atattttttttt

SEQ ID NO: 89928 - DNA, 7 bp, Unknown
  misc_feature (1)..( 7): Result.001 file - promoters60/1009053
actattc

SEQ ID NO: 89929 - DNA, 7 bp, Unknown
  misc_feature (1)..( 7): Result.001 file - promoters60/1009053
actcttc

SEQ ID NO: 89930 - DNA, 11 bp, Unknown
  misc_feature (1)..( 11): Result.001 file - promoters60/1009053
accggttatta

SEQ ID NO: 89931 - DNA, 11 bp, Unknown
  misc_feature (1)..( 11): Result.001 file - promoters60/1009053
accggatatta

SEQ ID NO: 89932 - DNA, 6 bp, Unknown
  misc_feature (1)..( 6): Result.001 file - promoters60/1009053
tactgt

SEQ ID NO: 89933 - DNA, 6 bp, Unknown
  misc_feature (1)..( 6): Result.001 file - promoters60/1009053
tactgt

SEQ ID NO: 89934 - DNA, 9 bp, Unknown
  misc_feature (1)..( 9): Result.001 file - promoters60/1009053
tcaaaattt

SEQ ID NO: 89935 - DNA, 9 bp, Unknown
  misc_feature (1)..( 9): Result.001 file - promoters60/1009053
tcagaattt

SEQ ID NO: 89936 - DNA, 6 bp, Unknown
  misc_feature (1)..( 6): Result.001 file - promoters60/1009053
ttgaaa

SEQ ID NO: 89937 - DNA, 6 bp, Unknown
  misc_feature (1)..( 6): Result.001 file - promoters60/1009053
ttgaaa

SEQ ID NO: 89938 - DNA, 7 bp, Unknown
  misc_feature (1)..( 7): Result.001 file - promoters60/1009053
cttctcc

SEQ ID NO: 89939 - DNA, 7 bp, Unknown
  misc_feature (1)..( 7): Result.001 file - promoters60/1009053
cttgtcc

SEQ ID NO: 89940 - DNA, 7 bp, Unknown
  misc_feature (1)..( 7): Result.001 file - promoters60/1009053
ttcatgt

SEQ ID NO: 89941 - DNA, 7 bp, Unknown
  misc_feature (1)..( 7): Result.001 file - promoters60/1009053
ttcatgt

SEQ ID NO: 89942 - DNA, 7 bp, Unknown
  misc_feature (1)..( 7): Result.001 file - promoters60/1009053
aagcttt

SEQ ID NO: 89943 - DNA, 7 bp, Unknown
  misc_feature (1)..( 7): Result.001 file - promoters60/1009053
aagattt

SEQ ID NO: 89944 - DNA, 7 bp, Unknown
  misc_feature (1)..( 7): Result.001 file - promoters60/1009053
tacctca

SEQ ID NO: 89945 - DNA, 7 bp, Unknown
  misc_feature (1)..( 7): Result.001 file - promoters60/1009053
tacctca

SEQ ID NO: 89946 - DNA, 7 bp, Unknown
  misc_feature (1)..( 7): Result.001 file - promoters60/1009053
ttttata

SEQ ID NO: 89947 - DNA, 7 bp, Unknown
  misc_feature (1)..( 7): Result.001 file - promoters60/1009053
tttgata

SEQ ID NO: 89948 - DNA, 9 bp, Unknown
  misc_feature (1)..( 9): Result.001 file - promoters60/1009053
catccttat

SEQ ID NO: 89949 - DNA, 9 bp, Unknown
  misc_feature (1)..( 9): Result.001 file - promoters60/1009086
catcattat

SEQ ID NO: 89950 - DNA, 8 bp, Unknown
  misc_feature (1)..( 8): Result.001 file - promoters60/1009086
ataaataa

SEQ ID NO: 89951 - DNA, 8 bp, Unknown
  misc_feature (1)..( 8): Result.001 file - promoters60/1009086
atatataa

SEQ ID NO: 89952 - DNA, 6 bp, Unknown
  misc_feature (1)..( 6): Result.001 file - promoters60/1009086
aattat

SEQ ID NO: 89953 - DNA, 6 bp, Unknown
  misc_feature (1)..( 6): Result.001 file - promoters60/1009086
aattat

SEQ ID NO: 89954 - DNA, 6 bp, Unknown
  misc_feature (1)..( 6): Result.001 file - promoters60/1009086
tttgtt

SEQ ID NO: 89955 - DNA, 6 bp, Unknown
  misc_feature (1)..( 6): Result.001 file - promoters60/1009086
tttgtt

SEQ ID NO: 89956 - DNA, 6 bp, Unknown
  misc_feature (1)..( 6): Result.001 file - promoters60/1009086
aaattg

SEQ ID NO: 89957 - DNA, 6 bp, Unknown
  misc_feature (1)..( 6): Result.001 file - promoters60/1009086
aaattg

SEQ ID NO: 89958 - DNA, 7 bp, Unknown
  misc_feature (1)..( 7): Result.001 file - promoters60/1009086
aaaaatt

SEQ ID NO: 89959 - DNA, 7 bp, Unknown
  misc_feature (1)..( 7): Result.001 file - promoters60/1009086
aaaaatt

SEQ ID NO: 89960 - DNA, 6 bp, Unknown
  misc_feature (1)..( 6): Result.001 file - promoters60/1009086
tttgat

SEQ ID NO: 89961 - DNA, 6 bp, Unknown
  misc_feature (1)..( 6): Result.001 file - promoters60/1009086
tttgat

SEQ ID NO: 89962 - DNA, 6 bp, Unknown
  misc_feature (1)..( 6): Result.001 file - promoters60/1009086
tcaaat

SEQ ID NO: 89963 - DNA, 6 bp, Unknown
  misc_feature (1)..( 6): Result.001 file - promoters60/1009086
tcaaat

SEQ ID NO: 89964 - DNA, 9 bp, Unknown
  misc_feature (1)..( 9): Result.001 file - promoters60/1009086
taaatatga

SEQ ID NO: 89965 - DNA, 9 bp, Unknown
  misc_feature (1)..( 9): Result.001 file - promoters60/1009086
caaagatga

SEQ ID NO: 89966 - DNA, 9 bp, Unknown
  misc_feature (1)..( 9): Result.001 file - promoters60/1009086
taaataagt

SEQ ID NO: 89967 - DNA, 7 bp, Unknown
  misc_feature (1)..( 7): Result.001 file - promoters60/1009086
aatactt

SEQ ID NO: 89968 - DNA, 7 bp, Unknown
  misc_feature (1)..( 7): Result.001 file - promoters60/1009086
aatactt

SEQ ID NO: 89969 - DNA, 7 bp, Unknown
  misc_feature (1)..( 7): Result.001 file - promoters60/1009086
aaactct

SEQ ID NO: 89970 - DNA, 7 bp, Unknown
  misc_feature (1)..( 7): Result.001 file - promoters60/1009086
aaagtct

SEQ ID NO: 89971 - DNA, 6 bp, Unknown
  misc_feature (1)..( 6): Result.001 file - promoters60/1009086
gttttt

SEQ ID NO: 89972 - DNA, 6 bp, Unknown
  misc_feature (1)..( 6): Result.001 file - promoters60/1009086
gttttt

SEQ ID NO: 89973 - DNA, 8 bp, Unknown
  misc_feature (1)..( 8): Result.001 file - promoters60/1009086
gaaacaga

SEQ ID NO: 89974 - DNA, 8 bp, Unknown
  misc_feature (1)..( 8): Result.001 file - promoters60/1009086
gaaacaga

SEQ ID NO: 89975 - DNA, 7 bp, Unknown
  misc_feature (1)..( 7): Result.001 file - promoters60/1009086
aaagctt

SEQ ID NO: 89976 - DNA, 7 bp, Unknown
  misc_feature (1)..( 7): Result.001 file - promoters60/1009086
aaagctt

SEQ ID NO: 89977 - DNA, 8 bp, Unknown
  misc_feature (1)..( 8): Result.001 file - promoters60/1009086
aatttgat

SEQ ID NO: 89978 - DNA, 8 bp, Unknown
  misc_feature (1)..( 8): Result.001 file - promoters60/1009086
aatatgat

SEQ ID NO: 89979 - DNA, 7 bp, Unknown
  misc_feature (1)..( 7): Result.001 file - promoters60/1009086
ctcaaca

SEQ ID NO: 89980 - DNA, 7 bp, Unknown
  misc_feature (1)..( 7): Result.001 file - promoters60/1009086
ctccaca

SEQ ID NO: 89981 - DNA, 8 bp, Unknown
  misc_feature (1)..( 8): Result.001 file - promoters60/1009086
ataaaaca

SEQ ID NO: 89982 - DNA, 8 bp, Unknown
  misc_feature (1)..( 8): Result.001 file - promoters60/1009086
ataagaca

SEQ ID NO: 89983 - DNA, 8 bp, Unknown
  misc_feature (1)..( 8): Result.001 file - promoters60/1009086
tatatttt

SEQ ID NO: 89984 - DNA, 8 bp, Unknown
  misc_feature (1)..( 8): Result.001 file - promoters60/1009086
tatttttt

SEQ ID NO: 89985 - DNA, 6 bp, Unknown
  misc_feature (1)..( 6): Result.001 file - promoters60/1009086
tatttc

SEQ ID NO: 89986 - DNA, 6 bp, Unknown
  misc_feature (1)..( 6): Result.001 file - promoters60/1009086
tatttc

SEQ ID NO: 89987 - DNA, 8 bp, Unknown
  misc_feature (1)..( 8): Result.001 file - promoters60/1009086
atcatgaa

SEQ ID NO: 89988 - DNA, 8 bp, Unknown
  misc_feature (1)..( 8): Result.001 file - promoters60/1009086
atcaggaa

SEQ ID NO: 89989 - DNA, 8 bp, Unknown
  misc_feature (1)..( 8): Result.001 file - promoters60/1009086
tttaaaag

SEQ ID NO: 89990 - DNA, 8 bp, Unknown
  misc_feature (1)..( 8): Result.001 file - promoters60/1009086
tttaaaag

SEQ ID NO: 89991 - DNA, 6 bp, Unknown
  misc_feature (1)..( 6): Result.001 file - promoters60/1009086
aggttt

SEQ ID NO: 89992 - DNA, 6 bp, Unknown
  misc_feature (1)..( 6): Result.001 file - promoters60/1009136
aggttt

SEQ ID NO: 89993 - DNA, 8 bp, Unknown
  misc_feature (1)..( 8): Result.001 file - promoters60/1009136
caaaccaa

SEQ ID NO: 89994 - DNA, 8 bp, Unknown
  misc_feature (1)..( 8): Result.001 file - promoters60/1009136
caaaacaa

SEQ ID NO: 89995 - DNA, 8 bp, Unknown
  misc_feature (1)..( 8): Result.001 file - promoters60/1009136
aaaaacaa

SEQ ID NO: 89996 - DNA, 8 bp, Unknown
  misc_feature (1)..( 8): Result.001 file - promoters60/1009136
taaaccaa

SEQ ID NO: 89997 - DNA, 8 bp, Unknown
  misc_feature (1)..( 8): Result.001 file - promoters60/1009136
tttcaatt

SEQ ID NO: 89998 - DNA, 8 bp, Unknown
  misc_feature (1)..( 8): Result.001 file - promoters60/1009136
attcaatg

SEQ ID NO: 89999 - DNA, 8 bp, Unknown
  misc_feature (1)..( 8): Result.001 file - promoters60/1009136
ttttaatt

SEQ ID NO: 90000 - DNA, 8 bp, Unknown
  misc_feature (1)..( 8): Result.001 file - promoters60/1009136
attcaact

SEQ ID NO: 90001 - DNA, 11 bp, Unknown
  misc_feature (1)..( 11): Result.001 file - promoters60/1009136
taggaaataaa

SEQ ID NO: 90002 - DNA, 11 bp, Unknown
  misc_feature (1)..( 11): Result.001 file - promoters60/1009136
actaaaataac

SEQ ID NO: 90003 - DNA, 11 bp, Unknown
  misc_feature (1)..( 11): Result.001 file - promoters60/1009136
acagaaataaa

SEQ ID NO: 90004 - DNA, 11 bp, Unknown
  misc_feature (1)..( 11): Result.001 file - promoters60/1009146
acacaaatatg

SEQ ID NO: 90005 - DNA, 8 bp, Unknown
  misc_feature (1)..( 8): Result.001 file - promoters60/1009146
caaatttt

SEQ ID NO: 90006 - DNA, 8 bp, Unknown
  misc_feature (1)..( 8): Result.001 file - promoters60/1009146
caattttt

SEQ ID NO: 90007 - DNA, 7 bp, Unknown
  misc_feature (1)..( 7): Result.001 file - promoters60/1009146
agacaag

SEQ ID NO: 90008 - DNA, 7 bp, Unknown
  misc_feature (1)..( 7): Result.001 file - promoters60/1009146
agagaag

SEQ ID NO: 90009 - DNA, 8 bp, Unknown
  misc_feature (1)..( 8): Result.001 file - promoters60/1009146
aaagcgac

SEQ ID NO: 90010 - DNA, 8 bp, Unknown
  misc_feature (1)..( 8): Result.001 file - promoters60/1009146
aaagtgac

SEQ ID NO: 90011 - DNA, 8 bp, Unknown
  misc_feature (1)..( 8): Result.001 file - promoters60/1009146
aggggaat

SEQ ID NO: 90012 - DNA, 8 bp, Unknown
  misc_feature (1)..( 8): Result.001 file - promoters60/1009146
aggtgaat

SEQ ID NO: 90013 - DNA, 7 bp, Unknown
  misc_feature (1)..( 7): Result.001 file - promoters60/1009146
gtttttg

SEQ ID NO: 90014 - DNA, 7 bp, Unknown
  misc_feature (1)..( 7): Result.001 file - promoters60/1009146
gttcttg

SEQ ID NO: 90015 - DNA, 13 bp, Unknown
  misc_feature (1)..( 13): Result.001 file - promoters60/1009146
ttgaatcaatatt

SEQ ID NO: 90016 - DNA, 13 bp, Unknown
  misc_feature (1)..( 13): Result.001 file - promoters60/1009146
ttgattcaaaatt

SEQ ID NO: 90017 - DNA, 7 bp, Unknown
  misc_feature (1)..( 7): Result.001 file - promoters60/1009146
tggattt

SEQ ID NO: 90018 - DNA, 7 bp, Unknown
  misc_feature (1)..( 7): Result.001 file - promoters60/1009146
tggattt

SEQ ID NO: 90019 - DNA, 6 bp, Unknown
  misc_feature (1)..( 6): Result.001 file - promoters60/1009146
aagatt

SEQ ID NO: 90020 - DNA, 6 bp, Unknown
  misc_feature (1)..( 6): Result.001 file - promoters60/1009146
aagatt

SEQ ID NO: 90021 - DNA, 6 bp, Unknown
  misc_feature (1)..( 6): Result.001 file - promoters60/1009146
ttggtt

SEQ ID NO: 90022 - DNA, 6 bp, Unknown
  misc_feature (1)..( 6): Result.001 file - promoters60/1009146
ttggtt

SEQ ID NO: 90023 - DNA, 6 bp, Unknown
  misc_feature (1)..( 6): Result.001 file - promoters60/1009146
ttaacc

SEQ ID NO: 90024 - DNA, 6 bp, Unknown
  misc_feature (1)..( 6): Result.001 file - promoters60/1009146
ttaacc

SEQ ID NO: 90025 - DNA, 7 bp, Unknown
  misc_feature (1)..( 7): Result.001 file - promoters60/1009146
ctcactc

SEQ ID NO: 90026 - DNA, 7 bp, Unknown
  misc_feature (1)..( 7): Result.001 file - promoters60/1009146
ctcgctc

SEQ ID NO: 90027 - DNA, 6 bp, Unknown
  misc_feature (1)..( 6): Result.001 file - promoters60/1009146
atttct

SEQ ID NO: 90028 - DNA, 6 bp, Unknown
  misc_feature (1)..( 6): Result.001 file - promoters60/1009211
atttct

SEQ ID NO: 90029 - DNA, 15 bp, Unknown
  misc_feature (1)..( 15): Result.001 file - promoters60/1009211
acaatgggctgggcc

SEQ ID NO: 90030 - DNA, 15 bp, Unknown
  misc_feature (1)..( 15): Result.001 file - promoters60/1009211
attttgggcttctta

SEQ ID NO: 90031 - DNA, 15 bp, Unknown
  misc_feature (1)..( 15): Result.001 file - promoters60/1009211
taattgggcttttta

SEQ ID NO: 90032 - DNA, 15 bp, Unknown
  misc_feature (1)..( 15): Result.001 file - promoters60/1009211
tgattggggttacaa

SEQ ID NO: 90033 - DNA, 15 bp, Unknown
  misc_feature (1)..( 15): Result.001 file - promoters60/1009211
caattgggattattt

SEQ ID NO: 90034 - DNA, 16 bp, Unknown
  misc_feature (1)..( 16): Result.001 file - promoters60/1009234
tgattgtggtaaaaag

SEQ ID NO: 90035 - DNA, 12 bp, Unknown
  misc_feature (1)..( 12): Result.001 file - promoters60/1009234
ttaaatgaagat

SEQ ID NO: 90036 - DNA, 12 bp, Unknown
  misc_feature (1)..( 12): Result.001 file - promoters60/1009234
aataatgatgat

SEQ ID NO: 90037 - DNA, 12 bp, Unknown
  misc_feature (1)..( 12): Result.001 file - promoters60/1009234
gacaatgaattg

SEQ ID NO: 90038 - DNA, 12 bp, Unknown
  misc_feature (1)..( 12): Result.001 file - promoters60/1009234
ttacatgaacag

SEQ ID NO: 90039 - DNA, 7 bp, Unknown
  misc_feature (1)..( 7): Result.001 file - promoters60/1009234
caagtat

SEQ ID NO: 90040 - DNA, 7 bp, Unknown
  misc_feature (1)..( 7): Result.001 file - promoters60/1009234
caaatat

SEQ ID NO: 90041 - DNA, 7 bp, Unknown
  misc_feature (1)..( 7): Result.001 file - promoters60/1009234
caaatag

SEQ ID NO: 90042 - DNA, 7 bp, Unknown
  misc_feature (1)..( 7): Result.001 file - promoters60/1009354
caattag

SEQ ID NO: 90043 - DNA, 9 bp, Unknown
  misc_feature (1)..( 9): Result.001 file - promoters60/1009354
attgaaata

SEQ ID NO: 90044 - DNA, 9 bp, Unknown
  misc_feature (1)..( 9): Result.001 file - promoters60/1009354
atttaaata

SEQ ID NO: 90045 - DNA, 6 bp, Unknown
  misc_feature (1)..( 6): Result.001 file - promoters60/1009354
ttattt

SEQ ID NO: 90046 - DNA, 6 bp, Unknown
  misc_feature (1)..( 6): Result.001 file - promoters60/1009354
ttattt

SEQ ID NO: 90047 - DNA, 6 bp, Unknown
  misc_feature (1)..( 6): Result.001 file - promoters60/1009354
ataatt

SEQ ID NO: 90048 - DNA, 6 bp, Unknown
  misc_feature (1)..( 6): Result.001 file - promoters60/1009354
ataatt

SEQ ID NO: 90049 - DNA, 8 bp, Unknown
  misc_feature (1)..( 8): Result.001 file - promoters60/1009354
taagaact

SEQ ID NO: 90050 - DNA, 8 bp, Unknown
  misc_feature (1)..( 8): Result.001 file - promoters60/1009354
taagaaat

SEQ ID NO: 90051 - DNA, 8 bp, Unknown
  misc_feature (1)..( 8): Result.001 file - promoters60/1009354
gaagaact

SEQ ID NO: 90052 - DNA, 7 bp, Unknown
  misc_feature (1)..( 7): Result.001 file - promoters60/1009354
accgtct

SEQ ID NO: 90053 - DNA, 7 bp, Unknown
  misc_feature (1)..( 7): Result.001 file - promoters60/1009354
accctct

SEQ ID NO: 90054 - DNA, 6 bp, Unknown
  misc_feature (1)..( 6): Result.001 file - promoters60/1009354
ttaaat

SEQ ID NO: 90055 - DNA, 6 bp, Unknown
  misc_feature (1)..( 6): Result.001 file - promoters60/1009354
ttaaat

SEQ ID NO: 90056 - DNA, 6 bp, Unknown
  misc_feature (1)..( 6): Result.001 file - promoters60/1009354
ttttgt

SEQ ID NO: 90057 - DNA, 6 bp, Unknown
  misc_feature (1)..( 6): Result.001 file - promoters60/1009354
ttttgt

SEQ ID NO: 90058 - DNA, 6 bp, Unknown
  misc_feature (1)..( 6): Result.001 file - promoters60/1009354
agtaat

SEQ ID NO: 90059 - DNA, 6 bp, Unknown
  misc_feature (1)..( 6): Result.001 file - promoters60/1009354
agtaat

SEQ ID NO: 90060 - DNA, 6 bp, Unknown
  misc_feature (1)..( 6): Result.001 file - promoters60/1009354
atagag

SEQ ID NO: 90061 - DNA, 6 bp, Unknown
  misc_feature (1)..( 6): Result.001 file - promoters60/1009354
atagag

SEQ ID NO: 90062 - DNA, 7 bp, Unknown
  misc_feature (1)..( 7): Result.001 file - promoters60/1009354
atgtggc

SEQ ID NO: 90063 - DNA, 7 bp, Unknown
  misc_feature (1)..( 7): Result.001 file - promoters60/1009354
atgtggc

SEQ ID NO: 90064 - DNA, 7 bp, Unknown
  misc_feature (1)..( 7): Result.001 file - promoters60/1009354
gatactt

SEQ ID NO: 90065 - DNA, 7 bp, Unknown
  misc_feature (1)..( 7): Result.001 file - promoters60/1009354
gattctt

SEQ ID NO: 90066 - DNA, 7 bp, Unknown
  misc_feature (1)..( 7): Result.001 file - promoters60/1009354
gattcta

SEQ ID NO: 90067 - DNA, 9 bp, Unknown
  misc_feature (1)..( 9): Result.001 file - promoters60/1009354
aatgaagat

SEQ ID NO: 90068 - DNA, 9 bp, Unknown
  misc_feature (1)..( 9): Result.001 file - promoters60/1009354
aatgatgat

SEQ ID NO: 90069 - DNA, 7 bp, Unknown
  misc_feature (1)..( 7): Result.001 file - promoters60/1009354
acacgtc

SEQ ID NO: 90070 - DNA, 7 bp, Unknown
  misc_feature (1)..( 7): Result.001 file - promoters60/1009354
acatgtc

SEQ ID NO: 90071 - DNA, 8 bp, Unknown
  misc_feature (1)..( 8): Result.001 file - promoters60/1009354
gtgatcca

SEQ ID NO: 90072 - DNA, 8 bp, Unknown
  misc_feature (1)..( 8): Result.001 file - promoters60/1009354
gtggtcca

SEQ ID NO: 90073 - DNA, 6 bp, Unknown
  misc_feature (1)..( 6): Result.001 file - promoters60/1009354
aaactt

SEQ ID NO: 90074 - DNA, 6 bp, Unknown
  misc_feature (1)..( 6): Result.001 file - promoters60/1009354
aaactt

SEQ ID NO: 90075 - DNA, 7 bp, Unknown
  misc_feature (1)..( 7): Result.001 file - promoters60/1009354
ttctaaa

SEQ ID NO: 90076 - DNA, 7 bp, Unknown
  misc_feature (1)..( 7): Result.001 file - promoters60/1009354
ttcaaaa

SEQ ID NO: 90077 - DNA, 6 bp, Unknown
  misc_feature (1)..( 6): Result.001 file - promoters60/1009354
taagaa

SEQ ID NO: 90078 - DNA, 6 bp, Unknown
  misc_feature (1)..( 6): Result.001 file - promoters60/1009354
taagaa

SEQ ID NO: 90079 - DNA, 8 bp, Unknown
  misc_feature (1)..( 8): Result.001 file - promoters60/1009354
gaaaatct

SEQ ID NO: 90080 - DNA, 8 bp, Unknown
  misc_feature (1)..( 8): Result.001 file - promoters60/1009354
gaagatct

SEQ ID NO: 90081 - DNA, 6 bp, Unknown
  misc_feature (1)..( 6): Result.001 file - promoters60/1009354
ttgtca

SEQ ID NO: 90082 - DNA, 6 bp, Unknown
  misc_feature (1)..( 6): Result.001 file - promoters60/1009354
ttgtca

SEQ ID NO: 90083 - DNA, 8 bp, Unknown
  misc_feature (1)..( 8): Result.001 file - promoters60/1009354
cataagta

SEQ ID NO: 90084 - DNA, 8 bp, Unknown
  misc_feature (1)..( 8): Result.001 file - promoters60/1009354
cattagta

SEQ ID NO: 90085 - DNA, 8 bp, Unknown
  misc_feature (1)..( 8): Result.001 file - promoters60/1009354
ggtgtata

SEQ ID NO: 90086 - DNA, 8 bp, Unknown
  misc_feature (1)..( 8): Result.001 file - promoters60/1009354
ggtggata

SEQ ID NO: 90087 - DNA, 7 bp, Unknown
  misc_feature (1)..( 7): Result.001 file - promoters60/1009354
cacacgt

SEQ ID NO: 90088 - DNA, 7 bp, Unknown
  misc_feature (1)..( 7): Result.001 file - promoters60/1009354
cacacgt

SEQ ID NO: 90089 - DNA, 13 bp, Unknown
  misc_feature (1)..( 13): Result.001 file - promoters60/1009354
taaccaaagattc

SEQ ID NO: 90090 - DNA, 13 bp, Unknown
  misc_feature (1)..( 13): Result.001 file - promoters60/1009430
taatcaaaaattc

SEQ ID NO: 90091 - DNA, 10 bp, Unknown
  misc_feature (1)..( 10): Result.001 file - promoters60/1009430
attttatata

SEQ ID NO: 90092 - DNA, 10 bp, Unknown
  misc_feature (1)..( 10): Result.001 file - promoters60/1009430
ctcttaaata

SEQ ID NO: 90093 - DNA, 10 bp, Unknown
  misc_feature (1)..( 10): Result.001 file - promoters60/1009430
ctctgaaaca

SEQ ID NO: 90094 - DNA, 10 bp, Unknown
  misc_feature (1)..( 10): Result.001 file - promoters60/1009430
agacaatttt

SEQ ID NO: 90095 - DNA, 10 bp, Unknown
  misc_feature (1)..( 10): Result.001 file - promoters60/1009430
agaaaatttc

SEQ ID NO: 90096 - DNA, 10 bp, Unknown
  misc_feature (1)..( 10): Result.001 file - promoters60/1009430
aaaaaaattc

SEQ ID NO: 90097 - DNA, 10 bp, Unknown
  misc_feature (1)..( 10): Result.001 file - promoters60/1009430
ttcaaagttc

SEQ ID NO: 90098 - DNA, 8 bp, Unknown
  misc_feature (1)..( 8): Result.001 file - promoters60/1009430
cttcttct

SEQ ID NO: 90099 - DNA, 8 bp, Unknown
  misc_feature (1)..( 8): Result.001 file - promoters60/1009430
cttcctct

SEQ ID NO: 90100 - DNA, 8 bp, Unknown
  misc_feature (1)..( 8): Result.001 file - promoters60/1009616
attcatct

SEQ ID NO: 90101 - DNA, 10 bp, Unknown
  misc_feature (1)..( 10): Result.001 file - promoters60/1009616
ttaaacaaaa

SEQ ID NO: 90102 - DNA, 10 bp, Unknown
  misc_feature (1)..( 10): Result.001 file - promoters60/1009616
ctaaacaaaa

SEQ ID NO: 90103 - DNA, 10 bp, Unknown
  misc_feature (1)..( 10): Result.001 file - promoters60/1009616
gtaaccaaat

SEQ ID NO: 90104 - DNA, 10 bp, Unknown
  misc_feature (1)..( 10): Result.001 file - promoters60/1009616
tcaaacacta

SEQ ID NO: 90105 - DNA, 10 bp, Unknown
  misc_feature (1)..( 10): Result.001 file - promoters60/1009616
ctagacagag

SEQ ID NO: 90106 - DNA, 9 bp, Unknown
  misc_feature (1)..( 9): Result.001 file - promoters60/1009616
gaaaacaat

SEQ ID NO: 90107 - DNA, 9 bp, Unknown
  misc_feature (1)..( 9): Result.001 file - promoters60/1009616
gaatacaat

SEQ ID NO: 90108 - DNA, 9 bp, Unknown
  misc_feature (1)..( 9): Result.001 file - promoters60/1009616
taatacaaa

SEQ ID NO: 90109 - DNA, 9 bp, Unknown
  misc_feature (1)..( 9): Result.001 file - promoters60/1009616
taacacaga

SEQ ID NO: 90110 - DNA, 14 bp, Unknown
  misc_feature (1)..( 14): Result.001 file - promoters60/1009616
aaagtataaacaca

SEQ ID NO: 90111 - DNA, 14 bp, Unknown
  misc_feature (1)..( 14): Result.001 file - promoters60/1009616
tatatattaacaca

SEQ ID NO: 90112 - DNA, 14 bp, Unknown
  misc_feature (1)..( 14): Result.001 file - promoters60/1009616
aaagtctaatacaa

SEQ ID NO: 90113 - DNA, 14 bp, Unknown
  misc_feature (1)..( 14): Result.001 file - promoters60/1009616
accaaatatacaaa

SEQ ID NO: 90114 - DNA, 14 bp, Unknown
  misc_feature (1)..( 14): Result.001 file - promoters60/1009616
aaaatctacgcata

SEQ ID NO: 90115 - DNA, 13 bp, Unknown
  misc_feature (1)..( 13): Result.001 file - promoters60/1009616
attattatgcatg

SEQ ID NO: 90116 - DNA, 13 bp, Unknown
  misc_feature (1)..( 13): Result.001 file - promoters60/1009616
tttataatgcaaa

SEQ ID NO: 90117 - DNA, 13 bp, Unknown
  misc_feature (1)..( 13): Result.001 file - promoters60/1009616
attactatttcaa

SEQ ID NO: 90118 - DNA, 13 bp, Unknown
  misc_feature (1)..( 13): Result.001 file - promoters60/1009616
atagaaatgaaaa

SEQ ID NO: 90119 - DNA, 20 bp, Unknown
  misc_feature (1)..( 20): Result.001 file - promoters60/1009616
acactaaaatagtttttttt

SEQ ID NO: 90120 - DNA, 20 bp, Unknown
  misc_feature (1)..( 20): Result.001 file - promoters60/1009616
acacttaaaaagtctttttt

SEQ ID NO: 90121 - DNA, 20 bp, Unknown
  misc_feature (1)..( 20): Result.001 file - promoters60/1009616
tgagatcaaaagtgaaaaca

SEQ ID NO: 90122 - DNA, 20 bp, Unknown
  misc_feature (1)..( 20): Result.001 file - promoters60/1009686
aaaattaaaaagaatacaaa

SEQ ID NO: 90123 - DNA, 7 bp, Unknown
  misc_feature (1)..( 7): Result.001 file - promoters60/1009686
tatgttt

SEQ ID NO: 90124 - DNA, 7 bp, Unknown
  misc_feature (1)..( 7): Result.001 file - promoters60/1009686
tattttt

SEQ ID NO: 90125 - DNA, 7 bp, Unknown
  misc_feature (1)..( 7): Result.001 file - promoters60/1009686
aaagttg

SEQ ID NO: 90126 - DNA, 7 bp, Unknown
  misc_feature (1)..( 7): Result.001 file - promoters60/1009686
aaatttg

SEQ ID NO: 90127 - DNA, 7 bp, Unknown
  misc_feature (1)..( 7): Result.001 file - promoters60/1009686
ttacata

SEQ ID NO: 90128 - DNA, 7 bp, Unknown
  misc_feature (1)..( 7): Result.001 file - promoters60/1009686
ttatata

SEQ ID NO: 90129 - DNA, 7 bp, Unknown
  misc_feature (1)..( 7): Result.001 file - promoters60/1009686
tagttaa

SEQ ID NO: 90130 - DNA, 7 bp, Unknown
  misc_feature (1)..( 7): Result.001 file - promoters60/1009686
tagttaa

SEQ ID NO: 90131 - DNA, 6 bp, Unknown
  misc_feature (1)..( 6): Result.001 file - promoters60/1009686
tgaaaa

SEQ ID NO: 90132 - DNA, 6 bp, Unknown
  misc_feature (1)..( 6): Result.001 file - promoters60/1009686
tgaaaa

SEQ ID NO: 90133 - DNA, 6 bp, Unknown
  misc_feature (1)..( 6): Result.001 file - promoters60/1009686
taaagt

SEQ ID NO: 90134 - DNA, 6 bp, Unknown
  misc_feature (1)..( 6): Result.001 file - promoters60/1009686
taaagt

SEQ ID NO: 90135 - DNA, 6 bp, Unknown
  misc_feature (1)..( 6): Result.001 file - promoters60/1009686
taattt

SEQ ID NO: 90136 - DNA, 6 bp, Unknown
  misc_feature (1)..( 6): Result.001 file - promoters60/1009686
taattt

SEQ ID NO: 90137 - DNA, 7 bp, Unknown
  misc_feature (1)..( 7): Result.001 file - promoters60/1009686
ttatgaa

SEQ ID NO: 90138 - DNA, 7 bp, Unknown
  misc_feature (1)..( 7): Result.001 file - promoters60/1009686
ttacgaa

SEQ ID NO: 90139 - DNA, 8 bp, Unknown
  misc_feature (1)..( 8): Result.001 file - promoters60/1009686
attcagtt

SEQ ID NO: 90140 - DNA, 8 bp, Unknown
  misc_feature (1)..( 8): Result.001 file - promoters60/1009686
attaagtc

SEQ ID NO: 90141 - DNA, 8 bp, Unknown
  misc_feature (1)..( 8): Result.001 file - promoters60/1009686
gttaagtc

SEQ ID NO: 90142 - DNA, 9 bp, Unknown
  misc_feature (1)..( 9): Result.001 file - promoters60/1009686
aattaaaaa

SEQ ID NO: 90143 - DNA, 9 bp, Unknown
  misc_feature (1)..( 9): Result.001 file - promoters60/1009686
aatcaaaaa

SEQ ID NO: 90144 - DNA, 9 bp, Unknown
  misc_feature (1)..( 9): Result.001 file - promoters60/1009686
aaacaatta

SEQ ID NO: 90145 - DNA, 9 bp, Unknown
  misc_feature (1)..( 9): Result.001 file - promoters60/1009686
aaataatta

SEQ ID NO: 90146 - DNA, 7 bp, Unknown
  misc_feature (1)..( 7): Result.001 file - promoters60/1009686
agtagtt

SEQ ID NO: 90147 - DNA, 7 bp, Unknown
  misc_feature (1)..( 7): Result.001 file - promoters60/1009686
agtggtt

SEQ ID NO: 90148 - DNA, 7 bp, Unknown
  misc_feature (1)..( 7): Result.001 file - promoters60/1009686
ctttctt

SEQ ID NO: 90149 - DNA, 7 bp, Unknown
  misc_feature (1)..( 7): Result.001 file - promoters60/1009686
cttcctt

SEQ ID NO: 90150 - DNA, 6 bp, Unknown
  misc_feature (1)..( 6): Result.001 file - promoters60/1009686
tttaca

SEQ ID NO: 90151 - DNA, 6 bp, Unknown
  misc_feature (1)..( 6): Result.001 file - promoters60/1009686
tttaca

SEQ ID NO: 90152 - DNA, 7 bp, Unknown
  misc_feature (1)..( 7): Result.001 file - promoters60/1009686
aataagg

SEQ ID NO: 90153 - DNA, 7 bp, Unknown
  misc_feature (1)..( 7): Result.001 file - promoters60/1009686
aattagg

SEQ ID NO: 90154 - DNA, 11 bp, Unknown
  misc_feature (1)..( 11): Result.001 file - promoters60/1009686
acagagaaata

SEQ ID NO: 90155 - DNA, 11 bp, Unknown
  misc_feature (1)..( 11): Result.001 file - promoters60/1009686
acaaagagata

SEQ ID NO: 90156 - DNA, 6 bp, Unknown
  misc_feature (1)..( 6): Result.001 file - promoters60/1009686
tcaaaa

SEQ ID NO: 90157 - DNA, 6 bp, Unknown
  misc_feature (1)..( 6): Result.001 file - promoters60/1009686
tcaaaa

SEQ ID NO: 90158 - DNA, 8 bp, Unknown
  misc_feature (1)..( 8): Result.001 file - promoters60/1009686
aagaggaa

SEQ ID NO: 90159 - DNA, 8 bp, Unknown
  misc_feature (1)..( 8): Result.001 file - promoters60/1009686
aagaagaa

SEQ ID NO: 90160 - DNA, 8 bp, Unknown
  misc_feature (1)..( 8): Result.001 file - promoters60/1009686
aagaggag

SEQ ID NO: 90161 - DNA, 8 bp, Unknown
  misc_feature (1)..( 8): Result.001 file - promoters60/1009752
aagcggag

SEQ ID NO: 90162 - DNA, 8 bp, Unknown
  misc_feature (1)..( 8): Result.001 file - promoters60/1009752
atttgaat

SEQ ID NO: 90163 - DNA, 8 bp, Unknown
  misc_feature (1)..( 8): Result.001 file - promoters60/1009752
atttcaat

SEQ ID NO: 90164 - DNA, 8 bp, Unknown
  misc_feature (1)..( 8): Result.001 file - promoters60/1009752
ttatttta

SEQ ID NO: 90165 - DNA, 8 bp, Unknown
  misc_feature (1)..( 8): Result.001 file - promoters60/1009752
atatttta

SEQ ID NO: 90166 - DNA, 8 bp, Unknown
  misc_feature (1)..( 8): Result.001 file - promoters60/1009752
ttaattta

SEQ ID NO: 90167 - DNA, 7 bp, Unknown
  misc_feature (1)..( 7): Result.001 file - promoters60/1009752
aaaaaat

SEQ ID NO: 90168 - DNA, 7 bp, Unknown
  misc_feature (1)..( 7): Result.001 file - promoters60/1009752
aaagaat

SEQ ID NO: 90169 - DNA, 6 bp, Unknown
  misc_feature (1)..( 6): Result.001 file - promoters60/1009752
aattag

SEQ ID NO: 90170 - DNA, 6 bp, Unknown
  misc_feature (1)..( 6): Result.001 file - promoters60/1009752
aattag

SEQ ID NO: 90171 - DNA, 8 bp, Unknown
  misc_feature (1)..( 8): Result.001 file - promoters60/1009752
aggatgtt

SEQ ID NO: 90172 - DNA, 8 bp, Unknown
  misc_feature (1)..( 8): Result.001 file - promoters60/1009752
aggttgtt

SEQ ID NO: 90173 - DNA, 6 bp, Unknown
  misc_feature (1)..( 6): Result.001 file - promoters60/1009752
taaacg

SEQ ID NO: 90174 - DNA, 6 bp, Unknown
  misc_feature (1)..( 6): Result.001 file - promoters60/1009752
taaacg

SEQ ID NO: 90175 - DNA, 6 bp, Unknown
  misc_feature (1)..( 6): Result.001 file - promoters60/1009752
ttaatt

SEQ ID NO: 90176 - DNA, 6 bp, Unknown
  misc_feature (1)..( 6): Result.001 file - promoters60/1009752
ttaatt

SEQ ID NO: 90177 - DNA, 7 bp, Unknown
  misc_feature (1)..( 7): Result.001 file - promoters60/1009752
taaaaat

SEQ ID NO: 90178 - DNA, 7 bp, Unknown
  misc_feature (1)..( 7): Result.001 file - promoters60/1009752
taacaat

SEQ ID NO: 90179 - DNA, 7 bp, Unknown
  misc_feature (1)..( 7): Result.001 file - promoters60/1009752
taacaac

SEQ ID NO: 90180 - DNA, 6 bp, Unknown
  misc_feature (1)..( 6): Result.001 file - promoters60/1009752
aaataa

SEQ ID NO: 90181 - DNA, 6 bp, Unknown
  misc_feature (1)..( 6): Result.001 file - promoters60/1009752
aaataa

SEQ ID NO: 90182 - DNA, 7 bp, Unknown
  misc_feature (1)..( 7): Result.001 file - promoters60/1009752
tttccct

SEQ ID NO: 90183 - DNA, 7 bp, Unknown
  misc_feature (1)..( 7): Result.001 file - promoters60/1009752
ttttcct

SEQ ID NO: 90184 - DNA, 6 bp, Unknown
  misc_feature (1)..( 6): Result.001 file - promoters60/1009752
tatttt

SEQ ID NO: 90185 - DNA, 6 bp, Unknown
  misc_feature (1)..( 6): Result.001 file - promoters60/1009752
tatttt

SEQ ID NO: 90186 - DNA, 6 bp, Unknown
  misc_feature (1)..( 6): Result.001 file - promoters60/1009752
atttaa

SEQ ID NO: 90187 - DNA, 6 bp, Unknown
  misc_feature (1)..( 6): Result.001 file - promoters60/1009752
atttaa

SEQ ID NO: 90188 - DNA, 6 bp, Unknown
  misc_feature (1)..( 6): Result.001 file - promoters60/1009752
taatta

SEQ ID NO: 90189 - DNA, 6 bp, Unknown
  misc_feature (1)..( 6): Result.001 file - promoters60/1009752
taatta

SEQ ID NO: 90190 - DNA, 7 bp, Unknown
  misc_feature (1)..( 7): Result.001 file - promoters60/1009752
gatgata

SEQ ID NO: 90191 - DNA, 7 bp, Unknown
  misc_feature (1)..( 7): Result.001 file - promoters60/1009752
gataata

SEQ ID NO: 90192 - DNA, 7 bp, Unknown
  misc_feature (1)..( 7): Result.001 file - promoters60/1009752
ttaaaaa

SEQ ID NO: 90193 - DNA, 7 bp, Unknown
  misc_feature (1)..( 7): Result.001 file - promoters60/1009752
ttacaaa

SEQ ID NO: 90194 - DNA, 6 bp, Unknown
  misc_feature (1)..( 6): Result.001 file - promoters60/1009752
aataaa

SEQ ID NO: 90195 - DNA, 6 bp, Unknown
  misc_feature (1)..( 6): Result.001 file - promoters60/1009752
aataaa

SEQ ID NO: 90196 - DNA, 7 bp, Unknown
  misc_feature (1)..( 7): Result.001 file - promoters60/1009752
tcctata

SEQ ID NO: 90197 - DNA, 7 bp, Unknown
  misc_feature (1)..( 7): Result.001 file - promoters60/1009834
tcctata

SEQ ID NO: 90198 - DNA, 9 bp, Unknown
  misc_feature (1)..( 9): Result.001 file - promoters60/1009834
aaggaaaga

SEQ ID NO: 90199 - DNA, 9 bp, Unknown
  misc_feature (1)..( 9): Result.001 file - promoters60/1009834
aagaaaaga

SEQ ID NO: 90200 - DNA, 7 bp, Unknown
  misc_feature (1)..( 7): Result.001 file - promoters60/1009834
ttttttc

SEQ ID NO: 90201 - DNA, 7 bp, Unknown
  misc_feature (1)..( 7): Result.001 file - promoters60/1009834
tttattc

SEQ ID NO: 90202 - DNA, 11 bp, Unknown
  misc_feature (1)..( 11): Result.001 file - promoters60/1009834
atattttggag

SEQ ID NO: 90203 - DNA, 11 bp, Unknown
  misc_feature (1)..( 11): Result.001 file - promoters60/1009834
atatttttgag

SEQ ID NO: 90204 - DNA, 7 bp, Unknown
  misc_feature (1)..( 7): Result.001 file - promoters60/1009834
ttcatta

SEQ ID NO: 90205 - DNA, 7 bp, Unknown
  misc_feature (1)..( 7): Result.001 file - promoters60/1009834
ttcttta

SEQ ID NO: 90206 - DNA, 7 bp, Unknown
  misc_feature (1)..( 7): Result.001 file - promoters60/1009834
aaacatt

SEQ ID NO: 90207 - DNA, 7 bp, Unknown
  misc_feature (1)..( 7): Result.001 file - promoters60/1009834
aaaaatt

SEQ ID NO: 90208 - DNA, 7 bp, Unknown
  misc_feature (1)..( 7): Result.001 file - promoters60/1009834
aaaaatt

SEQ ID NO: 90209 - DNA, 9 bp, Unknown
  misc_feature (1)..( 9): Result.001 file - promoters60/1009834
aaaaagagt

SEQ ID NO: 90210 - DNA, 9 bp, Unknown
  misc_feature (1)..( 9): Result.001 file - promoters60/1009834
aaaaaaagt

SEQ ID NO: 90211 - DNA, 7 bp, Unknown
  misc_feature (1)..( 7): Result.001 file - promoters60/1009834
gaaacaa

SEQ ID NO: 90212 - DNA, 7 bp, Unknown
  misc_feature (1)..( 7): Result.001 file - promoters60/1009834
gaaacaa

SEQ ID NO: 90213 - DNA, 8 bp, Unknown
  misc_feature (1)..( 8): Result.001 file - promoters60/1009834
ttacaata

SEQ ID NO: 90214 - DNA, 8 bp, Unknown
  misc_feature (1)..( 8): Result.001 file - promoters60/1009834
ttagaata

SEQ ID NO: 90215 - DNA, 9 bp, Unknown
  misc_feature (1)..( 9): Result.001 file - promoters60/1009834
atttgtttt

SEQ ID NO: 90216 - DNA, 9 bp, Unknown
  misc_feature (1)..( 9): Result.001 file - promoters60/1009834
attcgtttt

SEQ ID NO: 90217 - DNA, 7 bp, Unknown
  misc_feature (1)..( 7): Result.001 file - promoters60/1009834
tccgatt

SEQ ID NO: 90218 - DNA, 7 bp, Unknown
  misc_feature (1)..( 7): Result.001 file - promoters60/1009834
tcccatt

SEQ ID NO: 90219 - DNA, 7 bp, Unknown
  misc_feature (1)..( 7): Result.001 file - promoters60/1009834
attgttt

SEQ ID NO: 90220 - DNA, 7 bp, Unknown
  misc_feature (1)..( 7): Result.001 file - promoters60/1009834
atttttt

SEQ ID NO: 90221 - DNA, 6 bp, Unknown
  misc_feature (1)..( 6): Result.001 file - promoters60/1009834
tattaa

SEQ ID NO: 90222 - DNA, 6 bp, Unknown
  misc_feature (1)..( 6): Result.001 file - promoters60/1009834
tattaa

SEQ ID NO: 90223 - DNA, 6 bp, Unknown
  misc_feature (1)..( 6): Result.001 file - promoters60/1009834
taatat

SEQ ID NO: 90224 - DNA, 6 bp, Unknown
  misc_feature (1)..( 6): Result.001 file - promoters60/1009854
taatat

SEQ ID NO: 90225 - DNA, 13 bp, Unknown
  misc_feature (1)..( 13): Result.001 file - promoters60/1009854
attcattaacaaa

SEQ ID NO: 90226 - DNA, 13 bp, Unknown
  misc_feature (1)..( 13): Result.001 file - promoters60/1009854
attcataaaaaaa

SEQ ID NO: 90227 - DNA, 13 bp, Unknown
  misc_feature (1)..( 13): Result.001 file - promoters60/1009854
atttataaagaaa

SEQ ID NO: 90228 - DNA, 13 bp, Unknown
  misc_feature (1)..( 13): Result.001 file - promoters60/1009854
cagaaaaaagaaa

SEQ ID NO: 90229 - DNA, 8 bp, Unknown
  misc_feature (1)..( 8): Result.001 file - promoters60/1009854
taacaaat

SEQ ID NO: 90230 - DNA, 8 bp, Unknown
  misc_feature (1)..( 8): Result.001 file - promoters60/1009854
taaaaaaa

SEQ ID NO: 90231 - DNA, 8 bp, Unknown
  misc_feature (1)..( 8): Result.001 file - promoters60/1009854
gaaccaat

SEQ ID NO: 90232 - DNA, 8 bp, Unknown
  misc_feature (1)..( 8): Result.001 file - promoters60/1009854
gaaaaaag

SEQ ID NO: 90233 - DNA, 12 bp, Unknown
  misc_feature (1)..( 12): Result.001 file - promoters60/1009854
aactaattcaat

SEQ ID NO: 90234 - DNA, 12 bp, Unknown
  misc_feature (1)..( 12): Result.001 file - promoters60/1009854
gactaatgcaat

SEQ ID NO: 90235 - DNA, 12 bp, Unknown
  misc_feature (1)..( 12): Result.001 file - promoters60/1009854
aaccaatggttg

SEQ ID NO: 90236 - DNA, 13 bp, Unknown
  misc_feature (1)..( 13): Result.001 file - promoters60/1009854
atttctacaaaac

SEQ ID NO: 90237 - DNA, 13 bp, Unknown
  misc_feature (1)..( 13): Result.001 file - promoters60/1009854
attcctaaaaaat

SEQ ID NO: 90238 - DNA, 13 bp, Unknown
  misc_feature (1)..( 13): Result.001 file - promoters60/1009854
atggtcaaaaaag

SEQ ID NO: 90239 - DNA, 13 bp, Unknown
  misc_feature (1)..( 13): Result.001 file - promoters60/1009854
taaaataaatata

SEQ ID NO: 90240 - DNA, 10 bp, Unknown
  misc_feature (1)..( 10): Result.001 file - promoters60/1009854
aaataaaaca

SEQ ID NO: 90241 - DNA, 10 bp, Unknown
  misc_feature (1)..( 10): Result.001 file - promoters60/1009854
aaagaaaaca

SEQ ID NO: 90242 - DNA, 10 bp, Unknown
  misc_feature (1)..( 10): Result.001 file - promoters60/1009854
aaagaaagaa

SEQ ID NO: 90243 - DNA, 10 bp, Unknown
  misc_feature (1)..( 10): Result.001 file - promoters60/1009854
aaaaaaatct

SEQ ID NO: 90244 - DNA, 9 bp, Unknown
  misc_feature (1)..( 9): Result.001 file - promoters60/1009854
caaaacaaa

SEQ ID NO: 90245 - DNA, 9 bp, Unknown
  misc_feature (1)..( 9): Result.001 file - promoters60/1009854
caaatcaaa

SEQ ID NO: 90246 - DNA, 9 bp, Unknown
  misc_feature (1)..( 9): Result.001 file - promoters60/1009854
taaaacaat

SEQ ID NO: 90247 - DNA, 7 bp, Unknown
  misc_feature (1)..( 7): Result.001 file - promoters60/1009854
tattttg

SEQ ID NO: 90248 - DNA, 7 bp, Unknown
  misc_feature (1)..( 7): Result.001 file - promoters60/1009854
aattttg

SEQ ID NO: 90249 - DNA, 7 bp, Unknown
  misc_feature (1)..( 7): Result.001 file - promoters60/1009854
aatcttg

SEQ ID NO: 90250 - DNA, 9 bp, Unknown
  misc_feature (1)..( 9): Result.001 file - promoters60/1009854
tcatgttta

SEQ ID NO: 90251 - DNA, 9 bp, Unknown
  misc_feature (1)..( 9): Result.001 file - promoters60/1009854
ttttgttta

SEQ ID NO: 90252 - DNA, 9 bp, Unknown
  misc_feature (1)..( 9): Result.001 file - promoters60/1009854
ttttgtttc

SEQ ID NO: 90253 - DNA, 9 bp, Unknown
  misc_feature (1)..( 9): Result.001 file - promoters60/1009854
ctttgatta

SEQ ID NO: 90254 - DNA, 8 bp, Unknown
  misc_feature (1)..( 8): Result.001 file - promoters60/1009854
ttgaaatc

SEQ ID NO: 90255 - DNA, 8 bp, Unknown
  misc_feature (1)..( 8): Result.001 file - promoters60/1009854
ttgagatc

SEQ ID NO: 90256 - DNA, 8 bp, Unknown
  misc_feature (1)..( 8): Result.001 file - promoters60/1009854
atgagatg

SEQ ID NO: 90257 - DNA, 9 bp, Unknown
  misc_feature (1)..( 9): Result.001 file - promoters60/1009854
gaaatgatg

SEQ ID NO: 90258 - DNA, 9 bp, Unknown
  misc_feature (1)..( 9): Result.001 file - promoters60/1009854
gaaatgaag

SEQ ID NO: 90259 - DNA, 9 bp, Unknown
  misc_feature (1)..( 9): Result.001 file - promoters60/1009854
ctaatcaag

SEQ ID NO: 90260 - DNA, 8 bp, Unknown
  misc_feature (1)..( 8): Result.001 file - promoters60/1009854
aaacatat

SEQ ID NO: 90261 - DNA, 8 bp, Unknown
  misc_feature (1)..( 8): Result.001 file - promoters60/1009854
aaatatat

SEQ ID NO: 90262 - DNA, 8 bp, Unknown
  misc_feature (1)..( 8): Result.001 file - promoters60/1009854
aaaaatag

SEQ ID NO: 90263 - DNA, 12 bp, Unknown
  misc_feature (1)..( 12): Result.001 file - promoters60/1009854
tcatattacaat

SEQ ID NO: 90264 - DNA, 12 bp, Unknown
  misc_feature (1)..( 12): Result.001 file - promoters60/1009854
ttttattaaaat

SEQ ID NO: 90265 - DNA, 12 bp, Unknown
  misc_feature (1)..( 12): Result.001 file - promoters60/1009854
ttttcttaagtc

SEQ ID NO: 90266 - DNA, 9 bp, Unknown
  misc_feature (1)..( 9): Result.001 file - promoters60/1009854
ctttcacaa

SEQ ID NO: 90267 - DNA, 9 bp, Unknown
  misc_feature (1)..( 9): Result.001 file - promoters60/1009854
ttttgacaa

SEQ ID NO: 90268 - DNA, 9 bp, Unknown
  misc_feature (1)..( 9): Result.001 file - promoters60/1009854
ctttcataa

SEQ ID NO: 90269 - DNA, 9 bp, Unknown
  misc_feature (1)..( 9): Result.001 file - promoters60/1009854
aaataaatt

SEQ ID NO: 90270 - DNA, 9 bp, Unknown
  misc_feature (1)..( 9): Result.001 file - promoters60/1009854
aaaaaaaag

SEQ ID NO: 90271 - DNA, 10 bp, Unknown
  misc_feature (1)..( 10): Result.001 file - promoters60/1009854
aaattaaatt

SEQ ID NO: 90272 - DNA, 7 bp, Unknown
  misc_feature (1)..( 7): Result.001 file - promoters60/1009854
atataaa

SEQ ID NO: 90273 - DNA, 7 bp, Unknown
  misc_feature (1)..( 7): Result.001 file - promoters60/1009854
ctataaa

SEQ ID NO: 90274 - DNA, 7 bp, Unknown
  misc_feature (1)..( 7): Result.001 file - promoters60/1009861
ctataag

SEQ ID NO: 90275 - DNA, 6 bp, Unknown
  misc_feature (1)..( 6): Result.001 file - promoters60/1009861
aaagaa

SEQ ID NO: 90276 - DNA, 6 bp, Unknown
  misc_feature (1)..( 6): Result.001 file - promoters60/1009861
aaagaa

SEQ ID NO: 90277 - DNA, 8 bp, Unknown
  misc_feature (1)..( 8): Result.001 file - promoters60/1009861
attttaat

SEQ ID NO: 90278 - DNA, 8 bp, Unknown
  misc_feature (1)..( 8): Result.001 file - promoters60/1009861
attataat

SEQ ID NO: 90279 - DNA, 8 bp, Unknown
  misc_feature (1)..( 8): Result.001 file - promoters60/1009861
cttttaat

SEQ ID NO: 90280 - DNA, 6 bp, Unknown
  misc_feature (1)..( 6): Result.001 file - promoters60/1009861
aaccaa

SEQ ID NO: 90281 - DNA, 6 bp, Unknown
  misc_feature (1)..( 6): Result.001 file - promoters60/1009861
aaccaa

SEQ ID NO: 90282 - DNA, 6 bp, Unknown
  misc_feature (1)..( 6): Result.001 file - promoters60/1009861
aaaatt

SEQ ID NO: 90283 - DNA, 6 bp, Unknown
  misc_feature (1)..( 6): Result.001 file - promoters60/1009861
aaaatt

SEQ ID NO: 90284 - DNA, 6 bp, Unknown
  misc_feature (1)..( 6): Result.001 file - promoters60/1009861
aaaatt

SEQ ID NO: 90285 - DNA, 9 bp, Unknown
  misc_feature (1)..( 9): Result.001 file - promoters60/1009861
ttcaaattc

SEQ ID NO: 90286 - DNA, 9 bp, Unknown
  misc_feature (1)..( 9): Result.001 file - promoters60/1009861
ttcaaattt

SEQ ID NO: 90287 - DNA, 9 bp, Unknown
  misc_feature (1)..( 9): Result.001 file - promoters60/1009861
ttcaatttc

SEQ ID NO: 90288 - DNA, 8 bp, Unknown
  misc_feature (1)..( 8): Result.001 file - promoters60/1009861
ttagttgg

SEQ ID NO: 90289 - DNA, 8 bp, Unknown
  misc_feature (1)..( 8): Result.001 file - promoters60/1009861
ttagctgg

SEQ ID NO: 90290 - DNA, 9 bp, Unknown
  misc_feature (1)..( 9): Result.001 file - promoters60/1009861
agtaaaatg

SEQ ID NO: 90291 - DNA, 9 bp, Unknown
  misc_feature (1)..( 9): Result.001 file - promoters60/1009861
agtacaatg

SEQ ID NO: 90292 - DNA, 9 bp, Unknown
  misc_feature (1)..( 9): Result.001 file - promoters60/1009861
agtccaacc

SEQ ID NO: 90293 - DNA, 6 bp, Unknown
  misc_feature (1)..( 6): Result.001 file - promoters60/1009861
gaacat

SEQ ID NO: 90294 - DNA, 6 bp, Unknown
  misc_feature (1)..( 6): Result.001 file - promoters60/1009861
gaacat

SEQ ID NO: 90295 - DNA, 6 bp, Unknown
  misc_feature (1)..( 6): Result.001 file - promoters60/1009861
ttattt

SEQ ID NO: 90296 - DNA, 6 bp, Unknown
  misc_feature (1)..( 6): Result.001 file - promoters60/1009861
ttattt

SEQ ID NO: 90297 - DNA, 6 bp, Unknown
  misc_feature (1)..( 6): Result.001 file - promoters60/1009861
tctttt

SEQ ID NO: 90298 - DNA, 6 bp, Unknown
  misc_feature (1)..( 6): Result.001 file - promoters60/1009861
tctttt

SEQ ID NO: 90299 - DNA, 10 bp, Unknown
  misc_feature (1)..( 10): Result.001 file - promoters60/1009861
ttttcattca

SEQ ID NO: 90300 - DNA, 10 bp, Unknown
  misc_feature (1)..( 10): Result.001 file - promoters60/1009861
ttttaattaa

SEQ ID NO: 90301 - DNA, 10 bp, Unknown
  misc_feature (1)..( 10): Result.001 file - promoters60/1009861
acataattaa

SEQ ID NO: 90302 - DNA, 6 bp, Unknown
  misc_feature (1)..( 6): Result.001 file - promoters60/1009861
aatttc

SEQ ID NO: 90303 - DNA, 6 bp, Unknown
  misc_feature (1)..( 6): Result.001 file - promoters60/1009861
aatttc

SEQ ID NO: 90304 - DNA, 8 bp, Unknown
  misc_feature (1)..( 8): Result.001 file - promoters60/1009861
aaaatttc

SEQ ID NO: 90305 - DNA, 8 bp, Unknown
  misc_feature (1)..( 8): Result.001 file - promoters60/1009861
caaatttt

SEQ ID NO: 90306 - DNA, 7 bp, Unknown
  misc_feature (1)..( 7): Result.001 file - promoters60/1009861
tttaata

SEQ ID NO: 90307 - DNA, 7 bp, Unknown
  misc_feature (1)..( 7): Result.001 file - promoters60/1009861
tttaata

SEQ ID NO: 90308 - DNA, 7 bp, Unknown
  misc_feature (1)..( 7): Result.001 file - promoters60/1009861
caaaaac

SEQ ID NO: 90309 - DNA, 7 bp, Unknown
  misc_feature (1)..( 7): Result.001 file - promoters60/1009861
caaaaac

SEQ ID NO: 90310 - DNA, 8 bp, Unknown
  misc_feature (1)..( 8): Result.001 file - promoters60/1009861
aaaagcgc

SEQ ID NO: 90311 - DNA, 8 bp, Unknown
  misc_feature (1)..( 8): Result.001 file - promoters60/1009861
aaacgcgc

SEQ ID NO: 90312 - DNA, 8 bp, Unknown
  misc_feature (1)..( 8): Result.001 file - promoters60/1009861
tatacata

SEQ ID NO: 90313 - DNA, 8 bp, Unknown
  misc_feature (1)..( 8): Result.001 file - promoters60/1009861
tatatata

SEQ ID NO: 90314 - DNA, 7 bp, Unknown
  misc_feature (1)..( 7): Result.001 file - promoters60/1009861
aactgaa

SEQ ID NO: 90315 - DNA, 7 bp, Unknown
  misc_feature (1)..( 7): Result.001 file - promoters60/1009861
aaccgaa

SEQ ID NO: 90316 - DNA, 6 bp, Unknown
  misc_feature (1)..( 6): Result.001 file - promoters60/1009861
aatttt

SEQ ID NO: 90317 - DNA, 6 bp, Unknown
  misc_feature (1)..( 6): Result.001 file - promoters60/1009861
aatttt

SEQ ID NO: 90318 - DNA, 7 bp, Unknown
  misc_feature (1)..( 7): Result.001 file - promoters60/1009861
cataaac

SEQ ID NO: 90319 - DNA, 7 bp, Unknown
  misc_feature (1)..( 7): Result.001 file - promoters60/1009861
cataaac

SEQ ID NO: 90320 - DNA, 6 bp, Unknown
  misc_feature (1)..( 6): Result.001 file - promoters60/1009861
ctcctt

SEQ ID NO: 90321 - DNA, 6 bp, Unknown
  misc_feature (1)..( 6): Result.001 file - promoters60/1009861
ctcctt

SEQ ID NO: 90322 - DNA, 9 bp, Unknown
  misc_feature (1)..( 9): Result.001 file - promoters60/1009861
tttcaattt

SEQ ID NO: 90323 - DNA, 9 bp, Unknown
  misc_feature (1)..( 9): Result.001 file - promoters60/1009861
tttcatttt

SEQ ID NO: 90324 - DNA, 7 bp, Unknown
  misc_feature (1)..( 7): Result.001 file - promoters60/1009861
tttctct

SEQ ID NO: 90325 - DNA, 7 bp, Unknown
  misc_feature (1)..( 7): Result.001 file - promoters60/1009861
tttgtct

SEQ ID NO: 90326 - DNA, 6 bp, Unknown
  misc_feature (1)..( 6): Result.001 file - promoters60/1009861
taacat

SEQ ID NO: 90327 - DNA, 6 bp, Unknown
  misc_feature (1)..( 6): Result.001 file - promoters60/1009861
taacat

SEQ ID NO: 90328 - DNA, 6 bp, Unknown
  misc_feature (1)..( 6): Result.001 file - promoters60/1009861
ttttta

SEQ ID NO: 90329 - DNA, 6 bp, Unknown
  misc_feature (1)..( 6): Result.001 file - promoters60/1009861
ttttta

SEQ ID NO: 90330 - DNA, 6 bp, Unknown
  misc_feature (1)..( 6): Result.001 file - promoters60/1009861
ataata

SEQ ID NO: 90331 - DNA, 6 bp, Unknown
  misc_feature (1)..( 6): Result.001 file - promoters60/1009861
ataata

SEQ ID NO: 90332 - DNA, 8 bp, Unknown
  misc_feature (1)..( 8): Result.001 file - promoters60/1009861
catatata

SEQ ID NO: 90333 - DNA, 8 bp, Unknown
  misc_feature (1)..( 8): Result.001 file - promoters60/1009930
catatata

SEQ ID NO: 90334 - DNA, 9 bp, Unknown
  misc_feature (1)..( 9): Result.001 file - promoters60/1009930
ccatttctg

SEQ ID NO: 90335 - DNA, 9 bp, Unknown
  misc_feature (1)..( 9): Result.001 file - promoters60/1009930
tcatatctg

SEQ ID NO: 90336 - DNA, 9 bp, Unknown
  misc_feature (1)..( 9): Result.001 file - promoters60/1009930
tcatattta

SEQ ID NO: 90337 - DNA, 8 bp, Unknown
  misc_feature (1)..( 8): Result.001 file - promoters60/1009930
tttaaatt

SEQ ID NO: 90338 - DNA, 8 bp, Unknown
  misc_feature (1)..( 8): Result.001 file - promoters60/1009930
tttacatt

SEQ ID NO: 90339 - DNA, 8 bp, Unknown
  misc_feature (1)..( 8): Result.001 file - promoters60/1009930
tttcaatc

SEQ ID NO: 90340 - DNA, 9 bp, Unknown
  misc_feature (1)..( 9): Result.001 file - promoters60/1009930
aatttattt

SEQ ID NO: 90341 - DNA, 9 bp, Unknown
  misc_feature (1)..( 9): Result.001 file - promoters60/1009930
aatctattg

SEQ ID NO: 90342 - DNA, 9 bp, Unknown
  misc_feature (1)..( 9): Result.001 file - promoters60/1009930
ttcttattt

SEQ ID NO: 90343 - DNA, 9 bp, Unknown
  misc_feature (1)..( 9): Result.001 file - promoters60/1009930
ttacattag

SEQ ID NO: 90344 - DNA, 9 bp, Unknown
  misc_feature (1)..( 9): Result.001 file - promoters60/1009930
ttatatttt

SEQ ID NO: 90345 - DNA, 9 bp, Unknown
  misc_feature (1)..( 9): Result.001 file - promoters60/1009930
taacattag

SEQ ID NO: 90346 - DNA, 8 bp, Unknown
  misc_feature (1)..( 8): Result.001 file - promoters60/1009930
ttatgatc

SEQ ID NO: 90347 - DNA, 8 bp, Unknown
  misc_feature (1)..( 8): Result.001 file - promoters60/1009930
atatcatc

SEQ ID NO: 90348 - DNA, 8 bp, Unknown
  misc_feature (1)..( 8): Result.001 file - promoters60/1009930
ttatgaac

SEQ ID NO: 90349 - DNA, 7 bp, Unknown
  misc_feature (1)..( 7): Result.001 file - promoters60/1009930
taacact

SEQ ID NO: 90350 - DNA, 7 bp, Unknown
  misc_feature (1)..( 7): Result.001 file - promoters60/1009930
aaacact

SEQ ID NO: 90351 - DNA, 7 bp, Unknown
  misc_feature (1)..( 7): Result.001 file - promoters60/1009930
aaacact

SEQ ID NO: 90352 - DNA, 9 bp, Unknown
  misc_feature (1)..( 9): Result.001 file - promoters60/1009930
caaataatt

SEQ ID NO: 90353 - DNA, 9 bp, Unknown
  misc_feature (1)..( 9): Result.001 file - promoters60/1009930
tcaataata

SEQ ID NO: 90354 - DNA, 9 bp, Unknown
  misc_feature (1)..( 9): Result.001 file - promoters60/1009941
caaataatt

SEQ ID NO: 90355 - DNA, 10 bp, Unknown
  misc_feature (1)..( 10): Result.001 file - promoters60/1009941
ttcttttttc

SEQ ID NO: 90356 - DNA, 10 bp, Unknown
  misc_feature (1)..( 10): Result.001 file - promoters60/1009941
atcttcttta

SEQ ID NO: 90357 - DNA, 10 bp, Unknown
  misc_feature (1)..( 10): Result.001 file - promoters60/1009941
gtcttctttg

SEQ ID NO: 90358 - DNA, 10 bp, Unknown
  misc_feature (1)..( 10): Result.001 file - promoters60/1009941
ttcttttttt

SEQ ID NO: 90359 - DNA, 10 bp, Unknown
  misc_feature (1)..( 10): Result.001 file - promoters60/1009941
atctttttga

SEQ ID NO: 90360 - DNA, 10 bp, Unknown
  misc_feature (1)..( 10): Result.001 file - promoters60/1009941
ttcatcttca

SEQ ID NO: 90361 - DNA, 10 bp, Unknown
  misc_feature (1)..( 10): Result.001 file - promoters60/1009941
ctcttattta

SEQ ID NO: 90362 - DNA, 14 bp, Unknown
  misc_feature (1)..( 14): Result.001 file - promoters60/1009941
aaaagtatttatat

SEQ ID NO: 90363 - DNA, 14 bp, Unknown
  misc_feature (1)..( 14): Result.001 file - promoters60/1009941
catggtatatatat

SEQ ID NO: 90364 - DNA, 14 bp, Unknown
  misc_feature (1)..( 14): Result.001 file - promoters60/1009941
aaaaatatttgtat

SEQ ID NO: 90365 - DNA, 14 bp, Unknown
  misc_feature (1)..( 14): Result.001 file - promoters60/1009941
cgacctatatataa

SEQ ID NO: 90366 - DNA, 14 bp, Unknown
  misc_feature (1)..( 14): Result.001 file - promoters60/1009941
ctcagtatataaat

SEQ ID NO: 90367 - DNA, 14 bp, Unknown
  misc_feature (1)..( 14): Result.001 file - promoters60/1009941
cgtataatataaag

SEQ ID NO: 90368 - DNA, 10 bp, Unknown
  misc_feature (1)..( 10): Result.001 file - promoters60/1009941
acatatatat

SEQ ID NO: 90369 - DNA, 10 bp, Unknown
  misc_feature (1)..( 10): Result.001 file - promoters60/1009941
cagtatataa

SEQ ID NO: 90370 - DNA, 10 bp, Unknown
  misc_feature (1)..( 10): Result.001 file - promoters60/1009941
tcttatttat

SEQ ID NO: 90371 - DNA, 10 bp, Unknown
  misc_feature (1)..( 10): Result.001 file - promoters60/1009941
tagtatttat

SEQ ID NO: 90372 - DNA, 10 bp, Unknown
  misc_feature (1)..( 10): Result.001 file - promoters60/1009941
tactatatac

SEQ ID NO: 90373 - DNA, 10 bp, Unknown
  misc_feature (1)..( 10): Result.001 file - promoters60/1009941
tcttctttag

SEQ ID NO: 90374 - DNA, 10 bp, Unknown
  misc_feature (1)..( 10): Result.001 file - promoters60/1009941
taaagtgtat

SEQ ID NO: 90375 - DNA, 10 bp, Unknown
  misc_feature (1)..( 10): Result.001 file - promoters60/1009941
agtttttcgt

SEQ ID NO: 90376 - DNA, 10 bp, Unknown
  misc_feature (1)..( 10): Result.001 file - promoters60/1009941
gttttctcgt

SEQ ID NO: 90377 - DNA, 10 bp, Unknown
  misc_feature (1)..( 10): Result.001 file - promoters60/1009941
catttttcta

SEQ ID NO: 90378 - DNA, 10 bp, Unknown
  misc_feature (1)..( 10): Result.001 file - promoters60/1009941
ttgttttcta

SEQ ID NO: 90379 - DNA, 10 bp, Unknown
  misc_feature (1)..( 10): Result.001 file - promoters60/1009941
gattttttgc

SEQ ID NO: 90380 - DNA, 10 bp, Unknown
  misc_feature (1)..( 10): Result.001 file - promoters60/1009941
aattgttcta

SEQ ID NO: 90381 - DNA, 12 bp, Unknown
  misc_feature (1)..( 12): Result.001 file - promoters60/1009941
taaaataatttt

SEQ ID NO: 90382 - DNA, 12 bp, Unknown
  misc_feature (1)..( 12): Result.001 file - promoters60/1009941
agaaataacaaa

SEQ ID NO: 90383 - DNA, 12 bp, Unknown
  misc_feature (1)..( 12): Result.001 file - promoters60/1009941
aaaaattatttt

SEQ ID NO: 90384 - DNA, 12 bp, Unknown
  misc_feature (1)..( 12): Result.001 file - promoters60/1009941
agaaattaaagg

SEQ ID NO: 90385 - DNA, 13 bp, Unknown
  misc_feature (1)..( 13): Result.001 file - promoters60/1009941
gaaagattaataa

SEQ ID NO: 90386 - DNA, 13 bp, Unknown
  misc_feature (1)..( 13): Result.001 file - promoters60/1009941
caaaaatttataa

SEQ ID NO: 90387 - DNA, 16 bp, Unknown
  misc_feature (1)..( 16): Result.001 file - promoters60/1009941
agtaaagattattgat

SEQ ID NO: 90388 - DNA, 16 bp, Unknown
  misc_feature (1)..( 16): Result.001 file - promoters60/1009941
atgaaagactatttgc

SEQ ID NO: 90389 - DNA, 16 bp, Unknown
  misc_feature (1)..( 16): Result.001 file - promoters60/1009941
ttaaaagtttaaaatg

SEQ ID NO: 90390 - DNA, 16 bp, Unknown
  misc_feature (1)..( 16): Result.001 file - promoters60/1009941
tttaatgaagcagctg

SEQ ID NO: 90391 - DNA, 16 bp, Unknown
  misc_feature (1)..( 16): Result.001 file - promoters60/1009941
aagtaagactttggct

SEQ ID NO: 90392 - DNA, 16 bp, Unknown
  misc_feature (1)..( 16): Result.001 file - promoters60/1009941
tttttgttctatatgc

SEQ ID NO: 90393 - DNA, 16 bp, Unknown
  misc_feature (1)..( 16): Result.001 file - promoters60/1009999
tttaatcgatcatcat

SEQ ID NO: 90394 - DNA, 6 bp, Unknown
  misc_feature (1)..( 6): Result.001 file - promoters60/1009999
ttgttt

SEQ ID NO: 90395 - DNA, 6 bp, Unknown
  misc_feature (1)..( 6): Result.001 file - promoters60/1009999
ttgttt

SEQ ID NO: 90396 - DNA, 6 bp, Unknown
  misc_feature (1)..( 6): Result.001 file - promoters60/1009999
tatttt

SEQ ID NO: 90397 - DNA, 6 bp, Unknown
  misc_feature (1)..( 6): Result.001 file - promoters60/1009999
tatttt

SEQ ID NO: 90398 - DNA, 7 bp, Unknown
  misc_feature (1)..( 7): Result.001 file - promoters60/1009999
tttgctt

SEQ ID NO: 90399 - DNA, 7 bp, Unknown
  misc_feature (1)..( 7): Result.001 file - promoters60/1009999
tttactt

SEQ ID NO: 90400 - DNA, 6 bp, Unknown
  misc_feature (1)..( 6): Result.001 file - promoters60/1009999
aaaaga

SEQ ID NO: 90401 - DNA, 6 bp, Unknown
  misc_feature (1)..( 6): Result.001 file - promoters60/1009999
aaaaga

SEQ ID NO: 90402 - DNA, 6 bp, Unknown
  misc_feature (1)..( 6): Result.001 file - promoters60/1009999
aataaa

SEQ ID NO: 90403 - DNA, 6 bp, Unknown
  misc_feature (1)..( 6): Result.001 file - promoters60/1009999
aataaa

SEQ ID NO: 90404 - DNA, 7 bp, Unknown
  misc_feature (1)..( 7): Result.001 file - promoters60/1009999
ttcttcc

SEQ ID NO: 90405 - DNA, 7 bp, Unknown
  misc_feature (1)..( 7): Result.001 file - promoters60/1009999
ttcctcc

SEQ ID NO: 90406 - DNA, 10 bp, Unknown
  misc_feature (1)..( 10): Result.001 file - promoters60/1009999
gtacaaagta

SEQ ID NO: 90407 - DNA, 10 bp, Unknown
  misc_feature (1)..( 10): Result.001 file - promoters60/1009999
gtaaaaattt

SEQ ID NO: 90408 - DNA, 10 bp, Unknown
  misc_feature (1)..( 10): Result.001 file - promoters60/1009999
ctaaatattt

SEQ ID NO: 90409 - DNA, 7 bp, Unknown
  misc_feature (1)..( 7): Result.001 file - promoters60/1009999
ttggtca

SEQ ID NO: 90410 - DNA, 7 bp, Unknown
  misc_feature (1)..( 7): Result.001 file - promoters60/1009999
ttgctca

SEQ ID NO: 90411 - DNA, 7 bp, Unknown
  misc_feature (1)..( 7): Result.001 file - promoters60/1009999
ccactaa

SEQ ID NO: 90412 - DNA, 7 bp, Unknown
  misc_feature (1)..( 7): Result.001 file - promoters60/1009999
ccattaa

SEQ ID NO: 90413 - DNA, 6 bp, Unknown
  misc_feature (1)..( 6): Result.001 file - promoters60/1009999
ataaaa

SEQ ID NO: 90414 - DNA, 6 bp, Unknown
  misc_feature (1)..( 6): Result.001 file - promoters60/1009999
ataaaa

SEQ ID NO: 90415 - DNA, 8 bp, Unknown
  misc_feature (1)..( 8): Result.001 file - promoters60/1009999
tttatttt

SEQ ID NO: 90416 - DNA, 8 bp, Unknown
  misc_feature (1)..( 8): Result.001 file - promoters60/1009999
tttctttt

SEQ ID NO: 90417 - DNA, 6 bp, Unknown
  misc_feature (1)..( 6): Result.001 file - promoters60/1009999
tttact

SEQ ID NO: 90418 - DNA, 6 bp, Unknown
  misc_feature (1)..( 6): Result.001 file - promoters60/1009999
tttact

SEQ ID NO: 90419 - DNA, 9 bp, Unknown
  misc_feature (1)..( 9): Result.001 file - promoters60/1009999
cttattttt

SEQ ID NO: 90420 - DNA, 9 bp, Unknown
  misc_feature (1)..( 9): Result.001 file - promoters60/1009999
cttagtttt

SEQ ID NO: 90421 - DNA, 8 bp, Unknown
  misc_feature (1)..( 8): Result.001 file - promoters60/1009999
tttgtttg

SEQ ID NO: 90422 - DNA, 8 bp, Unknown
  misc_feature (1)..( 8): Result.001 file - promoters60/1009999
tttgtttg

SEQ ID NO: 90423 - DNA, 6 bp, Unknown
  misc_feature (1)..( 6): Result.001 file - promoters60/1009999
aagttt

SEQ ID NO: 90424 - DNA, 6 bp, Unknown
  misc_feature (1)..( 6): Result.001 file - promoters60/1009999
aagttt

SEQ ID NO: 90425 - DNA, 10 bp, Unknown
  misc_feature (1)..( 10): Result.001 file - promoters60/1009999
caaagtaatt

SEQ ID NO: 90426 - DNA, 10 bp, Unknown
  misc_feature (1)..( 10): Result.001 file - promoters60/1009999
caaactaatt

SEQ ID NO: 90427 - DNA, 7 bp, Unknown
  misc_feature (1)..( 7): Result.001 file - promoters60/1009999
attggaa

SEQ ID NO: 90428 - DNA, 7 bp, Unknown
  misc_feature (1)..( 7): Result.001 file - promoters60/1009999
attagaa

SEQ ID NO: 90429 - DNA, 8 bp, Unknown
  misc_feature (1)..( 8): Result.001 file - promoters60/1009999
aacaaaat

SEQ ID NO: 90430 - DNA, 8 bp, Unknown
  misc_feature (1)..( 8): Result.001 file - promoters60/1010019
aactaaat

SEQ ID NO: 90431 - DNA, 7 bp, Unknown
  misc_feature (1)..( 7): Result.001 file - promoters60/1010019
caagaac

SEQ ID NO: 90432 - DNA, 7 bp, Unknown
  misc_feature (1)..( 7): Result.001 file - promoters60/1010019
caaaaac

SEQ ID NO: 90433 - DNA, 7 bp, Unknown
  misc_feature (1)..( 7): Result.001 file - promoters60/1010025
caaaaag

SEQ ID NO: 90434 - DNA, 9 bp, Unknown
  misc_feature (1)..( 9): Result.001 file - promoters60/1010025
agattttct

SEQ ID NO: 90435 - DNA, 9 bp, Unknown
  misc_feature (1)..( 9): Result.001 file - promoters60/1010025
tcattatct

SEQ ID NO: 90436 - DNA, 9 bp, Unknown
  misc_feature (1)..( 9): Result.001 file - promoters60/1010025
agattttaa

SEQ ID NO: 90437 - DNA, 6 bp, Unknown
  misc_feature (1)..( 6): Result.001 file - promoters60/1010025
aaaaac

SEQ ID NO: 90438 - DNA, 6 bp, Unknown
  misc_feature (1)..( 6): Result.001 file - promoters60/1010025
aaaaac

SEQ ID NO: 90439 - DNA, 6 bp, Unknown
  misc_feature (1)..( 6): Result.001 file - promoters60/1010025
aaaaac

SEQ ID NO: 90440 - DNA, 9 bp, Unknown
  misc_feature (1)..( 9): Result.001 file - promoters60/1010025
tgaaaaagt

SEQ ID NO: 90441 - DNA, 9 bp, Unknown
  misc_feature (1)..( 9): Result.001 file - promoters60/1010025
tgaaaaaaa

SEQ ID NO: 90442 - DNA, 9 bp, Unknown
  misc_feature (1)..( 9): Result.001 file - promoters60/1010025
ttaaaaaaa

SEQ ID NO: 90443 - DNA, 11 bp, Unknown
  misc_feature (1)..( 11): Result.001 file - promoters60/1010025
gtttacttgct

SEQ ID NO: 90444 - DNA, 11 bp, Unknown
  misc_feature (1)..( 11): Result.001 file - promoters60/1010025
atttatttgtg

SEQ ID NO: 90445 - DNA, 11 bp, Unknown
  misc_feature (1)..( 11): Result.001 file - promoters60/1010025
atttattagtg

SEQ ID NO: 90446 - DNA, 8 bp, Unknown
  misc_feature (1)..( 8): Result.001 file - promoters60/1010025
tagtacta

SEQ ID NO: 90447 - DNA, 8 bp, Unknown
  misc_feature (1)..( 8): Result.001 file - promoters60/1010025
atgtacta

SEQ ID NO: 90448 - DNA, 8 bp, Unknown
  misc_feature (1)..( 8): Result.001 file - promoters60/1010025
atgaactc

SEQ ID NO: 90449 - DNA, 9 bp, Unknown
  misc_feature (1)..( 9): Result.001 file - promoters60/1010025
aaaatttgt

SEQ ID NO: 90450 - DNA, 9 bp, Unknown
  misc_feature (1)..( 9): Result.001 file - promoters60/1010025
aaaatgtgt

SEQ ID NO: 90451 - DNA, 9 bp, Unknown
  misc_feature (1)..( 9): Result.001 file - promoters60/1010055
aaaatttga

SEQ ID NO: 90452 - DNA, 10 bp, Unknown
  misc_feature (1)..( 10): Result.001 file - promoters60/1010055
gaaaaacaaa

SEQ ID NO: 90453 - DNA, 10 bp, Unknown
  misc_feature (1)..( 10): Result.001 file - promoters60/1010055
ggaaaaaaaa

SEQ ID NO: 90454 - DNA, 10 bp, Unknown
  misc_feature (1)..( 10): Result.001 file - promoters60/1010055
gtcaaacaaa

SEQ ID NO: 90455 - DNA, 10 bp, Unknown
  misc_feature (1)..( 10): Result.001 file - promoters60/1010055
tttaaaaaaa

SEQ ID NO: 90456 - DNA, 10 bp, Unknown
  misc_feature (1)..( 10): Result.001 file - promoters60/1010055
gtgaaacaaa

SEQ ID NO: 90457 - DNA, 10 bp, Unknown
  misc_feature (1)..( 10): Result.001 file - promoters60/1010055
tataagaaaa

SEQ ID NO: 90458 - DNA, 10 bp, Unknown
  misc_feature (1)..( 10): Result.001 file - promoters60/1010055
tatgagaaat

SEQ ID NO: 90459 - DNA, 14 bp, Unknown
  misc_feature (1)..( 14): Result.001 file - promoters60/1010055
atattattagtagg

SEQ ID NO: 90460 - DNA, 14 bp, Unknown
  misc_feature (1)..( 14): Result.001 file - promoters60/1010055
ttattatattgaga

SEQ ID NO: 90461 - DNA, 14 bp, Unknown
  misc_feature (1)..( 14): Result.001 file - promoters60/1010055
atataattattttg

SEQ ID NO: 90462 - DNA, 14 bp, Unknown
  misc_feature (1)..( 14): Result.001 file - promoters60/1010055
aaattatttacaaa

SEQ ID NO: 90463 - DNA, 14 bp, Unknown
  misc_feature (1)..( 14): Result.001 file - promoters60/1010055
gattaattcttttc

SEQ ID NO: 90464 - DNA, 14 bp, Unknown
  misc_feature (1)..( 14): Result.001 file - promoters60/1010055
ttttaatgattttg

SEQ ID NO: 90465 - DNA, 14 bp, Unknown
  misc_feature (1)..( 14): Result.001 file - promoters60/1010055
agaaaatatacatt

SEQ ID NO: 90466 - DNA, 9 bp, Unknown
  misc_feature (1)..( 9): Result.001 file - promoters60/1010055
aatgaaaaa

SEQ ID NO: 90467 - DNA, 9 bp, Unknown
  misc_feature (1)..( 9): Result.001 file - promoters60/1010055
aatgaaatt

SEQ ID NO: 90468 - DNA, 10 bp, Unknown
  misc_feature (1)..( 10): Result.001 file - promoters60/1010055
tatgagaaat

SEQ ID NO: 90469 - DNA, 10 bp, Unknown
  misc_feature (1)..( 10): Result.001 file - promoters60/1010055
aatgatattc

SEQ ID NO: 90470 - DNA, 10 bp, Unknown
  misc_feature (1)..( 10): Result.001 file - promoters60/1010055
aatgttattt

SEQ ID NO: 90471 - DNA, 10 bp, Unknown
  misc_feature (1)..( 10): Result.001 file - promoters60/1010055
ctatttattt

SEQ ID NO: 90472 - DNA, 11 bp, Unknown
  misc_feature (1)..( 11): Result.001 file - promoters60/1010055
atgaaaaacaa

SEQ ID NO: 90473 - DNA, 11 bp, Unknown
  misc_feature (1)..( 11): Result.001 file - promoters60/1010055
aagaaaaaata

SEQ ID NO: 90474 - DNA, 11 bp, Unknown
  misc_feature (1)..( 11): Result.001 file - promoters60/1010055
atgagaaatca

SEQ ID NO: 90475 - DNA, 11 bp, Unknown
  misc_feature (1)..( 11): Result.001 file - promoters60/1010055
gggaaaaaaaa

SEQ ID NO: 90476 - DNA, 11 bp, Unknown
  misc_feature (1)..( 11): Result.001 file - promoters60/1010055
aagaaaatata

SEQ ID NO: 90477 - DNA, 11 bp, Unknown
  misc_feature (1)..( 11): Result.001 file - promoters60/1010055
aacaaattatt

SEQ ID NO: 90478 - DNA, 8 bp, Unknown
  misc_feature (1)..( 8): Result.001 file - promoters60/1010055
atttattt

SEQ ID NO: 90479 - DNA, 8 bp, Unknown
  misc_feature (1)..( 8): Result.001 file - promoters60/1010055
attcattt

SEQ ID NO: 90480 - DNA, 8 bp, Unknown
  misc_feature (1)..( 8): Result.001 file - promoters60/1010055
ttttattc

SEQ ID NO: 90481 - DNA, 8 bp, Unknown
  misc_feature (1)..( 8): Result.001 file - promoters60/1010055
attttttt

SEQ ID NO: 90482 - DNA, 8 bp, Unknown
  misc_feature (1)..( 8): Result.001 file - promoters60/1010055
ttttcttt

SEQ ID NO: 90483 - DNA, 8 bp, Unknown
  misc_feature (1)..( 8): Result.001 file - promoters60/1010055
tttcattt

SEQ ID NO: 90484 - DNA, 8 bp, Unknown
  misc_feature (1)..( 8): Result.001 file - promoters60/1010065
atttttag

SEQ ID NO: 90485 - DNA, 8 bp, Unknown
  misc_feature (1)..( 8): Result.001 file - promoters60/1010065
tatacata

SEQ ID NO: 90486 - DNA, 8 bp, Unknown
  misc_feature (1)..( 8): Result.001 file - promoters60/1010065
tattcata

SEQ ID NO: 90487 - DNA, 9 bp, Unknown
  misc_feature (1)..( 9): Result.001 file - promoters60/1010065
tcgaagtag

SEQ ID NO: 90488 - DNA, 9 bp, Unknown
  misc_feature (1)..( 9): Result.001 file - promoters60/1010065
tcgaaatag

SEQ ID NO: 90489 - DNA, 9 bp, Unknown
  misc_feature (1)..( 9): Result.001 file - promoters60/1010065
gcgcaatta

SEQ ID NO: 90490 - DNA, 9 bp, Unknown
  misc_feature (1)..( 9): Result.001 file - promoters60/1010065
gcgcaatta

SEQ ID NO: 90491 - DNA, 6 bp, Unknown
  misc_feature (1)..( 6): Result.001 file - promoters60/1010065
taaaca

SEQ ID NO: 90492 - DNA, 6 bp, Unknown
  misc_feature (1)..( 6): Result.001 file - promoters60/1010065
taaaca

SEQ ID NO: 90493 - DNA, 8 bp, Unknown
  misc_feature (1)..( 8): Result.001 file - promoters60/1010065
attattta

SEQ ID NO: 90494 - DNA, 8 bp, Unknown
  misc_feature (1)..( 8): Result.001 file - promoters60/1010065
atttttta

SEQ ID NO: 90495 - DNA, 6 bp, Unknown
  misc_feature (1)..( 6): Result.001 file - promoters60/1010065
tttctc

SEQ ID NO: 90496 - DNA, 6 bp, Unknown
  misc_feature (1)..( 6): Result.001 file - promoters60/1010065
tttctc

SEQ ID NO: 90497 - DNA, 6 bp, Unknown
  misc_feature (1)..( 6): Result.001 file - promoters60/1010065
aatttt

SEQ ID NO: 90498 - DNA, 6 bp, Unknown
  misc_feature (1)..( 6): Result.001 file - promoters60/1010065
aatttt

SEQ ID NO: 90499 - DNA, 7 bp, Unknown
  misc_feature (1)..( 7): Result.001 file - promoters60/1010065
atatata

SEQ ID NO: 90500 - DNA, 7 bp, Unknown
  misc_feature (1)..( 7): Result.001 file - promoters60/1010065
atacata

SEQ ID NO: 90501 - DNA, 8 bp, Unknown
  misc_feature (1)..( 8): Result.001 file - promoters60/1010065
acatgcat

SEQ ID NO: 90502 - DNA, 8 bp, Unknown
  misc_feature (1)..( 8): Result.001 file - promoters60/1010065
acatacat

SEQ ID NO: 90503 - DNA, 7 bp, Unknown
  misc_feature (1)..( 7): Result.001 file - promoters60/1010065
atagtag

SEQ ID NO: 90504 - DNA, 7 bp, Unknown
  misc_feature (1)..( 7): Result.001 file - promoters60/1010065
atactag

SEQ ID NO: 90505 - DNA, 7 bp, Unknown
  misc_feature (1)..( 7): Result.001 file - promoters60/1010065
catttat

SEQ ID NO: 90506 - DNA, 7 bp, Unknown
  misc_feature (1)..( 7): Result.001 file - promoters60/1010065
catctat

SEQ ID NO: 90507 - DNA, 7 bp, Unknown
  misc_feature (1)..( 7): Result.001 file - promoters60/1010065
acatttc

SEQ ID NO: 90508 - DNA, 7 bp, Unknown
  misc_feature (1)..( 7): Result.001 file - promoters60/1010065
acatttc

SEQ ID NO: 90509 - DNA, 7 bp, Unknown
  misc_feature (1)..( 7): Result.001 file - promoters60/1010065
tcacata

SEQ ID NO: 90510 - DNA, 7 bp, Unknown
  misc_feature (1)..( 7): Result.001 file - promoters60/1010065
tcatata

SEQ ID NO: 90511 - DNA, 6 bp, Unknown
  misc_feature (1)..( 6): Result.001 file - promoters60/1010065
atttat

SEQ ID NO: 90512 - DNA, 6 bp, Unknown
  misc_feature (1)..( 6): Result.001 file - promoters60/1010065
atttat

SEQ ID NO: 90513 - DNA, 6 bp, Unknown
  misc_feature (1)..( 6): Result.001 file - promoters60/1010065
taataa

SEQ ID NO: 90514 - DNA, 6 bp, Unknown
  misc_feature (1)..( 6): Result.001 file - promoters60/1010065
taataa

SEQ ID NO: 90515 - DNA, 6 bp, Unknown
  misc_feature (1)..( 6): Result.001 file - promoters60/1010065
tcgatc

SEQ ID NO: 90516 - DNA, 6 bp, Unknown
  misc_feature (1)..( 6): Result.001 file - promoters60/1010065
tcgatc

SEQ ID NO: 90517 - DNA, 6 bp, Unknown
  misc_feature (1)..( 6): Result.001 file - promoters60/1010065
tagatt

SEQ ID NO: 90518 - DNA, 6 bp, Unknown
  misc_feature (1)..( 6): Result.001 file - promoters60/1010115
tagatt

SEQ ID NO: 90519 - DNA, 6 bp, Unknown
  misc_feature (1)..( 6): Result.001 file - promoters60/1010115
tttttt

SEQ ID NO: 90520 - DNA, 6 bp, Unknown
  misc_feature (1)..( 6): Result.001 file - promoters60/1010115
tttttt

SEQ ID NO: 90521 - DNA, 6 bp, Unknown
  misc_feature (1)..( 6): Result.001 file - promoters60/1010115
tttttt

SEQ ID NO: 90522 - DNA, 7 bp, Unknown
  misc_feature (1)..( 7): Result.001 file - promoters60/1010115
tttgttt

SEQ ID NO: 90523 - DNA, 7 bp, Unknown
  misc_feature (1)..( 7): Result.001 file - promoters60/1010115
tttgtta

SEQ ID NO: 90524 - DNA, 10 bp, Unknown
  misc_feature (1)..( 10): Result.001 file - promoters60/1010115
tcgagaatac

SEQ ID NO: 90525 - DNA, 10 bp, Unknown
  misc_feature (1)..( 10): Result.001 file - promoters60/1010115
ttgagattac

SEQ ID NO: 90526 - DNA, 10 bp, Unknown
  misc_feature (1)..( 10): Result.001 file - promoters60/1010115
tcgataattg

SEQ ID NO: 90527 - DNA, 10 bp, Unknown
  misc_feature (1)..( 10): Result.001 file - promoters60/1010115
tgaataattt

SEQ ID NO: 90528 - DNA, 10 bp, Unknown
  misc_feature (1)..( 10): Result.001 file - promoters60/1010140
tgtataattt

SEQ ID NO: 90529 - DNA, 6 bp, Unknown
  misc_feature (1)..( 6): Result.001 file - promoters60/1010140
atagaa

SEQ ID NO: 90530 - DNA, 6 bp, Unknown
  misc_feature (1)..( 6): Result.001 file - promoters60/1010140
atagaa

SEQ ID NO: 90531 - DNA, 7 bp, Unknown
  misc_feature (1)..( 7): Result.001 file - promoters60/1010140
aacaaca

SEQ ID NO: 90532 - DNA, 7 bp, Unknown
  misc_feature (1)..( 7): Result.001 file - promoters60/1010140
aacaaca

SEQ ID NO: 90533 - DNA, 6 bp, Unknown
  misc_feature (1)..( 6): Result.001 file - promoters60/1010140
ttgaat

SEQ ID NO: 90534 - DNA, 6 bp, Unknown
  misc_feature (1)..( 6): Result.001 file - promoters60/1010140
ttgaat

SEQ ID NO: 90535 - DNA, 6 bp, Unknown
  misc_feature (1)..( 6): Result.001 file - promoters60/1010140
acaaag

SEQ ID NO: 90536 - DNA, 6 bp, Unknown
  misc_feature (1)..( 6): Result.001 file - promoters60/1010140
acaaag

SEQ ID NO: 90537 - DNA, 7 bp, Unknown
  misc_feature (1)..( 7): Result.001 file - promoters60/1010140
ctgattc

SEQ ID NO: 90538 - DNA, 7 bp, Unknown
  misc_feature (1)..( 7): Result.001 file - promoters60/1010140
ctgtttc

SEQ ID NO: 90539 - DNA, 9 bp, Unknown
  misc_feature (1)..( 9): Result.001 file - promoters60/1010140
ttttttttt

SEQ ID NO: 90540 - DNA, 9 bp, Unknown
  misc_feature (1)..( 9): Result.001 file - promoters60/1010140
ttttttttt

SEQ ID NO: 90541 - DNA, 9 bp, Unknown
  misc_feature (1)..( 9): Result.001 file - promoters60/1010140
gaagaaaat

SEQ ID NO: 90542 - DNA, 9 bp, Unknown
  misc_feature (1)..( 9): Result.001 file - promoters60/1010140
gaagcaaat

SEQ ID NO: 90543 - DNA, 8 bp, Unknown
  misc_feature (1)..( 8): Result.001 file - promoters60/1010140
aaaggttt

SEQ ID NO: 90544 - DNA, 8 bp, Unknown
  misc_feature (1)..( 8): Result.001 file - promoters60/1010140
aaaagttt

SEQ ID NO: 90545 - DNA, 8 bp, Unknown
  misc_feature (1)..( 8): Result.001 file - promoters60/1010140
atttaaca

SEQ ID NO: 90546 - DNA, 8 bp, Unknown
  misc_feature (1)..( 8): Result.001 file - promoters60/1010140
attgaaca

SEQ ID NO: 90547 - DNA, 6 bp, Unknown
  misc_feature (1)..( 6): Result.001 file - promoters60/1010140
accaac

SEQ ID NO: 90548 - DNA, 6 bp, Unknown
  misc_feature (1)..( 6): Result.001 file - promoters60/1010140
accaac

SEQ ID NO: 90549 - DNA, 6 bp, Unknown
  misc_feature (1)..( 6): Result.001 file - promoters60/1010140
ataatc

SEQ ID NO: 90550 - DNA, 6 bp, Unknown
  misc_feature (1)..( 6): Result.001 file - promoters60/1010140
ataatc

SEQ ID NO: 90551 - DNA, 6 bp, Unknown
  misc_feature (1)..( 6): Result.001 file - promoters60/1010140
actaac

SEQ ID NO: 90552 - DNA, 6 bp, Unknown
  misc_feature (1)..( 6): Result.001 file - promoters60/1010140
actaac

SEQ ID NO: 90553 - DNA, 8 bp, Unknown
  misc_feature (1)..( 8): Result.001 file - promoters60/1010140
ataactct

SEQ ID NO: 90554 - DNA, 8 bp, Unknown
  misc_feature (1)..( 8): Result.001 file - promoters60/1010140
ataactct

SEQ ID NO: 90555 - DNA, 7 bp, Unknown
  misc_feature (1)..( 7): Result.001 file - promoters60/1010140
aaataca

SEQ ID NO: 90556 - DNA, 7 bp, Unknown
  misc_feature (1)..( 7): Result.001 file - promoters60/1010140
aaacaca

SEQ ID NO: 90557 - DNA, 10 bp, Unknown
  misc_feature (1)..( 10): Result.001 file - promoters60/1010140
aatgaacata

SEQ ID NO: 90558 - DNA, 10 bp, Unknown
  misc_feature (1)..( 10): Result.001 file - promoters60/1010140
aatgaagata

SEQ ID NO: 90559 - DNA, 6 bp, Unknown
  misc_feature (1)..( 6): Result.001 file - promoters60/1010140
atataa

SEQ ID NO: 90560 - DNA, 6 bp, Unknown
  misc_feature (1)..( 6): Result.001 file - promoters60/1010140
atataa

SEQ ID NO: 90561 - DNA, 8 bp, Unknown
  misc_feature (1)..( 8): Result.001 file - promoters60/1010140
agttttaa

SEQ ID NO: 90562 - DNA, 8 bp, Unknown
  misc_feature (1)..( 8): Result.001 file - promoters60/1010140
agtattaa

SEQ ID NO: 90563 - DNA, 6 bp, Unknown
  misc_feature (1)..( 6): Result.001 file - promoters60/1010140
tcatta

SEQ ID NO: 90564 - DNA, 6 bp, Unknown
  misc_feature (1)..( 6): Result.001 file - promoters60/1010140
tcatta

SEQ ID NO: 90565 - DNA, 8 bp, Unknown
  misc_feature (1)..( 8): Result.001 file - promoters60/1010140
ttttaaat

SEQ ID NO: 90566 - DNA, 8 bp, Unknown
  misc_feature (1)..( 8): Result.001 file - promoters60/1010140
tttcaaat

SEQ ID NO: 90567 - DNA, 8 bp, Unknown
  misc_feature (1)..( 8): Result.001 file - promoters60/1010140
gttatttt

SEQ ID NO: 90568 - DNA, 8 bp, Unknown
  misc_feature (1)..( 8): Result.001 file - promoters60/1010140
gttgtttt

SEQ ID NO: 90569 - DNA, 7 bp, Unknown
  misc_feature (1)..( 7): Result.001 file - promoters60/1010140
actcaat

SEQ ID NO: 90570 - DNA, 7 bp, Unknown
  misc_feature (1)..( 7): Result.001 file - promoters60/1010140
actcaat

SEQ ID NO: 90571 - DNA, 8 bp, Unknown
  misc_feature (1)..( 8): Result.001 file - promoters60/1010140
tttttaaa

SEQ ID NO: 90572 - DNA, 8 bp, Unknown
  misc_feature (1)..( 8): Result.001 file - promoters60/1010209
tttataaa

SEQ ID NO: 90573 - DNA, 11 bp, Unknown
  misc_feature (1)..( 11): Result.001 file - promoters60/1010209
cacacacatgc

SEQ ID NO: 90574 - DNA, 11 bp, Unknown
  misc_feature (1)..( 11): Result.001 file - promoters60/1010209
gcaacaaatgc

SEQ ID NO: 90575 - DNA, 11 bp, Unknown
  misc_feature (1)..( 11): Result.001 file - promoters60/1010209
cacacccatac

SEQ ID NO: 90576 - DNA, 13 bp, Unknown
  misc_feature (1)..( 13): Result.001 file - promoters60/1010209
taggaaatgtatt

SEQ ID NO: 90577 - DNA, 13 bp, Unknown
  misc_feature (1)..( 13): Result.001 file - promoters60/1010209
aaataaatttatt

SEQ ID NO: 90578 - DNA, 13 bp, Unknown
  misc_feature (1)..( 13): Result.001 file - promoters60/1010346
aaacaaattaggg

SEQ ID NO: 90579 - DNA, 8 bp, Unknown
  misc_feature (1)..( 8): Result.001 file - promoters60/1010346
ctttttac

SEQ ID NO: 90580 - DNA, 8 bp, Unknown
  misc_feature (1)..( 8): Result.001 file - promoters60/1010346
ctttttat

SEQ ID NO: 90581 - DNA, 8 bp, Unknown
  misc_feature (1)..( 8): Result.001 file - promoters60/1010346
atttttaa

SEQ ID NO: 90582 - DNA, 8 bp, Unknown
  misc_feature (1)..( 8): Result.001 file - promoters60/1010346
atttgtac

SEQ ID NO: 90583 - DNA, 8 bp, Unknown
  misc_feature (1)..( 8): Result.001 file - promoters60/1010346
tttaccag

SEQ ID NO: 90584 - DNA, 8 bp, Unknown
  misc_feature (1)..( 8): Result.001 file - promoters60/1010346
tttgccag

SEQ ID NO: 90585 - DNA, 8 bp, Unknown
  misc_feature (1)..( 8): Result.001 file - promoters60/1010346
tttgtacg

SEQ ID NO: 90586 - DNA, 10 bp, Unknown
  misc_feature (1)..( 10): Result.001 file - promoters60/1010346
ggaaaaaaat

SEQ ID NO: 90587 - DNA, 10 bp, Unknown
  misc_feature (1)..( 10): Result.001 file - promoters60/1010346
tataaaaaat

SEQ ID NO: 90588 - DNA, 10 bp, Unknown
  misc_feature (1)..( 10): Result.001 file - promoters60/1010346
tatacaaaag

SEQ ID NO: 90589 - DNA, 7 bp, Unknown
  misc_feature (1)..( 7): Result.001 file - promoters60/1010346
cataaaa

SEQ ID NO: 90590 - DNA, 7 bp, Unknown
  misc_feature (1)..( 7): Result.001 file - promoters60/1010346
tataaaa

SEQ ID NO: 90591 - DNA, 7 bp, Unknown
  misc_feature (1)..( 7): Result.001 file - promoters60/1010346
tatcaaa

SEQ ID NO: 90592 - DNA, 7 bp, Unknown
  misc_feature (1)..( 7): Result.001 file - promoters60/1010346
ccaaatt

SEQ ID NO: 90593 - DNA, 7 bp, Unknown
  misc_feature (1)..( 7): Result.001 file - promoters60/1010346
tcaaatt

SEQ ID NO: 90594 - DNA, 7 bp, Unknown
  misc_feature (1)..( 7): Result.001 file - promoters60/1010346
ccatatt

SEQ ID NO: 90595 - DNA, 8 bp, Unknown
  misc_feature (1)..( 8): Result.001 file - promoters60/1010346
tattttaa

SEQ ID NO: 90596 - DNA, 8 bp, Unknown
  misc_feature (1)..( 8): Result.001 file - promoters60/1010346
tattttaa

SEQ ID NO: 90597 - DNA, 8 bp, Unknown
  misc_feature (1)..( 8): Result.001 file - promoters60/1010346
tatattat

SEQ ID NO: 90598 - DNA, 10 bp, Unknown
  misc_feature (1)..( 10): Result.001 file - promoters60/1010346
gttgactttg

SEQ ID NO: 90599 - DNA, 10 bp, Unknown
  misc_feature (1)..( 10): Result.001 file - promoters60/1010346
attgaatttg

SEQ ID NO: 90600 - DNA, 10 bp, Unknown
  misc_feature (1)..( 10): Result.001 file - promoters60/1010367
attgaagttt

SEQ ID NO: 90601 - DNA, 9 bp, Unknown
  misc_feature (1)..( 9): Result.001 file - promoters60/1010367
gaaaatatt

SEQ ID NO: 90602 - DNA, 9 bp, Unknown
  misc_feature (1)..( 9): Result.001 file - promoters60/1010367
aaaaataag

SEQ ID NO: 90603 - DNA, 9 bp, Unknown
  misc_feature (1)..( 9): Result.001 file - promoters60/1010367
aaaaattaa

SEQ ID NO: 90604 - DNA, 9 bp, Unknown
  misc_feature (1)..( 9): Result.001 file - promoters60/1010367
taaagtata

SEQ ID NO: 90605 - DNA, 9 bp, Unknown
  misc_feature (1)..( 9): Result.001 file - promoters60/1010367
aaagattta

SEQ ID NO: 90606 - DNA, 9 bp, Unknown
  misc_feature (1)..( 9): Result.001 file - promoters60/1010367
taaaatttc

SEQ ID NO: 90607 - DNA, 9 bp, Unknown
  misc_feature (1)..( 9): Result.001 file - promoters60/1010367
caaaattga

SEQ ID NO: 90608 - DNA, 10 bp, Unknown
  misc_feature (1)..( 10): Result.001 file - promoters60/1010367
aaaacaaacg

SEQ ID NO: 90609 - DNA, 10 bp, Unknown
  misc_feature (1)..( 10): Result.001 file - promoters60/1010367
aaaaaaaaga

SEQ ID NO: 90610 - DNA, 10 bp, Unknown
  misc_feature (1)..( 10): Result.001 file - promoters60/1010367
taaataaatt

SEQ ID NO: 90611 - DNA, 10 bp, Unknown
  misc_feature (1)..( 10): Result.001 file - promoters60/1010367
caaacaaatg

SEQ ID NO: 90612 - DNA, 10 bp, Unknown
  misc_feature (1)..( 10): Result.001 file - promoters60/1010367
gaaacaaatt

SEQ ID NO: 90613 - DNA, 10 bp, Unknown
  misc_feature (1)..( 10): Result.001 file - promoters60/1010367
ataatgaatt

SEQ ID NO: 90614 - DNA, 10 bp, Unknown
  misc_feature (1)..( 10): Result.001 file - promoters60/1010367
taaattaatt

SEQ ID NO: 90615 - DNA, 10 bp, Unknown
  misc_feature (1)..( 10): Result.001 file - promoters60/1010367
gaaatgaatt

SEQ ID NO: 90616 - DNA, 13 bp, Unknown
  misc_feature (1)..( 13): Result.001 file - promoters60/1010367
aattgggactaaa

SEQ ID NO: 90617 - DNA, 13 bp, Unknown
  misc_feature (1)..( 13): Result.001 file - promoters60/1010367
tatttggataaaa

SEQ ID NO: 90618 - DNA, 13 bp, Unknown
  misc_feature (1)..( 13): Result.001 file - promoters60/1010367
cctttgaataaaa

SEQ ID NO: 90619 - DNA, 13 bp, Unknown
  misc_feature (1)..( 13): Result.001 file - promoters60/1010367
aattaaaaaggaa

SEQ ID NO: 90620 - DNA, 13 bp, Unknown
  misc_feature (1)..( 13): Result.001 file - promoters60/1010367
caataaatataaa

SEQ ID NO: 90621 - DNA, 13 bp, Unknown
  misc_feature (1)..( 13): Result.001 file - promoters60/1010367
tcttcgaaggtaa

SEQ ID NO: 90622 - DNA, 11 bp, Unknown
  misc_feature (1)..( 11): Result.001 file - promoters60/1010367
aattacaaaac

SEQ ID NO: 90623 - DNA, 11 bp, Unknown
  misc_feature (1)..( 11): Result.001 file - promoters60/1010367
gtatacaaaaa

SEQ ID NO: 90624 - DNA, 11 bp, Unknown
  misc_feature (1)..( 11): Result.001 file - promoters60/1010367
caatactatct

SEQ ID NO: 90625 - DNA, 11 bp, Unknown
  misc_feature (1)..( 11): Result.001 file - promoters60/1010367
tcatacaaaca

SEQ ID NO: 90626 - DNA, 11 bp, Unknown
  misc_feature (1)..( 11): Result.001 file - promoters60/1010367
actcccaaaaa

SEQ ID NO: 90627 - DNA, 11 bp, Unknown
  misc_feature (1)..( 11): Result.001 file - promoters60/1010367
aattcctaaaa

SEQ ID NO: 90628 - DNA, 11 bp, Unknown
  misc_feature (1)..( 11): Result.001 file - promoters60/1010367
taacccaaaat

SEQ ID NO: 90629 - DNA, 11 bp, Unknown
  misc_feature (1)..( 11): Result.001 file - promoters60/1010367
atatacaagaa

SEQ ID NO: 90630 - DNA, 11 bp, Unknown
  misc_feature (1)..( 11): Result.001 file - promoters60/1010367
aaaatgaaaaa

SEQ ID NO: 90631 - DNA, 11 bp, Unknown
  misc_feature (1)..( 11): Result.001 file - promoters60/1010367
ataatgaatta

SEQ ID NO: 90632 - DNA, 11 bp, Unknown
  misc_feature (1)..( 11): Result.001 file - promoters60/1010367
taaataaattt

SEQ ID NO: 90633 - DNA, 11 bp, Unknown
  misc_feature (1)..( 11): Result.001 file - promoters60/1010367
taaattaatta

SEQ ID NO: 90634 - DNA, 11 bp, Unknown
  misc_feature (1)..( 11): Result.001 file - promoters60/1010367
gaaatgaattt

SEQ ID NO: 90635 - DNA, 11 bp, Unknown
  misc_feature (1)..( 11): Result.001 file - promoters60/1010367
caaattattta

SEQ ID NO: 90636 - DNA, 8 bp, Unknown
  misc_feature (1)..( 8): Result.001 file - promoters60/1010367
tatatata

SEQ ID NO: 90637 - DNA, 8 bp, Unknown
  misc_feature (1)..( 8): Result.001 file - promoters60/1010367
tatataaa

SEQ ID NO: 90638 - DNA, 8 bp, Unknown
  misc_feature (1)..( 8): Result.001 file - promoters60/1010367
tatatata

SEQ ID NO: 90639 - DNA, 8 bp, Unknown
  misc_feature (1)..( 8): Result.001 file - promoters60/1010367
tataaata

SEQ ID NO: 90640 - DNA, 8 bp, Unknown
  misc_feature (1)..( 8): Result.001 file - promoters60/1010367
gatataat

SEQ ID NO: 90641 - DNA, 8 bp, Unknown
  misc_feature (1)..( 8): Result.001 file - promoters60/1010367
tataaaca

SEQ ID NO: 90642 - DNA, 10 bp, Unknown
  misc_feature (1)..( 10): Result.001 file - promoters60/1010367
atttatttcg

SEQ ID NO: 90643 - DNA, 10 bp, Unknown
  misc_feature (1)..( 10): Result.001 file - promoters60/1010367
atttatgtcg

SEQ ID NO: 90644 - DNA, 10 bp, Unknown
  misc_feature (1)..( 10): Result.001 file - promoters60/1010367
ttttattcta

SEQ ID NO: 90645 - DNA, 10 bp, Unknown
  misc_feature (1)..( 10): Result.001 file - promoters60/1010367
ttttcttttc

SEQ ID NO: 90646 - DNA, 10 bp, Unknown
  misc_feature (1)..( 10): Result.001 file - promoters60/1010367
atttatggac

SEQ ID NO: 90647 - DNA, 11 bp, Unknown
  misc_feature (1)..( 11): Result.001 file - promoters60/1010367
atttcatttcc

SEQ ID NO: 90648 - DNA, 7 bp, Unknown
  misc_feature (1)..( 7): Result.001 file - promoters60/1010367
taagatt

SEQ ID NO: 90649 - DNA, 7 bp, Unknown
  misc_feature (1)..( 7): Result.001 file - promoters60/1010367
taaaatt

SEQ ID NO: 90650 - DNA, 7 bp, Unknown
  misc_feature (1)..( 7): Result.001 file - promoters60/1010367
aaaaatt

SEQ ID NO: 90651 - DNA, 7 bp, Unknown
  misc_feature (1)..( 7): Result.001 file - promoters60/1010367
caaaatt

SEQ ID NO: 90652 - DNA, 7 bp, Unknown
  misc_feature (1)..( 7): Result.001 file - promoters60/1010367
caaaatt

SEQ ID NO: 90653 - DNA, 7 bp, Unknown
  misc_feature (1)..( 7): Result.001 file - promoters60/1010373
aaaaatt

SEQ ID NO: 90654 - DNA, 8 bp, Unknown
  misc_feature (1)..( 8): Result.001 file - promoters60/1010373
cttttttt

SEQ ID NO: 90655 - DNA, 8 bp, Unknown
  misc_feature (1)..( 8): Result.001 file - promoters60/1010373
ctttttta

SEQ ID NO: 90656 - DNA, 8 bp, Unknown
  misc_feature (1)..( 8): Result.001 file - promoters60/1010373
cttctttg

SEQ ID NO: 90657 - DNA, 8 bp, Unknown
  misc_feature (1)..( 8): Result.001 file - promoters60/1010373
gttttttt

SEQ ID NO: 90658 - DNA, 10 bp, Unknown
  misc_feature (1)..( 10): Result.001 file - promoters60/1010373
ttaatttaca

SEQ ID NO: 90659 - DNA, 10 bp, Unknown
  misc_feature (1)..( 10): Result.001 file - promoters60/1010373
ataatttaca

SEQ ID NO: 90660 - DNA, 10 bp, Unknown
  misc_feature (1)..( 10): Result.001 file - promoters60/1010373
aaaatataca

SEQ ID NO: 90661 - DNA, 10 bp, Unknown
  misc_feature (1)..( 10): Result.001 file - promoters60/1010373
ttaattagat

SEQ ID NO: 90662 - DNA, 12 bp, Unknown
  misc_feature (1)..( 12): Result.001 file - promoters60/1010373
cttcttcttttt

SEQ ID NO: 90663 - DNA, 12 bp, Unknown
  misc_feature (1)..( 12): Result.001 file - promoters60/1010373
cttctttgcaaa

SEQ ID NO: 90664 - DNA, 12 bp, Unknown
  misc_feature (1)..( 12): Result.001 file - promoters60/1010373
cttattcttttt

SEQ ID NO: 90665 - DNA, 12 bp, Unknown
  misc_feature (1)..( 12): Result.001 file - promoters60/1010373
ttttttaaagtt

SEQ ID NO: 90666 - DNA, 12 bp, Unknown
  misc_feature (1)..( 12): Result.001 file - promoters60/1010373
ttttataatata

SEQ ID NO: 90667 - DNA, 9 bp, Unknown
  misc_feature (1)..( 9): Result.001 file - promoters60/1010373
attttttaa

SEQ ID NO: 90668 - DNA, 9 bp, Unknown
  misc_feature (1)..( 9): Result.001 file - promoters60/1010373
attttataa

SEQ ID NO: 90669 - DNA, 9 bp, Unknown
  misc_feature (1)..( 9): Result.001 file - promoters60/1010373
tctttttaa

SEQ ID NO: 90670 - DNA, 9 bp, Unknown
  misc_feature (1)..( 9): Result.001 file - promoters60/1010385
attttattg

SEQ ID NO: 90671 - DNA, 10 bp, Unknown
  misc_feature (1)..( 10): Result.001 file - promoters60/1010385
cctaagttta

SEQ ID NO: 90672 - DNA, 10 bp, Unknown
  misc_feature (1)..( 10): Result.001 file - promoters60/1010385
gtaaagatta

SEQ ID NO: 90673 - DNA, 10 bp, Unknown
  misc_feature (1)..( 10): Result.001 file - promoters60/1010385
ctgaagtttc

SEQ ID NO: 90674 - DNA, 10 bp, Unknown
  misc_feature (1)..( 10): Result.001 file - promoters60/1010385
cagaattttt

SEQ ID NO: 90675 - DNA, 10 bp, Unknown
  misc_feature (1)..( 10): Result.001 file - promoters60/1010385
tcagagtttt

SEQ ID NO: 90676 - DNA, 10 bp, Unknown
  misc_feature (1)..( 10): Result.001 file - promoters60/1010385
ataaaaattc

SEQ ID NO: 90677 - DNA, 16 bp, Unknown
  misc_feature (1)..( 16): Result.001 file - promoters60/1010385
caatgggctgggccta

SEQ ID NO: 90678 - DNA, 16 bp, Unknown
  misc_feature (1)..( 16): Result.001 file - promoters60/1010385
aaataggcccaacaaa

SEQ ID NO: 90679 - DNA, 16 bp, Unknown
  misc_feature (1)..( 16): Result.001 file - promoters60/1010385
tgttgggcttttaatg

SEQ ID NO: 90680 - DNA, 16 bp, Unknown
  misc_feature (1)..( 16): Result.001 file - promoters60/1010385
aattgggctttttaag

SEQ ID NO: 90681 - DNA, 16 bp, Unknown
  misc_feature (1)..( 16): Result.001 file - promoters60/1010385
aaaaaggcccattata

SEQ ID NO: 90682 - DNA, 16 bp, Unknown
  misc_feature (1)..( 16): Result.001 file - promoters60/1010411
aataaagcccattata

SEQ ID NO: 90683 - DNA, 8 bp, Unknown
  misc_feature (1)..( 8): Result.001 file - promoters60/1010411
aataattg

SEQ ID NO: 90684 - DNA, 8 bp, Unknown
  misc_feature (1)..( 8): Result.001 file - promoters60/1010411
catacttg

SEQ ID NO: 90685 - DNA, 8 bp, Unknown
  misc_feature (1)..( 8): Result.001 file - promoters60/1010411
aattattt

SEQ ID NO: 90686 - DNA, 9 bp, Unknown
  misc_feature (1)..( 9): Result.001 file - promoters60/1010411
tatgtttgc

SEQ ID NO: 90687 - DNA, 9 bp, Unknown
  misc_feature (1)..( 9): Result.001 file - promoters60/1010411
ggtgtttgc

SEQ ID NO: 90688 - DNA, 9 bp, Unknown
  misc_feature (1)..( 9): Result.001 file - promoters60/1010411
tatattttt

SEQ ID NO: 90689 - DNA, 10 bp, Unknown
  misc_feature (1)..( 10): Result.001 file - promoters60/1010411
gtaatcgatg

SEQ ID NO: 90690 - DNA, 10 bp, Unknown
  misc_feature (1)..( 10): Result.001 file - promoters60/1010411
gtaattgatg

SEQ ID NO: 90691 - DNA, 10 bp, Unknown
  misc_feature (1)..( 10): Result.001 file - promoters60/1010411
ggacttgatg

SEQ ID NO: 90692 - DNA, 8 bp, Unknown
  misc_feature (1)..( 8): Result.001 file - promoters60/1010411
aaaatgag

SEQ ID NO: 90693 - DNA, 8 bp, Unknown
  misc_feature (1)..( 8): Result.001 file - promoters60/1010411
aaagtgaa

SEQ ID NO: 90694 - DNA, 8 bp, Unknown
  misc_feature (1)..( 8): Result.001 file - promoters60/1010411
gaagagaa

SEQ ID NO: 90695 - DNA, 14 bp, Unknown
  misc_feature (1)..( 14): Result.001 file - promoters60/1010411
ctacttattctttt

SEQ ID NO: 90696 - DNA, 14 bp, Unknown
  misc_feature (1)..( 14): Result.001 file - promoters60/1010411
ttaacaattttttt

SEQ ID NO: 90697 - DNA, 14 bp, Unknown
  misc_feature (1)..( 14): Result.001 file - promoters60/1010411
ttaataatttattt

SEQ ID NO: 90698 - DNA, 12 bp, Unknown
  misc_feature (1)..( 12): Result.001 file - promoters60/1010411
gctacttattct

SEQ ID NO: 90699 - DNA, 12 bp, Unknown
  misc_feature (1)..( 12): Result.001 file - promoters60/1010411
attactaatttt

SEQ ID NO: 90700 - DNA, 12 bp, Unknown
  misc_feature (1)..( 12): Result.001 file - promoters60/1010411
tagatttattaa

SEQ ID NO: 90701 - DNA, 6 bp, Unknown
  misc_feature (1)..( 6): Result.001 file - promoters60/1010411
tatttt

SEQ ID NO: 90702 - DNA, 6 bp, Unknown
  misc_feature (1)..( 6): Result.001 file - promoters60/1010411
tatttt

SEQ ID NO: 90703 - DNA, 6 bp, Unknown
  misc_feature (1)..( 6): Result.001 file - promoters60/1010418
tatttt

SEQ ID NO: 90704 - DNA, 11 bp, Unknown
  misc_feature (1)..( 11): Result.001 file - promoters60/1010418
ccagaagagaa

SEQ ID NO: 90705 - DNA, 11 bp, Unknown
  misc_feature (1)..( 11): Result.001 file - promoters60/1010418
ccaaaagaaat

SEQ ID NO: 90706 - DNA, 11 bp, Unknown
  misc_feature (1)..( 11): Result.001 file - promoters60/1010418
tgggaagtgaa

SEQ ID NO: 90707 - DNA, 8 bp, Unknown
  misc_feature (1)..( 8): Result.001 file - promoters60/1010418
ggatagat

SEQ ID NO: 90708 - DNA, 8 bp, Unknown
  misc_feature (1)..( 8): Result.001 file - promoters60/1010418
ggaaagaa

SEQ ID NO: 90709 - DNA, 8 bp, Unknown
  misc_feature (1)..( 8): Result.001 file - promoters60/1010418
tgaaagaa

SEQ ID NO: 90710 - DNA, 7 bp, Unknown
  misc_feature (1)..( 7): Result.001 file - promoters60/1010418
gagtgat

SEQ ID NO: 90711 - DNA, 7 bp, Unknown
  misc_feature (1)..( 7): Result.001 file - promoters60/1010418
tagtgat

SEQ ID NO: 90712 - DNA, 7 bp, Unknown
  misc_feature (1)..( 7): Result.001 file - promoters60/1010418
tagcgat

SEQ ID NO: 90713 - DNA, 8 bp, Unknown
  misc_feature (1)..( 8): Result.001 file - promoters60/1010418
ggcctaaa

SEQ ID NO: 90714 - DNA, 8 bp, Unknown
  misc_feature (1)..( 8): Result.001 file - promoters60/1010418
ggcctaat

SEQ ID NO: 90715 - DNA, 8 bp, Unknown
  misc_feature (1)..( 8): Result.001 file - promoters60/1010421
ggcctaat

SEQ ID NO: 90716 - DNA, 6 bp, Unknown
  misc_feature (1)..( 6): Result.001 file - promoters60/1010421
tgtggt

SEQ ID NO: 90717 - DNA, 6 bp, Unknown
  misc_feature (1)..( 6): Result.001 file - promoters60/1010421
tgtggt

SEQ ID NO: 90718 - DNA, 11 bp, Unknown
  misc_feature (1)..( 11): Result.001 file - promoters60/1010421
cttgaataaat

SEQ ID NO: 90719 - DNA, 11 bp, Unknown
  misc_feature (1)..( 11): Result.001 file - promoters60/1010421
cttaaatcaat

SEQ ID NO: 90720 - DNA, 6 bp, Unknown
  misc_feature (1)..( 6): Result.001 file - promoters60/1010421
caagat

SEQ ID NO: 90721 - DNA, 6 bp, Unknown
  misc_feature (1)..( 6): Result.001 file - promoters60/1010421
caagat

SEQ ID NO: 90722 - DNA, 7 bp, Unknown
  misc_feature (1)..( 7): Result.001 file - promoters60/1010421
aatgttt

SEQ ID NO: 90723 - DNA, 7 bp, Unknown
  misc_feature (1)..( 7): Result.001 file - promoters60/1010421
aatattt

SEQ ID NO: 90724 - DNA, 9 bp, Unknown
  misc_feature (1)..( 9): Result.001 file - promoters60/1010421
ataataaaa

SEQ ID NO: 90725 - DNA, 9 bp, Unknown
  misc_feature (1)..( 9): Result.001 file - promoters60/1010421
ataacaaaa

SEQ ID NO: 90726 - DNA, 7 bp, Unknown
  misc_feature (1)..( 7): Result.001 file - promoters60/1010421
ccacaaa

SEQ ID NO: 90727 - DNA, 7 bp, Unknown
  misc_feature (1)..( 7): Result.001 file - promoters60/1010421
ccaaaaa

SEQ ID NO: 90728 - DNA, 13 bp, Unknown
  misc_feature (1)..( 13): Result.001 file - promoters60/1010421
tgttcagtgatcc

SEQ ID NO: 90729 - DNA, 13 bp, Unknown
  misc_feature (1)..( 13): Result.001 file - promoters60/1010421
aataacgtggtcc

SEQ ID NO: 90730 - DNA, 13 bp, Unknown
  misc_feature (1)..( 13): Result.001 file - promoters60/1010421
aataacgtggtcc

SEQ ID NO: 90731 - DNA, 7 bp, Unknown
  misc_feature (1)..( 7): Result.001 file - promoters60/1010421
attcaaa

SEQ ID NO: 90732 - DNA, 7 bp, Unknown
  misc_feature (1)..( 7): Result.001 file - promoters60/1010421
atttaaa

SEQ ID NO: 90733 - DNA, 8 bp, Unknown
  misc_feature (1)..( 8): Result.001 file - promoters60/1010421
tgataatc

SEQ ID NO: 90734 - DNA, 8 bp, Unknown
  misc_feature (1)..( 8): Result.001 file - promoters60/1010421
tgattatc

SEQ ID NO: 90735 - DNA, 6 bp, Unknown
  misc_feature (1)..( 6): Result.001 file - promoters60/1010421
atatat

SEQ ID NO: 90736 - DNA, 6 bp, Unknown
  misc_feature (1)..( 6): Result.001 file - promoters60/1010421
atatat

SEQ ID NO: 90737 - DNA, 7 bp, Unknown
  misc_feature (1)..( 7): Result.001 file - promoters60/1010421
ttacttt

SEQ ID NO: 90738 - DNA, 7 bp, Unknown
  misc_feature (1)..( 7): Result.001 file - promoters60/1010421
ttagttt

SEQ ID NO: 90739 - DNA, 6 bp, Unknown
  misc_feature (1)..( 6): Result.001 file - promoters60/1010421
atttta

SEQ ID NO: 90740 - DNA, 6 bp, Unknown
  misc_feature (1)..( 6): Result.001 file - promoters60/1010421
atttta

SEQ ID NO: 90741 - DNA, 7 bp, Unknown
  misc_feature (1)..( 7): Result.001 file - promoters60/1010421
atatata

SEQ ID NO: 90742 - DNA, 7 bp, Unknown
  misc_feature (1)..( 7): Result.001 file - promoters60/1010421
atatata

SEQ ID NO: 90743 - DNA, 7 bp, Unknown
  misc_feature (1)..( 7): Result.001 file - promoters60/1010421
attcttt

SEQ ID NO: 90744 - DNA, 7 bp, Unknown
  misc_feature (1)..( 7): Result.001 file - promoters60/1010421
attattt

SEQ ID NO: 90745 - DNA, 7 bp, Unknown
  misc_feature (1)..( 7): Result.001 file - promoters60/1010421
tatttat

SEQ ID NO: 90746 - DNA, 7 bp, Unknown
  misc_feature (1)..( 7): Result.001 file - promoters60/1010421
tatgtat

SEQ ID NO: 90747 - DNA, 7 bp, Unknown
  misc_feature (1)..( 7): Result.001 file - promoters60/1010421
attcata

SEQ ID NO: 90748 - DNA, 7 bp, Unknown
  misc_feature (1)..( 7): Result.001 file - promoters60/1010421
attaata

SEQ ID NO: 90749 - DNA, 7 bp, Unknown
  misc_feature (1)..( 7): Result.001 file - promoters60/1010421
aaggatg

SEQ ID NO: 90750 - DNA, 7 bp, Unknown
  misc_feature (1)..( 7): Result.001 file - promoters60/1010421
aaggatg

SEQ ID NO: 90751 - DNA, 6 bp, Unknown
  misc_feature (1)..( 6): Result.001 file - promoters60/1010421
ccaact

SEQ ID NO: 90752 - DNA, 6 bp, Unknown
  misc_feature (1)..( 6): Result.001 file - promoters60/1010421
ccaact

SEQ ID NO: 90753 - DNA, 7 bp, Unknown
  misc_feature (1)..( 7): Result.001 file - promoters60/1010421
tataatt

SEQ ID NO: 90754 - DNA, 7 bp, Unknown
  misc_feature (1)..( 7): Result.001 file - promoters60/1010425
tatcatt

SEQ ID NO: 90755 - DNA, 8 bp, Unknown
  misc_feature (1)..( 8): Result.001 file - promoters60/1010425
gaaataca

SEQ ID NO: 90756 - DNA, 8 bp, Unknown
  misc_feature (1)..( 8): Result.001 file - promoters60/1010425
gaaaaaca

SEQ ID NO: 90757 - DNA, 8 bp, Unknown
  misc_feature (1)..( 8): Result.001 file - promoters60/1010425
gaaaaatt

SEQ ID NO: 90758 - DNA, 8 bp, Unknown
  misc_feature (1)..( 8): Result.001 file - promoters60/1010425
taatcagg

SEQ ID NO: 90759 - DNA, 8 bp, Unknown
  misc_feature (1)..( 8): Result.001 file - promoters60/1010425
aaattagg

SEQ ID NO: 90760 - DNA, 8 bp, Unknown
  misc_feature (1)..( 8): Result.001 file - promoters60/1010425
aaattaaa

SEQ ID NO: 90761 - DNA, 8 bp, Unknown
  misc_feature (1)..( 8): Result.001 file - promoters60/1010425
gaaagccc

SEQ ID NO: 90762 - DNA, 8 bp, Unknown
  misc_feature (1)..( 8): Result.001 file - promoters60/1010425
aaaaaccc

SEQ ID NO: 90763 - DNA, 8 bp, Unknown
  misc_feature (1)..( 8): Result.001 file - promoters60/1010429
aaaaacgt

SEQ ID NO: 90764 - DNA, 13 bp, Unknown
  misc_feature (1)..( 13): Result.001 file - promoters60/1010429
cgaaaaataaata

SEQ ID NO: 90765 - DNA, 13 bp, Unknown
  misc_feature (1)..( 13): Result.001 file - promoters60/1010429
ttaaacatatagt

SEQ ID NO: 90766 - DNA, 13 bp, Unknown
  misc_feature (1)..( 13): Result.001 file - promoters60/1010429
gaaaacaaaacta

SEQ ID NO: 90767 - DNA, 13 bp, Unknown
  misc_feature (1)..( 13): Result.001 file - promoters60/1010429
tataaaatacagt

SEQ ID NO: 90768 - DNA, 13 bp, Unknown
  misc_feature (1)..( 13): Result.001 file - promoters60/1010429
aaaaacaaaattt

SEQ ID NO: 90769 - DNA, 13 bp, Unknown
  misc_feature (1)..( 13): Result.001 file - promoters60/1010429
tgtcacaaaattt

SEQ ID NO: 90770 - DNA, 11 bp, Unknown
  misc_feature (1)..( 11): Result.001 file - promoters60/1010429
taaataaaagc

SEQ ID NO: 90771 - DNA, 11 bp, Unknown
  misc_feature (1)..( 11): Result.001 file - promoters60/1010429
taattaaacat

SEQ ID NO: 90772 - DNA, 11 bp, Unknown
  misc_feature (1)..( 11): Result.001 file - promoters60/1010429
aaaacaaaact

SEQ ID NO: 90773 - DNA, 11 bp, Unknown
  misc_feature (1)..( 11): Result.001 file - promoters60/1010429
attataaaata

SEQ ID NO: 90774 - DNA, 11 bp, Unknown
  misc_feature (1)..( 11): Result.001 file - promoters60/1010429
gaatgaaacat

SEQ ID NO: 90775 - DNA, 11 bp, Unknown
  misc_feature (1)..( 11): Result.001 file - promoters60/1010429
gcatcaagact

SEQ ID NO: 90776 - DNA, 10 bp, Unknown
  misc_feature (1)..( 10): Result.001 file - promoters60/1010429
tttgtttaac

SEQ ID NO: 90777 - DNA, 10 bp, Unknown
  misc_feature (1)..( 10): Result.001 file - promoters60/1010429
tttatttact

SEQ ID NO: 90778 - DNA, 10 bp, Unknown
  misc_feature (1)..( 10): Result.001 file - promoters60/1010429
cttgtttgag

SEQ ID NO: 90779 - DNA, 10 bp, Unknown
  misc_feature (1)..( 10): Result.001 file - promoters60/1010429
tttgtttctg

SEQ ID NO: 90780 - DNA, 10 bp, Unknown
  misc_feature (1)..( 10): Result.001 file - promoters60/1010429
tttattataa

SEQ ID NO: 90781 - DNA, 10 bp, Unknown
  misc_feature (1)..( 10): Result.001 file - promoters60/1010429
gttattaatt

SEQ ID NO: 90782 - DNA, 10 bp, Unknown
  misc_feature (1)..( 10): Result.001 file - promoters60/1010429
gttcttatga

SEQ ID NO: 90783 - DNA, 19 bp, Unknown
  misc_feature (1)..( 19): Result.001 file - promoters60/1010429
tccaatatgtttttcttaa

SEQ ID NO: 90784 - DNA, 19 bp, Unknown
  misc_feature (1)..( 19): Result.001 file - promoters60/1010429
cactttttgttttctatta

SEQ ID NO: 90785 - DNA, 19 bp, Unknown
  misc_feature (1)..( 19): Result.001 file - promoters60/1010429
aataagttgttctagtagt

SEQ ID NO: 90786 - DNA, 19 bp, Unknown
  misc_feature (1)..( 19): Result.001 file - promoters60/1010429
tacacttccttttgtgttc

SEQ ID NO: 90787 - DNA, 19 bp, Unknown
  misc_feature (1)..( 19): Result.001 file - promoters60/1010429
taaaacgtgttcaaggctt

SEQ ID NO: 90788 - DNA, 19 bp, Unknown
  misc_feature (1)..( 19): Result.001 file - promoters60/1010429
atttagttgtcaccagcaa

SEQ ID NO: 90789 - DNA, 16 bp, Unknown
  misc_feature (1)..( 16): Result.001 file - promoters60/1010429
atatgtttttcttaaa

SEQ ID NO: 90790 - DNA, 16 bp, Unknown
  misc_feature (1)..( 16): Result.001 file - promoters60/1010429
tttttgttttctatta

SEQ ID NO: 90791 - DNA, 17 bp, Unknown
  misc_feature (1)..( 17): Result.001 file - promoters60/1010429
aataagttgttctagta

SEQ ID NO: 90792 - DNA, 17 bp, Unknown
  misc_feature (1)..( 17): Result.001 file - promoters60/1010429
cacttccttttgtgttc

SEQ ID NO: 90793 - DNA, 17 bp, Unknown
  misc_feature (1)..( 17): Result.001 file - promoters60/1010429
taaaacgtgttcaaggc

SEQ ID NO: 90794 - DNA, 17 bp, Unknown
  misc_feature (1)..( 17): Result.001 file - promoters60/1010429
atttagttgtcaccagc

SEQ ID NO: 90795 - DNA, 10 bp, Unknown
  misc_feature (1)..( 10): Result.001 file - promoters60/1010429
ttatatatag

SEQ ID NO: 90796 - DNA, 10 bp, Unknown
  misc_feature (1)..( 10): Result.001 file - promoters60/1010429
gtatataaat

SEQ ID NO: 90797 - DNA, 10 bp, Unknown
  misc_feature (1)..( 10): Result.001 file - promoters60/1010429
atataaataa

SEQ ID NO: 90798 - DNA, 10 bp, Unknown
  misc_feature (1)..( 10): Result.001 file - promoters60/1010429
ttatacaaat

SEQ ID NO: 90799 - DNA, 10 bp, Unknown
  misc_feature (1)..( 10): Result.001 file - promoters60/1010429
ctataaaata

SEQ ID NO: 90800 - DNA, 10 bp, Unknown
  misc_feature (1)..( 10): Result.001 file - promoters60/1010429
ctatttaaac

SEQ ID NO: 90801 - DNA, 10 bp, Unknown
  misc_feature (1)..( 10): Result.001 file - promoters60/1010431
ctatttaagt

SEQ ID NO: 90802 - DNA, 9 bp, Unknown
  misc_feature (1)..( 9): Result.001 file - promoters60/1010431
gacacgtgg

SEQ ID NO: 90803 - DNA, 9 bp, Unknown
  misc_feature (1)..( 9): Result.001 file - promoters60/1010431
gccacgtgg

SEQ ID NO: 90804 - DNA, 9 bp, Unknown
  misc_feature (1)..( 9): Result.001 file - promoters60/1010431
gacacgtgg

SEQ ID NO: 90805 - DNA, 9 bp, Unknown
  misc_feature (1)..( 9): Result.001 file - promoters60/1010435
gcctcgttc

SEQ ID NO: 90806 - DNA, 8 bp, Unknown
  misc_feature (1)..( 8): Result.001 file - promoters60/1010435
tcttcttc

SEQ ID NO: 90807 - DNA, 8 bp, Unknown
  misc_feature (1)..( 8): Result.001 file - promoters60/1010435
cctttttc

SEQ ID NO: 90808 - DNA, 8 bp, Unknown
  misc_feature (1)..( 8): Result.001 file - promoters60/1010435
tcttctta

SEQ ID NO: 90809 - DNA, 10 bp, Unknown
  misc_feature (1)..( 10): Result.001 file - promoters60/1010435
attttcaaag

SEQ ID NO: 90810 - DNA, 10 bp, Unknown
  misc_feature (1)..( 10): Result.001 file - promoters60/1010435
attatcaaag

SEQ ID NO: 90811 - DNA, 10 bp, Unknown
  misc_feature (1)..( 10): Result.001 file - promoters60/1010435
attatccttg

SEQ ID NO: 90812 - DNA, 10 bp, Unknown
  misc_feature (1)..( 10): Result.001 file - promoters60/1010435
aatctgaatc

SEQ ID NO: 90813 - DNA, 10 bp, Unknown
  misc_feature (1)..( 10): Result.001 file - promoters60/1010435
actctgcatc

SEQ ID NO: 90814 - DNA, 10 bp, Unknown
  misc_feature (1)..( 10): Result.001 file - promoters60/1010449
aatttgattt

SEQ ID NO: 90815 - DNA, 9 bp, Unknown
  misc_feature (1)..( 9): Result.001 file - promoters60/1010449
agtgtgttt

SEQ ID NO: 90816 - DNA, 9 bp, Unknown
  misc_feature (1)..( 9): Result.001 file - promoters60/1010449
cttgtgttt

SEQ ID NO: 90817 - DNA, 9 bp, Unknown
  misc_feature (1)..( 9): Result.001 file - promoters60/1010449
attgtattt

SEQ ID NO: 90818 - DNA, 9 bp, Unknown
  misc_feature (1)..( 9): Result.001 file - promoters60/1010449
attctattt

SEQ ID NO: 90819 - DNA, 8 bp, Unknown
  misc_feature (1)..( 8): Result.001 file - promoters60/1010449
cacaataa

SEQ ID NO: 90820 - DNA, 8 bp, Unknown
  misc_feature (1)..( 8): Result.001 file - promoters60/1010449
tacaatat

SEQ ID NO: 90821 - DNA, 8 bp, Unknown
  misc_feature (1)..( 8): Result.001 file - promoters60/1010449
caaaatta

SEQ ID NO: 90822 - DNA, 8 bp, Unknown
  misc_feature (1)..( 8): Result.001 file - promoters60/1010491
atcaatat

SEQ ID NO: 90823 - DNA, 11 bp, Unknown
  misc_feature (1)..( 11): Result.001 file - promoters60/1010491
tttaaagaaat

SEQ ID NO: 90824 - DNA, 11 bp, Unknown
  misc_feature (1)..( 11): Result.001 file - promoters60/1010491
aataaagaaaa

SEQ ID NO: 90825 - DNA, 11 bp, Unknown
  misc_feature (1)..( 11): Result.001 file - promoters60/1010491
ttttaagttat

SEQ ID NO: 90826 - DNA, 11 bp, Unknown
  misc_feature (1)..( 11): Result.001 file - promoters60/1010524
taagaagtaaa

SEQ ID NO: 90827 - DNA, 7 bp, Unknown
  misc_feature (1)..( 7): Result.001 file - promoters60/1010524
taacata

SEQ ID NO: 90828 - DNA, 7 bp, Unknown
  misc_feature (1)..( 7): Result.001 file - promoters60/1010524
taaaata

SEQ ID NO: 90829 - DNA, 6 bp, Unknown
  misc_feature (1)..( 6): Result.001 file - promoters60/1010524
atcaaa

SEQ ID NO: 90830 - DNA, 6 bp, Unknown
  misc_feature (1)..( 6): Result.001 file - promoters60/1010524
atcaaa

SEQ ID NO: 90831 - DNA, 7 bp, Unknown
  misc_feature (1)..( 7): Result.001 file - promoters60/1010524
aacaaat

SEQ ID NO: 90832 - DNA, 7 bp, Unknown
  misc_feature (1)..( 7): Result.001 file - promoters60/1010524
aacaaag

SEQ ID NO: 90833 - DNA, 7 bp, Unknown
  misc_feature (1)..( 7): Result.001 file - promoters60/1010524
aactaat

SEQ ID NO: 90834 - DNA, 10 bp, Unknown
  misc_feature (1)..( 10): Result.001 file - promoters60/1010524
tattttgaaa

SEQ ID NO: 90835 - DNA, 10 bp, Unknown
  misc_feature (1)..( 10): Result.001 file - promoters60/1010524
tattttgttg

SEQ ID NO: 90836 - DNA, 10 bp, Unknown
  misc_feature (1)..( 10): Result.001 file - promoters60/1010524
ccttttgaaa

SEQ ID NO: 90837 - DNA, 10 bp, Unknown
  misc_feature (1)..( 10): Result.001 file - promoters60/1010524
gaatattttt

SEQ ID NO: 90838 - DNA, 10 bp, Unknown
  misc_feature (1)..( 10): Result.001 file - promoters60/1010524
gaatattttt

SEQ ID NO: 90839 - DNA, 10 bp, Unknown
  misc_feature (1)..( 10): Result.001 file - promoters60/1010524
ttatatattt

SEQ ID NO: 90840 - DNA, 7 bp, Unknown
  misc_feature (1)..( 7): Result.001 file - promoters60/1010524
attattt

SEQ ID NO: 90841 - DNA, 7 bp, Unknown
  misc_feature (1)..( 7): Result.001 file - promoters60/1010524
attcttt

SEQ ID NO: 90842 - DNA, 6 bp, Unknown
  misc_feature (1)..( 6): Result.001 file - promoters60/1010524
atttgg

SEQ ID NO: 90843 - DNA, 6 bp, Unknown
  misc_feature (1)..( 6): Result.001 file - promoters60/1010524
atttgg

SEQ ID NO: 90844 - DNA, 6 bp, Unknown
  misc_feature (1)..( 6): Result.001 file - promoters60/1010524
tttggt

SEQ ID NO: 90845 - DNA, 6 bp, Unknown
  misc_feature (1)..( 6): Result.001 file - promoters60/1010524
tttggt

SEQ ID NO: 90846 - DNA, 8 bp, Unknown
  misc_feature (1)..( 8): Result.001 file - promoters60/1010524
aaaagccc

SEQ ID NO: 90847 - DNA, 8 bp, Unknown
  misc_feature (1)..( 8): Result.001 file - promoters60/1010524
aaaacccc

SEQ ID NO: 90848 - DNA, 6 bp, Unknown
  misc_feature (1)..( 6): Result.001 file - promoters60/1010524
actttt

SEQ ID NO: 90849 - DNA, 6 bp, Unknown
  misc_feature (1)..( 6): Result.001 file - promoters60/1010524
actttt

SEQ ID NO: 90850 - DNA, 6 bp, Unknown
  misc_feature (1)..( 6): Result.001 file - promoters60/1010524
atcaaa

SEQ ID NO: 90851 - DNA, 6 bp, Unknown
  misc_feature (1)..( 6): Result.001 file - promoters60/1010524
atcaaa

SEQ ID NO: 90852 - DNA, 9 bp, Unknown
  misc_feature (1)..( 9): Result.001 file - promoters60/1010524
acaaacata

SEQ ID NO: 90853 - DNA, 9 bp, Unknown
  misc_feature (1)..( 9): Result.001 file - promoters60/1010524
acaaacgtt

SEQ ID NO: 90854 - DNA, 9 bp, Unknown
  misc_feature (1)..( 9): Result.001 file - promoters60/1010524
tcaagcgtt

SEQ ID NO: 90855 - DNA, 8 bp, Unknown
  misc_feature (1)..( 8): Result.001 file - promoters60/1010524
cgtagcta

SEQ ID NO: 90856 - DNA, 8 bp, Unknown
  misc_feature (1)..( 8): Result.001 file - promoters60/1010524
cgttgcta

SEQ ID NO: 90857 - DNA, 7 bp, Unknown
  misc_feature (1)..( 7): Result.001 file - promoters60/1010524
tccattt

SEQ ID NO: 90858 - DNA, 7 bp, Unknown
  misc_feature (1)..( 7): Result.001 file - promoters60/1010524
tcccttt

SEQ ID NO: 90859 - DNA, 8 bp, Unknown
  misc_feature (1)..( 8): Result.001 file - promoters60/1010524
atattttg

SEQ ID NO: 90860 - DNA, 8 bp, Unknown
  misc_feature (1)..( 8): Result.001 file - promoters60/1010524
atatttag

SEQ ID NO: 90861 - DNA, 8 bp, Unknown
  misc_feature (1)..( 8): Result.001 file - promoters60/1010524
atattttt

SEQ ID NO: 90862 - DNA, 6 bp, Unknown
  misc_feature (1)..( 6): Result.001 file - promoters60/1010524
ttttac

SEQ ID NO: 90863 - DNA, 6 bp, Unknown
  misc_feature (1)..( 6): Result.001 file - promoters60/1010524
ttttac

SEQ ID NO: 90864 - DNA, 12 bp, Unknown
  misc_feature (1)..( 12): Result.001 file - promoters60/1010524
tacattttatat

SEQ ID NO: 90865 - DNA, 12 bp, Unknown
  misc_feature (1)..( 12): Result.001 file - promoters60/1010524
tacatattatat

SEQ ID NO: 90866 - DNA, 7 bp, Unknown
  misc_feature (1)..( 7): Result.001 file - promoters60/1010524
ttctttt

SEQ ID NO: 90867 - DNA, 7 bp, Unknown
  misc_feature (1)..( 7): Result.001 file - promoters60/1010524
ttcgttt

SEQ ID NO: 90868 - DNA, 6 bp, Unknown
  misc_feature (1)..( 6): Result.001 file - promoters60/1010524
tacttg

SEQ ID NO: 90869 - DNA, 6 bp, Unknown
  misc_feature (1)..( 6): Result.001 file - promoters60/1010524
tacttg

SEQ ID NO: 90870 - DNA, 6 bp, Unknown
  misc_feature (1)..( 6): Result.001 file - promoters60/1010524
gaaaag

SEQ ID NO: 90871 - DNA, 6 bp, Unknown
  misc_feature (1)..( 6): Result.001 file - promoters60/1010536
gaaaag

SEQ ID NO: 90872 - DNA, 8 bp, Unknown
  misc_feature (1)..( 8): Result.001 file - promoters60/1010536
gtgtctga

SEQ ID NO: 90873 - DNA, 8 bp, Unknown
  misc_feature (1)..( 8): Result.001 file - promoters60/1010536
gtgtgtga

SEQ ID NO: 90874 - DNA, 7 bp, Unknown
  misc_feature (1)..( 7): Result.001 file - promoters60/1010536
tccgaaa

SEQ ID NO: 90875 - DNA, 7 bp, Unknown
  misc_feature (1)..( 7): Result.001 file - promoters60/1010536
tccaaaa

SEQ ID NO: 90876 - DNA, 6 bp, Unknown
  misc_feature (1)..( 6): Result.001 file - promoters60/1010536
ctccat

SEQ ID NO: 90877 - DNA, 6 bp, Unknown
  misc_feature (1)..( 6): Result.001 file - promoters60/1010536
ctccat

SEQ ID NO: 90878 - DNA, 6 bp, Unknown
  misc_feature (1)..( 6): Result.001 file - promoters60/1010536
tagaga

SEQ ID NO: 90879 - DNA, 6 bp, Unknown
  misc_feature (1)..( 6): Result.001 file - promoters60/1010536
tagaga

SEQ ID NO: 90880 - DNA, 8 bp, Unknown
  misc_feature (1)..( 8): Result.001 file - promoters60/1010536
ggcaaaac

SEQ ID NO: 90881 - DNA, 8 bp, Unknown
  misc_feature (1)..( 8): Result.001 file - promoters60/1010536
ggcaaaac

SEQ ID NO: 90882 - DNA, 6 bp, Unknown
  misc_feature (1)..( 6): Result.001 file - promoters60/1010536
aatctc

SEQ ID NO: 90883 - DNA, 6 bp, Unknown
  misc_feature (1)..( 6): Result.001 file - promoters60/1010536
aatctc

SEQ ID NO: 90884 - DNA, 8 bp, Unknown
  misc_feature (1)..( 8): Result.001 file - promoters60/1010536
tttgatta

SEQ ID NO: 90885 - DNA, 8 bp, Unknown
  misc_feature (1)..( 8): Result.001 file - promoters60/1010536
tttaatta

SEQ ID NO: 90886 - DNA, 7 bp, Unknown
  misc_feature (1)..( 7): Result.001 file - promoters60/1010536
taatatt

SEQ ID NO: 90887 - DNA, 7 bp, Unknown
  misc_feature (1)..( 7): Result.001 file - promoters60/1010536
taacatt

SEQ ID NO: 90888 - DNA, 6 bp, Unknown
  misc_feature (1)..( 6): Result.001 file - promoters60/1010536
aaaata

SEQ ID NO: 90889 - DNA, 6 bp, Unknown
  misc_feature (1)..( 6): Result.001 file - promoters60/1010536
aaaata

SEQ ID NO: 90890 - DNA, 7 bp, Unknown
  misc_feature (1)..( 7): Result.001 file - promoters60/1010536
caaattt

SEQ ID NO: 90891 - DNA, 7 bp, Unknown
  misc_feature (1)..( 7): Result.001 file - promoters60/1010536
caatttt

SEQ ID NO: 90892 - DNA, 6 bp, Unknown
  misc_feature (1)..( 6): Result.001 file - promoters60/1010536
aaaata

SEQ ID NO: 90893 - DNA, 6 bp, Unknown
  misc_feature (1)..( 6): Result.001 file - promoters60/1010536
aaaata

SEQ ID NO: 90894 - DNA, 7 bp, Unknown
  misc_feature (1)..( 7): Result.001 file - promoters60/1010536
tatgtaa

SEQ ID NO: 90895 - DNA, 7 bp, Unknown
  misc_feature (1)..( 7): Result.001 file - promoters60/1010536
tatttaa

SEQ ID NO: 90896 - DNA, 8 bp, Unknown
  misc_feature (1)..( 8): Result.001 file - promoters60/1010536
aatattta

SEQ ID NO: 90897 - DNA, 8 bp, Unknown
  misc_feature (1)..( 8): Result.001 file - promoters60/1010536
aataatta

SEQ ID NO: 90898 - DNA, 7 bp, Unknown
  misc_feature (1)..( 7): Result.001 file - promoters60/1010536
attcaat

SEQ ID NO: 90899 - DNA, 7 bp, Unknown
  misc_feature (1)..( 7): Result.001 file - promoters60/1010536
atttaat

SEQ ID NO: 90900 - DNA, 6 bp, Unknown
  misc_feature (1)..( 6): Result.001 file - promoters60/1010536
ttaata

SEQ ID NO: 90901 - DNA, 6 bp, Unknown
  misc_feature (1)..( 6): Result.001 file - promoters60/1010536
ttaata

SEQ ID NO: 90902 - DNA, 6 bp, Unknown
  misc_feature (1)..( 6): Result.001 file - promoters60/1010536
aaatag

SEQ ID NO: 90903 - DNA, 6 bp, Unknown
  misc_feature (1)..( 6): Result.001 file - promoters60/1010536
aaatag

SEQ ID NO: 90904 - DNA, 8 bp, Unknown
  misc_feature (1)..( 8): Result.001 file - promoters60/1010536
ttaatttt

SEQ ID NO: 90905 - DNA, 8 bp, Unknown
  misc_feature (1)..( 8): Result.001 file - promoters60/1010536
ttattttt

SEQ ID NO: 90906 - DNA, 6 bp, Unknown
  misc_feature (1)..( 6): Result.001 file - promoters60/1010536
gacaaa

SEQ ID NO: 90907 - DNA, 6 bp, Unknown
  misc_feature (1)..( 6): Result.001 file - promoters60/1010536
gacaaa

SEQ ID NO: 90908 - DNA, 6 bp, Unknown
  misc_feature (1)..( 6): Result.001 file - promoters60/1010536
aaaaaa

SEQ ID NO: 90909 - DNA, 6 bp, Unknown
  misc_feature (1)..( 6): Result.001 file - promoters60/1010536
aaaaaa

SEQ ID NO: 90910 - DNA, 9 bp, Unknown
  misc_feature (1)..( 9): Result.001 file - promoters60/1010536
agtactctt

SEQ ID NO: 90911 - DNA, 9 bp, Unknown
  misc_feature (1)..( 9): Result.001 file - promoters60/1010536
agtattctt

SEQ ID NO: 90912 - DNA, 6 bp, Unknown
  misc_feature (1)..( 6): Result.001 file - promoters60/1010536
aaagat

SEQ ID NO: 90913 - DNA, 6 bp, Unknown
  misc_feature (1)..( 6): Result.001 file - promoters60/1010536
aaagat

SEQ ID NO: 90914 - DNA, 9 bp, Unknown
  misc_feature (1)..( 9): Result.001 file - promoters60/1010536
ttaataatt

SEQ ID NO: 90915 - DNA, 9 bp, Unknown
  misc_feature (1)..( 9): Result.001 file - promoters60/1010536
ttaattatt

SEQ ID NO: 90916 - DNA, 6 bp, Unknown
  misc_feature (1)..( 6): Result.001 file - promoters60/1010536
ttttaa

SEQ ID NO: 90917 - DNA, 6 bp, Unknown
  misc_feature (1)..( 6): Result.001 file - promoters60/1010536
ttttaa

SEQ ID NO: 90918 - DNA, 6 bp, Unknown
  misc_feature (1)..( 6): Result.001 file - promoters60/1010536
gaaaat

SEQ ID NO: 90919 - DNA, 6 bp, Unknown
  misc_feature (1)..( 6): Result.001 file - promoters60/1010562
gaaaat

SEQ ID NO: 90920 - DNA, 7 bp, Unknown
  misc_feature (1)..( 7): Result.001 file - promoters60/1010562
aaagaaa

SEQ ID NO: 90921 - DNA, 7 bp, Unknown
  misc_feature (1)..( 7): Result.001 file - promoters60/1010562
aaataaa

SEQ ID NO: 90922 - DNA, 7 bp, Unknown
  misc_feature (1)..( 7): Result.001 file - promoters60/1010562
atataat

SEQ ID NO: 90923 - DNA, 6 bp, Unknown
  misc_feature (1)..( 6): Result.001 file - promoters60/1010562
aattag

SEQ ID NO: 90924 - DNA, 6 bp, Unknown
  misc_feature (1)..( 6): Result.001 file - promoters60/1010562
aattag

SEQ ID NO: 90925 - DNA, 8 bp, Unknown
  misc_feature (1)..( 8): Result.001 file - promoters60/1010562
tatctttc

SEQ ID NO: 90926 - DNA, 8 bp, Unknown
  misc_feature (1)..( 8): Result.001 file - promoters60/1010562
tatttttt

SEQ ID NO: 90927 - DNA, 8 bp, Unknown
  misc_feature (1)..( 8): Result.001 file - promoters60/1010562
catcattc

SEQ ID NO: 90928 - DNA, 7 bp, Unknown
  misc_feature (1)..( 7): Result.001 file - promoters60/1010562
aaagatg

SEQ ID NO: 90929 - DNA, 7 bp, Unknown
  misc_feature (1)..( 7): Result.001 file - promoters60/1010562
aaatatg

SEQ ID NO: 90930 - DNA, 7 bp, Unknown
  misc_feature (1)..( 7): Result.001 file - promoters60/1010562
caagtga

SEQ ID NO: 90931 - DNA, 7 bp, Unknown
  misc_feature (1)..( 7): Result.001 file - promoters60/1010562
caattga

SEQ ID NO: 90932 - DNA, 6 bp, Unknown
  misc_feature (1)..( 6): Result.001 file - promoters60/1010562
aatcat

SEQ ID NO: 90933 - DNA, 6 bp, Unknown
  misc_feature (1)..( 6): Result.001 file - promoters60/1010562
aatcat

SEQ ID NO: 90934 - DNA, 6 bp, Unknown
  misc_feature (1)..( 6): Result.001 file - promoters60/1010562
cattat

SEQ ID NO: 90935 - DNA, 6 bp, Unknown
  misc_feature (1)..( 6): Result.001 file - promoters60/1010562
cattat

SEQ ID NO: 90936 - DNA, 7 bp, Unknown
  misc_feature (1)..( 7): Result.001 file - promoters60/1010562
tcagatc

SEQ ID NO: 90937 - DNA, 7 bp, Unknown
  misc_feature (1)..( 7): Result.001 file - promoters60/1010562
tcatatc

SEQ ID NO: 90938 - DNA, 7 bp, Unknown
  misc_feature (1)..( 7): Result.001 file - promoters60/1010562
caaaatc

SEQ ID NO: 90939 - DNA, 7 bp, Unknown
  misc_feature (1)..( 7): Result.001 file - promoters60/1010562
caagatc

SEQ ID NO: 90940 - DNA, 9 bp, Unknown
  misc_feature (1)..( 9): Result.001 file - promoters60/1010562
ccaagaaat

SEQ ID NO: 90941 - DNA, 9 bp, Unknown
  misc_feature (1)..( 9): Result.001 file - promoters60/1010562
ccaataaat

SEQ ID NO: 90942 - DNA, 8 bp, Unknown
  misc_feature (1)..( 8): Result.001 file - promoters60/1010562
tttctttt

SEQ ID NO: 90943 - DNA, 8 bp, Unknown
  misc_feature (1)..( 8): Result.001 file - promoters60/1010562
tttgtttt

SEQ ID NO: 90944 - DNA, 6 bp, Unknown
  misc_feature (1)..( 6): Result.001 file - promoters60/1010562
tttgtt

SEQ ID NO: 90945 - DNA, 6 bp, Unknown
  misc_feature (1)..( 6): Result.001 file - promoters60/1010562
tttgtt

SEQ ID NO: 90946 - DNA, 8 bp, Unknown
  misc_feature (1)..( 8): Result.001 file - promoters60/1010562
tattataa

SEQ ID NO: 90947 - DNA, 8 bp, Unknown
  misc_feature (1)..( 8): Result.001 file - promoters60/1010562
tattataa

SEQ ID NO: 90948 - DNA, 7 bp, Unknown
  misc_feature (1)..( 7): Result.001 file - promoters60/1010562
ctcgcat

SEQ ID NO: 90949 - DNA, 7 bp, Unknown
  misc_feature (1)..( 7): Result.001 file - promoters60/1010562
ctcgcat

SEQ ID NO: 90950 - DNA, 6 bp, Unknown
  misc_feature (1)..( 6): Result.001 file - promoters60/1010562
cattct

SEQ ID NO: 90951 - DNA, 6 bp, Unknown
  misc_feature (1)..( 6): Result.001 file - promoters60/1010562
cattct

SEQ ID NO: 90952 - DNA, 7 bp, Unknown
  misc_feature (1)..( 7): Result.001 file - promoters60/1010562
tattgat

SEQ ID NO: 90953 - DNA, 7 bp, Unknown
  misc_feature (1)..( 7): Result.001 file - promoters60/1010562
tatggat

SEQ ID NO: 90954 - DNA, 9 bp, Unknown
  misc_feature (1)..( 9): Result.001 file - promoters60/1010562
ttagtatgg

SEQ ID NO: 90955 - DNA, 9 bp, Unknown
  misc_feature (1)..( 9): Result.001 file - promoters60/1010562
ttagtttgg

SEQ ID NO: 90956 - DNA, 7 bp, Unknown
  misc_feature (1)..( 7): Result.001 file - promoters60/1010562
tttttac

SEQ ID NO: 90957 - DNA, 7 bp, Unknown
  misc_feature (1)..( 7): Result.001 file - promoters60/1010562
tttctac

SEQ ID NO: 90958 - DNA, 8 bp, Unknown
  misc_feature (1)..( 8): Result.001 file - promoters60/1010562
ctatagaa

SEQ ID NO: 90959 - DNA, 8 bp, Unknown
  misc_feature (1)..( 8): Result.001 file - promoters60/1010562
ctaaagaa

SEQ ID NO: 90960 - DNA, 6 bp, Unknown
  misc_feature (1)..( 6): Result.001 file - promoters60/1010562
cccacc

SEQ ID NO: 90961 - DNA, 6 bp, Unknown
  misc_feature (1)..( 6): Result.001 file - promoters60/1010571
cccacc

SEQ ID NO: 90962 - DNA, 11 bp, Unknown
  misc_feature (1)..( 11): Result.001 file - promoters60/1010571
ttaaatcaata

SEQ ID NO: 90963 - DNA, 11 bp, Unknown
  misc_feature (1)..( 11): Result.001 file - promoters60/1010571
ctaaattaata

SEQ ID NO: 90964 - DNA, 11 bp, Unknown
  misc_feature (1)..( 11): Result.001 file - promoters60/1010571
ctacatttgga

SEQ ID NO: 90965 - DNA, 8 bp, Unknown
  misc_feature (1)..( 8): Result.001 file - promoters60/1010571
aatatata

SEQ ID NO: 90966 - DNA, 8 bp, Unknown
  misc_feature (1)..( 8): Result.001 file - promoters60/1010571
aatttata

SEQ ID NO: 90967 - DNA, 8 bp, Unknown
  misc_feature (1)..( 8): Result.001 file - promoters60/1010571
tatacctt

SEQ ID NO: 90968 - DNA, 8 bp, Unknown
  misc_feature (1)..( 8): Result.001 file - promoters60/1010571
tataactt

SEQ ID NO: 90969 - DNA, 10 bp, Unknown
  misc_feature (1)..( 10): Result.001 file - promoters60/1010571
ttaccaattg

SEQ ID NO: 90970 - DNA, 10 bp, Unknown
  misc_feature (1)..( 10): Result.001 file - promoters60/1010571
ttatcaatca

SEQ ID NO: 90971 - DNA, 10 bp, Unknown
  misc_feature (1)..( 10): Result.001 file - promoters60/1010571
aaaccatttg

SEQ ID NO: 90972 - DNA, 6 bp, Unknown
  misc_feature (1)..( 6): Result.001 file - promoters60/1010571
aaatat

SEQ ID NO: 90973 - DNA, 6 bp, Unknown
  misc_feature (1)..( 6): Result.001 file - promoters60/1010571
aaatat

SEQ ID NO: 90974 - DNA, 6 bp, Unknown
  misc_feature (1)..( 6): Result.001 file - promoters60/1010571
ataatt

SEQ ID NO: 90975 - DNA, 6 bp, Unknown
  misc_feature (1)..( 6): Result.001 file - promoters60/1010571
ataatt

SEQ ID NO: 90976 - DNA, 15 bp, Unknown
  misc_feature (1)..( 15): Result.001 file - promoters60/1010571
aaggatgatggacca

SEQ ID NO: 90977 - DNA, 15 bp, Unknown
  misc_feature (1)..( 15): Result.001 file - promoters60/1010571
aaggatgatggacca

SEQ ID NO: 90978 - DNA, 15 bp, Unknown
  misc_feature (1)..( 15): Result.001 file - promoters60/1010571
tacacattaataacg

SEQ ID NO: 90979 - DNA, 15 bp, Unknown
  misc_feature (1)..( 15): Result.001 file - promoters60/1010571
tacacattaataacg

SEQ ID NO: 90980 - DNA, 39 bp, Unknown
  misc_feature (1)..( 39): Result.001 file - promoters60/1010571
tttatcaaataaagaaaataaatttctatgacccaataa

SEQ ID NO: 90981 - DNA, 39 bp, Unknown
  misc_feature (1)..( 39): Result.001 file - promoters60/1010571
tttaccaaatcaagaaaatacatttctatgatccactaa

SEQ ID NO: 90982 - DNA, 39 bp, Unknown
  misc_feature (1)..( 39): Result.001 file - promoters60/1010571
gccattggtagcaaggtataaatttaatagcaatctgaa

SEQ ID NO: 90983 - DNA, 6 bp, Unknown
  misc_feature (1)..( 6): Result.001 file - promoters60/1010571
tggttt

SEQ ID NO: 90984 - DNA, 6 bp, Unknown
  misc_feature (1)..( 6): Result.001 file - promoters60/1010571
tggttt

SEQ ID NO: 90985 - DNA, 6 bp, Unknown
  misc_feature (1)..( 6): Result.001 file - promoters60/1010571
caaaac

SEQ ID NO: 90986 - DNA, 6 bp, Unknown
  misc_feature (1)..( 6): Result.001 file - promoters60/1010571
caaaac

SEQ ID NO: 90987 - DNA, 11 bp, Unknown
  misc_feature (1)..( 11): Result.001 file - promoters60/1010571
attcttttatt

SEQ ID NO: 90988 - DNA, 11 bp, Unknown
  misc_feature (1)..( 11): Result.001 file - promoters60/1010571
attctcttatt

SEQ ID NO: 90989 - DNA, 6 bp, Unknown
  misc_feature (1)..( 6): Result.001 file - promoters60/1010571
tgtttt

SEQ ID NO: 90990 - DNA, 6 bp, Unknown
  misc_feature (1)..( 6): Result.001 file - promoters60/1010571
tgtttt

SEQ ID NO: 90991 - DNA, 7 bp, Unknown
  misc_feature (1)..( 7): Result.001 file - promoters60/1010571
caaaaaa

SEQ ID NO: 90992 - DNA, 7 bp, Unknown
  misc_feature (1)..( 7): Result.001 file - promoters60/1010571
caacaaa

SEQ ID NO: 90993 - DNA, 7 bp, Unknown
  misc_feature (1)..( 7): Result.001 file - promoters60/1010571
aattttt

SEQ ID NO: 90994 - DNA, 7 bp, Unknown
  misc_feature (1)..( 7): Result.001 file - promoters60/1010571
aatgttt

SEQ ID NO: 90995 - DNA, 6 bp, Unknown
  misc_feature (1)..( 6): Result.001 file - promoters60/1010571
ttttat

SEQ ID NO: 90996 - DNA, 6 bp, Unknown
  misc_feature (1)..( 6): Result.001 file - promoters60/1010636
ttttat

SEQ ID NO: 90997 - DNA, 8 bp, Unknown
  misc_feature (1)..( 8): Result.001 file - promoters60/1010636
gctttgat

SEQ ID NO: 90998 - DNA, 8 bp, Unknown
  misc_feature (1)..( 8): Result.001 file - promoters60/1010636
gcttggat

SEQ ID NO: 90999 - DNA, 8 bp, Unknown
  misc_feature (1)..( 8): Result.001 file - promoters60/1010636
cattggat

SEQ ID NO: 91000 - DNA, 8 bp, Unknown
  misc_feature (1)..( 8): Result.001 file - promoters60/1010636
tcaaagtt

SEQ ID NO: 91001 - DNA, 8 bp, Unknown
  misc_feature (1)..( 8): Result.001 file - promoters60/1010636
cgaaagtt

SEQ ID NO: 91002 - DNA, 8 bp, Unknown
  misc_feature (1)..( 8): Result.001 file - promoters60/1010636
cgagagta

SEQ ID NO: 91003 - DNA, 10 bp, Unknown
  misc_feature (1)..( 10): Result.001 file - promoters60/1010636
cctaaaccct

SEQ ID NO: 91004 - DNA, 10 bp, Unknown
  misc_feature (1)..( 10): Result.001 file - promoters60/1010636
ttaaaaccct

SEQ ID NO: 91005 - DNA, 10 bp, Unknown
  misc_feature (1)..( 10): Result.001 file - promoters60/1010636
tttaaaccct

SEQ ID NO: 91006 - DNA, 10 bp, Unknown
  misc_feature (1)..( 10): Result.001 file - promoters60/1010636
ttttaacggc

SEQ ID NO: 91007 - DNA, 8 bp, Unknown
  misc_feature (1)..( 8): Result.001 file - promoters60/1010636
atggaatt

SEQ ID NO: 91008 - DNA, 8 bp, Unknown
  misc_feature (1)..( 8): Result.001 file - promoters60/1010636
gtggcatt

SEQ ID NO: 91009 - DNA, 8 bp, Unknown
  misc_feature (1)..( 8): Result.001 file - promoters60/1010636
gtgtcatc

SEQ ID NO: 91010 - DNA, 7 bp, Unknown
  misc_feature (1)..( 7): Result.001 file - promoters60/1010636
ttttctt

SEQ ID NO: 91011 - DNA, 7 bp, Unknown
  misc_feature (1)..( 7): Result.001 file - promoters60/1010636
ttttcta

SEQ ID NO: 91012 - DNA, 7 bp, Unknown
  misc_feature (1)..( 7): Result.001 file - promoters60/1010693
atttcta

SEQ ID NO: 91013 - DNA, 6 bp, Unknown
  misc_feature (1)..( 6): Result.001 file - promoters60/1010693
taattc

SEQ ID NO: 91014 - DNA, 6 bp, Unknown
  misc_feature (1)..( 6): Result.001 file - promoters60/1010693
taattc

SEQ ID NO: 91015 - DNA, 9 bp, Unknown
  misc_feature (1)..( 9): Result.001 file - promoters60/1010693
gaagctttt

SEQ ID NO: 91016 - DNA, 9 bp, Unknown
  misc_feature (1)..( 9): Result.001 file - promoters60/1010693
gaaggtttt

SEQ ID NO: 91017 - DNA, 6 bp, Unknown
  misc_feature (1)..( 6): Result.001 file - promoters60/1010693
ttttaa

SEQ ID NO: 91018 - DNA, 6 bp, Unknown
  misc_feature (1)..( 6): Result.001 file - promoters60/1010693
ttttaa

SEQ ID NO: 91019 - DNA, 7 bp, Unknown
  misc_feature (1)..( 7): Result.001 file - promoters60/1010693
aatcaat

SEQ ID NO: 91020 - DNA, 7 bp, Unknown
  misc_feature (1)..( 7): Result.001 file - promoters60/1010693
aatgaat

SEQ ID NO: 91021 - DNA, 8 bp, Unknown
  misc_feature (1)..( 8): Result.001 file - promoters60/1010693
ttatatat

SEQ ID NO: 91022 - DNA, 8 bp, Unknown
  misc_feature (1)..( 8): Result.001 file - promoters60/1010693
ttaaataa

SEQ ID NO: 91023 - DNA, 8 bp, Unknown
  misc_feature (1)..( 8): Result.001 file - promoters60/1010693
ttaaatat

SEQ ID NO: 91024 - DNA, 6 bp, Unknown
  misc_feature (1)..( 6): Result.001 file - promoters60/1010693
ataaaa

SEQ ID NO: 91025 - DNA, 6 bp, Unknown
  misc_feature (1)..( 6): Result.001 file - promoters60/1010693
ataaaa

SEQ ID NO: 91026 - DNA, 7 bp, Unknown
  misc_feature (1)..( 7): Result.001 file - promoters60/1010693
tttcatt

SEQ ID NO: 91027 - DNA, 7 bp, Unknown
  misc_feature (1)..( 7): Result.001 file - promoters60/1010693
tttgatt

SEQ ID NO: 91028 - DNA, 7 bp, Unknown
  misc_feature (1)..( 7): Result.001 file - promoters60/1010693
agttggt

SEQ ID NO: 91029 - DNA, 7 bp, Unknown
  misc_feature (1)..( 7): Result.001 file - promoters60/1010693
agttggt

SEQ ID NO: 91030 - DNA, 7 bp, Unknown
  misc_feature (1)..( 7): Result.001 file - promoters60/1010693
agtaaaa

SEQ ID NO: 91031 - DNA, 7 bp, Unknown
  misc_feature (1)..( 7): Result.001 file - promoters60/1010693
agtaaaa

SEQ ID NO: 91032 - DNA, 8 bp, Unknown
  misc_feature (1)..( 8): Result.001 file - promoters60/1010693
ataatata

SEQ ID NO: 91033 - DNA, 8 bp, Unknown
  misc_feature (1)..( 8): Result.001 file - promoters60/1010693
ataatatt

SEQ ID NO: 91034 - DNA, 8 bp, Unknown
  misc_feature (1)..( 8): Result.001 file - promoters60/1010693
ttaatata

SEQ ID NO: 91035 - DNA, 6 bp, Unknown
  misc_feature (1)..( 6): Result.001 file - promoters60/1010693
aacata

SEQ ID NO: 91036 - DNA, 6 bp, Unknown
  misc_feature (1)..( 6): Result.001 file - promoters60/1010693
aacata

SEQ ID NO: 91037 - DNA, 6 bp, Unknown
  misc_feature (1)..( 6): Result.001 file - promoters60/1010693
aaaatt

SEQ ID NO: 91038 - DNA, 6 bp, Unknown
  misc_feature (1)..( 6): Result.001 file - promoters60/1010693
aaaatt

SEQ ID NO: 91039 - DNA, 7 bp, Unknown
  misc_feature (1)..( 7): Result.001 file - promoters60/1010693
tttcatt

SEQ ID NO: 91040 - DNA, 7 bp, Unknown
  misc_feature (1)..( 7): Result.001 file - promoters60/1010693
ttttatt

SEQ ID NO: 91041 - DNA, 8 bp, Unknown
  misc_feature (1)..( 8): Result.001 file - promoters60/1010693
caaattcg

SEQ ID NO: 91042 - DNA, 8 bp, Unknown
  misc_feature (1)..( 8): Result.001 file - promoters60/1010693
caaagtcg

SEQ ID NO: 91043 - DNA, 8 bp, Unknown
  misc_feature (1)..( 8): Result.001 file - promoters60/1010693
aaaatttc

SEQ ID NO: 91044 - DNA, 8 bp, Unknown
  misc_feature (1)..( 8): Result.001 file - promoters60/1010693
aaaacttc

SEQ ID NO: 91045 - DNA, 6 bp, Unknown
  misc_feature (1)..( 6): Result.001 file - promoters60/1010693
taataa

SEQ ID NO: 91046 - DNA, 6 bp, Unknown
  misc_feature (1)..( 6): Result.001 file - promoters60/1010693
taataa

SEQ ID NO: 91047 - DNA, 7 bp, Unknown
  misc_feature (1)..( 7): Result.001 file - promoters60/1010693
aaaagcg

SEQ ID NO: 91048 - DNA, 7 bp, Unknown
  misc_feature (1)..( 7): Result.001 file - promoters60/1010693
aaacgcg

SEQ ID NO: 91049 - DNA, 9 bp, Unknown
  misc_feature (1)..( 9): Result.001 file - promoters60/1010693
tcgtaaata

SEQ ID NO: 91050 - DNA, 9 bp, Unknown
  misc_feature (1)..( 9): Result.001 file - promoters60/1010693
tcgttaata

SEQ ID NO: 91051 - DNA, 7 bp, Unknown
  misc_feature (1)..( 7): Result.001 file - promoters60/1010693
caataac

SEQ ID NO: 91052 - DNA, 7 bp, Unknown
  misc_feature (1)..( 7): Result.001 file - promoters60/1010693
caaaaac

SEQ ID NO: 91053 - DNA, 6 bp, Unknown
  misc_feature (1)..( 6): Result.001 file - promoters60/1010693
atgtta

SEQ ID NO: 91054 - DNA, 6 bp, Unknown
  misc_feature (1)..( 6): Result.001 file - promoters60/1010693
atgtta

SEQ ID NO: 91055 - DNA, 9 bp, Unknown
  misc_feature (1)..( 9): Result.001 file - promoters60/1010693
aaattaaaa

SEQ ID NO: 91056 - DNA, 9 bp, Unknown
  misc_feature (1)..( 9): Result.001 file - promoters60/1010693
aaactaaaa

SEQ ID NO: 91057 - DNA, 7 bp, Unknown
  misc_feature (1)..( 7): Result.001 file - promoters60/1010693
tatacaa

SEQ ID NO: 91058 - DNA, 7 bp, Unknown
  misc_feature (1)..( 7): Result.001 file - promoters60/1010693
tatccaa

SEQ ID NO: 91059 - DNA, 8 bp, Unknown
  misc_feature (1)..( 8): Result.001 file - promoters60/1010693
attttaat

SEQ ID NO: 91060 - DNA, 8 bp, Unknown
  misc_feature (1)..( 8): Result.001 file - promoters60/1010710
attgtaat

SEQ ID NO: 91061 - DNA, 6 bp, Unknown
  misc_feature (1)..( 6): Result.001 file - promoters60/1010710
cggtaa

SEQ ID NO: 91062 - DNA, 6 bp, Unknown
  misc_feature (1)..( 6): Result.001 file - promoters60/1010710
cggtaa

SEQ ID NO: 91063 - DNA, 7 bp, Unknown
  misc_feature (1)..( 7): Result.001 file - promoters60/1010710
tttgttg

SEQ ID NO: 91064 - DNA, 7 bp, Unknown
  misc_feature (1)..( 7): Result.001 file - promoters60/1010710
tttcttg

SEQ ID NO: 91065 - DNA, 6 bp, Unknown
  misc_feature (1)..( 6): Result.001 file - promoters60/1010710
acatat

SEQ ID NO: 91066 - DNA, 6 bp, Unknown
  misc_feature (1)..( 6): Result.001 file - promoters60/1010710
acatat

SEQ ID NO: 91067 - DNA, 7 bp, Unknown
  misc_feature (1)..( 7): Result.001 file - promoters60/1010710
tttgttc

SEQ ID NO: 91068 - DNA, 7 bp, Unknown
  misc_feature (1)..( 7): Result.001 file - promoters60/1010710
ttttttc

SEQ ID NO: 91069 - DNA, 8 bp, Unknown
  misc_feature (1)..( 8): Result.001 file - promoters60/1010710
aatctaaa

SEQ ID NO: 91070 - DNA, 8 bp, Unknown
  misc_feature (1)..( 8): Result.001 file - promoters60/1010710
aatcaaaa

SEQ ID NO: 91071 - DNA, 7 bp, Unknown
  misc_feature (1)..( 7): Result.001 file - promoters60/1010710
gatcaat

SEQ ID NO: 91072 - DNA, 7 bp, Unknown
  misc_feature (1)..( 7): Result.001 file - promoters60/1010710
gataaat

SEQ ID NO: 91073 - DNA, 7 bp, Unknown
  misc_feature (1)..( 7): Result.001 file - promoters60/1010710
gaacttt

SEQ ID NO: 91074 - DNA, 7 bp, Unknown
  misc_feature (1)..( 7): Result.001 file - promoters60/1010710
gaatttt

SEQ ID NO: 91075 - DNA, 6 bp, Unknown
  misc_feature (1)..( 6): Result.001 file - promoters60/1010710
agtata

SEQ ID NO: 91076 - DNA, 6 bp, Unknown
  misc_feature (1)..( 6): Result.001 file - promoters60/1010710
agtata

SEQ ID NO: 91077 - DNA, 10 bp, Unknown
  misc_feature (1)..( 10): Result.001 file - promoters60/1010710
accggttata

SEQ ID NO: 91078 - DNA, 10 bp, Unknown
  misc_feature (1)..( 10): Result.001 file - promoters60/1010710
accgtttata

SEQ ID NO: 91079 - DNA, 9 bp, Unknown
  misc_feature (1)..( 9): Result.001 file - promoters60/1010710
tattattac

SEQ ID NO: 91080 - DNA, 9 bp, Unknown
  misc_feature (1)..( 9): Result.001 file - promoters60/1010710
aattatttt

SEQ ID NO: 91081 - DNA, 9 bp, Unknown
  misc_feature (1)..( 9): Result.001 file - promoters60/1010710
aatgatttt

SEQ ID NO: 91082 - DNA, 7 bp, Unknown
  misc_feature (1)..( 7): Result.001 file - promoters60/1010710
tttgcgg

SEQ ID NO: 91083 - DNA, 7 bp, Unknown
  misc_feature (1)..( 7): Result.001 file - promoters60/1010710
tttccgg

SEQ ID NO: 91084 - DNA, 7 bp, Unknown
  misc_feature (1)..( 7): Result.001 file - promoters60/1010710
gaacagt

SEQ ID NO: 91085 - DNA, 7 bp, Unknown
  misc_feature (1)..( 7): Result.001 file - promoters60/1010710
gaagagt

SEQ ID NO: 91086 - DNA, 7 bp, Unknown
  misc_feature (1)..( 7): Result.001 file - promoters60/1010710
cgataca

SEQ ID NO: 91087 - DNA, 7 bp, Unknown
  misc_feature (1)..( 7): Result.001 file - promoters60/1010710
cgacaca

SEQ ID NO: 91088 - DNA, 7 bp, Unknown
  misc_feature (1)..( 7): Result.001 file - promoters60/1010710
tttatat

SEQ ID NO: 91089 - DNA, 7 bp, Unknown
  misc_feature (1)..( 7): Result.001 file - promoters60/1010710
tttgtat

SEQ ID NO: 91090 - DNA, 7 bp, Unknown
  misc_feature (1)..( 7): Result.001 file - promoters60/1010710
gatttga

SEQ ID NO: 91091 - DNA, 7 bp, Unknown
  misc_feature (1)..( 7): Result.001 file - promoters60/1010770
gatgtga

SEQ ID NO: 91092 - DNA, 6 bp, Unknown
  misc_feature (1)..( 6): Result.001 file - promoters60/1010770
ttttaa

SEQ ID NO: 91093 - DNA, 6 bp, Unknown
  misc_feature (1)..( 6): Result.001 file - promoters60/1010770
ttttaa

SEQ ID NO: 91094 - DNA, 6 bp, Unknown
  misc_feature (1)..( 6): Result.001 file - promoters60/1010770
aaaagc

SEQ ID NO: 91095 - DNA, 6 bp, Unknown
  misc_feature (1)..( 6): Result.001 file - promoters60/1010770
aaaagc

SEQ ID NO: 91096 - DNA, 7 bp, Unknown
  misc_feature (1)..( 7): Result.001 file - promoters60/1010770
atttttg

SEQ ID NO: 91097 - DNA, 7 bp, Unknown
  misc_feature (1)..( 7): Result.001 file - promoters60/1010770
attattg

SEQ ID NO: 91098 - DNA, 9 bp, Unknown
  misc_feature (1)..( 9): Result.001 file - promoters60/1010770
acaaagaga

SEQ ID NO: 91099 - DNA, 9 bp, Unknown
  misc_feature (1)..( 9): Result.001 file - promoters60/1010770
acagagaga

SEQ ID NO: 91100 - DNA, 7 bp, Unknown
  misc_feature (1)..( 7): Result.001 file - promoters60/1010770
tttggac

SEQ ID NO: 91101 - DNA, 7 bp, Unknown
  misc_feature (1)..( 7): Result.001 file - promoters60/1010770
tttggac

SEQ ID NO: 91102 - DNA, 6 bp, Unknown
  misc_feature (1)..( 6): Result.001 file - promoters60/1010770
gctttt

SEQ ID NO: 91103 - DNA, 6 bp, Unknown
  misc_feature (1)..( 6): Result.001 file - promoters60/1010770
gctttt

SEQ ID NO: 91104 - DNA, 7 bp, Unknown
  misc_feature (1)..( 7): Result.001 file - promoters60/1010770
ccaattg

SEQ ID NO: 91105 - DNA, 7 bp, Unknown
  misc_feature (1)..( 7): Result.001 file - promoters60/1010770
ccaattg

SEQ ID NO: 91106 - DNA, 8 bp, Unknown
  misc_feature (1)..( 8): Result.001 file - promoters60/1010770
gattaatt

SEQ ID NO: 91107 - DNA, 8 bp, Unknown
  misc_feature (1)..( 8): Result.001 file - promoters60/1010770
gattaatt

SEQ ID NO: 91108 - DNA, 6 bp, Unknown
  misc_feature (1)..( 6): Result.001 file - promoters60/1010770
taaatt

SEQ ID NO: 91109 - DNA, 6 bp, Unknown
  misc_feature (1)..( 6): Result.001 file - promoters60/1010770
taaatt

SEQ ID NO: 91110 - DNA, 8 bp, Unknown
  misc_feature (1)..( 8): Result.001 file - promoters60/1010770
aattgcaa

SEQ ID NO: 91111 - DNA, 8 bp, Unknown
  misc_feature (1)..( 8): Result.001 file - promoters60/1010770
aatttcaa

SEQ ID NO: 91112 - DNA, 7 bp, Unknown
  misc_feature (1)..( 7): Result.001 file - promoters60/1010770
gtttttg

SEQ ID NO: 91113 - DNA, 7 bp, Unknown
  misc_feature (1)..( 7): Result.001 file - promoters60/1010770
gttattg

SEQ ID NO: 91114 - DNA, 7 bp, Unknown
  misc_feature (1)..( 7): Result.001 file - promoters60/1010770
tttagtt

SEQ ID NO: 91115 - DNA, 7 bp, Unknown
  misc_feature (1)..( 7): Result.001 file - promoters60/1010770
tttggtt

SEQ ID NO: 91116 - DNA, 9 bp, Unknown
  misc_feature (1)..( 9): Result.001 file - promoters60/1010770
aatacaaaa

SEQ ID NO: 91117 - DNA, 9 bp, Unknown
  misc_feature (1)..( 9): Result.001 file - promoters60/1010770
aattcaaaa

SEQ ID NO: 91118 - DNA, 7 bp, Unknown
  misc_feature (1)..( 7): Result.001 file - promoters60/1010770
caaaaaa

SEQ ID NO: 91119 - DNA, 7 bp, Unknown
  misc_feature (1)..( 7): Result.001 file - promoters60/1010770
caataaa

SEQ ID NO: 91120 - DNA, 10 bp, Unknown
  misc_feature (1)..( 10): Result.001 file - promoters60/1010770
tttcaacaat

SEQ ID NO: 91121 - DNA, 10 bp, Unknown
  misc_feature (1)..( 10): Result.001 file - promoters60/1010770
tttaaacaat

SEQ ID NO: 91122 - DNA, 7 bp, Unknown
  misc_feature (1)..( 7): Result.001 file - promoters60/1010770
ttagtgc

SEQ ID NO: 91123 - DNA, 7 bp, Unknown
  misc_feature (1)..( 7): Result.001 file - promoters60/1010770
ttaatgc

SEQ ID NO: 91124 - DNA, 6 bp, Unknown
  misc_feature (1)..( 6): Result.001 file - promoters60/1010770
atatac

SEQ ID NO: 91125 - DNA, 6 bp, Unknown
  misc_feature (1)..( 6): Result.001 file - promoters60/1010770
atatac

SEQ ID NO: 91126 - DNA, 8 bp, Unknown
  misc_feature (1)..( 8): Result.001 file - promoters60/1010770
cttggttt

SEQ ID NO: 91127 - DNA, 8 bp, Unknown
  misc_feature (1)..( 8): Result.001 file - promoters60/1010770
ctttgttt

SEQ ID NO: 91128 - DNA, 8 bp, Unknown
  misc_feature (1)..( 8): Result.001 file - promoters60/1010770
ccatacat

SEQ ID NO: 91129 - DNA, 8 bp, Unknown
  misc_feature (1)..( 8): Result.001 file - promoters60/1010815
ccatacat

SEQ ID NO: 91130 - DNA, 15 bp, Unknown
  misc_feature (1)..( 15): Result.001 file - promoters60/1010815
tctctcaaagatttt

SEQ ID NO: 91131 - DNA, 15 bp, Unknown
  misc_feature (1)..( 15): Result.001 file - promoters60/1010815
agtttcaaagaaaga

SEQ ID NO: 91132 - DNA, 15 bp, Unknown
  misc_feature (1)..( 15): Result.001 file - promoters60/1010815
tctttcaaaatttga

SEQ ID NO: 91133 - DNA, 15 bp, Unknown
  misc_feature (1)..( 15): Result.001 file - promoters60/1010815
acaaggaaagacttt

SEQ ID NO: 91134 - DNA, 15 bp, Unknown
  misc_feature (1)..( 15): Result.001 file - promoters60/1010815
attacgaaaaaaaat

SEQ ID NO: 91135 - DNA, 15 bp, Unknown
  misc_feature (1)..( 15): Result.001 file - promoters60/1010815
gcaagtaaaaaagta

SEQ ID NO: 91136 - DNA, 9 bp, Unknown
  misc_feature (1)..( 9): Result.001 file - promoters60/1010815
aaatattaa

SEQ ID NO: 91137 - DNA, 9 bp, Unknown
  misc_feature (1)..( 9): Result.001 file - promoters60/1010815
aaataataa

SEQ ID NO: 91138 - DNA, 10 bp, Unknown
  misc_feature (1)..( 10): Result.001 file - promoters60/1010815
aaactatccc

SEQ ID NO: 91139 - DNA, 10 bp, Unknown
  misc_feature (1)..( 10): Result.001 file - promoters60/1010815
aaaatatttt

SEQ ID NO: 91140 - DNA, 10 bp, Unknown
  misc_feature (1)..( 10): Result.001 file - promoters60/1010815
ggtttaataa

SEQ ID NO: 91141 - DNA, 10 bp, Unknown
  misc_feature (1)..( 10): Result.001 file - promoters60/1010815
aaactagaat

SEQ ID NO: 91142 - DNA, 10 bp, Unknown
  misc_feature (1)..( 10): Result.001 file - promoters60/1010815
aacacaaaaa

SEQ ID NO: 91143 - DNA, 10 bp, Unknown
  misc_feature (1)..( 10): Result.001 file - promoters60/1010815
aacacaagaa

SEQ ID NO: 91144 - DNA, 10 bp, Unknown
  misc_feature (1)..( 10): Result.001 file - promoters60/1010815
aacaaaaaaa

SEQ ID NO: 91145 - DNA, 10 bp, Unknown
  misc_feature (1)..( 10): Result.001 file - promoters60/1010815
cacacgaaaa

SEQ ID NO: 91146 - DNA, 11 bp, Unknown
  misc_feature (1)..( 11): Result.001 file - promoters60/1010815
tacgaaaaaaa

SEQ ID NO: 91147 - DNA, 11 bp, Unknown
  misc_feature (1)..( 11): Result.001 file - promoters60/1010815
aactaaaatta

SEQ ID NO: 91148 - DNA, 13 bp, Unknown
  misc_feature (1)..( 13): Result.001 file - promoters60/1010815
tatatgttaattt

SEQ ID NO: 91149 - DNA, 13 bp, Unknown
  misc_feature (1)..( 13): Result.001 file - promoters60/1010815
cttttgtaaattt

SEQ ID NO: 91150 - DNA, 13 bp, Unknown
  misc_feature (1)..( 13): Result.001 file - promoters60/1010815
aatatataaaata

SEQ ID NO: 91151 - DNA, 13 bp, Unknown
  misc_feature (1)..( 13): Result.001 file - promoters60/1010815
tgtatatatatga

SEQ ID NO: 91152 - DNA, 13 bp, Unknown
  misc_feature (1)..( 13): Result.001 file - promoters60/1010815
actatatagctta

SEQ ID NO: 91153 - DNA, 13 bp, Unknown
  misc_feature (1)..( 13): Result.001 file - promoters60/1010819
gcgatataaagcc

SEQ ID NO: 91154 - DNA, 16 bp, Unknown
  misc_feature (1)..( 16): Result.001 file - promoters60/1010819
ttcatcaccaagaatg

SEQ ID NO: 91155 - DNA, 16 bp, Unknown
  misc_feature (1)..( 16): Result.001 file - promoters60/1010819
gattagtaaaagaatc

SEQ ID NO: 91156 - DNA, 16 bp, Unknown
  misc_feature (1)..( 16): Result.001 file - promoters60/1010819
tgattctaaaagcatc

SEQ ID NO: 91157 - DNA, 16 bp, Unknown
  misc_feature (1)..( 16): Result.001 file - promoters60/1010819
atcttctaaaatctta

SEQ ID NO: 91158 - DNA, 16 bp, Unknown
  misc_feature (1)..( 16): Result.001 file - promoters60/1010819
tttttctaaaataata

SEQ ID NO: 91159 - DNA, 16 bp, Unknown
  misc_feature (1)..( 16): Result.001 file - promoters60/1010819
tttatctaacaattaa

SEQ ID NO: 91160 - DNA, 16 bp, Unknown
  misc_feature (1)..( 16): Result.001 file - promoters60/1010993
tcagtctaaattgggt

SEQ ID NO: 91161 - DNA, 10 bp, Unknown
  misc_feature (1)..( 10): Result.001 file - promoters60/1010993
ttttcttatg

SEQ ID NO: 91162 - DNA, 10 bp, Unknown
  misc_feature (1)..( 10): Result.001 file - promoters60/1010993
tttttttata

SEQ ID NO: 91163 - DNA, 10 bp, Unknown
  misc_feature (1)..( 10): Result.001 file - promoters60/1010993
cccctttata

SEQ ID NO: 91164 - DNA, 10 bp, Unknown
  misc_feature (1)..( 10): Result.001 file - promoters60/1010993
gttttttcac

SEQ ID NO: 91165 - DNA, 10 bp, Unknown
  misc_feature (1)..( 10): Result.001 file - promoters60/1010993
taataataat

SEQ ID NO: 91166 - DNA, 10 bp, Unknown
  misc_feature (1)..( 10): Result.001 file - promoters60/1010993
taatattaaa

SEQ ID NO: 91167 - DNA, 10 bp, Unknown
  misc_feature (1)..( 10): Result.001 file - promoters60/1010993
tgatttaaat

SEQ ID NO: 91168 - DNA, 10 bp, Unknown
  misc_feature (1)..( 10): Result.001 file - promoters60/1010993
tgattcaaaa

SEQ ID NO: 91169 - DNA, 9 bp, Unknown
  misc_feature (1)..( 9): Result.001 file - promoters60/1010993
aaaattaaa

SEQ ID NO: 91170 - DNA, 9 bp, Unknown
  misc_feature (1)..( 9): Result.001 file - promoters60/1010993
aaaataaaa

SEQ ID NO: 91171 - DNA, 9 bp, Unknown
  misc_feature (1)..( 9): Result.001 file - promoters60/1010993
ttaatcaaa

SEQ ID NO: 91172 - DNA, 9 bp, Unknown
  misc_feature (1)..( 9): Result.001 file - promoters60/1010993
aaaataagt

SEQ ID NO: 91173 - DNA, 11 bp, Unknown
  misc_feature (1)..( 11): Result.001 file - promoters60/1010993
gaaaaaactaa

SEQ ID NO: 91174 - DNA, 11 bp, Unknown
  misc_feature (1)..( 11): Result.001 file - promoters60/1010993
gaacaaacgcc

SEQ ID NO: 91175 - DNA, 11 bp, Unknown
  misc_feature (1)..( 11): Result.001 file - promoters60/1010993
taaaaaaactg

SEQ ID NO: 91176 - DNA, 11 bp, Unknown
  misc_feature (1)..( 11): Result.001 file - promoters60/1010993
taaataataaa

SEQ ID NO: 91177 - DNA, 8 bp, Unknown
  misc_feature (1)..( 8): Result.001 file - promoters60/1010993
aagattta

SEQ ID NO: 91178 - DNA, 8 bp, Unknown
  misc_feature (1)..( 8): Result.001 file - promoters60/1010993
aagattat

SEQ ID NO: 91179 - DNA, 8 bp, Unknown
  misc_feature (1)..( 8): Result.001 file - promoters60/1010993
gagagtat

SEQ ID NO: 91180 - DNA, 8 bp, Unknown
  misc_feature (1)..( 8): Result.001 file - promoters60/1010993
gagggtac

SEQ ID NO: 91181 - DNA, 11 bp, Unknown
  misc_feature (1)..( 11): Result.001 file - promoters60/1010993
tatagatttta

SEQ ID NO: 91182 - DNA, 11 bp, Unknown
  misc_feature (1)..( 11): Result.001 file - promoters60/1010993
tatagaatttg

SEQ ID NO: 91183 - DNA, 11 bp, Unknown
  misc_feature (1)..( 11): Result.001 file - promoters60/1010993
atgacaatttg

SEQ ID NO: 91184 - DNA, 11 bp, Unknown
  misc_feature (1)..( 11): Result.001 file - promoters60/1010993
aataaaatacc

SEQ ID NO: 91185 - DNA, 8 bp, Unknown
  misc_feature (1)..( 8): Result.001 file - promoters60/1010993
gttgaaac

SEQ ID NO: 91186 - DNA, 8 bp, Unknown
  misc_feature (1)..( 8): Result.001 file - promoters60/1010993
attgaaaa

SEQ ID NO: 91187 - DNA, 8 bp, Unknown
  misc_feature (1)..( 8): Result.001 file - promoters60/1010993
atttaaat

SEQ ID NO: 91188 - DNA, 8 bp, Unknown
  misc_feature (1)..( 8): Result.001 file - promoters60/1011041
attcaaaa

SEQ ID NO: 91189 - DNA, 8 bp, Unknown
  misc_feature (1)..( 8): Result.001 file - promoters60/1011041
cagatttt

SEQ ID NO: 91190 - DNA, 8 bp, Unknown
  misc_feature (1)..( 8): Result.001 file - promoters60/1011041
cagattac

SEQ ID NO: 91191 - DNA, 8 bp, Unknown
  misc_feature (1)..( 8): Result.001 file - promoters60/1011041
cagattga

SEQ ID NO: 91192 - DNA, 8 bp, Unknown
  misc_feature (1)..( 8): Result.001 file - promoters60/1011041
aagagtga

SEQ ID NO: 91193 - DNA, 8 bp, Unknown
  misc_feature (1)..( 8): Result.001 file - promoters60/1011041
aagaatga

SEQ ID NO: 91194 - DNA, 8 bp, Unknown
  misc_feature (1)..( 8): Result.001 file - promoters60/1011041
cagattga

SEQ ID NO: 91195 - DNA, 8 bp, Unknown
  misc_feature (1)..( 8): Result.001 file - promoters60/1011041
aagagtga

SEQ ID NO: 91196 - DNA, 8 bp, Unknown
  misc_feature (1)..( 8): Result.001 file - promoters60/1011041
cagattac

SEQ ID NO: 91197 - DNA, 10 bp, Unknown
  misc_feature (1)..( 10): Result.001 file - promoters60/1011041
aaaattgaaa

SEQ ID NO: 91198 - DNA, 10 bp, Unknown
  misc_feature (1)..( 10): Result.001 file - promoters60/1011041
tgaatttaaa

SEQ ID NO: 91199 - DNA, 10 bp, Unknown
  misc_feature (1)..( 10): Result.001 file - promoters60/1011041
caaatcgaag

SEQ ID NO: 91200 - DNA, 10 bp, Unknown
  misc_feature (1)..( 10): Result.001 file - promoters60/1011041
tgaatttgta

SEQ ID NO: 91201 - DNA, 10 bp, Unknown
  misc_feature (1)..( 10): Result.001 file - promoters60/1011212
agaattttgg

SEQ ID NO: 91202 - DNA, 6 bp, Unknown
  misc_feature (1)..( 6): Result.001 file - promoters60/1011212
tttttg

SEQ ID NO: 91203 - DNA, 6 bp, Unknown
  misc_feature (1)..( 6): Result.001 file - promoters60/1011212
tttttg

SEQ ID NO: 91204 - DNA, 7 bp, Unknown
  misc_feature (1)..( 7): Result.001 file - promoters60/1011212
gacgtgg

SEQ ID NO: 91205 - DNA, 7 bp, Unknown
  misc_feature (1)..( 7): Result.001 file - promoters60/1011212
gacatgg

SEQ ID NO: 91206 - DNA, 7 bp, Unknown
  misc_feature (1)..( 7): Result.001 file - promoters60/1011212
taggagt

SEQ ID NO: 91207 - DNA, 7 bp, Unknown
  misc_feature (1)..( 7): Result.001 file - promoters60/1011212
tagtagt

SEQ ID NO: 91208 - DNA, 8 bp, Unknown
  misc_feature (1)..( 8): Result.001 file - promoters60/1011212
ttaaaaca

SEQ ID NO: 91209 - DNA, 8 bp, Unknown
  misc_feature (1)..( 8): Result.001 file - promoters60/1011212
ttaataca

SEQ ID NO: 91210 - DNA, 13 bp, Unknown
  misc_feature (1)..( 13): Result.001 file - promoters60/1011212
acattctttctta

SEQ ID NO: 91211 - DNA, 13 bp, Unknown
  misc_feature (1)..( 13): Result.001 file - promoters60/1011212
tacatctatctta

SEQ ID NO: 91212 - DNA, 13 bp, Unknown
  misc_feature (1)..( 13): Result.001 file - promoters60/1011212
acattctttaaaa

SEQ ID NO: 91213 - DNA, 7 bp, Unknown
  misc_feature (1)..( 7): Result.001 file - promoters60/1011212
taatttt

SEQ ID NO: 91214 - DNA, 7 bp, Unknown
  misc_feature (1)..( 7): Result.001 file - promoters60/1011212
aaatttt

SEQ ID NO: 91215 - DNA, 7 bp, Unknown
  misc_feature (1)..( 7): Result.001 file - promoters60/1011212
taatttc

SEQ ID NO: 91216 - DNA, 6 bp, Unknown
  misc_feature (1)..( 6): Result.001 file - promoters60/1011212
atttta

SEQ ID NO: 91217 - DNA, 6 bp, Unknown
  misc_feature (1)..( 6): Result.001 file - promoters60/1011212
atttta

SEQ ID NO: 91218 - DNA, 6 bp, Unknown
  misc_feature (1)..( 6): Result.001 file - promoters60/1011212
aattga

SEQ ID NO: 91219 - DNA, 6 bp, Unknown
  misc_feature (1)..( 6): Result.001 file - promoters60/1011212
aattga

SEQ ID NO: 91220 - DNA, 7 bp, Unknown
  misc_feature (1)..( 7): Result.001 file - promoters60/1011212
ttaaaac

SEQ ID NO: 91221 - DNA, 7 bp, Unknown
  misc_feature (1)..( 7): Result.001 file - promoters60/1011212
ttaaaac

SEQ ID NO: 91222 - DNA, 7 bp, Unknown
  misc_feature (1)..( 7): Result.001 file - promoters60/1011212
gttaaca

SEQ ID NO: 91223 - DNA, 7 bp, Unknown
  misc_feature (1)..( 7): Result.001 file - promoters60/1011212
gtttaca

SEQ ID NO: 91224 - DNA, 8 bp, Unknown
  misc_feature (1)..( 8): Result.001 file - promoters60/1011212
ttacagaa

SEQ ID NO: 91225 - DNA, 8 bp, Unknown
  misc_feature (1)..( 8): Result.001 file - promoters60/1011212
ttaaagaa

SEQ ID NO: 91226 - DNA, 6 bp, Unknown
  misc_feature (1)..( 6): Result.001 file - promoters60/1011212
aaaaat

SEQ ID NO: 91227 - DNA, 6 bp, Unknown
  misc_feature (1)..( 6): Result.001 file - promoters60/1011212
aaaaat

SEQ ID NO: 91228 - DNA, 6 bp, Unknown
  misc_feature (1)..( 6): Result.001 file - promoters60/1011212
actaca

SEQ ID NO: 91229 - DNA, 6 bp, Unknown
  misc_feature (1)..( 6): Result.001 file - promoters60/1011212
actaca

SEQ ID NO: 91230 - DNA, 6 bp, Unknown
  misc_feature (1)..( 6): Result.001 file - promoters60/1011212
ctaact

SEQ ID NO: 91231 - DNA, 6 bp, Unknown
  misc_feature (1)..( 6): Result.001 file - promoters60/1011212
ctaact

SEQ ID NO: 91232 - DNA, 6 bp, Unknown
  misc_feature (1)..( 6): Result.001 file - promoters60/1011212
ctattt

SEQ ID NO: 91233 - DNA, 6 bp, Unknown
  misc_feature (1)..( 6): Result.001 file - promoters60/1011212
ctattt

SEQ ID NO: 91234 - DNA, 7 bp, Unknown
  misc_feature (1)..( 7): Result.001 file - promoters60/1011212
acctgat

SEQ ID NO: 91235 - DNA, 7 bp, Unknown
  misc_feature (1)..( 7): Result.001 file - promoters60/1011212
acctgat

SEQ ID NO: 91236 - DNA, 6 bp, Unknown
  misc_feature (1)..( 6): Result.001 file - promoters60/1011212
tcttag

SEQ ID NO: 91237 - DNA, 6 bp, Unknown
  misc_feature (1)..( 6): Result.001 file - promoters60/1011212
tcttag

SEQ ID NO: 91238 - DNA, 7 bp, Unknown
  misc_feature (1)..( 7): Result.001 file - promoters60/1011212
cattagt

SEQ ID NO: 91239 - DNA, 7 bp, Unknown
  misc_feature (1)..( 7): Result.001 file - promoters60/1011212
catgagt

SEQ ID NO: 91240 - DNA, 7 bp, Unknown
  misc_feature (1)..( 7): Result.001 file - promoters60/1011212
ccacggt

SEQ ID NO: 91241 - DNA, 7 bp, Unknown
  misc_feature (1)..( 7): Result.001 file - promoters60/1011258
ccatggt

SEQ ID NO: 91242 - DNA, 6 bp, Unknown
  misc_feature (1)..( 6): Result.001 file - promoters60/1011258
ttaaaa

SEQ ID NO: 91243 - DNA, 6 bp, Unknown
  misc_feature (1)..( 6): Result.001 file - promoters60/1011258
ttaaaa

SEQ ID NO: 91244 - DNA, 6 bp, Unknown
  misc_feature (1)..( 6): Result.001 file - promoters60/1011258
taaaac

SEQ ID NO: 91245 - DNA, 6 bp, Unknown
  misc_feature (1)..( 6): Result.001 file - promoters60/1011258
taaaac

SEQ ID NO: 91246 - DNA, 6 bp, Unknown
  misc_feature (1)..( 6): Result.001 file - promoters60/1011258
aaactt

SEQ ID NO: 91247 - DNA, 6 bp, Unknown
  misc_feature (1)..( 6): Result.001 file - promoters60/1011258
aaactt

SEQ ID NO: 91248 - DNA, 7 bp, Unknown
  misc_feature (1)..( 7): Result.001 file - promoters60/1011258
cacgatc

SEQ ID NO: 91249 - DNA, 7 bp, Unknown
  misc_feature (1)..( 7): Result.001 file - promoters60/1011258
cacaatc

SEQ ID NO: 91250 - DNA, 7 bp, Unknown
  misc_feature (1)..( 7): Result.001 file - promoters60/1011258
aaagcaa

SEQ ID NO: 91251 - DNA, 7 bp, Unknown
  misc_feature (1)..( 7): Result.001 file - promoters60/1011258
aaaccaa

SEQ ID NO: 91252 - DNA, 7 bp, Unknown
  misc_feature (1)..( 7): Result.001 file - promoters60/1011258
aaagcaa

SEQ ID NO: 91253 - DNA, 7 bp, Unknown
  misc_feature (1)..( 7): Result.001 file - promoters60/1011258
aaaccaa

SEQ ID NO: 91254 - DNA, 6 bp, Unknown
  misc_feature (1)..( 6): Result.001 file - promoters60/1011258
aataaa

SEQ ID NO: 91255 - DNA, 6 bp, Unknown
  misc_feature (1)..( 6): Result.001 file - promoters60/1011258
aataaa

SEQ ID NO: 91256 - DNA, 7 bp, Unknown
  misc_feature (1)..( 7): Result.001 file - promoters60/1011258
aagaaga

SEQ ID NO: 91257 - DNA, 7 bp, Unknown
  misc_feature (1)..( 7): Result.001 file - promoters60/1011258
aagaaga

SEQ ID NO: 91258 - DNA, 9 bp, Unknown
  misc_feature (1)..( 9): Result.001 file - promoters60/1011258
aaacattta

SEQ ID NO: 91259 - DNA, 9 bp, Unknown
  misc_feature (1)..( 9): Result.001 file - promoters60/1011258
ttacagtta

SEQ ID NO: 91260 - DNA, 9 bp, Unknown
  misc_feature (1)..( 9): Result.001 file - promoters60/1011258
ttatagtca

SEQ ID NO: 91261 - DNA, 6 bp, Unknown
  misc_feature (1)..( 6): Result.001 file - promoters60/1011258
cagaaa

SEQ ID NO: 91262 - DNA, 6 bp, Unknown
  misc_feature (1)..( 6): Result.001 file - promoters60/1011258
cagaaa

SEQ ID NO: 91263 - DNA, 7 bp, Unknown
  misc_feature (1)..( 7): Result.001 file - promoters60/1011258
tccgcca

SEQ ID NO: 91264 - DNA, 7 bp, Unknown
  misc_feature (1)..( 7): Result.001 file - promoters60/1011258
tccacca

SEQ ID NO: 91265 - DNA, 6 bp, Unknown
  misc_feature (1)..( 6): Result.001 file - promoters60/1011258
ttttga

SEQ ID NO: 91266 - DNA, 6 bp, Unknown
  misc_feature (1)..( 6): Result.001 file - promoters60/1011258
ttttga

SEQ ID NO: 91267 - DNA, 6 bp, Unknown
  misc_feature (1)..( 6): Result.001 file - promoters60/1011258
tcttct

SEQ ID NO: 91268 - DNA, 6 bp, Unknown
  misc_feature (1)..( 6): Result.001 file - promoters60/1011258
tcttct

SEQ ID NO: 91269 - DNA, 7 bp, Unknown
  misc_feature (1)..( 7): Result.001 file - promoters60/1011258
cacacca

SEQ ID NO: 91270 - DNA, 7 bp, Unknown
  misc_feature (1)..( 7): Result.001 file - promoters60/1011258
cacccca

SEQ ID NO: 91271 - DNA, 11 bp, Unknown
  misc_feature (1)..( 11): Result.001 file - promoters60/1011258
ctttcttgttt

SEQ ID NO: 91272 - DNA, 11 bp, Unknown
  misc_feature (1)..( 11): Result.001 file - promoters60/1011258
ctttcttcttt

SEQ ID NO: 91273 - DNA, 8 bp, Unknown
  misc_feature (1)..( 8): Result.001 file - promoters60/1011258
tttgcttc

SEQ ID NO: 91274 - DNA, 8 bp, Unknown
  misc_feature (1)..( 8): Result.001 file - promoters60/1011258
ttttcttc

SEQ ID NO: 91275 - DNA, 7 bp, Unknown
  misc_feature (1)..( 7): Result.001 file - promoters60/1011258
caagttg

SEQ ID NO: 91276 - DNA, 7 bp, Unknown
  misc_feature (1)..( 7): Result.001 file - promoters60/1011258
caatttg

SEQ ID NO: 91277 - DNA, 8 bp, Unknown
  misc_feature (1)..( 8): Result.001 file - promoters60/1011258
taaaaaaa

SEQ ID NO: 91278 - DNA, 8 bp, Unknown
  misc_feature (1)..( 8): Result.001 file - promoters60/1011258
taagaaaa

SEQ ID NO: 91279 - DNA, 8 bp, Unknown
  misc_feature (1)..( 8): Result.001 file - promoters60/1011258
caataaaa

SEQ ID NO: 91280 - DNA, 8 bp, Unknown
  misc_feature (1)..( 8): Result.001 file - promoters60/1011258
caagaaaa

SEQ ID NO: 91281 - DNA, 8 bp, Unknown
  misc_feature (1)..( 8): Result.001 file - promoters60/1011258
aagaatct

SEQ ID NO: 91282 - DNA, 8 bp, Unknown
  misc_feature (1)..( 8): Result.001 file - promoters60/1011258
aaggatct

SEQ ID NO: 91283 - DNA, 8 bp, Unknown
  misc_feature (1)..( 8): Result.001 file - promoters60/1011258
tccaccaa

SEQ ID NO: 91284 - DNA, 8 bp, Unknown
  misc_feature (1)..( 8): Result.001 file - promoters60/1011262
tccaacaa

SEQ ID NO: 91285 - DNA, 6 bp, Unknown
  misc_feature (1)..( 6): Result.001 file - promoters60/1011262
atgttt

SEQ ID NO: 91286 - DNA, 6 bp, Unknown
  misc_feature (1)..( 6): Result.001 file - promoters60/1011262
atgttt

SEQ ID NO: 91287 - DNA, 9 bp, Unknown
  misc_feature (1)..( 9): Result.001 file - promoters60/1011262
taagcatat

SEQ ID NO: 91288 - DNA, 9 bp, Unknown
  misc_feature (1)..( 9): Result.001 file - promoters60/1011262
taagtatat

SEQ ID NO: 91289 - DNA, 6 bp, Unknown
  misc_feature (1)..( 6): Result.001 file - promoters60/1011262
taatat

SEQ ID NO: 91290 - DNA, 6 bp, Unknown
  misc_feature (1)..( 6): Result.001 file - promoters60/1011262
taatat

SEQ ID NO: 91291 - DNA, 10 bp, Unknown
  misc_feature (1)..( 10): Result.001 file - promoters60/1011262
atattataat

SEQ ID NO: 91292 - DNA, 10 bp, Unknown
  misc_feature (1)..( 10): Result.001 file - promoters60/1011262
atatcataat

SEQ ID NO: 91293 - DNA, 8 bp, Unknown
  misc_feature (1)..( 8): Result.001 file - promoters60/1011262
tatagata

SEQ ID NO: 91294 - DNA, 8 bp, Unknown
  misc_feature (1)..( 8): Result.001 file - promoters60/1011262
tatacata

SEQ ID NO: 91295 - DNA, 7 bp, Unknown
  misc_feature (1)..( 7): Result.001 file - promoters60/1011262
atttaca

SEQ ID NO: 91296 - DNA, 7 bp, Unknown
  misc_feature (1)..( 7): Result.001 file - promoters60/1011262
atttaca

SEQ ID NO: 91297 - DNA, 6 bp, Unknown
  misc_feature (1)..( 6): Result.001 file - promoters60/1011262
acattt

SEQ ID NO: 91298 - DNA, 6 bp, Unknown
  misc_feature (1)..( 6): Result.001 file - promoters60/1011262
acattt

SEQ ID NO: 91299 - DNA, 6 bp, Unknown
  misc_feature (1)..( 6): Result.001 file - promoters60/1011262
atttta

SEQ ID NO: 91300 - DNA, 6 bp, Unknown
  misc_feature (1)..( 6): Result.001 file - promoters60/1011262
atttta

SEQ ID NO: 91301 - DNA, 7 bp, Unknown
  misc_feature (1)..( 7): Result.001 file - promoters60/1011262
tatatat

SEQ ID NO: 91302 - DNA, 7 bp, Unknown
  misc_feature (1)..( 7): Result.001 file - promoters60/1011262
tatttat

SEQ ID NO: 91303 - DNA, 6 bp, Unknown
  misc_feature (1)..( 6): Result.001 file - promoters60/1011262
tatatt

SEQ ID NO: 91304 - DNA, 6 bp, Unknown
  misc_feature (1)..( 6): Result.001 file - promoters60/1011262
tatatt

SEQ ID NO: 91305 - DNA, 7 bp, Unknown
  misc_feature (1)..( 7): Result.001 file - promoters60/1011262
tttattt

SEQ ID NO: 91306 - DNA, 7 bp, Unknown
  misc_feature (1)..( 7): Result.001 file - promoters60/1011262
tttcttt

SEQ ID NO: 91307 - DNA, 6 bp, Unknown
  misc_feature (1)..( 6): Result.001 file - promoters60/1011262
aaaaaa

SEQ ID NO: 91308 - DNA, 6 bp, Unknown
  misc_feature (1)..( 6): Result.001 file - promoters60/1011262
aaaaaa

SEQ ID NO: 91309 - DNA, 6 bp, Unknown
  misc_feature (1)..( 6): Result.001 file - promoters60/1011262
aaattc

SEQ ID NO: 91310 - DNA, 6 bp, Unknown
  misc_feature (1)..( 6): Result.001 file - promoters60/1011262
aaattc

SEQ ID NO: 91311 - DNA, 7 bp, Unknown
  misc_feature (1)..( 7): Result.001 file - promoters60/1011262
ccatctg

SEQ ID NO: 91312 - DNA, 7 bp, Unknown
  misc_feature (1)..( 7): Result.001 file - promoters60/1011262
ccatctg

SEQ ID NO: 91313 - DNA, 6 bp, Unknown
  misc_feature (1)..( 6): Result.001 file - promoters60/1011262
atacac

SEQ ID NO: 91314 - DNA, 6 bp, Unknown
  misc_feature (1)..( 6): Result.001 file - promoters60/1011262
atacac

SEQ ID NO: 91315 - DNA, 6 bp, Unknown
  misc_feature (1)..( 6): Result.001 file - promoters60/1011262
ttgatt

SEQ ID NO: 91316 - DNA, 6 bp, Unknown
  misc_feature (1)..( 6): Result.001 file - promoters60/1011262
ttgatt

SEQ ID NO: 91317 - DNA, 8 bp, Unknown
  misc_feature (1)..( 8): Result.001 file - promoters60/1011262
gctgcaga

SEQ ID NO: 91318 - DNA, 8 bp, Unknown
  misc_feature (1)..( 8): Result.001 file - promoters60/1011303
gctacaga

SEQ ID NO: 91319 - DNA, 7 bp, Unknown
  misc_feature (1)..( 7): Result.001 file - promoters60/1011303
tgcttaa

SEQ ID NO: 91320 - DNA, 7 bp, Unknown
  misc_feature (1)..( 7): Result.001 file - promoters60/1011303
tgcataa

SEQ ID NO: 91321 - DNA, 9 bp, Unknown
  misc_feature (1)..( 9): Result.001 file - promoters60/1011303
tcaaaaact

SEQ ID NO: 91322 - DNA, 9 bp, Unknown
  misc_feature (1)..( 9): Result.001 file - promoters60/1011303
tcataaact

SEQ ID NO: 91323 - DNA, 9 bp, Unknown
  misc_feature (1)..( 9): Result.001 file - promoters60/1011303
acaacaaca

SEQ ID NO: 91324 - DNA, 6 bp, Unknown
  misc_feature (1)..( 6): Result.001 file - promoters60/1011303
aacaaa

SEQ ID NO: 91325 - DNA, 6 bp, Unknown
  misc_feature (1)..( 6): Result.001 file - promoters60/1011303
aacaaa

SEQ ID NO: 91326 - DNA, 6 bp, Unknown
  misc_feature (1)..( 6): Result.001 file - promoters60/1011303
ttttaa

SEQ ID NO: 91327 - DNA, 6 bp, Unknown
  misc_feature (1)..( 6): Result.001 file - promoters60/1011303
ttttaa

SEQ ID NO: 91328 - DNA, 8 bp, Unknown
  misc_feature (1)..( 8): Result.001 file - promoters60/1011303
accaattc

SEQ ID NO: 91329 - DNA, 8 bp, Unknown
  misc_feature (1)..( 8): Result.001 file - promoters60/1011303
tccaattt

SEQ ID NO: 91330 - DNA, 9 bp, Unknown
  misc_feature (1)..( 9): Result.001 file - promoters60/1011303
tccaaattg

SEQ ID NO: 91331 - DNA, 9 bp, Unknown
  misc_feature (1)..( 9): Result.001 file - promoters60/1011303
tataatgaa

SEQ ID NO: 91332 - DNA, 9 bp, Unknown
  misc_feature (1)..( 9): Result.001 file - promoters60/1011303
tataatgaa

SEQ ID NO: 91333 - DNA, 7 bp, Unknown
  misc_feature (1)..( 7): Result.001 file - promoters60/1011303
gtgatca

SEQ ID NO: 91334 - DNA, 7 bp, Unknown
  misc_feature (1)..( 7): Result.001 file - promoters60/1011303
gtgatca

SEQ ID NO: 91335 - DNA, 10 bp, Unknown
  misc_feature (1)..( 10): Result.001 file - promoters60/1011303
cttacaattt

SEQ ID NO: 91336 - DNA, 10 bp, Unknown
  misc_feature (1)..( 10): Result.001 file - promoters60/1011303
cttgcaattt

SEQ ID NO: 91337 - DNA, 8 bp, Unknown
  misc_feature (1)..( 8): Result.001 file - promoters60/1011303
tttgtagc

SEQ ID NO: 91338 - DNA, 8 bp, Unknown
  misc_feature (1)..( 8): Result.001 file - promoters60/1011303
tttgtaaa

SEQ ID NO: 91339 - DNA, 8 bp, Unknown
  misc_feature (1)..( 8): Result.001 file - promoters60/1011303
tttttaaa

SEQ ID NO: 91340 - DNA, 9 bp, Unknown
  misc_feature (1)..( 9): Result.001 file - promoters60/1011303
aacaatata

SEQ ID NO: 91341 - DNA, 9 bp, Unknown
  misc_feature (1)..( 9): Result.001 file - promoters60/1011303
attaatata

SEQ ID NO: 91342 - DNA, 9 bp, Unknown
  misc_feature (1)..( 9): Result.001 file - promoters60/1011303
aaccatatt

SEQ ID NO: 91343 - DNA, 6 bp, Unknown
  misc_feature (1)..( 6): Result.001 file - promoters60/1011303
aatggt

SEQ ID NO: 91344 - DNA, 6 bp, Unknown
  misc_feature (1)..( 6): Result.001 file - promoters60/1011303
aatggt

SEQ ID NO: 91345 - DNA, 7 bp, Unknown
  misc_feature (1)..( 7): Result.001 file - promoters60/1011303
caaaatc

SEQ ID NO: 91346 - DNA, 7 bp, Unknown
  misc_feature (1)..( 7): Result.001 file - promoters60/1011303
caacatc

SEQ ID NO: 91347 - DNA, 9 bp, Unknown
  misc_feature (1)..( 9): Result.001 file - promoters60/1011303
actacaaac

SEQ ID NO: 91348 - DNA, 9 bp, Unknown
  misc_feature (1)..( 9): Result.001 file - promoters60/1011303
actccaaac

SEQ ID NO: 91349 - DNA, 6 bp, Unknown
  misc_feature (1)..( 6): Result.001 file - promoters60/1011303
aaaact

SEQ ID NO: 91350 - DNA, 6 bp, Unknown
  misc_feature (1)..( 6): Result.001 file - promoters60/1011303
aaaact

SEQ ID NO: 91351 - DNA, 8 bp, Unknown
  misc_feature (1)..( 8): Result.001 file - promoters60/1011303
aggcaaat

SEQ ID NO: 91352 - DNA, 8 bp, Unknown
  misc_feature (1)..( 8): Result.001 file - promoters60/1011303
agggaaat

SEQ ID NO: 91353 - DNA, 10 bp, Unknown
  misc_feature (1)..( 10): Result.001 file - promoters60/1011303
cagtttcgga

SEQ ID NO: 91354 - DNA, 10 bp, Unknown
  misc_feature (1)..( 10): Result.001 file - promoters60/1011303
cagtgtcgga

SEQ ID NO: 91355 - DNA, 9 bp, Unknown
  misc_feature (1)..( 9): Result.001 file - promoters60/1011303
ttttgatta

SEQ ID NO: 91356 - DNA, 9 bp, Unknown
  misc_feature (1)..( 9): Result.001 file - promoters60/1011303
ttttgttta

SEQ ID NO: 91357 - DNA, 6 bp, Unknown
  misc_feature (1)..( 6): Result.001 file - promoters60/1011303
taacta

SEQ ID NO: 91358 - DNA, 6 bp, Unknown
  misc_feature (1)..( 6): Result.001 file - promoters60/1011303
taacta

SEQ ID NO: 91359 - DNA, 6 bp, Unknown
  misc_feature (1)..( 6): Result.001 file - promoters60/1011303
attact

SEQ ID NO: 91360 - DNA, 6 bp, Unknown
  misc_feature (1)..( 6): Result.001 file - promoters60/1011303
attact

SEQ ID NO: 91361 - DNA, 6 bp, Unknown
  misc_feature (1)..( 6): Result.001 file - promoters60/1011303
gtcttt

SEQ ID NO: 91362 - DNA, 6 bp, Unknown
  misc_feature (1)..( 6): Result.001 file - promoters60/1011303
gtcttt

SEQ ID NO: 91363 - DNA, 7 bp, Unknown
  misc_feature (1)..( 7): Result.001 file - promoters60/1011303
aattaaa

SEQ ID NO: 91364 - DNA, 7 bp, Unknown
  misc_feature (1)..( 7): Result.001 file - promoters60/1011303
aataaaa

SEQ ID NO: 91365 - DNA, 6 bp, Unknown
  misc_feature (1)..( 6): Result.001 file - promoters60/1011303
gcaaaa

SEQ ID NO: 91366 - DNA, 6 bp, Unknown
  misc_feature (1)..( 6): Result.001 file - promoters60/1011303
gcaaaa

SEQ ID NO: 91367 - DNA, 6 bp, Unknown
  misc_feature (1)..( 6): Result.001 file - promoters60/1011303
aaatta

SEQ ID NO: 91368 - DNA, 6 bp, Unknown
  misc_feature (1)..( 6): Result.001 file - promoters60/1011303
aaatta

SEQ ID NO: 91369 - DNA, 8 bp, Unknown
  misc_feature (1)..( 8): Result.001 file - promoters60/1011303
tttagtcg

SEQ ID NO: 91370 - DNA, 8 bp, Unknown
  misc_feature (1)..( 8): Result.001 file - promoters60/1011303
tttggtcg

SEQ ID NO: 91371 - DNA, 6 bp, Unknown
  misc_feature (1)..( 6): Result.001 file - promoters60/1011303
attttt

SEQ ID NO: 91372 - DNA, 6 bp, Unknown
  misc_feature (1)..( 6): Result.001 file - promoters60/1011337
attttt

SEQ ID NO: 91373 - DNA, 11 bp, Unknown
  misc_feature (1)..( 11): Result.001 file - promoters60/1011337
atatttttcgt

SEQ ID NO: 91374 - DNA, 11 bp, Unknown
  misc_feature (1)..( 11): Result.001 file - promoters60/1011337
tggttttccgt

SEQ ID NO: 91375 - DNA, 11 bp, Unknown
  misc_feature (1)..( 11): Result.001 file - promoters60/1011337
atatttttaca

SEQ ID NO: 91376 - DNA, 9 bp, Unknown
  misc_feature (1)..( 9): Result.001 file - promoters60/1011337
aaaaaaatt

SEQ ID NO: 91377 - DNA, 9 bp, Unknown
  misc_feature (1)..( 9): Result.001 file - promoters60/1011337
aaaacaatt

SEQ ID NO: 91378 - DNA, 9 bp, Unknown
  misc_feature (1)..( 9): Result.001 file - promoters60/1011337
gtaaaaata

SEQ ID NO: 91379 - DNA, 8 bp, Unknown
  misc_feature (1)..( 8): Result.001 file - promoters60/1011337
aataaata

SEQ ID NO: 91380 - DNA, 8 bp, Unknown
  misc_feature (1)..( 8): Result.001 file - promoters60/1011337
aatagata

SEQ ID NO: 91381 - DNA, 8 bp, Unknown
  misc_feature (1)..( 8): Result.001 file - promoters60/1011358
aataaaaa

SEQ ID NO: 91382 - DNA, 11 bp, Unknown
  misc_feature (1)..( 11): Result.001 file - promoters60/1011358
cgatacttgtc

SEQ ID NO: 91383 - DNA, 11 bp, Unknown
  misc_feature (1)..( 11): Result.001 file - promoters60/1011358
tgattcttcga

SEQ ID NO: 91384 - DNA, 11 bp, Unknown
  misc_feature (1)..( 11): Result.001 file - promoters60/1011358
cgaaactggtc

SEQ ID NO: 91385 - DNA, 10 bp, Unknown
  misc_feature (1)..( 10): Result.001 file - promoters60/1011358
aagaactcat

SEQ ID NO: 91386 - DNA, 10 bp, Unknown
  misc_feature (1)..( 10): Result.001 file - promoters60/1011358
aagaactaga

SEQ ID NO: 91387 - DNA, 10 bp, Unknown
  misc_feature (1)..( 10): Result.001 file - promoters60/1011358
atgaagtcat

SEQ ID NO: 91388 - DNA, 12 bp, Unknown
  misc_feature (1)..( 12): Result.001 file - promoters60/1011358
ttaaatgaagat

SEQ ID NO: 91389 - DNA, 12 bp, Unknown
  misc_feature (1)..( 12): Result.001 file - promoters60/1011358
aataatgatgat

SEQ ID NO: 91390 - DNA, 12 bp, Unknown
  misc_feature (1)..( 12): Result.001 file - promoters60/1011358
ttacatgaacag

SEQ ID NO: 91391 - DNA, 7 bp, Unknown
  misc_feature (1)..( 7): Result.001 file - promoters60/1011358
acacgtc

SEQ ID NO: 91392 - DNA, 7 bp, Unknown
  misc_feature (1)..( 7): Result.001 file - promoters60/1011358
acatgtc

SEQ ID NO: 91393 - DNA, 10 bp, Unknown
  misc_feature (1)..( 10): Result.001 file - promoters60/1011358
agtgatccaa

SEQ ID NO: 91394 - DNA, 10 bp, Unknown
  misc_feature (1)..( 10): Result.001 file - promoters60/1011358
tgtggtccat

SEQ ID NO: 91395 - DNA, 10 bp, Unknown
  misc_feature (1)..( 10): Result.001 file - promoters60/1011358
tgtggttcat

SEQ ID NO: 91396 - DNA, 9 bp, Unknown
  misc_feature (1)..( 9): Result.001 file - promoters60/1011358
ttatttgga

SEQ ID NO: 91397 - DNA, 9 bp, Unknown
  misc_feature (1)..( 9): Result.001 file - promoters60/1011358
ttatgtgga

SEQ ID NO: 91398 - DNA, 7 bp, Unknown
  misc_feature (1)..( 7): Result.001 file - promoters60/1011358
agaagaa

SEQ ID NO: 91399 - DNA, 7 bp, Unknown
  misc_feature (1)..( 7): Result.001 file - promoters60/1011358
agaagaa

SEQ ID NO: 91400 - DNA, 6 bp, Unknown
  misc_feature (1)..( 6): Result.001 file - promoters60/1011358
gtgtaa

SEQ ID NO: 91401 - DNA, 6 bp, Unknown
  misc_feature (1)..( 6): Result.001 file - promoters60/1011358
gtgtaa

SEQ ID NO: 91402 - DNA, 9 bp, Unknown
  misc_feature (1)..( 9): Result.001 file - promoters60/1011358
aaacaaaaa

SEQ ID NO: 91403 - DNA, 9 bp, Unknown
  misc_feature (1)..( 9): Result.001 file - promoters60/1011358
aaagaaaaa

SEQ ID NO: 91404 - DNA, 6 bp, Unknown
  misc_feature (1)..( 6): Result.001 file - promoters60/1011358
tataaa

SEQ ID NO: 91405 - DNA, 6 bp, Unknown
  misc_feature (1)..( 6): Result.001 file - promoters60/1011358
tataaa

SEQ ID NO: 91406 - DNA, 7 bp, Unknown
  misc_feature (1)..( 7): Result.001 file - promoters60/1011358
gacctta

SEQ ID NO: 91407 - DNA, 7 bp, Unknown
  misc_feature (1)..( 7): Result.001 file - promoters60/1011358
gacttta

SEQ ID NO: 91408 - DNA, 6 bp, Unknown
  misc_feature (1)..( 6): Result.001 file - promoters60/1011358
atgaag

SEQ ID NO: 91409 - DNA, 6 bp, Unknown
  misc_feature (1)..( 6): Result.001 file - promoters60/1011358
atgaag

SEQ ID NO: 91410 - DNA, 6 bp, Unknown
  misc_feature (1)..( 6): Result.001 file - promoters60/1011358
agtaat

SEQ ID NO: 91411 - DNA, 6 bp, Unknown
  misc_feature (1)..( 6): Result.001 file - promoters60/1011358
agtaat

SEQ ID NO: 91412 - DNA, 8 bp, Unknown
  misc_feature (1)..( 8): Result.001 file - promoters60/1011358
tcaggcag

SEQ ID NO: 91413 - DNA, 8 bp, Unknown
  misc_feature (1)..( 8): Result.001 file - promoters60/1011358
tcagccag

SEQ ID NO: 91414 - DNA, 6 bp, Unknown
  misc_feature (1)..( 6): Result.001 file - promoters60/1011358
cgttga

SEQ ID NO: 91415 - DNA, 6 bp, Unknown
  misc_feature (1)..( 6): Result.001 file - promoters60/1011516
cgttga

SEQ ID NO: 91416 - DNA, 7 bp, Unknown
  misc_feature (1)..( 7): Result.001 file - promoters60/1011516
tagattt

SEQ ID NO: 91417 - DNA, 7 bp, Unknown
  misc_feature (1)..( 7): Result.001 file - promoters60/1011516
tagtttt

SEQ ID NO: 91418 - DNA, 8 bp, Unknown
  misc_feature (1)..( 8): Result.001 file - promoters60/1011516
caatgaga

SEQ ID NO: 91419 - DNA, 8 bp, Unknown
  misc_feature (1)..( 8): Result.001 file - promoters60/1011516
caaagaga

SEQ ID NO: 91420 - DNA, 8 bp, Unknown
  misc_feature (1)..( 8): Result.001 file - promoters60/1011516
gaatcaga

SEQ ID NO: 91421 - DNA, 7 bp, Unknown
  misc_feature (1)..( 7): Result.001 file - promoters60/1011516
catcatt

SEQ ID NO: 91422 - DNA, 7 bp, Unknown
  misc_feature (1)..( 7): Result.001 file - promoters60/1011516
cataatt

SEQ ID NO: 91423 - DNA, 8 bp, Unknown
  misc_feature (1)..( 8): Result.001 file - promoters60/1011516
aatccata

SEQ ID NO: 91424 - DNA, 8 bp, Unknown
  misc_feature (1)..( 8): Result.001 file - promoters60/1011516
aatcaata

SEQ ID NO: 91425 - DNA, 6 bp, Unknown
  misc_feature (1)..( 6): Result.001 file - promoters60/1011516
aagaga

SEQ ID NO: 91426 - DNA, 6 bp, Unknown
  misc_feature (1)..( 6): Result.001 file - promoters60/1011516
aagaga

SEQ ID NO: 91427 - DNA, 9 bp, Unknown
  misc_feature (1)..( 9): Result.001 file - promoters60/1011516
ataatcata

SEQ ID NO: 91428 - DNA, 9 bp, Unknown
  misc_feature (1)..( 9): Result.001 file - promoters60/1011516
ataataata

SEQ ID NO: 91429 - DNA, 7 bp, Unknown
  misc_feature (1)..( 7): Result.001 file - promoters60/1011516
tttgttc

SEQ ID NO: 91430 - DNA, 7 bp, Unknown
  misc_feature (1)..( 7): Result.001 file - promoters60/1011516
ttttttc

SEQ ID NO: 91431 - DNA, 8 bp, Unknown
  misc_feature (1)..( 8): Result.001 file - promoters60/1011516
ccactcca

SEQ ID NO: 91432 - DNA, 8 bp, Unknown
  misc_feature (1)..( 8): Result.001 file - promoters60/1011516
ccattcca

SEQ ID NO: 91433 - DNA, 8 bp, Unknown
  misc_feature (1)..( 8): Result.001 file - promoters60/1011516
taagacgt

SEQ ID NO: 91434 - DNA, 8 bp, Unknown
  misc_feature (1)..( 8): Result.001 file - promoters60/1011516
taacacgt

SEQ ID NO: 91435 - DNA, 7 bp, Unknown
  misc_feature (1)..( 7): Result.001 file - promoters60/1011516
caaaaat

SEQ ID NO: 91436 - DNA, 7 bp, Unknown
  misc_feature (1)..( 7): Result.001 file - promoters60/1011516
caacaat

SEQ ID NO: 91437 - DNA, 7 bp, Unknown
  misc_feature (1)..( 7): Result.001 file - promoters60/1011516
aaaagga

SEQ ID NO: 91438 - DNA, 7 bp, Unknown
  misc_feature (1)..( 7): Result.001 file - promoters60/1011516
aaaggga

SEQ ID NO: 91439 - DNA, 10 bp, Unknown
  misc_feature (1)..( 10): Result.001 file - promoters60/1011516
ttatcttagt

SEQ ID NO: 91440 - DNA, 10 bp, Unknown
  misc_feature (1)..( 10): Result.001 file - promoters60/1011516
ctatattaat

SEQ ID NO: 91441 - DNA, 10 bp, Unknown
  misc_feature (1)..( 10): Result.001 file - promoters60/1011516
ctataataat

SEQ ID NO: 91442 - DNA, 6 bp, Unknown
  misc_feature (1)..( 6): Result.001 file - promoters60/1011516
gatcat

SEQ ID NO: 91443 - DNA, 6 bp, Unknown
  misc_feature (1)..( 6): Result.001 file - promoters60/1011516
gatcat

SEQ ID NO: 91444 - DNA, 7 bp, Unknown
  misc_feature (1)..( 7): Result.001 file - promoters60/1011516
tcttcat

SEQ ID NO: 91445 - DNA, 7 bp, Unknown
  misc_feature (1)..( 7): Result.001 file - promoters60/1011516
tctacat

SEQ ID NO: 91446 - DNA, 7 bp, Unknown
  misc_feature (1)..( 7): Result.001 file - promoters60/1011516
ttacaaa

SEQ ID NO: 91447 - DNA, 7 bp, Unknown
  misc_feature (1)..( 7): Result.001 file - promoters60/1011516
ttagaaa

SEQ ID NO: 91448 - DNA, 8 bp, Unknown
  misc_feature (1)..( 8): Result.001 file - promoters60/1011516
taaaatta

SEQ ID NO: 91449 - DNA, 8 bp, Unknown
  misc_feature (1)..( 8): Result.001 file - promoters60/1011516
taatatta

SEQ ID NO: 91450 - DNA, 8 bp, Unknown
  misc_feature (1)..( 8): Result.001 file - promoters60/1011516
aattaata

SEQ ID NO: 91451 - DNA, 8 bp, Unknown
  misc_feature (1)..( 8): Result.001 file - promoters60/1011556
aataaata

SEQ ID NO: 91452 - DNA, 9 bp, Unknown
  misc_feature (1)..( 9): Result.001 file - promoters60/1011556
gaataaatc

SEQ ID NO: 91453 - DNA, 9 bp, Unknown
  misc_feature (1)..( 9): Result.001 file - promoters60/1011556
gaaaaaaaa

SEQ ID NO: 91454 - DNA, 9 bp, Unknown
  misc_feature (1)..( 9): Result.001 file - promoters60/1011556
gaagaaagt

SEQ ID NO: 91455 - DNA, 9 bp, Unknown
  misc_feature (1)..( 9): Result.001 file - promoters60/1011556
taaaaaaaa

SEQ ID NO: 91456 - DNA, 9 bp, Unknown
  misc_feature (1)..( 9): Result.001 file - promoters60/1011556
taaaaatac

SEQ ID NO: 91457 - DNA, 9 bp, Unknown
  misc_feature (1)..( 9): Result.001 file - promoters60/1011556
caaaaagaa

SEQ ID NO: 91458 - DNA, 15 bp, Unknown
  misc_feature (1)..( 15): Result.001 file - promoters60/1011556
aaaattaatttcgag

SEQ ID NO: 91459 - DNA, 15 bp, Unknown
  misc_feature (1)..( 15): Result.001 file - promoters60/1011556
cctattaataaaatt

SEQ ID NO: 91460 - DNA, 15 bp, Unknown
  misc_feature (1)..( 15): Result.001 file - promoters60/1011556
aaaaataatcagaat

SEQ ID NO: 91461 - DNA, 15 bp, Unknown
  misc_feature (1)..( 15): Result.001 file - promoters60/1011556
tcaattaatcttttg

SEQ ID NO: 91462 - DNA, 15 bp, Unknown
  misc_feature (1)..( 15): Result.001 file - promoters60/1011556
actatttatacataa

SEQ ID NO: 91463 - DNA, 15 bp, Unknown
  misc_feature (1)..( 15): Result.001 file - promoters60/1011556
atttttaatatatat

SEQ ID NO: 91464 - DNA, 15 bp, Unknown
  misc_feature (1)..( 15): Result.001 file - promoters60/1011556
tcatttaaaaccaag

SEQ ID NO: 91465 - DNA, 8 bp, Unknown
  misc_feature (1)..( 8): Result.001 file - promoters60/1011556
gttaattc

SEQ ID NO: 91466 - DNA, 8 bp, Unknown
  misc_feature (1)..( 8): Result.001 file - promoters60/1011556
tttaattt

SEQ ID NO: 91467 - DNA, 8 bp, Unknown
  misc_feature (1)..( 8): Result.001 file - promoters60/1011556
attatttc

SEQ ID NO: 91468 - DNA, 8 bp, Unknown
  misc_feature (1)..( 8): Result.001 file - promoters60/1011556
tttcattc

SEQ ID NO: 91469 - DNA, 8 bp, Unknown
  misc_feature (1)..( 8): Result.001 file - promoters60/1011556
tttgattt

SEQ ID NO: 91470 - DNA, 9 bp, Unknown
  misc_feature (1)..( 9): Result.001 file - promoters60/1011556
cgtgacttg

SEQ ID NO: 91471 - DNA, 9 bp, Unknown
  misc_feature (1)..( 9): Result.001 file - promoters60/1011556
cataataat

SEQ ID NO: 91472 - DNA, 9 bp, Unknown
  misc_feature (1)..( 9): Result.001 file - promoters60/1011556
attaataaa

SEQ ID NO: 91473 - DNA, 9 bp, Unknown
  misc_feature (1)..( 9): Result.001 file - promoters60/1011556
ttaaataat

SEQ ID NO: 91474 - DNA, 9 bp, Unknown
  misc_feature (1)..( 9): Result.001 file - promoters60/1011556
aaaaataat

SEQ ID NO: 91475 - DNA, 9 bp, Unknown
  misc_feature (1)..( 9): Result.001 file - promoters60/1011556
ttaaataaa

SEQ ID NO: 91476 - DNA, 9 bp, Unknown
  misc_feature (1)..( 9): Result.001 file - promoters60/1011556
ataaatatt

SEQ ID NO: 91477 - DNA, 9 bp, Unknown
  misc_feature (1)..( 9): Result.001 file - promoters60/1011556
ggaaaaaat

SEQ ID NO: 91478 - DNA, 12 bp, Unknown
  misc_feature (1)..( 12): Result.001 file - promoters60/1011556
ttgtcaaatgat

SEQ ID NO: 91479 - DNA, 12 bp, Unknown
  misc_feature (1)..( 12): Result.001 file - promoters60/1011556
gtgttaaaagac

SEQ ID NO: 91480 - DNA, 12 bp, Unknown
  misc_feature (1)..( 12): Result.001 file - promoters60/1011556
aagttaaataaa

SEQ ID NO: 91481 - DNA, 12 bp, Unknown
  misc_feature (1)..( 12): Result.001 file - promoters60/1011556
gtgataaatatt

SEQ ID NO: 91482 - DNA, 12 bp, Unknown
  misc_feature (1)..( 12): Result.001 file - promoters60/1011556
tatttaaataat

SEQ ID NO: 91483 - DNA, 12 bp, Unknown
  misc_feature (1)..( 12): Result.001 file - promoters60/1011556
atgggaaaaaat

SEQ ID NO: 91484 - DNA, 10 bp, Unknown
  misc_feature (1)..( 10): Result.001 file - promoters60/1011556
tcaatacaag

SEQ ID NO: 91485 - DNA, 10 bp, Unknown
  misc_feature (1)..( 10): Result.001 file - promoters60/1011556
acaaaacaca

SEQ ID NO: 91486 - DNA, 10 bp, Unknown
  misc_feature (1)..( 10): Result.001 file - promoters60/1011556
tcactacaaa

SEQ ID NO: 91487 - DNA, 11 bp, Unknown
  misc_feature (1)..( 11): Result.001 file - promoters60/1011556
gggttacgaaa

SEQ ID NO: 91488 - DNA, 11 bp, Unknown
  misc_feature (1)..( 11): Result.001 file - promoters60/1011556
tacataacact

SEQ ID NO: 91489 - DNA, 11 bp, Unknown
  misc_feature (1)..( 11): Result.001 file - promoters60/1011616
tcactattcac

SEQ ID NO: 91490 - DNA, 8 bp, Unknown
  misc_feature (1)..( 8): Result.001 file - promoters60/1011616
actagaag

SEQ ID NO: 91491 - DNA, 8 bp, Unknown
  misc_feature (1)..( 8): Result.001 file - promoters60/1011616
actataag

SEQ ID NO: 91492 - DNA, 6 bp, Unknown
  misc_feature (1)..( 6): Result.001 file - promoters60/1011616
tataaa

SEQ ID NO: 91493 - DNA, 6 bp, Unknown
  misc_feature (1)..( 6): Result.001 file - promoters60/1011616
tataaa

SEQ ID NO: 91494 - DNA, 9 bp, Unknown
  misc_feature (1)..( 9): Result.001 file - promoters60/1011616
atgaacaat

SEQ ID NO: 91495 - DNA, 9 bp, Unknown
  misc_feature (1)..( 9): Result.001 file - promoters60/1011616
atggacaat

SEQ ID NO: 91496 - DNA, 7 bp, Unknown
  misc_feature (1)..( 7): Result.001 file - promoters60/1011616
ggacgct

SEQ ID NO: 91497 - DNA, 7 bp, Unknown
  misc_feature (1)..( 7): Result.001 file - promoters60/1011616
ggacgct

SEQ ID NO: 91498 - DNA, 7 bp, Unknown
  misc_feature (1)..( 7): Result.001 file - promoters60/1011616
caatcaa

SEQ ID NO: 91499 - DNA, 7 bp, Unknown
  misc_feature (1)..( 7): Result.001 file - promoters60/1011616
caaccaa

SEQ ID NO: 91500 - DNA, 6 bp, Unknown
  misc_feature (1)..( 6): Result.001 file - promoters60/1011616
aataaa

SEQ ID NO: 91501 - DNA, 6 bp, Unknown
  misc_feature (1)..( 6): Result.001 file - promoters60/1011616
aataaa

SEQ ID NO: 91502 - DNA, 6 bp, Unknown
  misc_feature (1)..( 6): Result.001 file - promoters60/1011616
aaaaat

SEQ ID NO: 91503 - DNA, 6 bp, Unknown
  misc_feature (1)..( 6): Result.001 file - promoters60/1011616
aaaaat

SEQ ID NO: 91504 - DNA, 7 bp, Unknown
  misc_feature (1)..( 7): Result.001 file - promoters60/1011616
ggtcggt

SEQ ID NO: 91505 - DNA, 7 bp, Unknown
  misc_feature (1)..( 7): Result.001 file - promoters60/1011616
ggttggt

SEQ ID NO: 91506 - DNA, 6 bp, Unknown
  misc_feature (1)..( 6): Result.001 file - promoters60/1011616
taaaaa

SEQ ID NO: 91507 - DNA, 6 bp, Unknown
  misc_feature (1)..( 6): Result.001 file - promoters60/1011616
taaaaa

SEQ ID NO: 91508 - DNA, 6 bp, Unknown
  misc_feature (1)..( 6): Result.001 file - promoters60/1011616
tataaa

SEQ ID NO: 91509 - DNA, 6 bp, Unknown
  misc_feature (1)..( 6): Result.001 file - promoters60/1011780
tataaa

SEQ ID NO: 91510 - DNA, 8 bp, Unknown
  misc_feature (1)..( 8): Result.001 file - promoters60/1011780
aggcccaa

SEQ ID NO: 91511 - DNA, 8 bp, Unknown
  misc_feature (1)..( 8): Result.001 file - promoters60/1011780
aggcccaa

SEQ ID NO: 91512 - DNA, 8 bp, Unknown
  misc_feature (1)..( 8): Result.001 file - promoters60/1011780
aagcccaa

SEQ ID NO: 91513 - DNA, 8 bp, Unknown
  misc_feature (1)..( 8): Result.001 file - promoters60/1011780
cggcccac

SEQ ID NO: 91514 - DNA, 8 bp, Unknown
  misc_feature (1)..( 8): Result.001 file - promoters60/1011780
aggcccat

SEQ ID NO: 91515 - DNA, 8 bp, Unknown
  misc_feature (1)..( 8): Result.001 file - promoters60/1011900
aggcccat

SEQ ID NO: 91516 - DNA, 6 bp, Unknown
  misc_feature (1)..( 6): Result.001 file - promoters60/1011900
aaaaat

SEQ ID NO: 91517 - DNA, 6 bp, Unknown
  misc_feature (1)..( 6): Result.001 file - promoters60/1011900
aaaaat

SEQ ID NO: 91518 - DNA, 9 bp, Unknown
  misc_feature (1)..( 9): Result.001 file - promoters60/1011900
gattattgt

SEQ ID NO: 91519 - DNA, 9 bp, Unknown
  misc_feature (1)..( 9): Result.001 file - promoters60/1011900
gatttttgt

SEQ ID NO: 91520 - DNA, 6 bp, Unknown
  misc_feature (1)..( 6): Result.001 file - promoters60/1011900
catatc

SEQ ID NO: 91521 - DNA, 6 bp, Unknown
  misc_feature (1)..( 6): Result.001 file - promoters60/1011900
catatc

SEQ ID NO: 91522 - DNA, 6 bp, Unknown
  misc_feature (1)..( 6): Result.001 file - promoters60/1011900
caaggt

SEQ ID NO: 91523 - DNA, 6 bp, Unknown
  misc_feature (1)..( 6): Result.001 file - promoters60/1011900
caaggt

SEQ ID NO: 91524 - DNA, 6 bp, Unknown
  misc_feature (1)..( 6): Result.001 file - promoters60/1011900
aaatgt

SEQ ID NO: 91525 - DNA, 6 bp, Unknown
  misc_feature (1)..( 6): Result.001 file - promoters60/1011900
aaatgt

SEQ ID NO: 91526 - DNA, 7 bp, Unknown
  misc_feature (1)..( 7): Result.001 file - promoters60/1011900
tcataat

SEQ ID NO: 91527 - DNA, 7 bp, Unknown
  misc_feature (1)..( 7): Result.001 file - promoters60/1011900
tcataat

SEQ ID NO: 91528 - DNA, 7 bp, Unknown
  misc_feature (1)..( 7): Result.001 file - promoters60/1011900
atttgag

SEQ ID NO: 91529 - DNA, 7 bp, Unknown
  misc_feature (1)..( 7): Result.001 file - promoters60/1011900
atttgag

SEQ ID NO: 91530 - DNA, 6 bp, Unknown
  misc_feature (1)..( 6): Result.001 file - promoters60/1011900
cttaga

SEQ ID NO: 91531 - DNA, 6 bp, Unknown
  misc_feature (1)..( 6): Result.001 file - promoters60/1011900
cttaga

SEQ ID NO: 91532 - DNA, 6 bp, Unknown
  misc_feature (1)..( 6): Result.001 file - promoters60/1011900
actttt

SEQ ID NO: 91533 - DNA, 6 bp, Unknown
  misc_feature (1)..( 6): Result.001 file - promoters60/1011900
actttt

SEQ ID NO: 91534 - DNA, 6 bp, Unknown
  misc_feature (1)..( 6): Result.001 file - promoters60/1011900
aaattc

SEQ ID NO: 91535 - DNA, 6 bp, Unknown
  misc_feature (1)..( 6): Result.001 file - promoters60/1011900
aaattc

SEQ ID NO: 91536 - DNA, 6 bp, Unknown
  misc_feature (1)..( 6): Result.001 file - promoters60/1011900
caacca

SEQ ID NO: 91537 - DNA, 6 bp, Unknown
  misc_feature (1)..( 6): Result.001 file - promoters60/1011900
caacca

SEQ ID NO: 91538 - DNA, 7 bp, Unknown
  misc_feature (1)..( 7): Result.001 file - promoters60/1011900
agttatc

SEQ ID NO: 91539 - DNA, 7 bp, Unknown
  misc_feature (1)..( 7): Result.001 file - promoters60/1011972
agtaatc

SEQ ID NO: 91540 - DNA, 10 bp, Unknown
  misc_feature (1)..( 10): Result.001 file - promoters60/1011972
aaactttttc

SEQ ID NO: 91541 - DNA, 10 bp, Unknown
  misc_feature (1)..( 10): Result.001 file - promoters60/1011972
aaactttttt

SEQ ID NO: 91542 - DNA, 10 bp, Unknown
  misc_feature (1)..( 10): Result.001 file - promoters60/1011972
catttttttc

SEQ ID NO: 91543 - DNA, 10 bp, Unknown
  misc_feature (1)..( 10): Result.001 file - promoters60/1011972
atataaaaaa

SEQ ID NO: 91544 - DNA, 10 bp, Unknown
  misc_feature (1)..( 10): Result.001 file - promoters60/1011972
ttttaacaaa

SEQ ID NO: 91545 - DNA, 10 bp, Unknown
  misc_feature (1)..( 10): Result.001 file - promoters60/1011972
ttttaacatc

SEQ ID NO: 91546 - DNA, 8 bp, Unknown
  misc_feature (1)..( 8): Result.001 file - promoters60/1011972
tgcataat

SEQ ID NO: 91547 - DNA, 8 bp, Unknown
  misc_feature (1)..( 8): Result.001 file - promoters60/1011972
agcataag

SEQ ID NO: 91548 - DNA, 8 bp, Unknown
  misc_feature (1)..( 8): Result.001 file - promoters60/1011972
tgcatatg

SEQ ID NO: 91549 - DNA, 8 bp, Unknown
  misc_feature (1)..( 8): Result.001 file - promoters60/1011972
tccataat

SEQ ID NO: 91550 - DNA, 9 bp, Unknown
  misc_feature (1)..( 9): Result.001 file - promoters60/1011972
gaatctctt

SEQ ID NO: 91551 - DNA, 9 bp, Unknown
  misc_feature (1)..( 9): Result.001 file - promoters60/1011972
gaatctctt

SEQ ID NO: 91552 - DNA, 9 bp, Unknown
  misc_feature (1)..( 9): Result.001 file - promoters60/1011972
gaatctaag

SEQ ID NO: 91553 - DNA, 7 bp, Unknown
  misc_feature (1)..( 7): Result.001 file - promoters60/1011972
tttaaaa

SEQ ID NO: 91554 - DNA, 7 bp, Unknown
  misc_feature (1)..( 7): Result.001 file - promoters60/1011972
tttaaag

SEQ ID NO: 91555 - DNA, 7 bp, Unknown
  misc_feature (1)..( 7): Result.001 file - promoters60/1011972
attaaag

SEQ ID NO: 91556 - DNA, 11 bp, Unknown
  misc_feature (1)..( 11): Result.001 file - promoters60/1011972
atgtattttat

SEQ ID NO: 91557 - DNA, 11 bp, Unknown
  misc_feature (1)..( 11): Result.001 file - promoters60/1011972
aatctttttat

SEQ ID NO: 91558 - DNA, 11 bp, Unknown
  misc_feature (1)..( 11): Result.001 file - promoters60/1011972
aatctttttac

SEQ ID NO: 91559 - DNA, 9 bp, Unknown
  misc_feature (1)..( 9): Result.001 file - promoters60/1011972
ttctgctaa

SEQ ID NO: 91560 - DNA, 9 bp, Unknown
  misc_feature (1)..( 9): Result.001 file - promoters60/1011972
ttctgcgaa

SEQ ID NO: 91561 - DNA, 9 bp, Unknown
  misc_feature (1)..( 9): Result.001 file - promoters60/1011972
atctcctaa

SEQ ID NO: 91562 - DNA, 9 bp, Unknown
  misc_feature (1)..( 9): Result.001 file - promoters60/1011972
tcatataaa

SEQ ID NO: 91563 - DNA, 9 bp, Unknown
  misc_feature (1)..( 9): Result.001 file - promoters60/1011972
ctatataaa

SEQ ID NO: 91564 - DNA, 9 bp, Unknown
  misc_feature (1)..( 9): Result.001 file - promoters60/1011972
ctacatatc

SEQ ID NO: 91565 - DNA, 12 bp, Unknown
  misc_feature (1)..( 12): Result.001 file - promoters60/1011972
agtgtttcatat

SEQ ID NO: 91566 - DNA, 12 bp, Unknown
  misc_feature (1)..( 12): Result.001 file - promoters60/1011972
agtttttgatat

SEQ ID NO: 91567 - DNA, 12 bp, Unknown
  misc_feature (1)..( 12): Result.001 file - promoters60/1011972
gccgtttgataa

SEQ ID NO: 91568 - DNA, 12 bp, Unknown
  misc_feature (1)..( 12): Result.001 file - promoters60/1011972
tcattttgacat

SEQ ID NO: 91569 - DNA, 7 bp, Unknown
  misc_feature (1)..( 7): Result.001 file - promoters60/1011972
ttttcaa

SEQ ID NO: 91570 - DNA, 7 bp, Unknown
  misc_feature (1)..( 7): Result.001 file - promoters60/1011972
gtttcaa

SEQ ID NO: 91571 - DNA, 8 bp, Unknown
  misc_feature (1)..( 8): Result.001 file - promoters60/1011972
attgtcaa

SEQ ID NO: 91572 - DNA, 9 bp, Unknown
  misc_feature (1)..( 9): Result.001 file - promoters60/1011972
ctaattaac

SEQ ID NO: 91573 - DNA, 9 bp, Unknown
  misc_feature (1)..( 9): Result.001 file - promoters60/1011972
ctaatcaac

SEQ ID NO: 91574 - DNA, 9 bp, Unknown
  misc_feature (1)..( 9): Result.001 file - promoters60/1011972
gtcatcaat

SEQ ID NO: 91575 - DNA, 10 bp, Unknown
  misc_feature (1)..( 10): Result.001 file - promoters60/1011972
atcttcatat

SEQ ID NO: 91576 - DNA, 10 bp, Unknown
  misc_feature (1)..( 10): Result.001 file - promoters60/1011972
atctacatat

SEQ ID NO: 91577 - DNA, 10 bp, Unknown
  misc_feature (1)..( 10): Result.001 file - promoters60/1011972
tactatataa

SEQ ID NO: 91578 - DNA, 8 bp, Unknown
  misc_feature (1)..( 8): Result.001 file - promoters60/1011972
atccatat

SEQ ID NO: 91579 - DNA, 8 bp, Unknown
  misc_feature (1)..( 8): Result.001 file - promoters60/1011972
atcaatat

SEQ ID NO: 91580 - DNA, 8 bp, Unknown
  misc_feature (1)..( 8): Result.001 file - promoters60/1011972
atcaacaa

SEQ ID NO: 91581 - DNA, 7 bp, Unknown
  misc_feature (1)..( 7): Result.001 file - promoters60/1011972
tgacatc

SEQ ID NO: 91582 - DNA, 7 bp, Unknown
  misc_feature (1)..( 7): Result.001 file - promoters60/1011972
tgacatt

SEQ ID NO: 91583 - DNA, 7 bp, Unknown
  misc_feature (1)..( 7): Result.001 file - promoters60/1011972
tgatatt

SEQ ID NO: 91584 - DNA, 6 bp, Unknown
  misc_feature (1)..( 6): Result.001 file - promoters60/1011972
tttgga

SEQ ID NO: 91585 - DNA, 6 bp, Unknown
  misc_feature (1)..( 6): Result.001 file - promoters60/1011972
tttgga

SEQ ID NO: 91586 - DNA, 7 bp, Unknown
  misc_feature (1)..( 7): Result.001 file - promoters60/1012017
tttcgga

SEQ ID NO: 91587 - DNA, 8 bp, Unknown
  misc_feature (1)..( 8): Result.001 file - promoters60/1012017
aattcaac

SEQ ID NO: 91588 - DNA, 8 bp, Unknown
  misc_feature (1)..( 8): Result.001 file - promoters60/1012017
aatgcaac

SEQ ID NO: 91589 - DNA, 6 bp, Unknown
  misc_feature (1)..( 6): Result.001 file - promoters60/1012017
aaattt

SEQ ID NO: 91590 - DNA, 6 bp, Unknown
  misc_feature (1)..( 6): Result.001 file - promoters60/1012017
aaattt

SEQ ID NO: 91591 - DNA, 10 bp, Unknown
  misc_feature (1)..( 10): Result.001 file - promoters60/1012017
tgttttcact

SEQ ID NO: 91592 - DNA, 10 bp, Unknown
  misc_feature (1)..( 10): Result.001 file - promoters60/1012017
taattttact

SEQ ID NO: 91593 - DNA, 10 bp, Unknown
  misc_feature (1)..( 10): Result.001 file - promoters60/1012017
tgtattcacc

SEQ ID NO: 91594 - DNA, 7 bp, Unknown
  misc_feature (1)..( 7): Result.001 file - promoters60/1012017
gttaata

SEQ ID NO: 91595 - DNA, 7 bp, Unknown
  misc_feature (1)..( 7): Result.001 file - promoters60/1012017
gttaata

SEQ ID NO: 91596 - DNA, 9 bp, Unknown
  misc_feature (1)..( 9): Result.001 file - promoters60/1012017
aactcttta

SEQ ID NO: 91597 - DNA, 9 bp, Unknown
  misc_feature (1)..( 9): Result.001 file - promoters60/1012017
aactttttt

SEQ ID NO: 91598 - DNA, 10 bp, Unknown
  misc_feature (1)..( 10): Result.001 file - promoters60/1012017
tgttttatta

SEQ ID NO: 91599 - DNA, 6 bp, Unknown
  misc_feature (1)..( 6): Result.001 file - promoters60/1012017
caaaaa

SEQ ID NO: 91600 - DNA, 6 bp, Unknown
  misc_feature (1)..( 6): Result.001 file - promoters60/1012017
caaaaa

SEQ ID NO: 91601 - DNA, 7 bp, Unknown
  misc_feature (1)..( 7): Result.001 file - promoters60/1012017
tttattg

SEQ ID NO: 91602 - DNA, 7 bp, Unknown
  misc_feature (1)..( 7): Result.001 file - promoters60/1012017
tttatta

SEQ ID NO: 91603 - DNA, 7 bp, Unknown
  misc_feature (1)..( 7): Result.001 file - promoters60/1012017
tttttta

SEQ ID NO: 91604 - DNA, 7 bp, Unknown
  misc_feature (1)..( 7): Result.001 file - promoters60/1012017
tgaaatt

SEQ ID NO: 91605 - DNA, 7 bp, Unknown
  misc_feature (1)..( 7): Result.001 file - promoters60/1012017
tgatatt

SEQ ID NO: 91606 - DNA, 6 bp, Unknown
  misc_feature (1)..( 6): Result.001 file - promoters60/1012017
aagttg

SEQ ID NO: 91607 - DNA, 6 bp, Unknown
  misc_feature (1)..( 6): Result.001 file - promoters60/1012017
aagttg

SEQ ID NO: 91608 - DNA, 8 bp, Unknown
  misc_feature (1)..( 8): Result.001 file - promoters60/1012017
attactat

SEQ ID NO: 91609 - DNA, 8 bp, Unknown
  misc_feature (1)..( 8): Result.001 file - promoters60/1012017
attgctat

SEQ ID NO: 91610 - DNA, 6 bp, Unknown
  misc_feature (1)..( 6): Result.001 file - promoters60/1012017
taattc

SEQ ID NO: 91611 - DNA, 6 bp, Unknown
  misc_feature (1)..( 6): Result.001 file - promoters60/1012017
taattc

SEQ ID NO: 91612 - DNA, 8 bp, Unknown
  misc_feature (1)..( 8): Result.001 file - promoters60/1012017
tgtctaag

SEQ ID NO: 91613 - DNA, 8 bp, Unknown
  misc_feature (1)..( 8): Result.001 file - promoters60/1012017
tgtcaaag

SEQ ID NO: 91614 - DNA, 7 bp, Unknown
  misc_feature (1)..( 7): Result.001 file - promoters60/1012017
aaaaaaa

SEQ ID NO: 91615 - DNA, 7 bp, Unknown
  misc_feature (1)..( 7): Result.001 file - promoters60/1012017
aaacaaa

SEQ ID NO: 91616 - DNA, 6 bp, Unknown
  misc_feature (1)..( 6): Result.001 file - promoters60/1012017
tgtcga

SEQ ID NO: 91617 - DNA, 6 bp, Unknown
  misc_feature (1)..( 6): Result.001 file - promoters60/1012017
tgtcga

SEQ ID NO: 91618 - DNA, 7 bp, Unknown
  misc_feature (1)..( 7): Result.001 file - promoters60/1012017
tttactt

SEQ ID NO: 91619 - DNA, 7 bp, Unknown
  misc_feature (1)..( 7): Result.001 file - promoters60/1012017
tttgctt

SEQ ID NO: 91620 - DNA, 6 bp, Unknown
  misc_feature (1)..( 6): Result.001 file - promoters60/1012017
ttgtac

SEQ ID NO: 91621 - DNA, 6 bp, Unknown
  misc_feature (1)..( 6): Result.001 file - promoters60/1012074
ttgtac

SEQ ID NO: 91622 - DNA, 12 bp, Unknown
  misc_feature (1)..( 12): Result.001 file - promoters60/1012074
atattttcaata

SEQ ID NO: 91623 - DNA, 12 bp, Unknown
  misc_feature (1)..( 12): Result.001 file - promoters60/1012074
ttatcttcttcg

SEQ ID NO: 91624 - DNA, 12 bp, Unknown
  misc_feature (1)..( 12): Result.001 file - promoters60/1012074
ataatttgataa

SEQ ID NO: 91625 - DNA, 12 bp, Unknown
  misc_feature (1)..( 12): Result.001 file - promoters60/1012074
atattttgttaa

SEQ ID NO: 91626 - DNA, 12 bp, Unknown
  misc_feature (1)..( 12): Result.001 file - promoters60/1012074
atatttactgga

SEQ ID NO: 91627 - DNA, 9 bp, Unknown
  misc_feature (1)..( 9): Result.001 file - promoters60/1012074
tttagtttc

SEQ ID NO: 91628 - DNA, 9 bp, Unknown
  misc_feature (1)..( 9): Result.001 file - promoters60/1012074
tttagtcat

SEQ ID NO: 91629 - DNA, 9 bp, Unknown
  misc_feature (1)..( 9): Result.001 file - promoters60/1012074
ttttgttaa

SEQ ID NO: 91630 - DNA, 9 bp, Unknown
  misc_feature (1)..( 9): Result.001 file - promoters60/1012074
ttttttaaa

SEQ ID NO: 91631 - DNA, 9 bp, Unknown
  misc_feature (1)..( 9): Result.001 file - promoters60/1012074
tttcttgga

SEQ ID NO: 91632 - DNA, 12 bp, Unknown
  misc_feature (1)..( 12): Result.001 file - promoters60/1012074
ttttaataagag

SEQ ID NO: 91633 - DNA, 12 bp, Unknown
  misc_feature (1)..( 12): Result.001 file - promoters60/1012074
tttcaataaccg

SEQ ID NO: 91634 - DNA, 12 bp, Unknown
  misc_feature (1)..( 12): Result.001 file - promoters60/1012074
gtctaaaaagta

SEQ ID NO: 91635 - DNA, 12 bp, Unknown
  misc_feature (1)..( 12): Result.001 file - promoters60/1012074
actcaatatcaa

SEQ ID NO: 91636 - DNA, 12 bp, Unknown
  misc_feature (1)..( 12): Result.001 file - promoters60/1012074
atctagaaattc

SEQ ID NO: 91637 - DNA, 11 bp, Unknown
  misc_feature (1)..( 11): Result.001 file - promoters60/1012074
taattttacta

SEQ ID NO: 91638 - DNA, 11 bp, Unknown
  misc_feature (1)..( 11): Result.001 file - promoters60/1012074
taatttgataa

SEQ ID NO: 91639 - DNA, 12 bp, Unknown
  misc_feature (1)..( 12): Result.001 file - promoters60/1012074
taatgttagctg

SEQ ID NO: 91640 - DNA, 12 bp, Unknown
  misc_feature (1)..( 12): Result.001 file - promoters60/1012074
taacgttgaaga

SEQ ID NO: 91641 - DNA, 12 bp, Unknown
  misc_feature (1)..( 12): Result.001 file - promoters60/1012078
atattttgttaa

SEQ ID NO: 91642 - DNA, 6 bp, Unknown
  misc_feature (1)..( 6): Result.001 file - promoters60/1012078
agccag

SEQ ID NO: 91643 - DNA, 6 bp, Unknown
  misc_feature (1)..( 6): Result.001 file - promoters60/1012078
agccag

SEQ ID NO: 91644 - DNA, 7 bp, Unknown
  misc_feature (1)..( 7): Result.001 file - promoters60/1012078
gaagcca

SEQ ID NO: 91645 - DNA, 7 bp, Unknown
  misc_feature (1)..( 7): Result.001 file - promoters60/1012078
gaaacca

SEQ ID NO: 91646 - DNA, 7 bp, Unknown
  misc_feature (1)..( 7): Result.001 file - promoters60/1012078
ttaggat

SEQ ID NO: 91647 - DNA, 7 bp, Unknown
  misc_feature (1)..( 7): Result.001 file - promoters60/1012078
ttatgat

SEQ ID NO: 91648 - DNA, 7 bp, Unknown
  misc_feature (1)..( 7): Result.001 file - promoters60/1012078
ttcatga

SEQ ID NO: 91649 - DNA, 7 bp, Unknown
  misc_feature (1)..( 7): Result.001 file - promoters60/1012078
ttcttga

SEQ ID NO: 91650 - DNA, 6 bp, Unknown
  misc_feature (1)..( 6): Result.001 file - promoters60/1012078
aagaaa

SEQ ID NO: 91651 - DNA, 6 bp, Unknown
  misc_feature (1)..( 6): Result.001 file - promoters60/1012078
aagaaa

SEQ ID NO: 91652 - DNA, 7 bp, Unknown
  misc_feature (1)..( 7): Result.001 file - promoters60/1012078
ttcctct

SEQ ID NO: 91653 - DNA, 7 bp, Unknown
  misc_feature (1)..( 7): Result.001 file - promoters60/1012078
ttcttct

SEQ ID NO: 91654 - DNA, 13 bp, Unknown
  misc_feature (1)..( 13): Result.001 file - promoters60/1012078
gttatgatttctt

SEQ ID NO: 91655 - DNA, 13 bp, Unknown
  misc_feature (1)..( 13): Result.001 file - promoters60/1012078
gttataatttttt

SEQ ID NO: 91656 - DNA, 13 bp, Unknown
  misc_feature (1)..( 13): Result.001 file - promoters60/1012078
gttacaatttttt

SEQ ID NO: 91657 - DNA, 7 bp, Unknown
  misc_feature (1)..( 7): Result.001 file - promoters60/1012078
tgattat

SEQ ID NO: 91658 - DNA, 7 bp, Unknown
  misc_feature (1)..( 7): Result.001 file - promoters60/1012078
tgaatat

SEQ ID NO: 91659 - DNA, 8 bp, Unknown
  misc_feature (1)..( 8): Result.001 file - promoters60/1012078
atgagata

SEQ ID NO: 91660 - DNA, 8 bp, Unknown
  misc_feature (1)..( 8): Result.001 file - promoters60/1012078
ttgatata

SEQ ID NO: 91661 - DNA, 8 bp, Unknown
  misc_feature (1)..( 8): Result.001 file - promoters60/1012078
ttgttatg

SEQ ID NO: 91662 - DNA, 8 bp, Unknown
  misc_feature (1)..( 8): Result.001 file - promoters60/1012078
gatcttgt

SEQ ID NO: 91663 - DNA, 8 bp, Unknown
  misc_feature (1)..( 8): Result.001 file - promoters60/1012078
gatattgt

SEQ ID NO: 91664 - DNA, 6 bp, Unknown
  misc_feature (1)..( 6): Result.001 file - promoters60/1012078
aattca

SEQ ID NO: 91665 - DNA, 6 bp, Unknown
  misc_feature (1)..( 6): Result.001 file - promoters60/1012078
aattca

SEQ ID NO: 91666 - DNA, 8 bp, Unknown
  misc_feature (1)..( 8): Result.001 file - promoters60/1012078
aaaaaaat

SEQ ID NO: 91667 - DNA, 8 bp, Unknown
  misc_feature (1)..( 8): Result.001 file - promoters60/1012078
aaaaaaat

SEQ ID NO: 91668 - DNA, 8 bp, Unknown
  misc_feature (1)..( 8): Result.001 file - promoters60/1012078
ttttcctt

SEQ ID NO: 91669 - DNA, 8 bp, Unknown
  misc_feature (1)..( 8): Result.001 file - promoters60/1012078
ttttgctt

SEQ ID NO: 91670 - DNA, 6 bp, Unknown
  misc_feature (1)..( 6): Result.001 file - promoters60/1012078
agtgtt

SEQ ID NO: 91671 - DNA, 6 bp, Unknown
  misc_feature (1)..( 6): Result.001 file - promoters60/1012078
agtgtt

SEQ ID NO: 91672 - DNA, 8 bp, Unknown
  misc_feature (1)..( 8): Result.001 file - promoters60/1012078
tttgtttt

SEQ ID NO: 91673 - DNA, 8 bp, Unknown
  misc_feature (1)..( 8): Result.001 file - promoters60/1012078
tttgtttt

SEQ ID NO: 91674 - DNA, 7 bp, Unknown
  misc_feature (1)..( 7): Result.001 file - promoters60/1012078
aaactat

SEQ ID NO: 91675 - DNA, 7 bp, Unknown
  misc_feature (1)..( 7): Result.001 file - promoters60/1012078
aaaatat

SEQ ID NO: 91676 - DNA, 10 bp, Unknown
  misc_feature (1)..( 10): Result.001 file - promoters60/1012078
aaattagaaa

SEQ ID NO: 91677 - DNA, 10 bp, Unknown
  misc_feature (1)..( 10): Result.001 file - promoters60/1012110
aaattaaaaa

SEQ ID NO: 91678 - DNA, 8 bp, Unknown
  misc_feature (1)..( 8): Result.001 file - promoters60/1012110
aaataaaa

SEQ ID NO: 91679 - DNA, 8 bp, Unknown
  misc_feature (1)..( 8): Result.001 file - promoters60/1012110
aaatgaaa

SEQ ID NO: 91680 - DNA, 8 bp, Unknown
  misc_feature (1)..( 8): Result.001 file - promoters60/1012110
aaatgaac

SEQ ID NO: 91681 - DNA, 11 bp, Unknown
  misc_feature (1)..( 11): Result.001 file - promoters60/1012110
ccagaattaag

SEQ ID NO: 91682 - DNA, 11 bp, Unknown
  misc_feature (1)..( 11): Result.001 file - promoters60/1012110
ccataattagt

SEQ ID NO: 91683 - DNA, 11 bp, Unknown
  misc_feature (1)..( 11): Result.001 file - promoters60/1012110
atgtaattaag

SEQ ID NO: 91684 - DNA, 9 bp, Unknown
  misc_feature (1)..( 9): Result.001 file - promoters60/1012110
ctcaataaa

SEQ ID NO: 91685 - DNA, 9 bp, Unknown
  misc_feature (1)..( 9): Result.001 file - promoters60/1012110
ctcaaaaaa

SEQ ID NO: 91686 - DNA, 9 bp, Unknown
  misc_feature (1)..( 9): Result.001 file - promoters60/1012110
ttcaagaaa

SEQ ID NO: 91687 - DNA, 9 bp, Unknown
  misc_feature (1)..( 9): Result.001 file - promoters60/1012110
gtaaaaata

SEQ ID NO: 91688 - DNA, 9 bp, Unknown
  misc_feature (1)..( 9): Result.001 file - promoters60/1012110
gtaaaatta

SEQ ID NO: 91689 - DNA, 10 bp, Unknown
  misc_feature (1)..( 10): Result.001 file - promoters60/1012128
ttaagaatag

SEQ ID NO: 91690 - DNA, 15 bp, Unknown
  misc_feature (1)..( 15): Result.001 file - promoters60/1012128
taaggcccatattta

SEQ ID NO: 91691 - DNA, 15 bp, Unknown
  misc_feature (1)..( 15): Result.001 file - promoters60/1012128
taaggcccaatgttt

SEQ ID NO: 91692 - DNA, 15 bp, Unknown
  misc_feature (1)..( 15): Result.001 file - promoters60/1012128
ttcggcccaaattta

SEQ ID NO: 91693 - DNA, 15 bp, Unknown
  misc_feature (1)..( 15): Result.001 file - promoters60/1012128
ttgggcccattggtt

SEQ ID NO: 91694 - DNA, 15 bp, Unknown
  misc_feature (1)..( 15): Result.001 file - promoters60/1012128
aaaggcccaataaat

SEQ ID NO: 91695 - DNA, 15 bp, Unknown
  misc_feature (1)..( 15): Result.001 file - promoters60/1012128
ataggcccaacaaaa

SEQ ID NO: 91696 - DNA, 9 bp, Unknown
  misc_feature (1)..( 9): Result.001 file - promoters60/1012128
catataaag

SEQ ID NO: 91697 - DNA, 9 bp, Unknown
  misc_feature (1)..( 9): Result.001 file - promoters60/1012128
catatatac

SEQ ID NO: 91698 - DNA, 9 bp, Unknown
  misc_feature (1)..( 9): Result.001 file - promoters60/1012128
aataaaaag

SEQ ID NO: 91699 - DNA, 9 bp, Unknown
  misc_feature (1)..( 9): Result.001 file - promoters60/1012128
catatataa

SEQ ID NO: 91700 - DNA, 9 bp, Unknown
  misc_feature (1)..( 9): Result.001 file - promoters60/1012128
tatatataa

SEQ ID NO: 91701 - DNA, 9 bp, Unknown
  misc_feature (1)..( 9): Result.001 file - promoters60/1012128
tatagataa

SEQ ID NO: 91702 - DNA, 9 bp, Unknown
  misc_feature (1)..( 9): Result.001 file - promoters60/1012128
cacaaaaat

SEQ ID NO: 91703 - DNA, 9 bp, Unknown
  misc_feature (1)..( 9): Result.001 file - promoters60/1012128
ctcaaaaaa

SEQ ID NO: 91704 - DNA, 9 bp, Unknown
  misc_feature (1)..( 9): Result.001 file - promoters60/1012128
gagaaaaaa

SEQ ID NO: 91705 - DNA, 10 bp, Unknown
  misc_feature (1)..( 10): Result.001 file - promoters60/1012128
ctaaaagaaa

SEQ ID NO: 91706 - DNA, 10 bp, Unknown
  misc_feature (1)..( 10): Result.001 file - promoters60/1012128
ttcaaaattt

SEQ ID NO: 91707 - DNA, 10 bp, Unknown
  misc_feature (1)..( 10): Result.001 file - promoters60/1012128
ctcaaaagtt

SEQ ID NO: 91708 - DNA, 12 bp, Unknown
  misc_feature (1)..( 12): Result.001 file - promoters60/1012128
tctctcaaagat

SEQ ID NO: 91709 - DNA, 12 bp, Unknown
  misc_feature (1)..( 12): Result.001 file - promoters60/1012128
gccctcaaaaaa

SEQ ID NO: 91710 - DNA, 12 bp, Unknown
  misc_feature (1)..( 12): Result.001 file - promoters60/1012128
tctttcaaaatt

SEQ ID NO: 91711 - DNA, 12 bp, Unknown
  misc_feature (1)..( 12): Result.001 file - promoters60/1012128
aatttcacagaa

SEQ ID NO: 91712 - DNA, 12 bp, Unknown
  misc_feature (1)..( 12): Result.001 file - promoters60/1012128
gccggcaccgaa

SEQ ID NO: 91713 - DNA, 12 bp, Unknown
  misc_feature (1)..( 12): Result.001 file - promoters60/1012128
agactcaaaagt

SEQ ID NO: 91714 - DNA, 10 bp, Unknown
  misc_feature (1)..( 10): Result.001 file - promoters60/1012128
actaatctga

SEQ ID NO: 91715 - DNA, 10 bp, Unknown
  misc_feature (1)..( 10): Result.001 file - promoters60/1012128
acttatctga

SEQ ID NO: 91716 - DNA, 10 bp, Unknown
  misc_feature (1)..( 10): Result.001 file - promoters60/1012128
tgtaatctga

SEQ ID NO: 91717 - DNA, 10 bp, Unknown
  misc_feature (1)..( 10): Result.001 file - promoters60/1012128
aaggatctga

SEQ ID NO: 91718 - DNA, 10 bp, Unknown
  misc_feature (1)..( 10): Result.001 file - promoters60/1012128
gcttctcttc

SEQ ID NO: 91719 - DNA, 10 bp, Unknown
  misc_feature (1)..( 10): Result.001 file - promoters60/1012140
ttagatctgt

SEQ ID NO: 91720 - DNA, 13 bp, Unknown
  misc_feature (1)..( 13): Result.001 file - promoters60/1012140
ttgagtcatatca

SEQ ID NO: 91721 - DNA, 13 bp, Unknown
  misc_feature (1)..( 13): Result.001 file - promoters60/1012140
ttgattcaaatca

SEQ ID NO: 91722 - DNA, 6 bp, Unknown
  misc_feature (1)..( 6): Result.001 file - promoters60/1012140
aaggtt

SEQ ID NO: 91723 - DNA, 6 bp, Unknown
  misc_feature (1)..( 6): Result.001 file - promoters60/1012140
aaggtt

SEQ ID NO: 91724 - DNA, 7 bp, Unknown
  misc_feature (1)..( 7): Result.001 file - promoters60/1012140
ttgaatt

SEQ ID NO: 91725 - DNA, 7 bp, Unknown
  misc_feature (1)..( 7): Result.001 file - promoters60/1012140
ttggatt

SEQ ID NO: 91726 - DNA, 9 bp, Unknown
  misc_feature (1)..( 9): Result.001 file - promoters60/1012140
tcttgttct

SEQ ID NO: 91727 - DNA, 9 bp, Unknown
  misc_feature (1)..( 9): Result.001 file - promoters60/1012140
tcttgttct

SEQ ID NO: 91728 - DNA, 6 bp, Unknown
  misc_feature (1)..( 6): Result.001 file - promoters60/1012140
ttcttt

SEQ ID NO: 91729 - DNA, 6 bp, Unknown
  misc_feature (1)..( 6): Result.001 file - promoters60/1012140
ttcttt

SEQ ID NO: 91730 - DNA, 6 bp, Unknown
  misc_feature (1)..( 6): Result.001 file - promoters60/1012140
tttttg

SEQ ID NO: 91731 - DNA, 6 bp, Unknown
  misc_feature (1)..( 6): Result.001 file - promoters60/1012140
tttttg

SEQ ID NO: 91732 - DNA, 8 bp, Unknown
  misc_feature (1)..( 8): Result.001 file - promoters60/1012140
gcaaaatt

SEQ ID NO: 91733 - DNA, 8 bp, Unknown
  misc_feature (1)..( 8): Result.001 file - promoters60/1012140
gcaacatt

SEQ ID NO: 91734 - DNA, 7 bp, Unknown
  misc_feature (1)..( 7): Result.001 file - promoters60/1012140
acaaaaa

SEQ ID NO: 91735 - DNA, 7 bp, Unknown
  misc_feature (1)..( 7): Result.001 file - promoters60/1012140
acaaaaa

SEQ ID NO: 91736 - DNA, 6 bp, Unknown
  misc_feature (1)..( 6): Result.001 file - promoters60/1012140
tcaaac

SEQ ID NO: 91737 - DNA, 6 bp, Unknown
  misc_feature (1)..( 6): Result.001 file - promoters60/1012213
tcaaac

SEQ ID NO: 91738 - DNA, 6 bp, Unknown
  misc_feature (1)..( 6): Result.001 file - promoters60/1012213
ctttct

SEQ ID NO: 91739 - DNA, 6 bp, Unknown
  misc_feature (1)..( 6): Result.001 file - promoters60/1012213
ctttct

SEQ ID NO: 91740 - DNA, 8 bp, Unknown
  misc_feature (1)..( 8): Result.001 file - promoters60/1012213
aaattaca

SEQ ID NO: 91741 - DNA, 8 bp, Unknown
  misc_feature (1)..( 8): Result.001 file - promoters60/1012213
aaaataca

SEQ ID NO: 91742 - DNA, 6 bp, Unknown
  misc_feature (1)..( 6): Result.001 file - promoters60/1012213
tgtgtt

SEQ ID NO: 91743 - DNA, 6 bp, Unknown
  misc_feature (1)..( 6): Result.001 file - promoters60/1012213
tgtgtt

SEQ ID NO: 91744 - DNA, 7 bp, Unknown
  misc_feature (1)..( 7): Result.001 file - promoters60/1012213
tttcatg

SEQ ID NO: 91745 - DNA, 7 bp, Unknown
  misc_feature (1)..( 7): Result.001 file - promoters60/1012213
tttcatg

SEQ ID NO: 91746 - DNA, 7 bp, Unknown
  misc_feature (1)..( 7): Result.001 file - promoters60/1012213
tgtgtat

SEQ ID NO: 91747 - DNA, 7 bp, Unknown
  misc_feature (1)..( 7): Result.001 file - promoters60/1012213
tgtctat

SEQ ID NO: 91748 - DNA, 6 bp, Unknown
  misc_feature (1)..( 6): Result.001 file - promoters60/1012213
gatgta

SEQ ID NO: 91749 - DNA, 6 bp, Unknown
  misc_feature (1)..( 6): Result.001 file - promoters60/1012213
gatgta

SEQ ID NO: 91750 - DNA, 6 bp, Unknown
  misc_feature (1)..( 6): Result.001 file - promoters60/1012213
tttttt

SEQ ID NO: 91751 - DNA, 6 bp, Unknown
  misc_feature (1)..( 6): Result.001 file - promoters60/1012213
tttttt

SEQ ID NO: 91752 - DNA, 7 bp, Unknown
  misc_feature (1)..( 7): Result.001 file - promoters60/1012213
tatcatg

SEQ ID NO: 91753 - DNA, 7 bp, Unknown
  misc_feature (1)..( 7): Result.001 file - promoters60/1012213
tattatg

SEQ ID NO: 91754 - DNA, 7 bp, Unknown
  misc_feature (1)..( 7): Result.001 file - promoters60/1012213
tttttat

SEQ ID NO: 91755 - DNA, 7 bp, Unknown
  misc_feature (1)..( 7): Result.001 file - promoters60/1012213
tttgtat

SEQ ID NO: 91756 - DNA, 6 bp, Unknown
  misc_feature (1)..( 6): Result.001 file - promoters60/1012213
aacaac

SEQ ID NO: 91757 - DNA, 6 bp, Unknown
  misc_feature (1)..( 6): Result.001 file - promoters60/1012213
aacaac

SEQ ID NO: 91758 - DNA, 8 bp, Unknown
  misc_feature (1)..( 8): Result.001 file - promoters60/1012213
aaaaatct

SEQ ID NO: 91759 - DNA, 8 bp, Unknown
  misc_feature (1)..( 8): Result.001 file - promoters60/1012213
aaaattct

SEQ ID NO: 91760 - DNA, 7 bp, Unknown
  misc_feature (1)..( 7): Result.001 file - promoters60/1012213
tatattt

SEQ ID NO: 91761 - DNA, 7 bp, Unknown
  misc_feature (1)..( 7): Result.001 file - promoters60/1012213
tattttt

SEQ ID NO: 91762 - DNA, 7 bp, Unknown
  misc_feature (1)..( 7): Result.001 file - promoters60/1012213
tatgatt

SEQ ID NO: 91763 - DNA, 7 bp, Unknown
  misc_feature (1)..( 7): Result.001 file - promoters60/1012213
tattatt

SEQ ID NO: 91764 - DNA, 7 bp, Unknown
  misc_feature (1)..( 7): Result.001 file - promoters60/1012213
tttctgt

SEQ ID NO: 91765 - DNA, 7 bp, Unknown
  misc_feature (1)..( 7): Result.001 file - promoters60/1012213
tttttgt

SEQ ID NO: 91766 - DNA, 6 bp, Unknown
  misc_feature (1)..( 6): Result.001 file - promoters60/1012213
gctaat

SEQ ID NO: 91767 - DNA, 6 bp, Unknown
  misc_feature (1)..( 6): Result.001 file - promoters60/1012245
gctaat

SEQ ID NO: 91768 - DNA, 7 bp, Unknown
  misc_feature (1)..( 7): Result.001 file - promoters60/1012245
agctatt

SEQ ID NO: 91769 - DNA, 7 bp, Unknown
  misc_feature (1)..( 7): Result.001 file - promoters60/1012245
agcgatt

SEQ ID NO: 91770 - DNA, 7 bp, Unknown
  misc_feature (1)..( 7): Result.001 file - promoters60/1012245
ttttggt

SEQ ID NO: 91771 - DNA, 7 bp, Unknown
  misc_feature (1)..( 7): Result.001 file - promoters60/1012245
gtttggt

SEQ ID NO: 91772 - DNA, 7 bp, Unknown
  misc_feature (1)..( 7): Result.001 file - promoters60/1012245
ttttggt

SEQ ID NO: 91773 - DNA, 7 bp, Unknown
  misc_feature (1)..( 7): Result.001 file - promoters60/1012245
gtttctt

SEQ ID NO: 91774 - DNA, 7 bp, Unknown
  misc_feature (1)..( 7): Result.001 file - promoters60/1012245
gttcctt

SEQ ID NO: 91775 - DNA, 6 bp, Unknown
  misc_feature (1)..( 6): Result.001 file - promoters60/1012245
atttaa

SEQ ID NO: 91776 - DNA, 6 bp, Unknown
  misc_feature (1)..( 6): Result.001 file - promoters60/1012245
atttaa

SEQ ID NO: 91777 - DNA, 6 bp, Unknown
  misc_feature (1)..( 6): Result.001 file - promoters60/1012245
catttt

SEQ ID NO: 91778 - DNA, 6 bp, Unknown
  misc_feature (1)..( 6): Result.001 file - promoters60/1012245
catttt

SEQ ID NO: 91779 - DNA, 7 bp, Unknown
  misc_feature (1)..( 7): Result.001 file - promoters60/1012245
tgagtct

SEQ ID NO: 91780 - DNA, 7 bp, Unknown
  misc_feature (1)..( 7): Result.001 file - promoters60/1012245
tgaatct

SEQ ID NO: 91781 - DNA, 8 bp, Unknown
  misc_feature (1)..( 8): Result.001 file - promoters60/1012245
aagattaa

SEQ ID NO: 91782 - DNA, 8 bp, Unknown
  misc_feature (1)..( 8): Result.001 file - promoters60/1012245
aagagtaa

SEQ ID NO: 91783 - DNA, 8 bp, Unknown
  misc_feature (1)..( 8): Result.001 file - promoters60/1012245
tttactta

SEQ ID NO: 91784 - DNA, 8 bp, Unknown
  misc_feature (1)..( 8): Result.001 file - promoters60/1012245
ttttctta

SEQ ID NO: 91785 - DNA, 7 bp, Unknown
  misc_feature (1)..( 7): Result.001 file - promoters60/1012245
ttttcat

SEQ ID NO: 91786 - DNA, 7 bp, Unknown
  misc_feature (1)..( 7): Result.001 file - promoters60/1012245
ttttcat

SEQ ID NO: 91787 - DNA, 8 bp, Unknown
  misc_feature (1)..( 8): Result.001 file - promoters60/1012245
tctcaaat

SEQ ID NO: 91788 - DNA, 8 bp, Unknown
  misc_feature (1)..( 8): Result.001 file - promoters60/1012245
tctgaaat

SEQ ID NO: 91789 - DNA, 9 bp, Unknown
  misc_feature (1)..( 9): Result.001 file - promoters60/1012245
tctcaggtg

SEQ ID NO: 91790 - DNA, 9 bp, Unknown
  misc_feature (1)..( 9): Result.001 file - promoters60/1012349
tctcaagtg

SEQ ID NO: 91791 - DNA, 10 bp, Unknown
  misc_feature (1)..( 10): Result.001 file - promoters60/1012349
ctttgcttac

SEQ ID NO: 91792 - DNA, 10 bp, Unknown
  misc_feature (1)..( 10): Result.001 file - promoters60/1012349
tttttctttt

SEQ ID NO: 91793 - DNA, 10 bp, Unknown
  misc_feature (1)..( 10): Result.001 file - promoters60/1012349
agttgtttat

SEQ ID NO: 91794 - DNA, 10 bp, Unknown
  misc_feature (1)..( 10): Result.001 file - promoters60/1012349
tttttatttt

SEQ ID NO: 91795 - DNA, 10 bp, Unknown
  misc_feature (1)..( 10): Result.001 file - promoters60/1012349
tcatgtttaa

SEQ ID NO: 91796 - DNA, 10 bp, Unknown
  misc_feature (1)..( 10): Result.001 file - promoters60/1012349
gagttcataa

SEQ ID NO: 91797 - DNA, 10 bp, Unknown
  misc_feature (1)..( 10): Result.001 file - promoters60/1012349
ttctgtttgg

SEQ ID NO: 91798 - DNA, 12 bp, Unknown
  misc_feature (1)..( 12): Result.001 file - promoters60/1012349
ttaaaaatccaa

SEQ ID NO: 91799 - DNA, 12 bp, Unknown
  misc_feature (1)..( 12): Result.001 file - promoters60/1012349
ataaatatcctc

SEQ ID NO: 91800 - DNA, 12 bp, Unknown
  misc_feature (1)..( 12): Result.001 file - promoters60/1012349
aacaaaatccaa

SEQ ID NO: 91801 - DNA, 12 bp, Unknown
  misc_feature (1)..( 12): Result.001 file - promoters60/1012349
ttaaaaacaatt

SEQ ID NO: 91802 - DNA, 12 bp, Unknown
  misc_feature (1)..( 12): Result.001 file - promoters60/1012349
ttaaaaacattt

SEQ ID NO: 91803 - DNA, 12 bp, Unknown
  misc_feature (1)..( 12): Result.001 file - promoters60/1012349
aaaaaaagaata

SEQ ID NO: 91804 - DNA, 14 bp, Unknown
  misc_feature (1)..( 14): Result.001 file - promoters60/1012349
caacaatgtacaaa

SEQ ID NO: 91805 - DNA, 14 bp, Unknown
  misc_feature (1)..( 14): Result.001 file - promoters60/1012349
caataatttacatt

SEQ ID NO: 91806 - DNA, 14 bp, Unknown
  misc_feature (1)..( 14): Result.001 file - promoters60/1012349
acacaatatacaga

SEQ ID NO: 91807 - DNA, 14 bp, Unknown
  misc_feature (1)..( 14): Result.001 file - promoters60/1012349
gaataataaaatgt

SEQ ID NO: 91808 - DNA, 14 bp, Unknown
  misc_feature (1)..( 14): Result.001 file - promoters60/1012349
tgaaaatttatacg

SEQ ID NO: 91809 - DNA, 14 bp, Unknown
  misc_feature (1)..( 14): Result.001 file - promoters60/1012349
atgcaaaatacaga

SEQ ID NO: 91810 - DNA, 11 bp, Unknown
  misc_feature (1)..( 11): Result.001 file - promoters60/1012349
gaatttttgta

SEQ ID NO: 91811 - DNA, 11 bp, Unknown
  misc_feature (1)..( 11): Result.001 file - promoters60/1012349
gaaattttcat

SEQ ID NO: 91812 - DNA, 11 bp, Unknown
  misc_feature (1)..( 11): Result.001 file - promoters60/1012349
gcatttttatt

SEQ ID NO: 91813 - DNA, 11 bp, Unknown
  misc_feature (1)..( 11): Result.001 file - promoters60/1012349
tattttatatt

SEQ ID NO: 91814 - DNA, 11 bp, Unknown
  misc_feature (1)..( 11): Result.001 file - promoters60/1012349
tcatatgagtg

SEQ ID NO: 91815 - DNA, 11 bp, Unknown
  misc_feature (1)..( 11): Result.001 file - promoters60/1012388
taatattagta

SEQ ID NO: 91816 - DNA, 14 bp, Unknown
  misc_feature (1)..( 14): Result.001 file - promoters60/1012388
aaattttgattttt

SEQ ID NO: 91817 - DNA, 14 bp, Unknown
  misc_feature (1)..( 14): Result.001 file - promoters60/1012388
attagttgatttaa

SEQ ID NO: 91818 - DNA, 13 bp, Unknown
  misc_feature (1)..( 13): Result.001 file - promoters60/1012388
ccatttaattttt

SEQ ID NO: 91819 - DNA, 14 bp, Unknown
  misc_feature (1)..( 14): Result.001 file - promoters60/1012388
aaattatgattaag

SEQ ID NO: 91820 - DNA, 8 bp, Unknown
  misc_feature (1)..( 8): Result.001 file - promoters60/1012388
tttttaat

SEQ ID NO: 91821 - DNA, 8 bp, Unknown
  misc_feature (1)..( 8): Result.001 file - promoters60/1012388
gatttaat

SEQ ID NO: 91822 - DNA, 8 bp, Unknown
  misc_feature (1)..( 8): Result.001 file - promoters60/1012388
catttaat

SEQ ID NO: 91823 - DNA, 8 bp, Unknown
  misc_feature (1)..( 8): Result.001 file - promoters60/1012388
tttttaaa

SEQ ID NO: 91824 - DNA, 10 bp, Unknown
  misc_feature (1)..( 10): Result.001 file - promoters60/1012388
taatattata

SEQ ID NO: 91825 - DNA, 10 bp, Unknown
  misc_feature (1)..( 10): Result.001 file - promoters60/1012388
taataatata

SEQ ID NO: 91826 - DNA, 11 bp, Unknown
  misc_feature (1)..( 11): Result.001 file - promoters60/1012388
gtataaattta

SEQ ID NO: 91827 - DNA, 11 bp, Unknown
  misc_feature (1)..( 11): Result.001 file - promoters60/1012388
atataaatatg

SEQ ID NO: 91828 - DNA, 11 bp, Unknown
  misc_feature (1)..( 11): Result.001 file - promoters60/1012388
aaattttgatt

SEQ ID NO: 91829 - DNA, 11 bp, Unknown
  misc_feature (1)..( 11): Result.001 file - promoters60/1012388
taattttttgg

SEQ ID NO: 91830 - DNA, 11 bp, Unknown
  misc_feature (1)..( 11): Result.001 file - promoters60/1012388
aaattatgatt

SEQ ID NO: 91831 - DNA, 11 bp, Unknown
  misc_feature (1)..( 11): Result.001 file - promoters60/1012388
taattatgata

SEQ ID NO: 91832 - DNA, 11 bp, Unknown
  misc_feature (1)..( 11): Result.001 file - promoters60/1012388
tttaaaataaa

SEQ ID NO: 91833 - DNA, 11 bp, Unknown
  misc_feature (1)..( 11): Result.001 file - promoters60/1012388
gataacataga

SEQ ID NO: 91834 - DNA, 11 bp, Unknown
  misc_feature (1)..( 11): Result.001 file - promoters60/1012388
tttaaaacatg

SEQ ID NO: 91835 - DNA, 11 bp, Unknown
  misc_feature (1)..( 11): Result.001 file - promoters60/1012397
ttggacataga

SEQ ID NO: 91836 - DNA, 12 bp, Unknown
  misc_feature (1)..( 12): Result.001 file - promoters60/1012397
cctatattcata

SEQ ID NO: 91837 - DNA, 12 bp, Unknown
  misc_feature (1)..( 12): Result.001 file - promoters60/1012397
ttcgtatacatg

SEQ ID NO: 91838 - DNA, 12 bp, Unknown
  misc_feature (1)..( 12): Result.001 file - promoters60/1012397
ctggaatatatg

SEQ ID NO: 91839 - DNA, 12 bp, Unknown
  misc_feature (1)..( 12): Result.001 file - promoters60/1012397
ggattataatac

SEQ ID NO: 91840 - DNA, 14 bp, Unknown
  misc_feature (1)..( 14): Result.001 file - promoters60/1012397
aatttatcttcttt

SEQ ID NO: 91841 - DNA, 14 bp, Unknown
  misc_feature (1)..( 14): Result.001 file - promoters60/1012397
aatttattttccaa

SEQ ID NO: 91842 - DNA, 14 bp, Unknown
  misc_feature (1)..( 14): Result.001 file - promoters60/1012397
catttctctgggtt

SEQ ID NO: 91843 - DNA, 14 bp, Unknown
  misc_feature (1)..( 14): Result.001 file - promoters60/1012397
attttctctccttt

SEQ ID NO: 91844 - DNA, 14 bp, Unknown
  misc_feature (1)..( 14): Result.001 file - promoters60/1012397
aatttcttgagacg

SEQ ID NO: 91845 - DNA, 14 bp, Unknown
  misc_feature (1)..( 14): Result.001 file - promoters60/1012397
gaattattttgcta

SEQ ID NO: 91846 - DNA, 10 bp, Unknown
  misc_feature (1)..( 10): Result.001 file - promoters60/1012397
ttaatttatt

SEQ ID NO: 91847 - DNA, 10 bp, Unknown
  misc_feature (1)..( 10): Result.001 file - promoters60/1012397
ataatttaat

SEQ ID NO: 91848 - DNA, 10 bp, Unknown
  misc_feature (1)..( 10): Result.001 file - promoters60/1012397
gtaatttgtc

SEQ ID NO: 91849 - DNA, 10 bp, Unknown
  misc_feature (1)..( 10): Result.001 file - promoters60/1012397
ttaattcatt

SEQ ID NO: 91850 - DNA, 10 bp, Unknown
  misc_feature (1)..( 10): Result.001 file - promoters60/1012397
tgaatccatc

SEQ ID NO: 91851 - DNA, 10 bp, Unknown
  misc_feature (1)..( 10): Result.001 file - promoters60/1012397
aaaacttgat

SEQ ID NO: 91852 - DNA, 10 bp, Unknown
  misc_feature (1)..( 10): Result.001 file - promoters60/1012397
aaaaattggt

SEQ ID NO: 91853 - DNA, 10 bp, Unknown
  misc_feature (1)..( 10): Result.001 file - promoters60/1012397
cttactcgat

SEQ ID NO: 91854 - DNA, 10 bp, Unknown
  misc_feature (1)..( 10): Result.001 file - promoters60/1012397
ccaaattgat

SEQ ID NO: 91855 - DNA, 13 bp, Unknown
  misc_feature (1)..( 13): Result.001 file - promoters60/1012397
ttatttaattatg

SEQ ID NO: 91856 - DNA, 13 bp, Unknown
  misc_feature (1)..( 13): Result.001 file - promoters60/1012397
caattgaatccat

SEQ ID NO: 91857 - DNA, 13 bp, Unknown
  misc_feature (1)..( 13): Result.001 file - promoters60/1012397
ttacttagctata

SEQ ID NO: 91858 - DNA, 13 bp, Unknown
  misc_feature (1)..( 13): Result.001 file - promoters60/1012397
tcgcttaattcat

SEQ ID NO: 91859 - DNA, 13 bp, Unknown
  misc_feature (1)..( 13): Result.001 file - promoters60/1012397
taatttaatgcat

SEQ ID NO: 91860 - DNA, 10 bp, Unknown
  misc_feature (1)..( 10): Result.001 file - promoters60/1012397
cattcttcaa

SEQ ID NO: 91861 - DNA, 10 bp, Unknown
  misc_feature (1)..( 10): Result.001 file - promoters60/1012397
cattcttctt

SEQ ID NO: 91862 - DNA, 10 bp, Unknown
  misc_feature (1)..( 10): Result.001 file - promoters60/1012397
ttctctactt

SEQ ID NO: 91863 - DNA, 10 bp, Unknown
  misc_feature (1)..( 10): Result.001 file - promoters60/1012403
ttctctcctt

SEQ ID NO: 91864 - DNA, 8 bp, Unknown
  misc_feature (1)..( 8): Result.001 file - promoters60/1012403
ttttatta

SEQ ID NO: 91865 - DNA, 8 bp, Unknown
  misc_feature (1)..( 8): Result.001 file - promoters60/1012403
ttttttta

SEQ ID NO: 91866 - DNA, 8 bp, Unknown
  misc_feature (1)..( 8): Result.001 file - promoters60/1012403
gtttttta

SEQ ID NO: 91867 - DNA, 7 bp, Unknown
  misc_feature (1)..( 7): Result.001 file - promoters60/1012403
aaaatat

SEQ ID NO: 91868 - DNA, 7 bp, Unknown
  misc_feature (1)..( 7): Result.001 file - promoters60/1012403
aaaataa

SEQ ID NO: 91869 - DNA, 7 bp, Unknown
  misc_feature (1)..( 7): Result.001 file - promoters60/1012403
aaagtaa

SEQ ID NO: 91870 - DNA, 8 bp, Unknown
  misc_feature (1)..( 8): Result.001 file - promoters60/1012403
ttttatta

SEQ ID NO: 91871 - DNA, 8 bp, Unknown
  misc_feature (1)..( 8): Result.001 file - promoters60/1012403
ttttgtta

SEQ ID NO: 91872 - DNA, 8 bp, Unknown
  misc_feature (1)..( 8): Result.001 file - promoters60/1012403
tttggttc

SEQ ID NO: 91873 - DNA, 8 bp, Unknown
  misc_feature (1)..( 8): Result.001 file - promoters60/1012403
gaatcttt

SEQ ID NO: 91874 - DNA, 8 bp, Unknown
  misc_feature (1)..( 8): Result.001 file - promoters60/1012403
caattttt

SEQ ID NO: 91875 - DNA, 8 bp, Unknown
  misc_feature (1)..( 8): Result.001 file - promoters60/1012403
caatttga

SEQ ID NO: 91876 - DNA, 12 bp, Unknown
  misc_feature (1)..( 12): Result.001 file - promoters60/1012403
gattatttcatg

SEQ ID NO: 91877 - DNA, 12 bp, Unknown
  misc_feature (1)..( 12): Result.001 file - promoters60/1012403
ttttgtttaatg

SEQ ID NO: 91878 - DNA, 12 bp, Unknown
  misc_feature (1)..( 12): Result.001 file - promoters60/1012403
ttttttttaaaa

SEQ ID NO: 91879 - DNA, 7 bp, Unknown
  misc_feature (1)..( 7): Result.001 file - promoters60/1012403
gttgaat

SEQ ID NO: 91880 - DNA, 7 bp, Unknown
  misc_feature (1)..( 7): Result.001 file - promoters60/1012403
gttcaat

SEQ ID NO: 91881 - DNA, 7 bp, Unknown
  misc_feature (1)..( 7): Result.001 file - promoters60/1012407
tttgaat

SEQ ID NO: 91882 - DNA, 11 bp, Unknown
  misc_feature (1)..( 11): Result.001 file - promoters60/1012407
caattttgtag

SEQ ID NO: 91883 - DNA, 11 bp, Unknown
  misc_feature (1)..( 11): Result.001 file - promoters60/1012407
gtgttttttag

SEQ ID NO: 91884 - DNA, 11 bp, Unknown
  misc_feature (1)..( 11): Result.001 file - promoters60/1012407
caattttgcta

SEQ ID NO: 91885 - DNA, 11 bp, Unknown
  misc_feature (1)..( 11): Result.001 file - promoters60/1012407
aggacttgtag

SEQ ID NO: 91886 - DNA, 11 bp, Unknown
  misc_feature (1)..( 11): Result.001 file - promoters60/1012407
aagtttttcga

SEQ ID NO: 91887 - DNA, 11 bp, Unknown
  misc_feature (1)..( 11): Result.001 file - promoters60/1012407
aatatttttac

SEQ ID NO: 91888 - DNA, 17 bp, Unknown
  misc_feature (1)..( 17): Result.001 file - promoters60/1012407
ccaaccttcttttaaac

SEQ ID NO: 91889 - DNA, 17 bp, Unknown
  misc_feature (1)..( 17): Result.001 file - promoters60/1012407
tttagattctttgaaca

SEQ ID NO: 91890 - DNA, 17 bp, Unknown
  misc_feature (1)..( 17): Result.001 file - promoters60/1012407
tttacattgtttaattt

SEQ ID NO: 91891 - DNA, 17 bp, Unknown
  misc_feature (1)..( 17): Result.001 file - promoters60/1012407
ccacttgtgtttgatta

SEQ ID NO: 91892 - DNA, 17 bp, Unknown
  misc_feature (1)..( 17): Result.001 file - promoters60/1012442
ttgtatttatttatatt

SEQ ID NO: 91893 - DNA, 7 bp, Unknown
  misc_feature (1)..( 7): Result.001 file - promoters60/1012442
caataag

SEQ ID NO: 91894 - DNA, 7 bp, Unknown
  misc_feature (1)..( 7): Result.001 file - promoters60/1012442
aaataag

SEQ ID NO: 91895 - DNA, 8 bp, Unknown
  misc_feature (1)..( 8): Result.001 file - promoters60/1012442
aaactaag

SEQ ID NO: 91896 - DNA, 7 bp, Unknown
  misc_feature (1)..( 7): Result.001 file - promoters60/1012442
tcagttt

SEQ ID NO: 91897 - DNA, 7 bp, Unknown
  misc_feature (1)..( 7): Result.001 file - promoters60/1012442
tcatttt

SEQ ID NO: 91898 - DNA, 13 bp, Unknown
  misc_feature (1)..( 13): Result.001 file - promoters60/1012442
taaaatttacata

SEQ ID NO: 91899 - DNA, 13 bp, Unknown
  misc_feature (1)..( 13): Result.001 file - promoters60/1012442
taagattaattaa

SEQ ID NO: 91900 - DNA, 13 bp, Unknown
  misc_feature (1)..( 13): Result.001 file - promoters60/1012442
taagattcacata

SEQ ID NO: 91901 - DNA, 7 bp, Unknown
  misc_feature (1)..( 7): Result.001 file - promoters60/1012442
tttttaa

SEQ ID NO: 91902 - DNA, 7 bp, Unknown
  misc_feature (1)..( 7): Result.001 file - promoters60/1012442
tttttaa

SEQ ID NO: 91903 - DNA, 8 bp, Unknown
  misc_feature (1)..( 8): Result.001 file - promoters60/1012442
aagaaatt

SEQ ID NO: 91904 - DNA, 8 bp, Unknown
  misc_feature (1)..( 8): Result.001 file - promoters60/1012442
aagaaaaa

SEQ ID NO: 91905 - DNA, 8 bp, Unknown
  misc_feature (1)..( 8): Result.001 file - promoters60/1012442
aagatatt

SEQ ID NO: 91906 - DNA, 7 bp, Unknown
  misc_feature (1)..( 7): Result.001 file - promoters60/1012442
aatgttt

SEQ ID NO: 91907 - DNA, 7 bp, Unknown
  misc_feature (1)..( 7): Result.001 file - promoters60/1012442
aatattt

SEQ ID NO: 91908 - DNA, 7 bp, Unknown
  misc_feature (1)..( 7): Result.001 file - promoters60/1012442
aatatat

SEQ ID NO: 91909 - DNA, 7 bp, Unknown
  misc_feature (1)..( 7): Result.001 file - promoters60/1012442
aatgtat

SEQ ID NO: 91910 - DNA, 6 bp, Unknown
  misc_feature (1)..( 6): Result.001 file - promoters60/1012442
aaaatc

SEQ ID NO: 91911 - DNA, 6 bp, Unknown
  misc_feature (1)..( 6): Result.001 file - promoters60/1012442
aaaatc

SEQ ID NO: 91912 - DNA, 8 bp, Unknown
  misc_feature (1)..( 8): Result.001 file - promoters60/1012442
caaggcat

SEQ ID NO: 91913 - DNA, 8 bp, Unknown
  misc_feature (1)..( 8): Result.001 file - promoters60/1012442
caatgcat

SEQ ID NO: 91914 - DNA, 7 bp, Unknown
  misc_feature (1)..( 7): Result.001 file - promoters60/1012442
aataaat

SEQ ID NO: 91915 - DNA, 7 bp, Unknown
  misc_feature (1)..( 7): Result.001 file - promoters60/1012442
aataaat

SEQ ID NO: 91916 - DNA, 7 bp, Unknown
  misc_feature (1)..( 7): Result.001 file - promoters60/1012442
ttaaaat

SEQ ID NO: 91917 - DNA, 7 bp, Unknown
  misc_feature (1)..( 7): Result.001 file - promoters60/1012442
ttaaaat

SEQ ID NO: 91918 - DNA, 7 bp, Unknown
  misc_feature (1)..( 7): Result.001 file - promoters60/1012442
aatgtta

SEQ ID NO: 91919 - DNA, 7 bp, Unknown
  misc_feature (1)..( 7): Result.001 file - promoters60/1012442
aatttta

SEQ ID NO: 91920 - DNA, 6 bp, Unknown
  misc_feature (1)..( 6): Result.001 file - promoters60/1012442
agatat

SEQ ID NO: 91921 - DNA, 6 bp, Unknown
  misc_feature (1)..( 6): Result.001 file - promoters60/1012442
agatat

SEQ ID NO: 91922 - DNA, 8 bp, Unknown
  misc_feature (1)..( 8): Result.001 file - promoters60/1012442
ccaacaca

SEQ ID NO: 91923 - DNA, 8 bp, Unknown
  misc_feature (1)..( 8): Result.001 file - promoters60/1012442
ccaccaca

SEQ ID NO: 91924 - DNA, 8 bp, Unknown
  misc_feature (1)..( 8): Result.001 file - promoters60/1012442
taagttgt

SEQ ID NO: 91925 - DNA, 8 bp, Unknown
  misc_feature (1)..( 8): Result.001 file - promoters60/1012442
taaattgt

SEQ ID NO: 91926 - DNA, 6 bp, Unknown
  misc_feature (1)..( 6): Result.001 file - promoters60/1012442
atagat

SEQ ID NO: 91927 - DNA, 6 bp, Unknown
  misc_feature (1)..( 6): Result.001 file - promoters60/1012442
atagat

SEQ ID NO: 91928 - DNA, 7 bp, Unknown
  misc_feature (1)..( 7): Result.001 file - promoters60/1012442
agatata

SEQ ID NO: 91929 - DNA, 7 bp, Unknown
  misc_feature (1)..( 7): Result.001 file - promoters60/1012442
agagata

SEQ ID NO: 91930 - DNA, 6 bp, Unknown
  misc_feature (1)..( 6): Result.001 file - promoters60/1012442
ttttgg

SEQ ID NO: 91931 - DNA, 6 bp, Unknown
  misc_feature (1)..( 6): Result.001 file - promoters60/1012442
ttttgg

SEQ ID NO: 91932 - DNA, 12 bp, Unknown
  misc_feature (1)..( 12): Result.001 file - promoters60/1012442
aaaaacaaaaca

SEQ ID NO: 91933 - DNA, 12 bp, Unknown
  misc_feature (1)..( 12): Result.001 file - promoters60/1012442
aaacacaataca

SEQ ID NO: 91934 - DNA, 6 bp, Unknown
  misc_feature (1)..( 6): Result.001 file - promoters60/1012442
aaaaat

SEQ ID NO: 91935 - DNA, 6 bp, Unknown
  misc_feature (1)..( 6): Result.001 file - promoters60/1012442
aaaaat

SEQ ID NO: 91936 - DNA, 6 bp, Unknown
  misc_feature (1)..( 6): Result.001 file - promoters60/1012442
taaccc

SEQ ID NO: 91937 - DNA, 6 bp, Unknown
  misc_feature (1)..( 6): Result.001 file - promoters60/1012561
taaccc

SEQ ID NO: 91938 - DNA, 7 bp, Unknown
  misc_feature (1)..( 7): Result.001 file - promoters60/1012561
aaacaaa

SEQ ID NO: 91939 - DNA, 7 bp, Unknown
  misc_feature (1)..( 7): Result.001 file - promoters60/1012561
aaataaa

SEQ ID NO: 91940 - DNA, 7 bp, Unknown
  misc_feature (1)..( 7): Result.001 file - promoters60/1012561
gtatctt

SEQ ID NO: 91941 - DNA, 7 bp, Unknown
  misc_feature (1)..( 7): Result.001 file - promoters60/1012561
gtatctt

SEQ ID NO: 91942 - DNA, 6 bp, Unknown
  misc_feature (1)..( 6): Result.001 file - promoters60/1012561
ttatct

SEQ ID NO: 91943 - DNA, 6 bp, Unknown
  misc_feature (1)..( 6): Result.001 file - promoters60/1012561
ttatct

SEQ ID NO: 91944 - DNA, 6 bp, Unknown
  misc_feature (1)..( 6): Result.001 file - promoters60/1012561
ttatct

SEQ ID NO: 91945 - DNA, 8 bp, Unknown
  misc_feature (1)..( 8): Result.001 file - promoters60/1012561
aacaaatt

SEQ ID NO: 91946 - DNA, 8 bp, Unknown
  misc_feature (1)..( 8): Result.001 file - promoters60/1012561
aacgaatt

SEQ ID NO: 91947 - DNA, 7 bp, Unknown
  misc_feature (1)..( 7): Result.001 file - promoters60/1012561
tttgctt

SEQ ID NO: 91948 - DNA, 7 bp, Unknown
  misc_feature (1)..( 7): Result.001 file - promoters60/1012561
ttttctt

SEQ ID NO: 91949 - DNA, 10 bp, Unknown
  misc_feature (1)..( 10): Result.001 file - promoters60/1012561
atttttgtgt

SEQ ID NO: 91950 - DNA, 10 bp, Unknown
  misc_feature (1)..( 10): Result.001 file - promoters60/1012561
attattgttt

SEQ ID NO: 91951 - DNA, 10 bp, Unknown
  misc_feature (1)..( 10): Result.001 file - promoters60/1012561
gttactgttt

SEQ ID NO: 91952 - DNA, 6 bp, Unknown
  misc_feature (1)..( 6): Result.001 file - promoters60/1012561
tcagat

SEQ ID NO: 91953 - DNA, 6 bp, Unknown
  misc_feature (1)..( 6): Result.001 file - promoters60/1012561
tcagat

SEQ ID NO: 91954 - DNA, 7 bp, Unknown
  misc_feature (1)..( 7): Result.001 file - promoters60/1012561
taaataa

SEQ ID NO: 91955 - DNA, 7 bp, Unknown
  misc_feature (1)..( 7): Result.001 file - promoters60/1012561
taaataa

SEQ ID NO: 91956 - DNA, 6 bp, Unknown
  misc_feature (1)..( 6): Result.001 file - promoters60/1012561
ataaat

SEQ ID NO: 91957 - DNA, 6 bp, Unknown
  misc_feature (1)..( 6): Result.001 file - promoters60/1012561
ataaat

SEQ ID NO: 91958 - DNA, 7 bp, Unknown
  misc_feature (1)..( 7): Result.001 file - promoters60/1012561
tattttt

SEQ ID NO: 91959 - DNA, 7 bp, Unknown
  misc_feature (1)..( 7): Result.001 file - promoters60/1012561
tatgttt

SEQ ID NO: 91960 - DNA, 7 bp, Unknown
  misc_feature (1)..( 7): Result.001 file - promoters60/1012561
caaaaaa

SEQ ID NO: 91961 - DNA, 7 bp, Unknown
  misc_feature (1)..( 7): Result.001 file - promoters60/1012561
caaaaaa

SEQ ID NO: 91962 - DNA, 6 bp, Unknown
  misc_feature (1)..( 6): Result.001 file - promoters60/1012561
taaaca

SEQ ID NO: 91963 - DNA, 6 bp, Unknown
  misc_feature (1)..( 6): Result.001 file - promoters60/1012561
taaaca

SEQ ID NO: 91964 - DNA, 7 bp, Unknown
  misc_feature (1)..( 7): Result.001 file - promoters60/1012561
ttagatc

SEQ ID NO: 91965 - DNA, 7 bp, Unknown
  misc_feature (1)..( 7): Result.001 file - promoters60/1012561
ttagatc

SEQ ID NO: 91966 - DNA, 7 bp, Unknown
  misc_feature (1)..( 7): Result.001 file - promoters60/1012561
atcattt

SEQ ID NO: 91967 - DNA, 7 bp, Unknown
  misc_feature (1)..( 7): Result.001 file - promoters60/1012561
atctttt

SEQ ID NO: 91968 - DNA, 7 bp, Unknown
  misc_feature (1)..( 7): Result.001 file - promoters60/1012561
gatttat

SEQ ID NO: 91969 - DNA, 7 bp, Unknown
  misc_feature (1)..( 7): Result.001 file - promoters60/1012561
gatctat

SEQ ID NO: 91970 - DNA, 6 bp, Unknown
  misc_feature (1)..( 6): Result.001 file - promoters60/1012561
ttttca

SEQ ID NO: 91971 - DNA, 6 bp, Unknown
  misc_feature (1)..( 6): Result.001 file - promoters60/1012561
ttttca

SEQ ID NO: 91972 - DNA, 7 bp, Unknown
  misc_feature (1)..( 7): Result.001 file - promoters60/1012561
cgagcaa

SEQ ID NO: 91973 - DNA, 7 bp, Unknown
  misc_feature (1)..( 7): Result.001 file - promoters60/1012561
cgaacaa

SEQ ID NO: 91974 - DNA, 6 bp, Unknown
  misc_feature (1)..( 6): Result.001 file - promoters60/1012561
tatcta

SEQ ID NO: 91975 - DNA, 6 bp, Unknown
  misc_feature (1)..( 6): Result.001 file - promoters60/1012580
tatcta

SEQ ID NO: 91976 - DNA, 9 bp, Unknown
  misc_feature (1)..( 9): Result.001 file - promoters60/1012580
aattacaat

SEQ ID NO: 91977 - DNA, 9 bp, Unknown
  misc_feature (1)..( 9): Result.001 file - promoters60/1012580
tcttataat

SEQ ID NO: 91978 - DNA, 9 bp, Unknown
  misc_feature (1)..( 9): Result.001 file - promoters60/1012580
tcttataaa

SEQ ID NO: 91979 - DNA, 7 bp, Unknown
  misc_feature (1)..( 7): Result.001 file - promoters60/1012580
acatcaa

SEQ ID NO: 91980 - DNA, 7 bp, Unknown
  misc_feature (1)..( 7): Result.001 file - promoters60/1012580
acaccaa

SEQ ID NO: 91981 - DNA, 8 bp, Unknown
  misc_feature (1)..( 8): Result.001 file - promoters60/1012580
acttatat

SEQ ID NO: 91982 - DNA, 8 bp, Unknown
  misc_feature (1)..( 8): Result.001 file - promoters60/1012580
tcttataa

SEQ ID NO: 91983 - DNA, 8 bp, Unknown
  misc_feature (1)..( 8): Result.001 file - promoters60/1012580
tcttataa

SEQ ID NO: 91984 - DNA, 8 bp, Unknown
  misc_feature (1)..( 8): Result.001 file - promoters60/1012580
aaaacaca

SEQ ID NO: 91985 - DNA, 8 bp, Unknown
  misc_feature (1)..( 8): Result.001 file - promoters60/1012580
aaaacaca

SEQ ID NO: 91986 - DNA, 8 bp, Unknown
  misc_feature (1)..( 8): Result.001 file - promoters60/1012580
caagcttt

SEQ ID NO: 91987 - DNA, 8 bp, Unknown
  misc_feature (1)..( 8): Result.001 file - promoters60/1012580
caaacttt

SEQ ID NO: 91988 - DNA, 6 bp, Unknown
  misc_feature (1)..( 6): Result.001 file - promoters60/1012580
aatatt

SEQ ID NO: 91989 - DNA, 6 bp, Unknown
  misc_feature (1)..( 6): Result.001 file - promoters60/1012580
aatatt

SEQ ID NO: 91990 - DNA, 6 bp, Unknown
  misc_feature (1)..( 6): Result.001 file - promoters60/1012580
atcaaa

SEQ ID NO: 91991 - DNA, 6 bp, Unknown
  misc_feature (1)..( 6): Result.001 file - promoters60/1012580
atcaaa

SEQ ID NO: 91992 - DNA, 7 bp, Unknown
  misc_feature (1)..( 7): Result.001 file - promoters60/1012580
caaatcc

SEQ ID NO: 91993 - DNA, 7 bp, Unknown
  misc_feature (1)..( 7): Result.001 file - promoters60/1012580
caagtcc

SEQ ID NO: 91994 - DNA, 7 bp, Unknown
  misc_feature (1)..( 7): Result.001 file - promoters60/1012580
cacaaga

SEQ ID NO: 91995 - DNA, 7 bp, Unknown
  misc_feature (1)..( 7): Result.001 file - promoters60/1012580
cacgaga

SEQ ID NO: 91996 - DNA, 8 bp, Unknown
  misc_feature (1)..( 8): Result.001 file - promoters60/1012580
ctcgcttc

SEQ ID NO: 91997 - DNA, 8 bp, Unknown
  misc_feature (1)..( 8): Result.001 file - promoters60/1012580
ctcgcttc

SEQ ID NO: 91998 - DNA, 8 bp, Unknown
  misc_feature (1)..( 8): Result.001 file - promoters60/1012580
cttctcga

SEQ ID NO: 91999 - DNA, 8 bp, Unknown
  misc_feature (1)..( 8): Result.001 file - promoters60/1012620
cttctcga

SEQ ID NO: 92000 - DNA, 11 bp, Unknown
  misc_feature (1)..( 11): Result.001 file - promoters60/1012620
ataatttgagt

SEQ ID NO: 92001 - DNA, 11 bp, Unknown
  misc_feature (1)..( 11): Result.001 file - promoters60/1012620
atatttttagt

SEQ ID NO: 92002 - DNA, 11 bp, Unknown
  misc_feature (1)..( 11): Result.001 file - promoters60/1012620
caaatgtgatt

SEQ ID NO: 92003 - DNA, 8 bp, Unknown
  misc_feature (1)..( 8): Result.001 file - promoters60/1012620
aggaggaa

SEQ ID NO: 92004 - DNA, 8 bp, Unknown
  misc_feature (1)..( 8): Result.001 file - promoters60/1012620
aggaggaa

SEQ ID NO: 92005 - DNA, 8 bp, Unknown
  misc_feature (1)..( 8): Result.001 file - promoters60/1012620
tggaggat

SEQ ID NO: 92006 - DNA, 8 bp, Unknown
  misc_feature (1)..( 8): Result.001 file - promoters60/1012620
gttacaaa

SEQ ID NO: 92007 - DNA, 8 bp, Unknown
  misc_feature (1)..( 8): Result.001 file - promoters60/1012620
gttacaac

SEQ ID NO: 92008 - DNA, 8 bp, Unknown
  misc_feature (1)..( 8): Result.001 file - promoters60/1012620
gttataac

SEQ ID NO: 92009 - DNA, 10 bp, Unknown
  misc_feature (1)..( 10): Result.001 file - promoters60/1012620
aatatataca

SEQ ID NO: 92010 - DNA, 10 bp, Unknown
  misc_feature (1)..( 10): Result.001 file - promoters60/1012620
aatttatcaa

SEQ ID NO: 92011 - DNA, 10 bp, Unknown
  misc_feature (1)..( 10): Result.001 file - promoters60/1012620
agtttatttt

SEQ ID NO: 92012 - DNA, 11 bp, Unknown
  misc_feature (1)..( 11): Result.001 file - promoters60/1012620
agagaaaggat

SEQ ID NO: 92013 - DNA, 11 bp, Unknown
  misc_feature (1)..( 11): Result.001 file - promoters60/1012620
agaaaaattgt

SEQ ID NO: 92014 - DNA, 11 bp, Unknown
  misc_feature (1)..( 11): Result.001 file - promoters60/1012620
aaacaaagatt

SEQ ID NO: 92015 - DNA, 9 bp, Unknown
  misc_feature (1)..( 9): Result.001 file - promoters60/1012620
atctataaa

SEQ ID NO: 92016 - DNA, 9 bp, Unknown
  misc_feature (1)..( 9): Result.001 file - promoters60/1012620
atatataaa

SEQ ID NO: 92017 - DNA, 9 bp, Unknown
  misc_feature (1)..( 9): Result.001 file - promoters60/1012620
ccttataaa

SEQ ID NO: 92018 - DNA, 9 bp, Unknown
  misc_feature (1)..( 9): Result.001 file - promoters60/1012673
ccttttaaa

SEQ ID NO: 92019 - DNA, 10 bp, Unknown
  misc_feature (1)..( 10): Result.001 file - promoters60/1012673
aaattaaaaa

SEQ ID NO: 92020 - DNA, 10 bp, Unknown
  misc_feature (1)..( 10): Result.001 file - promoters60/1012673
ctatttaaac

SEQ ID NO: 92021 - DNA, 10 bp, Unknown
  misc_feature (1)..( 10): Result.001 file - promoters60/1012673
agaataaaaa

SEQ ID NO: 92022 - DNA, 10 bp, Unknown
  misc_feature (1)..( 10): Result.001 file - promoters60/1012673
ctagttactt

SEQ ID NO: 92023 - DNA, 11 bp, Unknown
  misc_feature (1)..( 11): Result.001 file - promoters60/1012673
caaatatttcc

SEQ ID NO: 92024 - DNA, 11 bp, Unknown
  misc_feature (1)..( 11): Result.001 file - promoters60/1012673
caaataatttt

SEQ ID NO: 92025 - DNA, 11 bp, Unknown
  misc_feature (1)..( 11): Result.001 file - promoters60/1012673
caagtaatttt

SEQ ID NO: 92026 - DNA, 11 bp, Unknown
  misc_feature (1)..( 11): Result.001 file - promoters60/1012673
cactgattttt

SEQ ID NO: 92027 - DNA, 9 bp, Unknown
  misc_feature (1)..( 9): Result.001 file - promoters60/1012673
tatcatttt

SEQ ID NO: 92028 - DNA, 9 bp, Unknown
  misc_feature (1)..( 9): Result.001 file - promoters60/1012673
tatcatttt

SEQ ID NO: 92029 - DNA, 7 bp, Unknown
  misc_feature (1)..( 7): Result.001 file - promoters60/1012673
ccatttt

SEQ ID NO: 92030 - DNA, 9 bp, Unknown
  misc_feature (1)..( 9): Result.001 file - promoters60/1012673
tatgattaa

SEQ ID NO: 92031 - DNA, 11 bp, Unknown
  misc_feature (1)..( 11): Result.001 file - promoters60/1012673
agaatctaaat

SEQ ID NO: 92032 - DNA, 11 bp, Unknown
  misc_feature (1)..( 11): Result.001 file - promoters60/1012673
agaatccagct

SEQ ID NO: 92033 - DNA, 11 bp, Unknown
  misc_feature (1)..( 11): Result.001 file - promoters60/1012673
agactcctgct

SEQ ID NO: 92034 - DNA, 11 bp, Unknown
  misc_feature (1)..( 11): Result.001 file - promoters60/1012673
cttctgctggg

SEQ ID NO: 92035 - DNA, 12 bp, Unknown
  misc_feature (1)..( 12): Result.001 file - promoters60/1012673
tgtcaaatattt

SEQ ID NO: 92036 - DNA, 12 bp, Unknown
  misc_feature (1)..( 12): Result.001 file - promoters60/1012673
caagtaattttt

SEQ ID NO: 92037 - DNA, 12 bp, Unknown
  misc_feature (1)..( 12): Result.001 file - promoters60/1012673
caaataatttta

SEQ ID NO: 92038 - DNA, 12 bp, Unknown
  misc_feature (1)..( 12): Result.001 file - promoters60/1012673
tcactgattttt

SEQ ID NO: 92039 - DNA, 11 bp, Unknown
  misc_feature (1)..( 11): Result.001 file - promoters60/1012673
tgatttgtttg

SEQ ID NO: 92040 - DNA, 11 bp, Unknown
  misc_feature (1)..( 11): Result.001 file - promoters60/1012673
gaatttgtttg

SEQ ID NO: 92041 - DNA, 11 bp, Unknown
  misc_feature (1)..( 11): Result.001 file - promoters60/1012673
tgaattggcac

SEQ ID NO: 92042 - DNA, 11 bp, Unknown
  misc_feature (1)..( 11): Result.001 file - promoters60/1012720
tcatttgtata

SEQ ID NO: 92043 - DNA, 8 bp, Unknown
  misc_feature (1)..( 8): Result.001 file - promoters60/1012720
ttaagcta

SEQ ID NO: 92044 - DNA, 8 bp, Unknown
  misc_feature (1)..( 8): Result.001 file - promoters60/1012720
ttatgctg

SEQ ID NO: 92045 - DNA, 8 bp, Unknown
  misc_feature (1)..( 8): Result.001 file - promoters60/1012720
ataatcta

SEQ ID NO: 92046 - DNA, 14 bp, Unknown
  misc_feature (1)..( 14): Result.001 file - promoters60/1012720
tttgattcctataa

SEQ ID NO: 92047 - DNA, 14 bp, Unknown
  misc_feature (1)..( 14): Result.001 file - promoters60/1012720
tgggcttcctttaa

SEQ ID NO: 92048 - DNA, 14 bp, Unknown
  misc_feature (1)..( 14): Result.001 file - promoters60/1012720
tttgattccttgtt

SEQ ID NO: 92049 - DNA, 8 bp, Unknown
  misc_feature (1)..( 8): Result.001 file - promoters60/1012720
tgttaaaa

SEQ ID NO: 92050 - DNA, 8 bp, Unknown
  misc_feature (1)..( 8): Result.001 file - promoters60/1012720
tgtgaaat

SEQ ID NO: 92051 - DNA, 8 bp, Unknown
  misc_feature (1)..( 8): Result.001 file - promoters60/1012720
ttttaaaa

SEQ ID NO: 92052 - DNA, 9 bp, Unknown
  misc_feature (1)..( 9): Result.001 file - promoters60/1012720
atgttttaa

SEQ ID NO: 92053 - DNA, 9 bp, Unknown
  misc_feature (1)..( 9): Result.001 file - promoters60/1012720
atgttttgc

SEQ ID NO: 92054 - DNA, 9 bp, Unknown
  misc_feature (1)..( 9): Result.001 file - promoters60/1012720
ttgttatgc

SEQ ID NO: 92055 - DNA, 7 bp, Unknown
  misc_feature (1)..( 7): Result.001 file - promoters60/1012720
aagaaaa

SEQ ID NO: 92056 - DNA, 7 bp, Unknown
  misc_feature (1)..( 7): Result.001 file - promoters60/1012720
aagaaag

SEQ ID NO: 92057 - DNA, 7 bp, Unknown
  misc_feature (1)..( 7): Result.001 file - promoters60/1012720
aaggaag

SEQ ID NO: 92058 - DNA, 8 bp, Unknown
  misc_feature (1)..( 8): Result.001 file - promoters60/1012720
aaacctgt

SEQ ID NO: 92059 - DNA, 8 bp, Unknown
  misc_feature (1)..( 8): Result.001 file - promoters60/1012720
taacttgt

SEQ ID NO: 92060 - DNA, 8 bp, Unknown
  misc_feature (1)..( 8): Result.001 file - promoters60/1012720
taaattgt

SEQ ID NO: 92061 - DNA, 9 bp, Unknown
  misc_feature (1)..( 9): Result.001 file - promoters60/1012720
tgttttaag

SEQ ID NO: 92062 - DNA, 9 bp, Unknown
  misc_feature (1)..( 9): Result.001 file - promoters60/1012720
tgttataaa

SEQ ID NO: 92063 - DNA, 9 bp, Unknown
  misc_feature (1)..( 9): Result.001 file - promoters60/1012757
tagtataaa

SEQ ID NO: 92064 - DNA, 7 bp, Unknown
  misc_feature (1)..( 7): Result.001 file - promoters60/1012757
aaaataa

SEQ ID NO: 92065 - DNA, 7 bp, Unknown
  misc_feature (1)..( 7): Result.001 file - promoters60/1012757
aaaatat

SEQ ID NO: 92066 - DNA, 7 bp, Unknown
  misc_feature (1)..( 7): Result.001 file - promoters60/1012757
aaattat

SEQ ID NO: 92067 - DNA, 9 bp, Unknown
  misc_feature (1)..( 9): Result.001 file - promoters60/1012757
tgcttaaaa

SEQ ID NO: 92068 - DNA, 9 bp, Unknown
  misc_feature (1)..( 9): Result.001 file - promoters60/1012757
aaattaaaa

SEQ ID NO: 92069 - DNA, 9 bp, Unknown
  misc_feature (1)..( 9): Result.001 file - promoters60/1012757
aaatgaaaa

SEQ ID NO: 92070 - DNA, 7 bp, Unknown
  misc_feature (1)..( 7): Result.001 file - promoters60/1012757
tctttgt

SEQ ID NO: 92071 - DNA, 7 bp, Unknown
  misc_feature (1)..( 7): Result.001 file - promoters60/1012757
tctatgt

SEQ ID NO: 92072 - DNA, 7 bp, Unknown
  misc_feature (1)..( 7): Result.001 file - promoters60/1012757
tctatat

SEQ ID NO: 92073 - DNA, 11 bp, Unknown
  misc_feature (1)..( 11): Result.001 file - promoters60/1012757
tgtttgaccat

SEQ ID NO: 92074 - DNA, 11 bp, Unknown
  misc_feature (1)..( 11): Result.001 file - promoters60/1012757
tatttgaacat

SEQ ID NO: 92075 - DNA, 11 bp, Unknown
  misc_feature (1)..( 11): Result.001 file - promoters60/1012757
tgtgtgagttc

SEQ ID NO: 92076 - DNA, 8 bp, Unknown
  misc_feature (1)..( 8): Result.001 file - promoters60/1012757
taacgaac

SEQ ID NO: 92077 - DNA, 8 bp, Unknown
  misc_feature (1)..( 8): Result.001 file - promoters60/1012757
caacgaaa

SEQ ID NO: 92078 - DNA, 8 bp, Unknown
  misc_feature (1)..( 8): Result.001 file - promoters60/1012791
caactaaa

SEQ ID NO: 92079 - DNA, 6 bp, Unknown
  misc_feature (1)..( 6): Result.001 file - promoters60/1012791
ttgttt

SEQ ID NO: 92080 - DNA, 6 bp, Unknown
  misc_feature (1)..( 6): Result.001 file - promoters60/1012791
ttgttt

SEQ ID NO: 92081 - DNA, 6 bp, Unknown
  misc_feature (1)..( 6): Result.001 file - promoters60/1012791
atatat

SEQ ID NO: 92082 - DNA, 6 bp, Unknown
  misc_feature (1)..( 6): Result.001 file - promoters60/1012791
atatat

SEQ ID NO: 92083 - DNA, 6 bp, Unknown
  misc_feature (1)..( 6): Result.001 file - promoters60/1012791
attttt

SEQ ID NO: 92084 - DNA, 6 bp, Unknown
  misc_feature (1)..( 6): Result.001 file - promoters60/1012791
attttt

SEQ ID NO: 92085 - DNA, 8 bp, Unknown
  misc_feature (1)..( 8): Result.001 file - promoters60/1012791
aaacaaaa

SEQ ID NO: 92086 - DNA, 8 bp, Unknown
  misc_feature (1)..( 8): Result.001 file - promoters60/1012791
aaacaatt

SEQ ID NO: 92087 - DNA, 8 bp, Unknown
  misc_feature (1)..( 8): Result.001 file - promoters60/1012791
aaacaaaa

SEQ ID NO: 92088 - DNA, 7 bp, Unknown
  misc_feature (1)..( 7): Result.001 file - promoters60/1012791
aataaac

SEQ ID NO: 92089 - DNA, 7 bp, Unknown
  misc_feature (1)..( 7): Result.001 file - promoters60/1012791
aattaac

SEQ ID NO: 92090 - DNA, 6 bp, Unknown
  misc_feature (1)..( 6): Result.001 file - promoters60/1012791
tttatt

SEQ ID NO: 92091 - DNA, 6 bp, Unknown
  misc_feature (1)..( 6): Result.001 file - promoters60/1012791
tttatt

SEQ ID NO: 92092 - DNA, 6 bp, Unknown
  misc_feature (1)..( 6): Result.001 file - promoters60/1012791
attaaa

SEQ ID NO: 92093 - DNA, 6 bp, Unknown
  misc_feature (1)..( 6): Result.001 file - promoters60/1012791
attaaa

SEQ ID NO: 92094 - DNA, 6 bp, Unknown
  misc_feature (1)..( 6): Result.001 file - promoters60/1012791
attaca

SEQ ID NO: 92095 - DNA, 6 bp, Unknown
  misc_feature (1)..( 6): Result.001 file - promoters60/1012791
attaca

SEQ ID NO: 92096 - DNA, 6 bp, Unknown
  misc_feature (1)..( 6): Result.001 file - promoters60/1012791
tatatt

SEQ ID NO: 92097 - DNA, 6 bp, Unknown
  misc_feature (1)..( 6): Result.001 file - promoters60/1012791
tatatt

SEQ ID NO: 92098 - DNA, 12 bp, Unknown
  misc_feature (1)..( 12): Result.001 file - promoters60/1012791
tatatatattgc

SEQ ID NO: 92099 - DNA, 12 bp, Unknown
  misc_feature (1)..( 12): Result.001 file - promoters60/1012791
tatatataatgc

SEQ ID NO: 92100 - DNA, 10 bp, Unknown
  misc_feature (1)..( 10): Result.001 file - promoters60/1012791
tttctatatt

SEQ ID NO: 92101 - DNA, 10 bp, Unknown
  misc_feature (1)..( 10): Result.001 file - promoters60/1012791
tttttatatt

SEQ ID NO: 92102 - DNA, 10 bp, Unknown
  misc_feature (1)..( 10): Result.001 file - promoters60/1012791
cttttatcat

SEQ ID NO: 92103 - DNA, 7 bp, Unknown
  misc_feature (1)..( 7): Result.001 file - promoters60/1012791
aacatta

SEQ ID NO: 92104 - DNA, 7 bp, Unknown
  misc_feature (1)..( 7): Result.001 file - promoters60/1012791
aacttta

SEQ ID NO: 92105 - DNA, 10 bp, Unknown
  misc_feature (1)..( 10): Result.001 file - promoters60/1012791
caaaataaat

SEQ ID NO: 92106 - DNA, 10 bp, Unknown
  misc_feature (1)..( 10): Result.001 file - promoters60/1012791
aaaaacaaat

SEQ ID NO: 92107 - DNA, 10 bp, Unknown
  misc_feature (1)..( 10): Result.001 file - promoters60/1012791
aaaaacaatt

SEQ ID NO: 92108 - DNA, 8 bp, Unknown
  misc_feature (1)..( 8): Result.001 file - promoters60/1012791
aaaaaaac

SEQ ID NO: 92109 - DNA, 8 bp, Unknown
  misc_feature (1)..( 8): Result.001 file - promoters60/1012791
aaagaaac

SEQ ID NO: 92110 - DNA, 7 bp, Unknown
  misc_feature (1)..( 7): Result.001 file - promoters60/1012791
accgcag

SEQ ID NO: 92111 - DNA, 7 bp, Unknown
  misc_feature (1)..( 7): Result.001 file - promoters60/1012791
accacag

SEQ ID NO: 92112 - DNA, 8 bp, Unknown
  misc_feature (1)..( 8): Result.001 file - promoters60/1012791
aaacaaaa

SEQ ID NO: 92113 - DNA, 8 bp, Unknown
  misc_feature (1)..( 8): Result.001 file - promoters60/1012791
aaaaaaaa

SEQ ID NO: 92114 - DNA, 6 bp, Unknown
  misc_feature (1)..( 6): Result.001 file - promoters60/1012791
aaaaaa

SEQ ID NO: 92115 - DNA, 6 bp, Unknown
  misc_feature (1)..( 6): Result.001 file - promoters60/1012791
aaaaaa

SEQ ID NO: 92116 - DNA, 7 bp, Unknown
  misc_feature (1)..( 7): Result.001 file - promoters60/1012791
aaagaag

SEQ ID NO: 92117 - DNA, 7 bp, Unknown
  misc_feature (1)..( 7): Result.001 file - promoters60/1012791
aaaaaag

SEQ ID NO: 92118 - DNA, 7 bp, Unknown
  misc_feature (1)..( 7): Result.001 file - promoters60/1012791
ttctttt

SEQ ID NO: 92119 - DNA, 7 bp, Unknown
  misc_feature (1)..( 7): Result.001 file - promoters60/1012791
ttctttt

SEQ ID NO: 92120 - DNA, 6 bp, Unknown
  misc_feature (1)..( 6): Result.001 file - promoters60/1012791
ataaag

SEQ ID NO: 92121 - DNA, 6 bp, Unknown
  misc_feature (1)..( 6): Result.001 file - promoters60/1012791
ataaag

SEQ ID NO: 92122 - DNA, 8 bp, Unknown
  misc_feature (1)..( 8): Result.001 file - promoters60/1012791
cttcgcaa

SEQ ID NO: 92123 - DNA, 8 bp, Unknown
  misc_feature (1)..( 8): Result.001 file - promoters60/1012791
cttctcaa

SEQ ID NO: 92124 - DNA, 8 bp, Unknown
  misc_feature (1)..( 8): Result.001 file - promoters60/1012791
tttaaaaa

SEQ ID NO: 92125 - DNA, 8 bp, Unknown
  misc_feature (1)..( 8): Result.001 file - promoters60/1012791
tttacaaa

SEQ ID NO: 92126 - DNA, 6 bp, Unknown
  misc_feature (1)..( 6): Result.001 file - promoters60/1012791
tcattt

SEQ ID NO: 92127 - DNA, 6 bp, Unknown
  misc_feature (1)..( 6): Result.001 file - promoters60/1012791
tcattt

SEQ ID NO: 92128 - DNA, 8 bp, Unknown
  misc_feature (1)..( 8): Result.001 file - promoters60/1012791
ttgtttca

SEQ ID NO: 92129 - DNA, 8 bp, Unknown
  misc_feature (1)..( 8): Result.001 file - promoters60/1012791
ttgtttca

SEQ ID NO: 92130 - DNA, 8 bp, Unknown
  misc_feature (1)..( 8): Result.001 file - promoters60/1012791
tctatata

SEQ ID NO: 92131 - DNA, 8 bp, Unknown
  misc_feature (1)..( 8): Result.001 file - promoters60/1012791
tctatata

SEQ ID NO: 92132 - DNA, 6 bp, Unknown
  misc_feature (1)..( 6): Result.001 file - promoters60/1012791
aagata

SEQ ID NO: 92133 - DNA, 6 bp, Unknown
  misc_feature (1)..( 6): Result.001 file - promoters60/1012791
aagata

SEQ ID NO: 92134 - DNA, 11 bp, Unknown
  misc_feature (1)..( 11): Result.001 file - promoters60/1012791
atccaccaccg

SEQ ID NO: 92135 - DNA, 11 bp, Unknown
  misc_feature (1)..( 11): Result.001 file - promoters60/1012883
atccaccaccg

SEQ ID NO: 92136 - DNA, 10 bp, Unknown
  misc_feature (1)..( 10): Result.001 file - promoters60/1012883
gtatatatta

SEQ ID NO: 92137 - DNA, 10 bp, Unknown
  misc_feature (1)..( 10): Result.001 file - promoters60/1012883
gtagatattt

SEQ ID NO: 92138 - DNA, 10 bp, Unknown
  misc_feature (1)..( 10): Result.001 file - promoters60/1012883
gaataaattg

SEQ ID NO: 92139 - DNA, 11 bp, Unknown
  misc_feature (1)..( 11): Result.001 file - promoters60/1012883
gcagatactta

SEQ ID NO: 92140 - DNA, 8 bp, Unknown
  misc_feature (1)..( 8): Result.001 file - promoters60/1012883
tgaagaaa

SEQ ID NO: 92141 - DNA, 8 bp, Unknown
  misc_feature (1)..( 8): Result.001 file - promoters60/1012883
tgatgaat

SEQ ID NO: 92142 - DNA, 8 bp, Unknown
  misc_feature (1)..( 8): Result.001 file - promoters60/1012883
tgatgaat

SEQ ID NO: 92143 - DNA, 8 bp, Unknown
  misc_feature (1)..( 8): Result.001 file - promoters60/1012883
ggataaat

SEQ ID NO: 92144 - DNA, 8 bp, Unknown
  misc_feature (1)..( 8): Result.001 file - promoters60/1012883
agataaaa

SEQ ID NO: 92145 - DNA, 10 bp, Unknown
  misc_feature (1)..( 10): Result.001 file - promoters60/1012883
ttacaaaaag

SEQ ID NO: 92146 - DNA, 10 bp, Unknown
  misc_feature (1)..( 10): Result.001 file - promoters60/1012883
ttagaaaaaa

SEQ ID NO: 92147 - DNA, 10 bp, Unknown
  misc_feature (1)..( 10): Result.001 file - promoters60/1012883
ttataaaaca

SEQ ID NO: 92148 - DNA, 10 bp, Unknown
  misc_feature (1)..( 10): Result.001 file - promoters60/1012883
aaggaaaaaa

SEQ ID NO: 92149 - DNA, 11 bp, Unknown
  misc_feature (1)..( 11): Result.001 file - promoters60/1012883
ccgtacacgtg

SEQ ID NO: 92150 - DNA, 11 bp, Unknown
  misc_feature (1)..( 11): Result.001 file - promoters60/1012883
aggtacacgtg

SEQ ID NO: 92151 - DNA, 11 bp, Unknown
  misc_feature (1)..( 11): Result.001 file - promoters60/1012883
cggttcacgtc

SEQ ID NO: 92152 - DNA, 11 bp, Unknown
  misc_feature (1)..( 11): Result.001 file - promoters60/1012883
cggttcggatt

SEQ ID NO: 92153 - DNA, 9 bp, Unknown
  misc_feature (1)..( 9): Result.001 file - promoters60/1012883
gaaagattg

SEQ ID NO: 92154 - DNA, 9 bp, Unknown
  misc_feature (1)..( 9): Result.001 file - promoters60/1012883
taaagcttg

SEQ ID NO: 92155 - DNA, 9 bp, Unknown
  misc_feature (1)..( 9): Result.001 file - promoters60/1012883
taaaaattt

SEQ ID NO: 92156 - DNA, 9 bp, Unknown
  misc_feature (1)..( 9): Result.001 file - promoters60/1012883
taaaaagga

SEQ ID NO: 92157 - DNA, 9 bp, Unknown
  misc_feature (1)..( 9): Result.001 file - promoters60/1012883
tcccactaa

SEQ ID NO: 92158 - DNA, 9 bp, Unknown
  misc_feature (1)..( 9): Result.001 file - promoters60/1012883
aaccattaa

SEQ ID NO: 92159 - DNA, 9 bp, Unknown
  misc_feature (1)..( 9): Result.001 file - promoters60/1012883
aactattct

SEQ ID NO: 92160 - DNA, 9 bp, Unknown
  misc_feature (1)..( 9): Result.001 file - promoters60/1012883
gtccattag

SEQ ID NO: 92161 - DNA, 8 bp, Unknown
  misc_feature (1)..( 8): Result.001 file - promoters60/1012883
cagttttc

SEQ ID NO: 92162 - DNA, 8 bp, Unknown
  misc_feature (1)..( 8): Result.001 file - promoters60/1012883
tagttttg

SEQ ID NO: 92163 - DNA, 8 bp, Unknown
  misc_feature (1)..( 8): Result.001 file - promoters60/1012883
tcgttttg

SEQ ID NO: 92164 - DNA, 8 bp, Unknown
  misc_feature (1)..( 8): Result.001 file - promoters60/1012883
tagctttg

SEQ ID NO: 92165 - DNA, 14 bp, Unknown
  misc_feature (1)..( 14): Result.001 file - promoters60/1012883
tttgaatttgatga

SEQ ID NO: 92166 - DNA, 14 bp, Unknown
  misc_feature (1)..( 14): Result.001 file - promoters60/1012883
tttaaatgggccta

SEQ ID NO: 92167 - DNA, 14 bp, Unknown
  misc_feature (1)..( 14): Result.001 file - promoters60/1012883
tctgaatatgatga

SEQ ID NO: 92168 - DNA, 14 bp, Unknown
  misc_feature (1)..( 14): Result.001 file - promoters60/1012906
tttaaaatcacatc

SEQ ID NO: 92169 - DNA, 10 bp, Unknown
  misc_feature (1)..( 10): Result.001 file - promoters60/1012906
tgaagaaaaa

SEQ ID NO: 92170 - DNA, 10 bp, Unknown
  misc_feature (1)..( 10): Result.001 file - promoters60/1012906
taaagtaaat

SEQ ID NO: 92171 - DNA, 10 bp, Unknown
  misc_feature (1)..( 10): Result.001 file - promoters60/1012906
tgaagaaaaa

SEQ ID NO: 92172 - DNA, 12 bp, Unknown
  misc_feature (1)..( 12): Result.001 file - promoters60/1012906
aaaaaaatgttt

SEQ ID NO: 92173 - DNA, 12 bp, Unknown
  misc_feature (1)..( 12): Result.001 file - promoters60/1012906
acacgaatattt

SEQ ID NO: 92174 - DNA, 12 bp, Unknown
  misc_feature (1)..( 12): Result.001 file - promoters60/1012906
aaaaacatgttg

SEQ ID NO: 92175 - DNA, 8 bp, Unknown
  misc_feature (1)..( 8): Result.001 file - promoters60/1012906
ttaaaaaa

SEQ ID NO: 92176 - DNA, 8 bp, Unknown
  misc_feature (1)..( 8): Result.001 file - promoters60/1012906
agaaaaaa

SEQ ID NO: 92177 - DNA, 8 bp, Unknown
  misc_feature (1)..( 8): Result.001 file - promoters60/1012906
ttaaaaaa

SEQ ID NO: 92178 - DNA, 8 bp, Unknown
  misc_feature (1)..( 8): Result.001 file - promoters60/1012906
ttataaat

SEQ ID NO: 92179 - DNA, 15 bp, Unknown
  misc_feature (1)..( 15): Result.001 file - promoters60/1012906
agttaaaaaatcttg

SEQ ID NO: 92180 - DNA, 15 bp, Unknown
  misc_feature (1)..( 15): Result.001 file - promoters60/1012906
agcatcttaattttg

SEQ ID NO: 92181 - DNA, 15 bp, Unknown
  misc_feature (1)..( 15): Result.001 file - promoters60/1012906
agtaaaaaaatcttg

SEQ ID NO: 92182 - DNA, 15 bp, Unknown
  misc_feature (1)..( 15): Result.001 file - promoters60/1012906
tttaaaaaaaaaaag

SEQ ID NO: 92183 - DNA, 9 bp, Unknown
  misc_feature (1)..( 9): Result.001 file - promoters60/1012906
ataatatct

SEQ ID NO: 92184 - DNA, 9 bp, Unknown
  misc_feature (1)..( 9): Result.001 file - promoters60/1012906
atattatcc

SEQ ID NO: 92185 - DNA, 9 bp, Unknown
  misc_feature (1)..( 9): Result.001 file - promoters60/1012906
aacatatct

SEQ ID NO: 92186 - DNA, 11 bp, Unknown
  misc_feature (1)..( 11): Result.001 file - promoters60/1012906
tatctgaaata

SEQ ID NO: 92187 - DNA, 11 bp, Unknown
  misc_feature (1)..( 11): Result.001 file - promoters60/1012906
gaattgatata

SEQ ID NO: 92188 - DNA, 11 bp, Unknown
  misc_feature (1)..( 11): Result.001 file - promoters60/1012906
gaatttataaa

SEQ ID NO: 92189 - DNA, 9 bp, Unknown
  misc_feature (1)..( 9): Result.001 file - promoters60/1012906
aaaatccat

SEQ ID NO: 92190 - DNA, 9 bp, Unknown
  misc_feature (1)..( 9): Result.001 file - promoters60/1012906
aaagtccaa

SEQ ID NO: 92191 - DNA, 9 bp, Unknown
  misc_feature (1)..( 9): Result.001 file - promoters60/1012906
aatatccat

SEQ ID NO: 92192 - DNA, 7 bp, Unknown
  misc_feature (1)..( 7): Result.001 file - promoters60/1012906
ctatata

SEQ ID NO: 92193 - DNA, 7 bp, Unknown
  misc_feature (1)..( 7): Result.001 file - promoters60/1012906
atatata

SEQ ID NO: 92194 - DNA, 7 bp, Unknown
  misc_feature (1)..( 7): Result.001 file - promoters60/1012906
ctatata

SEQ ID NO: 92195 - DNA, 10 bp, Unknown
  misc_feature (1)..( 10): Result.001 file - promoters60/1012906
ctgaaatatt

SEQ ID NO: 92196 - DNA, 10 bp, Unknown
  misc_feature (1)..( 10): Result.001 file - promoters60/1012906
ttgacatatt

SEQ ID NO: 92197 - DNA, 10 bp, Unknown
  misc_feature (1)..( 10): Result.001 file - promoters60/1012906
ttgacttatt

SEQ ID NO: 92198 - DNA, 9 bp, Unknown
  misc_feature (1)..( 9): Result.001 file - promoters60/1012906
atattataa

SEQ ID NO: 92199 - DNA, 9 bp, Unknown
  misc_feature (1)..( 9): Result.001 file - promoters60/1012906
aatttataa

SEQ ID NO: 92200 - DNA, 10 bp, Unknown
  misc_feature (1)..( 10): Result.001 file - promoters60/1012906
gaattgatat

SEQ ID NO: 92201 - DNA, 10 bp, Unknown
  misc_feature (1)..( 10): Result.001 file - promoters60/1012906
agaattagaa

SEQ ID NO: 92202 - DNA, 10 bp, Unknown
  misc_feature (1)..( 10): Result.001 file - promoters60/1012906
agaatttata

SEQ ID NO: 92203 - DNA, 10 bp, Unknown
  misc_feature (1)..( 10): Result.001 file - promoters60/1012906
tgaattgata

SEQ ID NO: 92204 - DNA, 9 bp, Unknown
  misc_feature (1)..( 9): Result.001 file - promoters60/1012906
tatattatt

SEQ ID NO: 92205 - DNA, 9 bp, Unknown
  misc_feature (1)..( 9): Result.001 file - promoters60/1012906
ccaattatt

SEQ ID NO: 92206 - DNA, 9 bp, Unknown
  misc_feature (1)..( 9): Result.001 file - promoters60/1012906
ccaataatt

SEQ ID NO: 92207 - DNA, 9 bp, Unknown
  misc_feature (1)..( 9): Result.001 file - promoters60/1012906
gaattgata

SEQ ID NO: 92208 - DNA, 9 bp, Unknown
  misc_feature (1)..( 9): Result.001 file - promoters60/1012906
gaagtgaag

SEQ ID NO: 92209 - DNA, 9 bp, Unknown
  misc_feature (1)..( 9): Result.001 file - promoters60/1012906
gaatttata

SEQ ID NO: 92210 - DNA, 9 bp, Unknown
  misc_feature (1)..( 9): Result.001 file - promoters60/1012906
taatcgtat

SEQ ID NO: 92211 - DNA, 9 bp, Unknown
  misc_feature (1)..( 9): Result.001 file - promoters60/1012906
aaatcatat

SEQ ID NO: 92212 - DNA, 9 bp, Unknown
  misc_feature (1)..( 9): Result.001 file - promoters60/1012912
aaataataa

SEQ ID NO: 92213 - DNA, 12 bp, Unknown
  misc_feature (1)..( 12): Result.001 file - promoters60/1012912
tttgaaaatata

SEQ ID NO: 92214 - DNA, 12 bp, Unknown
  misc_feature (1)..( 12): Result.001 file - promoters60/1012912
atgagaaagata

SEQ ID NO: 92215 - DNA, 12 bp, Unknown
  misc_feature (1)..( 12): Result.001 file - promoters60/1012912
tttgtaaataga

SEQ ID NO: 92216 - DNA, 12 bp, Unknown
  misc_feature (1)..( 12): Result.001 file - promoters60/1012912
cattgaaagaga

SEQ ID NO: 92217 - DNA, 12 bp, Unknown
  misc_feature (1)..( 12): Result.001 file - promoters60/1012912
acgaggaagatt

SEQ ID NO: 92218 - DNA, 8 bp, Unknown
  misc_feature (1)..( 8): Result.001 file - promoters60/1012912
atatcttc

SEQ ID NO: 92219 - DNA, 8 bp, Unknown
  misc_feature (1)..( 8): Result.001 file - promoters60/1012912
atatctag

SEQ ID NO: 92220 - DNA, 8 bp, Unknown
  misc_feature (1)..( 8): Result.001 file - promoters60/1012912
atatattc

SEQ ID NO: 92221 - DNA, 8 bp, Unknown
  misc_feature (1)..( 8): Result.001 file - promoters60/1012912
atagctat

SEQ ID NO: 92222 - DNA, 8 bp, Unknown
  misc_feature (1)..( 8): Result.001 file - promoters60/1012943
atagctgg

SEQ ID NO: 92223 - DNA, 12 bp, Unknown
  misc_feature (1)..( 12): Result.001 file - promoters60/1012943
ttaaaaataaat

SEQ ID NO: 92224 - DNA, 12 bp, Unknown
  misc_feature (1)..( 12): Result.001 file - promoters60/1012943
aagaaaataaat

SEQ ID NO: 92225 - DNA, 13 bp, Unknown
  misc_feature (1)..( 13): Result.001 file - promoters60/1012943
attaaagatatag

SEQ ID NO: 92226 - DNA, 13 bp, Unknown
  misc_feature (1)..( 13): Result.001 file - promoters60/1012943
aaaaaaaataaaa

SEQ ID NO: 92227 - DNA, 13 bp, Unknown
  misc_feature (1)..( 13): Result.001 file - promoters60/1012943
tataagtataaat

SEQ ID NO: 92228 - DNA, 14 bp, Unknown
  misc_feature (1)..( 14): Result.001 file - promoters60/1012943
tcaaaatgacaaaa

SEQ ID NO: 92229 - DNA, 14 bp, Unknown
  misc_feature (1)..( 14): Result.001 file - promoters60/1012943
tcacaatttagatt

SEQ ID NO: 92230 - DNA, 14 bp, Unknown
  misc_feature (1)..( 14): Result.001 file - promoters60/1012943
ccaaaatgaaaggt

SEQ ID NO: 92231 - DNA, 14 bp, Unknown
  misc_feature (1)..( 14): Result.001 file - promoters60/1012943
tgaaaaagaaaaag

SEQ ID NO: 92232 - DNA, 14 bp, Unknown
  misc_feature (1)..( 14): Result.001 file - promoters60/1012943
agaaaagaaatatg

SEQ ID NO: 92233 - DNA, 14 bp, Unknown
  misc_feature (1)..( 14): Result.001 file - promoters60/1012943
gggaaatgaaatat

SEQ ID NO: 92234 - DNA, 13 bp, Unknown
  misc_feature (1)..( 13): Result.001 file - promoters60/1012943
ataaaagataagt

SEQ ID NO: 92235 - DNA, 13 bp, Unknown
  misc_feature (1)..( 13): Result.001 file - promoters60/1012943
ttaaaatatagat

SEQ ID NO: 92236 - DNA, 13 bp, Unknown
  misc_feature (1)..( 13): Result.001 file - promoters60/1012943
atttaatataagt

SEQ ID NO: 92237 - DNA, 13 bp, Unknown
  misc_feature (1)..( 13): Result.001 file - promoters60/1012943
aaaaaaaataaaa

SEQ ID NO: 92238 - DNA, 13 bp, Unknown
  misc_feature (1)..( 13): Result.001 file - promoters60/1012943
taagaaaataaat

SEQ ID NO: 92239 - DNA, 12 bp, Unknown
  misc_feature (1)..( 12): Result.001 file - promoters60/1012943
gataagtaaagt

SEQ ID NO: 92240 - DNA, 12 bp, Unknown
  misc_feature (1)..( 12): Result.001 file - promoters60/1012943
aaaaagaaaaaa

SEQ ID NO: 92241 - DNA, 12 bp, Unknown
  misc_feature (1)..( 12): Result.001 file - promoters60/1012943
tgaaagaaaatc

SEQ ID NO: 92242 - DNA, 12 bp, Unknown
  misc_feature (1)..( 12): Result.001 file - promoters60/1012943
gaaaagaaatat

SEQ ID NO: 92243 - DNA, 12 bp, Unknown
  misc_feature (1)..( 12): Result.001 file - promoters60/1012943
gaaatgaaatat

SEQ ID NO: 92244 - DNA, 10 bp, Unknown
  misc_feature (1)..( 10): Result.001 file - promoters60/1012943
tttagataag

SEQ ID NO: 92245 - DNA, 10 bp, Unknown
  misc_feature (1)..( 10): Result.001 file - promoters60/1012943
aaaagaaaag

SEQ ID NO: 92246 - DNA, 10 bp, Unknown
  misc_feature (1)..( 10): Result.001 file - promoters60/1012943
accagaaaag

SEQ ID NO: 92247 - DNA, 10 bp, Unknown
  misc_feature (1)..( 10): Result.001 file - promoters60/1012943
aaatgaaata

SEQ ID NO: 92248 - DNA, 10 bp, Unknown
  misc_feature (1)..( 10): Result.001 file - promoters60/1012943
gaaagaaaat

SEQ ID NO: 92249 - DNA, 10 bp, Unknown
  misc_feature (1)..( 10): Result.001 file - promoters60/1012943
caccaataga

SEQ ID NO: 92250 - DNA, 10 bp, Unknown
  misc_feature (1)..( 10): Result.001 file - promoters60/1012943
caccaaaaaa

SEQ ID NO: 92251 - DNA, 10 bp, Unknown
  misc_feature (1)..( 10): Result.001 file - promoters60/1012943
caccaaaccc

SEQ ID NO: 92252 - DNA, 11 bp, Unknown
  misc_feature (1)..( 11): Result.001 file - promoters60/1012943
aaccgaaaaaa

SEQ ID NO: 92253 - DNA, 11 bp, Unknown
  misc_feature (1)..( 11): Result.001 file - promoters60/1012943
gtttgaaaaaa

SEQ ID NO: 92254 - DNA, 12 bp, Unknown
  misc_feature (1)..( 12): Result.001 file - promoters60/1012943
gtaaattcattg

SEQ ID NO: 92255 - DNA, 12 bp, Unknown
  misc_feature (1)..( 12): Result.001 file - promoters60/1012943
ttaaattatttt

SEQ ID NO: 92256 - DNA, 12 bp, Unknown
  misc_feature (1)..( 12): Result.001 file - promoters60/1012943
ccaaatgatttg

SEQ ID NO: 92257 - DNA, 12 bp, Unknown
  misc_feature (1)..( 12): Result.001 file - promoters60/1012943
ttccatgatttg

SEQ ID NO: 92258 - DNA, 12 bp, Unknown
  misc_feature (1)..( 12): Result.001 file - promoters60/1012984
ttacattttaca

SEQ ID NO: 92259 - DNA, 8 bp, Unknown
  misc_feature (1)..( 8): Result.001 file - promoters60/1012984
tttgtgaa

SEQ ID NO: 92260 - DNA, 8 bp, Unknown
  misc_feature (1)..( 8): Result.001 file - promoters60/1012984
tttttgaa

SEQ ID NO: 92261 - DNA, 12 bp, Unknown
  misc_feature (1)..( 12): Result.001 file - promoters60/1012984
aatagacataga

SEQ ID NO: 92262 - DNA, 12 bp, Unknown
  misc_feature (1)..( 12): Result.001 file - promoters60/1012984
ggtagagataga

SEQ ID NO: 92263 - DNA, 12 bp, Unknown
  misc_feature (1)..( 12): Result.001 file - promoters60/1012984
ggtggagagagg

SEQ ID NO: 92264 - DNA, 8 bp, Unknown
  misc_feature (1)..( 8): Result.001 file - promoters60/1012984
ttgatatt

SEQ ID NO: 92265 - DNA, 8 bp, Unknown
  misc_feature (1)..( 8): Result.001 file - promoters60/1012984
ttgaaatt

SEQ ID NO: 92266 - DNA, 7 bp, Unknown
  misc_feature (1)..( 7): Result.001 file - promoters60/1012984
tggattt

SEQ ID NO: 92267 - DNA, 7 bp, Unknown
  misc_feature (1)..( 7): Result.001 file - promoters60/1012984
tggtttt

SEQ ID NO: 92268 - DNA, 8 bp, Unknown
  misc_feature (1)..( 8): Result.001 file - promoters60/1012984
tgaaattt

SEQ ID NO: 92269 - DNA, 8 bp, Unknown
  misc_feature (1)..( 8): Result.001 file - promoters60/1012984
tgaaattt

SEQ ID NO: 92270 - DNA, 6 bp, Unknown
  misc_feature (1)..( 6): Result.001 file - promoters60/1012984
atacag

SEQ ID NO: 92271 - DNA, 6 bp, Unknown
  misc_feature (1)..( 6): Result.001 file - promoters60/1012984
atacag

SEQ ID NO: 92272 - DNA, 7 bp, Unknown
  misc_feature (1)..( 7): Result.001 file - promoters60/1012984
cggtttg

SEQ ID NO: 92273 - DNA, 7 bp, Unknown
  misc_feature (1)..( 7): Result.001 file - promoters60/1013121
cggtttg

SEQ ID NO: 92274 - DNA, 9 bp, Unknown
  misc_feature (1)..( 9): Result.001 file - promoters60/1013121
gaaaagaaa

SEQ ID NO: 92275 - DNA, 9 bp, Unknown
  misc_feature (1)..( 9): Result.001 file - promoters60/1013121
caaaacaaa

SEQ ID NO: 92276 - DNA, 9 bp, Unknown
  misc_feature (1)..( 9): Result.001 file - promoters60/1013121
gaaacgaaa

SEQ ID NO: 92277 - DNA, 9 bp, Unknown
  misc_feature (1)..( 9): Result.001 file - promoters60/1013121
gaaaagtct

SEQ ID NO: 92278 - DNA, 12 bp, Unknown
  misc_feature (1)..( 12): Result.001 file - promoters60/1013121
ttaaatttaaac

SEQ ID NO: 92279 - DNA, 12 bp, Unknown
  misc_feature (1)..( 12): Result.001 file - promoters60/1013121
tccaatctaaac

SEQ ID NO: 92280 - DNA, 12 bp, Unknown
  misc_feature (1)..( 12): Result.001 file - promoters60/1013121
agtaatttttgg

SEQ ID NO: 92281 - DNA, 12 bp, Unknown
  misc_feature (1)..( 12): Result.001 file - promoters60/1013121
aaatattcaaag

SEQ ID NO: 92282 - DNA, 12 bp, Unknown
  misc_feature (1)..( 12): Result.001 file - promoters60/1013121
tccaatctgcta

SEQ ID NO: 92283 - DNA, 10 bp, Unknown
  misc_feature (1)..( 10): Result.001 file - promoters60/1013121
gatttctgat

SEQ ID NO: 92284 - DNA, 10 bp, Unknown
  misc_feature (1)..( 10): Result.001 file - promoters60/1013121
gatttcagtt

SEQ ID NO: 92285 - DNA, 10 bp, Unknown
  misc_feature (1)..( 10): Result.001 file - promoters60/1013121
tatttaattt

SEQ ID NO: 92286 - DNA, 10 bp, Unknown
  misc_feature (1)..( 10): Result.001 file - promoters60/1013128
gatttaacaa

SEQ ID NO: 92287 - DNA, 9 bp, Unknown
  misc_feature (1)..( 9): Result.001 file - promoters60/1013128
gtatatata

SEQ ID NO: 92288 - DNA, 9 bp, Unknown
  misc_feature (1)..( 9): Result.001 file - promoters60/1013128
atatataaa

SEQ ID NO: 92289 - DNA, 9 bp, Unknown
  misc_feature (1)..( 9): Result.001 file - promoters60/1013128
ctataaata

SEQ ID NO: 92290 - DNA, 9 bp, Unknown
  misc_feature (1)..( 9): Result.001 file - promoters60/1013128
atataaagg

SEQ ID NO: 92291 - DNA, 13 bp, Unknown
  misc_feature (1)..( 13): Result.001 file - promoters60/1013128
gactaaaataaag

SEQ ID NO: 92292 - DNA, 13 bp, Unknown
  misc_feature (1)..( 13): Result.001 file - promoters60/1013128
tgaaaaaatagtt

SEQ ID NO: 92293 - DNA, 13 bp, Unknown
  misc_feature (1)..( 13): Result.001 file - promoters60/1013128
agagaaaaaaaag

SEQ ID NO: 92294 - DNA, 13 bp, Unknown
  misc_feature (1)..( 13): Result.001 file - promoters60/1013190
agagaaaggaaga

SEQ ID NO: 92295 - DNA, 8 bp, Unknown
  misc_feature (1)..( 8): Result.001 file - promoters60/1013190
taattaaa

SEQ ID NO: 92296 - DNA, 8 bp, Unknown
  misc_feature (1)..( 8): Result.001 file - promoters60/1013190
gaattaaa

SEQ ID NO: 92297 - DNA, 8 bp, Unknown
  misc_feature (1)..( 8): Result.001 file - promoters60/1013190
gaattacc

SEQ ID NO: 92298 - DNA, 8 bp, Unknown
  misc_feature (1)..( 8): Result.001 file - promoters60/1013190
aaaaaaaa

SEQ ID NO: 92299 - DNA, 8 bp, Unknown
  misc_feature (1)..( 8): Result.001 file - promoters60/1013190
aaaataaa

SEQ ID NO: 92300 - DNA, 7 bp, Unknown
  misc_feature (1)..( 7): Result.001 file - promoters60/1013190
attaaaa

SEQ ID NO: 92301 - DNA, 7 bp, Unknown
  misc_feature (1)..( 7): Result.001 file - promoters60/1013190
attaaaa

SEQ ID NO: 92302 - DNA, 8 bp, Unknown
  misc_feature (1)..( 8): Result.001 file - promoters60/1013190
ccaaagat

SEQ ID NO: 92303 - DNA, 8 bp, Unknown
  misc_feature (1)..( 8): Result.001 file - promoters60/1013190
ccaaagaa

SEQ ID NO: 92304 - DNA, 8 bp, Unknown
  misc_feature (1)..( 8): Result.001 file - promoters60/1013190
tgaaagaa

SEQ ID NO: 92305 - DNA, 7 bp, Unknown
  misc_feature (1)..( 7): Result.001 file - promoters60/1013190
tttattt

SEQ ID NO: 92306 - DNA, 7 bp, Unknown
  misc_feature (1)..( 7): Result.001 file - promoters60/1013190
tttattt

SEQ ID NO: 92307 - DNA, 7 bp, Unknown
  misc_feature (1)..( 7): Result.001 file - promoters60/1013190
ggtttta

SEQ ID NO: 92308 - DNA, 7 bp, Unknown
  misc_feature (1)..( 7): Result.001 file - promoters60/1013190
ggtatta

SEQ ID NO: 92309 - DNA, 6 bp, Unknown
  misc_feature (1)..( 6): Result.001 file - promoters60/1013190
taaaag

SEQ ID NO: 92310 - DNA, 6 bp, Unknown
  misc_feature (1)..( 6): Result.001 file - promoters60/1013190
taaaag

SEQ ID NO: 92311 - DNA, 6 bp, Unknown
  misc_feature (1)..( 6): Result.001 file - promoters60/1013190
aaaatt

SEQ ID NO: 92312 - DNA, 6 bp, Unknown
  misc_feature (1)..( 6): Result.001 file - promoters60/1013190
aaaatt

SEQ ID NO: 92313 - DNA, 9 bp, Unknown
  misc_feature (1)..( 9): Result.001 file - promoters60/1013190
gaatattat

SEQ ID NO: 92314 - DNA, 9 bp, Unknown
  misc_feature (1)..( 9): Result.001 file - promoters60/1013190
gaatatctt

SEQ ID NO: 92315 - DNA, 9 bp, Unknown
  misc_feature (1)..( 9): Result.001 file - promoters60/1013190
gaaaaaata

SEQ ID NO: 92316 - DNA, 6 bp, Unknown
  misc_feature (1)..( 6): Result.001 file - promoters60/1013190
tgaaat

SEQ ID NO: 92317 - DNA, 6 bp, Unknown
  misc_feature (1)..( 6): Result.001 file - promoters60/1013190
tgaaat

SEQ ID NO: 92318 - DNA, 8 bp, Unknown
  misc_feature (1)..( 8): Result.001 file - promoters60/1013190
aattatta

SEQ ID NO: 92319 - DNA, 8 bp, Unknown
  misc_feature (1)..( 8): Result.001 file - promoters60/1013190
aataatta

SEQ ID NO: 92320 - DNA, 6 bp, Unknown
  misc_feature (1)..( 6): Result.001 file - promoters60/1013190
agttct

SEQ ID NO: 92321 - DNA, 6 bp, Unknown
  misc_feature (1)..( 6): Result.001 file - promoters60/1013190
agttct

SEQ ID NO: 92322 - DNA, 7 bp, Unknown
  misc_feature (1)..( 7): Result.001 file - promoters60/1013190
tataaac

SEQ ID NO: 92323 - DNA, 7 bp, Unknown
  misc_feature (1)..( 7): Result.001 file - promoters60/1013190
tattaac

SEQ ID NO: 92324 - DNA, 6 bp, Unknown
  misc_feature (1)..( 6): Result.001 file - promoters60/1013190
aaacat

SEQ ID NO: 92325 - DNA, 6 bp, Unknown
  misc_feature (1)..( 6): Result.001 file - promoters60/1013190
aaacat

SEQ ID NO: 92326 - DNA, 8 bp, Unknown
  misc_feature (1)..( 8): Result.001 file - promoters60/1013190
tttagctt

SEQ ID NO: 92327 - DNA, 8 bp, Unknown
  misc_feature (1)..( 8): Result.001 file - promoters60/1013190
tttatctt

SEQ ID NO: 92328 - DNA, 6 bp, Unknown
  misc_feature (1)..( 6): Result.001 file - promoters60/1013190
gcggaa

SEQ ID NO: 92329 - DNA, 6 bp, Unknown
  misc_feature (1)..( 6): Result.001 file - promoters60/1013190
gcggaa

SEQ ID NO: 92330 - DNA, 7 bp, Unknown
  misc_feature (1)..( 7): Result.001 file - promoters60/1013190
tattttc

SEQ ID NO: 92331 - DNA, 7 bp, Unknown
  misc_feature (1)..( 7): Result.001 file - promoters60/1013190
tatcttc

SEQ ID NO: 92332 - DNA, 6 bp, Unknown
  misc_feature (1)..( 6): Result.001 file - promoters60/1013190
tccttg

SEQ ID NO: 92333 - DNA, 6 bp, Unknown
  misc_feature (1)..( 6): Result.001 file - promoters60/1013190
tccttg

SEQ ID NO: 92334 - DNA, 7 bp, Unknown
  misc_feature (1)..( 7): Result.001 file - promoters60/1013190
gatatat

SEQ ID NO: 92335 - DNA, 7 bp, Unknown
  misc_feature (1)..( 7): Result.001 file - promoters60/1013208
gatgtat

SEQ ID NO: 92336 - DNA, 10 bp, Unknown
  misc_feature (1)..( 10): Result.001 file - promoters60/1013208
ctttcaattg

SEQ ID NO: 92337 - DNA, 10 bp, Unknown
  misc_feature (1)..( 10): Result.001 file - promoters60/1013208
agttccattt

SEQ ID NO: 92338 - DNA, 10 bp, Unknown
  misc_feature (1)..( 10): Result.001 file - promoters60/1013208
atttaaatcc

SEQ ID NO: 92339 - DNA, 10 bp, Unknown
  misc_feature (1)..( 10): Result.001 file - promoters60/1013208
ctttcatttg

SEQ ID NO: 92340 - DNA, 10 bp, Unknown
  misc_feature (1)..( 10): Result.001 file - promoters60/1013208
gctacatttg

SEQ ID NO: 92341 - DNA, 10 bp, Unknown
  misc_feature (1)..( 10): Result.001 file - promoters60/1013208
aattaaatca

SEQ ID NO: 92342 - DNA, 10 bp, Unknown
  misc_feature (1)..( 10): Result.001 file - promoters60/1013208
aaataaatcg

SEQ ID NO: 92343 - DNA, 12 bp, Unknown
  misc_feature (1)..( 12): Result.001 file - promoters60/1013208
aaatgaaaaatg

SEQ ID NO: 92344 - DNA, 12 bp, Unknown
  misc_feature (1)..( 12): Result.001 file - promoters60/1013208
aaaagaaattat

SEQ ID NO: 92345 - DNA, 12 bp, Unknown
  misc_feature (1)..( 12): Result.001 file - promoters60/1013208
aaatcaaattta

SEQ ID NO: 92346 - DNA, 12 bp, Unknown
  misc_feature (1)..( 12): Result.001 file - promoters60/1013208
ctatcaaaatta

SEQ ID NO: 92347 - DNA, 12 bp, Unknown
  misc_feature (1)..( 12): Result.001 file - promoters60/1013208
aaatttaaaaat

SEQ ID NO: 92348 - DNA, 12 bp, Unknown
  misc_feature (1)..( 12): Result.001 file - promoters60/1013208
gattgaaatcat

SEQ ID NO: 92349 - DNA, 9 bp, Unknown
  misc_feature (1)..( 9): Result.001 file - promoters60/1013208
gaataaaaa

SEQ ID NO: 92350 - DNA, 9 bp, Unknown
  misc_feature (1)..( 9): Result.001 file - promoters60/1013208
taataaaaa

SEQ ID NO: 92351 - DNA, 9 bp, Unknown
  misc_feature (1)..( 9): Result.001 file - promoters60/1013208
taatcaaat

SEQ ID NO: 92352 - DNA, 9 bp, Unknown
  misc_feature (1)..( 9): Result.001 file - promoters60/1013208
ctatagaaa

SEQ ID NO: 92353 - DNA, 9 bp, Unknown
  misc_feature (1)..( 9): Result.001 file - promoters60/1013208
gaacaaaga

SEQ ID NO: 92354 - DNA, 9 bp, Unknown
  misc_feature (1)..( 9): Result.001 file - promoters60/1013208
tcataaaat

SEQ ID NO: 92355 - DNA, 11 bp, Unknown
  misc_feature (1)..( 11): Result.001 file - promoters60/1013208
attttaatctc

SEQ ID NO: 92356 - DNA, 11 bp, Unknown
  misc_feature (1)..( 11): Result.001 file - promoters60/1013208
tttttattcta

SEQ ID NO: 92357 - DNA, 11 bp, Unknown
  misc_feature (1)..( 11): Result.001 file - promoters60/1013208
attttatcttt

SEQ ID NO: 92358 - DNA, 11 bp, Unknown
  misc_feature (1)..( 11): Result.001 file - promoters60/1013208
gttgtattcta

SEQ ID NO: 92359 - DNA, 11 bp, Unknown
  misc_feature (1)..( 11): Result.001 file - promoters60/1013208
tctttgttcaa

SEQ ID NO: 92360 - DNA, 11 bp, Unknown
  misc_feature (1)..( 11): Result.001 file - promoters60/1013208
caattaatctc

SEQ ID NO: 92361 - DNA, 11 bp, Unknown
  misc_feature (1)..( 11): Result.001 file - promoters60/1013208
tttttacggcg

SEQ ID NO: 92362 - DNA, 9 bp, Unknown
  misc_feature (1)..( 9): Result.001 file - promoters60/1013208
tgaaaaatg

SEQ ID NO: 92363 - DNA, 9 bp, Unknown
  misc_feature (1)..( 9): Result.001 file - promoters60/1013208
ttaaaaata

SEQ ID NO: 92364 - DNA, 9 bp, Unknown
  misc_feature (1)..( 9): Result.001 file - promoters60/1013208
ttataaacc

SEQ ID NO: 92365 - DNA, 9 bp, Unknown
  misc_feature (1)..( 9): Result.001 file - promoters60/1013208
gcaaaaata

SEQ ID NO: 92366 - DNA, 9 bp, Unknown
  misc_feature (1)..( 9): Result.001 file - promoters60/1013208
ttaaaaatt

SEQ ID NO: 92367 - DNA, 9 bp, Unknown
  misc_feature (1)..( 9): Result.001 file - promoters60/1013208
atcaaaatt

SEQ ID NO: 92368 - DNA, 11 bp, Unknown
  misc_feature (1)..( 11): Result.001 file - promoters60/1013208
aggaaagtaat

SEQ ID NO: 92369 - DNA, 11 bp, Unknown
  misc_feature (1)..( 11): Result.001 file - promoters60/1013208
gttaaattaac

SEQ ID NO: 92370 - DNA, 11 bp, Unknown
  misc_feature (1)..( 11): Result.001 file - promoters60/1013208
catgaagaaat

SEQ ID NO: 92371 - DNA, 11 bp, Unknown
  misc_feature (1)..( 11): Result.001 file - promoters60/1013208
acgaaaaaaac

SEQ ID NO: 92372 - DNA, 11 bp, Unknown
  misc_feature (1)..( 11): Result.001 file - promoters60/1013208
aagaaataaat

SEQ ID NO: 92373 - DNA, 11 bp, Unknown
  misc_feature (1)..( 11): Result.001 file - promoters60/1013208
aataaattaaa

SEQ ID NO: 92374 - DNA, 11 bp, Unknown
  misc_feature (1)..( 11): Result.001 file - promoters60/1013208
aaatttgttgt

SEQ ID NO: 92375 - DNA, 11 bp, Unknown
  misc_feature (1)..( 11): Result.001 file - promoters60/1013208
ttctttgttca

SEQ ID NO: 92376 - DNA, 11 bp, Unknown
  misc_feature (1)..( 11): Result.001 file - promoters60/1013208
aaatatgttaa

SEQ ID NO: 92377 - DNA, 11 bp, Unknown
  misc_feature (1)..( 11): Result.001 file - promoters60/1013208
atttttattct

SEQ ID NO: 92378 - DNA, 11 bp, Unknown
  misc_feature (1)..( 11): Result.001 file - promoters60/1013208
tcaattaatct

SEQ ID NO: 92379 - DNA, 11 bp, Unknown
  misc_feature (1)..( 11): Result.001 file - promoters60/1013208
taaataaataa

SEQ ID NO: 92380 - DNA, 11 bp, Unknown
  misc_feature (1)..( 11): Result.001 file - promoters60/1013208
tactatgttgc

SEQ ID NO: 92381 - DNA, 9 bp, Unknown
  misc_feature (1)..( 9): Result.001 file - promoters60/1013208
atagttaag

SEQ ID NO: 92382 - DNA, 9 bp, Unknown
  misc_feature (1)..( 9): Result.001 file - promoters60/1013208
atatttagg

SEQ ID NO: 92383 - DNA, 9 bp, Unknown
  misc_feature (1)..( 9): Result.001 file - promoters60/1013208
ataattaaa

SEQ ID NO: 92384 - DNA, 9 bp, Unknown
  misc_feature (1)..( 9): Result.001 file - promoters60/1013208
gtaataaaa

SEQ ID NO: 92385 - DNA, 9 bp, Unknown
  misc_feature (1)..( 9): Result.001 file - promoters60/1013208
aaaattaaa

SEQ ID NO: 92386 - DNA, 9 bp, Unknown
  misc_feature (1)..( 9): Result.001 file - promoters60/1013208
caaataaaa

SEQ ID NO: 92387 - DNA, 8 bp, Unknown
  misc_feature (1)..( 8): Result.001 file - promoters60/1013208
caaaaaag

SEQ ID NO: 92388 - DNA, 8 bp, Unknown
  misc_feature (1)..( 8): Result.001 file - promoters60/1013208
caaaaata

SEQ ID NO: 92389 - DNA, 8 bp, Unknown
  misc_feature (1)..( 8): Result.001 file - promoters60/1013208
taaaaaac

SEQ ID NO: 92390 - DNA, 8 bp, Unknown
  misc_feature (1)..( 8): Result.001 file - promoters60/1013208
taaaaatt

SEQ ID NO: 92391 - DNA, 8 bp, Unknown
  misc_feature (1)..( 8): Result.001 file - promoters60/1013208
gaaacact

SEQ ID NO: 92392 - DNA, 8 bp, Unknown
  misc_feature (1)..( 8): Result.001 file - promoters60/1013208
tcaaaatt

SEQ ID NO: 92393 - DNA, 13 bp, Unknown
  misc_feature (1)..( 13): Result.001 file - promoters60/1013208
ttcctaaaaagtg

SEQ ID NO: 92394 - DNA, 13 bp, Unknown
  misc_feature (1)..( 13): Result.001 file - promoters60/1013208
taaataaaaaaaa

SEQ ID NO: 92395 - DNA, 14 bp, Unknown
  misc_feature (1)..( 14): Result.001 file - promoters60/1013208
ggtttaataaataa

SEQ ID NO: 92396 - DNA, 14 bp, Unknown
  misc_feature (1)..( 14): Result.001 file - promoters60/1013208
gaagaaataaataa

SEQ ID NO: 92397 - DNA, 14 bp, Unknown
  misc_feature (1)..( 14): Result.001 file - promoters60/1013208
aaagaaataaatct

SEQ ID NO: 92398 - DNA, 14 bp, Unknown
  misc_feature (1)..( 14): Result.001 file - promoters60/1013208
aacgaaacaaattc

SEQ ID NO: 92399 - DNA, 17 bp, Unknown
  misc_feature (1)..( 17): Result.001 file - promoters60/1013208
acgaaaaaaacagagct

SEQ ID NO: 92400 - DNA, 17 bp, Unknown
  misc_feature (1)..( 17): Result.001 file - promoters60/1013208
acgaaacaaattcataa

SEQ ID NO: 92401 - DNA, 17 bp, Unknown
  misc_feature (1)..( 17): Result.001 file - promoters60/1013208
taaaaaaaaactttaaa

SEQ ID NO: 92402 - DNA, 17 bp, Unknown
  misc_feature (1)..( 17): Result.001 file - promoters60/1013208
aagaaataaataatttc

SEQ ID NO: 92403 - DNA, 17 bp, Unknown
  misc_feature (1)..( 17): Result.001 file - promoters60/1013208
aagaaataaatcttttt

SEQ ID NO: 92404 - DNA, 17 bp, Unknown
  misc_feature (1)..( 17): Result.001 file - promoters60/1013242
tttttgtccatctcttt

SEQ ID NO: 92405 - DNA, 10 bp, Unknown
  misc_feature (1)..( 10): Result.001 file - promoters60/1013242
ttataagttt

SEQ ID NO: 92406 - DNA, 10 bp, Unknown
  misc_feature (1)..( 10): Result.001 file - promoters60/1013242
ttttaaattt

SEQ ID NO: 92407 - DNA, 10 bp, Unknown
  misc_feature (1)..( 10): Result.001 file - promoters60/1013242
ttttacattt

SEQ ID NO: 92408 - DNA, 10 bp, Unknown
  misc_feature (1)..( 10): Result.001 file - promoters60/1013242
gtttaacaaa

SEQ ID NO: 92409 - DNA, 10 bp, Unknown
  misc_feature (1)..( 10): Result.001 file - promoters60/1013242
ttttgacaca

SEQ ID NO: 92410 - DNA, 10 bp, Unknown
  misc_feature (1)..( 10): Result.001 file - promoters60/1013242
gtctacatta

SEQ ID NO: 92411 - DNA, 12 bp, Unknown
  misc_feature (1)..( 12): Result.001 file - promoters60/1013242
atttttaaattt

SEQ ID NO: 92412 - DNA, 12 bp, Unknown
  misc_feature (1)..( 12): Result.001 file - promoters60/1013242
ctttttaaccgt

SEQ ID NO: 92413 - DNA, 12 bp, Unknown
  misc_feature (1)..( 12): Result.001 file - promoters60/1013242
aattttacattt

SEQ ID NO: 92414 - DNA, 12 bp, Unknown
  misc_feature (1)..( 12): Result.001 file - promoters60/1013242
ttgtttaacaaa

SEQ ID NO: 92415 - DNA, 12 bp, Unknown
  misc_feature (1)..( 12): Result.001 file - promoters60/1013242
ctttttgacaca

SEQ ID NO: 92416 - DNA, 12 bp, Unknown
  misc_feature (1)..( 12): Result.001 file - promoters60/1013274
tcgtctacatta

SEQ ID NO: 92417 - DNA, 13 bp, Unknown
  misc_feature (1)..( 13): Result.001 file - promoters60/1013274
gtatatattgttt

SEQ ID NO: 92418 - DNA, 13 bp, Unknown
  misc_feature (1)..( 13): Result.001 file - promoters60/1013274
ttatctatttttt

SEQ ID NO: 92419 - DNA, 13 bp, Unknown
  misc_feature (1)..( 13): Result.001 file - promoters60/1013274
ctttctctgattt

SEQ ID NO: 92420 - DNA, 13 bp, Unknown
  misc_feature (1)..( 13): Result.001 file - promoters60/1013274
ttatatatgtttc

SEQ ID NO: 92421 - DNA, 13 bp, Unknown
  misc_feature (1)..( 13): Result.001 file - promoters60/1013274
ttgtaaatgtttc

SEQ ID NO: 92422 - DNA, 10 bp, Unknown
  misc_feature (1)..( 10): Result.001 file - promoters60/1013274
aatatataat

SEQ ID NO: 92423 - DNA, 10 bp, Unknown
  misc_feature (1)..( 10): Result.001 file - promoters60/1013274
catatattag

SEQ ID NO: 92424 - DNA, 10 bp, Unknown
  misc_feature (1)..( 10): Result.001 file - promoters60/1013274
aatataaagg

SEQ ID NO: 92425 - DNA, 10 bp, Unknown
  misc_feature (1)..( 10): Result.001 file - promoters60/1013274
actatttaaa

SEQ ID NO: 92426 - DNA, 10 bp, Unknown
  misc_feature (1)..( 10): Result.001 file - promoters60/1013274
gtgctttaaa

SEQ ID NO: 92427 - DNA, 10 bp, Unknown
  misc_feature (1)..( 10): Result.001 file - promoters60/1013274
aagataaatg

SEQ ID NO: 92428 - DNA, 10 bp, Unknown
  misc_feature (1)..( 10): Result.001 file - promoters60/1013274
acaataaata

SEQ ID NO: 92429 - DNA, 10 bp, Unknown
  misc_feature (1)..( 10): Result.001 file - promoters60/1013274
aaaagaaaaa

SEQ ID NO: 92430 - DNA, 10 bp, Unknown
  misc_feature (1)..( 10): Result.001 file - promoters60/1013274
taaagcaaat

SEQ ID NO: 92431 - DNA, 10 bp, Unknown
  misc_feature (1)..( 10): Result.001 file - promoters60/1013274
agaagaaaac

SEQ ID NO: 92432 - DNA, 10 bp, Unknown
  misc_feature (1)..( 10): Result.001 file - promoters60/1013274
tctagaaaat

SEQ ID NO: 92433 - DNA, 9 bp, Unknown
  misc_feature (1)..( 9): Result.001 file - promoters60/1013274
tgtttgttc

SEQ ID NO: 92434 - DNA, 9 bp, Unknown
  misc_feature (1)..( 9): Result.001 file - promoters60/1013274
tttttgttg

SEQ ID NO: 92435 - DNA, 9 bp, Unknown
  misc_feature (1)..( 9): Result.001 file - promoters60/1013274
tttttgttc

SEQ ID NO: 92436 - DNA, 9 bp, Unknown
  misc_feature (1)..( 9): Result.001 file - promoters60/1013274
tttttgtct

SEQ ID NO: 92437 - DNA, 9 bp, Unknown
  misc_feature (1)..( 9): Result.001 file - promoters60/1013274
tatttgttc

SEQ ID NO: 92438 - DNA, 11 bp, Unknown
  misc_feature (1)..( 11): Result.001 file - promoters60/1013274
catttttcttt

SEQ ID NO: 92439 - DNA, 11 bp, Unknown
  misc_feature (1)..( 11): Result.001 file - promoters60/1013274
gattttttttt

SEQ ID NO: 92440 - DNA, 11 bp, Unknown
  misc_feature (1)..( 11): Result.001 file - promoters60/1013274
catttttgttc

SEQ ID NO: 92441 - DNA, 11 bp, Unknown
  misc_feature (1)..( 11): Result.001 file - promoters60/1013274
actttctctga

SEQ ID NO: 92442 - DNA, 11 bp, Unknown
  misc_feature (1)..( 11): Result.001 file - promoters60/1013274
cgtttttgtct

SEQ ID NO: 92443 - DNA, 11 bp, Unknown
  misc_feature (1)..( 11): Result.001 file - promoters60/1013274
aactttaaata

SEQ ID NO: 92444 - DNA, 11 bp, Unknown
  misc_feature (1)..( 11): Result.001 file - promoters60/1013274
ggctttaacca

SEQ ID NO: 92445 - DNA, 11 bp, Unknown
  misc_feature (1)..( 11): Result.001 file - promoters60/1013274
aacttgaaatt

SEQ ID NO: 92446 - DNA, 11 bp, Unknown
  misc_feature (1)..( 11): Result.001 file - promoters60/1013274
ttttttaacaa

SEQ ID NO: 92447 - DNA, 11 bp, Unknown
  misc_feature (1)..( 11): Result.001 file - promoters60/1013298
aaaaagaaatt

SEQ ID NO: 92448 - DNA, 6 bp, Unknown
  misc_feature (1)..( 6): Result.001 file - promoters60/1013298
ctttca

SEQ ID NO: 92449 - DNA, 6 bp, Unknown
  misc_feature (1)..( 6): Result.001 file - promoters60/1013298
ctttca

SEQ ID NO: 92450 - DNA, 6 bp, Unknown
  misc_feature (1)..( 6): Result.001 file - promoters60/1013298
agacta

SEQ ID NO: 92451 - DNA, 6 bp, Unknown
  misc_feature (1)..( 6): Result.001 file - promoters60/1013298
agacta

SEQ ID NO: 92452 - DNA, 7 bp, Unknown
  misc_feature (1)..( 7): Result.001 file - promoters60/1013298
aaattta

SEQ ID NO: 92453 - DNA, 7 bp, Unknown
  misc_feature (1)..( 7): Result.001 file - promoters60/1013298
aaaatta

SEQ ID NO: 92454 - DNA, 6 bp, Unknown
  misc_feature (1)..( 6): Result.001 file - promoters60/1013298
ttgaag

SEQ ID NO: 92455 - DNA, 6 bp, Unknown
  misc_feature (1)..( 6): Result.001 file - promoters60/1013298
ttgaag

SEQ ID NO: 92456 - DNA, 7 bp, Unknown
  misc_feature (1)..( 7): Result.001 file - promoters60/1013298
tttaaat

SEQ ID NO: 92457 - DNA, 7 bp, Unknown
  misc_feature (1)..( 7): Result.001 file - promoters60/1013298
tttgaat

SEQ ID NO: 92458 - DNA, 7 bp, Unknown
  misc_feature (1)..( 7): Result.001 file - promoters60/1013298
ttttgtt

SEQ ID NO: 92459 - DNA, 7 bp, Unknown
  misc_feature (1)..( 7): Result.001 file - promoters60/1013298
ttttgtt

SEQ ID NO: 92460 - DNA, 7 bp, Unknown
  misc_feature (1)..( 7): Result.001 file - promoters60/1013298
attttaa

SEQ ID NO: 92461 - DNA, 7 bp, Unknown
  misc_feature (1)..( 7): Result.001 file - promoters60/1013298
attttaa

SEQ ID NO: 92462 - DNA, 7 bp, Unknown
  misc_feature (1)..( 7): Result.001 file - promoters60/1013298
ttaattt

SEQ ID NO: 92463 - DNA, 7 bp, Unknown
  misc_feature (1)..( 7): Result.001 file - promoters60/1013298
ttagttt

SEQ ID NO: 92464 - DNA, 8 bp, Unknown
  misc_feature (1)..( 8): Result.001 file - promoters60/1013298
gtcatttt

SEQ ID NO: 92465 - DNA, 8 bp, Unknown
  misc_feature (1)..( 8): Result.001 file - promoters60/1013298
gtcctttt

SEQ ID NO: 92466 - DNA, 8 bp, Unknown
  misc_feature (1)..( 8): Result.001 file - promoters60/1013298
ttttatgg

SEQ ID NO: 92467 - DNA, 8 bp, Unknown
  misc_feature (1)..( 8): Result.001 file - promoters60/1013298
ttttttgg

SEQ ID NO: 92468 - DNA, 6 bp, Unknown
  misc_feature (1)..( 6): Result.001 file - promoters60/1013298
atcaaa

SEQ ID NO: 92469 - DNA, 6 bp, Unknown
  misc_feature (1)..( 6): Result.001 file - promoters60/1013298
atcaaa

SEQ ID NO: 92470 - DNA, 7 bp, Unknown
  misc_feature (1)..( 7): Result.001 file - promoters60/1013298
ttaatat

SEQ ID NO: 92471 - DNA, 7 bp, Unknown
  misc_feature (1)..( 7): Result.001 file - promoters60/1013298
ttagtat

SEQ ID NO: 92472 - DNA, 8 bp, Unknown
  misc_feature (1)..( 8): Result.001 file - promoters60/1013298
ttggcttt

SEQ ID NO: 92473 - DNA, 8 bp, Unknown
  misc_feature (1)..( 8): Result.001 file - promoters60/1013298
ttggattt

SEQ ID NO: 92474 - DNA, 6 bp, Unknown
  misc_feature (1)..( 6): Result.001 file - promoters60/1013298
ttccat

SEQ ID NO: 92475 - DNA, 6 bp, Unknown
  misc_feature (1)..( 6): Result.001 file - promoters60/1013298
ttccat

SEQ ID NO: 92476 - DNA, 8 bp, Unknown
  misc_feature (1)..( 8): Result.001 file - promoters60/1013298
atgctttt

SEQ ID NO: 92477 - DNA, 8 bp, Unknown
  misc_feature (1)..( 8): Result.001 file - promoters60/1013298
atgttttt

SEQ ID NO: 92478 - DNA, 6 bp, Unknown
  misc_feature (1)..( 6): Result.001 file - promoters60/1013298
ttctca

SEQ ID NO: 92479 - DNA, 6 bp, Unknown
  misc_feature (1)..( 6): Result.001 file - promoters60/1013298
ttctca

SEQ ID NO: 92480 - DNA, 6 bp, Unknown
  misc_feature (1)..( 6): Result.001 file - promoters60/1013298
tgtctc

SEQ ID NO: 92481 - DNA, 6 bp, Unknown
  misc_feature (1)..( 6): Result.001 file - promoters60/1013298
tgtctc

SEQ ID NO: 92482 - DNA, 6 bp, Unknown
  misc_feature (1)..( 6): Result.001 file - promoters60/1013298
tatttt

SEQ ID NO: 92483 - DNA, 6 bp, Unknown
  misc_feature (1)..( 6): Result.001 file - promoters60/1013298
tatttt

SEQ ID NO: 92484 - DNA, 8 bp, Unknown
  misc_feature (1)..( 8): Result.001 file - promoters60/1013298
caattgat

SEQ ID NO: 92485 - DNA, 8 bp, Unknown
  misc_feature (1)..( 8): Result.001 file - promoters60/1013298
caattgat

SEQ ID NO: 92486 - DNA, 7 bp, Unknown
  misc_feature (1)..( 7): Result.001 file - promoters60/1013298
gaagttt

SEQ ID NO: 92487 - DNA, 7 bp, Unknown
  misc_feature (1)..( 7): Result.001 file - promoters60/1013298
gaatttt

SEQ ID NO: 92488 - DNA, 6 bp, Unknown
  misc_feature (1)..( 6): Result.001 file - promoters60/1013298
aaagtt

SEQ ID NO: 92489 - DNA, 6 bp, Unknown
  misc_feature (1)..( 6): Result.001 file - promoters60/1013298
aaagtt

SEQ ID NO: 92490 - DNA, 6 bp, Unknown
  misc_feature (1)..( 6): Result.001 file - promoters60/1013298
ttgtca

SEQ ID NO: 92491 - DNA, 6 bp, Unknown
  misc_feature (1)..( 6): Result.001 file - promoters60/1013310
ttgtca

SEQ ID NO: 92492 - DNA, 13 bp, Unknown
  misc_feature (1)..( 13): Result.001 file - promoters60/1013310
aacctctttataa

SEQ ID NO: 92493 - DNA, 13 bp, Unknown
  misc_feature (1)..( 13): Result.001 file - promoters60/1013310
ttcttttttatat

SEQ ID NO: 92494 - DNA, 13 bp, Unknown
  misc_feature (1)..( 13): Result.001 file - promoters60/1013310
tcctctcttataa

SEQ ID NO: 92495 - DNA, 13 bp, Unknown
  misc_feature (1)..( 13): Result.001 file - promoters60/1013310
ttctattttattg

SEQ ID NO: 92496 - DNA, 8 bp, Unknown
  misc_feature (1)..( 8): Result.001 file - promoters60/1013310
aattcaat

SEQ ID NO: 92497 - DNA, 8 bp, Unknown
  misc_feature (1)..( 8): Result.001 file - promoters60/1013310
aattcaaa

SEQ ID NO: 92498 - DNA, 8 bp, Unknown
  misc_feature (1)..( 8): Result.001 file - promoters60/1013310
gatttaaa

SEQ ID NO: 92499 - DNA, 9 bp, Unknown
  misc_feature (1)..( 9): Result.001 file - promoters60/1013310
tcctcttcc

SEQ ID NO: 92500 - DNA, 9 bp, Unknown
  misc_feature (1)..( 9): Result.001 file - promoters60/1013310
tccactttg

SEQ ID NO: 92501 - DNA, 9 bp, Unknown
  misc_feature (1)..( 9): Result.001 file - promoters60/1013314
tccattttg

SEQ ID NO: 92502 - DNA, 12 bp, Unknown
  misc_feature (1)..( 12): Result.001 file - promoters60/1013314
gaaaatacaaat

SEQ ID NO: 92503 - DNA, 12 bp, Unknown
  misc_feature (1)..( 12): Result.001 file - promoters60/1013314
taaaatataaat

SEQ ID NO: 92504 - DNA, 12 bp, Unknown
  misc_feature (1)..( 12): Result.001 file - promoters60/1013314
taacatacaaca

SEQ ID NO: 92505 - DNA, 12 bp, Unknown
  misc_feature (1)..( 12): Result.001 file - promoters60/1013314
taaaatgcacgt

SEQ ID NO: 92506 - DNA, 12 bp, Unknown
  misc_feature (1)..( 12): Result.001 file - promoters60/1013314
tttgataaaaga

SEQ ID NO: 92507 - DNA, 13 bp, Unknown
  misc_feature (1)..( 13): Result.001 file - promoters60/1013314
aaatatttttatg

SEQ ID NO: 92508 - DNA, 13 bp, Unknown
  misc_feature (1)..( 13): Result.001 file - promoters60/1013314
ttgaaattttatg

SEQ ID NO: 92509 - DNA, 13 bp, Unknown
  misc_feature (1)..( 13): Result.001 file - promoters60/1013314
aaatatttttaat

SEQ ID NO: 92510 - DNA, 13 bp, Unknown
  misc_feature (1)..( 13): Result.001 file - promoters60/1013314
ctttttttttaac

SEQ ID NO: 92511 - DNA, 13 bp, Unknown
  misc_feature (1)..( 13): Result.001 file - promoters60/1013314
acatatttttata

SEQ ID NO: 92512 - DNA, 13 bp, Unknown
  misc_feature (1)..( 13): Result.001 file - promoters60/1013314
caacatttttttc

SEQ ID NO: 92513 - DNA, 10 bp, Unknown
  misc_feature (1)..( 10): Result.001 file - promoters60/1013314
cttgaagaaa

SEQ ID NO: 92514 - DNA, 10 bp, Unknown
  misc_feature (1)..( 10): Result.001 file - promoters60/1013314
gataaagaaa

SEQ ID NO: 92515 - DNA, 10 bp, Unknown
  misc_feature (1)..( 10): Result.001 file - promoters60/1013314
tatatagaat

SEQ ID NO: 92516 - DNA, 10 bp, Unknown
  misc_feature (1)..( 10): Result.001 file - promoters60/1013314
tatttagaaa

SEQ ID NO: 92517 - DNA, 10 bp, Unknown
  misc_feature (1)..( 10): Result.001 file - promoters60/1013314
gatatagtca

SEQ ID NO: 92518 - DNA, 10 bp, Unknown
  misc_feature (1)..( 10): Result.001 file - promoters60/1013314
tttttataaa

SEQ ID NO: 92519 - DNA, 10 bp, Unknown
  misc_feature (1)..( 10): Result.001 file - promoters60/1013314
atttatatga

SEQ ID NO: 92520 - DNA, 10 bp, Unknown
  misc_feature (1)..( 10): Result.001 file - promoters60/1013314
atttttattt

SEQ ID NO: 92521 - DNA, 10 bp, Unknown
  misc_feature (1)..( 10): Result.001 file - promoters60/1013314
cttttttttt

SEQ ID NO: 92522 - DNA, 10 bp, Unknown
  misc_feature (1)..( 10): Result.001 file - promoters60/1013314
atttttttca

SEQ ID NO: 92523 - DNA, 10 bp, Unknown
  misc_feature (1)..( 10): Result.001 file - promoters60/1013314
atttttaata

SEQ ID NO: 92524 - DNA, 12 bp, Unknown
  misc_feature (1)..( 12): Result.001 file - promoters60/1013314
tcaaaagattta

SEQ ID NO: 92525 - DNA, 12 bp, Unknown
  misc_feature (1)..( 12): Result.001 file - promoters60/1013314
acaaaagaaaaa

SEQ ID NO: 92526 - DNA, 12 bp, Unknown
  misc_feature (1)..( 12): Result.001 file - promoters60/1013314
tcataagagaat

SEQ ID NO: 92527 - DNA, 12 bp, Unknown
  misc_feature (1)..( 12): Result.001 file - promoters60/1013314
tcaaaaaaagaa

SEQ ID NO: 92528 - DNA, 12 bp, Unknown
  misc_feature (1)..( 12): Result.001 file - promoters60/1013314
ggaaaaaaaaaa

SEQ ID NO: 92529 - DNA, 14 bp, Unknown
  misc_feature (1)..( 14): Result.001 file - promoters60/1013314
aaaataaaatttgc

SEQ ID NO: 92530 - DNA, 14 bp, Unknown
  misc_feature (1)..( 14): Result.001 file - promoters60/1013314
ttttaaaactttaa

SEQ ID NO: 92531 - DNA, 14 bp, Unknown
  misc_feature (1)..( 14): Result.001 file - promoters60/1013314
aaaagaaaataaac

SEQ ID NO: 92532 - DNA, 14 bp, Unknown
  misc_feature (1)..( 14): Result.001 file - promoters60/1013314
aaatgttaatttgg

SEQ ID NO: 92533 - DNA, 14 bp, Unknown
  misc_feature (1)..( 14): Result.001 file - promoters60/1013314
aacagaaaacgtta

SEQ ID NO: 92534 - DNA, 10 bp, Unknown
  misc_feature (1)..( 10): Result.001 file - promoters60/1013314
taattaaatg

SEQ ID NO: 92535 - DNA, 10 bp, Unknown
  misc_feature (1)..( 10): Result.001 file - promoters60/1013314
aaattaataa

SEQ ID NO: 92536 - DNA, 10 bp, Unknown
  misc_feature (1)..( 10): Result.001 file - promoters60/1013314
cgattaaatg

SEQ ID NO: 92537 - DNA, 10 bp, Unknown
  misc_feature (1)..( 10): Result.001 file - promoters60/1013314
aaaataaact

SEQ ID NO: 92538 - DNA, 10 bp, Unknown
  misc_feature (1)..( 10): Result.001 file - promoters60/1013314
aaatttagat

SEQ ID NO: 92539 - DNA, 9 bp, Unknown
  misc_feature (1)..( 9): Result.001 file - promoters60/1013314
ttataaaag

SEQ ID NO: 92540 - DNA, 9 bp, Unknown
  misc_feature (1)..( 9): Result.001 file - promoters60/1013314
ttatataag

SEQ ID NO: 92541 - DNA, 9 bp, Unknown
  misc_feature (1)..( 9): Result.001 file - promoters60/1013314
atataaact

SEQ ID NO: 92542 - DNA, 9 bp, Unknown
  misc_feature (1)..( 9): Result.001 file - promoters60/1013314
atataaaca

SEQ ID NO: 92543 - DNA, 9 bp, Unknown
  misc_feature (1)..( 9): Result.001 file - promoters60/1013314
ttatatcac

SEQ ID NO: 92544 - DNA, 12 bp, Unknown
  misc_feature (1)..( 12): Result.001 file - promoters60/1013314
aacattgtccat

SEQ ID NO: 92545 - DNA, 12 bp, Unknown
  misc_feature (1)..( 12): Result.001 file - promoters60/1013314
catattatccat

SEQ ID NO: 92546 - DNA, 12 bp, Unknown
  misc_feature (1)..( 12): Result.001 file - promoters60/1013314
ataattatccaa

SEQ ID NO: 92547 - DNA, 12 bp, Unknown
  misc_feature (1)..( 12): Result.001 file - promoters60/1013314
ttaaatattttt

SEQ ID NO: 92548 - DNA, 12 bp, Unknown
  misc_feature (1)..( 12): Result.001 file - promoters60/1013314
atcaatattctt

SEQ ID NO: 92549 - DNA, 12 bp, Unknown
  misc_feature (1)..( 12): Result.001 file - promoters60/1013314
atcaacaaataa

SEQ ID NO: 92550 - DNA, 13 bp, Unknown
  misc_feature (1)..( 13): Result.001 file - promoters60/1013314
atatttttatgtg

SEQ ID NO: 92551 - DNA, 13 bp, Unknown
  misc_feature (1)..( 13): Result.001 file - promoters60/1013314
acatttttttcac

SEQ ID NO: 92552 - DNA, 13 bp, Unknown
  misc_feature (1)..( 13): Result.001 file - promoters60/1013314
atatttttataaa

SEQ ID NO: 92553 - DNA, 13 bp, Unknown
  misc_feature (1)..( 13): Result.001 file - promoters60/1013314
atatttttatttt

SEQ ID NO: 92554 - DNA, 13 bp, Unknown
  misc_feature (1)..( 13): Result.001 file - promoters60/1013314
atatttttaatat

SEQ ID NO: 92555 - DNA, 13 bp, Unknown
  misc_feature (1)..( 13): Result.001 file - promoters60/1013314
atgtatttagaaa

SEQ ID NO: 92556 - DNA, 9 bp, Unknown
  misc_feature (1)..( 9): Result.001 file - promoters60/1013314
ttaaattat

SEQ ID NO: 92557 - DNA, 9 bp, Unknown
  misc_feature (1)..( 9): Result.001 file - promoters60/1013314
ctaaatttt

SEQ ID NO: 92558 - DNA, 9 bp, Unknown
  misc_feature (1)..( 9): Result.001 file - promoters60/1013314
ataaaatat

SEQ ID NO: 92559 - DNA, 9 bp, Unknown
  misc_feature (1)..( 9): Result.001 file - promoters60/1013314
ctaaatagg

SEQ ID NO: 92560 - DNA, 10 bp, Unknown
  misc_feature (1)..( 10): Result.001 file - promoters60/1013314
atacaatgca

SEQ ID NO: 92561 - DNA, 12 bp, Unknown
  misc_feature (1)..( 12): Result.001 file - promoters60/1013314
ttttgaaatttt

SEQ ID NO: 92562 - DNA, 12 bp, Unknown
  misc_feature (1)..( 12): Result.001 file - promoters60/1013314
attttaaataac

SEQ ID NO: 92563 - DNA, 12 bp, Unknown
  misc_feature (1)..( 12): Result.001 file - promoters60/1013314
ttttgacatcat

SEQ ID NO: 92564 - DNA, 12 bp, Unknown
  misc_feature (1)..( 12): Result.001 file - promoters60/1013314
ttttgatattgc

SEQ ID NO: 92565 - DNA, 12 bp, Unknown
  misc_feature (1)..( 12): Result.001 file - promoters60/1013314
gactgacatttt

SEQ ID NO: 92566 - DNA, 12 bp, Unknown
  misc_feature (1)..( 12): Result.001 file - promoters60/1013314
gattgacatatt

SEQ ID NO: 92567 - DNA, 11 bp, Unknown
  misc_feature (1)..( 11): Result.001 file - promoters60/1013314
gaaaaaatatt

SEQ ID NO: 92568 - DNA, 11 bp, Unknown
  misc_feature (1)..( 11): Result.001 file - promoters60/1013314
atcaaaataag

SEQ ID NO: 92569 - DNA, 11 bp, Unknown
  misc_feature (1)..( 11): Result.001 file - promoters60/1013314
aaaaaaatctt

SEQ ID NO: 92570 - DNA, 11 bp, Unknown
  misc_feature (1)..( 11): Result.001 file - promoters60/1013314
taacaaatttc

SEQ ID NO: 92571 - DNA, 11 bp, Unknown
  misc_feature (1)..( 11): Result.001 file - promoters60/1013314
agtcaaatatc

SEQ ID NO: 92572 - DNA, 14 bp, Unknown
  misc_feature (1)..( 14): Result.001 file - promoters60/1013314
agttaaagacttta

SEQ ID NO: 92573 - DNA, 14 bp, Unknown
  misc_feature (1)..( 14): Result.001 file - promoters60/1013314
cataagagaatttc

SEQ ID NO: 92574 - DNA, 14 bp, Unknown
  misc_feature (1)..( 14): Result.001 file - promoters60/1013314
aaaaaaagaattta

SEQ ID NO: 92575 - DNA, 14 bp, Unknown
  misc_feature (1)..( 14): Result.001 file - promoters60/1013314
aaaaaaaaaataca

SEQ ID NO: 92576 - DNA, 14 bp, Unknown
  misc_feature (1)..( 14): Result.001 file - promoters60/1013314
gatttaagaatatt

SEQ ID NO: 92577 - DNA, 12 bp, Unknown
  misc_feature (1)..( 12): Result.001 file - promoters60/1013314
taaaaaataaat

SEQ ID NO: 92578 - DNA, 12 bp, Unknown
  misc_feature (1)..( 12): Result.001 file - promoters60/1013314
taagaaaaaaat

SEQ ID NO: 92579 - DNA, 12 bp, Unknown
  misc_feature (1)..( 12): Result.001 file - promoters60/1013314
atccaaacaaaa

SEQ ID NO: 92580 - DNA, 12 bp, Unknown
  misc_feature (1)..( 12): Result.001 file - promoters60/1013314
gtcaaagtaaaa

SEQ ID NO: 92581 - DNA, 12 bp, Unknown
  misc_feature (1)..( 12): Result.001 file - promoters60/1013314
ttctagataaaa

SEQ ID NO: 92582 - DNA, 13 bp, Unknown
  misc_feature (1)..( 13): Result.001 file - promoters60/1013314
ttaaagctttgaa

SEQ ID NO: 92583 - DNA, 13 bp, Unknown
  misc_feature (1)..( 13): Result.001 file - promoters60/1013314
agaaatcttttta

SEQ ID NO: 92584 - DNA, 13 bp, Unknown
  misc_feature (1)..( 13): Result.001 file - promoters60/1013314
ttaaagcgaaaag

SEQ ID NO: 92585 - DNA, 13 bp, Unknown
  misc_feature (1)..( 13): Result.001 file - promoters60/1013314
atcaatcttttta

SEQ ID NO: 92586 - DNA, 13 bp, Unknown
  misc_feature (1)..( 13): Result.001 file - promoters60/1013314
ggaaaacgacaca

SEQ ID NO: 92587 - DNA, 11 bp, Unknown
  misc_feature (1)..( 11): Result.001 file - promoters60/1013314
cttttaaagtt

SEQ ID NO: 92588 - DNA, 11 bp, Unknown
  misc_feature (1)..( 11): Result.001 file - promoters60/1013314
attttaacatc

SEQ ID NO: 92589 - DNA, 11 bp, Unknown
  misc_feature (1)..( 11): Result.001 file - promoters60/1013314
tttttaacaaa

SEQ ID NO: 92590 - DNA, 11 bp, Unknown
  misc_feature (1)..( 11): Result.001 file - promoters60/1013314
atagtaaaaaa

SEQ ID NO: 92591 - DNA, 11 bp, Unknown
  misc_feature (1)..( 11): Result.001 file - promoters60/1013314
atagtcaaata

SEQ ID NO: 92592 - DNA, 8 bp, Unknown
  misc_feature (1)..( 8): Result.001 file - promoters60/1013314
taaatatt

SEQ ID NO: 92593 - DNA, 8 bp, Unknown
  misc_feature (1)..( 8): Result.001 file - promoters60/1013314
tcaatatt

SEQ ID NO: 92594 - DNA, 9 bp, Unknown
  misc_feature (1)..( 9): Result.001 file - promoters60/1013314
ataattatc

SEQ ID NO: 92595 - DNA, 9 bp, Unknown
  misc_feature (1)..( 9): Result.001 file - promoters60/1013314
atccatata

SEQ ID NO: 92596 - DNA, 9 bp, Unknown
  misc_feature (1)..( 9): Result.001 file - promoters60/1013314
ataattaaa

SEQ ID NO: 92597 - DNA, 10 bp, Unknown
  misc_feature (1)..( 10): Result.001 file - promoters60/1013314
gaataaaatc

SEQ ID NO: 92598 - DNA, 10 bp, Unknown
  misc_feature (1)..( 10): Result.001 file - promoters60/1013314
ttttaacatc

SEQ ID NO: 92599 - DNA, 10 bp, Unknown
  misc_feature (1)..( 10): Result.001 file - promoters60/1013314
taaaaaaatc

SEQ ID NO: 92600 - DNA, 10 bp, Unknown
  misc_feature (1)..( 10): Result.001 file - promoters60/1013314
ttttaacaaa

SEQ ID NO: 92601 - DNA, 11 bp, Unknown
  misc_feature (1)..( 11): Result.001 file - promoters60/1013384
agtcaaatatc

SEQ ID NO: 92602 - DNA, 8 bp, Unknown
  misc_feature (1)..( 8): Result.001 file - promoters60/1013384
aaaacaga

SEQ ID NO: 92603 - DNA, 8 bp, Unknown
  misc_feature (1)..( 8): Result.001 file - promoters60/1013384
aaaacagt

SEQ ID NO: 92604 - DNA, 8 bp, Unknown
  misc_feature (1)..( 8): Result.001 file - promoters60/1013384
aacacaaa

SEQ ID NO: 92605 - DNA, 7 bp, Unknown
  misc_feature (1)..( 7): Result.001 file - promoters60/1013384
ccaatga

SEQ ID NO: 92606 - DNA, 7 bp, Unknown
  misc_feature (1)..( 7): Result.001 file - promoters60/1013384
ccaatga

SEQ ID NO: 92607 - DNA, 8 bp, Unknown
  misc_feature (1)..( 8): Result.001 file - promoters60/1013384
gagcatga

SEQ ID NO: 92608 - DNA, 8 bp, Unknown
  misc_feature (1)..( 8): Result.001 file - promoters60/1013384
gagcctga

SEQ ID NO: 92609 - DNA, 8 bp, Unknown
  misc_feature (1)..( 8): Result.001 file - promoters60/1013384
tcctgaag

SEQ ID NO: 92610 - DNA, 8 bp, Unknown
  misc_feature (1)..( 8): Result.001 file - promoters60/1013384
tccagaag

SEQ ID NO: 92611 - DNA, 6 bp, Unknown
  misc_feature (1)..( 6): Result.001 file - promoters60/1013384
gacttg

SEQ ID NO: 92612 - DNA, 6 bp, Unknown
  misc_feature (1)..( 6): Result.001 file - promoters60/1013384
gacttg

SEQ ID NO: 92613 - DNA, 6 bp, Unknown
  misc_feature (1)..( 6): Result.001 file - promoters60/1013384
tcttct

SEQ ID NO: 92614 - DNA, 6 bp, Unknown
  misc_feature (1)..( 6): Result.001 file - promoters60/1013384
tcttct

SEQ ID NO: 92615 - DNA, 6 bp, Unknown
  misc_feature (1)..( 6): Result.001 file - promoters60/1013384
caagaa

SEQ ID NO: 92616 - DNA, 6 bp, Unknown
  misc_feature (1)..( 6): Result.001 file - promoters60/1013384
caagaa

SEQ ID NO: 92617 - DNA, 6 bp, Unknown
  misc_feature (1)..( 6): Result.001 file - promoters60/1013384
tctaaa

SEQ ID NO: 92618 - DNA, 6 bp, Unknown
  misc_feature (1)..( 6): Result.001 file - promoters60/1013384
tctaaa

SEQ ID NO: 92619 - DNA, 6 bp, Unknown
  misc_feature (1)..( 6): Result.001 file - promoters60/1013384
caaacc

SEQ ID NO: 92620 - DNA, 6 bp, Unknown
  misc_feature (1)..( 6): Result.001 file - promoters60/1013384
caaacc

SEQ ID NO: 92621 - DNA, 7 bp, Unknown
  misc_feature (1)..( 7): Result.001 file - promoters60/1013384
tttaggt

SEQ ID NO: 92622 - DNA, 7 bp, Unknown
  misc_feature (1)..( 7): Result.001 file - promoters60/1013384
ttttggt

SEQ ID NO: 92623 - DNA, 6 bp, Unknown
  misc_feature (1)..( 6): Result.001 file - promoters60/1013384
ttcagt

SEQ ID NO: 92624 - DNA, 6 bp, Unknown
  misc_feature (1)..( 6): Result.001 file - promoters60/1013413
ttcagt

SEQ ID NO: 92625 - DNA, 15 bp, Unknown
  misc_feature (1)..( 15): Result.001 file - promoters60/1013413
taataacatcaataa

SEQ ID NO: 92626 - DNA, 15 bp, Unknown
  misc_feature (1)..( 15): Result.001 file - promoters60/1013413
taaaaacattaataa

SEQ ID NO: 92627 - DNA, 15 bp, Unknown
  misc_feature (1)..( 15): Result.001 file - promoters60/1013413
aaataacaaatacaa

SEQ ID NO: 92628 - DNA, 15 bp, Unknown
  misc_feature (1)..( 15): Result.001 file - promoters60/1013413
tcaaaaaaaaaagtt

SEQ ID NO: 92629 - DNA, 15 bp, Unknown
  misc_feature (1)..( 15): Result.001 file - promoters60/1013413
taataatattttgaa

SEQ ID NO: 92630 - DNA, 15 bp, Unknown
  misc_feature (1)..( 15): Result.001 file - promoters60/1013413
gaaaaaaataactgt

SEQ ID NO: 92631 - DNA, 15 bp, Unknown
  misc_feature (1)..( 15): Result.001 file - promoters60/1013413
caattacaacttgtt

SEQ ID NO: 92632 - DNA, 11 bp, Unknown
  misc_feature (1)..( 11): Result.001 file - promoters60/1013413
ttttaataatt

SEQ ID NO: 92633 - DNA, 11 bp, Unknown
  misc_feature (1)..( 11): Result.001 file - promoters60/1013413
gtttattaaaa

SEQ ID NO: 92634 - DNA, 11 bp, Unknown
  misc_feature (1)..( 11): Result.001 file - promoters60/1013413
agctaagaata

SEQ ID NO: 92635 - DNA, 11 bp, Unknown
  misc_feature (1)..( 11): Result.001 file - promoters60/1013413
ggctaataaat

SEQ ID NO: 92636 - DNA, 11 bp, Unknown
  misc_feature (1)..( 11): Result.001 file - promoters60/1013413
ttttaatctga

SEQ ID NO: 92637 - DNA, 11 bp, Unknown
  misc_feature (1)..( 11): Result.001 file - promoters60/1013413
aaaaaagaata

SEQ ID NO: 92638 - DNA, 11 bp, Unknown
  misc_feature (1)..( 11): Result.001 file - promoters60/1013427
aattaaaaatg

SEQ ID NO: 92639 - DNA, 6 bp, Unknown
  misc_feature (1)..( 6): Result.001 file - promoters60/1013427
aattca

SEQ ID NO: 92640 - DNA, 6 bp, Unknown
  misc_feature (1)..( 6): Result.001 file - promoters60/1013427
aattca

SEQ ID NO: 92641 - DNA, 6 bp, Unknown
  misc_feature (1)..( 6): Result.001 file - promoters60/1013427
caacgg

SEQ ID NO: 92642 - DNA, 6 bp, Unknown
  misc_feature (1)..( 6): Result.001 file - promoters60/1013427
caacgg

SEQ ID NO: 92643 - DNA, 8 bp, Unknown
  misc_feature (1)..( 8): Result.001 file - promoters60/1013427
tttctctt

SEQ ID NO: 92644 - DNA, 8 bp, Unknown
  misc_feature (1)..( 8): Result.001 file - promoters60/1013427
tttttctt

SEQ ID NO: 92645 - DNA, 9 bp, Unknown
  misc_feature (1)..( 9): Result.001 file - promoters60/1013427
tttatatta

SEQ ID NO: 92646 - DNA, 9 bp, Unknown
  misc_feature (1)..( 9): Result.001 file - promoters60/1013427
cttatatta

SEQ ID NO: 92647 - DNA, 9 bp, Unknown
  misc_feature (1)..( 9): Result.001 file - promoters60/1013427
tttaaattt

SEQ ID NO: 92648 - DNA, 7 bp, Unknown
  misc_feature (1)..( 7): Result.001 file - promoters60/1013427
ttcaatt

SEQ ID NO: 92649 - DNA, 7 bp, Unknown
  misc_feature (1)..( 7): Result.001 file - promoters60/1013427
ttctatt

SEQ ID NO: 92650 - DNA, 8 bp, Unknown
  misc_feature (1)..( 8): Result.001 file - promoters60/1013427
aataattt

SEQ ID NO: 92651 - DNA, 8 bp, Unknown
  misc_feature (1)..( 8): Result.001 file - promoters60/1013427
aatatttt

SEQ ID NO: 92652 - DNA, 6 bp, Unknown
  misc_feature (1)..( 6): Result.001 file - promoters60/1013427
tctttg

SEQ ID NO: 92653 - DNA, 6 bp, Unknown
  misc_feature (1)..( 6): Result.001 file - promoters60/1013427
tctttg

SEQ ID NO: 92654 - DNA, 11 bp, Unknown
  misc_feature (1)..( 11): Result.001 file - promoters60/1013427
aatgatgattt

SEQ ID NO: 92655 - DNA, 11 bp, Unknown
  misc_feature (1)..( 11): Result.001 file - promoters60/1013427
aataatgtttt

SEQ ID NO: 92656 - DNA, 7 bp, Unknown
  misc_feature (1)..( 7): Result.001 file - promoters60/1013427
ataatta

SEQ ID NO: 92657 - DNA, 7 bp, Unknown
  misc_feature (1)..( 7): Result.001 file - promoters60/1013427
atagtta

SEQ ID NO: 92658 - DNA, 6 bp, Unknown
  misc_feature (1)..( 6): Result.001 file - promoters60/1013427
ttacaa

SEQ ID NO: 92659 - DNA, 6 bp, Unknown
  misc_feature (1)..( 6): Result.001 file - promoters60/1013427
ttacaa

SEQ ID NO: 92660 - DNA, 7 bp, Unknown
  misc_feature (1)..( 7): Result.001 file - promoters60/1013427
gaaatca

SEQ ID NO: 92661 - DNA, 7 bp, Unknown
  misc_feature (1)..( 7): Result.001 file - promoters60/1013497
gaaatca

SEQ ID NO: 92662 - DNA, 7 bp, Unknown
  misc_feature (1)..( 7): Result.001 file - promoters60/1013497
aaatgaa

SEQ ID NO: 92663 - DNA, 7 bp, Unknown
  misc_feature (1)..( 7): Result.001 file - promoters60/1013497
aaaggaa

SEQ ID NO: 92664 - DNA, 6 bp, Unknown
  misc_feature (1)..( 6): Result.001 file - promoters60/1013497
aataaa

SEQ ID NO: 92665 - DNA, 6 bp, Unknown
  misc_feature (1)..( 6): Result.001 file - promoters60/1013497
aataaa

SEQ ID NO: 92666 - DNA, 8 bp, Unknown
  misc_feature (1)..( 8): Result.001 file - promoters60/1013497
aaatgtta

SEQ ID NO: 92667 - DNA, 8 bp, Unknown
  misc_feature (1)..( 8): Result.001 file - promoters60/1013497
aaatttta

SEQ ID NO: 92668 - DNA, 8 bp, Unknown
  misc_feature (1)..( 8): Result.001 file - promoters60/1013497
aattttca

SEQ ID NO: 92669 - DNA, 8 bp, Unknown
  misc_feature (1)..( 8): Result.001 file - promoters60/1013497
aattatca

SEQ ID NO: 92670 - DNA, 6 bp, Unknown
  misc_feature (1)..( 6): Result.001 file - promoters60/1013497
aaaatg

SEQ ID NO: 92671 - DNA, 6 bp, Unknown
  misc_feature (1)..( 6): Result.001 file - promoters60/1013497
aaaatg

SEQ ID NO: 92672 - DNA, 6 bp, Unknown
  misc_feature (1)..( 6): Result.001 file - promoters60/1013497
ataaga

SEQ ID NO: 92673 - DNA, 6 bp, Unknown
  misc_feature (1)..( 6): Result.001 file - promoters60/1013497
ataaga

SEQ ID NO: 92674 - DNA, 6 bp, Unknown
  misc_feature (1)..( 6): Result.001 file - promoters60/1013497
gttgac

SEQ ID NO: 92675 - DNA, 6 bp, Unknown
  misc_feature (1)..( 6): Result.001 file - promoters60/1013497
gttgac

SEQ ID NO: 92676 - DNA, 6 bp, Unknown
  misc_feature (1)..( 6): Result.001 file - promoters60/1013497
cactca

SEQ ID NO: 92677 - DNA, 6 bp, Unknown
  misc_feature (1)..( 6): Result.001 file - promoters60/1013497
cactca

SEQ ID NO: 92678 - DNA, 6 bp, Unknown
  misc_feature (1)..( 6): Result.001 file - promoters60/1013497
ccacca

SEQ ID NO: 92679 - DNA, 6 bp, Unknown
  misc_feature (1)..( 6): Result.001 file - promoters60/1013497
ccacca

SEQ ID NO: 92680 - DNA, 6 bp, Unknown
  misc_feature (1)..( 6): Result.001 file - promoters60/1013497
cggtga

SEQ ID NO: 92681 - DNA, 6 bp, Unknown
  misc_feature (1)..( 6): Result.001 file - promoters60/1013497
cggtga

SEQ ID NO: 92682 - DNA, 9 bp, Unknown
  misc_feature (1)..( 9): Result.001 file - promoters60/1013497
gaagttcta

SEQ ID NO: 92683 - DNA, 9 bp, Unknown
  misc_feature (1)..( 9): Result.001 file - promoters60/1013497
gaagtacta

SEQ ID NO: 92684 - DNA, 6 bp, Unknown
  misc_feature (1)..( 6): Result.001 file - promoters60/1013497
ccaagt

SEQ ID NO: 92685 - DNA, 6 bp, Unknown
  misc_feature (1)..( 6): Result.001 file - promoters60/1013497
ccaagt

SEQ ID NO: 92686 - DNA, 7 bp, Unknown
  misc_feature (1)..( 7): Result.001 file - promoters60/1013497
tctaagc

SEQ ID NO: 92687 - DNA, 7 bp, Unknown
  misc_feature (1)..( 7): Result.001 file - promoters60/1013540
tctgagc

SEQ ID NO: 92688 - DNA, 13 bp, Unknown
  misc_feature (1)..( 13): Result.001 file - promoters60/1013540
atcttctatgctt

SEQ ID NO: 92689 - DNA, 13 bp, Unknown
  misc_feature (1)..( 13): Result.001 file - promoters60/1013540
gttttctatatat

SEQ ID NO: 92690 - DNA, 13 bp, Unknown
  misc_feature (1)..( 13): Result.001 file - promoters60/1013540
aacttccatgttt

SEQ ID NO: 92691 - DNA, 13 bp, Unknown
  misc_feature (1)..( 13): Result.001 file - promoters60/1013540
atcttgtatatca

SEQ ID NO: 92692 - DNA, 13 bp, Unknown
  misc_feature (1)..( 13): Result.001 file - promoters60/1013540
attgtctatgctt

SEQ ID NO: 92693 - DNA, 13 bp, Unknown
  misc_feature (1)..( 13): Result.001 file - promoters60/1013629
ctcttgtaatgaa

SEQ ID NO: 92694 - DNA, 7 bp, Unknown
  misc_feature (1)..( 7): Result.001 file - promoters60/1013629
ggtttct

SEQ ID NO: 92695 - DNA, 7 bp, Unknown
  misc_feature (1)..( 7): Result.001 file - promoters60/1013629
ggtttct

SEQ ID NO: 92696 - DNA, 7 bp, Unknown
  misc_feature (1)..( 7): Result.001 file - promoters60/1013629
tgtttct

SEQ ID NO: 92697 - DNA, 8 bp, Unknown
  misc_feature (1)..( 8): Result.001 file - promoters60/1013629
agagaaag

SEQ ID NO: 92698 - DNA, 8 bp, Unknown
  misc_feature (1)..( 8): Result.001 file - promoters60/1013629
agaggaag

SEQ ID NO: 92699 - DNA, 8 bp, Unknown
  misc_feature (1)..( 8): Result.001 file - promoters60/1013629
agaaaaaa

SEQ ID NO: 92700 - DNA, 9 bp, Unknown
  misc_feature (1)..( 9): Result.001 file - promoters60/1013629
tatctaaga

SEQ ID NO: 92701 - DNA, 9 bp, Unknown
  misc_feature (1)..( 9): Result.001 file - promoters60/1013629
tttcttaga

SEQ ID NO: 92702 - DNA, 9 bp, Unknown
  misc_feature (1)..( 9): Result.001 file - promoters60/1013629
ttttttaga

SEQ ID NO: 92703 - DNA, 8 bp, Unknown
  misc_feature (1)..( 8): Result.001 file - promoters60/1013629
ttttcttt

SEQ ID NO: 92704 - DNA, 8 bp, Unknown
  misc_feature (1)..( 8): Result.001 file - promoters60/1013629
ttttgttt

SEQ ID NO: 92705 - DNA, 8 bp, Unknown
  misc_feature (1)..( 8): Result.001 file - promoters60/1013641
tttttttt

SEQ ID NO: 92706 - DNA, 9 bp, Unknown
  misc_feature (1)..( 9): Result.001 file - promoters60/1013641
tattatcag

SEQ ID NO: 92707 - DNA, 9 bp, Unknown
  misc_feature (1)..( 9): Result.001 file - promoters60/1013641
gattatcct

SEQ ID NO: 92708 - DNA, 9 bp, Unknown
  misc_feature (1)..( 9): Result.001 file - promoters60/1013641
tattattat

SEQ ID NO: 92709 - DNA, 12 bp, Unknown
  misc_feature (1)..( 12): Result.001 file - promoters60/1013641
tttgatttttgg

SEQ ID NO: 92710 - DNA, 12 bp, Unknown
  misc_feature (1)..( 12): Result.001 file - promoters60/1013641
tttgacttttca

SEQ ID NO: 92711 - DNA, 12 bp, Unknown
  misc_feature (1)..( 12): Result.001 file - promoters60/1013641
agtctcttatca

SEQ ID NO: 92712 - DNA, 10 bp, Unknown
  misc_feature (1)..( 10): Result.001 file - promoters60/1013641
ggatttaaaa

SEQ ID NO: 92713 - DNA, 10 bp, Unknown
  misc_feature (1)..( 10): Result.001 file - promoters60/1013641
ggatttaaat

SEQ ID NO: 92714 - DNA, 11 bp, Unknown
  misc_feature (1)..( 11): Result.001 file - promoters60/1013641
tagtttcaaat

SEQ ID NO: 92715 - DNA, 9 bp, Unknown
  misc_feature (1)..( 9): Result.001 file - promoters60/1013641
tttaaaata

SEQ ID NO: 92716 - DNA, 9 bp, Unknown
  misc_feature (1)..( 9): Result.001 file - promoters60/1013641
ctaaaaata

SEQ ID NO: 92717 - DNA, 9 bp, Unknown
  misc_feature (1)..( 9): Result.001 file - promoters60/1013641
tttcaaatg

SEQ ID NO: 92718 - DNA, 11 bp, Unknown
  misc_feature (1)..( 11): Result.001 file - promoters60/1013641
agactacgtag

SEQ ID NO: 92719 - DNA, 11 bp, Unknown
  misc_feature (1)..( 11): Result.001 file - promoters60/1013641
tttctacatag

SEQ ID NO: 92720 - DNA, 11 bp, Unknown
  misc_feature (1)..( 11): Result.001 file - promoters60/1013641
tttcaacaatg

SEQ ID NO: 92721 - DNA, 10 bp, Unknown
  misc_feature (1)..( 10): Result.001 file - promoters60/1013641
tctaccttcc

SEQ ID NO: 92722 - DNA, 10 bp, Unknown
  misc_feature (1)..( 10): Result.001 file - promoters60/1013641
tctcccttct

SEQ ID NO: 92723 - DNA, 10 bp, Unknown
  misc_feature (1)..( 10): Result.001 file - promoters60/1013645
cctctcttct

SEQ ID NO: 92724 - DNA, 8 bp, Unknown
  misc_feature (1)..( 8): Result.001 file - promoters60/1013645
agcttctc

SEQ ID NO: 92725 - DNA, 8 bp, Unknown
  misc_feature (1)..( 8): Result.001 file - promoters60/1013645
agctcctc

SEQ ID NO: 92726 - DNA, 7 bp, Unknown
  misc_feature (1)..( 7): Result.001 file - promoters60/1013645
ttcgtct

SEQ ID NO: 92727 - DNA, 7 bp, Unknown
  misc_feature (1)..( 7): Result.001 file - promoters60/1013645
ttcttct

SEQ ID NO: 92728 - DNA, 6 bp, Unknown
  misc_feature (1)..( 6): Result.001 file - promoters60/1013645
ataaat

SEQ ID NO: 92729 - DNA, 6 bp, Unknown
  misc_feature (1)..( 6): Result.001 file - promoters60/1013645
ataaat

SEQ ID NO: 92730 - DNA, 6 bp, Unknown
  misc_feature (1)..( 6): Result.001 file - promoters60/1013645
atgatc

SEQ ID NO: 92731 - DNA, 6 bp, Unknown
  misc_feature (1)..( 6): Result.001 file - promoters60/1013645
atgatc

SEQ ID NO: 92732 - DNA, 7 bp, Unknown
  misc_feature (1)..( 7): Result.001 file - promoters60/1013645
agaattg

SEQ ID NO: 92733 - DNA, 7 bp, Unknown
  misc_feature (1)..( 7): Result.001 file - promoters60/1013645
agagttg

SEQ ID NO: 92734 - DNA, 7 bp, Unknown
  misc_feature (1)..( 7): Result.001 file - promoters60/1013645
tgtatat

SEQ ID NO: 92735 - DNA, 7 bp, Unknown
  misc_feature (1)..( 7): Result.001 file - promoters60/1013645
tgtctat

SEQ ID NO: 92736 - DNA, 8 bp, Unknown
  misc_feature (1)..( 8): Result.001 file - promoters60/1013645
tctggttt

SEQ ID NO: 92737 - DNA, 8 bp, Unknown
  misc_feature (1)..( 8): Result.001 file - promoters60/1013645
tctggttt

SEQ ID NO: 92738 - DNA, 7 bp, Unknown
  misc_feature (1)..( 7): Result.001 file - promoters60/1013645
tttactt

SEQ ID NO: 92739 - DNA, 7 bp, Unknown
  misc_feature (1)..( 7): Result.001 file - promoters60/1013645
tttgctt

SEQ ID NO: 92740 - DNA, 8 bp, Unknown
  misc_feature (1)..( 8): Result.001 file - promoters60/1013645
cttttctc

SEQ ID NO: 92741 - DNA, 8 bp, Unknown
  misc_feature (1)..( 8): Result.001 file - promoters60/1013645
cttgtctc

SEQ ID NO: 92742 - DNA, 7 bp, Unknown
  misc_feature (1)..( 7): Result.001 file - promoters60/1013645
ttgaagc

SEQ ID NO: 92743 - DNA, 7 bp, Unknown
  misc_feature (1)..( 7): Result.001 file - promoters60/1013645
ttgaagc

SEQ ID NO: 92744 - DNA, 6 bp, Unknown
  misc_feature (1)..( 6): Result.001 file - promoters60/1013645
cctttt

SEQ ID NO: 92745 - DNA, 6 bp, Unknown
  misc_feature (1)..( 6): Result.001 file - promoters60/1013645
cctttt

SEQ ID NO: 92746 - DNA, 7 bp, Unknown
  misc_feature (1)..( 7): Result.001 file - promoters60/1013645
ttttttt

SEQ ID NO: 92747 - DNA, 7 bp, Unknown
  misc_feature (1)..( 7): Result.001 file - promoters60/1013645
ttttttt

SEQ ID NO: 92748 - DNA, 7 bp, Unknown
  misc_feature (1)..( 7): Result.001 file - promoters60/1013645
ggcctat

SEQ ID NO: 92749 - DNA, 7 bp, Unknown
  misc_feature (1)..( 7): Result.001 file - promoters60/1013674
ggcctat

SEQ ID NO: 92750 - DNA, 8 bp, Unknown
  misc_feature (1)..( 8): Result.001 file - promoters60/1013674
ttttgttt

SEQ ID NO: 92751 - DNA, 8 bp, Unknown
  misc_feature (1)..( 8): Result.001 file - promoters60/1013674
ttttgtgg

SEQ ID NO: 92752 - DNA, 8 bp, Unknown
  misc_feature (1)..( 8): Result.001 file - promoters60/1013674
atttattt

SEQ ID NO: 92753 - DNA, 8 bp, Unknown
  misc_feature (1)..( 8): Result.001 file - promoters60/1013674
attacttt

SEQ ID NO: 92754 - DNA, 8 bp, Unknown
  misc_feature (1)..( 8): Result.001 file - promoters60/1013674
attgcttt

SEQ ID NO: 92755 - DNA, 6 bp, Unknown
  misc_feature (1)..( 6): Result.001 file - promoters60/1013674
aaacat

SEQ ID NO: 92756 - DNA, 6 bp, Unknown
  misc_feature (1)..( 6): Result.001 file - promoters60/1013674
aaacat

SEQ ID NO: 92757 - DNA, 8 bp, Unknown
  misc_feature (1)..( 8): Result.001 file - promoters60/1013674
tgagtttt

SEQ ID NO: 92758 - DNA, 8 bp, Unknown
  misc_feature (1)..( 8): Result.001 file - promoters60/1013674
tgagtttt

SEQ ID NO: 92759 - DNA, 9 bp, Unknown
  misc_feature (1)..( 9): Result.001 file - promoters60/1013674
ataagtttt

SEQ ID NO: 92760 - DNA, 9 bp, Unknown
  misc_feature (1)..( 9): Result.001 file - promoters60/1013674
ataagcttt

SEQ ID NO: 92761 - DNA, 12 bp, Unknown
  misc_feature (1)..( 12): Result.001 file - promoters60/1013674
tttttgtgtgta

SEQ ID NO: 92762 - DNA, 12 bp, Unknown
  misc_feature (1)..( 12): Result.001 file - promoters60/1013674
tttctgtttcaa

SEQ ID NO: 92763 - DNA, 12 bp, Unknown
  misc_feature (1)..( 12): Result.001 file - promoters60/1013674
tttttgttttgt

SEQ ID NO: 92764 - DNA, 6 bp, Unknown
  misc_feature (1)..( 6): Result.001 file - promoters60/1013674
atatca

SEQ ID NO: 92765 - DNA, 6 bp, Unknown
  misc_feature (1)..( 6): Result.001 file - promoters60/1013674
atatca

SEQ ID NO: 92766 - DNA, 7 bp, Unknown
  misc_feature (1)..( 7): Result.001 file - promoters60/1013674
atatttt

SEQ ID NO: 92767 - DNA, 7 bp, Unknown
  misc_feature (1)..( 7): Result.001 file - promoters60/1013674
atagttt

SEQ ID NO: 92768 - DNA, 8 bp, Unknown
  misc_feature (1)..( 8): Result.001 file - promoters60/1013674
tagcataa

SEQ ID NO: 92769 - DNA, 8 bp, Unknown
  misc_feature (1)..( 8): Result.001 file - promoters60/1013674
taggataa

SEQ ID NO: 92770 - DNA, 8 bp, Unknown
  misc_feature (1)..( 8): Result.001 file - promoters60/1013674
ttaaaaat

SEQ ID NO: 92771 - DNA, 8 bp, Unknown
  misc_feature (1)..( 8): Result.001 file - promoters60/1013674
ttataaat

SEQ ID NO: 92772 - DNA, 8 bp, Unknown
  misc_feature (1)..( 8): Result.001 file - promoters60/1013674
acaaaaat

SEQ ID NO: 92773 - DNA, 6 bp, Unknown
  misc_feature (1)..( 6): Result.001 file - promoters60/1013674
acaaaa

SEQ ID NO: 92774 - DNA, 6 bp, Unknown
  misc_feature (1)..( 6): Result.001 file - promoters60/1013674
acaaaa

SEQ ID NO: 92775 - DNA, 7 bp, Unknown
  misc_feature (1)..( 7): Result.001 file - promoters60/1013674
atatttt

SEQ ID NO: 92776 - DNA, 7 bp, Unknown
  misc_feature (1)..( 7): Result.001 file - promoters60/1013674
ataattt

SEQ ID NO: 92777 - DNA, 7 bp, Unknown
  misc_feature (1)..( 7): Result.001 file - promoters60/1013674
ttttata

SEQ ID NO: 92778 - DNA, 7 bp, Unknown
  misc_feature (1)..( 7): Result.001 file - promoters60/1013674
tttaata

SEQ ID NO: 92779 - DNA, 7 bp, Unknown
  misc_feature (1)..( 7): Result.001 file - promoters60/1013674
attaaat

SEQ ID NO: 92780 - DNA, 7 bp, Unknown
  misc_feature (1)..( 7): Result.001 file - promoters60/1013674
attaaat

SEQ ID NO: 92781 - DNA, 8 bp, Unknown
  misc_feature (1)..( 8): Result.001 file - promoters60/1013674
aaaacaat

SEQ ID NO: 92782 - DNA, 8 bp, Unknown
  misc_feature (1)..( 8): Result.001 file - promoters60/1013674
aaaacaat

SEQ ID NO: 92783 - DNA, 7 bp, Unknown
  misc_feature (1)..( 7): Result.001 file - promoters60/1013674
ataaaat

SEQ ID NO: 92784 - DNA, 7 bp, Unknown
  misc_feature (1)..( 7): Result.001 file - promoters60/1013674
atacaat

SEQ ID NO: 92785 - DNA, 7 bp, Unknown
  misc_feature (1)..( 7): Result.001 file - promoters60/1013674
taccttt

SEQ ID NO: 92786 - DNA, 7 bp, Unknown
  misc_feature (1)..( 7): Result.001 file - promoters60/1013674
taccttt

SEQ ID NO: 92787 - DNA, 7 bp, Unknown
  misc_feature (1)..( 7): Result.001 file - promoters60/1013674
tttacta

SEQ ID NO: 92788 - DNA, 7 bp, Unknown
  misc_feature (1)..( 7): Result.001 file - promoters60/1013674
ttttcta

SEQ ID NO: 92789 - DNA, 6 bp, Unknown
  misc_feature (1)..( 6): Result.001 file - promoters60/1013674
atatat

SEQ ID NO: 92790 - DNA, 6 bp, Unknown
  misc_feature (1)..( 6): Result.001 file - promoters60/1013674
atatat

SEQ ID NO: 92791 - DNA, 7 bp, Unknown
  misc_feature (1)..( 7): Result.001 file - promoters60/1013674
atattat

SEQ ID NO: 92792 - DNA, 7 bp, Unknown
  misc_feature (1)..( 7): Result.001 file - promoters60/1013674
ataatat

SEQ ID NO: 92793 - DNA, 8 bp, Unknown
  misc_feature (1)..( 8): Result.001 file - promoters60/1013674
attacaat

SEQ ID NO: 92794 - DNA, 8 bp, Unknown
  misc_feature (1)..( 8): Result.001 file - promoters60/1013674
cttataat

SEQ ID NO: 92795 - DNA, 8 bp, Unknown
  misc_feature (1)..( 8): Result.001 file - promoters60/1013674
cttaaaat

SEQ ID NO: 92796 - DNA, 6 bp, Unknown
  misc_feature (1)..( 6): Result.001 file - promoters60/1013674
tttcct

SEQ ID NO: 92797 - DNA, 6 bp, Unknown
  misc_feature (1)..( 6): Result.001 file - promoters60/1013674
tttcct

SEQ ID NO: 92798 - DNA, 6 bp, Unknown
  misc_feature (1)..( 6): Result.001 file - promoters60/1013674
attttt

SEQ ID NO: 92799 - DNA, 6 bp, Unknown
  misc_feature (1)..( 6): Result.001 file - promoters60/1013674
attttt

SEQ ID NO: 92800 - DNA, 7 bp, Unknown
  misc_feature (1)..( 7): Result.001 file - promoters60/1013674
tttgtta

SEQ ID NO: 92801 - DNA, 7 bp, Unknown
  misc_feature (1)..( 7): Result.001 file - promoters60/1013674
tttgtta

SEQ ID NO: 92802 - DNA, 6 bp, Unknown
  misc_feature (1)..( 6): Result.001 file - promoters60/1013674
atttaa

SEQ ID NO: 92803 - DNA, 6 bp, Unknown
  misc_feature (1)..( 6): Result.001 file - promoters60/1013674
atttaa

SEQ ID NO: 92804 - DNA, 6 bp, Unknown
  misc_feature (1)..( 6): Result.001 file - promoters60/1013674
aataga

SEQ ID NO: 92805 - DNA, 6 bp, Unknown
  misc_feature (1)..( 6): Result.001 file - promoters60/1013674
aataga

SEQ ID NO: 92806 - DNA, 8 bp, Unknown
  misc_feature (1)..( 8): Result.001 file - promoters60/1013674
aaagaaag

SEQ ID NO: 92807 - DNA, 8 bp, Unknown
  misc_feature (1)..( 8): Result.001 file - promoters60/1013674
aaacaaag

SEQ ID NO: 92808 - DNA, 7 bp, Unknown
  misc_feature (1)..( 7): Result.001 file - promoters60/1013674
aacaaaa

SEQ ID NO: 92809 - DNA, 7 bp, Unknown
  misc_feature (1)..( 7): Result.001 file - promoters60/1013674
aacaaaa

SEQ ID NO: 92810 - DNA, 7 bp, Unknown
  misc_feature (1)..( 7): Result.001 file - promoters60/1013674
gacaaaa

SEQ ID NO: 92811 - DNA, 6 bp, Unknown
  misc_feature (1)..( 6): Result.001 file - promoters60/1013674
tgtatt

SEQ ID NO: 92812 - DNA, 6 bp, Unknown
  misc_feature (1)..( 6): Result.001 file - promoters60/1013674
tgtatt

SEQ ID NO: 92813 - DNA, 7 bp, Unknown
  misc_feature (1)..( 7): Result.001 file - promoters60/1013674
tatctgt

SEQ ID NO: 92814 - DNA, 7 bp, Unknown
  misc_feature (1)..( 7): Result.001 file - promoters60/1013674
tatttgt

SEQ ID NO: 92815 - DNA, 7 bp, Unknown
  misc_feature (1)..( 7): Result.001 file - promoters60/1013674
attgtat

SEQ ID NO: 92816 - DNA, 7 bp, Unknown
  misc_feature (1)..( 7): Result.001 file - promoters60/1013674
attgtat

SEQ ID NO: 92817 - DNA, 11 bp, Unknown
  misc_feature (1)..( 11): Result.001 file - promoters60/1013674
aaataataatt

SEQ ID NO: 92818 - DNA, 11 bp, Unknown
  misc_feature (1)..( 11): Result.001 file - promoters60/1013690
aaataataatt

SEQ ID NO: 92819 - DNA, 7 bp, Unknown
  misc_feature (1)..( 7): Result.001 file - promoters60/1013690
ttttaga

SEQ ID NO: 92820 - DNA, 7 bp, Unknown
  misc_feature (1)..( 7): Result.001 file - promoters60/1013690
tttcaga

SEQ ID NO: 92821 - DNA, 11 bp, Unknown
  misc_feature (1)..( 11): Result.001 file - promoters60/1013690
taagaggtata

SEQ ID NO: 92822 - DNA, 11 bp, Unknown
  misc_feature (1)..( 11): Result.001 file - promoters60/1013690
taacaggtacg

SEQ ID NO: 92823 - DNA, 11 bp, Unknown
  misc_feature (1)..( 11): Result.001 file - promoters60/1013690
gtggaggtata

SEQ ID NO: 92824 - DNA, 6 bp, Unknown
  misc_feature (1)..( 6): Result.001 file - promoters60/1013690
tatgtt

SEQ ID NO: 92825 - DNA, 6 bp, Unknown
  misc_feature (1)..( 6): Result.001 file - promoters60/1013690
tatgtt

SEQ ID NO: 92826 - DNA, 6 bp, Unknown
  misc_feature (1)..( 6): Result.001 file - promoters60/1013690
caagaa

SEQ ID NO: 92827 - DNA, 6 bp, Unknown
  misc_feature (1)..( 6): Result.001 file - promoters60/1013690
caagaa

SEQ ID NO: 92828 - DNA, 8 bp, Unknown
  misc_feature (1)..( 8): Result.001 file - promoters60/1013690
attattga

SEQ ID NO: 92829 - DNA, 8 bp, Unknown
  misc_feature (1)..( 8): Result.001 file - promoters60/1013690
attactga

SEQ ID NO: 92830 - DNA, 7 bp, Unknown
  misc_feature (1)..( 7): Result.001 file - promoters60/1013690
tattata

SEQ ID NO: 92831 - DNA, 7 bp, Unknown
  misc_feature (1)..( 7): Result.001 file - promoters60/1013690
tatcata

SEQ ID NO: 92832 - DNA, 6 bp, Unknown
  misc_feature (1)..( 6): Result.001 file - promoters60/1013690
aatttg

SEQ ID NO: 92833 - DNA, 6 bp, Unknown
  misc_feature (1)..( 6): Result.001 file - promoters60/1013690
aatttg

SEQ ID NO: 92834 - DNA, 6 bp, Unknown
  misc_feature (1)..( 6): Result.001 file - promoters60/1013690
tataaa

SEQ ID NO: 92835 - DNA, 6 bp, Unknown
  misc_feature (1)..( 6): Result.001 file - promoters60/1013690
tataaa

SEQ ID NO: 92836 - DNA, 6 bp, Unknown
  misc_feature (1)..( 6): Result.001 file - promoters60/1013690
tctcaa

SEQ ID NO: 92837 - DNA, 6 bp, Unknown
  misc_feature (1)..( 6): Result.001 file - promoters60/1013690
tctcaa

SEQ ID NO: 92838 - DNA, 7 bp, Unknown
  misc_feature (1)..( 7): Result.001 file - promoters60/1013690
aaccaca

SEQ ID NO: 92839 - DNA, 7 bp, Unknown
  misc_feature (1)..( 7): Result.001 file - promoters60/1013690
aaccaca

SEQ ID NO: 92840 - DNA, 6 bp, Unknown
  misc_feature (1)..( 6): Result.001 file - promoters60/1013690
ggctga

SEQ ID NO: 92841 - DNA, 6 bp, Unknown
  misc_feature (1)..( 6): Result.001 file - promoters60/1013690
ggctga

SEQ ID NO: 92842 - DNA, 11 bp, Unknown
  misc_feature (1)..( 11): Result.001 file - promoters60/1013690
aggttctcaga

SEQ ID NO: 92843 - DNA, 11 bp, Unknown
  misc_feature (1)..( 11): Result.001 file - promoters60/1013690
agggtctgaga

SEQ ID NO: 92844 - DNA, 6 bp, Unknown
  misc_feature (1)..( 6): Result.001 file - promoters60/1013690
agattt

SEQ ID NO: 92845 - DNA, 6 bp, Unknown
  misc_feature (1)..( 6): Result.001 file - promoters60/1013710
agattt

SEQ ID NO: 92846 - DNA, 6 bp, Unknown
  misc_feature (1)..( 6): Result.001 file - promoters60/1013710
acatgt

SEQ ID NO: 92847 - DNA, 6 bp, Unknown
  misc_feature (1)..( 6): Result.001 file - promoters60/1013710
acatgt

SEQ ID NO: 92848 - DNA, 8 bp, Unknown
  misc_feature (1)..( 8): Result.001 file - promoters60/1013710
taatgagt

SEQ ID NO: 92849 - DNA, 8 bp, Unknown
  misc_feature (1)..( 8): Result.001 file - promoters60/1013710
taatgata

SEQ ID NO: 92850 - DNA, 8 bp, Unknown
  misc_feature (1)..( 8): Result.001 file - promoters60/1013710
aaatcagt

SEQ ID NO: 92851 - DNA, 6 bp, Unknown
  misc_feature (1)..( 6): Result.001 file - promoters60/1013710
ttttaa

SEQ ID NO: 92852 - DNA, 6 bp, Unknown
  misc_feature (1)..( 6): Result.001 file - promoters60/1013710
ttttaa

SEQ ID NO: 92853 - DNA, 6 bp, Unknown
  misc_feature (1)..( 6): Result.001 file - promoters60/1013710
aaaata

SEQ ID NO: 92854 - DNA, 6 bp, Unknown
  misc_feature (1)..( 6): Result.001 file - promoters60/1013710
aaaata

SEQ ID NO: 92855 - DNA, 8 bp, Unknown
  misc_feature (1)..( 8): Result.001 file - promoters60/1013710
aagcattg

SEQ ID NO: 92856 - DNA, 8 bp, Unknown
  misc_feature (1)..( 8): Result.001 file - promoters60/1013710
aagctttg

SEQ ID NO: 92857 - DNA, 6 bp, Unknown
  misc_feature (1)..( 6): Result.001 file - promoters60/1013710
tccaca

SEQ ID NO: 92858 - DNA, 6 bp, Unknown
  misc_feature (1)..( 6): Result.001 file - promoters60/1013710
tccaca

SEQ ID NO: 92859 - DNA, 7 bp, Unknown
  misc_feature (1)..( 7): Result.001 file - promoters60/1013710
ttgaaat

SEQ ID NO: 92860 - DNA, 7 bp, Unknown
  misc_feature (1)..( 7): Result.001 file - promoters60/1013710
ttggaat

SEQ ID NO: 92861 - DNA, 6 bp, Unknown
  misc_feature (1)..( 6): Result.001 file - promoters60/1013710
aagaag

SEQ ID NO: 92862 - DNA, 6 bp, Unknown
  misc_feature (1)..( 6): Result.001 file - promoters60/1013710
aagaag

SEQ ID NO: 92863 - DNA, 6 bp, Unknown
  misc_feature (1)..( 6): Result.001 file - promoters60/1013710
aataaa

SEQ ID NO: 92864 - DNA, 6 bp, Unknown
  misc_feature (1)..( 6): Result.001 file - promoters60/1013710
aataaa

SEQ ID NO: 92865 - DNA, 8 bp, Unknown
  misc_feature (1)..( 8): Result.001 file - promoters60/1013710
aaaatttt

SEQ ID NO: 92866 - DNA, 8 bp, Unknown
  misc_feature (1)..( 8): Result.001 file - promoters60/1013710
aaaacttt

SEQ ID NO: 92867 - DNA, 9 bp, Unknown
  misc_feature (1)..( 9): Result.001 file - promoters60/1013710
taaaaagag

SEQ ID NO: 92868 - DNA, 9 bp, Unknown
  misc_feature (1)..( 9): Result.001 file - promoters60/1013710
taagaagag

SEQ ID NO: 92869 - DNA, 7 bp, Unknown
  misc_feature (1)..( 7): Result.001 file - promoters60/1013710
tttcaag

SEQ ID NO: 92870 - DNA, 7 bp, Unknown
  misc_feature (1)..( 7): Result.001 file - promoters60/1013710
ttttaag

SEQ ID NO: 92871 - DNA, 8 bp, Unknown
  misc_feature (1)..( 8): Result.001 file - promoters60/1013710
agctatac

SEQ ID NO: 92872 - DNA, 8 bp, Unknown
  misc_feature (1)..( 8): Result.001 file - promoters60/1013710
agccatac

SEQ ID NO: 92873 - DNA, 10 bp, Unknown
  misc_feature (1)..( 10): Result.001 file - promoters60/1013710
cttgattaac

SEQ ID NO: 92874 - DNA, 10 bp, Unknown
  misc_feature (1)..( 10): Result.001 file - promoters60/1013710
cttgaataac

SEQ ID NO: 92875 - DNA, 9 bp, Unknown
  misc_feature (1)..( 9): Result.001 file - promoters60/1013710
taaactaaa

SEQ ID NO: 92876 - DNA, 9 bp, Unknown
  misc_feature (1)..( 9): Result.001 file - promoters60/1013714
taaacgaaa

SEQ ID NO: 92877 - DNA, 6 bp, Unknown
  misc_feature (1)..( 6): Result.001 file - promoters60/1013714
tctttt

SEQ ID NO: 92878 - DNA, 6 bp, Unknown
  misc_feature (1)..( 6): Result.001 file - promoters60/1013714
tctttt

SEQ ID NO: 92879 - DNA, 8 bp, Unknown
  misc_feature (1)..( 8): Result.001 file - promoters60/1013714
atttaaat

SEQ ID NO: 92880 - DNA, 8 bp, Unknown
  misc_feature (1)..( 8): Result.001 file - promoters60/1013714
atttcaat

SEQ ID NO: 92881 - DNA, 7 bp, Unknown
  misc_feature (1)..( 7): Result.001 file - promoters60/1013714
aaaaact

SEQ ID NO: 92882 - DNA, 7 bp, Unknown
  misc_feature (1)..( 7): Result.001 file - promoters60/1013714
aaatact

SEQ ID NO: 92883 - DNA, 10 bp, Unknown
  misc_feature (1)..( 10): Result.001 file - promoters60/1013714
aaatagttat

SEQ ID NO: 92884 - DNA, 10 bp, Unknown
  misc_feature (1)..( 10): Result.001 file - promoters60/1013714
aaataattat

SEQ ID NO: 92885 - DNA, 6 bp, Unknown
  misc_feature (1)..( 6): Result.001 file - promoters60/1013714
atgatc

SEQ ID NO: 92886 - DNA, 6 bp, Unknown
  misc_feature (1)..( 6): Result.001 file - promoters60/1013714
atgatc

SEQ ID NO: 92887 - DNA, 7 bp, Unknown
  misc_feature (1)..( 7): Result.001 file - promoters60/1013714
cacgaca

SEQ ID NO: 92888 - DNA, 7 bp, Unknown
  misc_feature (1)..( 7): Result.001 file - promoters60/1013714
cactaca

SEQ ID NO: 92889 - DNA, 7 bp, Unknown
  misc_feature (1)..( 7): Result.001 file - promoters60/1013714
ttctaaa

SEQ ID NO: 92890 - DNA, 7 bp, Unknown
  misc_feature (1)..( 7): Result.001 file - promoters60/1013714
ttcaaaa

SEQ ID NO: 92891 - DNA, 8 bp, Unknown
  misc_feature (1)..( 8): Result.001 file - promoters60/1013714
aaagtaag

SEQ ID NO: 92892 - DNA, 8 bp, Unknown
  misc_feature (1)..( 8): Result.001 file - promoters60/1013714
aaaggaag

SEQ ID NO: 92893 - DNA, 9 bp, Unknown
  misc_feature (1)..( 9): Result.001 file - promoters60/1013714
gaaaaaagt

SEQ ID NO: 92894 - DNA, 9 bp, Unknown
  misc_feature (1)..( 9): Result.001 file - promoters60/1013714
gaacaaagt

SEQ ID NO: 92895 - DNA, 11 bp, Unknown
  misc_feature (1)..( 11): Result.001 file - promoters60/1013714
tatatatccgc

SEQ ID NO: 92896 - DNA, 11 bp, Unknown
  misc_feature (1)..( 11): Result.001 file - promoters60/1013714
tatataatagt

SEQ ID NO: 92897 - DNA, 11 bp, Unknown
  misc_feature (1)..( 11): Result.001 file - promoters60/1013714
tatataaatcc

SEQ ID NO: 92898 - DNA, 9 bp, Unknown
  misc_feature (1)..( 9): Result.001 file - promoters60/1013714
gccttgaac

SEQ ID NO: 92899 - DNA, 9 bp, Unknown
  misc_feature (1)..( 9): Result.001 file - promoters60/1013714
gccatgaac

SEQ ID NO: 92900 - DNA, 8 bp, Unknown
  misc_feature (1)..( 8): Result.001 file - promoters60/1013714
cattgtca

SEQ ID NO: 92901 - DNA, 8 bp, Unknown
  misc_feature (1)..( 8): Result.001 file - promoters60/1013714
cattatca

SEQ ID NO: 92902 - DNA, 8 bp, Unknown
  misc_feature (1)..( 8): Result.001 file - promoters60/1013714
atgcaatt

SEQ ID NO: 92903 - DNA, 8 bp, Unknown
  misc_feature (1)..( 8): Result.001 file - promoters60/1013714
atgaaatt

SEQ ID NO: 92904 - DNA, 8 bp, Unknown
  misc_feature (1)..( 8): Result.001 file - promoters60/1013714
ttgtattt

SEQ ID NO: 92905 - DNA, 8 bp, Unknown
  misc_feature (1)..( 8): Result.001 file - promoters60/1013714
ttgtgttt

SEQ ID NO: 92906 - DNA, 8 bp, Unknown
  misc_feature (1)..( 8): Result.001 file - promoters60/1013714
ttattttt

SEQ ID NO: 92907 - DNA, 8 bp, Unknown
  misc_feature (1)..( 8): Result.001 file - promoters60/1013714
ttaatttt

SEQ ID NO: 92908 - DNA, 6 bp, Unknown
  misc_feature (1)..( 6): Result.001 file - promoters60/1013714
aaattt

SEQ ID NO: 92909 - DNA, 6 bp, Unknown
  misc_feature (1)..( 6): Result.001 file - promoters60/1013714
aaattt

SEQ ID NO: 92910 - DNA, 7 bp, Unknown
  misc_feature (1)..( 7): Result.001 file - promoters60/1013714
aacgtta

SEQ ID NO: 92911 - DNA, 7 bp, Unknown
  misc_feature (1)..( 7): Result.001 file - promoters60/1013714
aacctta

SEQ ID NO: 92912 - DNA, 9 bp, Unknown
  misc_feature (1)..( 9): Result.001 file - promoters60/1013714
cattctaaa

SEQ ID NO: 92913 - DNA, 9 bp, Unknown
  misc_feature (1)..( 9): Result.001 file - promoters60/1013714
cattttaaa

SEQ ID NO: 92914 - DNA, 6 bp, Unknown
  misc_feature (1)..( 6): Result.001 file - promoters60/1013714
aagcat

SEQ ID NO: 92915 - DNA, 6 bp, Unknown
  misc_feature (1)..( 6): Result.001 file - promoters60/1013714
aagcat

SEQ ID NO: 92916 - DNA, 7 bp, Unknown
  misc_feature (1)..( 7): Result.001 file - promoters60/1013714
atttttt

SEQ ID NO: 92917 - DNA, 7 bp, Unknown
  misc_feature (1)..( 7): Result.001 file - promoters60/1013714
atttttt

SEQ ID NO: 92918 - DNA, 8 bp, Unknown
  misc_feature (1)..( 8): Result.001 file - promoters60/1013714
aaattgct

SEQ ID NO: 92919 - DNA, 8 bp, Unknown
  misc_feature (1)..( 8): Result.001 file - promoters60/1013714
aaattgct

SEQ ID NO: 92920 - DNA, 8 bp, Unknown
  misc_feature (1)..( 8): Result.001 file - promoters60/1013714
aaaacatg

SEQ ID NO: 92921 - DNA, 8 bp, Unknown
  misc_feature (1)..( 8): Result.001 file - promoters60/1013714
aaaaaatg

SEQ ID NO: 92922 - DNA, 6 bp, Unknown
  misc_feature (1)..( 6): Result.001 file - promoters60/1013714
aaatat

SEQ ID NO: 92923 - DNA, 6 bp, Unknown
  misc_feature (1)..( 6): Result.001 file - promoters60/1013714
aaatat

SEQ ID NO: 92924 - DNA, 6 bp, Unknown
  misc_feature (1)..( 6): Result.001 file - promoters60/1013714
aattta

SEQ ID NO: 92925 - DNA, 6 bp, Unknown
  misc_feature (1)..( 6): Result.001 file - promoters60/1013764
aattta

SEQ ID NO: 92926 - DNA, 8 bp, Unknown
  misc_feature (1)..( 8): Result.001 file - promoters60/1013764
tattatgt

SEQ ID NO: 92927 - DNA, 8 bp, Unknown
  misc_feature (1)..( 8): Result.001 file - promoters60/1013764
tattgtgt

SEQ ID NO: 92928 - DNA, 8 bp, Unknown
  misc_feature (1)..( 8): Result.001 file - promoters60/1013764
gaccgatc

SEQ ID NO: 92929 - DNA, 8 bp, Unknown
  misc_feature (1)..( 8): Result.001 file - promoters60/1013764
taccaatc

SEQ ID NO: 92930 - DNA, 8 bp, Unknown
  misc_feature (1)..( 8): Result.001 file - promoters60/1013764
taccaaat

SEQ ID NO: 92931 - DNA, 7 bp, Unknown
  misc_feature (1)..( 7): Result.001 file - promoters60/1013764
gtatgtt

SEQ ID NO: 92932 - DNA, 7 bp, Unknown
  misc_feature (1)..( 7): Result.001 file - promoters60/1013764
gtaggtt

SEQ ID NO: 92933 - DNA, 6 bp, Unknown
  misc_feature (1)..( 6): Result.001 file - promoters60/1013764
gtttct

SEQ ID NO: 92934 - DNA, 6 bp, Unknown
  misc_feature (1)..( 6): Result.001 file - promoters60/1013764
gtttct

SEQ ID NO: 92935 - DNA, 6 bp, Unknown
  misc_feature (1)..( 6): Result.001 file - promoters60/1013764
gttttg

SEQ ID NO: 92936 - DNA, 6 bp, Unknown
  misc_feature (1)..( 6): Result.001 file - promoters60/1013764
gttttg

SEQ ID NO: 92937 - DNA, 6 bp, Unknown
  misc_feature (1)..( 6): Result.001 file - promoters60/1013764
tagtaa

SEQ ID NO: 92938 - DNA, 6 bp, Unknown
  misc_feature (1)..( 6): Result.001 file - promoters60/1013764
tagtaa

SEQ ID NO: 92939 - DNA, 7 bp, Unknown
  misc_feature (1)..( 7): Result.001 file - promoters60/1013764
atatctg

SEQ ID NO: 92940 - DNA, 7 bp, Unknown
  misc_feature (1)..( 7): Result.001 file - promoters60/1013764
atatctg

SEQ ID NO: 92941 - DNA, 8 bp, Unknown
  misc_feature (1)..( 8): Result.001 file - promoters60/1013764
gctaccat

SEQ ID NO: 92942 - DNA, 8 bp, Unknown
  misc_feature (1)..( 8): Result.001 file - promoters60/1013764
gctagcat

SEQ ID NO: 92943 - DNA, 6 bp, Unknown
  misc_feature (1)..( 6): Result.001 file - promoters60/1013764
ggtgag

SEQ ID NO: 92944 - DNA, 6 bp, Unknown
  misc_feature (1)..( 6): Result.001 file - promoters60/1013764
ggtgag

SEQ ID NO: 92945 - DNA, 11 bp, Unknown
  misc_feature (1)..( 11): Result.001 file - promoters60/1013764
tgttgtttcct

SEQ ID NO: 92946 - DNA, 11 bp, Unknown
  misc_feature (1)..( 11): Result.001 file - promoters60/1013764
acttgtctcct

SEQ ID NO: 92947 - DNA, 11 bp, Unknown
  misc_feature (1)..( 11): Result.001 file - promoters60/1013764
actcgtcgttt

SEQ ID NO: 92948 - DNA, 7 bp, Unknown
  misc_feature (1)..( 7): Result.001 file - promoters60/1013764
gtgctaa

SEQ ID NO: 92949 - DNA, 7 bp, Unknown
  misc_feature (1)..( 7): Result.001 file - promoters60/1013764
gtgttaa

SEQ ID NO: 92950 - DNA, 7 bp, Unknown
  misc_feature (1)..( 7): Result.001 file - promoters60/1013764
gatgaag

SEQ ID NO: 92951 - DNA, 7 bp, Unknown
  misc_feature (1)..( 7): Result.001 file - promoters60/1013764
gattaag

SEQ ID NO: 92952 - DNA, 7 bp, Unknown
  misc_feature (1)..( 7): Result.001 file - promoters60/1013764
tctacct

SEQ ID NO: 92953 - DNA, 7 bp, Unknown
  misc_feature (1)..( 7): Result.001 file - promoters60/1013764
tcttcct

SEQ ID NO: 92954 - DNA, 7 bp, Unknown
  misc_feature (1)..( 7): Result.001 file - promoters60/1013764
cttattg

SEQ ID NO: 92955 - DNA, 7 bp, Unknown
  misc_feature (1)..( 7): Result.001 file - promoters60/1013764
cttcttg

SEQ ID NO: 92956 - DNA, 7 bp, Unknown
  misc_feature (1)..( 7): Result.001 file - promoters60/1013764
gtttctt

SEQ ID NO: 92957 - DNA, 7 bp, Unknown
  misc_feature (1)..( 7): Result.001 file - promoters60/1013805
gttcctt

SEQ ID NO: 92958 - DNA, 9 bp, Unknown
  misc_feature (1)..( 9): Result.001 file - promoters60/1013805
attctttca

SEQ ID NO: 92959 - DNA, 9 bp, Unknown
  misc_feature (1)..( 9): Result.001 file - promoters60/1013805
cttctttgg

SEQ ID NO: 92960 - DNA, 9 bp, Unknown
  misc_feature (1)..( 9): Result.001 file - promoters60/1013805
tttcttttt

SEQ ID NO: 92961 - DNA, 9 bp, Unknown
  misc_feature (1)..( 9): Result.001 file - promoters60/1013805
attgttttc

SEQ ID NO: 92962 - DNA, 9 bp, Unknown
  misc_feature (1)..( 9): Result.001 file - promoters60/1013805
tgtcttttg

SEQ ID NO: 92963 - DNA, 9 bp, Unknown
  misc_feature (1)..( 9): Result.001 file - promoters60/1013850
agtgttttc

SEQ ID NO: 92964 - DNA, 7 bp, Unknown
  misc_feature (1)..( 7): Result.001 file - promoters60/1013850
attttaa

SEQ ID NO: 92965 - DNA, 7 bp, Unknown
  misc_feature (1)..( 7): Result.001 file - promoters60/1013850
attataa

SEQ ID NO: 92966 - DNA, 6 bp, Unknown
  misc_feature (1)..( 6): Result.001 file - promoters60/1013850
gttcta

SEQ ID NO: 92967 - DNA, 6 bp, Unknown
  misc_feature (1)..( 6): Result.001 file - promoters60/1013850
gttcta

SEQ ID NO: 92968 - DNA, 6 bp, Unknown
  misc_feature (1)..( 6): Result.001 file - promoters60/1013850
atttga

SEQ ID NO: 92969 - DNA, 6 bp, Unknown
  misc_feature (1)..( 6): Result.001 file - promoters60/1013850
atttga

SEQ ID NO: 92970 - DNA, 6 bp, Unknown
  misc_feature (1)..( 6): Result.001 file - promoters60/1013850
ttaaaa

SEQ ID NO: 92971 - DNA, 6 bp, Unknown
  misc_feature (1)..( 6): Result.001 file - promoters60/1013850
ttaaaa

SEQ ID NO: 92972 - DNA, 8 bp, Unknown
  misc_feature (1)..( 8): Result.001 file - promoters60/1013850
attttgtt

SEQ ID NO: 92973 - DNA, 8 bp, Unknown
  misc_feature (1)..( 8): Result.001 file - promoters60/1013850
attgtgtt

SEQ ID NO: 92974 - DNA, 6 bp, Unknown
  misc_feature (1)..( 6): Result.001 file - promoters60/1013850
aaaatt

SEQ ID NO: 92975 - DNA, 6 bp, Unknown
  misc_feature (1)..( 6): Result.001 file - promoters60/1013850
aaaatt

SEQ ID NO: 92976 - DNA, 6 bp, Unknown
  misc_feature (1)..( 6): Result.001 file - promoters60/1013850
tttggt

SEQ ID NO: 92977 - DNA, 6 bp, Unknown
  misc_feature (1)..( 6): Result.001 file - promoters60/1013850
tttggt

SEQ ID NO: 92978 - DNA, 6 bp, Unknown
  misc_feature (1)..( 6): Result.001 file - promoters60/1013850
aaaaaa

SEQ ID NO: 92979 - DNA, 6 bp, Unknown
  misc_feature (1)..( 6): Result.001 file - promoters60/1013850
aaaaaa

SEQ ID NO: 92980 - DNA, 8 bp, Unknown
  misc_feature (1)..( 8): Result.001 file - promoters60/1013850
gagaccca

SEQ ID NO: 92981 - DNA, 8 bp, Unknown
  misc_feature (1)..( 8): Result.001 file - promoters60/1013850
gagaacca

SEQ ID NO: 92982 - DNA, 7 bp, Unknown
  misc_feature (1)..( 7): Result.001 file - promoters60/1013850
tgaaacg

SEQ ID NO: 92983 - DNA, 7 bp, Unknown
  misc_feature (1)..( 7): Result.001 file - promoters60/1013850
tgatacg

SEQ ID NO: 92984 - DNA, 6 bp, Unknown
  misc_feature (1)..( 6): Result.001 file - promoters60/1013850
ccattt

SEQ ID NO: 92985 - DNA, 6 bp, Unknown
  misc_feature (1)..( 6): Result.001 file - promoters60/1013850
ccattt

SEQ ID NO: 92986 - DNA, 6 bp, Unknown
  misc_feature (1)..( 6): Result.001 file - promoters60/1013850
gttttt

SEQ ID NO: 92987 - DNA, 6 bp, Unknown
  misc_feature (1)..( 6): Result.001 file - promoters60/1013850
gttttt

SEQ ID NO: 92988 - DNA, 7 bp, Unknown
  misc_feature (1)..( 7): Result.001 file - promoters60/1013850
ggcttcg

SEQ ID NO: 92989 - DNA, 7 bp, Unknown
  misc_feature (1)..( 7): Result.001 file - promoters60/1013850
ggcgtcg

SEQ ID NO: 92990 - DNA, 6 bp, Unknown
  misc_feature (1)..( 6): Result.001 file - promoters60/1013850
aagccc

SEQ ID NO: 92991 - DNA, 6 bp, Unknown
  misc_feature (1)..( 6): Result.001 file - promoters60/1013850
aagccc

SEQ ID NO: 92992 - DNA, 7 bp, Unknown
  misc_feature (1)..( 7): Result.001 file - promoters60/1013850
taagaga

SEQ ID NO: 92993 - DNA, 7 bp, Unknown
  misc_feature (1)..( 7): Result.001 file - promoters60/1013870
taataga

SEQ ID NO: 92994 - DNA, 6 bp, Unknown
  misc_feature (1)..( 6): Result.001 file - promoters60/1013870
aattta

SEQ ID NO: 92995 - DNA, 6 bp, Unknown
  misc_feature (1)..( 6): Result.001 file - promoters60/1013870
aattta

SEQ ID NO: 92996 - DNA, 8 bp, Unknown
  misc_feature (1)..( 8): Result.001 file - promoters60/1013870
attaatta

SEQ ID NO: 92997 - DNA, 8 bp, Unknown
  misc_feature (1)..( 8): Result.001 file - promoters60/1013870
tataatta

SEQ ID NO: 92998 - DNA, 8 bp, Unknown
  misc_feature (1)..( 8): Result.001 file - promoters60/1013870
tatgattt

SEQ ID NO: 92999 - DNA, 10 bp, Unknown
  misc_feature (1)..( 10): Result.001 file - promoters60/1013870
aataaaaata

SEQ ID NO: 93000 - DNA, 10 bp, Unknown
  misc_feature (1)..( 10): Result.001 file - promoters60/1013870
catataaata

SEQ ID NO: 93001 - DNA, 10 bp, Unknown
  misc_feature (1)..( 10): Result.001 file - promoters60/1013870
aataaactac

SEQ ID NO: 93002 - DNA, 7 bp, Unknown
  misc_feature (1)..( 7): Result.001 file - promoters60/1013870
tggcttg

SEQ ID NO: 93003 - DNA, 7 bp, Unknown
  misc_feature (1)..( 7): Result.001 file - promoters60/1013870
tggcttg

SEQ ID NO: 93004 - DNA, 7 bp, Unknown
  misc_feature (1)..( 7): Result.001 file - promoters60/1013870
tgggttg

SEQ ID NO: 93005 - DNA, 12 bp, Unknown
  misc_feature (1)..( 12): Result.001 file - promoters60/1013870
taagtttaaaaa

SEQ ID NO: 93006 - DNA, 12 bp, Unknown
  misc_feature (1)..( 12): Result.001 file - promoters60/1013870
taattttaataa

SEQ ID NO: 93007 - DNA, 12 bp, Unknown
  misc_feature (1)..( 12): Result.001 file - promoters60/1013870
tagatttattaa

SEQ ID NO: 93008 - DNA, 8 bp, Unknown
  misc_feature (1)..( 8): Result.001 file - promoters60/1013870
aaatctat

SEQ ID NO: 93009 - DNA, 8 bp, Unknown
  misc_feature (1)..( 8): Result.001 file - promoters60/1013870
aaatgtat

SEQ ID NO: 93010 - DNA, 7 bp, Unknown
  misc_feature (1)..( 7): Result.001 file - promoters60/1013870
acaatat

SEQ ID NO: 93011 - DNA, 7 bp, Unknown
  misc_feature (1)..( 7): Result.001 file - promoters60/1013870
acaatat

SEQ ID NO: 93012 - DNA, 9 bp, Unknown
  misc_feature (1)..( 9): Result.001 file - promoters60/1013870
ttacttata

SEQ ID NO: 93013 - DNA, 9 bp, Unknown
  misc_feature (1)..( 9): Result.001 file - promoters60/1013870
ttatttata

SEQ ID NO: 93014 - DNA, 6 bp, Unknown
  misc_feature (1)..( 6): Result.001 file - promoters60/1013870
tacctt

SEQ ID NO: 93015 - DNA, 6 bp, Unknown
  misc_feature (1)..( 6): Result.001 file - promoters60/1013870
tacctt

SEQ ID NO: 93016 - DNA, 7 bp, Unknown
  misc_feature (1)..( 7): Result.001 file - promoters60/1013870
aataata

SEQ ID NO: 93017 - DNA, 7 bp, Unknown
  misc_feature (1)..( 7): Result.001 file - promoters60/1013870
aataata

SEQ ID NO: 93018 - DNA, 6 bp, Unknown
  misc_feature (1)..( 6): Result.001 file - promoters60/1013870
atattt

SEQ ID NO: 93019 - DNA, 6 bp, Unknown
  misc_feature (1)..( 6): Result.001 file - promoters60/1013870
atattt

SEQ ID NO: 93020 - DNA, 7 bp, Unknown
  misc_feature (1)..( 7): Result.001 file - promoters60/1013870
tttattt

SEQ ID NO: 93021 - DNA, 7 bp, Unknown
  misc_feature (1)..( 7): Result.001 file - promoters60/1013870
tttgttt

SEQ ID NO: 93022 - DNA, 8 bp, Unknown
  misc_feature (1)..( 8): Result.001 file - promoters60/1013870
ttttgtca

SEQ ID NO: 93023 - DNA, 8 bp, Unknown
  misc_feature (1)..( 8): Result.001 file - promoters60/1013870
ttttgtca

SEQ ID NO: 93024 - DNA, 8 bp, Unknown
  misc_feature (1)..( 8): Result.001 file - promoters60/1013870
aatttatt

SEQ ID NO: 93025 - DNA, 8 bp, Unknown
  misc_feature (1)..( 8): Result.001 file - promoters60/1013870
aattcatt

SEQ ID NO: 93026 - DNA, 7 bp, Unknown
  misc_feature (1)..( 7): Result.001 file - promoters60/1013870
aactaaa

SEQ ID NO: 93027 - DNA, 7 bp, Unknown
  misc_feature (1)..( 7): Result.001 file - promoters60/1013870
aactaaa

SEQ ID NO: 93028 - DNA, 6 bp, Unknown
  misc_feature (1)..( 6): Result.001 file - promoters60/1013870
gattta

SEQ ID NO: 93029 - DNA, 6 bp, Unknown
  misc_feature (1)..( 6): Result.001 file - promoters60/1013870
gattta

SEQ ID NO: 93030 - DNA, 12 bp, Unknown
  misc_feature (1)..( 12): Result.001 file - promoters60/1013870
tagatttattaa

SEQ ID NO: 93031 - DNA, 12 bp, Unknown
  misc_feature (1)..( 12): Result.001 file - promoters60/1013870
tagaattactaa

SEQ ID NO: 93032 - DNA, 7 bp, Unknown
  misc_feature (1)..( 7): Result.001 file - promoters60/1013870
taataat

SEQ ID NO: 93033 - DNA, 7 bp, Unknown
  misc_feature (1)..( 7): Result.001 file - promoters60/1013870
taataat

SEQ ID NO: 93034 - DNA, 9 bp, Unknown
  misc_feature (1)..( 9): Result.001 file - promoters60/1013870
aattttttt

SEQ ID NO: 93035 - DNA, 9 bp, Unknown
  misc_feature (1)..( 9): Result.001 file - promoters60/1013870
aatattttt

SEQ ID NO: 93036 - DNA, 6 bp, Unknown
  misc_feature (1)..( 6): Result.001 file - promoters60/1013870
atattt

SEQ ID NO: 93037 - DNA, 6 bp, Unknown
  misc_feature (1)..( 6): Result.001 file - promoters60/1013870
atattt

SEQ ID NO: 93038 - DNA, 7 bp, Unknown
  misc_feature (1)..( 7): Result.001 file - promoters60/1013870
tatccaa

SEQ ID NO: 93039 - DNA, 7 bp, Unknown
  misc_feature (1)..( 7): Result.001 file - promoters60/1013870
tatacaa

SEQ ID NO: 93040 - DNA, 11 bp, Unknown
  misc_feature (1)..( 11): Result.001 file - promoters60/1013870
ttttctacaat

SEQ ID NO: 93041 - DNA, 11 bp, Unknown
  misc_feature (1)..( 11): Result.001 file - promoters60/1013870
ttttctaaaat

SEQ ID NO: 93042 - DNA, 7 bp, Unknown
  misc_feature (1)..( 7): Result.001 file - promoters60/1013870
ttataat

SEQ ID NO: 93043 - DNA, 7 bp, Unknown
  misc_feature (1)..( 7): Result.001 file - promoters60/1013870
ttataat

SEQ ID NO: 93044 - DNA, 6 bp, Unknown
  misc_feature (1)..( 6): Result.001 file - promoters60/1013870
aaaaaa

SEQ ID NO: 93045 - DNA, 6 bp, Unknown
  misc_feature (1)..( 6): Result.001 file - promoters60/1013870
aaaaaa

SEQ ID NO: 93046 - DNA, 8 bp, Unknown
  misc_feature (1)..( 8): Result.001 file - promoters60/1013870
taaatttc

SEQ ID NO: 93047 - DNA, 8 bp, Unknown
  misc_feature (1)..( 8): Result.001 file - promoters60/1013870
taactttc

SEQ ID NO: 93048 - DNA, 7 bp, Unknown
  misc_feature (1)..( 7): Result.001 file - promoters60/1013870
aagagaa

SEQ ID NO: 93049 - DNA, 7 bp, Unknown
  misc_feature (1)..( 7): Result.001 file - promoters60/1013878
aagtgaa

SEQ ID NO: 93050 - DNA, 8 bp, Unknown
  misc_feature (1)..( 8): Result.001 file - promoters60/1013878
ataatatg

SEQ ID NO: 93051 - DNA, 8 bp, Unknown
  misc_feature (1)..( 8): Result.001 file - promoters60/1013878
ttaagatg

SEQ ID NO: 93052 - DNA, 8 bp, Unknown
  misc_feature (1)..( 8): Result.001 file - promoters60/1013878
ataatata

SEQ ID NO: 93053 - DNA, 8 bp, Unknown
  misc_feature (1)..( 8): Result.001 file - promoters60/1013878
aaaaaatt

SEQ ID NO: 93054 - DNA, 9 bp, Unknown
  misc_feature (1)..( 9): Result.001 file - promoters60/1013878
atttataaa

SEQ ID NO: 93055 - DNA, 9 bp, Unknown
  misc_feature (1)..( 9): Result.001 file - promoters60/1013878
atttgtaaa

SEQ ID NO: 93056 - DNA, 9 bp, Unknown
  misc_feature (1)..( 9): Result.001 file - promoters60/1013878
atttatcct

SEQ ID NO: 93057 - DNA, 9 bp, Unknown
  misc_feature (1)..( 9): Result.001 file - promoters60/1013878
atttatatt

SEQ ID NO: 93058 - DNA, 8 bp, Unknown
  misc_feature (1)..( 8): Result.001 file - promoters60/1013878
ttacaaga

SEQ ID NO: 93059 - DNA, 8 bp, Unknown
  misc_feature (1)..( 8): Result.001 file - promoters60/1013878
ctacaaga

SEQ ID NO: 93060 - DNA, 8 bp, Unknown
  misc_feature (1)..( 8): Result.001 file - promoters60/1013878
ttagaaga

SEQ ID NO: 93061 - DNA, 10 bp, Unknown
  misc_feature (1)..( 10): Result.001 file - promoters60/1013878
taatttctat

SEQ ID NO: 93062 - DNA, 10 bp, Unknown
  misc_feature (1)..( 10): Result.001 file - promoters60/1013878
taaattcttc

SEQ ID NO: 93063 - DNA, 10 bp, Unknown
  misc_feature (1)..( 10): Result.001 file - promoters60/1013878
caatttatat

SEQ ID NO: 93064 - DNA, 10 bp, Unknown
  misc_feature (1)..( 10): Result.001 file - promoters60/1013878
taaattttgt

SEQ ID NO: 93065 - DNA, 15 bp, Unknown
  misc_feature (1)..( 15): Result.001 file - promoters60/1013878
acaagagaaacttgt

SEQ ID NO: 93066 - DNA, 15 bp, Unknown
  misc_feature (1)..( 15): Result.001 file - promoters60/1013878
agaaataaaaattgg

SEQ ID NO: 93067 - DNA, 15 bp, Unknown
  misc_feature (1)..( 15): Result.001 file - promoters60/1013878
agaaaaaaaaaatgg

SEQ ID NO: 93068 - DNA, 15 bp, Unknown
  misc_feature (1)..( 15): Result.001 file - promoters60/1013878
gaaactcaaaatttt

SEQ ID NO: 93069 - DNA, 9 bp, Unknown
  misc_feature (1)..( 9): Result.001 file - promoters60/1013878
aaatataat

SEQ ID NO: 93070 - DNA, 9 bp, Unknown
  misc_feature (1)..( 9): Result.001 file - promoters60/1013878
aaatatttt

SEQ ID NO: 93071 - DNA, 9 bp, Unknown
  misc_feature (1)..( 9): Result.001 file - promoters60/1013878
gaatctaat

SEQ ID NO: 93072 - DNA, 10 bp, Unknown
  misc_feature (1)..( 10): Result.001 file - promoters60/1013878
ctgcccgaaa

SEQ ID NO: 93073 - DNA, 10 bp, Unknown
  misc_feature (1)..( 10): Result.001 file - promoters60/1013878
ttacccaaaa

SEQ ID NO: 93074 - DNA, 10 bp, Unknown
  misc_feature (1)..( 10): Result.001 file - promoters60/1013881
ttacccaaat

SEQ ID NO: 93075 - DNA, 8 bp, Unknown
  misc_feature (1)..( 8): Result.001 file - promoters60/1013881
ggacaaaa

SEQ ID NO: 93076 - DNA, 8 bp, Unknown
  misc_feature (1)..( 8): Result.001 file - promoters60/1013881
ggataaaa

SEQ ID NO: 93077 - DNA, 8 bp, Unknown
  misc_feature (1)..( 8): Result.001 file - promoters60/1013881
aaataaaa

SEQ ID NO: 93078 - DNA, 11 bp, Unknown
  misc_feature (1)..( 11): Result.001 file - promoters60/1013881
tgtttagtttt

SEQ ID NO: 93079 - DNA, 11 bp, Unknown
  misc_feature (1)..( 11): Result.001 file - promoters60/1013881
agtttattttt

SEQ ID NO: 93080 - DNA, 11 bp, Unknown
  misc_feature (1)..( 11): Result.001 file - promoters60/1013881
agtatatatat

SEQ ID NO: 93081 - DNA, 8 bp, Unknown
  misc_feature (1)..( 8): Result.001 file - promoters60/1013881
attttctt

SEQ ID NO: 93082 - DNA, 8 bp, Unknown
  misc_feature (1)..( 8): Result.001 file - promoters60/1013881
tttttctc

SEQ ID NO: 93083 - DNA, 8 bp, Unknown
  misc_feature (1)..( 8): Result.001 file - promoters60/1013881
attttctt

SEQ ID NO: 93084 - DNA, 9 bp, Unknown
  misc_feature (1)..( 9): Result.001 file - promoters60/1013881
ttttcttta

SEQ ID NO: 93085 - DNA, 9 bp, Unknown
  misc_feature (1)..( 9): Result.001 file - promoters60/1013881
ttttctcaa

SEQ ID NO: 93086 - DNA, 9 bp, Unknown
  misc_feature (1)..( 9): Result.001 file - promoters60/1013881
atttattta

SEQ ID NO: 93087 - DNA, 7 bp, Unknown
  misc_feature (1)..( 7): Result.001 file - promoters60/1013881
caatttt

SEQ ID NO: 93088 - DNA, 7 bp, Unknown
  misc_feature (1)..( 7): Result.001 file - promoters60/1013881
caatttt

SEQ ID NO: 93089 - DNA, 8 bp, Unknown
  misc_feature (1)..( 8): Result.001 file - promoters60/1013881
caatattt

SEQ ID NO: 93090 - DNA, 7 bp, Unknown
  misc_feature (1)..( 7): Result.001 file - promoters60/1013881
ttattac

SEQ ID NO: 93091 - DNA, 7 bp, Unknown
  misc_feature (1)..( 7): Result.001 file - promoters60/1013881
ttactac

SEQ ID NO: 93092 - DNA, 7 bp, Unknown
  misc_feature (1)..( 7): Result.001 file - promoters60/1013893
ttactaa

SEQ ID NO: 93093 - DNA, 12 bp, Unknown
  misc_feature (1)..( 12): Result.001 file - promoters60/1013893
catctccacaaa

SEQ ID NO: 93094 - DNA, 12 bp, Unknown
  misc_feature (1)..( 12): Result.001 file - promoters60/1013893
agaatacacaaa

SEQ ID NO: 93095 - DNA, 12 bp, Unknown
  misc_feature (1)..( 12): Result.001 file - promoters60/1013893
caagtccataaa

SEQ ID NO: 93096 - DNA, 12 bp, Unknown
  misc_feature (1)..( 12): Result.001 file - promoters60/1013893
tttctactcaaa

SEQ ID NO: 93097 - DNA, 12 bp, Unknown
  misc_feature (1)..( 12): Result.001 file - promoters60/1013893
attatacaaaaa

SEQ ID NO: 93098 - DNA, 12 bp, Unknown
  misc_feature (1)..( 12): Result.001 file - promoters60/1013893
aaagtataaaaa

SEQ ID NO: 93099 - DNA, 9 bp, Unknown
  misc_feature (1)..( 9): Result.001 file - promoters60/1013893
atttagtgg

SEQ ID NO: 93100 - DNA, 9 bp, Unknown
  misc_feature (1)..( 9): Result.001 file - promoters60/1013893
tttttgtgt

SEQ ID NO: 93101 - DNA, 9 bp, Unknown
  misc_feature (1)..( 9): Result.001 file - promoters60/1013893
atttggtgg

SEQ ID NO: 93102 - DNA, 9 bp, Unknown
  misc_feature (1)..( 9): Result.001 file - promoters60/1013893
cttttgtct

SEQ ID NO: 93103 - DNA, 9 bp, Unknown
  misc_feature (1)..( 9): Result.001 file - promoters60/1013893
attttgttt

SEQ ID NO: 93104 - DNA, 9 bp, Unknown
  misc_feature (1)..( 9): Result.001 file - promoters60/1013904
cttttgggc

SEQ ID NO: 93105 - DNA, 7 bp, Unknown
  misc_feature (1)..( 7): Result.001 file - promoters60/1013904
atataat

SEQ ID NO: 93106 - DNA, 7 bp, Unknown
  misc_feature (1)..( 7): Result.001 file - promoters60/1013904
ttataat

SEQ ID NO: 93107 - DNA, 7 bp, Unknown
  misc_feature (1)..( 7): Result.001 file - promoters60/1013904
atataac

SEQ ID NO: 93108 - DNA, 7 bp, Unknown
  misc_feature (1)..( 7): Result.001 file - promoters60/1013904
atatttt

SEQ ID NO: 93109 - DNA, 9 bp, Unknown
  misc_feature (1)..( 9): Result.001 file - promoters60/1013904
tatttaata

SEQ ID NO: 93110 - DNA, 9 bp, Unknown
  misc_feature (1)..( 9): Result.001 file - promoters60/1013904
aatttaatt

SEQ ID NO: 93111 - DNA, 9 bp, Unknown
  misc_feature (1)..( 9): Result.001 file - promoters60/1013904
tatttattt

SEQ ID NO: 93112 - DNA, 9 bp, Unknown
  misc_feature (1)..( 9): Result.001 file - promoters60/1013904
tgtttgatt

SEQ ID NO: 93113 - DNA, 10 bp, Unknown
  misc_feature (1)..( 10): Result.001 file - promoters60/1013904
tgataaaatt

SEQ ID NO: 93114 - DNA, 10 bp, Unknown
  misc_feature (1)..( 10): Result.001 file - promoters60/1013904
aaatacaatc

SEQ ID NO: 93115 - DNA, 10 bp, Unknown
  misc_feature (1)..( 10): Result.001 file - promoters60/1013904
tgatcaaatc

SEQ ID NO: 93116 - DNA, 10 bp, Unknown
  misc_feature (1)..( 10): Result.001 file - promoters60/1013904
ttataatatt

SEQ ID NO: 93117 - DNA, 8 bp, Unknown
  misc_feature (1)..( 8): Result.001 file - promoters60/1013904
aatttaat

SEQ ID NO: 93118 - DNA, 8 bp, Unknown
  misc_feature (1)..( 8): Result.001 file - promoters60/1013904
aatctaac

SEQ ID NO: 93119 - DNA, 8 bp, Unknown
  misc_feature (1)..( 8): Result.001 file - promoters60/1013904
attctaac

SEQ ID NO: 93120 - DNA, 8 bp, Unknown
  misc_feature (1)..( 8): Result.001 file - promoters60/1013904
tttctaaa

SEQ ID NO: 93121 - DNA, 9 bp, Unknown
  misc_feature (1)..( 9): Result.001 file - promoters60/1013904
caaacttat

SEQ ID NO: 93122 - DNA, 9 bp, Unknown
  misc_feature (1)..( 9): Result.001 file - promoters60/1013904
caaaattat

SEQ ID NO: 93123 - DNA, 9 bp, Unknown
  misc_feature (1)..( 9): Result.001 file - promoters60/1013904
caatatttg

SEQ ID NO: 93124 - DNA, 9 bp, Unknown
  misc_feature (1)..( 9): Result.001 file - promoters60/1013907
caatatgtg

SEQ ID NO: 93125 - DNA, 9 bp, Unknown
  misc_feature (1)..( 9): Result.001 file - promoters60/1013907
tttactttc

SEQ ID NO: 93126 - DNA, 9 bp, Unknown
  misc_feature (1)..( 9): Result.001 file - promoters60/1013907
gggactttc

SEQ ID NO: 93127 - DNA, 9 bp, Unknown
  misc_feature (1)..( 9): Result.001 file - promoters60/1013907
ttttctttg

SEQ ID NO: 93128 - DNA, 8 bp, Unknown
  misc_feature (1)..( 8): Result.001 file - promoters60/1013907
aaagattg

SEQ ID NO: 93129 - DNA, 8 bp, Unknown
  misc_feature (1)..( 8): Result.001 file - promoters60/1013907
aaagcttg

SEQ ID NO: 93130 - DNA, 8 bp, Unknown
  misc_feature (1)..( 8): Result.001 file - promoters60/1013907
aaaaattt

SEQ ID NO: 93131 - DNA, 8 bp, Unknown
  misc_feature (1)..( 8): Result.001 file - promoters60/1013907
tagttata

SEQ ID NO: 93132 - DNA, 8 bp, Unknown
  misc_feature (1)..( 8): Result.001 file - promoters60/1013907
tagatatt

SEQ ID NO: 93133 - DNA, 8 bp, Unknown
  misc_feature (1)..( 8): Result.001 file - promoters60/1013907
tggatatt

SEQ ID NO: 93134 - DNA, 7 bp, Unknown
  misc_feature (1)..( 7): Result.001 file - promoters60/1013907
ccactaa

SEQ ID NO: 93135 - DNA, 7 bp, Unknown
  misc_feature (1)..( 7): Result.001 file - promoters60/1013907
ccattaa

SEQ ID NO: 93136 - DNA, 7 bp, Unknown
  misc_feature (1)..( 7): Result.001 file - promoters60/1013907
ccattag

SEQ ID NO: 93137 - DNA, 9 bp, Unknown
  misc_feature (1)..( 9): Result.001 file - promoters60/1013907
cttaattta

SEQ ID NO: 93138 - DNA, 9 bp, Unknown
  misc_feature (1)..( 9): Result.001 file - promoters60/1013907
actaaatta

SEQ ID NO: 93139 - DNA, 9 bp, Unknown
  misc_feature (1)..( 9): Result.001 file - promoters60/1013907
actgaattc

SEQ ID NO: 93140 - DNA, 9 bp, Unknown
  misc_feature (1)..( 9): Result.001 file - promoters60/1013907
tttagaatc

SEQ ID NO: 93141 - DNA, 9 bp, Unknown
  misc_feature (1)..( 9): Result.001 file - promoters60/1013907
tttaaaatc

SEQ ID NO: 93142 - DNA, 9 bp, Unknown
  misc_feature (1)..( 9): Result.001 file - promoters60/1013923
tttaaatgg

SEQ ID NO: 93143 - DNA, 12 bp, Unknown
  misc_feature (1)..( 12): Result.001 file - promoters60/1013923
acaattttagtt

SEQ ID NO: 93144 - DNA, 11 bp, Unknown
  misc_feature (1)..( 11): Result.001 file - promoters60/1013923
aaatttttagc

SEQ ID NO: 93145 - DNA, 12 bp, Unknown
  misc_feature (1)..( 12): Result.001 file - promoters60/1013923
aagatttttgtt

SEQ ID NO: 93146 - DNA, 12 bp, Unknown
  misc_feature (1)..( 12): Result.001 file - promoters60/1013923
acaatattagaa

SEQ ID NO: 93147 - DNA, 12 bp, Unknown
  misc_feature (1)..( 12): Result.001 file - promoters60/1013923
agactttgggtg

SEQ ID NO: 93148 - DNA, 12 bp, Unknown
  misc_feature (1)..( 12): Result.001 file - promoters60/1013923
acaattttagtt

SEQ ID NO: 93149 - DNA, 12 bp, Unknown
  misc_feature (1)..( 12): Result.001 file - promoters60/1013923
aaatttttagcc

SEQ ID NO: 93150 - DNA, 12 bp, Unknown
  misc_feature (1)..( 12): Result.001 file - promoters60/1013923
aagatttttgtt

SEQ ID NO: 93151 - DNA, 12 bp, Unknown
  misc_feature (1)..( 12): Result.001 file - promoters60/1013923
acaatattagaa

SEQ ID NO: 93152 - DNA, 12 bp, Unknown
  misc_feature (1)..( 12): Result.001 file - promoters60/1013923
agactttgggtg

SEQ ID NO: 93153 - DNA, 11 bp, Unknown
  misc_feature (1)..( 11): Result.001 file - promoters60/1013923
ttttaatcgaa

SEQ ID NO: 93154 - DNA, 11 bp, Unknown
  misc_feature (1)..( 11): Result.001 file - promoters60/1013923
ttttaatcagc

SEQ ID NO: 93155 - DNA, 11 bp, Unknown
  misc_feature (1)..( 11): Result.001 file - promoters60/1013923
agttattcgaa

SEQ ID NO: 93156 - DNA, 11 bp, Unknown
  misc_feature (1)..( 11): Result.001 file - promoters60/1013923
atttattcagg

SEQ ID NO: 93157 - DNA, 10 bp, Unknown
  misc_feature (1)..( 10): Result.001 file - promoters60/1013923
ttcatctaat

SEQ ID NO: 93158 - DNA, 10 bp, Unknown
  misc_feature (1)..( 10): Result.001 file - promoters60/1013923
ttcatttaat

SEQ ID NO: 93159 - DNA, 10 bp, Unknown
  misc_feature (1)..( 10): Result.001 file - promoters60/1013923
ttcatcaagc

SEQ ID NO: 93160 - DNA, 10 bp, Unknown
  misc_feature (1)..( 10): Result.001 file - promoters60/1013923
ttcatttatt

SEQ ID NO: 93161 - DNA, 10 bp, Unknown
  misc_feature (1)..( 10): Result.001 file - promoters60/1013923
ttattgttgg

SEQ ID NO: 93162 - DNA, 8 bp, Unknown
  misc_feature (1)..( 8): Result.001 file - promoters60/1013923
tttcacaa

SEQ ID NO: 93163 - DNA, 8 bp, Unknown
  misc_feature (1)..( 8): Result.001 file - promoters60/1013923
tttcacat

SEQ ID NO: 93164 - DNA, 8 bp, Unknown
  misc_feature (1)..( 8): Result.001 file - promoters60/1013923
tttcacgg

SEQ ID NO: 93165 - DNA, 8 bp, Unknown
  misc_feature (1)..( 8): Result.001 file - promoters60/1013923
cttcccgg

SEQ ID NO: 93166 - DNA, 8 bp, Unknown
  misc_feature (1)..( 8): Result.001 file - promoters60/1013923
gataatat

SEQ ID NO: 93167 - DNA, 8 bp, Unknown
  misc_feature (1)..( 8): Result.001 file - promoters60/1013923
cataatat

SEQ ID NO: 93168 - DNA, 8 bp, Unknown
  misc_feature (1)..( 8): Result.001 file - promoters60/1013923
gataatgg

SEQ ID NO: 93169 - DNA, 8 bp, Unknown
  misc_feature (1)..( 8): Result.001 file - promoters60/1013923
gataattt

SEQ ID NO: 93170 - DNA, 9 bp, Unknown
  misc_feature (1)..( 9): Result.001 file - promoters60/1013923
acatttttt

SEQ ID NO: 93171 - DNA, 9 bp, Unknown
  misc_feature (1)..( 9): Result.001 file - promoters60/1013923
gaatttttt

SEQ ID NO: 93172 - DNA, 9 bp, Unknown
  misc_feature (1)..( 9): Result.001 file - promoters60/1013923
agatttttg

SEQ ID NO: 93173 - DNA, 9 bp, Unknown
  misc_feature (1)..( 9): Result.001 file - promoters60/1013931
agactttgg

SEQ ID NO: 93174 - DNA, 9 bp, Unknown
  misc_feature (1)..( 9): Result.001 file - promoters60/1013931
agaaacata

SEQ ID NO: 93175 - DNA, 9 bp, Unknown
  misc_feature (1)..( 9): Result.001 file - promoters60/1013931
agaagcata

SEQ ID NO: 93176 - DNA, 9 bp, Unknown
  misc_feature (1)..( 9): Result.001 file - promoters60/1013931
agaagcacc

SEQ ID NO: 93177 - DNA, 6 bp, Unknown
  misc_feature (1)..( 6): Result.001 file - promoters60/1013931
ttcagg

SEQ ID NO: 93178 - DNA, 6 bp, Unknown
  misc_feature (1)..( 6): Result.001 file - promoters60/1013931
ttcagg

SEQ ID NO: 93179 - DNA, 6 bp, Unknown
  misc_feature (1)..( 6): Result.001 file - promoters60/1013931
attggt

SEQ ID NO: 93180 - DNA, 6 bp, Unknown
  misc_feature (1)..( 6): Result.001 file - promoters60/1013931
attggt

SEQ ID NO: 93181 - DNA, 8 bp, Unknown
  misc_feature (1)..( 8): Result.001 file - promoters60/1013931
ttaaactt

SEQ ID NO: 93182 - DNA, 8 bp, Unknown
  misc_feature (1)..( 8): Result.001 file - promoters60/1013931
ttagactt

SEQ ID NO: 93183 - DNA, 8 bp, Unknown
  misc_feature (1)..( 8): Result.001 file - promoters60/1013931
atagactc

SEQ ID NO: 93184 - DNA, 8 bp, Unknown
  misc_feature (1)..( 8): Result.001 file - promoters60/1013931
ttgtgatt

SEQ ID NO: 93185 - DNA, 8 bp, Unknown
  misc_feature (1)..( 8): Result.001 file - promoters60/1013931
ttgtgatt

SEQ ID NO: 93186 - DNA, 10 bp, Unknown
  misc_feature (1)..( 10): Result.001 file - promoters60/1013931
ttctcttaga

SEQ ID NO: 93187 - DNA, 10 bp, Unknown
  misc_feature (1)..( 10): Result.001 file - promoters60/1013931
ttctcttaga

SEQ ID NO: 93188 - DNA, 8 bp, Unknown
  misc_feature (1)..( 8): Result.001 file - promoters60/1013931
aaaaattg

SEQ ID NO: 93189 - DNA, 8 bp, Unknown
  misc_feature (1)..( 8): Result.001 file - promoters60/1013931
aaaacttg

SEQ ID NO: 93190 - DNA, 6 bp, Unknown
  misc_feature (1)..( 6): Result.001 file - promoters60/1013931
cccttg

SEQ ID NO: 93191 - DNA, 6 bp, Unknown
  misc_feature (1)..( 6): Result.001 file - promoters60/1013931
cccttg

SEQ ID NO: 93192 - DNA, 10 bp, Unknown
  misc_feature (1)..( 10): Result.001 file - promoters60/1013931
atctctgctt

SEQ ID NO: 93193 - DNA, 10 bp, Unknown
  misc_feature (1)..( 10): Result.001 file - promoters60/1013931
atctctcgtg

SEQ ID NO: 93194 - DNA, 10 bp, Unknown
  misc_feature (1)..( 10): Result.001 file - promoters60/1013931
ttctctggtg

SEQ ID NO: 93195 - DNA, 7 bp, Unknown
  misc_feature (1)..( 7): Result.001 file - promoters60/1013931
tttgtat

SEQ ID NO: 93196 - DNA, 7 bp, Unknown
  misc_feature (1)..( 7): Result.001 file - promoters60/1013931
tttttat

SEQ ID NO: 93197 - DNA, 8 bp, Unknown
  misc_feature (1)..( 8): Result.001 file - promoters60/1013931
ttttattt

SEQ ID NO: 93198 - DNA, 8 bp, Unknown
  misc_feature (1)..( 8): Result.001 file - promoters60/1013931
tttgattt

SEQ ID NO: 93199 - DNA, 9 bp, Unknown
  misc_feature (1)..( 9): Result.001 file - promoters60/1013931
agttccata

SEQ ID NO: 93200 - DNA, 9 bp, Unknown
  misc_feature (1)..( 9): Result.001 file - promoters60/1013931
agtttcata

SEQ ID NO: 93201 - DNA, 7 bp, Unknown
  misc_feature (1)..( 7): Result.001 file - promoters60/1013931
tctttta

SEQ ID NO: 93202 - DNA, 7 bp, Unknown
  misc_feature (1)..( 7): Result.001 file - promoters60/1014010
tctttta

SEQ ID NO: 93203 - DNA, 14 bp, Unknown
  misc_feature (1)..( 14): Result.001 file - promoters60/1014010
gtaataaaataaga

SEQ ID NO: 93204 - DNA, 14 bp, Unknown
  misc_feature (1)..( 14): Result.001 file - promoters60/1014010
gtaataaaagggtt

SEQ ID NO: 93205 - DNA, 14 bp, Unknown
  misc_feature (1)..( 14): Result.001 file - promoters60/1014010
cccttaaaatttcg

SEQ ID NO: 93206 - DNA, 14 bp, Unknown
  misc_feature (1)..( 14): Result.001 file - promoters60/1014010
acattaaaagaaca

SEQ ID NO: 93207 - DNA, 14 bp, Unknown
  misc_feature (1)..( 14): Result.001 file - promoters60/1014010
cttcagaaaggaac

SEQ ID NO: 93208 - DNA, 7 bp, Unknown
  misc_feature (1)..( 7): Result.001 file - promoters60/1014010
aattaaa

SEQ ID NO: 93209 - DNA, 7 bp, Unknown
  misc_feature (1)..( 7): Result.001 file - promoters60/1014010
tattaaa

SEQ ID NO: 93210 - DNA, 7 bp, Unknown
  misc_feature (1)..( 7): Result.001 file - promoters60/1014010
tataaaa

SEQ ID NO: 93211 - DNA, 7 bp, Unknown
  misc_feature (1)..( 7): Result.001 file - promoters60/1014050
tataaaa

SEQ ID NO: 93212 - DNA, 12 bp, Unknown
  misc_feature (1)..( 12): Result.001 file - promoters60/1014050
ataaaatattaa

SEQ ID NO: 93213 - DNA, 12 bp, Unknown
  misc_feature (1)..( 12): Result.001 file - promoters60/1014050
cctaaataataa

SEQ ID NO: 93214 - DNA, 13 bp, Unknown
  misc_feature (1)..( 13): Result.001 file - promoters60/1014050
cccaaactatccc

SEQ ID NO: 93215 - DNA, 13 bp, Unknown
  misc_feature (1)..( 13): Result.001 file - promoters60/1014050
aaaaaaatatttt

SEQ ID NO: 93216 - DNA, 13 bp, Unknown
  misc_feature (1)..( 13): Result.001 file - promoters60/1014050
agataagtaagat

SEQ ID NO: 93217 - DNA, 13 bp, Unknown
  misc_feature (1)..( 13): Result.001 file - promoters60/1014050
agaaaagtctaaa

SEQ ID NO: 93218 - DNA, 13 bp, Unknown
  misc_feature (1)..( 13): Result.001 file - promoters60/1014125
ggaaaactagaat

SEQ ID NO: 93219 - DNA, 8 bp, Unknown
  misc_feature (1)..( 8): Result.001 file - promoters60/1014125
ccaaattt

SEQ ID NO: 93220 - DNA, 8 bp, Unknown
  misc_feature (1)..( 8): Result.001 file - promoters60/1014125
ccaatttt

SEQ ID NO: 93221 - DNA, 8 bp, Unknown
  misc_feature (1)..( 8): Result.001 file - promoters60/1014125
ataatttt

SEQ ID NO: 93222 - DNA, 10 bp, Unknown
  misc_feature (1)..( 10): Result.001 file - promoters60/1014125
ctaatgattt

SEQ ID NO: 93223 - DNA, 10 bp, Unknown
  misc_feature (1)..( 10): Result.001 file - promoters60/1014125
ctaagtttgg

SEQ ID NO: 93224 - DNA, 10 bp, Unknown
  misc_feature (1)..( 10): Result.001 file - promoters60/1014176
tatatgatta

SEQ ID NO: 93225 - DNA, 13 bp, Unknown
  misc_feature (1)..( 13): Result.001 file - promoters60/1014176
gattctattttta

SEQ ID NO: 93226 - DNA, 13 bp, Unknown
  misc_feature (1)..( 13): Result.001 file - promoters60/1014176
tttagcatttttg

SEQ ID NO: 93227 - DNA, 13 bp, Unknown
  misc_feature (1)..( 13): Result.001 file - promoters60/1014176
attctaattttct

SEQ ID NO: 93228 - DNA, 13 bp, Unknown
  misc_feature (1)..( 13): Result.001 file - promoters60/1014176
ttgccaatactat

SEQ ID NO: 93229 - DNA, 13 bp, Unknown
  misc_feature (1)..( 13): Result.001 file - promoters60/1014176
gtgttaattgtct

SEQ ID NO: 93230 - DNA, 13 bp, Unknown
  misc_feature (1)..( 13): Result.001 file - promoters60/1014180
ggaacaagtctct

SEQ ID NO: 93231 - DNA, 10 bp, Unknown
  misc_feature (1)..( 10): Result.001 file - promoters60/1014180
tttttaacat

SEQ ID NO: 93232 - DNA, 10 bp, Unknown
  misc_feature (1)..( 10): Result.001 file - promoters60/1014180
ctttgaacat

SEQ ID NO: 93233 - DNA, 11 bp, Unknown
  misc_feature (1)..( 11): Result.001 file - promoters60/1014180
ttttctaaaat

SEQ ID NO: 93234 - DNA, 11 bp, Unknown
  misc_feature (1)..( 11): Result.001 file - promoters60/1014180
tgttttaatta

SEQ ID NO: 93235 - DNA, 11 bp, Unknown
  misc_feature (1)..( 11): Result.001 file - promoters60/1014180
tcttcgaagca

SEQ ID NO: 93236 - DNA, 11 bp, Unknown
  misc_feature (1)..( 11): Result.001 file - promoters60/1014223
tgtttgattag

SEQ ID NO: 93237 - DNA, 7 bp, Unknown
  misc_feature (1)..( 7): Result.001 file - promoters60/1014223
aatctgt

SEQ ID NO: 93238 - DNA, 7 bp, Unknown
  misc_feature (1)..( 7): Result.001 file - promoters60/1014223
aatttgt

SEQ ID NO: 93239 - DNA, 7 bp, Unknown
  misc_feature (1)..( 7): Result.001 file - promoters60/1014223
cctacaa

SEQ ID NO: 93240 - DNA, 7 bp, Unknown
  misc_feature (1)..( 7): Result.001 file - promoters60/1014223
ccttcaa

SEQ ID NO: 93241 - DNA, 6 bp, Unknown
  misc_feature (1)..( 6): Result.001 file - promoters60/1014223
aagaga

SEQ ID NO: 93242 - DNA, 6 bp, Unknown
  misc_feature (1)..( 6): Result.001 file - promoters60/1014223
aagaga

SEQ ID NO: 93243 - DNA, 8 bp, Unknown
  misc_feature (1)..( 8): Result.001 file - promoters60/1014223
ttattttt

SEQ ID NO: 93244 - DNA, 8 bp, Unknown
  misc_feature (1)..( 8): Result.001 file - promoters60/1014223
ttattttt

SEQ ID NO: 93245 - DNA, 6 bp, Unknown
  misc_feature (1)..( 6): Result.001 file - promoters60/1014223
aaaaaa

SEQ ID NO: 93246 - DNA, 6 bp, Unknown
  misc_feature (1)..( 6): Result.001 file - promoters60/1014223
aaaaaa

SEQ ID NO: 93247 - DNA, 9 bp, Unknown
  misc_feature (1)..( 9): Result.001 file - promoters60/1014223
ttttgttat

SEQ ID NO: 93248 - DNA, 9 bp, Unknown
  misc_feature (1)..( 9): Result.001 file - promoters60/1014223
ttttggtat

SEQ ID NO: 93249 - DNA, 7 bp, Unknown
  misc_feature (1)..( 7): Result.001 file - promoters60/1014223
ttttatg

SEQ ID NO: 93250 - DNA, 7 bp, Unknown
  misc_feature (1)..( 7): Result.001 file - promoters60/1014223
tttaatg

SEQ ID NO: 93251 - DNA, 9 bp, Unknown
  misc_feature (1)..( 9): Result.001 file - promoters60/1014223
gtgtattgg

SEQ ID NO: 93252 - DNA, 9 bp, Unknown
  misc_feature (1)..( 9): Result.001 file - promoters60/1014223
gtgttttgg

SEQ ID NO: 93253 - DNA, 7 bp, Unknown
  misc_feature (1)..( 7): Result.001 file - promoters60/1014223
tgttgta

SEQ ID NO: 93254 - DNA, 7 bp, Unknown
  misc_feature (1)..( 7): Result.001 file - promoters60/1014223
tgttgta

SEQ ID NO: 93255 - DNA, 6 bp, Unknown
  misc_feature (1)..( 6): Result.001 file - promoters60/1014223
caagag

SEQ ID NO: 93256 - DNA, 6 bp, Unknown
  misc_feature (1)..( 6): Result.001 file - promoters60/1014223
caagag

SEQ ID NO: 93257 - DNA, 7 bp, Unknown
  misc_feature (1)..( 7): Result.001 file - promoters60/1014223
gactata

SEQ ID NO: 93258 - DNA, 7 bp, Unknown
  misc_feature (1)..( 7): Result.001 file - promoters60/1014259
gaccata

SEQ ID NO: 93259 - DNA, 8 bp, Unknown
  misc_feature (1)..( 8): Result.001 file - promoters60/1014259
gcatcaga

SEQ ID NO: 93260 - DNA, 8 bp, Unknown
  misc_feature (1)..( 8): Result.001 file - promoters60/1014259
gcaacaga

SEQ ID NO: 93261 - DNA, 8 bp, Unknown
  misc_feature (1)..( 8): Result.001 file - promoters60/1014259
atatatta

SEQ ID NO: 93262 - DNA, 8 bp, Unknown
  misc_feature (1)..( 8): Result.001 file - promoters60/1014259
atatttta

SEQ ID NO: 93263 - DNA, 10 bp, Unknown
  misc_feature (1)..( 10): Result.001 file - promoters60/1014259
taattactaa

SEQ ID NO: 93264 - DNA, 10 bp, Unknown
  misc_feature (1)..( 10): Result.001 file - promoters60/1014259
taatgactaa

SEQ ID NO: 93265 - DNA, 7 bp, Unknown
  misc_feature (1)..( 7): Result.001 file - promoters60/1014259
taatctg

SEQ ID NO: 93266 - DNA, 7 bp, Unknown
  misc_feature (1)..( 7): Result.001 file - promoters60/1014259
taatctg

SEQ ID NO: 93267 - DNA, 8 bp, Unknown
  misc_feature (1)..( 8): Result.001 file - promoters60/1014259
aatatata

SEQ ID NO: 93268 - DNA, 8 bp, Unknown
  misc_feature (1)..( 8): Result.001 file - promoters60/1014259
aatatata

SEQ ID NO: 93269 - DNA, 8 bp, Unknown
  misc_feature (1)..( 8): Result.001 file - promoters60/1014259
aatttatc

SEQ ID NO: 93270 - DNA, 8 bp, Unknown
  misc_feature (1)..( 8): Result.001 file - promoters60/1014259
tataccaa

SEQ ID NO: 93271 - DNA, 8 bp, Unknown
  misc_feature (1)..( 8): Result.001 file - promoters60/1014259
aataacaa

SEQ ID NO: 93272 - DNA, 8 bp, Unknown
  misc_feature (1)..( 8): Result.001 file - promoters60/1014259
aatgacac

SEQ ID NO: 93273 - DNA, 10 bp, Unknown
  misc_feature (1)..( 10): Result.001 file - promoters60/1014259
taaaaactaa

SEQ ID NO: 93274 - DNA, 10 bp, Unknown
  misc_feature (1)..( 10): Result.001 file - promoters60/1014259
taacaactaa

SEQ ID NO: 93275 - DNA, 6 bp, Unknown
  misc_feature (1)..( 6): Result.001 file - promoters60/1014259
ataaac

SEQ ID NO: 93276 - DNA, 6 bp, Unknown
  misc_feature (1)..( 6): Result.001 file - promoters60/1014259
ataaac

SEQ ID NO: 93277 - DNA, 8 bp, Unknown
  misc_feature (1)..( 8): Result.001 file - promoters60/1014259
aaactcta

SEQ ID NO: 93278 - DNA, 8 bp, Unknown
  misc_feature (1)..( 8): Result.001 file - promoters60/1014259
aaacccta

SEQ ID NO: 93279 - DNA, 7 bp, Unknown
  misc_feature (1)..( 7): Result.001 file - promoters60/1014259
gatcatt

SEQ ID NO: 93280 - DNA, 7 bp, Unknown
  misc_feature (1)..( 7): Result.001 file - promoters60/1014259
gattatt

SEQ ID NO: 93281 - DNA, 9 bp, Unknown
  misc_feature (1)..( 9): Result.001 file - promoters60/1014259
ttcgttttg

SEQ ID NO: 93282 - DNA, 9 bp, Unknown
  misc_feature (1)..( 9): Result.001 file - promoters60/1014259
ttcgttttc

SEQ ID NO: 93283 - DNA, 9 bp, Unknown
  misc_feature (1)..( 9): Result.001 file - promoters60/1014259
aaagttttc

SEQ ID NO: 93284 - DNA, 8 bp, Unknown
  misc_feature (1)..( 8): Result.001 file - promoters60/1014259
tctgtttg

SEQ ID NO: 93285 - DNA, 8 bp, Unknown
  misc_feature (1)..( 8): Result.001 file - promoters60/1014259
tctattta

SEQ ID NO: 93286 - DNA, 8 bp, Unknown
  misc_feature (1)..( 8): Result.001 file - promoters60/1014259
catattta

SEQ ID NO: 93287 - DNA, 7 bp, Unknown
  misc_feature (1)..( 7): Result.001 file - promoters60/1014259
taccaaa

SEQ ID NO: 93288 - DNA, 7 bp, Unknown
  misc_feature (1)..( 7): Result.001 file - promoters60/1014259
tactaaa

SEQ ID NO: 93289 - DNA, 10 bp, Unknown
  misc_feature (1)..( 10): Result.001 file - promoters60/1014259
atgtgtgtct

SEQ ID NO: 93290 - DNA, 10 bp, Unknown
  misc_feature (1)..( 10): Result.001 file - promoters60/1014259
atgtgcgtct

SEQ ID NO: 93291 - DNA, 6 bp, Unknown
  misc_feature (1)..( 6): Result.001 file - promoters60/1014259
tgaaaa

SEQ ID NO: 93292 - DNA, 6 bp, Unknown
  misc_feature (1)..( 6): Result.001 file - promoters60/1014259
tgaaaa

SEQ ID NO: 93293 - DNA, 7 bp, Unknown
  misc_feature (1)..( 7): Result.001 file - promoters60/1014259
tatctaa

SEQ ID NO: 93294 - DNA, 7 bp, Unknown
  misc_feature (1)..( 7): Result.001 file - promoters60/1014259
tatgtaa

SEQ ID NO: 93295 - DNA, 6 bp, Unknown
  misc_feature (1)..( 6): Result.001 file - promoters60/1014259
caactt

SEQ ID NO: 93296 - DNA, 6 bp, Unknown
  misc_feature (1)..( 6): Result.001 file - promoters60/1014259
caactt

SEQ ID NO: 93297 - DNA, 8 bp, Unknown
  misc_feature (1)..( 8): Result.001 file - promoters60/1014259
taattacc

SEQ ID NO: 93298 - DNA, 8 bp, Unknown
  misc_feature (1)..( 8): Result.001 file - promoters60/1014259
taataacc

SEQ ID NO: 93299 - DNA, 6 bp, Unknown
  misc_feature (1)..( 6): Result.001 file - promoters60/1014259
aatggg

SEQ ID NO: 93300 - DNA, 6 bp, Unknown
  misc_feature (1)..( 6): Result.001 file - promoters60/1014333
aatggg

SEQ ID NO: 93301 - DNA, 8 bp, Unknown
  misc_feature (1)..( 8): Result.001 file - promoters60/1014333
caatttgt

SEQ ID NO: 93302 - DNA, 8 bp, Unknown
  misc_feature (1)..( 8): Result.001 file - promoters60/1014333
caatgtgt

SEQ ID NO: 93303 - DNA, 10 bp, Unknown
  misc_feature (1)..( 10): Result.001 file - promoters60/1014333
atatcatttt

SEQ ID NO: 93304 - DNA, 10 bp, Unknown
  misc_feature (1)..( 10): Result.001 file - promoters60/1014333
atataatttt

SEQ ID NO: 93305 - DNA, 10 bp, Unknown
  misc_feature (1)..( 10): Result.001 file - promoters60/1014333
taattatagt

SEQ ID NO: 93306 - DNA, 8 bp, Unknown
  misc_feature (1)..( 8): Result.001 file - promoters60/1014333
aaaccaaa

SEQ ID NO: 93307 - DNA, 8 bp, Unknown
  misc_feature (1)..( 8): Result.001 file - promoters60/1014333
aaatcaaa

SEQ ID NO: 93308 - DNA, 7 bp, Unknown
  misc_feature (1)..( 7): Result.001 file - promoters60/1014333
tcgtcaa

SEQ ID NO: 93309 - DNA, 7 bp, Unknown
  misc_feature (1)..( 7): Result.001 file - promoters60/1014333
tcgtcaa

SEQ ID NO: 93310 - DNA, 7 bp, Unknown
  misc_feature (1)..( 7): Result.001 file - promoters60/1014333
aaagaaa

SEQ ID NO: 93311 - DNA, 7 bp, Unknown
  misc_feature (1)..( 7): Result.001 file - promoters60/1014333
aaacaaa

SEQ ID NO: 93312 - DNA, 8 bp, Unknown
  misc_feature (1)..( 8): Result.001 file - promoters60/1014333
taaatata

SEQ ID NO: 93313 - DNA, 8 bp, Unknown
  misc_feature (1)..( 8): Result.001 file - promoters60/1014333
taattata

SEQ ID NO: 93314 - DNA, 8 bp, Unknown
  misc_feature (1)..( 8): Result.001 file - promoters60/1014333
taatctta

SEQ ID NO: 93315 - DNA, 8 bp, Unknown
  misc_feature (1)..( 8): Result.001 file - promoters60/1014333
taatatta

SEQ ID NO: 93316 - DNA, 6 bp, Unknown
  misc_feature (1)..( 6): Result.001 file - promoters60/1014333
tttaaa

SEQ ID NO: 93317 - DNA, 6 bp, Unknown
  misc_feature (1)..( 6): Result.001 file - promoters60/1014333
tttaaa

SEQ ID NO: 93318 - DNA, 10 bp, Unknown
  misc_feature (1)..( 10): Result.001 file - promoters60/1014333
ttaaaaattc

SEQ ID NO: 93319 - DNA, 10 bp, Unknown
  misc_feature (1)..( 10): Result.001 file - promoters60/1014333
ttaataattc

SEQ ID NO: 93320 - DNA, 7 bp, Unknown
  misc_feature (1)..( 7): Result.001 file - promoters60/1014333
gttggtt

SEQ ID NO: 93321 - DNA, 7 bp, Unknown
  misc_feature (1)..( 7): Result.001 file - promoters60/1014333
gttggtt

SEQ ID NO: 93322 - DNA, 7 bp, Unknown
  misc_feature (1)..( 7): Result.001 file - promoters60/1014333
aaccgaa

SEQ ID NO: 93323 - DNA, 7 bp, Unknown
  misc_feature (1)..( 7): Result.001 file - promoters60/1014333
aactgaa

SEQ ID NO: 93324 - DNA, 11 bp, Unknown
  misc_feature (1)..( 11): Result.001 file - promoters60/1014333
aatccaaacac

SEQ ID NO: 93325 - DNA, 11 bp, Unknown
  misc_feature (1)..( 11): Result.001 file - promoters60/1014333
aatccaatcac

SEQ ID NO: 93326 - DNA, 9 bp, Unknown
  misc_feature (1)..( 9): Result.001 file - promoters60/1014333
tgttgcata

SEQ ID NO: 93327 - DNA, 9 bp, Unknown
  misc_feature (1)..( 9): Result.001 file - promoters60/1014333
tgtcgcata

SEQ ID NO: 93328 - DNA, 7 bp, Unknown
  misc_feature (1)..( 7): Result.001 file - promoters60/1014333
ttttttg

SEQ ID NO: 93329 - DNA, 7 bp, Unknown
  misc_feature (1)..( 7): Result.001 file - promoters60/1014362
tttattg

SEQ ID NO: 93330 - DNA, 10 bp, Unknown
  misc_feature (1)..( 10): Result.001 file - promoters60/1014362
taatgttttt

SEQ ID NO: 93331 - DNA, 10 bp, Unknown
  misc_feature (1)..( 10): Result.001 file - promoters60/1014362
tgatgatttt

SEQ ID NO: 93332 - DNA, 10 bp, Unknown
  misc_feature (1)..( 10): Result.001 file - promoters60/1014362
ccatgttttt

SEQ ID NO: 93333 - DNA, 10 bp, Unknown
  misc_feature (1)..( 10): Result.001 file - promoters60/1014362
cgcagttttt

SEQ ID NO: 93334 - DNA, 10 bp, Unknown
  misc_feature (1)..( 10): Result.001 file - promoters60/1014362
ccaagttcat

SEQ ID NO: 93335 - DNA, 11 bp, Unknown
  misc_feature (1)..( 11): Result.001 file - promoters60/1014362
agtttgtttat

SEQ ID NO: 93336 - DNA, 11 bp, Unknown
  misc_feature (1)..( 11): Result.001 file - promoters60/1014362
tttttgtttgt

SEQ ID NO: 93337 - DNA, 11 bp, Unknown
  misc_feature (1)..( 11): Result.001 file - promoters60/1014362
cgcgtgtttat

SEQ ID NO: 93338 - DNA, 11 bp, Unknown
  misc_feature (1)..( 11): Result.001 file - promoters60/1014362
tttctgttcaa

SEQ ID NO: 93339 - DNA, 11 bp, Unknown
  misc_feature (1)..( 11): Result.001 file - promoters60/1014387
cctcttttctg

SEQ ID NO: 93340 - DNA, 9 bp, Unknown
  misc_feature (1)..( 9): Result.001 file - promoters60/1014387
cctaaaatc

SEQ ID NO: 93341 - DNA, 9 bp, Unknown
  misc_feature (1)..( 9): Result.001 file - promoters60/1014387
cctaaaaaa

SEQ ID NO: 93342 - DNA, 9 bp, Unknown
  misc_feature (1)..( 9): Result.001 file - promoters60/1014387
tttaaaata

SEQ ID NO: 93343 - DNA, 9 bp, Unknown
  misc_feature (1)..( 9): Result.001 file - promoters60/1014387
attaaaata

SEQ ID NO: 93344 - DNA, 10 bp, Unknown
  misc_feature (1)..( 10): Result.001 file - promoters60/1014387
agtaacaaat

SEQ ID NO: 93345 - DNA, 10 bp, Unknown
  misc_feature (1)..( 10): Result.001 file - promoters60/1014387
cggaacaaag

SEQ ID NO: 93346 - DNA, 7 bp, Unknown
  misc_feature (1)..( 7): Result.001 file - promoters60/1014387
taaaatc

SEQ ID NO: 93347 - DNA, 7 bp, Unknown
  misc_feature (1)..( 7): Result.001 file - promoters60/1014387
aaaaatc

SEQ ID NO: 93348 - DNA, 7 bp, Unknown
  misc_feature (1)..( 7): Result.001 file - promoters60/1014387
taaaata

SEQ ID NO: 93349 - DNA, 7 bp, Unknown
  misc_feature (1)..( 7): Result.001 file - promoters60/1014387
taaaata

SEQ ID NO: 93350 - DNA, 8 bp, Unknown
  misc_feature (1)..( 8): Result.001 file - promoters60/1014387
taacaaat

SEQ ID NO: 93351 - DNA, 8 bp, Unknown
  misc_feature (1)..( 8): Result.001 file - promoters60/1014387
gaacaaag

SEQ ID NO: 93352 - DNA, 14 bp, Unknown
  misc_feature (1)..( 14): Result.001 file - promoters60/1014387
tggtaaaatttcat

SEQ ID NO: 93353 - DNA, 14 bp, Unknown
  misc_feature (1)..( 14): Result.001 file - promoters60/1014387
tcgtaaaattccca

SEQ ID NO: 93354 - DNA, 14 bp, Unknown
  misc_feature (1)..( 14): Result.001 file - promoters60/1014387
tatcaaaattaaac

SEQ ID NO: 93355 - DNA, 14 bp, Unknown
  misc_feature (1)..( 14): Result.001 file - promoters60/1014387
tgggaaatgaggag

SEQ ID NO: 93356 - DNA, 14 bp, Unknown
  misc_feature (1)..( 14): Result.001 file - promoters60/1014387
gggataaattaaaa

SEQ ID NO: 93357 - DNA, 14 bp, Unknown
  misc_feature (1)..( 14): Result.001 file - promoters60/1014387
gcgacgaattcaaa

SEQ ID NO: 93358 - DNA, 14 bp, Unknown
  misc_feature (1)..( 14): Result.001 file - promoters60/1014387
gtcctctcttcttc

SEQ ID NO: 93359 - DNA, 14 bp, Unknown
  misc_feature (1)..( 14): Result.001 file - promoters60/1014387
tgtctctctctgtt

SEQ ID NO: 93360 - DNA, 14 bp, Unknown
  misc_feature (1)..( 14): Result.001 file - promoters60/1014387
tttctctctttccc

SEQ ID NO: 93361 - DNA, 14 bp, Unknown
  misc_feature (1)..( 14): Result.001 file - promoters60/1014387
gtcgtctcctcctt

SEQ ID NO: 93362 - DNA, 14 bp, Unknown
  misc_feature (1)..( 14): Result.001 file - promoters60/1014387
ttggtctctttttc

SEQ ID NO: 93363 - DNA, 14 bp, Unknown
  misc_feature (1)..( 14): Result.001 file - promoters60/1014452
ttttccttttttat

SEQ ID NO: 93364 - DNA, 11 bp, Unknown
  misc_feature (1)..( 11): Result.001 file - promoters60/1014452
tttttattcaa

SEQ ID NO: 93365 - DNA, 11 bp, Unknown
  misc_feature (1)..( 11): Result.001 file - promoters60/1014452
tatttatttga

SEQ ID NO: 93366 - DNA, 11 bp, Unknown
  misc_feature (1)..( 11): Result.001 file - promoters60/1014452
ttgttattatt

SEQ ID NO: 93367 - DNA, 11 bp, Unknown
  misc_feature (1)..( 11): Result.001 file - promoters60/1014452
gatttctttgg

SEQ ID NO: 93368 - DNA, 8 bp, Unknown
  misc_feature (1)..( 8): Result.001 file - promoters60/1014452
tataaata

SEQ ID NO: 93369 - DNA, 8 bp, Unknown
  misc_feature (1)..( 8): Result.001 file - promoters60/1014452
tataaata

SEQ ID NO: 93370 - DNA, 8 bp, Unknown
  misc_feature (1)..( 8): Result.001 file - promoters60/1014452
tatatata

SEQ ID NO: 93371 - DNA, 8 bp, Unknown
  misc_feature (1)..( 8): Result.001 file - promoters60/1014452
tataaaaa

SEQ ID NO: 93372 - DNA, 8 bp, Unknown
  misc_feature (1)..( 8): Result.001 file - promoters60/1014452
aatatatg

SEQ ID NO: 93373 - DNA, 10 bp, Unknown
  misc_feature (1)..( 10): Result.001 file - promoters60/1014452
tcaatttttt

SEQ ID NO: 93374 - DNA, 10 bp, Unknown
  misc_feature (1)..( 10): Result.001 file - promoters60/1014452
tcaatcttta

SEQ ID NO: 93375 - DNA, 11 bp, Unknown
  misc_feature (1)..( 11): Result.001 file - promoters60/1014452
gttattattta

SEQ ID NO: 93376 - DNA, 11 bp, Unknown
  misc_feature (1)..( 11): Result.001 file - promoters60/1014452
aaatatattta

SEQ ID NO: 93377 - DNA, 9 bp, Unknown
  misc_feature (1)..( 9): Result.001 file - promoters60/1014452
caacgtaaa

SEQ ID NO: 93378 - DNA, 9 bp, Unknown
  misc_feature (1)..( 9): Result.001 file - promoters60/1014452
aaacttaaa

SEQ ID NO: 93379 - DNA, 10 bp, Unknown
  misc_feature (1)..( 10): Result.001 file - promoters60/1014452
taagcttgtc

SEQ ID NO: 93380 - DNA, 10 bp, Unknown
  misc_feature (1)..( 10): Result.001 file - promoters60/1014452
aactcttaaa

SEQ ID NO: 93381 - DNA, 19 bp, Unknown
  misc_feature (1)..( 19): Result.001 file - promoters60/1014452
ctttatcgtccaatcaatc

SEQ ID NO: 93382 - DNA, 19 bp, Unknown
  misc_feature (1)..( 19): Result.001 file - promoters60/1014452
cagtatcgtccaaacaatc

SEQ ID NO: 93383 - DNA, 19 bp, Unknown
  misc_feature (1)..( 19): Result.001 file - promoters60/1014452
ctttttcgagaatacaaag

SEQ ID NO: 93384 - DNA, 19 bp, Unknown
  misc_feature (1)..( 19): Result.001 file - promoters60/1014452
tcttacattccaatcgttc

SEQ ID NO: 93385 - DNA, 9 bp, Unknown
  misc_feature (1)..( 9): Result.001 file - promoters60/1014452
ctaaaaata

SEQ ID NO: 93386 - DNA, 9 bp, Unknown
  misc_feature (1)..( 9): Result.001 file - promoters60/1014452
tataaaata

SEQ ID NO: 93387 - DNA, 10 bp, Unknown
  misc_feature (1)..( 10): Result.001 file - promoters60/1014452
aataacaatt

SEQ ID NO: 93388 - DNA, 11 bp, Unknown
  misc_feature (1)..( 11): Result.001 file - promoters60/1014452
agtatataatt

SEQ ID NO: 93389 - DNA, 11 bp, Unknown
  misc_feature (1)..( 11): Result.001 file - promoters60/1014452
tttatataatt

SEQ ID NO: 93390 - DNA, 11 bp, Unknown
  misc_feature (1)..( 11): Result.001 file - promoters60/1014452
gattttttctc

SEQ ID NO: 93391 - DNA, 11 bp, Unknown
  misc_feature (1)..( 11): Result.001 file - promoters60/1014452
aatttttactt

SEQ ID NO: 93392 - DNA, 11 bp, Unknown
  misc_feature (1)..( 11): Result.001 file - promoters60/1014452
aatatttactg

SEQ ID NO: 93393 - DNA, 11 bp, Unknown
  misc_feature (1)..( 11): Result.001 file - promoters60/1014452
gatttgtactt

SEQ ID NO: 93394 - DNA, 9 bp, Unknown
  misc_feature (1)..( 9): Result.001 file - promoters60/1014452
taactataa

SEQ ID NO: 93395 - DNA, 9 bp, Unknown
  misc_feature (1)..( 9): Result.001 file - promoters60/1014452
taaatatat

SEQ ID NO: 93396 - DNA, 9 bp, Unknown
  misc_feature (1)..( 9): Result.001 file - promoters60/1014452
actatatat

SEQ ID NO: 93397 - DNA, 9 bp, Unknown
  misc_feature (1)..( 9): Result.001 file - promoters60/1014452
gaaatctat

SEQ ID NO: 93398 - DNA, 8 bp, Unknown
  misc_feature (1)..( 8): Result.001 file - promoters60/1014452
actaatag

SEQ ID NO: 93399 - DNA, 8 bp, Unknown
  misc_feature (1)..( 8): Result.001 file - promoters60/1014452
gctaatat

SEQ ID NO: 93400 - DNA, 8 bp, Unknown
  misc_feature (1)..( 8): Result.001 file - promoters60/1014452
actcatat

SEQ ID NO: 93401 - DNA, 8 bp, Unknown
  misc_feature (1)..( 8): Result.001 file - promoters60/1014525
attaatat

SEQ ID NO: 93402 - DNA, 10 bp, Unknown
  misc_feature (1)..( 10): Result.001 file - promoters60/1014525
taaataaaag

SEQ ID NO: 93403 - DNA, 10 bp, Unknown
  misc_feature (1)..( 10): Result.001 file - promoters60/1014525
taattaaaca

SEQ ID NO: 93404 - DNA, 10 bp, Unknown
  misc_feature (1)..( 10): Result.001 file - promoters60/1014525
attataaaat

SEQ ID NO: 93405 - DNA, 11 bp, Unknown
  misc_feature (1)..( 11): Result.001 file - promoters60/1014525
aatttacaaac

SEQ ID NO: 93406 - DNA, 11 bp, Unknown
  misc_feature (1)..( 11): Result.001 file - promoters60/1014525
ttcttagaaaa

SEQ ID NO: 93407 - DNA, 11 bp, Unknown
  misc_feature (1)..( 11): Result.001 file - promoters60/1014525
tcattaacatg

SEQ ID NO: 93408 - DNA, 9 bp, Unknown
  misc_feature (1)..( 9): Result.001 file - promoters60/1014525
gtcatatta

SEQ ID NO: 93409 - DNA, 9 bp, Unknown
  misc_feature (1)..( 9): Result.001 file - promoters60/1014525
tatatatta

SEQ ID NO: 93410 - DNA, 10 bp, Unknown
  misc_feature (1)..( 10): Result.001 file - promoters60/1014525
gatataatta

SEQ ID NO: 93411 - DNA, 10 bp, Unknown
  misc_feature (1)..( 10): Result.001 file - promoters60/1014525
gtatgtattg

SEQ ID NO: 93412 - DNA, 11 bp, Unknown
  misc_feature (1)..( 11): Result.001 file - promoters60/1014525
aatatacattc

SEQ ID NO: 93413 - DNA, 11 bp, Unknown
  misc_feature (1)..( 11): Result.001 file - promoters60/1014525
atactgtatgt

SEQ ID NO: 93414 - DNA, 12 bp, Unknown
  misc_feature (1)..( 12): Result.001 file - promoters60/1014525
ataagaatgtca

SEQ ID NO: 93415 - DNA, 12 bp, Unknown
  misc_feature (1)..( 12): Result.001 file - promoters60/1014525
ttaacaatattt

SEQ ID NO: 93416 - DNA, 12 bp, Unknown
  misc_feature (1)..( 12): Result.001 file - promoters60/1014525
ataaaaaagaga

SEQ ID NO: 93417 - DNA, 12 bp, Unknown
  misc_feature (1)..( 12): Result.001 file - promoters60/1014525
acaacaatcagt

SEQ ID NO: 93418 - DNA, 12 bp, Unknown
  misc_feature (1)..( 12): Result.001 file - promoters60/1014525
tgaacaacattt

SEQ ID NO: 93419 - DNA, 12 bp, Unknown
  misc_feature (1)..( 12): Result.001 file - promoters60/1014525
ttaacacaaaac

SEQ ID NO: 93420 - DNA, 11 bp, Unknown
  misc_feature (1)..( 11): Result.001 file - promoters60/1014525
aaattaaaatc

SEQ ID NO: 93421 - DNA, 11 bp, Unknown
  misc_feature (1)..( 11): Result.001 file - promoters60/1014525
gaatgaaaaaa

SEQ ID NO: 93422 - DNA, 11 bp, Unknown
  misc_feature (1)..( 11): Result.001 file - promoters60/1014525
aaatcaaatag

SEQ ID NO: 93423 - DNA, 11 bp, Unknown
  misc_feature (1)..( 11): Result.001 file - promoters60/1014525
gaacaaatgtt

SEQ ID NO: 93424 - DNA, 11 bp, Unknown
  misc_feature (1)..( 11): Result.001 file - promoters60/1014525
atatgaaaatg

SEQ ID NO: 93425 - DNA, 11 bp, Unknown
  misc_feature (1)..( 11): Result.001 file - promoters60/1014525
ttatgaaattt

SEQ ID NO: 93426 - DNA, 11 bp, Unknown
  misc_feature (1)..( 11): Result.001 file - promoters60/1014525
cccagaaaaaa

SEQ ID NO: 93427 - DNA, 12 bp, Unknown
  misc_feature (1)..( 12): Result.001 file - promoters60/1014525
cattatatatag

SEQ ID NO: 93428 - DNA, 12 bp, Unknown
  misc_feature (1)..( 12): Result.001 file - promoters60/1014525
ttgtatatatac

SEQ ID NO: 93429 - DNA, 12 bp, Unknown
  misc_feature (1)..( 12): Result.001 file - promoters60/1014525
ccttataaatat

SEQ ID NO: 93430 - DNA, 12 bp, Unknown
  misc_feature (1)..( 12): Result.001 file - promoters60/1014525
acatatatataa

SEQ ID NO: 93431 - DNA, 12 bp, Unknown
  misc_feature (1)..( 12): Result.001 file - promoters60/1014525
atatatttatac

SEQ ID NO: 93432 - DNA, 12 bp, Unknown
  misc_feature (1)..( 12): Result.001 file - promoters60/1014525
ccttaaaaacca

SEQ ID NO: 93433 - DNA, 12 bp, Unknown
  misc_feature (1)..( 12): Result.001 file - promoters60/1014525
ccctataaactt

SEQ ID NO: 93434 - DNA, 11 bp, Unknown
  misc_feature (1)..( 11): Result.001 file - promoters60/1014525
tctacaaattg

SEQ ID NO: 93435 - DNA, 11 bp, Unknown
  misc_feature (1)..( 11): Result.001 file - promoters60/1014525
tttacaaactt

SEQ ID NO: 93436 - DNA, 11 bp, Unknown
  misc_feature (1)..( 11): Result.001 file - promoters60/1014525
tcttcaaggag

SEQ ID NO: 93437 - DNA, 11 bp, Unknown
  misc_feature (1)..( 11): Result.001 file - promoters60/1014525
attataaaata

SEQ ID NO: 93438 - DNA, 11 bp, Unknown
  misc_feature (1)..( 11): Result.001 file - promoters60/1014525
cttagaaaaat

SEQ ID NO: 93439 - DNA, 11 bp, Unknown
  misc_feature (1)..( 11): Result.001 file - promoters60/1014573
ttaacatgttc

SEQ ID NO: 93440 - DNA, 6 bp, Unknown
  misc_feature (1)..( 6): Result.001 file - promoters60/1014573
tttagg

SEQ ID NO: 93441 - DNA, 6 bp, Unknown
  misc_feature (1)..( 6): Result.001 file - promoters60/1014573
tttagg

SEQ ID NO: 93442 - DNA, 6 bp, Unknown
  misc_feature (1)..( 6): Result.001 file - promoters60/1014573
tttttt

SEQ ID NO: 93443 - DNA, 6 bp, Unknown
  misc_feature (1)..( 6): Result.001 file - promoters60/1014573
tttttt

SEQ ID NO: 93444 - DNA, 6 bp, Unknown
  misc_feature (1)..( 6): Result.001 file - promoters60/1014573
tttttt

SEQ ID NO: 93445 - DNA, 7 bp, Unknown
  misc_feature (1)..( 7): Result.001 file - promoters60/1014573
ggtttta

SEQ ID NO: 93446 - DNA, 7 bp, Unknown
  misc_feature (1)..( 7): Result.001 file - promoters60/1014573
ggtttta

SEQ ID NO: 93447 - DNA, 9 bp, Unknown
  misc_feature (1)..( 9): Result.001 file - promoters60/1014573
tctatagca

SEQ ID NO: 93448 - DNA, 9 bp, Unknown
  misc_feature (1)..( 9): Result.001 file - promoters60/1014573
tctttagca

SEQ ID NO: 93449 - DNA, 7 bp, Unknown
  misc_feature (1)..( 7): Result.001 file - promoters60/1014573
atagttc

SEQ ID NO: 93450 - DNA, 7 bp, Unknown
  misc_feature (1)..( 7): Result.001 file - promoters60/1014573
atatttc

SEQ ID NO: 93451 - DNA, 7 bp, Unknown
  misc_feature (1)..( 7): Result.001 file - promoters60/1014573
caataaa

SEQ ID NO: 93452 - DNA, 7 bp, Unknown
  misc_feature (1)..( 7): Result.001 file - promoters60/1014573
caacaaa

SEQ ID NO: 93453 - DNA, 8 bp, Unknown
  misc_feature (1)..( 8): Result.001 file - promoters60/1014573
tataaaat

SEQ ID NO: 93454 - DNA, 8 bp, Unknown
  misc_feature (1)..( 8): Result.001 file - promoters60/1014573
tatgaaat

SEQ ID NO: 93455 - DNA, 10 bp, Unknown
  misc_feature (1)..( 10): Result.001 file - promoters60/1014573
ttaatgattc

SEQ ID NO: 93456 - DNA, 10 bp, Unknown
  misc_feature (1)..( 10): Result.001 file - promoters60/1014573
ttagtgattc

SEQ ID NO: 93457 - DNA, 8 bp, Unknown
  misc_feature (1)..( 8): Result.001 file - promoters60/1014573
aaacccaa

SEQ ID NO: 93458 - DNA, 8 bp, Unknown
  misc_feature (1)..( 8): Result.001 file - promoters60/1014573
aaacacaa

SEQ ID NO: 93459 - DNA, 8 bp, Unknown
  misc_feature (1)..( 8): Result.001 file - promoters60/1014573
tagattta

SEQ ID NO: 93460 - DNA, 8 bp, Unknown
  misc_feature (1)..( 8): Result.001 file - promoters60/1014573
aagattta

SEQ ID NO: 93461 - DNA, 8 bp, Unknown
  misc_feature (1)..( 8): Result.001 file - promoters60/1014573
aagctttt

SEQ ID NO: 93462 - DNA, 7 bp, Unknown
  misc_feature (1)..( 7): Result.001 file - promoters60/1014573
tgaatat

SEQ ID NO: 93463 - DNA, 7 bp, Unknown
  misc_feature (1)..( 7): Result.001 file - promoters60/1014573
tgaatat

SEQ ID NO: 93464 - DNA, 15 bp, Unknown
  misc_feature (1)..( 15): Result.001 file - promoters60/1014573
tatcagatatgagat

SEQ ID NO: 93465 - DNA, 15 bp, Unknown
  misc_feature (1)..( 15): Result.001 file - promoters60/1014573
tatcagatgtgagat

SEQ ID NO: 93466 - DNA, 6 bp, Unknown
  misc_feature (1)..( 6): Result.001 file - promoters60/1014573
tactgt

SEQ ID NO: 93467 - DNA, 6 bp, Unknown
  misc_feature (1)..( 6): Result.001 file - promoters60/1014573
tactgt

SEQ ID NO: 93468 - DNA, 9 bp, Unknown
  misc_feature (1)..( 9): Result.001 file - promoters60/1014573
tcaaaattt

SEQ ID NO: 93469 - DNA, 9 bp, Unknown
  misc_feature (1)..( 9): Result.001 file - promoters60/1014573
tcagaattt

SEQ ID NO: 93470 - DNA, 6 bp, Unknown
  misc_feature (1)..( 6): Result.001 file - promoters60/1014573
ttgaaa

SEQ ID NO: 93471 - DNA, 6 bp, Unknown
  misc_feature (1)..( 6): Result.001 file - promoters60/1014573
ttgaaa

SEQ ID NO: 93472 - DNA, 7 bp, Unknown
  misc_feature (1)..( 7): Result.001 file - promoters60/1014573
cttctcc

SEQ ID NO: 93473 - DNA, 7 bp, Unknown
  misc_feature (1)..( 7): Result.001 file - promoters60/1014573
cttgtcc

SEQ ID NO: 93474 - DNA, 7 bp, Unknown
  misc_feature (1)..( 7): Result.001 file - promoters60/1014573
ttcatgt

SEQ ID NO: 93475 - DNA, 7 bp, Unknown
  misc_feature (1)..( 7): Result.001 file - promoters60/1014573
ttcatgt

SEQ ID NO: 93476 - DNA, 7 bp, Unknown
  misc_feature (1)..( 7): Result.001 file - promoters60/1014573
tacctca

SEQ ID NO: 93477 - DNA, 7 bp, Unknown
  misc_feature (1)..( 7): Result.001 file - promoters60/1014573
tacctca

SEQ ID NO: 93478 - DNA, 7 bp, Unknown
  misc_feature (1)..( 7): Result.001 file - promoters60/1014573
ttttata

SEQ ID NO: 93479 - DNA, 7 bp, Unknown
  misc_feature (1)..( 7): Result.001 file - promoters60/1014573
tttgata

SEQ ID NO: 93480 - DNA, 9 bp, Unknown
  misc_feature (1)..( 9): Result.001 file - promoters60/1014573
catccttat

SEQ ID NO: 93481 - DNA, 9 bp, Unknown
  misc_feature (1)..( 9): Result.001 file - promoters60/1014649
catcattat

SEQ ID NO: 93482 - DNA, 11 bp, Unknown
  misc_feature (1)..( 11): Result.001 file - promoters60/1014649
tgctctatact

SEQ ID NO: 93483 - DNA, 11 bp, Unknown
  misc_feature (1)..( 11): Result.001 file - promoters60/1014649
tgctctttact

SEQ ID NO: 93484 - DNA, 6 bp, Unknown
  misc_feature (1)..( 6): Result.001 file - promoters60/1014649
caccac

SEQ ID NO: 93485 - DNA, 6 bp, Unknown
  misc_feature (1)..( 6): Result.001 file - promoters60/1014649
caccac

SEQ ID NO: 93486 - DNA, 9 bp, Unknown
  misc_feature (1)..( 9): Result.001 file - promoters60/1014649
attctttac

SEQ ID NO: 93487 - DNA, 9 bp, Unknown
  misc_feature (1)..( 9): Result.001 file - promoters60/1014649
tttctctac

SEQ ID NO: 93488 - DNA, 9 bp, Unknown
  misc_feature (1)..( 9): Result.001 file - promoters60/1014649
attttttgg

SEQ ID NO: 93489 - DNA, 9 bp, Unknown
  misc_feature (1)..( 9): Result.001 file - promoters60/1014649
tttgatttt

SEQ ID NO: 93490 - DNA, 9 bp, Unknown
  misc_feature (1)..( 9): Result.001 file - promoters60/1014649
tttgttttt

SEQ ID NO: 93491 - DNA, 8 bp, Unknown
  misc_feature (1)..( 8): Result.001 file - promoters60/1014649
acatatgt

SEQ ID NO: 93492 - DNA, 8 bp, Unknown
  misc_feature (1)..( 8): Result.001 file - promoters60/1014649
acatctgt

SEQ ID NO: 93493 - DNA, 8 bp, Unknown
  misc_feature (1)..( 8): Result.001 file - promoters60/1014649
atatatat

SEQ ID NO: 93494 - DNA, 7 bp, Unknown
  misc_feature (1)..( 7): Result.001 file - promoters60/1014649
ttacatt

SEQ ID NO: 93495 - DNA, 7 bp, Unknown
  misc_feature (1)..( 7): Result.001 file - promoters60/1014649
ttacatt

SEQ ID NO: 93496 - DNA, 6 bp, Unknown
  misc_feature (1)..( 6): Result.001 file - promoters60/1014649
tttata

SEQ ID NO: 93497 - DNA, 6 bp, Unknown
  misc_feature (1)..( 6): Result.001 file - promoters60/1014649
tttata

SEQ ID NO: 93498 - DNA, 6 bp, Unknown
  misc_feature (1)..( 6): Result.001 file - promoters60/1014649
tcttcg

SEQ ID NO: 93499 - DNA, 6 bp, Unknown
  misc_feature (1)..( 6): Result.001 file - promoters60/1014649
tcttcg

SEQ ID NO: 93500 - DNA, 7 bp, Unknown
  misc_feature (1)..( 7): Result.001 file - promoters60/1014649
gttatca

SEQ ID NO: 93501 - DNA, 7 bp, Unknown
  misc_feature (1)..( 7): Result.001 file - promoters60/1014649
gttttca

SEQ ID NO: 93502 - DNA, 9 bp, Unknown
  misc_feature (1)..( 9): Result.001 file - promoters60/1014649
aaaaataaa

SEQ ID NO: 93503 - DNA, 9 bp, Unknown
  misc_feature (1)..( 9): Result.001 file - promoters60/1014649
aaaaataaa

SEQ ID NO: 93504 - DNA, 6 bp, Unknown
  misc_feature (1)..( 6): Result.001 file - promoters60/1014649
taaaat

SEQ ID NO: 93505 - DNA, 6 bp, Unknown
  misc_feature (1)..( 6): Result.001 file - promoters60/1014649
taaaat

SEQ ID NO: 93506 - DNA, 9 bp, Unknown
  misc_feature (1)..( 9): Result.001 file - promoters60/1014649
aaaattaat

SEQ ID NO: 93507 - DNA, 9 bp, Unknown
  misc_feature (1)..( 9): Result.001 file - promoters60/1014649
aaaataaat

SEQ ID NO: 93508 - DNA, 9 bp, Unknown
  misc_feature (1)..( 9): Result.001 file - promoters60/1014649
atttattta

SEQ ID NO: 93509 - DNA, 9 bp, Unknown
  misc_feature (1)..( 9): Result.001 file - promoters60/1014649
atttatttt

SEQ ID NO: 93510 - DNA, 9 bp, Unknown
  misc_feature (1)..( 9): Result.001 file - promoters60/1014649
attaaatta

SEQ ID NO: 93511 - DNA, 8 bp, Unknown
  misc_feature (1)..( 8): Result.001 file - promoters60/1014649
tctatttt

SEQ ID NO: 93512 - DNA, 8 bp, Unknown
  misc_feature (1)..( 8): Result.001 file - promoters60/1014649
tctttttt

SEQ ID NO: 93513 - DNA, 8 bp, Unknown
  misc_feature (1)..( 8): Result.001 file - promoters60/1014649
tcttttgt

SEQ ID NO: 93514 - DNA, 6 bp, Unknown
  misc_feature (1)..( 6): Result.001 file - promoters60/1014649
ttttaa

SEQ ID NO: 93515 - DNA, 6 bp, Unknown
  misc_feature (1)..( 6): Result.001 file - promoters60/1014649
ttttaa

SEQ ID NO: 93516 - DNA, 8 bp, Unknown
  misc_feature (1)..( 8): Result.001 file - promoters60/1014649
aagtaata

SEQ ID NO: 93517 - DNA, 8 bp, Unknown
  misc_feature (1)..( 8): Result.001 file - promoters60/1014649
aagtaata

SEQ ID NO: 93518 - DNA, 8 bp, Unknown
  misc_feature (1)..( 8): Result.001 file - promoters60/1014649
caaccaag

SEQ ID NO: 93519 - DNA, 8 bp, Unknown
  misc_feature (1)..( 8): Result.001 file - promoters60/1014649
caaacaag

SEQ ID NO: 93520 - DNA, 6 bp, Unknown
  misc_feature (1)..( 6): Result.001 file - promoters60/1014649
actttt

SEQ ID NO: 93521 - DNA, 6 bp, Unknown
  misc_feature (1)..( 6): Result.001 file - promoters60/1014649
actttt

SEQ ID NO: 93522 - DNA, 6 bp, Unknown
  misc_feature (1)..( 6): Result.001 file - promoters60/1014649
atttgt

SEQ ID NO: 93523 - DNA, 6 bp, Unknown
  misc_feature (1)..( 6): Result.001 file - promoters60/1014649
atttgt

SEQ ID NO: 93524 - DNA, 7 bp, Unknown
  misc_feature (1)..( 7): Result.001 file - promoters60/1014649
ttctttt

SEQ ID NO: 93525 - DNA, 7 bp, Unknown
  misc_feature (1)..( 7): Result.001 file - promoters60/1014662
ttccttt

SEQ ID NO: 93526 - DNA, 10 bp, Unknown
  misc_feature (1)..( 10): Result.001 file - promoters60/1014662
taaaaatgaa

SEQ ID NO: 93527 - DNA, 10 bp, Unknown
  misc_feature (1)..( 10): Result.001 file - promoters60/1014662
taaaaagtct

SEQ ID NO: 93528 - DNA, 11 bp, Unknown
  misc_feature (1)..( 11): Result.001 file - promoters60/1014662
caaaaaaagaa

SEQ ID NO: 93529 - DNA, 11 bp, Unknown
  misc_feature (1)..( 11): Result.001 file - promoters60/1014662
ccaaaaatctt

SEQ ID NO: 93530 - DNA, 11 bp, Unknown
  misc_feature (1)..( 11): Result.001 file - promoters60/1014662
cgaaaaagggt

SEQ ID NO: 93531 - DNA, 11 bp, Unknown
  misc_feature (1)..( 11): Result.001 file - promoters60/1014662
ccaagaatctg

SEQ ID NO: 93532 - DNA, 13 bp, Unknown
  misc_feature (1)..( 13): Result.001 file - promoters60/1014662
actcataataaat

SEQ ID NO: 93533 - DNA, 13 bp, Unknown
  misc_feature (1)..( 13): Result.001 file - promoters60/1014662
tcatataatagta

SEQ ID NO: 93534 - DNA, 13 bp, Unknown
  misc_feature (1)..( 13): Result.001 file - promoters60/1014662
atttataatataa

SEQ ID NO: 93535 - DNA, 13 bp, Unknown
  misc_feature (1)..( 13): Result.001 file - promoters60/1014662
acttataatgaat

SEQ ID NO: 93536 - DNA, 13 bp, Unknown
  misc_feature (1)..( 13): Result.001 file - promoters60/1014662
gaagatagtgaac

SEQ ID NO: 93537 - DNA, 12 bp, Unknown
  misc_feature (1)..( 12): Result.001 file - promoters60/1014662
atataataaata

SEQ ID NO: 93538 - DNA, 12 bp, Unknown
  misc_feature (1)..( 12): Result.001 file - promoters60/1014662
gcataaaaaata

SEQ ID NO: 93539 - DNA, 12 bp, Unknown
  misc_feature (1)..( 12): Result.001 file - promoters60/1014662
ttattatacttc

SEQ ID NO: 93540 - DNA, 12 bp, Unknown
  misc_feature (1)..( 12): Result.001 file - promoters60/1014662
atataattatct

SEQ ID NO: 93541 - DNA, 12 bp, Unknown
  misc_feature (1)..( 12): Result.001 file - promoters60/1014662
gtttaataacaa

SEQ ID NO: 93542 - DNA, 12 bp, Unknown
  misc_feature (1)..( 12): Result.001 file - promoters60/1014662
ctaaaatataat

SEQ ID NO: 93543 - DNA, 11 bp, Unknown
  misc_feature (1)..( 11): Result.001 file - promoters60/1014662
tgtatatatat

SEQ ID NO: 93544 - DNA, 11 bp, Unknown
  misc_feature (1)..( 11): Result.001 file - promoters60/1014662
aaaataaatag

SEQ ID NO: 93545 - DNA, 11 bp, Unknown
  misc_feature (1)..( 11): Result.001 file - promoters60/1014662
aaaatatataa

SEQ ID NO: 93546 - DNA, 11 bp, Unknown
  misc_feature (1)..( 11): Result.001 file - promoters60/1014662
agaataaaaat

SEQ ID NO: 93547 - DNA, 11 bp, Unknown
  misc_feature (1)..( 11): Result.001 file - promoters60/1014662
aaaatataata

SEQ ID NO: 93548 - DNA, 12 bp, Unknown
  misc_feature (1)..( 12): Result.001 file - promoters60/1014662
tagaaattaata

SEQ ID NO: 93549 - DNA, 12 bp, Unknown
  misc_feature (1)..( 12): Result.001 file - promoters60/1014662
agataattaagt

SEQ ID NO: 93550 - DNA, 11 bp, Unknown
  misc_feature (1)..( 11): Result.001 file - promoters60/1014662
taaaatcaata

SEQ ID NO: 93551 - DNA, 11 bp, Unknown
  misc_feature (1)..( 11): Result.001 file - promoters60/1014662
tttaattatta

SEQ ID NO: 93552 - DNA, 12 bp, Unknown
  misc_feature (1)..( 12): Result.001 file - promoters60/1014662
ataacatcactt

SEQ ID NO: 93553 - DNA, 12 bp, Unknown
  misc_feature (1)..( 12): Result.001 file - promoters60/1014662
ttttatcacaag

SEQ ID NO: 93554 - DNA, 12 bp, Unknown
  misc_feature (1)..( 12): Result.001 file - promoters60/1014662
ttttgtcaacga

SEQ ID NO: 93555 - DNA, 12 bp, Unknown
  misc_feature (1)..( 12): Result.001 file - promoters60/1014662
gtataacaataa

SEQ ID NO: 93556 - DNA, 12 bp, Unknown
  misc_feature (1)..( 12): Result.001 file - promoters60/1014662
cggtgtaaacga

SEQ ID NO: 93557 - DNA, 12 bp, Unknown
  misc_feature (1)..( 12): Result.001 file - promoters60/1014662
gggtgtaatgct

SEQ ID NO: 93558 - DNA, 12 bp, Unknown
  misc_feature (1)..( 12): Result.001 file - promoters60/1014662
ttttgtatctaa

SEQ ID NO: 93559 - DNA, 8 bp, Unknown
  misc_feature (1)..( 8): Result.001 file - promoters60/1014662
aatcaaaa

SEQ ID NO: 93560 - DNA, 8 bp, Unknown
  misc_feature (1)..( 8): Result.001 file - promoters60/1014662
aatcaaat

SEQ ID NO: 93561 - DNA, 9 bp, Unknown
  misc_feature (1)..( 9): Result.001 file - promoters60/1014662
gatccaaac

SEQ ID NO: 93562 - DNA, 9 bp, Unknown
  misc_feature (1)..( 9): Result.001 file - promoters60/1014662
ctttcaaat

SEQ ID NO: 93563 - DNA, 9 bp, Unknown
  misc_feature (1)..( 9): Result.001 file - promoters60/1014662
tatcctaac

SEQ ID NO: 93564 - DNA, 11 bp, Unknown
  misc_feature (1)..( 11): Result.001 file - promoters60/1014662
aaatgaagaat

SEQ ID NO: 93565 - DNA, 11 bp, Unknown
  misc_feature (1)..( 11): Result.001 file - promoters60/1014662
agaccaagaat

SEQ ID NO: 93566 - DNA, 11 bp, Unknown
  misc_feature (1)..( 11): Result.001 file - promoters60/1014662
tgtgcaaaaat

SEQ ID NO: 93567 - DNA, 11 bp, Unknown
  misc_feature (1)..( 11): Result.001 file - promoters60/1014662
tgtccaaaaat

SEQ ID NO: 93568 - DNA, 11 bp, Unknown
  misc_feature (1)..( 11): Result.001 file - promoters60/1014662
tgaccaaaaaa

SEQ ID NO: 93569 - DNA, 11 bp, Unknown
  misc_feature (1)..( 11): Result.001 file - promoters60/1014662
tgtgcaaaaat

SEQ ID NO: 93570 - DNA, 11 bp, Unknown
  misc_feature (1)..( 11): Result.001 file - promoters60/1014662
tgaccaaaaaa

SEQ ID NO: 93571 - DNA, 11 bp, Unknown
  misc_feature (1)..( 11): Result.001 file - promoters60/1014662
agaccaagaat

SEQ ID NO: 93572 - DNA, 11 bp, Unknown
  misc_feature (1)..( 11): Result.001 file - promoters60/1014662
tgtccaaaaat

SEQ ID NO: 93573 - DNA, 11 bp, Unknown
  misc_feature (1)..( 11): Result.001 file - promoters60/1014662
agacgaaaaag

SEQ ID NO: 93574 - DNA, 10 bp, Unknown
  misc_feature (1)..( 10): Result.001 file - promoters60/1014662
aagcattttt

SEQ ID NO: 93575 - DNA, 10 bp, Unknown
  misc_feature (1)..( 10): Result.001 file - promoters60/1014662
aagcattttc

SEQ ID NO: 93576 - DNA, 10 bp, Unknown
  misc_feature (1)..( 10): Result.001 file - promoters60/1014662
agctattttt

SEQ ID NO: 93577 - DNA, 10 bp, Unknown
  misc_feature (1)..( 10): Result.001 file - promoters60/1014662
attaattttt

SEQ ID NO: 93578 - DNA, 10 bp, Unknown
  misc_feature (1)..( 10): Result.001 file - promoters60/1014678
gaaaatcttt

SEQ ID NO: 93579 - DNA, 8 bp, Unknown
  misc_feature (1)..( 8): Result.001 file - promoters60/1014678
cacgtgtc

SEQ ID NO: 93580 - DNA, 8 bp, Unknown
  misc_feature (1)..( 8): Result.001 file - promoters60/1014678
cacatgtc

SEQ ID NO: 93581 - DNA, 6 bp, Unknown
  misc_feature (1)..( 6): Result.001 file - promoters60/1014678
ttactc

SEQ ID NO: 93582 - DNA, 6 bp, Unknown
  misc_feature (1)..( 6): Result.001 file - promoters60/1014678
ttactc

SEQ ID NO: 93583 - DNA, 7 bp, Unknown
  misc_feature (1)..( 7): Result.001 file - promoters60/1014678
catgaga

SEQ ID NO: 93584 - DNA, 7 bp, Unknown
  misc_feature (1)..( 7): Result.001 file - promoters60/1014678
cataaga

SEQ ID NO: 93585 - DNA, 10 bp, Unknown
  misc_feature (1)..( 10): Result.001 file - promoters60/1014678
acaacacatc

SEQ ID NO: 93586 - DNA, 10 bp, Unknown
  misc_feature (1)..( 10): Result.001 file - promoters60/1014678
aaaacaaatc

SEQ ID NO: 93587 - DNA, 10 bp, Unknown
  misc_feature (1)..( 10): Result.001 file - promoters60/1014678
aaaacaaaat

SEQ ID NO: 93588 - DNA, 6 bp, Unknown
  misc_feature (1)..( 6): Result.001 file - promoters60/1014678
aaaact

SEQ ID NO: 93589 - DNA, 6 bp, Unknown
  misc_feature (1)..( 6): Result.001 file - promoters60/1014678
aaaact

SEQ ID NO: 93590 - DNA, 10 bp, Unknown
  misc_feature (1)..( 10): Result.001 file - promoters60/1014678
cacgatggaa

SEQ ID NO: 93591 - DNA, 10 bp, Unknown
  misc_feature (1)..( 10): Result.001 file - promoters60/1014678
cacaatggaa

SEQ ID NO: 93592 - DNA, 11 bp, Unknown
  misc_feature (1)..( 11): Result.001 file - promoters60/1014678
aaaaataaatt

SEQ ID NO: 93593 - DNA, 11 bp, Unknown
  misc_feature (1)..( 11): Result.001 file - promoters60/1014678
aaaaatcaatt

SEQ ID NO: 93594 - DNA, 7 bp, Unknown
  misc_feature (1)..( 7): Result.001 file - promoters60/1014678
atattgt

SEQ ID NO: 93595 - DNA, 7 bp, Unknown
  misc_feature (1)..( 7): Result.001 file - promoters60/1014678
atattgt

SEQ ID NO: 93596 - DNA, 6 bp, Unknown
  misc_feature (1)..( 6): Result.001 file - promoters60/1014678
cagtat

SEQ ID NO: 93597 - DNA, 6 bp, Unknown
  misc_feature (1)..( 6): Result.001 file - promoters60/1014678
cagtat

SEQ ID NO: 93598 - DNA, 8 bp, Unknown
  misc_feature (1)..( 8): Result.001 file - promoters60/1014678
aaagaaaa

SEQ ID NO: 93599 - DNA, 8 bp, Unknown
  misc_feature (1)..( 8): Result.001 file - promoters60/1014678
aaataaaa

SEQ ID NO: 93600 - DNA, 8 bp, Unknown
  misc_feature (1)..( 8): Result.001 file - promoters60/1014678
aaaatcgt

SEQ ID NO: 93601 - DNA, 8 bp, Unknown
  misc_feature (1)..( 8): Result.001 file - promoters60/1014678
aaactcga

SEQ ID NO: 93602 - DNA, 8 bp, Unknown
  misc_feature (1)..( 8): Result.001 file - promoters60/1014678
gaacacga

SEQ ID NO: 93603 - DNA, 6 bp, Unknown
  misc_feature (1)..( 6): Result.001 file - promoters60/1014678
gtcttc

SEQ ID NO: 93604 - DNA, 6 bp, Unknown
  misc_feature (1)..( 6): Result.001 file - promoters60/1014678
gtcttc

SEQ ID NO: 93605 - DNA, 6 bp, Unknown
  misc_feature (1)..( 6): Result.001 file - promoters60/1014678
accgtt

SEQ ID NO: 93606 - DNA, 6 bp, Unknown
  misc_feature (1)..( 6): Result.001 file - promoters60/1014678
accgtt

SEQ ID NO: 93607 - DNA, 7 bp, Unknown
  misc_feature (1)..( 7): Result.001 file - promoters60/1014678
catacaa

SEQ ID NO: 93608 - DNA, 7 bp, Unknown
  misc_feature (1)..( 7): Result.001 file - promoters60/1014678
cattcaa

SEQ ID NO: 93609 - DNA, 7 bp, Unknown
  misc_feature (1)..( 7): Result.001 file - promoters60/1014678
caataca

SEQ ID NO: 93610 - DNA, 7 bp, Unknown
  misc_feature (1)..( 7): Result.001 file - promoters60/1014678
caaaaca

SEQ ID NO: 93611 - DNA, 7 bp, Unknown
  misc_feature (1)..( 7): Result.001 file - promoters60/1014678
ttcttct

SEQ ID NO: 93612 - DNA, 7 bp, Unknown
  misc_feature (1)..( 7): Result.001 file - promoters60/1014693
ttcttct

SEQ ID NO: 93613 - DNA, 14 bp, Unknown
  misc_feature (1)..( 14): Result.001 file - promoters60/1014693
tttttgatagagaa

SEQ ID NO: 93614 - DNA, 14 bp, Unknown
  misc_feature (1)..( 14): Result.001 file - promoters60/1014693
ttttttataaagaa

SEQ ID NO: 93615 - DNA, 14 bp, Unknown
  misc_feature (1)..( 14): Result.001 file - promoters60/1014693
catcttaaaaaaaa

SEQ ID NO: 93616 - DNA, 14 bp, Unknown
  misc_feature (1)..( 14): Result.001 file - promoters60/1014693
ttttttagttacag

SEQ ID NO: 93617 - DNA, 11 bp, Unknown
  misc_feature (1)..( 11): Result.001 file - promoters60/1014693
tgagtctacta

SEQ ID NO: 93618 - DNA, 11 bp, Unknown
  misc_feature (1)..( 11): Result.001 file - promoters60/1014693
agattcttcta

SEQ ID NO: 93619 - DNA, 11 bp, Unknown
  misc_feature (1)..( 11): Result.001 file - promoters60/1014693
ttcgtctactt

SEQ ID NO: 93620 - DNA, 11 bp, Unknown
  misc_feature (1)..( 11): Result.001 file - promoters60/1014771
ttcatcttaaa

SEQ ID NO: 93621 - DNA, 14 bp, Unknown
  misc_feature (1)..( 14): Result.001 file - promoters60/1014771
taaaaacataattt

SEQ ID NO: 93622 - DNA, 14 bp, Unknown
  misc_feature (1)..( 14): Result.001 file - promoters60/1014771
tttaaagatagcat

SEQ ID NO: 93623 - DNA, 14 bp, Unknown
  misc_feature (1)..( 14): Result.001 file - promoters60/1014771
taacaacttaattc

SEQ ID NO: 93624 - DNA, 14 bp, Unknown
  misc_feature (1)..( 14): Result.001 file - promoters60/1014771
cataagcttagaga

SEQ ID NO: 93625 - DNA, 14 bp, Unknown
  misc_feature (1)..( 14): Result.001 file - promoters60/1014771
aagaaacaagtaat

SEQ ID NO: 93626 - DNA, 14 bp, Unknown
  misc_feature (1)..( 14): Result.001 file - promoters60/1014771
tatgttgttaaaga

SEQ ID NO: 93627 - DNA, 14 bp, Unknown
  misc_feature (1)..( 14): Result.001 file - promoters60/1014771
ttgaaagaagggat

SEQ ID NO: 93628 - DNA, 12 bp, Unknown
  misc_feature (1)..( 12): Result.001 file - promoters60/1014771
tttaacaattaa

SEQ ID NO: 93629 - DNA, 12 bp, Unknown
  misc_feature (1)..( 12): Result.001 file - promoters60/1014771
gctaacaactta

SEQ ID NO: 93630 - DNA, 12 bp, Unknown
  misc_feature (1)..( 12): Result.001 file - promoters60/1014771
agaaacaagtaa

SEQ ID NO: 93631 - DNA, 12 bp, Unknown
  misc_feature (1)..( 12): Result.001 file - promoters60/1014771
agagacaaagta

SEQ ID NO: 93632 - DNA, 12 bp, Unknown
  misc_feature (1)..( 12): Result.001 file - promoters60/1014771
gttaaagagctt

SEQ ID NO: 93633 - DNA, 12 bp, Unknown
  misc_feature (1)..( 12): Result.001 file - promoters60/1014778
tgaaagaaggga

SEQ ID NO: 93634 - DNA, 8 bp, Unknown
  misc_feature (1)..( 8): Result.001 file - promoters60/1014778
aagagaag

SEQ ID NO: 93635 - DNA, 8 bp, Unknown
  misc_feature (1)..( 8): Result.001 file - promoters60/1014778
aagggaag

SEQ ID NO: 93636 - DNA, 6 bp, Unknown
  misc_feature (1)..( 6): Result.001 file - promoters60/1014778
catgaa

SEQ ID NO: 93637 - DNA, 6 bp, Unknown
  misc_feature (1)..( 6): Result.001 file - promoters60/1014778
catgaa

SEQ ID NO: 93638 - DNA, 6 bp, Unknown
  misc_feature (1)..( 6): Result.001 file - promoters60/1014778
attctt

SEQ ID NO: 93639 - DNA, 6 bp, Unknown
  misc_feature (1)..( 6): Result.001 file - promoters60/1014778
attctt

SEQ ID NO: 93640 - DNA, 6 bp, Unknown
  misc_feature (1)..( 6): Result.001 file - promoters60/1014778
taattt

SEQ ID NO: 93641 - DNA, 6 bp, Unknown
  misc_feature (1)..( 6): Result.001 file - promoters60/1014778
taattt

SEQ ID NO: 93642 - DNA, 8 bp, Unknown
  misc_feature (1)..( 8): Result.001 file - promoters60/1014778
tagtttct

SEQ ID NO: 93643 - DNA, 8 bp, Unknown
  misc_feature (1)..( 8): Result.001 file - promoters60/1014778
tagtgtct

SEQ ID NO: 93644 - DNA, 8 bp, Unknown
  misc_feature (1)..( 8): Result.001 file - promoters60/1014778
cagaaaaa

SEQ ID NO: 93645 - DNA, 8 bp, Unknown
  misc_feature (1)..( 8): Result.001 file - promoters60/1014778
cagaaaaa

SEQ ID NO: 93646 - DNA, 8 bp, Unknown
  misc_feature (1)..( 8): Result.001 file - promoters60/1014778
tttcgaag

SEQ ID NO: 93647 - DNA, 8 bp, Unknown
  misc_feature (1)..( 8): Result.001 file - promoters60/1014778
aatcgaag

SEQ ID NO: 93648 - DNA, 8 bp, Unknown
  misc_feature (1)..( 8): Result.001 file - promoters60/1014778
tttcgaat

SEQ ID NO: 93649 - DNA, 9 bp, Unknown
  misc_feature (1)..( 9): Result.001 file - promoters60/1014778
ggcttttga

SEQ ID NO: 93650 - DNA, 9 bp, Unknown
  misc_feature (1)..( 9): Result.001 file - promoters60/1014778
ggcttatga

SEQ ID NO: 93651 - DNA, 7 bp, Unknown
  misc_feature (1)..( 7): Result.001 file - promoters60/1014778
ccaagaa

SEQ ID NO: 93652 - DNA, 7 bp, Unknown
  misc_feature (1)..( 7): Result.001 file - promoters60/1014778
acaagaa

SEQ ID NO: 93653 - DNA, 7 bp, Unknown
  misc_feature (1)..( 7): Result.001 file - promoters60/1014778
ccaagat

SEQ ID NO: 93654 - DNA, 9 bp, Unknown
  misc_feature (1)..( 9): Result.001 file - promoters60/1014778
acactacaa

SEQ ID NO: 93655 - DNA, 9 bp, Unknown
  misc_feature (1)..( 9): Result.001 file - promoters60/1014778
acaatacaa

SEQ ID NO: 93656 - DNA, 11 bp, Unknown
  misc_feature (1)..( 11): Result.001 file - promoters60/1014778
gaagaacgatg

SEQ ID NO: 93657 - DNA, 11 bp, Unknown
  misc_feature (1)..( 11): Result.001 file - promoters60/1014778
gaataacaatg

SEQ ID NO: 93658 - DNA, 8 bp, Unknown
  misc_feature (1)..( 8): Result.001 file - promoters60/1014778
gtttgtca

SEQ ID NO: 93659 - DNA, 8 bp, Unknown
  misc_feature (1)..( 8): Result.001 file - promoters60/1014778
gtttatca

SEQ ID NO: 93660 - DNA, 9 bp, Unknown
  misc_feature (1)..( 9): Result.001 file - promoters60/1014778
gagatcctc

SEQ ID NO: 93661 - DNA, 9 bp, Unknown
  misc_feature (1)..( 9): Result.001 file - promoters60/1014803
gagaacctc

SEQ ID NO: 93662 - DNA, 6 bp, Unknown
  misc_feature (1)..( 6): Result.001 file - promoters60/1014803
ttgctt

SEQ ID NO: 93663 - DNA, 6 bp, Unknown
  misc_feature (1)..( 6): Result.001 file - promoters60/1014803
ttgctt

SEQ ID NO: 93664 - DNA, 6 bp, Unknown
  misc_feature (1)..( 6): Result.001 file - promoters60/1014803
gcaatg

SEQ ID NO: 93665 - DNA, 6 bp, Unknown
  misc_feature (1)..( 6): Result.001 file - promoters60/1014803
gcaatg

SEQ ID NO: 93666 - DNA, 7 bp, Unknown
  misc_feature (1)..( 7): Result.001 file - promoters60/1014803
aatgcat

SEQ ID NO: 93667 - DNA, 7 bp, Unknown
  misc_feature (1)..( 7): Result.001 file - promoters60/1014803
aattcat

SEQ ID NO: 93668 - DNA, 7 bp, Unknown
  misc_feature (1)..( 7): Result.001 file - promoters60/1014803
tctttga

SEQ ID NO: 93669 - DNA, 7 bp, Unknown
  misc_feature (1)..( 7): Result.001 file - promoters60/1014803
tctctga

SEQ ID NO: 93670 - DNA, 6 bp, Unknown
  misc_feature (1)..( 6): Result.001 file - promoters60/1014803
taaagt

SEQ ID NO: 93671 - DNA, 6 bp, Unknown
  misc_feature (1)..( 6): Result.001 file - promoters60/1014803
taaagt

SEQ ID NO: 93672 - DNA, 6 bp, Unknown
  misc_feature (1)..( 6): Result.001 file - promoters60/1014803
tttcaa

SEQ ID NO: 93673 - DNA, 6 bp, Unknown
  misc_feature (1)..( 6): Result.001 file - promoters60/1014803
tttcaa

SEQ ID NO: 93674 - DNA, 8 bp, Unknown
  misc_feature (1)..( 8): Result.001 file - promoters60/1014803
ttcaatat

SEQ ID NO: 93675 - DNA, 8 bp, Unknown
  misc_feature (1)..( 8): Result.001 file - promoters60/1014803
ttcaatat

SEQ ID NO: 93676 - DNA, 9 bp, Unknown
  misc_feature (1)..( 9): Result.001 file - promoters60/1014803
aaattggta

SEQ ID NO: 93677 - DNA, 9 bp, Unknown
  misc_feature (1)..( 9): Result.001 file - promoters60/1014803
aaattggta

SEQ ID NO: 93678 - DNA, 6 bp, Unknown
  misc_feature (1)..( 6): Result.001 file - promoters60/1014803
aatagt

SEQ ID NO: 93679 - DNA, 6 bp, Unknown
  misc_feature (1)..( 6): Result.001 file - promoters60/1014803
aatagt

SEQ ID NO: 93680 - DNA, 6 bp, Unknown
  misc_feature (1)..( 6): Result.001 file - promoters60/1014803
ctttcg

SEQ ID NO: 93681 - DNA, 6 bp, Unknown
  misc_feature (1)..( 6): Result.001 file - promoters60/1014803
ctttcg

SEQ ID NO: 93682 - DNA, 11 bp, Unknown
  misc_feature (1)..( 11): Result.001 file - promoters60/1014803
ttcttagctac

SEQ ID NO: 93683 - DNA, 11 bp, Unknown
  misc_feature (1)..( 11): Result.001 file - promoters60/1014803
ttcctagatac

SEQ ID NO: 93684 - DNA, 6 bp, Unknown
  misc_feature (1)..( 6): Result.001 file - promoters60/1014803
ttctga

SEQ ID NO: 93685 - DNA, 6 bp, Unknown
  misc_feature (1)..( 6): Result.001 file - promoters60/1014803
ttctga

SEQ ID NO: 93686 - DNA, 8 bp, Unknown
  misc_feature (1)..( 8): Result.001 file - promoters60/1014803
ctcttgtt

SEQ ID NO: 93687 - DNA, 8 bp, Unknown
  misc_feature (1)..( 8): Result.001 file - promoters60/1014803
ctcttgtt

SEQ ID NO: 93688 - DNA, 6 bp, Unknown
  misc_feature (1)..( 6): Result.001 file - promoters60/1014803
gatatt

SEQ ID NO: 93689 - DNA, 6 bp, Unknown
  misc_feature (1)..( 6): Result.001 file - promoters60/1014803
gatatt

SEQ ID NO: 93690 - DNA, 6 bp, Unknown
  misc_feature (1)..( 6): Result.001 file - promoters60/1014803
gttcac

SEQ ID NO: 93691 - DNA, 6 bp, Unknown
  misc_feature (1)..( 6): Result.001 file - promoters60/1014885
gttcac

SEQ ID NO: 93692 - DNA, 10 bp, Unknown
  misc_feature (1)..( 10): Result.001 file - promoters60/1014885
gttttcattt

SEQ ID NO: 93693 - DNA, 10 bp, Unknown
  misc_feature (1)..( 10): Result.001 file - promoters60/1014885
gttttctgct

SEQ ID NO: 93694 - DNA, 10 bp, Unknown
  misc_feature (1)..( 10): Result.001 file - promoters60/1014885
attttgattt

SEQ ID NO: 93695 - DNA, 6 bp, Unknown
  misc_feature (1)..( 6): Result.001 file - promoters60/1014885
ttaaaa

SEQ ID NO: 93696 - DNA, 6 bp, Unknown
  misc_feature (1)..( 6): Result.001 file - promoters60/1014885
ttaaaa

SEQ ID NO: 93697 - DNA, 6 bp, Unknown
  misc_feature (1)..( 6): Result.001 file - promoters60/1014885
ttaaaa

SEQ ID NO: 93698 - DNA, 7 bp, Unknown
  misc_feature (1)..( 7): Result.001 file - promoters60/1014885
taaaagt

SEQ ID NO: 93699 - DNA, 7 bp, Unknown
  misc_feature (1)..( 7): Result.001 file - promoters60/1014885
aaaaagt

SEQ ID NO: 93700 - DNA, 7 bp, Unknown
  misc_feature (1)..( 7): Result.001 file - promoters60/1014885
aaaaagg

SEQ ID NO: 93701 - DNA, 8 bp, Unknown
  misc_feature (1)..( 8): Result.001 file - promoters60/1014885
taccctct

SEQ ID NO: 93702 - DNA, 8 bp, Unknown
  misc_feature (1)..( 8): Result.001 file - promoters60/1014885
taccctcc

SEQ ID NO: 93703 - DNA, 8 bp, Unknown
  misc_feature (1)..( 8): Result.001 file - promoters60/1014885
aaccctct

SEQ ID NO: 93704 - DNA, 9 bp, Unknown
  misc_feature (1)..( 9): Result.001 file - promoters60/1014885
aaagactga

SEQ ID NO: 93705 - DNA, 9 bp, Unknown
  misc_feature (1)..( 9): Result.001 file - promoters60/1014885
aaaaactaa

SEQ ID NO: 93706 - DNA, 9 bp, Unknown
  misc_feature (1)..( 9): Result.001 file - promoters60/1014895
aaaaagtaa

SEQ ID NO: 93707 - DNA, 11 bp, Unknown
  misc_feature (1)..( 11): Result.001 file - promoters60/1014895
aatagataact

SEQ ID NO: 93708 - DNA, 11 bp, Unknown
  misc_feature (1)..( 11): Result.001 file - promoters60/1014895
aatggatagtg

SEQ ID NO: 93709 - DNA, 11 bp, Unknown
  misc_feature (1)..( 11): Result.001 file - promoters60/1014895
ccgggaaagtg

SEQ ID NO: 93710 - DNA, 8 bp, Unknown
  misc_feature (1)..( 8): Result.001 file - promoters60/1014895
gaaaatct

SEQ ID NO: 93711 - DNA, 8 bp, Unknown
  misc_feature (1)..( 8): Result.001 file - promoters60/1014895
gaaaatga

SEQ ID NO: 93712 - DNA, 8 bp, Unknown
  misc_feature (1)..( 8): Result.001 file - promoters60/1014895
aaaactga

SEQ ID NO: 93713 - DNA, 7 bp, Unknown
  misc_feature (1)..( 7): Result.001 file - promoters60/1014895
aaatagc

SEQ ID NO: 93714 - DNA, 7 bp, Unknown
  misc_feature (1)..( 7): Result.001 file - promoters60/1014895
aaaaagc

SEQ ID NO: 93715 - DNA, 8 bp, Unknown
  misc_feature (1)..( 8): Result.001 file - promoters60/1014895
ctatcaca

SEQ ID NO: 93716 - DNA, 8 bp, Unknown
  misc_feature (1)..( 8): Result.001 file - promoters60/1014895
ctagcaca

SEQ ID NO: 93717 - DNA, 7 bp, Unknown
  misc_feature (1)..( 7): Result.001 file - promoters60/1014895
aatctct

SEQ ID NO: 93718 - DNA, 7 bp, Unknown
  misc_feature (1)..( 7): Result.001 file - promoters60/1014895
aatgtct

SEQ ID NO: 93719 - DNA, 6 bp, Unknown
  misc_feature (1)..( 6): Result.001 file - promoters60/1014895
tataaa

SEQ ID NO: 93720 - DNA, 6 bp, Unknown
  misc_feature (1)..( 6): Result.001 file - promoters60/1014895
tataaa

SEQ ID NO: 93721 - DNA, 6 bp, Unknown
  misc_feature (1)..( 6): Result.001 file - promoters60/1014895
cacaca

SEQ ID NO: 93722 - DNA, 6 bp, Unknown
  misc_feature (1)..( 6): Result.001 file - promoters60/1014895
cacaca

SEQ ID NO: 93723 - DNA, 6 bp, Unknown
  misc_feature (1)..( 6): Result.001 file - promoters60/1014895
aaggta

SEQ ID NO: 93724 - DNA, 6 bp, Unknown
  misc_feature (1)..( 6): Result.001 file - promoters60/1014895
aaggta

SEQ ID NO: 93725 - DNA, 7 bp, Unknown
  misc_feature (1)..( 7): Result.001 file - promoters60/1014895
tataatt

SEQ ID NO: 93726 - DNA, 7 bp, Unknown
  misc_feature (1)..( 7): Result.001 file - promoters60/1014895
tatgatt

SEQ ID NO: 93727 - DNA, 6 bp, Unknown
  misc_feature (1)..( 6): Result.001 file - promoters60/1014895
tcgtta

SEQ ID NO: 93728 - DNA, 6 bp, Unknown
  misc_feature (1)..( 6): Result.001 file - promoters60/1014895
tcgtta

SEQ ID NO: 93729 - DNA, 8 bp, Unknown
  misc_feature (1)..( 8): Result.001 file - promoters60/1014895
cgggaaaa

SEQ ID NO: 93730 - DNA, 8 bp, Unknown
  misc_feature (1)..( 8): Result.001 file - promoters60/1014895
cgggaaaa

SEQ ID NO: 93731 - DNA, 7 bp, Unknown
  misc_feature (1)..( 7): Result.001 file - promoters60/1014895
ggaatat

SEQ ID NO: 93732 - DNA, 7 bp, Unknown
  misc_feature (1)..( 7): Result.001 file - promoters60/1014895
ggaatat

SEQ ID NO: 93733 - DNA, 7 bp, Unknown
  misc_feature (1)..( 7): Result.001 file - promoters60/1014895
gaataaa

SEQ ID NO: 93734 - DNA, 7 bp, Unknown
  misc_feature (1)..( 7): Result.001 file - promoters60/1014895
gaaaaaa

SEQ ID NO: 93735 - DNA, 7 bp, Unknown
  misc_feature (1)..( 7): Result.001 file - promoters60/1014895
aaaaaaa

SEQ ID NO: 93736 - DNA, 7 bp, Unknown
  misc_feature (1)..( 7): Result.001 file - promoters60/1014895
aaaaaaa

SEQ ID NO: 93737 - DNA, 7 bp, Unknown
  misc_feature (1)..( 7): Result.001 file - promoters60/1014895
acaaaat

SEQ ID NO: 93738 - DNA, 7 bp, Unknown
  misc_feature (1)..( 7): Result.001 file - promoters60/1014895
acagaat

SEQ ID NO: 93739 - DNA, 6 bp, Unknown
  misc_feature (1)..( 6): Result.001 file - promoters60/1014895
aatttt

SEQ ID NO: 93740 - DNA, 6 bp, Unknown
  misc_feature (1)..( 6): Result.001 file - promoters60/1014895
aatttt

SEQ ID NO: 93741 - DNA, 8 bp, Unknown
  misc_feature (1)..( 8): Result.001 file - promoters60/1014895
gaatttgt

SEQ ID NO: 93742 - DNA, 8 bp, Unknown
  misc_feature (1)..( 8): Result.001 file - promoters60/1014895
gaaattgt

SEQ ID NO: 93743 - DNA, 7 bp, Unknown
  misc_feature (1)..( 7): Result.001 file - promoters60/1014895
ggtttgg

SEQ ID NO: 93744 - DNA, 7 bp, Unknown
  misc_feature (1)..( 7): Result.001 file - promoters60/1014899
ggtttgg

SEQ ID NO: 93745 - DNA, 6 bp, Unknown
  misc_feature (1)..( 6): Result.001 file - promoters60/1014899
cgagtc

SEQ ID NO: 93746 - DNA, 6 bp, Unknown
  misc_feature (1)..( 6): Result.001 file - promoters60/1014899
cgagtc

SEQ ID NO: 93747 - DNA, 6 bp, Unknown
  misc_feature (1)..( 6): Result.001 file - promoters60/1014899
gaaatt

SEQ ID NO: 93748 - DNA, 6 bp, Unknown
  misc_feature (1)..( 6): Result.001 file - promoters60/1014899
gaaatt

SEQ ID NO: 93749 - DNA, 7 bp, Unknown
  misc_feature (1)..( 7): Result.001 file - promoters60/1014899
gactgaa

SEQ ID NO: 93750 - DNA, 7 bp, Unknown
  misc_feature (1)..( 7): Result.001 file - promoters60/1014899
gacagaa

SEQ ID NO: 93751 - DNA, 8 bp, Unknown
  misc_feature (1)..( 8): Result.001 file - promoters60/1014899
aaagatca

SEQ ID NO: 93752 - DNA, 8 bp, Unknown
  misc_feature (1)..( 8): Result.001 file - promoters60/1014899
aaagatca

SEQ ID NO: 93753 - DNA, 6 bp, Unknown
  misc_feature (1)..( 6): Result.001 file - promoters60/1014899
tagtag

SEQ ID NO: 93754 - DNA, 6 bp, Unknown
  misc_feature (1)..( 6): Result.001 file - promoters60/1014899
tagtag

SEQ ID NO: 93755 - DNA, 6 bp, Unknown
  misc_feature (1)..( 6): Result.001 file - promoters60/1014899
cctttt

SEQ ID NO: 93756 - DNA, 6 bp, Unknown
  misc_feature (1)..( 6): Result.001 file - promoters60/1014899
cctttt

SEQ ID NO: 93757 - DNA, 6 bp, Unknown
  misc_feature (1)..( 6): Result.001 file - promoters60/1014899
tttgat

SEQ ID NO: 93758 - DNA, 6 bp, Unknown
  misc_feature (1)..( 6): Result.001 file - promoters60/1014899
tttgat

SEQ ID NO: 93759 - DNA, 8 bp, Unknown
  misc_feature (1)..( 8): Result.001 file - promoters60/1014899
tttaacta

SEQ ID NO: 93760 - DNA, 8 bp, Unknown
  misc_feature (1)..( 8): Result.001 file - promoters60/1014899
tttatcta

SEQ ID NO: 93761 - DNA, 8 bp, Unknown
  misc_feature (1)..( 8): Result.001 file - promoters60/1014899
ctattttt

SEQ ID NO: 93762 - DNA, 8 bp, Unknown
  misc_feature (1)..( 8): Result.001 file - promoters60/1014899
ctatcttt

SEQ ID NO: 93763 - DNA, 8 bp, Unknown
  misc_feature (1)..( 8): Result.001 file - promoters60/1014899
cactaacc

SEQ ID NO: 93764 - DNA, 8 bp, Unknown
  misc_feature (1)..( 8): Result.001 file - promoters60/1014899
cactaacc

SEQ ID NO: 93765 - DNA, 7 bp, Unknown
  misc_feature (1)..( 7): Result.001 file - promoters60/1014899
aatcggt

SEQ ID NO: 93766 - DNA, 7 bp, Unknown
  misc_feature (1)..( 7): Result.001 file - promoters60/1014899
aattggt

SEQ ID NO: 93767 - DNA, 6 bp, Unknown
  misc_feature (1)..( 6): Result.001 file - promoters60/1014899
gacctc

SEQ ID NO: 93768 - DNA, 6 bp, Unknown
  misc_feature (1)..( 6): Result.001 file - promoters60/1014899
gacctc

SEQ ID NO: 93769 - DNA, 8 bp, Unknown
  misc_feature (1)..( 8): Result.001 file - promoters60/1014899
ttttaata

SEQ ID NO: 93770 - DNA, 8 bp, Unknown
  misc_feature (1)..( 8): Result.001 file - promoters60/1014899
ttttaata

SEQ ID NO: 93771 - DNA, 9 bp, Unknown
  misc_feature (1)..( 9): Result.001 file - promoters60/1014899
tcttgttta

SEQ ID NO: 93772 - DNA, 9 bp, Unknown
  misc_feature (1)..( 9): Result.001 file - promoters60/1014899
tctttttta

SEQ ID NO: 93773 - DNA, 7 bp, Unknown
  misc_feature (1)..( 7): Result.001 file - promoters60/1014899
aaacata

SEQ ID NO: 93774 - DNA, 7 bp, Unknown
  misc_feature (1)..( 7): Result.001 file - promoters60/1014899
aaatata

SEQ ID NO: 93775 - DNA, 7 bp, Unknown
  misc_feature (1)..( 7): Result.001 file - promoters60/1014899
caagata

SEQ ID NO: 93776 - DNA, 7 bp, Unknown
  misc_feature (1)..( 7): Result.001 file - promoters60/1014899
caacata

SEQ ID NO: 93777 - DNA, 7 bp, Unknown
  misc_feature (1)..( 7): Result.001 file - promoters60/1014899
ttaaaaa

SEQ ID NO: 93778 - DNA, 7 bp, Unknown
  misc_feature (1)..( 7): Result.001 file - promoters60/1014899
ttacaaa

SEQ ID NO: 93779 - DNA, 8 bp, Unknown
  misc_feature (1)..( 8): Result.001 file - promoters60/1014899
gtgaaaaa

SEQ ID NO: 93780 - DNA, 8 bp, Unknown
  misc_feature (1)..( 8): Result.001 file - promoters60/1014899
gtgaaaaa

SEQ ID NO: 93781 - DNA, 8 bp, Unknown
  misc_feature (1)..( 8): Result.001 file - promoters60/1014899
tattaata

SEQ ID NO: 93782 - DNA, 8 bp, Unknown
  misc_feature (1)..( 8): Result.001 file - promoters60/1014907
tataaata

SEQ ID NO: 93783 - DNA, 11 bp, Unknown
  misc_feature (1)..( 11): Result.001 file - promoters60/1014907
ctacatatcat

SEQ ID NO: 93784 - DNA, 11 bp, Unknown
  misc_feature (1)..( 11): Result.001 file - promoters60/1014907
agacatatatg

SEQ ID NO: 93785 - DNA, 11 bp, Unknown
  misc_feature (1)..( 11): Result.001 file - promoters60/1014907
ctacatatcat

SEQ ID NO: 93786 - DNA, 7 bp, Unknown
  misc_feature (1)..( 7): Result.001 file - promoters60/1014907
ttttcta

SEQ ID NO: 93787 - DNA, 7 bp, Unknown
  misc_feature (1)..( 7): Result.001 file - promoters60/1014907
ttttcta

SEQ ID NO: 93788 - DNA, 7 bp, Unknown
  misc_feature (1)..( 7): Result.001 file - promoters60/1014907
tttttag

SEQ ID NO: 93789 - DNA, 7 bp, Unknown
  misc_feature (1)..( 7): Result.001 file - promoters60/1014907
tatttta

SEQ ID NO: 93790 - DNA, 7 bp, Unknown
  misc_feature (1)..( 7): Result.001 file - promoters60/1014907
tatttta

SEQ ID NO: 93791 - DNA, 8 bp, Unknown
  misc_feature (1)..( 8): Result.001 file - promoters60/1014907
cattcttt

SEQ ID NO: 93792 - DNA, 9 bp, Unknown
  misc_feature (1)..( 9): Result.001 file - promoters60/1014907
atttgtaat

SEQ ID NO: 93793 - DNA, 9 bp, Unknown
  misc_feature (1)..( 9): Result.001 file - promoters60/1014907
ttttttaat

SEQ ID NO: 93794 - DNA, 9 bp, Unknown
  misc_feature (1)..( 9): Result.001 file - promoters60/1014907
atttttttt

SEQ ID NO: 93795 - DNA, 9 bp, Unknown
  misc_feature (1)..( 9): Result.001 file - promoters60/1014907
caaaaaaag

SEQ ID NO: 93796 - DNA, 9 bp, Unknown
  misc_feature (1)..( 9): Result.001 file - promoters60/1014907
aaaaacaag

SEQ ID NO: 93797 - DNA, 9 bp, Unknown
  misc_feature (1)..( 9): Result.001 file - promoters60/1014907
caaaaaaaa

SEQ ID NO: 93798 - DNA, 10 bp, Unknown
  misc_feature (1)..( 10): Result.001 file - promoters60/1014907
taaaataatc

SEQ ID NO: 93799 - DNA, 10 bp, Unknown
  misc_feature (1)..( 10): Result.001 file - promoters60/1014907
gaaaatgatc

SEQ ID NO: 93800 - DNA, 10 bp, Unknown
  misc_feature (1)..( 10): Result.001 file - promoters60/1014907
taaaatgcga

SEQ ID NO: 93801 - DNA, 7 bp, Unknown
  misc_feature (1)..( 7): Result.001 file - promoters60/1014907
aaagtct

SEQ ID NO: 93802 - DNA, 7 bp, Unknown
  misc_feature (1)..( 7): Result.001 file - promoters60/1014907
aaattct

SEQ ID NO: 93803 - DNA, 7 bp, Unknown
  misc_feature (1)..( 7): Result.001 file - promoters60/1014926
aaaatct

SEQ ID NO: 93804 - DNA, 6 bp, Unknown
  misc_feature (1)..( 6): Result.001 file - promoters60/1014926
aataca

SEQ ID NO: 93805 - DNA, 6 bp, Unknown
  misc_feature (1)..( 6): Result.001 file - promoters60/1014926
aataca

SEQ ID NO: 93806 - DNA, 8 bp, Unknown
  misc_feature (1)..( 8): Result.001 file - promoters60/1014926
taagacag

SEQ ID NO: 93807 - DNA, 8 bp, Unknown
  misc_feature (1)..( 8): Result.001 file - promoters60/1014926
taacacag

SEQ ID NO: 93808 - DNA, 7 bp, Unknown
  misc_feature (1)..( 7): Result.001 file - promoters60/1014926
ctccttc

SEQ ID NO: 93809 - DNA, 7 bp, Unknown
  misc_feature (1)..( 7): Result.001 file - promoters60/1014926
ctcattc

SEQ ID NO: 93810 - DNA, 7 bp, Unknown
  misc_feature (1)..( 7): Result.001 file - promoters60/1014926
ccttcct

SEQ ID NO: 93811 - DNA, 7 bp, Unknown
  misc_feature (1)..( 7): Result.001 file - promoters60/1014926
ccttccc

SEQ ID NO: 93812 - DNA, 7 bp, Unknown
  misc_feature (1)..( 7): Result.001 file - promoters60/1014926
ctttctt

SEQ ID NO: 93813 - DNA, 8 bp, Unknown
  misc_feature (1)..( 8): Result.001 file - promoters60/1014926
ctttttta

SEQ ID NO: 93814 - DNA, 8 bp, Unknown
  misc_feature (1)..( 8): Result.001 file - promoters60/1014926
cttattta

SEQ ID NO: 93815 - DNA, 6 bp, Unknown
  misc_feature (1)..( 6): Result.001 file - promoters60/1014926
aaaagg

SEQ ID NO: 93816 - DNA, 6 bp, Unknown
  misc_feature (1)..( 6): Result.001 file - promoters60/1014926
aaaagg

SEQ ID NO: 93817 - DNA, 11 bp, Unknown
  misc_feature (1)..( 11): Result.001 file - promoters60/1014926
gttgttatagg

SEQ ID NO: 93818 - DNA, 11 bp, Unknown
  misc_feature (1)..( 11): Result.001 file - promoters60/1014926
attgttaaagg

SEQ ID NO: 93819 - DNA, 11 bp, Unknown
  misc_feature (1)..( 11): Result.001 file - promoters60/1014926
atttttattta

SEQ ID NO: 93820 - DNA, 7 bp, Unknown
  misc_feature (1)..( 7): Result.001 file - promoters60/1014926
ttacaga

SEQ ID NO: 93821 - DNA, 7 bp, Unknown
  misc_feature (1)..( 7): Result.001 file - promoters60/1014926
ttagaga

SEQ ID NO: 93822 - DNA, 7 bp, Unknown
  misc_feature (1)..( 7): Result.001 file - promoters60/1014926
ttacgtt

SEQ ID NO: 93823 - DNA, 7 bp, Unknown
  misc_feature (1)..( 7): Result.001 file - promoters60/1014926
ttatgtt

SEQ ID NO: 93824 - DNA, 8 bp, Unknown
  misc_feature (1)..( 8): Result.001 file - promoters60/1014926
taataaat

SEQ ID NO: 93825 - DNA, 8 bp, Unknown
  misc_feature (1)..( 8): Result.001 file - promoters60/1014926
taagaaat

SEQ ID NO: 93826 - DNA, 6 bp, Unknown
  misc_feature (1)..( 6): Result.001 file - promoters60/1014926
ggctca

SEQ ID NO: 93827 - DNA, 6 bp, Unknown
  misc_feature (1)..( 6): Result.001 file - promoters60/1014926
ggctca

SEQ ID NO: 93828 - DNA, 6 bp, Unknown
  misc_feature (1)..( 6): Result.001 file - promoters60/1014926
aagttg

SEQ ID NO: 93829 - DNA, 6 bp, Unknown
  misc_feature (1)..( 6): Result.001 file - promoters60/1014926
aagttg

SEQ ID NO: 93830 - DNA, 6 bp, Unknown
  misc_feature (1)..( 6): Result.001 file - promoters60/1014926
cattct

SEQ ID NO: 93831 - DNA, 6 bp, Unknown
  misc_feature (1)..( 6): Result.001 file - promoters60/1014926
cattct

SEQ ID NO: 93832 - DNA, 6 bp, Unknown
  misc_feature (1)..( 6): Result.001 file - promoters60/1014926
tctgga

SEQ ID NO: 93833 - DNA, 6 bp, Unknown
  misc_feature (1)..( 6): Result.001 file - promoters60/1014926
tctgga

SEQ ID NO: 93834 - DNA, 7 bp, Unknown
  misc_feature (1)..( 7): Result.001 file - promoters60/1014926
cctaaat

SEQ ID NO: 93835 - DNA, 7 bp, Unknown
  misc_feature (1)..( 7): Result.001 file - promoters60/1014989
cctcaat

SEQ ID NO: 93836 - DNA, 8 bp, Unknown
  misc_feature (1)..( 8): Result.001 file - promoters60/1014989
ttttcaaa

SEQ ID NO: 93837 - DNA, 8 bp, Unknown
  misc_feature (1)..( 8): Result.001 file - promoters60/1014989
ttttgaaa

SEQ ID NO: 93838 - DNA, 8 bp, Unknown
  misc_feature (1)..( 8): Result.001 file - promoters60/1014989
ttttgatg

SEQ ID NO: 93839 - DNA, 9 bp, Unknown
  misc_feature (1)..( 9): Result.001 file - promoters60/1014989
aacacatat

SEQ ID NO: 93840 - DNA, 9 bp, Unknown
  misc_feature (1)..( 9): Result.001 file - promoters60/1014989
aacaaatat

SEQ ID NO: 93841 - DNA, 7 bp, Unknown
  misc_feature (1)..( 7): Result.001 file - promoters60/1014989
atatatg

SEQ ID NO: 93842 - DNA, 7 bp, Unknown
  misc_feature (1)..( 7): Result.001 file - promoters60/1014989
atatatg

SEQ ID NO: 93843 - DNA, 6 bp, Unknown
  misc_feature (1)..( 6): Result.001 file - promoters60/1014989
aattgg

SEQ ID NO: 93844 - DNA, 6 bp, Unknown
  misc_feature (1)..( 6): Result.001 file - promoters60/1014989
aattgg

SEQ ID NO: 93845 - DNA, 6 bp, Unknown
  misc_feature (1)..( 6): Result.001 file - promoters60/1014989
gtaata

SEQ ID NO: 93846 - DNA, 6 bp, Unknown
  misc_feature (1)..( 6): Result.001 file - promoters60/1014989
gtaata

SEQ ID NO: 93847 - DNA, 8 bp, Unknown
  misc_feature (1)..( 8): Result.001 file - promoters60/1014989
aacttatt

SEQ ID NO: 93848 - DNA, 8 bp, Unknown
  misc_feature (1)..( 8): Result.001 file - promoters60/1014989
aacttatt

SEQ ID NO: 93849 - DNA, 6 bp, Unknown
  misc_feature (1)..( 6): Result.001 file - promoters60/1014989
tatttt

SEQ ID NO: 93850 - DNA, 6 bp, Unknown
  misc_feature (1)..( 6): Result.001 file - promoters60/1014989
tatttt

SEQ ID NO: 93851 - DNA, 7 bp, Unknown
  misc_feature (1)..( 7): Result.001 file - promoters60/1014989
attatat

SEQ ID NO: 93852 - DNA, 7 bp, Unknown
  misc_feature (1)..( 7): Result.001 file - promoters60/1014989
attttat

SEQ ID NO: 93853 - DNA, 7 bp, Unknown
  misc_feature (1)..( 7): Result.001 file - promoters60/1014989
agaatat

SEQ ID NO: 93854 - DNA, 7 bp, Unknown
  misc_feature (1)..( 7): Result.001 file - promoters60/1014989
agattat

SEQ ID NO: 93855 - DNA, 7 bp, Unknown
  misc_feature (1)..( 7): Result.001 file - promoters60/1014989
ttaaaac

SEQ ID NO: 93856 - DNA, 7 bp, Unknown
  misc_feature (1)..( 7): Result.001 file - promoters60/1014989
ttacaac

SEQ ID NO: 93857 - DNA, 7 bp, Unknown
  misc_feature (1)..( 7): Result.001 file - promoters60/1014989
tttcaaa

SEQ ID NO: 93858 - DNA, 7 bp, Unknown
  misc_feature (1)..( 7): Result.001 file - promoters60/1014989
tttcaaa

SEQ ID NO: 93859 - DNA, 7 bp, Unknown
  misc_feature (1)..( 7): Result.001 file - promoters60/1014989
aactatt

SEQ ID NO: 93860 - DNA, 7 bp, Unknown
  misc_feature (1)..( 7): Result.001 file - promoters60/1014989
aaccatt

SEQ ID NO: 93861 - DNA, 7 bp, Unknown
  misc_feature (1)..( 7): Result.001 file - promoters60/1014989
atgtgag

SEQ ID NO: 93862 - DNA, 7 bp, Unknown
  misc_feature (1)..( 7): Result.001 file - promoters60/1014989
atgggag

SEQ ID NO: 93863 - DNA, 8 bp, Unknown
  misc_feature (1)..( 8): Result.001 file - promoters60/1014989
caattcaa

SEQ ID NO: 93864 - DNA, 8 bp, Unknown
  misc_feature (1)..( 8): Result.001 file - promoters60/1014989
caaatcaa

SEQ ID NO: 93865 - DNA, 7 bp, Unknown
  misc_feature (1)..( 7): Result.001 file - promoters60/1014989
attcaat

SEQ ID NO: 93866 - DNA, 7 bp, Unknown
  misc_feature (1)..( 7): Result.001 file - promoters60/1014989
atttaat

SEQ ID NO: 93867 - DNA, 8 bp, Unknown
  misc_feature (1)..( 8): Result.001 file - promoters60/1014989
atatcaat

SEQ ID NO: 93868 - DNA, 8 bp, Unknown
  misc_feature (1)..( 8): Result.001 file - promoters60/1014989
atagcaat

SEQ ID NO: 93869 - DNA, 6 bp, Unknown
  misc_feature (1)..( 6): Result.001 file - promoters60/1014989
ttttat

SEQ ID NO: 93870 - DNA, 6 bp, Unknown
  misc_feature (1)..( 6): Result.001 file - promoters60/1014989
ttttat

SEQ ID NO: 93871 - DNA, 6 bp, Unknown
  misc_feature (1)..( 6): Result.001 file - promoters60/1014989
atattt

SEQ ID NO: 93872 - DNA, 6 bp, Unknown
  misc_feature (1)..( 6): Result.001 file - promoters60/1014989
atattt

SEQ ID NO: 93873 - DNA, 7 bp, Unknown
  misc_feature (1)..( 7): Result.001 file - promoters60/1014989
tttcatg

SEQ ID NO: 93874 - DNA, 7 bp, Unknown
  misc_feature (1)..( 7): Result.001 file - promoters60/1014989
tttgatg

SEQ ID NO: 93875 - DNA, 6 bp, Unknown
  misc_feature (1)..( 6): Result.001 file - promoters60/1014989
gatcat

SEQ ID NO: 93876 - DNA, 6 bp, Unknown
  misc_feature (1)..( 6): Result.001 file - promoters60/1014989
gatcat

SEQ ID NO: 93877 - DNA, 6 bp, Unknown
  misc_feature (1)..( 6): Result.001 file - promoters60/1014989
aaattt

SEQ ID NO: 93878 - DNA, 6 bp, Unknown
  misc_feature (1)..( 6): Result.001 file - promoters60/1014989
aaattt

SEQ ID NO: 93879 - DNA, 6 bp, Unknown
  misc_feature (1)..( 6): Result.001 file - promoters60/1014989
tgtttt

SEQ ID NO: 93880 - DNA, 6 bp, Unknown
  misc_feature (1)..( 6): Result.001 file - promoters60/1014989
tgtttt

SEQ ID NO: 93881 - DNA, 6 bp, Unknown
  misc_feature (1)..( 6): Result.001 file - promoters60/1014989
atgcaa

SEQ ID NO: 93882 - DNA, 6 bp, Unknown
  misc_feature (1)..( 6): Result.001 file - promoters60/1014989
atgcaa

SEQ ID NO: 93883 - DNA, 7 bp, Unknown
  misc_feature (1)..( 7): Result.001 file - promoters60/1014989
tactttt

SEQ ID NO: 93884 - DNA, 7 bp, Unknown
  misc_feature (1)..( 7): Result.001 file - promoters60/1014991
tacattt

SEQ ID NO: 93885 - DNA, 11 bp, Unknown
  misc_feature (1)..( 11): Result.001 file - promoters60/1014991
cgtgtcttctt

SEQ ID NO: 93886 - DNA, 11 bp, Unknown
  misc_feature (1)..( 11): Result.001 file - promoters60/1014991
cttgtcttttt

SEQ ID NO: 93887 - DNA, 11 bp, Unknown
  misc_feature (1)..( 11): Result.001 file - promoters60/1014991
gcagtcatctt

SEQ ID NO: 93888 - DNA, 11 bp, Unknown
  misc_feature (1)..( 11): Result.001 file - promoters60/1014991
cttgtgtttga

SEQ ID NO: 93889 - DNA, 11 bp, Unknown
  misc_feature (1)..( 11): Result.001 file - promoters60/1014991
attgtatttat

SEQ ID NO: 93890 - DNA, 11 bp, Unknown
  misc_feature (1)..( 11): Result.001 file - promoters60/1015030
attgggttttg

SEQ ID NO: 93891 - DNA, 10 bp, Unknown
  misc_feature (1)..( 10): Result.001 file - promoters60/1015030
tttttaaaaa

SEQ ID NO: 93892 - DNA, 10 bp, Unknown
  misc_feature (1)..( 10): Result.001 file - promoters60/1015030
ttttgaaaaa

SEQ ID NO: 93893 - DNA, 8 bp, Unknown
  misc_feature (1)..( 8): Result.001 file - promoters60/1015030
aaaattta

SEQ ID NO: 93894 - DNA, 8 bp, Unknown
  misc_feature (1)..( 8): Result.001 file - promoters60/1015030
aaagttta

SEQ ID NO: 93895 - DNA, 6 bp, Unknown
  misc_feature (1)..( 6): Result.001 file - promoters60/1015030
acaaaa

SEQ ID NO: 93896 - DNA, 6 bp, Unknown
  misc_feature (1)..( 6): Result.001 file - promoters60/1015030
acaaaa

SEQ ID NO: 93897 - DNA, 10 bp, Unknown
  misc_feature (1)..( 10): Result.001 file - promoters60/1015030
ttttgagcta

SEQ ID NO: 93898 - DNA, 10 bp, Unknown
  misc_feature (1)..( 10): Result.001 file - promoters60/1015030
ttttgacttg

SEQ ID NO: 93899 - DNA, 10 bp, Unknown
  misc_feature (1)..( 10): Result.001 file - promoters60/1015030
ttttgatcta

SEQ ID NO: 93900 - DNA, 8 bp, Unknown
  misc_feature (1)..( 8): Result.001 file - promoters60/1015030
aaaaataa

SEQ ID NO: 93901 - DNA, 8 bp, Unknown
  misc_feature (1)..( 8): Result.001 file - promoters60/1015030
aaaactaa

SEQ ID NO: 93902 - DNA, 7 bp, Unknown
  misc_feature (1)..( 7): Result.001 file - promoters60/1015030
tccatta

SEQ ID NO: 93903 - DNA, 7 bp, Unknown
  misc_feature (1)..( 7): Result.001 file - promoters60/1015030
tccatta

SEQ ID NO: 93904 - DNA, 7 bp, Unknown
  misc_feature (1)..( 7): Result.001 file - promoters60/1015030
ttttttc

SEQ ID NO: 93905 - DNA, 7 bp, Unknown
  misc_feature (1)..( 7): Result.001 file - promoters60/1015030
tttgttc

SEQ ID NO: 93906 - DNA, 7 bp, Unknown
  misc_feature (1)..( 7): Result.001 file - promoters60/1015030
tatatac

SEQ ID NO: 93907 - DNA, 7 bp, Unknown
  misc_feature (1)..( 7): Result.001 file - promoters60/1015030
tatttac

SEQ ID NO: 93908 - DNA, 7 bp, Unknown
  misc_feature (1)..( 7): Result.001 file - promoters60/1015030
atataaa

SEQ ID NO: 93909 - DNA, 7 bp, Unknown
  misc_feature (1)..( 7): Result.001 file - promoters60/1015030
atataaa

SEQ ID NO: 93910 - DNA, 7 bp, Unknown
  misc_feature (1)..( 7): Result.001 file - promoters60/1015030
tctttag

SEQ ID NO: 93911 - DNA, 7 bp, Unknown
  misc_feature (1)..( 7): Result.001 file - promoters60/1015030
tctttag

SEQ ID NO: 93912 - DNA, 7 bp, Unknown
  misc_feature (1)..( 7): Result.001 file - promoters60/1015030
ttttgag

SEQ ID NO: 93913 - DNA, 8 bp, Unknown
  misc_feature (1)..( 8): Result.001 file - promoters60/1015030
agattttt

SEQ ID NO: 93914 - DNA, 8 bp, Unknown
  misc_feature (1)..( 8): Result.001 file - promoters60/1015030
agatgttt

SEQ ID NO: 93915 - DNA, 6 bp, Unknown
  misc_feature (1)..( 6): Result.001 file - promoters60/1015030
agtttt

SEQ ID NO: 93916 - DNA, 6 bp, Unknown
  misc_feature (1)..( 6): Result.001 file - promoters60/1015030
agtttt

SEQ ID NO: 93917 - DNA, 11 bp, Unknown
  misc_feature (1)..( 11): Result.001 file - promoters60/1015030
tttatatcgtg

SEQ ID NO: 93918 - DNA, 11 bp, Unknown
  misc_feature (1)..( 11): Result.001 file - promoters60/1015030
cttatctcgtg

SEQ ID NO: 93919 - DNA, 11 bp, Unknown
  misc_feature (1)..( 11): Result.001 file - promoters60/1015030
cttttctttct

SEQ ID NO: 93920 - DNA, 8 bp, Unknown
  misc_feature (1)..( 8): Result.001 file - promoters60/1015030
aatatata

SEQ ID NO: 93921 - DNA, 8 bp, Unknown
  misc_feature (1)..( 8): Result.001 file - promoters60/1015030
aatttata

SEQ ID NO: 93922 - DNA, 7 bp, Unknown
  misc_feature (1)..( 7): Result.001 file - promoters60/1015030
acttaat

SEQ ID NO: 93923 - DNA, 7 bp, Unknown
  misc_feature (1)..( 7): Result.001 file - promoters60/1015030
actaaat

SEQ ID NO: 93924 - DNA, 6 bp, Unknown
  misc_feature (1)..( 6): Result.001 file - promoters60/1015030
gttcaa

SEQ ID NO: 93925 - DNA, 6 bp, Unknown
  misc_feature (1)..( 6): Result.001 file - promoters60/1015030
gttcaa

SEQ ID NO: 93926 - DNA, 6 bp, Unknown
  misc_feature (1)..( 6): Result.001 file - promoters60/1015030
tttttt

SEQ ID NO: 93927 - DNA, 6 bp, Unknown
  misc_feature (1)..( 6): Result.001 file - promoters60/1015030
tttttt

SEQ ID NO: 93928 - DNA, 6 bp, Unknown
  misc_feature (1)..( 6): Result.001 file - promoters60/1015030
actttt

SEQ ID NO: 93929 - DNA, 6 bp, Unknown
  misc_feature (1)..( 6): Result.001 file - promoters60/1015030
actttt

SEQ ID NO: 93930 - DNA, 7 bp, Unknown
  misc_feature (1)..( 7): Result.001 file - promoters60/1015030
ttttctt

SEQ ID NO: 93931 - DNA, 7 bp, Unknown
  misc_feature (1)..( 7): Result.001 file - promoters60/1015030
ttttctt

SEQ ID NO: 93932 - DNA, 8 bp, Unknown
  misc_feature (1)..( 8): Result.001 file - promoters60/1015030
tccttttt

SEQ ID NO: 93933 - DNA, 8 bp, Unknown
  misc_feature (1)..( 8): Result.001 file - promoters60/1015030
tcctcttt

SEQ ID NO: 93934 - DNA, 6 bp, Unknown
  misc_feature (1)..( 6): Result.001 file - promoters60/1015030
tgaaag

SEQ ID NO: 93935 - DNA, 6 bp, Unknown
  misc_feature (1)..( 6): Result.001 file - promoters60/1015030
tgaaag

SEQ ID NO: 93936 - DNA, 7 bp, Unknown
  misc_feature (1)..( 7): Result.001 file - promoters60/1015030
gatatac

SEQ ID NO: 93937 - DNA, 7 bp, Unknown
  misc_feature (1)..( 7): Result.001 file - promoters60/1015030
gatttac

SEQ ID NO: 93938 - DNA, 7 bp, Unknown
  misc_feature (1)..( 7): Result.001 file - promoters60/1015030
ccaaata

SEQ ID NO: 93939 - DNA, 7 bp, Unknown
  misc_feature (1)..( 7): Result.001 file - promoters60/1015064
ccaaata

SEQ ID NO: 93940 - DNA, 13 bp, Unknown
  misc_feature (1)..( 13): Result.001 file - promoters60/1015064
tagttgattcgtt

SEQ ID NO: 93941 - DNA, 13 bp, Unknown
  misc_feature (1)..( 13): Result.001 file - promoters60/1015064
atttttatttgtt

SEQ ID NO: 93942 - DNA, 13 bp, Unknown
  misc_feature (1)..( 13): Result.001 file - promoters60/1015064
tagtttattcgag

SEQ ID NO: 93943 - DNA, 14 bp, Unknown
  misc_feature (1)..( 14): Result.001 file - promoters60/1015064
tgaaatgtttagtt

SEQ ID NO: 93944 - DNA, 8 bp, Unknown
  misc_feature (1)..( 8): Result.001 file - promoters60/1015064
tattaatg

SEQ ID NO: 93945 - DNA, 8 bp, Unknown
  misc_feature (1)..( 8): Result.001 file - promoters60/1015064
tattaata

SEQ ID NO: 93946 - DNA, 8 bp, Unknown
  misc_feature (1)..( 8): Result.001 file - promoters60/1015064
agttaatg

SEQ ID NO: 93947 - DNA, 8 bp, Unknown
  misc_feature (1)..( 8): Result.001 file - promoters60/1015064
ggttaatt

SEQ ID NO: 93948 - DNA, 7 bp, Unknown
  misc_feature (1)..( 7): Result.001 file - promoters60/1015064
aatatta

SEQ ID NO: 93949 - DNA, 7 bp, Unknown
  misc_feature (1)..( 7): Result.001 file - promoters60/1015064
aatattt

SEQ ID NO: 93950 - DNA, 7 bp, Unknown
  misc_feature (1)..( 7): Result.001 file - promoters60/1015064
aatgttt

SEQ ID NO: 93951 - DNA, 7 bp, Unknown
  misc_feature (1)..( 7): Result.001 file - promoters60/1015064
aatgttt

SEQ ID NO: 93952 - DNA, 8 bp, Unknown
  misc_feature (1)..( 8): Result.001 file - promoters60/1015064
tttagtgg

SEQ ID NO: 93953 - DNA, 8 bp, Unknown
  misc_feature (1)..( 8): Result.001 file - promoters60/1015064
tttagtta

SEQ ID NO: 93954 - DNA, 8 bp, Unknown
  misc_feature (1)..( 8): Result.001 file - promoters60/1015064
tttagttt

SEQ ID NO: 93955 - DNA, 8 bp, Unknown
  misc_feature (1)..( 8): Result.001 file - promoters60/1015064
cttatttt

SEQ ID NO: 93956 - DNA, 10 bp, Unknown
  misc_feature (1)..( 10): Result.001 file - promoters60/1015064
tgaagccaaa

SEQ ID NO: 93957 - DNA, 10 bp, Unknown
  misc_feature (1)..( 10): Result.001 file - promoters60/1015064
tgaaaccaac

SEQ ID NO: 93958 - DNA, 10 bp, Unknown
  misc_feature (1)..( 10): Result.001 file - promoters60/1015064
aagaacaaac

SEQ ID NO: 93959 - DNA, 7 bp, Unknown
  misc_feature (1)..( 7): Result.001 file - promoters60/1015064
tttcgat

SEQ ID NO: 93960 - DNA, 7 bp, Unknown
  misc_feature (1)..( 7): Result.001 file - promoters60/1015064
ttttgat

SEQ ID NO: 93961 - DNA, 7 bp, Unknown
  misc_feature (1)..( 7): Result.001 file - promoters60/1015064
ttttgat

SEQ ID NO: 93962 - DNA, 9 bp, Unknown
  misc_feature (1)..( 9): Result.001 file - promoters60/1015064
aatttattt

SEQ ID NO: 93963 - DNA, 9 bp, Unknown
  misc_feature (1)..( 9): Result.001 file - promoters60/1015064
agtttattc

SEQ ID NO: 93964 - DNA, 9 bp, Unknown
  misc_feature (1)..( 9): Result.001 file - promoters60/1015064
aatatattt

SEQ ID NO: 93965 - DNA, 11 bp, Unknown
  misc_feature (1)..( 11): Result.001 file - promoters60/1015064
tacgtaacatg

SEQ ID NO: 93966 - DNA, 11 bp, Unknown
  misc_feature (1)..( 11): Result.001 file - promoters60/1015064
gtattaatatg

SEQ ID NO: 93967 - DNA, 11 bp, Unknown
  misc_feature (1)..( 11): Result.001 file - promoters60/1015092
tacgttacaat

SEQ ID NO: 93968 - DNA, 7 bp, Unknown
  misc_feature (1)..( 7): Result.001 file - promoters60/1015092
gtcgaaa

SEQ ID NO: 93969 - DNA, 7 bp, Unknown
  misc_feature (1)..( 7): Result.001 file - promoters60/1015092
gtctaaa

SEQ ID NO: 93970 - DNA, 7 bp, Unknown
  misc_feature (1)..( 7): Result.001 file - promoters60/1015092
aaacatt

SEQ ID NO: 93971 - DNA, 7 bp, Unknown
  misc_feature (1)..( 7): Result.001 file - promoters60/1015092
aaatatt

SEQ ID NO: 93972 - DNA, 10 bp, Unknown
  misc_feature (1)..( 10): Result.001 file - promoters60/1015092
taaatttgct

SEQ ID NO: 93973 - DNA, 10 bp, Unknown
  misc_feature (1)..( 10): Result.001 file - promoters60/1015092
taaatttaaa

SEQ ID NO: 93974 - DNA, 10 bp, Unknown
  misc_feature (1)..( 10): Result.001 file - promoters60/1015092
tgaatctgct

SEQ ID NO: 93975 - DNA, 9 bp, Unknown
  misc_feature (1)..( 9): Result.001 file - promoters60/1015092
tcagttaga

SEQ ID NO: 93976 - DNA, 9 bp, Unknown
  misc_feature (1)..( 9): Result.001 file - promoters60/1015092
tcagtaaga

SEQ ID NO: 93977 - DNA, 7 bp, Unknown
  misc_feature (1)..( 7): Result.001 file - promoters60/1015092
tttattg

SEQ ID NO: 93978 - DNA, 7 bp, Unknown
  misc_feature (1)..( 7): Result.001 file - promoters60/1015092
tttcttg

SEQ ID NO: 93979 - DNA, 7 bp, Unknown
  misc_feature (1)..( 7): Result.001 file - promoters60/1015092
tgaaaaa

SEQ ID NO: 93980 - DNA, 7 bp, Unknown
  misc_feature (1)..( 7): Result.001 file - promoters60/1015092
tgaaaaa

SEQ ID NO: 93981 - DNA, 6 bp, Unknown
  misc_feature (1)..( 6): Result.001 file - promoters60/1015092
aatatt

SEQ ID NO: 93982 - DNA, 6 bp, Unknown
  misc_feature (1)..( 6): Result.001 file - promoters60/1015092
aatatt

SEQ ID NO: 93983 - DNA, 12 bp, Unknown
  misc_feature (1)..( 12): Result.001 file - promoters60/1015092
ttagtttggtct

SEQ ID NO: 93984 - DNA, 12 bp, Unknown
  misc_feature (1)..( 12): Result.001 file - promoters60/1015092
ttagtttgttct

SEQ ID NO: 93985 - DNA, 6 bp, Unknown
  misc_feature (1)..( 6): Result.001 file - promoters60/1015092
ttttat

SEQ ID NO: 93986 - DNA, 6 bp, Unknown
  misc_feature (1)..( 6): Result.001 file - promoters60/1015092
ttttat

SEQ ID NO: 93987 - DNA, 9 bp, Unknown
  misc_feature (1)..( 9): Result.001 file - promoters60/1015092
attataaga

SEQ ID NO: 93988 - DNA, 9 bp, Unknown
  misc_feature (1)..( 9): Result.001 file - promoters60/1015179
attagaaga

SEQ ID NO: 93989 - DNA, 12 bp, Unknown
  misc_feature (1)..( 12): Result.001 file - promoters60/1015179
aaattcttataa

SEQ ID NO: 93990 - DNA, 12 bp, Unknown
  misc_feature (1)..( 12): Result.001 file - promoters60/1015179
aaactcttataa

SEQ ID NO: 93991 - DNA, 12 bp, Unknown
  misc_feature (1)..( 12): Result.001 file - promoters60/1015179
atactctttatc

SEQ ID NO: 93992 - DNA, 7 bp, Unknown
  misc_feature (1)..( 7): Result.001 file - promoters60/1015179
tttgaat

SEQ ID NO: 93993 - DNA, 7 bp, Unknown
  misc_feature (1)..( 7): Result.001 file - promoters60/1015179
tttgaat

SEQ ID NO: 93994 - DNA, 7 bp, Unknown
  misc_feature (1)..( 7): Result.001 file - promoters60/1015179
tttgaaa

SEQ ID NO: 93995 - DNA, 10 bp, Unknown
  misc_feature (1)..( 10): Result.001 file - promoters60/1015179
ttataataca

SEQ ID NO: 93996 - DNA, 10 bp, Unknown
  misc_feature (1)..( 10): Result.001 file - promoters60/1015179
ctattataca

SEQ ID NO: 93997 - DNA, 10 bp, Unknown
  misc_feature (1)..( 10): Result.001 file - promoters60/1015179
ttattatatc

SEQ ID NO: 93998 - DNA, 8 bp, Unknown
  misc_feature (1)..( 8): Result.001 file - promoters60/1015179
ccaaattt

SEQ ID NO: 93999 - DNA, 8 bp, Unknown
  misc_feature (1)..( 8): Result.001 file - promoters60/1015179
ccaatttt

SEQ ID NO: 94000 - DNA, 8 bp, Unknown
  misc_feature (1)..( 8): Result.001 file - promoters60/1015179
tcaaattg

SEQ ID NO: 94001 - DNA, 9 bp, Unknown
  misc_feature (1)..( 9): Result.001 file - promoters60/1015179
tttattctc

SEQ ID NO: 94002 - DNA, 9 bp, Unknown
  misc_feature (1)..( 9): Result.001 file - promoters60/1015179
tttcttctc

SEQ ID NO: 94003 - DNA, 9 bp, Unknown
  misc_feature (1)..( 9): Result.001 file - promoters60/1015210
cttcctcta

SEQ ID NO: 94004 - DNA, 8 bp, Unknown
  misc_feature (1)..( 8): Result.001 file - promoters60/1015210
ctttattt

SEQ ID NO: 94005 - DNA, 8 bp, Unknown
  misc_feature (1)..( 8): Result.001 file - promoters60/1015210
ttttatta

SEQ ID NO: 94006 - DNA, 8 bp, Unknown
  misc_feature (1)..( 8): Result.001 file - promoters60/1015210
ctttgttt

SEQ ID NO: 94007 - DNA, 8 bp, Unknown
  misc_feature (1)..( 8): Result.001 file - promoters60/1015210
ttttatgg

SEQ ID NO: 94008 - DNA, 7 bp, Unknown
  misc_feature (1)..( 7): Result.001 file - promoters60/1015210
aaataaa

SEQ ID NO: 94009 - DNA, 7 bp, Unknown
  misc_feature (1)..( 7): Result.001 file - promoters60/1015210
aaataaa

SEQ ID NO: 94010 - DNA, 7 bp, Unknown
  misc_feature (1)..( 7): Result.001 file - promoters60/1015210
aaataat

SEQ ID NO: 94011 - DNA, 7 bp, Unknown
  misc_feature (1)..( 7): Result.001 file - promoters60/1015210
atgatag

SEQ ID NO: 94012 - DNA, 7 bp, Unknown
  misc_feature (1)..( 7): Result.001 file - promoters60/1015210
atgataa

SEQ ID NO: 94013 - DNA, 7 bp, Unknown
  misc_feature (1)..( 7): Result.001 file - promoters60/1015214
atgctaa

SEQ ID NO: 94014 - DNA, 10 bp, Unknown
  misc_feature (1)..( 10): Result.001 file - promoters60/1015214
aaaacaaaac

SEQ ID NO: 94015 - DNA, 10 bp, Unknown
  misc_feature (1)..( 10): Result.001 file - promoters60/1015214
agcacacaac

SEQ ID NO: 94016 - DNA, 10 bp, Unknown
  misc_feature (1)..( 10): Result.001 file - promoters60/1015214
gaaagaaaga

SEQ ID NO: 94017 - DNA, 10 bp, Unknown
  misc_feature (1)..( 10): Result.001 file - promoters60/1015214
gaatgaaaca

SEQ ID NO: 94018 - DNA, 10 bp, Unknown
  misc_feature (1)..( 10): Result.001 file - promoters60/1015214
aagtgaatgt

SEQ ID NO: 94019 - DNA, 11 bp, Unknown
  misc_feature (1)..( 11): Result.001 file - promoters60/1015214
tttgttttcta

SEQ ID NO: 94020 - DNA, 11 bp, Unknown
  misc_feature (1)..( 11): Result.001 file - promoters60/1015214
tttctttacta

SEQ ID NO: 94021 - DNA, 11 bp, Unknown
  misc_feature (1)..( 11): Result.001 file - promoters60/1015214
tttgtgttcgt

SEQ ID NO: 94022 - DNA, 11 bp, Unknown
  misc_feature (1)..( 11): Result.001 file - promoters60/1015214
cttggtttctt

SEQ ID NO: 94023 - DNA, 11 bp, Unknown
  misc_feature (1)..( 11): Result.001 file - promoters60/1015214
ggaattttcta

SEQ ID NO: 94024 - DNA, 9 bp, Unknown
  misc_feature (1)..( 9): Result.001 file - promoters60/1015214
tctataaaa

SEQ ID NO: 94025 - DNA, 9 bp, Unknown
  misc_feature (1)..( 9): Result.001 file - promoters60/1015214
tatataaat

SEQ ID NO: 94026 - DNA, 9 bp, Unknown
  misc_feature (1)..( 9): Result.001 file - promoters60/1015214
tatttaaac

SEQ ID NO: 94027 - DNA, 9 bp, Unknown
  misc_feature (1)..( 9): Result.001 file - promoters60/1015214
tatataagc

SEQ ID NO: 94028 - DNA, 9 bp, Unknown
  misc_feature (1)..( 9): Result.001 file - promoters60/1015214
tatataaac

SEQ ID NO: 94029 - DNA, 13 bp, Unknown
  misc_feature (1)..( 13): Result.001 file - promoters60/1015214
atatatgtaaacg

SEQ ID NO: 94030 - DNA, 13 bp, Unknown
  misc_feature (1)..( 13): Result.001 file - promoters60/1015214
ctttatttaaaaa

SEQ ID NO: 94031 - DNA, 13 bp, Unknown
  misc_feature (1)..( 13): Result.001 file - promoters60/1015214
atagatgtttcat

SEQ ID NO: 94032 - DNA, 13 bp, Unknown
  misc_feature (1)..( 13): Result.001 file - promoters60/1015214
aaagagagagatg

SEQ ID NO: 94033 - DNA, 13 bp, Unknown
  misc_feature (1)..( 13): Result.001 file - promoters60/1015214
tcgtatctaagac

SEQ ID NO: 94034 - DNA, 13 bp, Unknown
  misc_feature (1)..( 13): Result.001 file - promoters60/1015214
ttagcattaaaat

SEQ ID NO: 94035 - DNA, 13 bp, Unknown
  misc_feature (1)..( 13): Result.001 file - promoters60/1015214
aattttagaaaga

SEQ ID NO: 94036 - DNA, 12 bp, Unknown
  misc_feature (1)..( 12): Result.001 file - promoters60/1015214
tgcattaatgtt

SEQ ID NO: 94037 - DNA, 12 bp, Unknown
  misc_feature (1)..( 12): Result.001 file - promoters60/1015214
ttcatttatgac

SEQ ID NO: 94038 - DNA, 12 bp, Unknown
  misc_feature (1)..( 12): Result.001 file - promoters60/1015214
agttcttatgac

SEQ ID NO: 94039 - DNA, 12 bp, Unknown
  misc_feature (1)..( 12): Result.001 file - promoters60/1015214
ttcaattaactt

SEQ ID NO: 94040 - DNA, 12 bp, Unknown
  misc_feature (1)..( 12): Result.001 file - promoters60/1015261
ttgttttatgtt

SEQ ID NO: 94041 - DNA, 11 bp, Unknown
  misc_feature (1)..( 11): Result.001 file - promoters60/1015261
gcttgtgaatt

SEQ ID NO: 94042 - DNA, 11 bp, Unknown
  misc_feature (1)..( 11): Result.001 file - promoters60/1015261
gctgctgaatt

SEQ ID NO: 94043 - DNA, 11 bp, Unknown
  misc_feature (1)..( 11): Result.001 file - promoters60/1015261
tgttgtaaatg

SEQ ID NO: 94044 - DNA, 11 bp, Unknown
  misc_feature (1)..( 11): Result.001 file - promoters60/1015261
acttgtaaatg

SEQ ID NO: 94045 - DNA, 11 bp, Unknown
  misc_feature (1)..( 11): Result.001 file - promoters60/1015261
acttataagtc

SEQ ID NO: 94046 - DNA, 11 bp, Unknown
  misc_feature (1)..( 11): Result.001 file - promoters60/1015261
actcgtactct

SEQ ID NO: 94047 - DNA, 11 bp, Unknown
  misc_feature (1)..( 11): Result.001 file - promoters60/1015261
gtatttatatt

SEQ ID NO: 94048 - DNA, 11 bp, Unknown
  misc_feature (1)..( 11): Result.001 file - promoters60/1015261
gtatatatata

SEQ ID NO: 94049 - DNA, 11 bp, Unknown
  misc_feature (1)..( 11): Result.001 file - promoters60/1015261
gactttaaatt

SEQ ID NO: 94050 - DNA, 11 bp, Unknown
  misc_feature (1)..( 11): Result.001 file - promoters60/1015261
tcatatataaa

SEQ ID NO: 94051 - DNA, 11 bp, Unknown
  misc_feature (1)..( 11): Result.001 file - promoters60/1015261
tgatatataaa

SEQ ID NO: 94052 - DNA, 11 bp, Unknown
  misc_feature (1)..( 11): Result.001 file - promoters60/1015261
acagttaaata

SEQ ID NO: 94053 - DNA, 11 bp, Unknown
  misc_feature (1)..( 11): Result.001 file - promoters60/1015261
taatataaagg

SEQ ID NO: 94054 - DNA, 10 bp, Unknown
  misc_feature (1)..( 10): Result.001 file - promoters60/1015261
gcttgtgaat

SEQ ID NO: 94055 - DNA, 10 bp, Unknown
  misc_feature (1)..( 10): Result.001 file - promoters60/1015261
tgttgtgagc

SEQ ID NO: 94056 - DNA, 10 bp, Unknown
  misc_feature (1)..( 10): Result.001 file - promoters60/1015261
acttgtaaat

SEQ ID NO: 94057 - DNA, 10 bp, Unknown
  misc_feature (1)..( 10): Result.001 file - promoters60/1015261
ccttatgagc

SEQ ID NO: 94058 - DNA, 10 bp, Unknown
  misc_feature (1)..( 10): Result.001 file - promoters60/1015261
acttataagt

SEQ ID NO: 94059 - DNA, 10 bp, Unknown
  misc_feature (1)..( 10): Result.001 file - promoters60/1015261
actcgtactc

SEQ ID NO: 94060 - DNA, 14 bp, Unknown
  misc_feature (1)..( 14): Result.001 file - promoters60/1015261
gtttgagaaatccg

SEQ ID NO: 94061 - DNA, 14 bp, Unknown
  misc_feature (1)..( 14): Result.001 file - promoters60/1015261
gctagagaaaattc

SEQ ID NO: 94062 - DNA, 14 bp, Unknown
  misc_feature (1)..( 14): Result.001 file - promoters60/1015261
atttgtgaaacaca

SEQ ID NO: 94063 - DNA, 14 bp, Unknown
  misc_feature (1)..( 14): Result.001 file - promoters60/1015261
attagtgaactttt

SEQ ID NO: 94064 - DNA, 14 bp, Unknown
  misc_feature (1)..( 14): Result.001 file - promoters60/1015261
gacccagaaaaaca

SEQ ID NO: 94065 - DNA, 14 bp, Unknown
  misc_feature (1)..( 14): Result.001 file - promoters60/1015261
atttttgaagcaca

SEQ ID NO: 94066 - DNA, 9 bp, Unknown
  misc_feature (1)..( 9): Result.001 file - promoters60/1015261
attgatata

SEQ ID NO: 94067 - DNA, 9 bp, Unknown
  misc_feature (1)..( 9): Result.001 file - promoters60/1015261
atttatatc

SEQ ID NO: 94068 - DNA, 9 bp, Unknown
  misc_feature (1)..( 9): Result.001 file - promoters60/1015261
attcataaa

SEQ ID NO: 94069 - DNA, 9 bp, Unknown
  misc_feature (1)..( 9): Result.001 file - promoters60/1015261
atttttgaa

SEQ ID NO: 94070 - DNA, 9 bp, Unknown
  misc_feature (1)..( 9): Result.001 file - promoters60/1015261
ggttttgag

SEQ ID NO: 94071 - DNA, 9 bp, Unknown
  misc_feature (1)..( 9): Result.001 file - promoters60/1015261
gtttagaat

SEQ ID NO: 94072 - DNA, 9 bp, Unknown
  misc_feature (1)..( 9): Result.001 file - promoters60/1015261
gattttaag

SEQ ID NO: 94073 - DNA, 11 bp, Unknown
  misc_feature (1)..( 11): Result.001 file - promoters60/1015261
ataattttatg

SEQ ID NO: 94074 - DNA, 11 bp, Unknown
  misc_feature (1)..( 11): Result.001 file - promoters60/1015261
ccaatttttaa

SEQ ID NO: 94075 - DNA, 11 bp, Unknown
  misc_feature (1)..( 11): Result.001 file - promoters60/1015261
ttaattttggt

SEQ ID NO: 94076 - DNA, 11 bp, Unknown
  misc_feature (1)..( 11): Result.001 file - promoters60/1015261
tatatttgtaa

SEQ ID NO: 94077 - DNA, 11 bp, Unknown
  misc_feature (1)..( 11): Result.001 file - promoters60/1015261
ccagtttgtag

SEQ ID NO: 94078 - DNA, 11 bp, Unknown
  misc_feature (1)..( 11): Result.001 file - promoters60/1015264
acaactttagg

SEQ ID NO: 94079 - DNA, 8 bp, Unknown
  misc_feature (1)..( 8): Result.001 file - promoters60/1015264
attttttt

SEQ ID NO: 94080 - DNA, 8 bp, Unknown
  misc_feature (1)..( 8): Result.001 file - promoters60/1015264
attttttt

SEQ ID NO: 94081 - DNA, 6 bp, Unknown
  misc_feature (1)..( 6): Result.001 file - promoters60/1015264
ataata

SEQ ID NO: 94082 - DNA, 6 bp, Unknown
  misc_feature (1)..( 6): Result.001 file - promoters60/1015264
ataata

SEQ ID NO: 94083 - DNA, 8 bp, Unknown
  misc_feature (1)..( 8): Result.001 file - promoters60/1015264
tgtatgaa

SEQ ID NO: 94084 - DNA, 8 bp, Unknown
  misc_feature (1)..( 8): Result.001 file - promoters60/1015264
tgtacgaa

SEQ ID NO: 94085 - DNA, 8 bp, Unknown
  misc_feature (1)..( 8): Result.001 file - promoters60/1015264
aatttaaa

SEQ ID NO: 94086 - DNA, 8 bp, Unknown
  misc_feature (1)..( 8): Result.001 file - promoters60/1015264
aattaaaa

SEQ ID NO: 94087 - DNA, 7 bp, Unknown
  misc_feature (1)..( 7): Result.001 file - promoters60/1015264
aaattta

SEQ ID NO: 94088 - DNA, 7 bp, Unknown
  misc_feature (1)..( 7): Result.001 file - promoters60/1015264
aaaatta

SEQ ID NO: 94089 - DNA, 6 bp, Unknown
  misc_feature (1)..( 6): Result.001 file - promoters60/1015264
caaggt

SEQ ID NO: 94090 - DNA, 6 bp, Unknown
  misc_feature (1)..( 6): Result.001 file - promoters60/1015264
caaggt

SEQ ID NO: 94091 - DNA, 6 bp, Unknown
  misc_feature (1)..( 6): Result.001 file - promoters60/1015264
taatta

SEQ ID NO: 94092 - DNA, 6 bp, Unknown
  misc_feature (1)..( 6): Result.001 file - promoters60/1015264
taatta

SEQ ID NO: 94093 - DNA, 8 bp, Unknown
  misc_feature (1)..( 8): Result.001 file - promoters60/1015264
tcagatta

SEQ ID NO: 94094 - DNA, 8 bp, Unknown
  misc_feature (1)..( 8): Result.001 file - promoters60/1015264
tcagatta

SEQ ID NO: 94095 - DNA, 7 bp, Unknown
  misc_feature (1)..( 7): Result.001 file - promoters60/1015264
tcggttt

SEQ ID NO: 94096 - DNA, 7 bp, Unknown
  misc_feature (1)..( 7): Result.001 file - promoters60/1015264
tcgattt

SEQ ID NO: 94097 - DNA, 6 bp, Unknown
  misc_feature (1)..( 6): Result.001 file - promoters60/1015264
attagt

SEQ ID NO: 94098 - DNA, 6 bp, Unknown
  misc_feature (1)..( 6): Result.001 file - promoters60/1015264
attagt

SEQ ID NO: 94099 - DNA, 8 bp, Unknown
  misc_feature (1)..( 8): Result.001 file - promoters60/1015264
agaacaaa

SEQ ID NO: 94100 - DNA, 8 bp, Unknown
  misc_feature (1)..( 8): Result.001 file - promoters60/1015264
agaaaaaa

SEQ ID NO: 94101 - DNA, 8 bp, Unknown
  misc_feature (1)..( 8): Result.001 file - promoters60/1015264
aaatataa

SEQ ID NO: 94102 - DNA, 8 bp, Unknown
  misc_feature (1)..( 8): Result.001 file - promoters60/1015264
aaatttaa

SEQ ID NO: 94103 - DNA, 6 bp, Unknown
  misc_feature (1)..( 6): Result.001 file - promoters60/1015264
tctgta

SEQ ID NO: 94104 - DNA, 6 bp, Unknown
  misc_feature (1)..( 6): Result.001 file - promoters60/1015264
tctgta

SEQ ID NO: 94105 - DNA, 7 bp, Unknown
  misc_feature (1)..( 7): Result.001 file - promoters60/1015264
tcatttt

SEQ ID NO: 94106 - DNA, 7 bp, Unknown
  misc_feature (1)..( 7): Result.001 file - promoters60/1015264
tcatttg

SEQ ID NO: 94107 - DNA, 7 bp, Unknown
  misc_feature (1)..( 7): Result.001 file - promoters60/1015264
ccatttg

SEQ ID NO: 94108 - DNA, 7 bp, Unknown
  misc_feature (1)..( 7): Result.001 file - promoters60/1015264
ttttaag

SEQ ID NO: 94109 - DNA, 7 bp, Unknown
  misc_feature (1)..( 7): Result.001 file - promoters60/1015264
tttgaag

SEQ ID NO: 94110 - DNA, 7 bp, Unknown
  misc_feature (1)..( 7): Result.001 file - promoters60/1015264
ttaacca

SEQ ID NO: 94111 - DNA, 7 bp, Unknown
  misc_feature (1)..( 7): Result.001 file - promoters60/1015264
ttaacca

SEQ ID NO: 94112 - DNA, 6 bp, Unknown
  misc_feature (1)..( 6): Result.001 file - promoters60/1015264
tgacat

SEQ ID NO: 94113 - DNA, 6 bp, Unknown
  misc_feature (1)..( 6): Result.001 file - promoters60/1015264
tgacat

SEQ ID NO: 94114 - DNA, 7 bp, Unknown
  misc_feature (1)..( 7): Result.001 file - promoters60/1015264
tatcatt

SEQ ID NO: 94115 - DNA, 7 bp, Unknown
  misc_feature (1)..( 7): Result.001 file - promoters60/1015264
tatgatt

SEQ ID NO: 94116 - DNA, 7 bp, Unknown
  misc_feature (1)..( 7): Result.001 file - promoters60/1015264
gaatttg

SEQ ID NO: 94117 - DNA, 7 bp, Unknown
  misc_feature (1)..( 7): Result.001 file - promoters60/1015264
gaatttg

SEQ ID NO: 94118 - DNA, 7 bp, Unknown
  misc_feature (1)..( 7): Result.001 file - promoters60/1015264
tttgatt

SEQ ID NO: 94119 - DNA, 7 bp, Unknown
  misc_feature (1)..( 7): Result.001 file - promoters60/1015264
tttgatt

SEQ ID NO: 94120 - DNA, 7 bp, Unknown
  misc_feature (1)..( 7): Result.001 file - promoters60/1015264
ttagatc

SEQ ID NO: 94121 - DNA, 7 bp, Unknown
  misc_feature (1)..( 7): Result.001 file - promoters60/1015337
ttatatc

SEQ ID NO: 94122 - DNA, 13 bp, Unknown
  misc_feature (1)..( 13): Result.001 file - promoters60/1015337
attctaatttaaa

SEQ ID NO: 94123 - DNA, 13 bp, Unknown
  misc_feature (1)..( 13): Result.001 file - promoters60/1015337
aaaaaaatttaaa

SEQ ID NO: 94124 - DNA, 13 bp, Unknown
  misc_feature (1)..( 13): Result.001 file - promoters60/1015337
aaacaaatttttg

SEQ ID NO: 94125 - DNA, 13 bp, Unknown
  misc_feature (1)..( 13): Result.001 file - promoters60/1015337
gaggaaaacataa

SEQ ID NO: 94126 - DNA, 13 bp, Unknown
  misc_feature (1)..( 13): Result.001 file - promoters60/1015337
aaagaaaaacagt

SEQ ID NO: 94127 - DNA, 13 bp, Unknown
  misc_feature (1)..( 13): Result.001 file - promoters60/1015360
catcaactttttt

SEQ ID NO: 94128 - DNA, 7 bp, Unknown
  misc_feature (1)..( 7): Result.001 file - promoters60/1015360
gttatat

SEQ ID NO: 94129 - DNA, 7 bp, Unknown
  misc_feature (1)..( 7): Result.001 file - promoters60/1015360
gttataa

SEQ ID NO: 94130 - DNA, 7 bp, Unknown
  misc_feature (1)..( 7): Result.001 file - promoters60/1015360
tttatat

SEQ ID NO: 94131 - DNA, 7 bp, Unknown
  misc_feature (1)..( 7): Result.001 file - promoters60/1015360
ctactaa

SEQ ID NO: 94132 - DNA, 7 bp, Unknown
  misc_feature (1)..( 7): Result.001 file - promoters60/1015360
ctaataa

SEQ ID NO: 94133 - DNA, 7 bp, Unknown
  misc_feature (1)..( 7): Result.001 file - promoters60/1015360
ctattaa

SEQ ID NO: 94134 - DNA, 8 bp, Unknown
  misc_feature (1)..( 8): Result.001 file - promoters60/1015360
atttcaca

SEQ ID NO: 94135 - DNA, 8 bp, Unknown
  misc_feature (1)..( 8): Result.001 file - promoters60/1015360
atttcatt

SEQ ID NO: 94136 - DNA, 8 bp, Unknown
  misc_feature (1)..( 8): Result.001 file - promoters60/1015360
atttaatt

SEQ ID NO: 94137 - DNA, 13 bp, Unknown
  misc_feature (1)..( 13): Result.001 file - promoters60/1015360
accaaaaaaatta

SEQ ID NO: 94138 - DNA, 13 bp, Unknown
  misc_feature (1)..( 13): Result.001 file - promoters60/1015360
accaaaaaagaaa

SEQ ID NO: 94139 - DNA, 13 bp, Unknown
  misc_feature (1)..( 13): Result.001 file - promoters60/1015360
tctaaaaagcaat

SEQ ID NO: 94140 - DNA, 10 bp, Unknown
  misc_feature (1)..( 10): Result.001 file - promoters60/1015360
ttaaacaaaa

SEQ ID NO: 94141 - DNA, 10 bp, Unknown
  misc_feature (1)..( 10): Result.001 file - promoters60/1015360
aaaaagaaat

SEQ ID NO: 94142 - DNA, 10 bp, Unknown
  misc_feature (1)..( 10): Result.001 file - promoters60/1015360
aaaaagcaat

SEQ ID NO: 94143 - DNA, 10 bp, Unknown
  misc_feature (1)..( 10): Result.001 file - promoters60/1015360
gaaaaataaa

SEQ ID NO: 94144 - DNA, 10 bp, Unknown
  misc_feature (1)..( 10): Result.001 file - promoters60/1015360
taaaactaaa

SEQ ID NO: 94145 - DNA, 10 bp, Unknown
  misc_feature (1)..( 10): Result.001 file - promoters60/1015475
gaaaaaaaaa

SEQ ID NO: 94146 - DNA, 9 bp, Unknown
  misc_feature (1)..( 9): Result.001 file - promoters60/1015475
gtttccttt

SEQ ID NO: 94147 - DNA, 9 bp, Unknown
  misc_feature (1)..( 9): Result.001 file - promoters60/1015475
gttaccttt

SEQ ID NO: 94148 - DNA, 9 bp, Unknown
  misc_feature (1)..( 9): Result.001 file - promoters60/1015475
gcttcgttt

SEQ ID NO: 94149 - DNA, 8 bp, Unknown
  misc_feature (1)..( 8): Result.001 file - promoters60/1015475
caccaata

SEQ ID NO: 94150 - DNA, 8 bp, Unknown
  misc_feature (1)..( 8): Result.001 file - promoters60/1015475
aaccaata

SEQ ID NO: 94151 - DNA, 8 bp, Unknown
  misc_feature (1)..( 8): Result.001 file - promoters60/1015475
aacaaata

SEQ ID NO: 94152 - DNA, 9 bp, Unknown
  misc_feature (1)..( 9): Result.001 file - promoters60/1015475
tttcctttt

SEQ ID NO: 94153 - DNA, 9 bp, Unknown
  misc_feature (1)..( 9): Result.001 file - promoters60/1015475
ttttcttaa

SEQ ID NO: 94154 - DNA, 9 bp, Unknown
  misc_feature (1)..( 9): Result.001 file - promoters60/1015524
gttcctaat

SEQ ID NO: 94155 - DNA, 12 bp, Unknown
  misc_feature (1)..( 12): Result.001 file - promoters60/1015524
acttgttttctt

SEQ ID NO: 94156 - DNA, 12 bp, Unknown
  misc_feature (1)..( 12): Result.001 file - promoters60/1015524
acttgtataatg

SEQ ID NO: 94157 - DNA, 12 bp, Unknown
  misc_feature (1)..( 12): Result.001 file - promoters60/1015524
acttgaatatta

SEQ ID NO: 94158 - DNA, 12 bp, Unknown
  misc_feature (1)..( 12): Result.001 file - promoters60/1015524
tgatgaagatta

SEQ ID NO: 94159 - DNA, 8 bp, Unknown
  misc_feature (1)..( 8): Result.001 file - promoters60/1015524
agatatac

SEQ ID NO: 94160 - DNA, 8 bp, Unknown
  misc_feature (1)..( 8): Result.001 file - promoters60/1015524
ggatttac

SEQ ID NO: 94161 - DNA, 8 bp, Unknown
  misc_feature (1)..( 8): Result.001 file - promoters60/1015524
agaaatag

SEQ ID NO: 94162 - DNA, 8 bp, Unknown
  misc_feature (1)..( 8): Result.001 file - promoters60/1015524
cggttttg

SEQ ID NO: 94163 - DNA, 10 bp, Unknown
  misc_feature (1)..( 10): Result.001 file - promoters60/1015524
atttttttct

SEQ ID NO: 94164 - DNA, 10 bp, Unknown
  misc_feature (1)..( 10): Result.001 file - promoters60/1015524
attgttttcg

SEQ ID NO: 94165 - DNA, 10 bp, Unknown
  misc_feature (1)..( 10): Result.001 file - promoters60/1015524
ttttgtttct

SEQ ID NO: 94166 - DNA, 10 bp, Unknown
  misc_feature (1)..( 10): Result.001 file - promoters60/1015537
aacgttttct

SEQ ID NO: 94167 - DNA, 12 bp, Unknown
  misc_feature (1)..( 12): Result.001 file - promoters60/1015537
caaatattatcc

SEQ ID NO: 94168 - DNA, 12 bp, Unknown
  misc_feature (1)..( 12): Result.001 file - promoters60/1015537
aaaaaattcaag

SEQ ID NO: 94169 - DNA, 12 bp, Unknown
  misc_feature (1)..( 12): Result.001 file - promoters60/1015537
aaaaaatctttg

SEQ ID NO: 94170 - DNA, 12 bp, Unknown
  misc_feature (1)..( 12): Result.001 file - promoters60/1015537
accaaatttaag

SEQ ID NO: 94171 - DNA, 12 bp, Unknown
  misc_feature (1)..( 12): Result.001 file - promoters60/1015537
ctaaaatcttcc

SEQ ID NO: 94172 - DNA, 12 bp, Unknown
  misc_feature (1)..( 12): Result.001 file - promoters60/1015537
ttctaatttatt

SEQ ID NO: 94173 - DNA, 7 bp, Unknown
  misc_feature (1)..( 7): Result.001 file - promoters60/1015537
aatcaag

SEQ ID NO: 94174 - DNA, 7 bp, Unknown
  misc_feature (1)..( 7): Result.001 file - promoters60/1015537
aatcaat

SEQ ID NO: 94175 - DNA, 7 bp, Unknown
  misc_feature (1)..( 7): Result.001 file - promoters60/1015537
tatcaat

SEQ ID NO: 94176 - DNA, 7 bp, Unknown
  misc_feature (1)..( 7): Result.001 file - promoters60/1015537
tataaat

SEQ ID NO: 94177 - DNA, 7 bp, Unknown
  misc_feature (1)..( 7): Result.001 file - promoters60/1015537
aatcaaa

SEQ ID NO: 94178 - DNA, 7 bp, Unknown
  misc_feature (1)..( 7): Result.001 file - promoters60/1015537
aatcaaa

SEQ ID NO: 94179 - DNA, 7 bp, Unknown
  misc_feature (1)..( 7): Result.001 file - promoters60/1015537
catcaaa

SEQ ID NO: 94180 - DNA, 7 bp, Unknown
  misc_feature (1)..( 7): Result.001 file - promoters60/1015537
aataaaa

SEQ ID NO: 94181 - DNA, 9 bp, Unknown
  misc_feature (1)..( 9): Result.001 file - promoters60/1015537
ttaattttg

SEQ ID NO: 94182 - DNA, 9 bp, Unknown
  misc_feature (1)..( 9): Result.001 file - promoters60/1015537
ttaattgtc

SEQ ID NO: 94183 - DNA, 9 bp, Unknown
  misc_feature (1)..( 9): Result.001 file - promoters60/1015537
ctaatttat

SEQ ID NO: 94184 - DNA, 9 bp, Unknown
  misc_feature (1)..( 9): Result.001 file - promoters60/1015537
gtaatttaa

SEQ ID NO: 94185 - DNA, 9 bp, Unknown
  misc_feature (1)..( 9): Result.001 file - promoters60/1015537
caaatttaa

SEQ ID NO: 94186 - DNA, 8 bp, Unknown
  misc_feature (1)..( 8): Result.001 file - promoters60/1015537
atataaat

SEQ ID NO: 94187 - DNA, 8 bp, Unknown
  misc_feature (1)..( 8): Result.001 file - promoters60/1015537
atataaat

SEQ ID NO: 94188 - DNA, 8 bp, Unknown
  misc_feature (1)..( 8): Result.001 file - promoters60/1015537
ttattaat

SEQ ID NO: 94189 - DNA, 8 bp, Unknown
  misc_feature (1)..( 8): Result.001 file - promoters60/1015537
atataatc

SEQ ID NO: 94190 - DNA, 11 bp, Unknown
  misc_feature (1)..( 11): Result.001 file - promoters60/1015537
ttagtttccta

SEQ ID NO: 94191 - DNA, 11 bp, Unknown
  misc_feature (1)..( 11): Result.001 file - promoters60/1015537
tccattttcta

SEQ ID NO: 94192 - DNA, 11 bp, Unknown
  misc_feature (1)..( 11): Result.001 file - promoters60/1015537
ttagtttcctc

SEQ ID NO: 94193 - DNA, 11 bp, Unknown
  misc_feature (1)..( 11): Result.001 file - promoters60/1015597
ttattttaccg

SEQ ID NO: 94194 - DNA, 10 bp, Unknown
  misc_feature (1)..( 10): Result.001 file - promoters60/1015597
tttgttgttt

SEQ ID NO: 94195 - DNA, 10 bp, Unknown
  misc_feature (1)..( 10): Result.001 file - promoters60/1015597
agggtttttt

SEQ ID NO: 94196 - DNA, 10 bp, Unknown
  misc_feature (1)..( 10): Result.001 file - promoters60/1015597
tttgttgttg

SEQ ID NO: 94197 - DNA, 10 bp, Unknown
  misc_feature (1)..( 10): Result.001 file - promoters60/1015597
gaaattgttt

SEQ ID NO: 94198 - DNA, 10 bp, Unknown
  misc_feature (1)..( 10): Result.001 file - promoters60/1015597
acagttttta

SEQ ID NO: 94199 - DNA, 10 bp, Unknown
  misc_feature (1)..( 10): Result.001 file - promoters60/1015661
gacgttcttg

SEQ ID NO: 94200 - DNA, 7 bp, Unknown
  misc_feature (1)..( 7): Result.001 file - promoters60/1015661
attaata

SEQ ID NO: 94201 - DNA, 7 bp, Unknown
  misc_feature (1)..( 7): Result.001 file - promoters60/1015661
attcata

SEQ ID NO: 94202 - DNA, 8 bp, Unknown
  misc_feature (1)..( 8): Result.001 file - promoters60/1015661
tttctaat

SEQ ID NO: 94203 - DNA, 8 bp, Unknown
  misc_feature (1)..( 8): Result.001 file - promoters60/1015661
tttataat

SEQ ID NO: 94204 - DNA, 9 bp, Unknown
  misc_feature (1)..( 9): Result.001 file - promoters60/1015661
tatattaaa

SEQ ID NO: 94205 - DNA, 9 bp, Unknown
  misc_feature (1)..( 9): Result.001 file - promoters60/1015661
tatataaaa

SEQ ID NO: 94206 - DNA, 9 bp, Unknown
  misc_feature (1)..( 9): Result.001 file - promoters60/1015661
tatatagat

SEQ ID NO: 94207 - DNA, 6 bp, Unknown
  misc_feature (1)..( 6): Result.001 file - promoters60/1015661
ttaatg

SEQ ID NO: 94208 - DNA, 6 bp, Unknown
  misc_feature (1)..( 6): Result.001 file - promoters60/1015661
ttaatg

SEQ ID NO: 94209 - DNA, 7 bp, Unknown
  misc_feature (1)..( 7): Result.001 file - promoters60/1015661
gaaatat

SEQ ID NO: 94210 - DNA, 7 bp, Unknown
  misc_feature (1)..( 7): Result.001 file - promoters60/1015661
gaattat

SEQ ID NO: 94211 - DNA, 6 bp, Unknown
  misc_feature (1)..( 6): Result.001 file - promoters60/1015661
aaatgt

SEQ ID NO: 94212 - DNA, 6 bp, Unknown
  misc_feature (1)..( 6): Result.001 file - promoters60/1015661
aaatgt

SEQ ID NO: 94213 - DNA, 7 bp, Unknown
  misc_feature (1)..( 7): Result.001 file - promoters60/1015661
tgtccac

SEQ ID NO: 94214 - DNA, 7 bp, Unknown
  misc_feature (1)..( 7): Result.001 file - promoters60/1015661
tgtacac

SEQ ID NO: 94215 - DNA, 9 bp, Unknown
  misc_feature (1)..( 9): Result.001 file - promoters60/1015661
aaatcaaat

SEQ ID NO: 94216 - DNA, 9 bp, Unknown
  misc_feature (1)..( 9): Result.001 file - promoters60/1015661
aaagcaatg

SEQ ID NO: 94217 - DNA, 9 bp, Unknown
  misc_feature (1)..( 9): Result.001 file - promoters60/1015661
aaagaaatg

SEQ ID NO: 94218 - DNA, 6 bp, Unknown
  misc_feature (1)..( 6): Result.001 file - promoters60/1015661
aaacaa

SEQ ID NO: 94219 - DNA, 6 bp, Unknown
  misc_feature (1)..( 6): Result.001 file - promoters60/1015661
aaacaa

SEQ ID NO: 94220 - DNA, 8 bp, Unknown
  misc_feature (1)..( 8): Result.001 file - promoters60/1015661
aaccaaaa

SEQ ID NO: 94221 - DNA, 8 bp, Unknown
  misc_feature (1)..( 8): Result.001 file - promoters60/1015661
aaccaaaa

SEQ ID NO: 94222 - DNA, 6 bp, Unknown
  misc_feature (1)..( 6): Result.001 file - promoters60/1015661
caaaga

SEQ ID NO: 94223 - DNA, 6 bp, Unknown
  misc_feature (1)..( 6): Result.001 file - promoters60/1015661
caaaga

SEQ ID NO: 94224 - DNA, 6 bp, Unknown
  misc_feature (1)..( 6): Result.001 file - promoters60/1015661
attatt

SEQ ID NO: 94225 - DNA, 6 bp, Unknown
  misc_feature (1)..( 6): Result.001 file - promoters60/1015661
attatt

SEQ ID NO: 94226 - DNA, 7 bp, Unknown
  misc_feature (1)..( 7): Result.001 file - promoters60/1015661
tttgtga

SEQ ID NO: 94227 - DNA, 7 bp, Unknown
  misc_feature (1)..( 7): Result.001 file - promoters60/1015661
tttgtga

SEQ ID NO: 94228 - DNA, 6 bp, Unknown
  misc_feature (1)..( 6): Result.001 file - promoters60/1015661
taaaaa

SEQ ID NO: 94229 - DNA, 6 bp, Unknown
  misc_feature (1)..( 6): Result.001 file - promoters60/1015661
taaaaa

SEQ ID NO: 94230 - DNA, 6 bp, Unknown
  misc_feature (1)..( 6): Result.001 file - promoters60/1015661
atattt

SEQ ID NO: 94231 - DNA, 6 bp, Unknown
  misc_feature (1)..( 6): Result.001 file - promoters60/1015661
atattt

SEQ ID NO: 94232 - DNA, 9 bp, Unknown
  misc_feature (1)..( 9): Result.001 file - promoters60/1015661
tagtgtaaa

SEQ ID NO: 94233 - DNA, 9 bp, Unknown
  misc_feature (1)..( 9): Result.001 file - promoters60/1015661
tagtttaaa

SEQ ID NO: 94234 - DNA, 6 bp, Unknown
  misc_feature (1)..( 6): Result.001 file - promoters60/1015661
ctaatt

SEQ ID NO: 94235 - DNA, 6 bp, Unknown
  misc_feature (1)..( 6): Result.001 file - promoters60/1015676
ctaatt

SEQ ID NO: 94236 - DNA, 8 bp, Unknown
  misc_feature (1)..( 8): Result.001 file - promoters60/1015676
ttttcaaa

SEQ ID NO: 94237 - DNA, 8 bp, Unknown
  misc_feature (1)..( 8): Result.001 file - promoters60/1015676
ttttgaaa

SEQ ID NO: 94238 - DNA, 8 bp, Unknown
  misc_feature (1)..( 8): Result.001 file - promoters60/1015676
ttttgatg

SEQ ID NO: 94239 - DNA, 8 bp, Unknown
  misc_feature (1)..( 8): Result.001 file - promoters60/1015676
aatatttt

SEQ ID NO: 94240 - DNA, 8 bp, Unknown
  misc_feature (1)..( 8): Result.001 file - promoters60/1015676
gttatttt

SEQ ID NO: 94241 - DNA, 8 bp, Unknown
  misc_feature (1)..( 8): Result.001 file - promoters60/1015676
aatatttt

SEQ ID NO: 94242 - DNA, 13 bp, Unknown
  misc_feature (1)..( 13): Result.001 file - promoters60/1015676
attatattaacat

SEQ ID NO: 94243 - DNA, 13 bp, Unknown
  misc_feature (1)..( 13): Result.001 file - promoters60/1015676
attttatcaatgg

SEQ ID NO: 94244 - DNA, 13 bp, Unknown
  misc_feature (1)..( 13): Result.001 file - promoters60/1015676
tgtatatgaacat

SEQ ID NO: 94245 - DNA, 8 bp, Unknown
  misc_feature (1)..( 8): Result.001 file - promoters60/1015676
ttaaaaca

SEQ ID NO: 94246 - DNA, 8 bp, Unknown
  misc_feature (1)..( 8): Result.001 file - promoters60/1015676
ttaaaaca

SEQ ID NO: 94247 - DNA, 8 bp, Unknown
  misc_feature (1)..( 8): Result.001 file - promoters60/1015676
ttacaact

SEQ ID NO: 94248 - DNA, 8 bp, Unknown
  misc_feature (1)..( 8): Result.001 file - promoters60/1015676
gtttcaaa

SEQ ID NO: 94249 - DNA, 8 bp, Unknown
  misc_feature (1)..( 8): Result.001 file - promoters60/1015676
gttgcaac

SEQ ID NO: 94250 - DNA, 8 bp, Unknown
  misc_feature (1)..( 8): Result.001 file - promoters60/1015748
ttttcaaa

SEQ ID NO: 94251 - DNA, 8 bp, Unknown
  misc_feature (1)..( 8): Result.001 file - promoters60/1015748
gttttaat

SEQ ID NO: 94252 - DNA, 8 bp, Unknown
  misc_feature (1)..( 8): Result.001 file - promoters60/1015748
gttgtaat

SEQ ID NO: 94253 - DNA, 8 bp, Unknown
  misc_feature (1)..( 8): Result.001 file - promoters60/1015748
tttttaat

SEQ ID NO: 94254 - DNA, 10 bp, Unknown
  misc_feature (1)..( 10): Result.001 file - promoters60/1015748
caattttgtt

SEQ ID NO: 94255 - DNA, 10 bp, Unknown
  misc_feature (1)..( 10): Result.001 file - promoters60/1015748
caattttgca

SEQ ID NO: 94256 - DNA, 10 bp, Unknown
  misc_feature (1)..( 10): Result.001 file - promoters60/1015748
aaatgttgtt

SEQ ID NO: 94257 - DNA, 8 bp, Unknown
  misc_feature (1)..( 8): Result.001 file - promoters60/1015748
ttataaac

SEQ ID NO: 94258 - DNA, 8 bp, Unknown
  misc_feature (1)..( 8): Result.001 file - promoters60/1015748
ttaaaaaa

SEQ ID NO: 94259 - DNA, 8 bp, Unknown
  misc_feature (1)..( 8): Result.001 file - promoters60/1015778
ctaaaaaa

SEQ ID NO: 94260 - DNA, 8 bp, Unknown
  misc_feature (1)..( 8): Result.001 file - promoters60/1015778
attatcca

SEQ ID NO: 94261 - DNA, 8 bp, Unknown
  misc_feature (1)..( 8): Result.001 file - promoters60/1015778
attatccc

SEQ ID NO: 94262 - DNA, 8 bp, Unknown
  misc_feature (1)..( 8): Result.001 file - promoters60/1015778
attacccc

SEQ ID NO: 94263 - DNA, 11 bp, Unknown
  misc_feature (1)..( 11): Result.001 file - promoters60/1015778
gaagatacatt

SEQ ID NO: 94264 - DNA, 11 bp, Unknown
  misc_feature (1)..( 11): Result.001 file - promoters60/1015778
tataataaatt

SEQ ID NO: 94265 - DNA, 10 bp, Unknown
  misc_feature (1)..( 10): Result.001 file - promoters60/1015778
ataataaaat

SEQ ID NO: 94266 - DNA, 11 bp, Unknown
  misc_feature (1)..( 11): Result.001 file - promoters60/1015778
tcaattaaatt

SEQ ID NO: 94267 - DNA, 12 bp, Unknown
  misc_feature (1)..( 12): Result.001 file - promoters60/1015778
aacaaaaaaaaa

SEQ ID NO: 94268 - DNA, 12 bp, Unknown
  misc_feature (1)..( 12): Result.001 file - promoters60/1015778
tacaaaaaaaaa

SEQ ID NO: 94269 - DNA, 12 bp, Unknown
  misc_feature (1)..( 12): Result.001 file - promoters60/1015778
aacaaaataaaa

SEQ ID NO: 94270 - DNA, 7 bp, Unknown
  misc_feature (1)..( 7): Result.001 file - promoters60/1015778
aaaagat

SEQ ID NO: 94271 - DNA, 7 bp, Unknown
  misc_feature (1)..( 7): Result.001 file - promoters60/1015778
aaaagat

SEQ ID NO: 94272 - DNA, 7 bp, Unknown
  misc_feature (1)..( 7): Result.001 file - promoters60/1015778
aaaaatt

SEQ ID NO: 94273 - DNA, 9 bp, Unknown
  misc_feature (1)..( 9): Result.001 file - promoters60/1015778
actctaaaa

SEQ ID NO: 94274 - DNA, 9 bp, Unknown
  misc_feature (1)..( 9): Result.001 file - promoters60/1015778
actataaaa

SEQ ID NO: 94275 - DNA, 9 bp, Unknown
  misc_feature (1)..( 9): Result.001 file - promoters60/1015778
actctaaaa

SEQ ID NO: 94276 - DNA, 8 bp, Unknown
  misc_feature (1)..( 8): Result.001 file - promoters60/1015778
tttgggcc

SEQ ID NO: 94277 - DNA, 8 bp, Unknown
  misc_feature (1)..( 8): Result.001 file - promoters60/1015778
attgggcc

SEQ ID NO: 94278 - DNA, 8 bp, Unknown
  misc_feature (1)..( 8): Result.001 file - promoters60/1015778
tttgagcc

SEQ ID NO: 94279 - DNA, 12 bp, Unknown
  misc_feature (1)..( 12): Result.001 file - promoters60/1015778
agtaagatacta

SEQ ID NO: 94280 - DNA, 12 bp, Unknown
  misc_feature (1)..( 12): Result.001 file - promoters60/1015778
aataaaatacta

SEQ ID NO: 94281 - DNA, 12 bp, Unknown
  misc_feature (1)..( 12): Result.001 file - promoters60/1015848
aattaaattata

SEQ ID NO: 94282 - DNA, 9 bp, Unknown
  misc_feature (1)..( 9): Result.001 file - promoters60/1015848
gtttccttt

SEQ ID NO: 94283 - DNA, 9 bp, Unknown
  misc_feature (1)..( 9): Result.001 file - promoters60/1015848
gttaccttt

SEQ ID NO: 94284 - DNA, 9 bp, Unknown
  misc_feature (1)..( 9): Result.001 file - promoters60/1015848
gcttcgttt

SEQ ID NO: 94285 - DNA, 8 bp, Unknown
  misc_feature (1)..( 8): Result.001 file - promoters60/1015848
caccaata

SEQ ID NO: 94286 - DNA, 8 bp, Unknown
  misc_feature (1)..( 8): Result.001 file - promoters60/1015848
aaccaata

SEQ ID NO: 94287 - DNA, 8 bp, Unknown
  misc_feature (1)..( 8): Result.001 file - promoters60/1015848
aacaaata

SEQ ID NO: 94288 - DNA, 9 bp, Unknown
  misc_feature (1)..( 9): Result.001 file - promoters60/1015848
tttcctttt

SEQ ID NO: 94289 - DNA, 9 bp, Unknown
  misc_feature (1)..( 9): Result.001 file - promoters60/1015848
ttttcttaa

SEQ ID NO: 94290 - DNA, 9 bp, Unknown
  misc_feature (1)..( 9): Result.001 file - promoters60/1016056
gttcctaat

SEQ ID NO: 94291 - DNA, 7 bp, Unknown
  misc_feature (1)..( 7): Result.001 file - promoters60/1016056
tgtattg

SEQ ID NO: 94292 - DNA, 7 bp, Unknown
  misc_feature (1)..( 7): Result.001 file - promoters60/1016056
tgttttg

SEQ ID NO: 94293 - DNA, 6 bp, Unknown
  misc_feature (1)..( 6): Result.001 file - promoters60/1016056
attaaa

SEQ ID NO: 94294 - DNA, 6 bp, Unknown
  misc_feature (1)..( 6): Result.001 file - promoters60/1016056
attaaa

SEQ ID NO: 94295 - DNA, 8 bp, Unknown
  misc_feature (1)..( 8): Result.001 file - promoters60/1016056
cagtaact

SEQ ID NO: 94296 - DNA, 8 bp, Unknown
  misc_feature (1)..( 8): Result.001 file - promoters60/1016056
cagtcact

SEQ ID NO: 94297 - DNA, 8 bp, Unknown
  misc_feature (1)..( 8): Result.001 file - promoters60/1016056
atacaagt

SEQ ID NO: 94298 - DNA, 8 bp, Unknown
  misc_feature (1)..( 8): Result.001 file - promoters60/1016056
ataaaagt

SEQ ID NO: 94299 - DNA, 11 bp, Unknown
  misc_feature (1)..( 11): Result.001 file - promoters60/1016056
tatacaataaa

SEQ ID NO: 94300 - DNA, 11 bp, Unknown
  misc_feature (1)..( 11): Result.001 file - promoters60/1016056
aataaaataaa

SEQ ID NO: 94301 - DNA, 11 bp, Unknown
  misc_feature (1)..( 11): Result.001 file - promoters60/1016056
aatgaaatatc

SEQ ID NO: 94302 - DNA, 6 bp, Unknown
  misc_feature (1)..( 6): Result.001 file - promoters60/1016056
tttatt

SEQ ID NO: 94303 - DNA, 6 bp, Unknown
  misc_feature (1)..( 6): Result.001 file - promoters60/1016056
tttatt

SEQ ID NO: 94304 - DNA, 11 bp, Unknown
  misc_feature (1)..( 11): Result.001 file - promoters60/1016056
aataaaatctt

SEQ ID NO: 94305 - DNA, 11 bp, Unknown
  misc_feature (1)..( 11): Result.001 file - promoters60/1016056
aataaaggggt

SEQ ID NO: 94306 - DNA, 11 bp, Unknown
  misc_feature (1)..( 11): Result.001 file - promoters60/1016056
aataaaaactt

SEQ ID NO: 94307 - DNA, 7 bp, Unknown
  misc_feature (1)..( 7): Result.001 file - promoters60/1016056
ttgagaa

SEQ ID NO: 94308 - DNA, 7 bp, Unknown
  misc_feature (1)..( 7): Result.001 file - promoters60/1016056
ttgagaa

SEQ ID NO: 94309 - DNA, 6 bp, Unknown
  misc_feature (1)..( 6): Result.001 file - promoters60/1016056
taaaaa

SEQ ID NO: 94310 - DNA, 6 bp, Unknown
  misc_feature (1)..( 6): Result.001 file - promoters60/1016056
taaaaa

SEQ ID NO: 94311 - DNA, 6 bp, Unknown
  misc_feature (1)..( 6): Result.001 file - promoters60/1016056
tgttat

SEQ ID NO: 94312 - DNA, 6 bp, Unknown
  misc_feature (1)..( 6): Result.001 file - promoters60/1016056
tgttat

SEQ ID NO: 94313 - DNA, 6 bp, Unknown
  misc_feature (1)..( 6): Result.001 file - promoters60/1016056
agtaaa

SEQ ID NO: 94314 - DNA, 6 bp, Unknown
  misc_feature (1)..( 6): Result.001 file - promoters60/1016056
agtaaa

SEQ ID NO: 94315 - DNA, 7 bp, Unknown
  misc_feature (1)..( 7): Result.001 file - promoters60/1016056
aatcggg

SEQ ID NO: 94316 - DNA, 7 bp, Unknown
  misc_feature (1)..( 7): Result.001 file - promoters60/1016056
aattggg

SEQ ID NO: 94317 - DNA, 8 bp, Unknown
  misc_feature (1)..( 8): Result.001 file - promoters60/1016056
gaaagaaa

SEQ ID NO: 94318 - DNA, 8 bp, Unknown
  misc_feature (1)..( 8): Result.001 file - promoters60/1016056
gaaacaaa

SEQ ID NO: 94319 - DNA, 7 bp, Unknown
  misc_feature (1)..( 7): Result.001 file - promoters60/1016056
cccacta

SEQ ID NO: 94320 - DNA, 7 bp, Unknown
  misc_feature (1)..( 7): Result.001 file - promoters60/1016056
cccacta

SEQ ID NO: 94321 - DNA, 9 bp, Unknown
  misc_feature (1)..( 9): Result.001 file - promoters60/1016056
aaagaaaag

SEQ ID NO: 94322 - DNA, 9 bp, Unknown
  misc_feature (1)..( 9): Result.001 file - promoters60/1016056
aaagtaaag

SEQ ID NO: 94323 - DNA, 7 bp, Unknown
  misc_feature (1)..( 7): Result.001 file - promoters60/1016056
gtatata

SEQ ID NO: 94324 - DNA, 7 bp, Unknown
  misc_feature (1)..( 7): Result.001 file - promoters60/1016094
gtatata

SEQ ID NO: 94325 - DNA, 15 bp, Unknown
  misc_feature (1)..( 15): Result.001 file - promoters60/1016094
cacatgtgagagtaa

SEQ ID NO: 94326 - DNA, 15 bp, Unknown
  misc_feature (1)..( 15): Result.001 file - promoters60/1016094
cacttgtgtttgatt

SEQ ID NO: 94327 - DNA, 15 bp, Unknown
  misc_feature (1)..( 15): Result.001 file - promoters60/1016094
tgattgagttttatt

SEQ ID NO: 94328 - DNA, 15 bp, Unknown
  misc_feature (1)..( 15): Result.001 file - promoters60/1016094
taattgtatttattt

SEQ ID NO: 94329 - DNA, 9 bp, Unknown
  misc_feature (1)..( 9): Result.001 file - promoters60/1016094
gaaaaaaaa

SEQ ID NO: 94330 - DNA, 9 bp, Unknown
  misc_feature (1)..( 9): Result.001 file - promoters60/1016094
gaataaaaa

SEQ ID NO: 94331 - DNA, 9 bp, Unknown
  misc_feature (1)..( 9): Result.001 file - promoters60/1016094
gaaaaaaat

SEQ ID NO: 94332 - DNA, 9 bp, Unknown
  misc_feature (1)..( 9): Result.001 file - promoters60/1016133
taaaataat

SEQ ID NO: 94333 - DNA, 7 bp, Unknown
  misc_feature (1)..( 7): Result.001 file - promoters60/1016133
aaataat

SEQ ID NO: 94334 - DNA, 7 bp, Unknown
  misc_feature (1)..( 7): Result.001 file - promoters60/1016133
aaaaaat

SEQ ID NO: 94335 - DNA, 7 bp, Unknown
  misc_feature (1)..( 7): Result.001 file - promoters60/1016133
atacaaa

SEQ ID NO: 94336 - DNA, 7 bp, Unknown
  misc_feature (1)..( 7): Result.001 file - promoters60/1016133
atacaaa

SEQ ID NO: 94337 - DNA, 7 bp, Unknown
  misc_feature (1)..( 7): Result.001 file - promoters60/1016133
aaatttt

SEQ ID NO: 94338 - DNA, 7 bp, Unknown
  misc_feature (1)..( 7): Result.001 file - promoters60/1016133
aaatttt

SEQ ID NO: 94339 - DNA, 6 bp, Unknown
  misc_feature (1)..( 6): Result.001 file - promoters60/1016133
ttttat

SEQ ID NO: 94340 - DNA, 6 bp, Unknown
  misc_feature (1)..( 6): Result.001 file - promoters60/1016133
ttttat

SEQ ID NO: 94341 - DNA, 8 bp, Unknown
  misc_feature (1)..( 8): Result.001 file - promoters60/1016133
ataacatt

SEQ ID NO: 94342 - DNA, 8 bp, Unknown
  misc_feature (1)..( 8): Result.001 file - promoters60/1016133
ataccatt

SEQ ID NO: 94343 - DNA, 8 bp, Unknown
  misc_feature (1)..( 8): Result.001 file - promoters60/1016133
gtaacatt

SEQ ID NO: 94344 - DNA, 6 bp, Unknown
  misc_feature (1)..( 6): Result.001 file - promoters60/1016133
ttaatt

SEQ ID NO: 94345 - DNA, 6 bp, Unknown
  misc_feature (1)..( 6): Result.001 file - promoters60/1016133
ttaatt

SEQ ID NO: 94346 - DNA, 10 bp, Unknown
  misc_feature (1)..( 10): Result.001 file - promoters60/1016133
gtatatcaaa

SEQ ID NO: 94347 - DNA, 10 bp, Unknown
  misc_feature (1)..( 10): Result.001 file - promoters60/1016133
aaatattaaa

SEQ ID NO: 94348 - DNA, 10 bp, Unknown
  misc_feature (1)..( 10): Result.001 file - promoters60/1016133
gtatgtcagc

SEQ ID NO: 94349 - DNA, 6 bp, Unknown
  misc_feature (1)..( 6): Result.001 file - promoters60/1016133
tttgaa

SEQ ID NO: 94350 - DNA, 6 bp, Unknown
  misc_feature (1)..( 6): Result.001 file - promoters60/1016133
tttgaa

SEQ ID NO: 94351 - DNA, 8 bp, Unknown
  misc_feature (1)..( 8): Result.001 file - promoters60/1016133
aactttca

SEQ ID NO: 94352 - DNA, 8 bp, Unknown
  misc_feature (1)..( 8): Result.001 file - promoters60/1016133
aacattca

SEQ ID NO: 94353 - DNA, 6 bp, Unknown
  misc_feature (1)..( 6): Result.001 file - promoters60/1016133
ctctat

SEQ ID NO: 94354 - DNA, 6 bp, Unknown
  misc_feature (1)..( 6): Result.001 file - promoters60/1016133
ctctat

SEQ ID NO: 94355 - DNA, 8 bp, Unknown
  misc_feature (1)..( 8): Result.001 file - promoters60/1016133
attttatg

SEQ ID NO: 94356 - DNA, 8 bp, Unknown
  misc_feature (1)..( 8): Result.001 file - promoters60/1016133
atttgatg

SEQ ID NO: 94357 - DNA, 7 bp, Unknown
  misc_feature (1)..( 7): Result.001 file - promoters60/1016133
gatgtat

SEQ ID NO: 94358 - DNA, 7 bp, Unknown
  misc_feature (1)..( 7): Result.001 file - promoters60/1016133
gatatat

SEQ ID NO: 94359 - DNA, 7 bp, Unknown
  misc_feature (1)..( 7): Result.001 file - promoters60/1016133
tatttag

SEQ ID NO: 94360 - DNA, 7 bp, Unknown
  misc_feature (1)..( 7): Result.001 file - promoters60/1016133
tatttag

SEQ ID NO: 94361 - DNA, 7 bp, Unknown
  misc_feature (1)..( 7): Result.001 file - promoters60/1016133
atcgttt

SEQ ID NO: 94362 - DNA, 7 bp, Unknown
  misc_feature (1)..( 7): Result.001 file - promoters60/1016133
atctttt

SEQ ID NO: 94363 - DNA, 6 bp, Unknown
  misc_feature (1)..( 6): Result.001 file - promoters60/1016133
atttta

SEQ ID NO: 94364 - DNA, 6 bp, Unknown
  misc_feature (1)..( 6): Result.001 file - promoters60/1016133
atttta

SEQ ID NO: 94365 - DNA, 6 bp, Unknown
  misc_feature (1)..( 6): Result.001 file - promoters60/1016133
aataat

SEQ ID NO: 94366 - DNA, 6 bp, Unknown
  misc_feature (1)..( 6): Result.001 file - promoters60/1016133
aataat

SEQ ID NO: 94367 - DNA, 8 bp, Unknown
  misc_feature (1)..( 8): Result.001 file - promoters60/1016133
atcaaata

SEQ ID NO: 94368 - DNA, 8 bp, Unknown
  misc_feature (1)..( 8): Result.001 file - promoters60/1016133
atcatata

SEQ ID NO: 94369 - DNA, 6 bp, Unknown
  misc_feature (1)..( 6): Result.001 file - promoters60/1016133
aattaa

SEQ ID NO: 94370 - DNA, 6 bp, Unknown
  misc_feature (1)..( 6): Result.001 file - promoters60/1016133
aattaa

SEQ ID NO: 94371 - DNA, 6 bp, Unknown
  misc_feature (1)..( 6): Result.001 file - promoters60/1016133
aataat

SEQ ID NO: 94372 - DNA, 6 bp, Unknown
  misc_feature (1)..( 6): Result.001 file - promoters60/1016133
aataat

SEQ ID NO: 94373 - DNA, 9 bp, Unknown
  misc_feature (1)..( 9): Result.001 file - promoters60/1016133
tagatcatt

SEQ ID NO: 94374 - DNA, 9 bp, Unknown
  misc_feature (1)..( 9): Result.001 file - promoters60/1016133
tagataatt

SEQ ID NO: 94375 - DNA, 7 bp, Unknown
  misc_feature (1)..( 7): Result.001 file - promoters60/1016133
aatatta

SEQ ID NO: 94376 - DNA, 7 bp, Unknown
  misc_feature (1)..( 7): Result.001 file - promoters60/1016133
aatttta

SEQ ID NO: 94377 - DNA, 6 bp, Unknown
  misc_feature (1)..( 6): Result.001 file - promoters60/1016133
attcta

SEQ ID NO: 94378 - DNA, 6 bp, Unknown
  misc_feature (1)..( 6): Result.001 file - promoters60/1016133
attcta

SEQ ID NO: 94379 - DNA, 6 bp, Unknown
  misc_feature (1)..( 6): Result.001 file - promoters60/1016133
atatat

SEQ ID NO: 94380 - DNA, 6 bp, Unknown
  misc_feature (1)..( 6): Result.001 file - promoters60/1016133
atatat

SEQ ID NO: 94381 - DNA, 7 bp, Unknown
  misc_feature (1)..( 7): Result.001 file - promoters60/1016133
tatgata

SEQ ID NO: 94382 - DNA, 7 bp, Unknown
  misc_feature (1)..( 7): Result.001 file - promoters60/1016133
tatcata

SEQ ID NO: 94383 - DNA, 6 bp, Unknown
  misc_feature (1)..( 6): Result.001 file - promoters60/1016133
aaagat

SEQ ID NO: 94384 - DNA, 6 bp, Unknown
  misc_feature (1)..( 6): Result.001 file - promoters60/1016133
aaagat

SEQ ID NO: 94385 - DNA, 6 bp, Unknown
  misc_feature (1)..( 6): Result.001 file - promoters60/1016133
actata

SEQ ID NO: 94386 - DNA, 6 bp, Unknown
  misc_feature (1)..( 6): Result.001 file - promoters60/1016133
actata

SEQ ID NO: 94387 - DNA, 11 bp, Unknown
  misc_feature (1)..( 11): Result.001 file - promoters60/1016133
tatactttact

SEQ ID NO: 94388 - DNA, 11 bp, Unknown
  misc_feature (1)..( 11): Result.001 file - promoters60/1016133
tattctttact

SEQ ID NO: 94389 - DNA, 7 bp, Unknown
  misc_feature (1)..( 7): Result.001 file - promoters60/1016133
attcaaa

SEQ ID NO: 94390 - DNA, 7 bp, Unknown
  misc_feature (1)..( 7): Result.001 file - promoters60/1016133
attcaaa

SEQ ID NO: 94391 - DNA, 7 bp, Unknown
  misc_feature (1)..( 7): Result.001 file - promoters60/1016133
aaactta

SEQ ID NO: 94392 - DNA, 7 bp, Unknown
  misc_feature (1)..( 7): Result.001 file - promoters60/1016133
aaaatta

SEQ ID NO: 94393 - DNA, 7 bp, Unknown
  misc_feature (1)..( 7): Result.001 file - promoters60/1016133
ctataaa

SEQ ID NO: 94394 - DNA, 7 bp, Unknown
  misc_feature (1)..( 7): Result.001 file - promoters60/1016165
ctacaaa

SEQ ID NO: 94395 - DNA, 6 bp, Unknown
  misc_feature (1)..( 6): Result.001 file - promoters60/1016165
tattat

SEQ ID NO: 94396 - DNA, 6 bp, Unknown
  misc_feature (1)..( 6): Result.001 file - promoters60/1016165
tattat

SEQ ID NO: 94397 - DNA, 10 bp, Unknown
  misc_feature (1)..( 10): Result.001 file - promoters60/1016165
gattatggat

SEQ ID NO: 94398 - DNA, 10 bp, Unknown
  misc_feature (1)..( 10): Result.001 file - promoters60/1016165
gattattgat

SEQ ID NO: 94399 - DNA, 10 bp, Unknown
  misc_feature (1)..( 10): Result.001 file - promoters60/1016165
gatgatgcag

SEQ ID NO: 94400 - DNA, 7 bp, Unknown
  misc_feature (1)..( 7): Result.001 file - promoters60/1016165
tgtattt

SEQ ID NO: 94401 - DNA, 7 bp, Unknown
  misc_feature (1)..( 7): Result.001 file - promoters60/1016165
tgttttt

SEQ ID NO: 94402 - DNA, 8 bp, Unknown
  misc_feature (1)..( 8): Result.001 file - promoters60/1016165
aaattgtg

SEQ ID NO: 94403 - DNA, 8 bp, Unknown
  misc_feature (1)..( 8): Result.001 file - promoters60/1016165
aaaatgtg

SEQ ID NO: 94404 - DNA, 10 bp, Unknown
  misc_feature (1)..( 10): Result.001 file - promoters60/1016165
tattttaatg

SEQ ID NO: 94405 - DNA, 10 bp, Unknown
  misc_feature (1)..( 10): Result.001 file - promoters60/1016165
tatttttatt

SEQ ID NO: 94406 - DNA, 10 bp, Unknown
  misc_feature (1)..( 10): Result.001 file - promoters60/1016165
cattataatg

SEQ ID NO: 94407 - DNA, 10 bp, Unknown
  misc_feature (1)..( 10): Result.001 file - promoters60/1016165
ttactaattt

SEQ ID NO: 94408 - DNA, 10 bp, Unknown
  misc_feature (1)..( 10): Result.001 file - promoters60/1016165
ttaataattt

SEQ ID NO: 94409 - DNA, 8 bp, Unknown
  misc_feature (1)..( 8): Result.001 file - promoters60/1016165
aataaaag

SEQ ID NO: 94410 - DNA, 8 bp, Unknown
  misc_feature (1)..( 8): Result.001 file - promoters60/1016165
aattaaag

SEQ ID NO: 94411 - DNA, 6 bp, Unknown
  misc_feature (1)..( 6): Result.001 file - promoters60/1016165
aaaatt

SEQ ID NO: 94412 - DNA, 6 bp, Unknown
  misc_feature (1)..( 6): Result.001 file - promoters60/1016165
aaaatt

SEQ ID NO: 94413 - DNA, 7 bp, Unknown
  misc_feature (1)..( 7): Result.001 file - promoters60/1016165
aatcaaa

SEQ ID NO: 94414 - DNA, 7 bp, Unknown
  misc_feature (1)..( 7): Result.001 file - promoters60/1016165
aattaaa

SEQ ID NO: 94415 - DNA, 6 bp, Unknown
  misc_feature (1)..( 6): Result.001 file - promoters60/1016165
ggccca

SEQ ID NO: 94416 - DNA, 6 bp, Unknown
  misc_feature (1)..( 6): Result.001 file - promoters60/1016165
ggccca

SEQ ID NO: 94417 - DNA, 8 bp, Unknown
  misc_feature (1)..( 8): Result.001 file - promoters60/1016165
agacaagt

SEQ ID NO: 94418 - DNA, 8 bp, Unknown
  misc_feature (1)..( 8): Result.001 file - promoters60/1016165
agacgagt

SEQ ID NO: 94419 - DNA, 7 bp, Unknown
  misc_feature (1)..( 7): Result.001 file - promoters60/1016165
aagctca

SEQ ID NO: 94420 - DNA, 7 bp, Unknown
  misc_feature (1)..( 7): Result.001 file - promoters60/1016165
aagatca

SEQ ID NO: 94421 - DNA, 7 bp, Unknown
  misc_feature (1)..( 7): Result.001 file - promoters60/1016165
taataaa

SEQ ID NO: 94422 - DNA, 7 bp, Unknown
  misc_feature (1)..( 7): Result.001 file - promoters60/1016165
taacaaa

SEQ ID NO: 94423 - DNA, 7 bp, Unknown
  misc_feature (1)..( 7): Result.001 file - promoters60/1016165
taatcac

SEQ ID NO: 94424 - DNA, 7 bp, Unknown
  misc_feature (1)..( 7): Result.001 file - promoters60/1016165
taatcac

SEQ ID NO: 94425 - DNA, 7 bp, Unknown
  misc_feature (1)..( 7): Result.001 file - promoters60/1016165
agttaat

SEQ ID NO: 94426 - DNA, 7 bp, Unknown
  misc_feature (1)..( 7): Result.001 file - promoters60/1016165
agtgaat

SEQ ID NO: 94427 - DNA, 7 bp, Unknown
  misc_feature (1)..( 7): Result.001 file - promoters60/1016165
ccctttt

SEQ ID NO: 94428 - DNA, 7 bp, Unknown
  misc_feature (1)..( 7): Result.001 file - promoters60/1016165
cccattt

SEQ ID NO: 94429 - DNA, 6 bp, Unknown
  misc_feature (1)..( 6): Result.001 file - promoters60/1016165
aaccaa

SEQ ID NO: 94430 - DNA, 6 bp, Unknown
  misc_feature (1)..( 6): Result.001 file - promoters60/1016165
aaccaa

SEQ ID NO: 94431 - DNA, 7 bp, Unknown
  misc_feature (1)..( 7): Result.001 file - promoters60/1016165
agggata

SEQ ID NO: 94432 - DNA, 7 bp, Unknown
  misc_feature (1)..( 7): Result.001 file - promoters60/1016165
aggtata

SEQ ID NO: 94433 - DNA, 7 bp, Unknown
  misc_feature (1)..( 7): Result.001 file - promoters60/1016165
tgatcat

SEQ ID NO: 94434 - DNA, 7 bp, Unknown
  misc_feature (1)..( 7): Result.001 file - promoters60/1016165
tgatcat

SEQ ID NO: 94435 - DNA, 6 bp, Unknown
  misc_feature (1)..( 6): Result.001 file - promoters60/1016165
taattt

SEQ ID NO: 94436 - DNA, 6 bp, Unknown
  misc_feature (1)..( 6): Result.001 file - promoters60/1016165
taattt

SEQ ID NO: 94437 - DNA, 7 bp, Unknown
  misc_feature (1)..( 7): Result.001 file - promoters60/1016165
ttccatt

SEQ ID NO: 94438 - DNA, 7 bp, Unknown
  misc_feature (1)..( 7): Result.001 file - promoters60/1016165
ttccatt

SEQ ID NO: 94439 - DNA, 8 bp, Unknown
  misc_feature (1)..( 8): Result.001 file - promoters60/1016165
ttagcaat

SEQ ID NO: 94440 - DNA, 8 bp, Unknown
  misc_feature (1)..( 8): Result.001 file - promoters60/1016176
ttaacaat

SEQ ID NO: 94441 - DNA, 13 bp, Unknown
  misc_feature (1)..( 13): Result.001 file - promoters60/1016176
agttataaatcgt

SEQ ID NO: 94442 - DNA, 13 bp, Unknown
  misc_feature (1)..( 13): Result.001 file - promoters60/1016176
agttatgaatccg

SEQ ID NO: 94443 - DNA, 13 bp, Unknown
  misc_feature (1)..( 13): Result.001 file - promoters60/1016176
tcaaataaattat

SEQ ID NO: 94444 - DNA, 13 bp, Unknown
  misc_feature (1)..( 13): Result.001 file - promoters60/1016176
gaaaatgaattct

SEQ ID NO: 94445 - DNA, 13 bp, Unknown
  misc_feature (1)..( 13): Result.001 file - promoters60/1016176
gtaactaaaatta

SEQ ID NO: 94446 - DNA, 14 bp, Unknown
  misc_feature (1)..( 14): Result.001 file - promoters60/1016176
aattttaatatttt

SEQ ID NO: 94447 - DNA, 14 bp, Unknown
  misc_feature (1)..( 14): Result.001 file - promoters60/1016176
acgaataaaataaa

SEQ ID NO: 94448 - DNA, 11 bp, Unknown
  misc_feature (1)..( 11): Result.001 file - promoters60/1016176
ataaatcgtta

SEQ ID NO: 94449 - DNA, 11 bp, Unknown
  misc_feature (1)..( 11): Result.001 file - promoters60/1016176
gagaatcatta

SEQ ID NO: 94450 - DNA, 11 bp, Unknown
  misc_feature (1)..( 11): Result.001 file - promoters60/1016176
accaatcataa

SEQ ID NO: 94451 - DNA, 11 bp, Unknown
  misc_feature (1)..( 11): Result.001 file - promoters60/1016176
accaatcaaac

SEQ ID NO: 94452 - DNA, 11 bp, Unknown
  misc_feature (1)..( 11): Result.001 file - promoters60/1016176
ataaattattt

SEQ ID NO: 94453 - DNA, 11 bp, Unknown
  misc_feature (1)..( 11): Result.001 file - promoters60/1016176
acgaataaaat

SEQ ID NO: 94454 - DNA, 13 bp, Unknown
  misc_feature (1)..( 13): Result.001 file - promoters60/1016176
cacagacaccaag

SEQ ID NO: 94455 - DNA, 13 bp, Unknown
  misc_feature (1)..( 13): Result.001 file - promoters60/1016176
gaaagaaacctga

SEQ ID NO: 94456 - DNA, 13 bp, Unknown
  misc_feature (1)..( 13): Result.001 file - promoters60/1016176
gtaagaaaaaaaa

SEQ ID NO: 94457 - DNA, 13 bp, Unknown
  misc_feature (1)..( 13): Result.001 file - promoters60/1016176
caaacaaaacata

SEQ ID NO: 94458 - DNA, 13 bp, Unknown
  misc_feature (1)..( 13): Result.001 file - promoters60/1016176
gaaacaaagactt

SEQ ID NO: 94459 - DNA, 13 bp, Unknown
  misc_feature (1)..( 13): Result.001 file - promoters60/1016176
agtagaataaaaa

SEQ ID NO: 94460 - DNA, 13 bp, Unknown
  misc_feature (1)..( 13): Result.001 file - promoters60/1016223
tttggtataatga

SEQ ID NO: 94461 - DNA, 8 bp, Unknown
  misc_feature (1)..( 8): Result.001 file - promoters60/1016223
aaaacaac

SEQ ID NO: 94462 - DNA, 8 bp, Unknown
  misc_feature (1)..( 8): Result.001 file - promoters60/1016223
aaaacaat

SEQ ID NO: 94463 - DNA, 8 bp, Unknown
  misc_feature (1)..( 8): Result.001 file - promoters60/1016223
aaaaaaac

SEQ ID NO: 94464 - DNA, 6 bp, Unknown
  misc_feature (1)..( 6): Result.001 file - promoters60/1016223
atggca

SEQ ID NO: 94465 - DNA, 6 bp, Unknown
  misc_feature (1)..( 6): Result.001 file - promoters60/1016223
atggca

SEQ ID NO: 94466 - DNA, 7 bp, Unknown
  misc_feature (1)..( 7): Result.001 file - promoters60/1016223
cgtgaaa

SEQ ID NO: 94467 - DNA, 7 bp, Unknown
  misc_feature (1)..( 7): Result.001 file - promoters60/1016223
cgttaaa

SEQ ID NO: 94468 - DNA, 8 bp, Unknown
  misc_feature (1)..( 8): Result.001 file - promoters60/1016223
agagattg

SEQ ID NO: 94469 - DNA, 8 bp, Unknown
  misc_feature (1)..( 8): Result.001 file - promoters60/1016223
agaaattg

SEQ ID NO: 94470 - DNA, 8 bp, Unknown
  misc_feature (1)..( 8): Result.001 file - promoters60/1016223
aaaacaat

SEQ ID NO: 94471 - DNA, 8 bp, Unknown
  misc_feature (1)..( 8): Result.001 file - promoters60/1016223
aaaacaat

SEQ ID NO: 94472 - DNA, 8 bp, Unknown
  misc_feature (1)..( 8): Result.001 file - promoters60/1016223
gaattaaa

SEQ ID NO: 94473 - DNA, 8 bp, Unknown
  misc_feature (1)..( 8): Result.001 file - promoters60/1016223
gaaataaa

SEQ ID NO: 94474 - DNA, 7 bp, Unknown
  misc_feature (1)..( 7): Result.001 file - promoters60/1016223
caaattt

SEQ ID NO: 94475 - DNA, 7 bp, Unknown
  misc_feature (1)..( 7): Result.001 file - promoters60/1016223
caatttt

SEQ ID NO: 94476 - DNA, 6 bp, Unknown
  misc_feature (1)..( 6): Result.001 file - promoters60/1016223
ttaaaa

SEQ ID NO: 94477 - DNA, 6 bp, Unknown
  misc_feature (1)..( 6): Result.001 file - promoters60/1016223
ttaaaa

SEQ ID NO: 94478 - DNA, 6 bp, Unknown
  misc_feature (1)..( 6): Result.001 file - promoters60/1016223
gtaacg

SEQ ID NO: 94479 - DNA, 6 bp, Unknown
  misc_feature (1)..( 6): Result.001 file - promoters60/1016223
gtaacg

SEQ ID NO: 94480 - DNA, 7 bp, Unknown
  misc_feature (1)..( 7): Result.001 file - promoters60/1016223
gtggtta

SEQ ID NO: 94481 - DNA, 7 bp, Unknown
  misc_feature (1)..( 7): Result.001 file - promoters60/1016223
gtgttta

SEQ ID NO: 94482 - DNA, 8 bp, Unknown
  misc_feature (1)..( 8): Result.001 file - promoters60/1016223
acgtgtca

SEQ ID NO: 94483 - DNA, 8 bp, Unknown
  misc_feature (1)..( 8): Result.001 file - promoters60/1016223
acgtgtca

SEQ ID NO: 94484 - DNA, 15 bp, Unknown
  misc_feature (1)..( 15): Result.001 file - promoters60/1016223
tattgcttcaccgcc

SEQ ID NO: 94485 - DNA, 15 bp, Unknown
  misc_feature (1)..( 15): Result.001 file - promoters60/1016223
tattgcttcaccgcc

SEQ ID NO: 94486 - DNA, 6 bp, Unknown
  misc_feature (1)..( 6): Result.001 file - promoters60/1016223
ctcgtc

SEQ ID NO: 94487 - DNA, 6 bp, Unknown
  misc_feature (1)..( 6): Result.001 file - promoters60/1016223
ctcgtc

SEQ ID NO: 94488 - DNA, 15 bp, Unknown
  misc_feature (1)..( 15): Result.001 file - promoters60/1016223
ttcttcttctataaa

SEQ ID NO: 94489 - DNA, 15 bp, Unknown
  misc_feature (1)..( 15): Result.001 file - promoters60/1016250
ttcttcttctataaa

SEQ ID NO: 94490 - DNA, 11 bp, Unknown
  misc_feature (1)..( 11): Result.001 file - promoters60/1016250
ctcaatcaaac

SEQ ID NO: 94491 - DNA, 11 bp, Unknown
  misc_feature (1)..( 11): Result.001 file - promoters60/1016250
gtcaaccaact

SEQ ID NO: 94492 - DNA, 11 bp, Unknown
  misc_feature (1)..( 11): Result.001 file - promoters60/1016250
accaatcacaa

SEQ ID NO: 94493 - DNA, 11 bp, Unknown
  misc_feature (1)..( 11): Result.001 file - promoters60/1016250
ctctatcaaaa

SEQ ID NO: 94494 - DNA, 11 bp, Unknown
  misc_feature (1)..( 11): Result.001 file - promoters60/1016250
aacaaacaaac

SEQ ID NO: 94495 - DNA, 11 bp, Unknown
  misc_feature (1)..( 11): Result.001 file - promoters60/1016250
atgaattacac

SEQ ID NO: 94496 - DNA, 11 bp, Unknown
  misc_feature (1)..( 11): Result.001 file - promoters60/1016250
agtgttcaaaa

SEQ ID NO: 94497 - DNA, 13 bp, Unknown
  misc_feature (1)..( 13): Result.001 file - promoters60/1016250
accactatataag

SEQ ID NO: 94498 - DNA, 13 bp, Unknown
  misc_feature (1)..( 13): Result.001 file - promoters60/1016250
tccattatatata

SEQ ID NO: 94499 - DNA, 13 bp, Unknown
  misc_feature (1)..( 13): Result.001 file - promoters60/1016250
agtgagatataat

SEQ ID NO: 94500 - DNA, 13 bp, Unknown
  misc_feature (1)..( 13): Result.001 file - promoters60/1016250
aaaattatataaa

SEQ ID NO: 94501 - DNA, 13 bp, Unknown
  misc_feature (1)..( 13): Result.001 file - promoters60/1016250
tcctttatattct

SEQ ID NO: 94502 - DNA, 13 bp, Unknown
  misc_feature (1)..( 13): Result.001 file - promoters60/1016250
atctccctataaa

SEQ ID NO: 94503 - DNA, 10 bp, Unknown
  misc_feature (1)..( 10): Result.001 file - promoters60/1016250
aaataaataa

SEQ ID NO: 94504 - DNA, 10 bp, Unknown
  misc_feature (1)..( 10): Result.001 file - promoters60/1016250
taataaagct

SEQ ID NO: 94505 - DNA, 10 bp, Unknown
  misc_feature (1)..( 10): Result.001 file - promoters60/1016250
aaataaataa

SEQ ID NO: 94506 - DNA, 10 bp, Unknown
  misc_feature (1)..( 10): Result.001 file - promoters60/1016250
aaagaaaaag

SEQ ID NO: 94507 - DNA, 10 bp, Unknown
  misc_feature (1)..( 10): Result.001 file - promoters60/1016250
ttagaaaatt

SEQ ID NO: 94508 - DNA, 10 bp, Unknown
  misc_feature (1)..( 10): Result.001 file - promoters60/1016250
gaaaaaacca

SEQ ID NO: 94509 - DNA, 12 bp, Unknown
  misc_feature (1)..( 12): Result.001 file - promoters60/1016250
aaatgaaaaaca

SEQ ID NO: 94510 - DNA, 12 bp, Unknown
  misc_feature (1)..( 12): Result.001 file - promoters60/1016250
atatgaaaatct

SEQ ID NO: 94511 - DNA, 12 bp, Unknown
  misc_feature (1)..( 12): Result.001 file - promoters60/1016250
caatcaaataaa

SEQ ID NO: 94512 - DNA, 12 bp, Unknown
  misc_feature (1)..( 12): Result.001 file - promoters60/1016250
aaaccaaaagaa

SEQ ID NO: 94513 - DNA, 12 bp, Unknown
  misc_feature (1)..( 12): Result.001 file - promoters60/1016250
gaaaaaaaagac

SEQ ID NO: 94514 - DNA, 12 bp, Unknown
  misc_feature (1)..( 12): Result.001 file - promoters60/1016278
aaatgaatttag

SEQ ID NO: 94515 - DNA, 6 bp, Unknown
  misc_feature (1)..( 6): Result.001 file - promoters60/1016278
aaaaag

SEQ ID NO: 94516 - DNA, 6 bp, Unknown
  misc_feature (1)..( 6): Result.001 file - promoters60/1016278
aaaaag

SEQ ID NO: 94517 - DNA, 9 bp, Unknown
  misc_feature (1)..( 9): Result.001 file - promoters60/1016278
gggattttt

SEQ ID NO: 94518 - DNA, 9 bp, Unknown
  misc_feature (1)..( 9): Result.001 file - promoters60/1016278
gggttttta

SEQ ID NO: 94519 - DNA, 9 bp, Unknown
  misc_feature (1)..( 9): Result.001 file - promoters60/1016278
ttgattttt

SEQ ID NO: 94520 - DNA, 8 bp, Unknown
  misc_feature (1)..( 8): Result.001 file - promoters60/1016278
tgtgtcta

SEQ ID NO: 94521 - DNA, 8 bp, Unknown
  misc_feature (1)..( 8): Result.001 file - promoters60/1016278
tgtatcta

SEQ ID NO: 94522 - DNA, 7 bp, Unknown
  misc_feature (1)..( 7): Result.001 file - promoters60/1016278
taattaa

SEQ ID NO: 94523 - DNA, 7 bp, Unknown
  misc_feature (1)..( 7): Result.001 file - promoters60/1016278
taattat

SEQ ID NO: 94524 - DNA, 7 bp, Unknown
  misc_feature (1)..( 7): Result.001 file - promoters60/1016278
taattat

SEQ ID NO: 94525 - DNA, 7 bp, Unknown
  misc_feature (1)..( 7): Result.001 file - promoters60/1016278
ttatata

SEQ ID NO: 94526 - DNA, 7 bp, Unknown
  misc_feature (1)..( 7): Result.001 file - promoters60/1016278
ttatata

SEQ ID NO: 94527 - DNA, 8 bp, Unknown
  misc_feature (1)..( 8): Result.001 file - promoters60/1016278
aacgcaag

SEQ ID NO: 94528 - DNA, 8 bp, Unknown
  misc_feature (1)..( 8): Result.001 file - promoters60/1016278
aacgtaag

SEQ ID NO: 94529 - DNA, 6 bp, Unknown
  misc_feature (1)..( 6): Result.001 file - promoters60/1016278
attttt

SEQ ID NO: 94530 - DNA, 6 bp, Unknown
  misc_feature (1)..( 6): Result.001 file - promoters60/1016278
attttt

SEQ ID NO: 94531 - DNA, 6 bp, Unknown
  misc_feature (1)..( 6): Result.001 file - promoters60/1016278
atcaac

SEQ ID NO: 94532 - DNA, 6 bp, Unknown
  misc_feature (1)..( 6): Result.001 file - promoters60/1016278
atcaac

SEQ ID NO: 94533 - DNA, 11 bp, Unknown
  misc_feature (1)..( 11): Result.001 file - promoters60/1016278
tatcatataat

SEQ ID NO: 94534 - DNA, 11 bp, Unknown
  misc_feature (1)..( 11): Result.001 file - promoters60/1016278
tataatataat

SEQ ID NO: 94535 - DNA, 6 bp, Unknown
  misc_feature (1)..( 6): Result.001 file - promoters60/1016278
aaataa

SEQ ID NO: 94536 - DNA, 6 bp, Unknown
  misc_feature (1)..( 6): Result.001 file - promoters60/1016278
aaataa

SEQ ID NO: 94537 - DNA, 10 bp, Unknown
  misc_feature (1)..( 10): Result.001 file - promoters60/1016278
aaatagataa

SEQ ID NO: 94538 - DNA, 10 bp, Unknown
  misc_feature (1)..( 10): Result.001 file - promoters60/1016278
aaatatataa

SEQ ID NO: 94539 - DNA, 6 bp, Unknown
  misc_feature (1)..( 6): Result.001 file - promoters60/1016278
aattgt

SEQ ID NO: 94540 - DNA, 6 bp, Unknown
  misc_feature (1)..( 6): Result.001 file - promoters60/1016278
aattgt

SEQ ID NO: 94541 - DNA, 6 bp, Unknown
  misc_feature (1)..( 6): Result.001 file - promoters60/1016278
gctacc

SEQ ID NO: 94542 - DNA, 6 bp, Unknown
  misc_feature (1)..( 6): Result.001 file - promoters60/1016278
gctacc

SEQ ID NO: 94543 - DNA, 6 bp, Unknown
  misc_feature (1)..( 6): Result.001 file - promoters60/1016278
tctctc

SEQ ID NO: 94544 - DNA, 6 bp, Unknown
  misc_feature (1)..( 6): Result.001 file - promoters60/1016278
tctctc

SEQ ID NO: 94545 - DNA, 7 bp, Unknown
  misc_feature (1)..( 7): Result.001 file - promoters60/1016278
tttattt

SEQ ID NO: 94546 - DNA, 7 bp, Unknown
  misc_feature (1)..( 7): Result.001 file - promoters60/1016278
tttcttt

SEQ ID NO: 94547 - DNA, 8 bp, Unknown
  misc_feature (1)..( 8): Result.001 file - promoters60/1016278
ttactgat

SEQ ID NO: 94548 - DNA, 8 bp, Unknown
  misc_feature (1)..( 8): Result.001 file - promoters60/1016278
ttattgat

SEQ ID NO: 94549 - DNA, 6 bp, Unknown
  misc_feature (1)..( 6): Result.001 file - promoters60/1016278
atttat

SEQ ID NO: 94550 - DNA, 6 bp, Unknown
  misc_feature (1)..( 6): Result.001 file - promoters60/1016278
atttat

SEQ ID NO: 94551 - DNA, 7 bp, Unknown
  misc_feature (1)..( 7): Result.001 file - promoters60/1016278
tttgttt

SEQ ID NO: 94552 - DNA, 7 bp, Unknown
  misc_feature (1)..( 7): Result.001 file - promoters60/1016278
tttattt

SEQ ID NO: 94553 - DNA, 6 bp, Unknown
  misc_feature (1)..( 6): Result.001 file - promoters60/1016278
tatctc

SEQ ID NO: 94554 - DNA, 6 bp, Unknown
  misc_feature (1)..( 6): Result.001 file - promoters60/1016278
tatctc

SEQ ID NO: 94555 - DNA, 8 bp, Unknown
  misc_feature (1)..( 8): Result.001 file - promoters60/1016278
atccaaac

SEQ ID NO: 94556 - DNA, 8 bp, Unknown
  misc_feature (1)..( 8): Result.001 file - promoters60/1016278
atcctaac

SEQ ID NO: 94557 - DNA, 7 bp, Unknown
  misc_feature (1)..( 7): Result.001 file - promoters60/1016278
ataaaaa

SEQ ID NO: 94558 - DNA, 7 bp, Unknown
  misc_feature (1)..( 7): Result.001 file - promoters60/1016278
ataaaaa

SEQ ID NO: 94559 - DNA, 7 bp, Unknown
  misc_feature (1)..( 7): Result.001 file - promoters60/1016278
gaatacg

SEQ ID NO: 94560 - DNA, 7 bp, Unknown
  misc_feature (1)..( 7): Result.001 file - promoters60/1016343
gaaaacg

SEQ ID NO: 94561 - DNA, 6 bp, Unknown
  misc_feature (1)..( 6): Result.001 file - promoters60/1016343
tttccg

SEQ ID NO: 94562 - DNA, 6 bp, Unknown
  misc_feature (1)..( 6): Result.001 file - promoters60/1016343
tttccg

SEQ ID NO: 94563 - DNA, 6 bp, Unknown
  misc_feature (1)..( 6): Result.001 file - promoters60/1016343
ttttat

SEQ ID NO: 94564 - DNA, 6 bp, Unknown
  misc_feature (1)..( 6): Result.001 file - promoters60/1016343
ttttat

SEQ ID NO: 94565 - DNA, 7 bp, Unknown
  misc_feature (1)..( 7): Result.001 file - promoters60/1016343
atttata

SEQ ID NO: 94566 - DNA, 7 bp, Unknown
  misc_feature (1)..( 7): Result.001 file - promoters60/1016343
attaata

SEQ ID NO: 94567 - DNA, 6 bp, Unknown
  misc_feature (1)..( 6): Result.001 file - promoters60/1016343
taaatt

SEQ ID NO: 94568 - DNA, 6 bp, Unknown
  misc_feature (1)..( 6): Result.001 file - promoters60/1016343
taaatt

SEQ ID NO: 94569 - DNA, 9 bp, Unknown
  misc_feature (1)..( 9): Result.001 file - promoters60/1016343
atatttttt

SEQ ID NO: 94570 - DNA, 9 bp, Unknown
  misc_feature (1)..( 9): Result.001 file - promoters60/1016343
atatttttt

SEQ ID NO: 94571 - DNA, 6 bp, Unknown
  misc_feature (1)..( 6): Result.001 file - promoters60/1016343
caatat

SEQ ID NO: 94572 - DNA, 6 bp, Unknown
  misc_feature (1)..( 6): Result.001 file - promoters60/1016343
caatat

SEQ ID NO: 94573 - DNA, 9 bp, Unknown
  misc_feature (1)..( 9): Result.001 file - promoters60/1016343
atatcatat

SEQ ID NO: 94574 - DNA, 9 bp, Unknown
  misc_feature (1)..( 9): Result.001 file - promoters60/1016343
atatcatat

SEQ ID NO: 94575 - DNA, 8 bp, Unknown
  misc_feature (1)..( 8): Result.001 file - promoters60/1016343
aaaaaaaa

SEQ ID NO: 94576 - DNA, 8 bp, Unknown
  misc_feature (1)..( 8): Result.001 file - promoters60/1016343
aaaaaaaa

SEQ ID NO: 94577 - DNA, 6 bp, Unknown
  misc_feature (1)..( 6): Result.001 file - promoters60/1016343
aatttt

SEQ ID NO: 94578 - DNA, 6 bp, Unknown
  misc_feature (1)..( 6): Result.001 file - promoters60/1016343
aatttt

SEQ ID NO: 94579 - DNA, 6 bp, Unknown
  misc_feature (1)..( 6): Result.001 file - promoters60/1016343
attttg

SEQ ID NO: 94580 - DNA, 6 bp, Unknown
  misc_feature (1)..( 6): Result.001 file - promoters60/1016343
attttg

SEQ ID NO: 94581 - DNA, 6 bp, Unknown
  misc_feature (1)..( 6): Result.001 file - promoters60/1016343
aatttt

SEQ ID NO: 94582 - DNA, 6 bp, Unknown
  misc_feature (1)..( 6): Result.001 file - promoters60/1016343
aatttt

SEQ ID NO: 94583 - DNA, 7 bp, Unknown
  misc_feature (1)..( 7): Result.001 file - promoters60/1016343
tttcata

SEQ ID NO: 94584 - DNA, 7 bp, Unknown
  misc_feature (1)..( 7): Result.001 file - promoters60/1016343
ttttata

SEQ ID NO: 94585 - DNA, 7 bp, Unknown
  misc_feature (1)..( 7): Result.001 file - promoters60/1016343
tcatatt

SEQ ID NO: 94586 - DNA, 7 bp, Unknown
  misc_feature (1)..( 7): Result.001 file - promoters60/1016343
tcacatt

SEQ ID NO: 94587 - DNA, 6 bp, Unknown
  misc_feature (1)..( 6): Result.001 file - promoters60/1016343
tgctca

SEQ ID NO: 94588 - DNA, 6 bp, Unknown
  misc_feature (1)..( 6): Result.001 file - promoters60/1016343
tgctca

SEQ ID NO: 94589 - DNA, 7 bp, Unknown
  misc_feature (1)..( 7): Result.001 file - promoters60/1016343
tgtgttc

SEQ ID NO: 94590 - DNA, 7 bp, Unknown
  misc_feature (1)..( 7): Result.001 file - promoters60/1016343
tgtgttc

SEQ ID NO: 94591 - DNA, 6 bp, Unknown
  misc_feature (1)..( 6): Result.001 file - promoters60/1016343
ttcaat

SEQ ID NO: 94592 - DNA, 6 bp, Unknown
  misc_feature (1)..( 6): Result.001 file - promoters60/1016382
ttcaat

SEQ ID NO: 94593 - DNA, 7 bp, Unknown
  misc_feature (1)..( 7): Result.001 file - promoters60/1016382
ctgattc

SEQ ID NO: 94594 - DNA, 7 bp, Unknown
  misc_feature (1)..( 7): Result.001 file - promoters60/1016382
ctgattc

SEQ ID NO: 94595 - DNA, 6 bp, Unknown
  misc_feature (1)..( 6): Result.001 file - promoters60/1016382
taggag

SEQ ID NO: 94596 - DNA, 6 bp, Unknown
  misc_feature (1)..( 6): Result.001 file - promoters60/1016382
taggag

SEQ ID NO: 94597 - DNA, 6 bp, Unknown
  misc_feature (1)..( 6): Result.001 file - promoters60/1016382
gaaaga

SEQ ID NO: 94598 - DNA, 6 bp, Unknown
  misc_feature (1)..( 6): Result.001 file - promoters60/1016382
gaaaga

SEQ ID NO: 94599 - DNA, 6 bp, Unknown
  misc_feature (1)..( 6): Result.001 file - promoters60/1016382
cttttg

SEQ ID NO: 94600 - DNA, 6 bp, Unknown
  misc_feature (1)..( 6): Result.001 file - promoters60/1016382
cttttg

SEQ ID NO: 94601 - DNA, 6 bp, Unknown
  misc_feature (1)..( 6): Result.001 file - promoters60/1016382
tttacc

SEQ ID NO: 94602 - DNA, 6 bp, Unknown
  misc_feature (1)..( 6): Result.001 file - promoters60/1016382
tttacc

SEQ ID NO: 94603 - DNA, 11 bp, Unknown
  misc_feature (1)..( 11): Result.001 file - promoters60/1016382
ttttaatatat

SEQ ID NO: 94604 - DNA, 11 bp, Unknown
  misc_feature (1)..( 11): Result.001 file - promoters60/1016382
atttcatatcc

SEQ ID NO: 94605 - DNA, 11 bp, Unknown
  misc_feature (1)..( 11): Result.001 file - promoters60/1016382
ttttaatctat

SEQ ID NO: 94606 - DNA, 6 bp, Unknown
  misc_feature (1)..( 6): Result.001 file - promoters60/1016382
gttagt

SEQ ID NO: 94607 - DNA, 6 bp, Unknown
  misc_feature (1)..( 6): Result.001 file - promoters60/1016382
gttagt

SEQ ID NO: 94608 - DNA, 6 bp, Unknown
  misc_feature (1)..( 6): Result.001 file - promoters60/1016382
taaaaa

SEQ ID NO: 94609 - DNA, 6 bp, Unknown
  misc_feature (1)..( 6): Result.001 file - promoters60/1016382
taaaaa

SEQ ID NO: 94610 - DNA, 6 bp, Unknown
  misc_feature (1)..( 6): Result.001 file - promoters60/1016382
gagtgt

SEQ ID NO: 94611 - DNA, 6 bp, Unknown
  misc_feature (1)..( 6): Result.001 file - promoters60/1016382
gagtgt

SEQ ID NO: 94612 - DNA, 7 bp, Unknown
  misc_feature (1)..( 7): Result.001 file - promoters60/1016382
tctctaa

SEQ ID NO: 94613 - DNA, 7 bp, Unknown
  misc_feature (1)..( 7): Result.001 file - promoters60/1016382
tctgtaa

SEQ ID NO: 94614 - DNA, 6 bp, Unknown
  misc_feature (1)..( 6): Result.001 file - promoters60/1016382
ttcaaa

SEQ ID NO: 94615 - DNA, 6 bp, Unknown
  misc_feature (1)..( 6): Result.001 file - promoters60/1016382
ttcaaa

SEQ ID NO: 94616 - DNA, 6 bp, Unknown
  misc_feature (1)..( 6): Result.001 file - promoters60/1016382
gtttaa

SEQ ID NO: 94617 - DNA, 6 bp, Unknown
  misc_feature (1)..( 6): Result.001 file - promoters60/1016382
gtttaa

SEQ ID NO: 94618 - DNA, 6 bp, Unknown
  misc_feature (1)..( 6): Result.001 file - promoters60/1016382
tactgt

SEQ ID NO: 94619 - DNA, 6 bp, Unknown
  misc_feature (1)..( 6): Result.001 file - promoters60/1016382
tactgt

SEQ ID NO: 94620 - DNA, 9 bp, Unknown
  misc_feature (1)..( 9): Result.001 file - promoters60/1016382
tcaaaattt

SEQ ID NO: 94621 - DNA, 9 bp, Unknown
  misc_feature (1)..( 9): Result.001 file - promoters60/1016382
tcagaattt

SEQ ID NO: 94622 - DNA, 6 bp, Unknown
  misc_feature (1)..( 6): Result.001 file - promoters60/1016382
ttgaaa

SEQ ID NO: 94623 - DNA, 6 bp, Unknown
  misc_feature (1)..( 6): Result.001 file - promoters60/1016382
ttgaaa

SEQ ID NO: 94624 - DNA, 7 bp, Unknown
  misc_feature (1)..( 7): Result.001 file - promoters60/1016382
cttctcc

SEQ ID NO: 94625 - DNA, 7 bp, Unknown
  misc_feature (1)..( 7): Result.001 file - promoters60/1016382
cttgtcc

SEQ ID NO: 94626 - DNA, 7 bp, Unknown
  misc_feature (1)..( 7): Result.001 file - promoters60/1016382
ttcatgt

SEQ ID NO: 94627 - DNA, 7 bp, Unknown
  misc_feature (1)..( 7): Result.001 file - promoters60/1016382
ttcatgt

SEQ ID NO: 94628 - DNA, 7 bp, Unknown
  misc_feature (1)..( 7): Result.001 file - promoters60/1016382
aagcttt

SEQ ID NO: 94629 - DNA, 7 bp, Unknown
  misc_feature (1)..( 7): Result.001 file - promoters60/1016382
aagattt

SEQ ID NO: 94630 - DNA, 10 bp, Unknown
  misc_feature (1)..( 10): Result.001 file - promoters60/1016382
atattttttt

SEQ ID NO: 94631 - DNA, 10 bp, Unknown
  misc_feature (1)..( 10): Result.001 file - promoters60/1016382
atattttttt

SEQ ID NO: 94632 - DNA, 7 bp, Unknown
  misc_feature (1)..( 7): Result.001 file - promoters60/1016382
tacctca

SEQ ID NO: 94633 - DNA, 7 bp, Unknown
  misc_feature (1)..( 7): Result.001 file - promoters60/1016382
tacctca

SEQ ID NO: 94634 - DNA, 7 bp, Unknown
  misc_feature (1)..( 7): Result.001 file - promoters60/1016382
ttttata

SEQ ID NO: 94635 - DNA, 7 bp, Unknown
  misc_feature (1)..( 7): Result.001 file - promoters60/1016382
tttgata

SEQ ID NO: 94636 - DNA, 9 bp, Unknown
  misc_feature (1)..( 9): Result.001 file - promoters60/1016382
catccttat

SEQ ID NO: 94637 - DNA, 9 bp, Unknown
  misc_feature (1)..( 9): Result.001 file - promoters60/1016418
catcattat

SEQ ID NO: 94638 - DNA, 8 bp, Unknown
  misc_feature (1)..( 8): Result.001 file - promoters60/1016418
taattaat

SEQ ID NO: 94639 - DNA, 8 bp, Unknown
  misc_feature (1)..( 8): Result.001 file - promoters60/1016418
taatcaat

SEQ ID NO: 94640 - DNA, 8 bp, Unknown
  misc_feature (1)..( 8): Result.001 file - promoters60/1016418
atatcaat

SEQ ID NO: 94641 - DNA, 9 bp, Unknown
  misc_feature (1)..( 9): Result.001 file - promoters60/1016418
ttatttgga

SEQ ID NO: 94642 - DNA, 9 bp, Unknown
  misc_feature (1)..( 9): Result.001 file - promoters60/1016418
atatttgtt

SEQ ID NO: 94643 - DNA, 9 bp, Unknown
  misc_feature (1)..( 9): Result.001 file - promoters60/1016418
ttatgtgga

SEQ ID NO: 94644 - DNA, 7 bp, Unknown
  misc_feature (1)..( 7): Result.001 file - promoters60/1016418
tataaat

SEQ ID NO: 94645 - DNA, 7 bp, Unknown
  misc_feature (1)..( 7): Result.001 file - promoters60/1016418
tataaat

SEQ ID NO: 94646 - DNA, 7 bp, Unknown
  misc_feature (1)..( 7): Result.001 file - promoters60/1016418
tataaaa

SEQ ID NO: 94647 - DNA, 8 bp, Unknown
  misc_feature (1)..( 8): Result.001 file - promoters60/1016418
attgatga

SEQ ID NO: 94648 - DNA, 8 bp, Unknown
  misc_feature (1)..( 8): Result.001 file - promoters60/1016418
tttgttga

SEQ ID NO: 94649 - DNA, 8 bp, Unknown
  misc_feature (1)..( 8): Result.001 file - promoters60/1016418
gtttatgt

SEQ ID NO: 94650 - DNA, 6 bp, Unknown
  misc_feature (1)..( 6): Result.001 file - promoters60/1016418
agcaat

SEQ ID NO: 94651 - DNA, 6 bp, Unknown
  misc_feature (1)..( 6): Result.001 file - promoters60/1016418
agcaat

SEQ ID NO: 94652 - DNA, 6 bp, Unknown
  misc_feature (1)..( 6): Result.001 file - promoters60/1016426
agcaat

SEQ ID NO: 94653 - DNA, 7 bp, Unknown
  misc_feature (1)..( 7): Result.001 file - promoters60/1016426
aatagga

SEQ ID NO: 94654 - DNA, 7 bp, Unknown
  misc_feature (1)..( 7): Result.001 file - promoters60/1016426
aatagga

SEQ ID NO: 94655 - DNA, 9 bp, Unknown
  misc_feature (1)..( 9): Result.001 file - promoters60/1016426
tagaaatac

SEQ ID NO: 94656 - DNA, 9 bp, Unknown
  misc_feature (1)..( 9): Result.001 file - promoters60/1016426
tagcaatac

SEQ ID NO: 94657 - DNA, 9 bp, Unknown
  misc_feature (1)..( 9): Result.001 file - promoters60/1016426
gaaagttaa

SEQ ID NO: 94658 - DNA, 9 bp, Unknown
  misc_feature (1)..( 9): Result.001 file - promoters60/1016426
gaaggtttt

SEQ ID NO: 94659 - DNA, 9 bp, Unknown
  misc_feature (1)..( 9): Result.001 file - promoters60/1016426
caaaattaa

SEQ ID NO: 94660 - DNA, 6 bp, Unknown
  misc_feature (1)..( 6): Result.001 file - promoters60/1016426
aatttt

SEQ ID NO: 94661 - DNA, 6 bp, Unknown
  misc_feature (1)..( 6): Result.001 file - promoters60/1016426
aatttt

SEQ ID NO: 94662 - DNA, 8 bp, Unknown
  misc_feature (1)..( 8): Result.001 file - promoters60/1016426
tttaaatt

SEQ ID NO: 94663 - DNA, 8 bp, Unknown
  misc_feature (1)..( 8): Result.001 file - promoters60/1016426
tttcaatt

SEQ ID NO: 94664 - DNA, 6 bp, Unknown
  misc_feature (1)..( 6): Result.001 file - promoters60/1016426
cctaaa

SEQ ID NO: 94665 - DNA, 6 bp, Unknown
  misc_feature (1)..( 6): Result.001 file - promoters60/1016426
cctaaa

SEQ ID NO: 94666 - DNA, 11 bp, Unknown
  misc_feature (1)..( 11): Result.001 file - promoters60/1016426
taaaatattga

SEQ ID NO: 94667 - DNA, 11 bp, Unknown
  misc_feature (1)..( 11): Result.001 file - promoters60/1016426
taaattattga

SEQ ID NO: 94668 - DNA, 12 bp, Unknown
  misc_feature (1)..( 12): Result.001 file - promoters60/1016426
gaaaagcaaaac

SEQ ID NO: 94669 - DNA, 12 bp, Unknown
  misc_feature (1)..( 12): Result.001 file - promoters60/1016426
gaagagcaaaac

SEQ ID NO: 94670 - DNA, 9 bp, Unknown
  misc_feature (1)..( 9): Result.001 file - promoters60/1016426
ttaaatttt

SEQ ID NO: 94671 - DNA, 9 bp, Unknown
  misc_feature (1)..( 9): Result.001 file - promoters60/1016426
ttaattttt

SEQ ID NO: 94672 - DNA, 7 bp, Unknown
  misc_feature (1)..( 7): Result.001 file - promoters60/1016426
caattgt

SEQ ID NO: 94673 - DNA, 7 bp, Unknown
  misc_feature (1)..( 7): Result.001 file - promoters60/1016426
caagtgt

SEQ ID NO: 94674 - DNA, 7 bp, Unknown
  misc_feature (1)..( 7): Result.001 file - promoters60/1016426
ctgattt

SEQ ID NO: 94675 - DNA, 7 bp, Unknown
  misc_feature (1)..( 7): Result.001 file - promoters60/1016426
ctgtttt

SEQ ID NO: 94676 - DNA, 6 bp, Unknown
  misc_feature (1)..( 6): Result.001 file - promoters60/1016426
tcttcc

SEQ ID NO: 94677 - DNA, 6 bp, Unknown
  misc_feature (1)..( 6): Result.001 file - promoters60/1016426
tcttcc

SEQ ID NO: 94678 - DNA, 8 bp, Unknown
  misc_feature (1)..( 8): Result.001 file - promoters60/1016426
ctctctcg

SEQ ID NO: 94679 - DNA, 8 bp, Unknown
  misc_feature (1)..( 8): Result.001 file - promoters60/1016468
ctctctcg

SEQ ID NO: 94680 - DNA, 10 bp, Unknown
  misc_feature (1)..( 10): Result.001 file - promoters60/1016468
ctacaacaaa

SEQ ID NO: 94681 - DNA, 10 bp, Unknown
  misc_feature (1)..( 10): Result.001 file - promoters60/1016468
gaaaaacaaa

SEQ ID NO: 94682 - DNA, 10 bp, Unknown
  misc_feature (1)..( 10): Result.001 file - promoters60/1016468
acggaacaaa

SEQ ID NO: 94683 - DNA, 10 bp, Unknown
  misc_feature (1)..( 10): Result.001 file - promoters60/1016468
gtcaaacaaa

SEQ ID NO: 94684 - DNA, 10 bp, Unknown
  misc_feature (1)..( 10): Result.001 file - promoters60/1016468
tttaaaaaaa

SEQ ID NO: 94685 - DNA, 10 bp, Unknown
  misc_feature (1)..( 10): Result.001 file - promoters60/1016468
tataagaaaa

SEQ ID NO: 94686 - DNA, 10 bp, Unknown
  misc_feature (1)..( 10): Result.001 file - promoters60/1016468
tatgagaaat

SEQ ID NO: 94687 - DNA, 11 bp, Unknown
  misc_feature (1)..( 11): Result.001 file - promoters60/1016468
ccactatataa

SEQ ID NO: 94688 - DNA, 11 bp, Unknown
  misc_feature (1)..( 11): Result.001 file - promoters60/1016468
ccattatatat

SEQ ID NO: 94689 - DNA, 11 bp, Unknown
  misc_feature (1)..( 11): Result.001 file - promoters60/1016468
caaccatataa

SEQ ID NO: 94690 - DNA, 11 bp, Unknown
  misc_feature (1)..( 11): Result.001 file - promoters60/1016468
cgcctatatat

SEQ ID NO: 94691 - DNA, 11 bp, Unknown
  misc_feature (1)..( 11): Result.001 file - promoters60/1016468
gtgagatataa

SEQ ID NO: 94692 - DNA, 11 bp, Unknown
  misc_feature (1)..( 11): Result.001 file - promoters60/1016468
cacatatatat

SEQ ID NO: 94693 - DNA, 11 bp, Unknown
  misc_feature (1)..( 11): Result.001 file - promoters60/1016468
gaattctttaa

SEQ ID NO: 94694 - DNA, 11 bp, Unknown
  misc_feature (1)..( 11): Result.001 file - promoters60/1016468
aaatccttaat

SEQ ID NO: 94695 - DNA, 11 bp, Unknown
  misc_feature (1)..( 11): Result.001 file - promoters60/1016468
taattattttg

SEQ ID NO: 94696 - DNA, 11 bp, Unknown
  misc_feature (1)..( 11): Result.001 file - promoters60/1016468
taattcttttc

SEQ ID NO: 94697 - DNA, 11 bp, Unknown
  misc_feature (1)..( 11): Result.001 file - promoters60/1016468
atattattagt

SEQ ID NO: 94698 - DNA, 11 bp, Unknown
  misc_feature (1)..( 11): Result.001 file - promoters60/1016468
taatgattttg

SEQ ID NO: 94699 - DNA, 9 bp, Unknown
  misc_feature (1)..( 9): Result.001 file - promoters60/1016468
tgtttgatt

SEQ ID NO: 94700 - DNA, 9 bp, Unknown
  misc_feature (1)..( 9): Result.001 file - promoters60/1016468
tatttcatt

SEQ ID NO: 94701 - DNA, 9 bp, Unknown
  misc_feature (1)..( 9): Result.001 file - promoters60/1016468
atttttatt

SEQ ID NO: 94702 - DNA, 9 bp, Unknown
  misc_feature (1)..( 9): Result.001 file - promoters60/1016468
tatatcaca

SEQ ID NO: 94703 - DNA, 9 bp, Unknown
  misc_feature (1)..( 9): Result.001 file - promoters60/1016468
tagtagatc

SEQ ID NO: 94704 - DNA, 9 bp, Unknown
  misc_feature (1)..( 9): Result.001 file - promoters60/1016468
ttttttaca

SEQ ID NO: 94705 - DNA, 11 bp, Unknown
  misc_feature (1)..( 11): Result.001 file - promoters60/1016468
ccttgagttta

SEQ ID NO: 94706 - DNA, 11 bp, Unknown
  misc_feature (1)..( 11): Result.001 file - promoters60/1016468
ttttgactttt

SEQ ID NO: 94707 - DNA, 11 bp, Unknown
  misc_feature (1)..( 11): Result.001 file - promoters60/1016468
tgttgaatttt

SEQ ID NO: 94708 - DNA, 11 bp, Unknown
  misc_feature (1)..( 11): Result.001 file - promoters60/1016468
cgttggcttct

SEQ ID NO: 94709 - DNA, 11 bp, Unknown
  misc_feature (1)..( 11): Result.001 file - promoters60/1016468
attctaatttt

SEQ ID NO: 94710 - DNA, 11 bp, Unknown
  misc_feature (1)..( 11): Result.001 file - promoters60/1016468
agttaactttg

SEQ ID NO: 94711 - DNA, 11 bp, Unknown
  misc_feature (1)..( 11): Result.001 file - promoters60/1016468
agtcaacttgt

SEQ ID NO: 94712 - DNA, 14 bp, Unknown
  misc_feature (1)..( 14): Result.001 file - promoters60/1016468
atattattagtagg

SEQ ID NO: 94713 - DNA, 14 bp, Unknown
  misc_feature (1)..( 14): Result.001 file - promoters60/1016468
ttattatattgaga

SEQ ID NO: 94714 - DNA, 14 bp, Unknown
  misc_feature (1)..( 14): Result.001 file - promoters60/1016468
atataattattttg

SEQ ID NO: 94715 - DNA, 14 bp, Unknown
  misc_feature (1)..( 14): Result.001 file - promoters60/1016468
ccttaattaccgat

SEQ ID NO: 94716 - DNA, 14 bp, Unknown
  misc_feature (1)..( 14): Result.001 file - promoters60/1016468
gattaattcttttc

SEQ ID NO: 94717 - DNA, 14 bp, Unknown
  misc_feature (1)..( 14): Result.001 file - promoters60/1016468
ttttaatgattttg

SEQ ID NO: 94718 - DNA, 9 bp, Unknown
  misc_feature (1)..( 9): Result.001 file - promoters60/1016468
aatgaaaaa

SEQ ID NO: 94719 - DNA, 9 bp, Unknown
  misc_feature (1)..( 9): Result.001 file - promoters60/1016468
aatgaaatt

SEQ ID NO: 94720 - DNA, 10 bp, Unknown
  misc_feature (1)..( 10): Result.001 file - promoters60/1016468
tatgagaaat

SEQ ID NO: 94721 - DNA, 10 bp, Unknown
  misc_feature (1)..( 10): Result.001 file - promoters60/1016468
aatgatattc

SEQ ID NO: 94722 - DNA, 10 bp, Unknown
  misc_feature (1)..( 10): Result.001 file - promoters60/1016468
aatgttattt

SEQ ID NO: 94723 - DNA, 10 bp, Unknown
  misc_feature (1)..( 10): Result.001 file - promoters60/1016468
ctatttattt

SEQ ID NO: 94724 - DNA, 13 bp, Unknown
  misc_feature (1)..( 13): Result.001 file - promoters60/1016468
cgttaatttttga

SEQ ID NO: 94725 - DNA, 13 bp, Unknown
  misc_feature (1)..( 13): Result.001 file - promoters60/1016468
ttctaattttcta

SEQ ID NO: 94726 - DNA, 13 bp, Unknown
  misc_feature (1)..( 13): Result.001 file - promoters60/1016468
gttgaattttttt

SEQ ID NO: 94727 - DNA, 13 bp, Unknown
  misc_feature (1)..( 13): Result.001 file - promoters60/1016468
agttaactttgta

SEQ ID NO: 94728 - DNA, 13 bp, Unknown
  misc_feature (1)..( 13): Result.001 file - promoters60/1016468
tcatcacttggta

SEQ ID NO: 94729 - DNA, 13 bp, Unknown
  misc_feature (1)..( 13): Result.001 file - promoters60/1016514
agtcaacttgtac

SEQ ID NO: 94730 - DNA, 9 bp, Unknown
  misc_feature (1)..( 9): Result.001 file - promoters60/1016514
taagaaaat

SEQ ID NO: 94731 - DNA, 9 bp, Unknown
  misc_feature (1)..( 9): Result.001 file - promoters60/1016514
taacaaaat

SEQ ID NO: 94732 - DNA, 9 bp, Unknown
  misc_feature (1)..( 9): Result.001 file - promoters60/1016514
aaagaaaaa

SEQ ID NO: 94733 - DNA, 10 bp, Unknown
  misc_feature (1)..( 10): Result.001 file - promoters60/1016514
gtagcatata

SEQ ID NO: 94734 - DNA, 10 bp, Unknown
  misc_feature (1)..( 10): Result.001 file - promoters60/1016514
gtagcaaata

SEQ ID NO: 94735 - DNA, 7 bp, Unknown
  misc_feature (1)..( 7): Result.001 file - promoters60/1016514
tttctgt

SEQ ID NO: 94736 - DNA, 7 bp, Unknown
  misc_feature (1)..( 7): Result.001 file - promoters60/1016514
tttgtgt

SEQ ID NO: 94737 - DNA, 9 bp, Unknown
  misc_feature (1)..( 9): Result.001 file - promoters60/1016514
atgttgaca

SEQ ID NO: 94738 - DNA, 9 bp, Unknown
  misc_feature (1)..( 9): Result.001 file - promoters60/1016514
atggtgaca

SEQ ID NO: 94739 - DNA, 8 bp, Unknown
  misc_feature (1)..( 8): Result.001 file - promoters60/1016514
atataaca

SEQ ID NO: 94740 - DNA, 8 bp, Unknown
  misc_feature (1)..( 8): Result.001 file - promoters60/1016514
atacaaca

SEQ ID NO: 94741 - DNA, 8 bp, Unknown
  misc_feature (1)..( 8): Result.001 file - promoters60/1016514
aaacttct

SEQ ID NO: 94742 - DNA, 8 bp, Unknown
  misc_feature (1)..( 8): Result.001 file - promoters60/1016514
aaaattct

SEQ ID NO: 94743 - DNA, 8 bp, Unknown
  misc_feature (1)..( 8): Result.001 file - promoters60/1016514
taatttta

SEQ ID NO: 94744 - DNA, 8 bp, Unknown
  misc_feature (1)..( 8): Result.001 file - promoters60/1016514
taatatta

SEQ ID NO: 94745 - DNA, 6 bp, Unknown
  misc_feature (1)..( 6): Result.001 file - promoters60/1016514
atacca

SEQ ID NO: 94746 - DNA, 6 bp, Unknown
  misc_feature (1)..( 6): Result.001 file - promoters60/1016514
atacca

SEQ ID NO: 94747 - DNA, 8 bp, Unknown
  misc_feature (1)..( 8): Result.001 file - promoters60/1016514
ttaatttt

SEQ ID NO: 94748 - DNA, 8 bp, Unknown
  misc_feature (1)..( 8): Result.001 file - promoters60/1016514
ttagtttt

SEQ ID NO: 94749 - DNA, 16 bp, Unknown
  misc_feature (1)..( 16): Result.001 file - promoters60/1016514
ttttctgaactagaag

SEQ ID NO: 94750 - DNA, 16 bp, Unknown
  misc_feature (1)..( 16): Result.001 file - promoters60/1016514
ttttccgaaatagtta

SEQ ID NO: 94751 - DNA, 16 bp, Unknown
  misc_feature (1)..( 16): Result.001 file - promoters60/1016514
ataattcaaataatta

SEQ ID NO: 94752 - DNA, 7 bp, Unknown
  misc_feature (1)..( 7): Result.001 file - promoters60/1016514
attttat

SEQ ID NO: 94753 - DNA, 7 bp, Unknown
  misc_feature (1)..( 7): Result.001 file - promoters60/1016514
attgtat

SEQ ID NO: 94754 - DNA, 6 bp, Unknown
  misc_feature (1)..( 6): Result.001 file - promoters60/1016514
tatata

SEQ ID NO: 94755 - DNA, 6 bp, Unknown
  misc_feature (1)..( 6): Result.001 file - promoters60/1016514
tatata

SEQ ID NO: 94756 - DNA, 6 bp, Unknown
  misc_feature (1)..( 6): Result.001 file - promoters60/1016514
atatat

SEQ ID NO: 94757 - DNA, 6 bp, Unknown
  misc_feature (1)..( 6): Result.001 file - promoters60/1016514
atatat

SEQ ID NO: 94758 - DNA, 7 bp, Unknown
  misc_feature (1)..( 7): Result.001 file - promoters60/1016514
atctttt

SEQ ID NO: 94759 - DNA, 7 bp, Unknown
  misc_feature (1)..( 7): Result.001 file - promoters60/1016514
atctttt

SEQ ID NO: 94760 - DNA, 9 bp, Unknown
  misc_feature (1)..( 9): Result.001 file - promoters60/1016514
tttacggtt

SEQ ID NO: 94761 - DNA, 9 bp, Unknown
  misc_feature (1)..( 9): Result.001 file - promoters60/1016514
tttaaggtt

SEQ ID NO: 94762 - DNA, 7 bp, Unknown
  misc_feature (1)..( 7): Result.001 file - promoters60/1016514
tatttgt

SEQ ID NO: 94763 - DNA, 7 bp, Unknown
  misc_feature (1)..( 7): Result.001 file - promoters60/1016514
tatatgt

SEQ ID NO: 94764 - DNA, 7 bp, Unknown
  misc_feature (1)..( 7): Result.001 file - promoters60/1016514
taatatt

SEQ ID NO: 94765 - DNA, 7 bp, Unknown
  misc_feature (1)..( 7): Result.001 file - promoters60/1016514
taaaatt

SEQ ID NO: 94766 - DNA, 8 bp, Unknown
  misc_feature (1)..( 8): Result.001 file - promoters60/1016514
ttatttta

SEQ ID NO: 94767 - DNA, 8 bp, Unknown
  misc_feature (1)..( 8): Result.001 file - promoters60/1016514
ttagttta

SEQ ID NO: 94768 - DNA, 6 bp, Unknown
  misc_feature (1)..( 6): Result.001 file - promoters60/1016514
ttaatg

SEQ ID NO: 94769 - DNA, 6 bp, Unknown
  misc_feature (1)..( 6): Result.001 file - promoters60/1016514
ttaatg

SEQ ID NO: 94770 - DNA, 11 bp, Unknown
  misc_feature (1)..( 11): Result.001 file - promoters60/1016514
atagaaatatc

SEQ ID NO: 94771 - DNA, 11 bp, Unknown
  misc_feature (1)..( 11): Result.001 file - promoters60/1016514
atagatatatc

SEQ ID NO: 94772 - DNA, 6 bp, Unknown
  misc_feature (1)..( 6): Result.001 file - promoters60/1016514
tatttg

SEQ ID NO: 94773 - DNA, 6 bp, Unknown
  misc_feature (1)..( 6): Result.001 file - promoters60/1016514
tatttg

SEQ ID NO: 94774 - DNA, 6 bp, Unknown
  misc_feature (1)..( 6): Result.001 file - promoters60/1016514
tttcaa

SEQ ID NO: 94775 - DNA, 6 bp, Unknown
  misc_feature (1)..( 6): Result.001 file - promoters60/1016514
tttcaa

SEQ ID NO: 94776 - DNA, 6 bp, Unknown
  misc_feature (1)..( 6): Result.001 file - promoters60/1016514
aacatt

SEQ ID NO: 94777 - DNA, 6 bp, Unknown
  misc_feature (1)..( 6): Result.001 file - promoters60/1016514
aacatt

SEQ ID NO: 94778 - DNA, 6 bp, Unknown
  misc_feature (1)..( 6): Result.001 file - promoters60/1016514
taaaaa

SEQ ID NO: 94779 - DNA, 6 bp, Unknown
  misc_feature (1)..( 6): Result.001 file - promoters60/1016514
taaaaa

SEQ ID NO: 94780 - DNA, 10 bp, Unknown
  misc_feature (1)..( 10): Result.001 file - promoters60/1016514
aaaattatat

SEQ ID NO: 94781 - DNA, 10 bp, Unknown
  misc_feature (1)..( 10): Result.001 file - promoters60/1016514
aaaatcatat

SEQ ID NO: 94782 - DNA, 6 bp, Unknown
  misc_feature (1)..( 6): Result.001 file - promoters60/1016514
ggaaaa

SEQ ID NO: 94783 - DNA, 6 bp, Unknown
  misc_feature (1)..( 6): Result.001 file - promoters60/1016514
ggaaaa

SEQ ID NO: 94784 - DNA, 6 bp, Unknown
  misc_feature (1)..( 6): Result.001 file - promoters60/1016514
aatttt

SEQ ID NO: 94785 - DNA, 6 bp, Unknown
  misc_feature (1)..( 6): Result.001 file - promoters60/1016514
aatttt

SEQ ID NO: 94786 - DNA, 6 bp, Unknown
  misc_feature (1)..( 6): Result.001 file - promoters60/1016514
ataatt

SEQ ID NO: 94787 - DNA, 6 bp, Unknown
  misc_feature (1)..( 6): Result.001 file - promoters60/1016514
ataatt

SEQ ID NO: 94788 - DNA, 7 bp, Unknown
  misc_feature (1)..( 7): Result.001 file - promoters60/1016514
ctataaa

SEQ ID NO: 94789 - DNA, 7 bp, Unknown
  misc_feature (1)..( 7): Result.001 file - promoters60/1016525
ctacaaa

SEQ ID NO: 94790 - DNA, 8 bp, Unknown
  misc_feature (1)..( 8): Result.001 file - promoters60/1016525
ctttttaa

SEQ ID NO: 94791 - DNA, 8 bp, Unknown
  misc_feature (1)..( 8): Result.001 file - promoters60/1016525
cttattat

SEQ ID NO: 94792 - DNA, 8 bp, Unknown
  misc_feature (1)..( 8): Result.001 file - promoters60/1016525
ttttgtaa

SEQ ID NO: 94793 - DNA, 14 bp, Unknown
  misc_feature (1)..( 14): Result.001 file - promoters60/1016525
cgataagtatctca

SEQ ID NO: 94794 - DNA, 14 bp, Unknown
  misc_feature (1)..( 14): Result.001 file - promoters60/1016525
atgaaaatatatca

SEQ ID NO: 94795 - DNA, 14 bp, Unknown
  misc_feature (1)..( 14): Result.001 file - promoters60/1016525
ttaaaaatataatt

SEQ ID NO: 94796 - DNA, 14 bp, Unknown
  misc_feature (1)..( 14): Result.001 file - promoters60/1016525
ttacaaattatcaa

SEQ ID NO: 94797 - DNA, 11 bp, Unknown
  misc_feature (1)..( 11): Result.001 file - promoters60/1016525
taaaaactaga

SEQ ID NO: 94798 - DNA, 11 bp, Unknown
  misc_feature (1)..( 11): Result.001 file - promoters60/1016525
gaaaaattagt

SEQ ID NO: 94799 - DNA, 11 bp, Unknown
  misc_feature (1)..( 11): Result.001 file - promoters60/1016525
aggctactaga

SEQ ID NO: 94800 - DNA, 11 bp, Unknown
  misc_feature (1)..( 11): Result.001 file - promoters60/1016525
taataactaat

SEQ ID NO: 94801 - DNA, 7 bp, Unknown
  misc_feature (1)..( 7): Result.001 file - promoters60/1016525
caataaa

SEQ ID NO: 94802 - DNA, 7 bp, Unknown
  misc_feature (1)..( 7): Result.001 file - promoters60/1016525
caataat

SEQ ID NO: 94803 - DNA, 7 bp, Unknown
  misc_feature (1)..( 7): Result.001 file - promoters60/1016525
caaaaaa

SEQ ID NO: 94804 - DNA, 7 bp, Unknown
  misc_feature (1)..( 7): Result.001 file - promoters60/1016525
taataaa

SEQ ID NO: 94805 - DNA, 6 bp, Unknown
  misc_feature (1)..( 6): Result.001 file - promoters60/1016525
aagata

SEQ ID NO: 94806 - DNA, 6 bp, Unknown
  misc_feature (1)..( 6): Result.001 file - promoters60/1016525
aagata

SEQ ID NO: 94807 - DNA, 6 bp, Unknown
  misc_feature (1)..( 6): Result.001 file - promoters60/1016525
aagata

SEQ ID NO: 94808 - DNA, 7 bp, Unknown
  misc_feature (1)..( 7): Result.001 file - promoters60/1016525
tttaaaa

SEQ ID NO: 94809 - DNA, 7 bp, Unknown
  misc_feature (1)..( 7): Result.001 file - promoters60/1016525
cttaaaa

SEQ ID NO: 94810 - DNA, 7 bp, Unknown
  misc_feature (1)..( 7): Result.001 file - promoters60/1016525
tttaaac

SEQ ID NO: 94811 - DNA, 7 bp, Unknown
  misc_feature (1)..( 7): Result.001 file - promoters60/1016525
aataaac

SEQ ID NO: 94812 - DNA, 7 bp, Unknown
  misc_feature (1)..( 7): Result.001 file - promoters60/1016525
tataaac

SEQ ID NO: 94813 - DNA, 7 bp, Unknown
  misc_feature (1)..( 7): Result.001 file - promoters60/1016525
aataaat

SEQ ID NO: 94814 - DNA, 8 bp, Unknown
  misc_feature (1)..( 8): Result.001 file - promoters60/1016525
agaaaaat

SEQ ID NO: 94815 - DNA, 8 bp, Unknown
  misc_feature (1)..( 8): Result.001 file - promoters60/1016525
aaaaaaat

SEQ ID NO: 94816 - DNA, 8 bp, Unknown
  misc_feature (1)..( 8): Result.001 file - promoters60/1016525
agaaaaaa

SEQ ID NO: 94817 - DNA, 9 bp, Unknown
  misc_feature (1)..( 9): Result.001 file - promoters60/1016525
attttaaaa

SEQ ID NO: 94818 - DNA, 9 bp, Unknown
  misc_feature (1)..( 9): Result.001 file - promoters60/1016525
attctaacg

SEQ ID NO: 94819 - DNA, 9 bp, Unknown
  misc_feature (1)..( 9): Result.001 file - promoters60/1016525
catttaaaa

SEQ ID NO: 94820 - DNA, 11 bp, Unknown
  misc_feature (1)..( 11): Result.001 file - promoters60/1016525
agaaaaacagg

SEQ ID NO: 94821 - DNA, 11 bp, Unknown
  misc_feature (1)..( 11): Result.001 file - promoters60/1016525
ataaaaacttt

SEQ ID NO: 94822 - DNA, 11 bp, Unknown
  misc_feature (1)..( 11): Result.001 file - promoters60/1016525
atataaacttt

SEQ ID NO: 94823 - DNA, 8 bp, Unknown
  misc_feature (1)..( 8): Result.001 file - promoters60/1016525
gctataaa

SEQ ID NO: 94824 - DNA, 8 bp, Unknown
  misc_feature (1)..( 8): Result.001 file - promoters60/1016525
tatataaa

SEQ ID NO: 94825 - DNA, 8 bp, Unknown
  misc_feature (1)..( 8): Result.001 file - promoters60/1016525
tatataat

SEQ ID NO: 94826 - DNA, 11 bp, Unknown
  misc_feature (1)..( 11): Result.001 file - promoters60/1016525
atgaaaatata

SEQ ID NO: 94827 - DNA, 11 bp, Unknown
  misc_feature (1)..( 11): Result.001 file - promoters60/1016525
ttaaaaatata

SEQ ID NO: 94828 - DNA, 11 bp, Unknown
  misc_feature (1)..( 11): Result.001 file - promoters60/1016525
ttacaaattat

SEQ ID NO: 94829 - DNA, 6 bp, Unknown
  misc_feature (1)..( 6): Result.001 file - promoters60/1016525
tttgaa

SEQ ID NO: 94830 - DNA, 6 bp, Unknown
  misc_feature (1)..( 6): Result.001 file - promoters60/1016525
tttgaa

SEQ ID NO: 94831 - DNA, 6 bp, Unknown
  misc_feature (1)..( 6): Result.001 file - promoters60/1016624
tttgaa

SEQ ID NO: 94832 - DNA, 7 bp, Unknown
  misc_feature (1)..( 7): Result.001 file - promoters60/1016624
ttgtttc

SEQ ID NO: 94833 - DNA, 7 bp, Unknown
  misc_feature (1)..( 7): Result.001 file - promoters60/1016624
ctgtttc

SEQ ID NO: 94834 - DNA, 7 bp, Unknown
  misc_feature (1)..( 7): Result.001 file - promoters60/1016624
ttgtttt

SEQ ID NO: 94835 - DNA, 8 bp, Unknown
  misc_feature (1)..( 8): Result.001 file - promoters60/1016624
gatctact

SEQ ID NO: 94836 - DNA, 8 bp, Unknown
  misc_feature (1)..( 8): Result.001 file - promoters60/1016624
tctctact

SEQ ID NO: 94837 - DNA, 8 bp, Unknown
  misc_feature (1)..( 8): Result.001 file - promoters60/1016624
gatctacc

SEQ ID NO: 94838 - DNA, 8 bp, Unknown
  misc_feature (1)..( 8): Result.001 file - promoters60/1016624
ttcaactt

SEQ ID NO: 94839 - DNA, 8 bp, Unknown
  misc_feature (1)..( 8): Result.001 file - promoters60/1016624
gtcaactt

SEQ ID NO: 94840 - DNA, 8 bp, Unknown
  misc_feature (1)..( 8): Result.001 file - promoters60/1016624
ttcaacga

SEQ ID NO: 94841 - DNA, 7 bp, Unknown
  misc_feature (1)..( 7): Result.001 file - promoters60/1016624
taatgaa

SEQ ID NO: 94842 - DNA, 7 bp, Unknown
  misc_feature (1)..( 7): Result.001 file - promoters60/1016624
aaatgaa

SEQ ID NO: 94843 - DNA, 7 bp, Unknown
  misc_feature (1)..( 7): Result.001 file - promoters60/1016624
aaaggaa

SEQ ID NO: 94844 - DNA, 8 bp, Unknown
  misc_feature (1)..( 8): Result.001 file - promoters60/1016624
tgaacatt

SEQ ID NO: 94845 - DNA, 8 bp, Unknown
  misc_feature (1)..( 8): Result.001 file - promoters60/1016624
tgaacaca

SEQ ID NO: 94846 - DNA, 8 bp, Unknown
  misc_feature (1)..( 8): Result.001 file - promoters60/1016624
ggaaaatt

SEQ ID NO: 94847 - DNA, 9 bp, Unknown
  misc_feature (1)..( 9): Result.001 file - promoters60/1016624
attctgaat

SEQ ID NO: 94848 - DNA, 9 bp, Unknown
  misc_feature (1)..( 9): Result.001 file - promoters60/1016624
cttcttaat

SEQ ID NO: 94849 - DNA, 9 bp, Unknown
  misc_feature (1)..( 9): Result.001 file - promoters60/1016624
cttcttcaa

SEQ ID NO: 94850 - DNA, 7 bp, Unknown
  misc_feature (1)..( 7): Result.001 file - promoters60/1016624
gttcttc

SEQ ID NO: 94851 - DNA, 7 bp, Unknown
  misc_feature (1)..( 7): Result.001 file - promoters60/1016624
cttcttc

SEQ ID NO: 94852 - DNA, 7 bp, Unknown
  misc_feature (1)..( 7): Result.001 file - promoters60/1016665
cttctta

SEQ ID NO: 94853 - DNA, 10 bp, Unknown
  misc_feature (1)..( 10): Result.001 file - promoters60/1016665
aatttatcat

SEQ ID NO: 94854 - DNA, 10 bp, Unknown
  misc_feature (1)..( 10): Result.001 file - promoters60/1016665
aatatatcat

SEQ ID NO: 94855 - DNA, 10 bp, Unknown
  misc_feature (1)..( 10): Result.001 file - promoters60/1016665
aatatatctc

SEQ ID NO: 94856 - DNA, 7 bp, Unknown
  misc_feature (1)..( 7): Result.001 file - promoters60/1016665
ttttgaa

SEQ ID NO: 94857 - DNA, 7 bp, Unknown
  misc_feature (1)..( 7): Result.001 file - promoters60/1016665
ttttgaa

SEQ ID NO: 94858 - DNA, 7 bp, Unknown
  misc_feature (1)..( 7): Result.001 file - promoters60/1016665
aacatat

SEQ ID NO: 94859 - DNA, 7 bp, Unknown
  misc_feature (1)..( 7): Result.001 file - promoters60/1016665
aacatat

SEQ ID NO: 94860 - DNA, 6 bp, Unknown
  misc_feature (1)..( 6): Result.001 file - promoters60/1016665
tttatt

SEQ ID NO: 94861 - DNA, 6 bp, Unknown
  misc_feature (1)..( 6): Result.001 file - promoters60/1016665
tttatt

SEQ ID NO: 94862 - DNA, 9 bp, Unknown
  misc_feature (1)..( 9): Result.001 file - promoters60/1016665
acaaccaca

SEQ ID NO: 94863 - DNA, 9 bp, Unknown
  misc_feature (1)..( 9): Result.001 file - promoters60/1016665
acaactaca

SEQ ID NO: 94864 - DNA, 7 bp, Unknown
  misc_feature (1)..( 7): Result.001 file - promoters60/1016665
tatatgt

SEQ ID NO: 94865 - DNA, 7 bp, Unknown
  misc_feature (1)..( 7): Result.001 file - promoters60/1016665
tatatgt

SEQ ID NO: 94866 - DNA, 6 bp, Unknown
  misc_feature (1)..( 6): Result.001 file - promoters60/1016665
cagaat

SEQ ID NO: 94867 - DNA, 6 bp, Unknown
  misc_feature (1)..( 6): Result.001 file - promoters60/1016665
cagaat

SEQ ID NO: 94868 - DNA, 6 bp, Unknown
  misc_feature (1)..( 6): Result.001 file - promoters60/1016665
aatttc

SEQ ID NO: 94869 - DNA, 6 bp, Unknown
  misc_feature (1)..( 6): Result.001 file - promoters60/1016665
aatttc

SEQ ID NO: 94870 - DNA, 6 bp, Unknown
  misc_feature (1)..( 6): Result.001 file - promoters60/1016665
ttttga

SEQ ID NO: 94871 - DNA, 6 bp, Unknown
  misc_feature (1)..( 6): Result.001 file - promoters60/1016665
ttttga

SEQ ID NO: 94872 - DNA, 6 bp, Unknown
  misc_feature (1)..( 6): Result.001 file - promoters60/1016665
aattaa

SEQ ID NO: 94873 - DNA, 6 bp, Unknown
  misc_feature (1)..( 6): Result.001 file - promoters60/1016665
aattaa

SEQ ID NO: 94874 - DNA, 6 bp, Unknown
  misc_feature (1)..( 6): Result.001 file - promoters60/1016665
ttgcta

SEQ ID NO: 94875 - DNA, 6 bp, Unknown
  misc_feature (1)..( 6): Result.001 file - promoters60/1016665
ttgcta

SEQ ID NO: 94876 - DNA, 10 bp, Unknown
  misc_feature (1)..( 10): Result.001 file - promoters60/1016665
tcttttactt

SEQ ID NO: 94877 - DNA, 10 bp, Unknown
  misc_feature (1)..( 10): Result.001 file - promoters60/1016665
tctttttctt

SEQ ID NO: 94878 - DNA, 7 bp, Unknown
  misc_feature (1)..( 7): Result.001 file - promoters60/1016665
tttagtg

SEQ ID NO: 94879 - DNA, 7 bp, Unknown
  misc_feature (1)..( 7): Result.001 file - promoters60/1016665
ttttgtg

SEQ ID NO: 94880 - DNA, 7 bp, Unknown
  misc_feature (1)..( 7): Result.001 file - promoters60/1016665
tgtgttc

SEQ ID NO: 94881 - DNA, 7 bp, Unknown
  misc_feature (1)..( 7): Result.001 file - promoters60/1016665
tgttttc

SEQ ID NO: 94882 - DNA, 6 bp, Unknown
  misc_feature (1)..( 6): Result.001 file - promoters60/1016665
atgttc

SEQ ID NO: 94883 - DNA, 6 bp, Unknown
  misc_feature (1)..( 6): Result.001 file - promoters60/1016665
atgttc

SEQ ID NO: 94884 - DNA, 11 bp, Unknown
  misc_feature (1)..( 11): Result.001 file - promoters60/1016665
gttttaattta

SEQ ID NO: 94885 - DNA, 11 bp, Unknown
  misc_feature (1)..( 11): Result.001 file - promoters60/1016665
gttttatttta

SEQ ID NO: 94886 - DNA, 6 bp, Unknown
  misc_feature (1)..( 6): Result.001 file - promoters60/1016665
aaaaat

SEQ ID NO: 94887 - DNA, 6 bp, Unknown
  misc_feature (1)..( 6): Result.001 file - promoters60/1016692
aaaaat

SEQ ID NO: 94888 - DNA, 11 bp, Unknown
  misc_feature (1)..( 11): Result.001 file - promoters60/1016692
aaagaatccaa

SEQ ID NO: 94889 - DNA, 11 bp, Unknown
  misc_feature (1)..( 11): Result.001 file - promoters60/1016692
acagaaaccaa

SEQ ID NO: 94890 - DNA, 11 bp, Unknown
  misc_feature (1)..( 11): Result.001 file - promoters60/1016692
aaagaaacgtc

SEQ ID NO: 94891 - DNA, 11 bp, Unknown
  misc_feature (1)..( 11): Result.001 file - promoters60/1016692
aaagaaagaaa

SEQ ID NO: 94892 - DNA, 9 bp, Unknown
  misc_feature (1)..( 9): Result.001 file - promoters60/1016692
tggtttatt

SEQ ID NO: 94893 - DNA, 9 bp, Unknown
  misc_feature (1)..( 9): Result.001 file - promoters60/1016692
ctatttatt

SEQ ID NO: 94894 - DNA, 9 bp, Unknown
  misc_feature (1)..( 9): Result.001 file - promoters60/1016692
ctaattatg

SEQ ID NO: 94895 - DNA, 9 bp, Unknown
  misc_feature (1)..( 9): Result.001 file - promoters60/1016692
gaaatgatg

SEQ ID NO: 94896 - DNA, 8 bp, Unknown
  misc_feature (1)..( 8): Result.001 file - promoters60/1016692
caaactta

SEQ ID NO: 94897 - DNA, 8 bp, Unknown
  misc_feature (1)..( 8): Result.001 file - promoters60/1016692
gaaagtta

SEQ ID NO: 94898 - DNA, 8 bp, Unknown
  misc_feature (1)..( 8): Result.001 file - promoters60/1016692
gaaagttt

SEQ ID NO: 94899 - DNA, 8 bp, Unknown
  misc_feature (1)..( 8): Result.001 file - promoters60/1016692
aaaaatta

SEQ ID NO: 94900 - DNA, 9 bp, Unknown
  misc_feature (1)..( 9): Result.001 file - promoters60/1016692
gaaacaagt

SEQ ID NO: 94901 - DNA, 9 bp, Unknown
  misc_feature (1)..( 9): Result.001 file - promoters60/1016692
aaaataaga

SEQ ID NO: 94902 - DNA, 9 bp, Unknown
  misc_feature (1)..( 9): Result.001 file - promoters60/1016692
ataattaga

SEQ ID NO: 94903 - DNA, 9 bp, Unknown
  misc_feature (1)..( 9): Result.001 file - promoters60/1016729
aaaatatct

SEQ ID NO: 94904 - DNA, 6 bp, Unknown
  misc_feature (1)..( 6): Result.001 file - promoters60/1016729
agattc

SEQ ID NO: 94905 - DNA, 6 bp, Unknown
  misc_feature (1)..( 6): Result.001 file - promoters60/1016729
agattc

SEQ ID NO: 94906 - DNA, 6 bp, Unknown
  misc_feature (1)..( 6): Result.001 file - promoters60/1016729
ttcata

SEQ ID NO: 94907 - DNA, 6 bp, Unknown
  misc_feature (1)..( 6): Result.001 file - promoters60/1016729
ttcata

SEQ ID NO: 94908 - DNA, 6 bp, Unknown
  misc_feature (1)..( 6): Result.001 file - promoters60/1016729
agcaac

SEQ ID NO: 94909 - DNA, 6 bp, Unknown
  misc_feature (1)..( 6): Result.001 file - promoters60/1016729
agcaac

SEQ ID NO: 94910 - DNA, 7 bp, Unknown
  misc_feature (1)..( 7): Result.001 file - promoters60/1016729
caaaaat

SEQ ID NO: 94911 - DNA, 7 bp, Unknown
  misc_feature (1)..( 7): Result.001 file - promoters60/1016729
caacaat

SEQ ID NO: 94912 - DNA, 6 bp, Unknown
  misc_feature (1)..( 6): Result.001 file - promoters60/1016729
attgtg

SEQ ID NO: 94913 - DNA, 6 bp, Unknown
  misc_feature (1)..( 6): Result.001 file - promoters60/1016729
attgtg

SEQ ID NO: 94914 - DNA, 11 bp, Unknown
  misc_feature (1)..( 11): Result.001 file - promoters60/1016729
gaaacgaacat

SEQ ID NO: 94915 - DNA, 11 bp, Unknown
  misc_feature (1)..( 11): Result.001 file - promoters60/1016729
gaaaccaacat

SEQ ID NO: 94916 - DNA, 6 bp, Unknown
  misc_feature (1)..( 6): Result.001 file - promoters60/1016729
gttttt

SEQ ID NO: 94917 - DNA, 6 bp, Unknown
  misc_feature (1)..( 6): Result.001 file - promoters60/1016729
gttttt

SEQ ID NO: 94918 - DNA, 7 bp, Unknown
  misc_feature (1)..( 7): Result.001 file - promoters60/1016729
cttcttg

SEQ ID NO: 94919 - DNA, 7 bp, Unknown
  misc_feature (1)..( 7): Result.001 file - promoters60/1016729
cttattg

SEQ ID NO: 94920 - DNA, 8 bp, Unknown
  misc_feature (1)..( 8): Result.001 file - promoters60/1016729
gatgcaaa

SEQ ID NO: 94921 - DNA, 8 bp, Unknown
  misc_feature (1)..( 8): Result.001 file - promoters60/1016729
gattcaaa

SEQ ID NO: 94922 - DNA, 8 bp, Unknown
  misc_feature (1)..( 8): Result.001 file - promoters60/1016729
tgtggaaa

SEQ ID NO: 94923 - DNA, 8 bp, Unknown
  misc_feature (1)..( 8): Result.001 file - promoters60/1016729
tgtggaaa

SEQ ID NO: 94924 - DNA, 7 bp, Unknown
  misc_feature (1)..( 7): Result.001 file - promoters60/1016729
ggcgtgt

SEQ ID NO: 94925 - DNA, 7 bp, Unknown
  misc_feature (1)..( 7): Result.001 file - promoters60/1016729
ggcgtgt

SEQ ID NO: 94926 - DNA, 6 bp, Unknown
  misc_feature (1)..( 6): Result.001 file - promoters60/1016729
tctatt

SEQ ID NO: 94927 - DNA, 6 bp, Unknown
  misc_feature (1)..( 6): Result.001 file - promoters60/1016729
tctatt

SEQ ID NO: 94928 - DNA, 8 bp, Unknown
  misc_feature (1)..( 8): Result.001 file - promoters60/1016729
tacctgat

SEQ ID NO: 94929 - DNA, 8 bp, Unknown
  misc_feature (1)..( 8): Result.001 file - promoters60/1016729
taccagat

SEQ ID NO: 94930 - DNA, 6 bp, Unknown
  misc_feature (1)..( 6): Result.001 file - promoters60/1016729
agatta

SEQ ID NO: 94931 - DNA, 6 bp, Unknown
  misc_feature (1)..( 6): Result.001 file - promoters60/1016771
agatta

SEQ ID NO: 94932 - DNA, 10 bp, Unknown
  misc_feature (1)..( 10): Result.001 file - promoters60/1016771
taaatcgtta

SEQ ID NO: 94933 - DNA, 10 bp, Unknown
  misc_feature (1)..( 10): Result.001 file - promoters60/1016771
taaatcttta

SEQ ID NO: 94934 - DNA, 10 bp, Unknown
  misc_feature (1)..( 10): Result.001 file - promoters60/1016771
agaatcatta

SEQ ID NO: 94935 - DNA, 10 bp, Unknown
  misc_feature (1)..( 10): Result.001 file - promoters60/1016771
gaaaccgtat

SEQ ID NO: 94936 - DNA, 10 bp, Unknown
  misc_feature (1)..( 10): Result.001 file - promoters60/1016771
gagagcatca

SEQ ID NO: 94937 - DNA, 10 bp, Unknown
  misc_feature (1)..( 10): Result.001 file - promoters60/1016771
ccaatcataa

SEQ ID NO: 94938 - DNA, 13 bp, Unknown
  misc_feature (1)..( 13): Result.001 file - promoters60/1016771
gtaatcaatccta

SEQ ID NO: 94939 - DNA, 13 bp, Unknown
  misc_feature (1)..( 13): Result.001 file - promoters60/1016771
aaaatgaattctt

SEQ ID NO: 94940 - DNA, 13 bp, Unknown
  misc_feature (1)..( 13): Result.001 file - promoters60/1016771
tgcatcaatgctt

SEQ ID NO: 94941 - DNA, 13 bp, Unknown
  misc_feature (1)..( 13): Result.001 file - promoters60/1016771
aaaacgaatggca

SEQ ID NO: 94942 - DNA, 13 bp, Unknown
  misc_feature (1)..( 13): Result.001 file - promoters60/1016771
gccattaatgttt

SEQ ID NO: 94943 - DNA, 13 bp, Unknown
  misc_feature (1)..( 13): Result.001 file - promoters60/1016814
atcattaatcctt

SEQ ID NO: 94944 - DNA, 17 bp, Unknown
  misc_feature (1)..( 17): Result.001 file - promoters60/1016814
tggtgataaatattcaa

SEQ ID NO: 94945 - DNA, 17 bp, Unknown
  misc_feature (1)..( 17): Result.001 file - promoters60/1016814
ctctggtatatatacaa

SEQ ID NO: 94946 - DNA, 17 bp, Unknown
  misc_feature (1)..( 17): Result.001 file - promoters60/1016814
atccataaaattttcca

SEQ ID NO: 94947 - DNA, 17 bp, Unknown
  misc_feature (1)..( 17): Result.001 file - promoters60/1016814
aaaatcaaaaaattatt

SEQ ID NO: 94948 - DNA, 17 bp, Unknown
  misc_feature (1)..( 17): Result.001 file - promoters60/1016814
ttgttaactatataaaa

SEQ ID NO: 94949 - DNA, 17 bp, Unknown
  misc_feature (1)..( 17): Result.001 file - promoters60/1016814
gtagagataatttttct

SEQ ID NO: 94950 - DNA, 17 bp, Unknown
  misc_feature (1)..( 17): Result.001 file - promoters60/1016814
aaaaacaaaaaataaca

SEQ ID NO: 94951 - DNA, 14 bp, Unknown
  misc_feature (1)..( 14): Result.001 file - promoters60/1016814
aggactcagaccag

SEQ ID NO: 94952 - DNA, 14 bp, Unknown
  misc_feature (1)..( 14): Result.001 file - promoters60/1016814
aggattcatcatct

SEQ ID NO: 94953 - DNA, 14 bp, Unknown
  misc_feature (1)..( 14): Result.001 file - promoters60/1016814
ctcattcatcttct

SEQ ID NO: 94954 - DNA, 14 bp, Unknown
  misc_feature (1)..( 14): Result.001 file - promoters60/1016814
ccacttctccgcct

SEQ ID NO: 94955 - DNA, 14 bp, Unknown
  misc_feature (1)..( 14): Result.001 file - promoters60/1016814
ttggatcttccctt

SEQ ID NO: 94956 - DNA, 14 bp, Unknown
  misc_feature (1)..( 14): Result.001 file - promoters60/1016814
aacatgcatttatg

SEQ ID NO: 94957 - DNA, 12 bp, Unknown
  misc_feature (1)..( 12): Result.001 file - promoters60/1016814
atacaaaaatgt

SEQ ID NO: 94958 - DNA, 12 bp, Unknown
  misc_feature (1)..( 12): Result.001 file - promoters60/1016814
gggaaaaaatca

SEQ ID NO: 94959 - DNA, 12 bp, Unknown
  misc_feature (1)..( 12): Result.001 file - promoters60/1016814
aaacaaaaaata

SEQ ID NO: 94960 - DNA, 12 bp, Unknown
  misc_feature (1)..( 12): Result.001 file - promoters60/1016814
aaagaaaagaca

SEQ ID NO: 94961 - DNA, 12 bp, Unknown
  misc_feature (1)..( 12): Result.001 file - promoters60/1016814
gtttaaaaaata

SEQ ID NO: 94962 - DNA, 12 bp, Unknown
  misc_feature (1)..( 12): Result.001 file - promoters60/1016886
atataaaaccaa

SEQ ID NO: 94963 - DNA, 11 bp, Unknown
  misc_feature (1)..( 11): Result.001 file - promoters60/1016886
gtgttgttccc

SEQ ID NO: 94964 - DNA, 11 bp, Unknown
  misc_feature (1)..( 11): Result.001 file - promoters60/1016886
ttgtttttcac

SEQ ID NO: 94965 - DNA, 11 bp, Unknown
  misc_feature (1)..( 11): Result.001 file - promoters60/1016886
acgttcttctt

SEQ ID NO: 94966 - DNA, 12 bp, Unknown
  misc_feature (1)..( 12): Result.001 file - promoters60/1016886
gcttttcttccc

SEQ ID NO: 94967 - DNA, 12 bp, Unknown
  misc_feature (1)..( 12): Result.001 file - promoters60/1016886
atgtattttaca

SEQ ID NO: 94968 - DNA, 12 bp, Unknown
  misc_feature (1)..( 12): Result.001 file - promoters60/1016915
ttacattttgct

SEQ ID NO: 94969 - DNA, 8 bp, Unknown
  misc_feature (1)..( 8): Result.001 file - promoters60/1016915
aaaataga

SEQ ID NO: 94970 - DNA, 8 bp, Unknown
  misc_feature (1)..( 8): Result.001 file - promoters60/1016915
aaaataag

SEQ ID NO: 94971 - DNA, 8 bp, Unknown
  misc_feature (1)..( 8): Result.001 file - promoters60/1016915
aaactaag

SEQ ID NO: 94972 - DNA, 12 bp, Unknown
  misc_feature (1)..( 12): Result.001 file - promoters60/1016915
ataagttagtca

SEQ ID NO: 94973 - DNA, 12 bp, Unknown
  misc_feature (1)..( 12): Result.001 file - promoters60/1016915
ataatttaatca

SEQ ID NO: 94974 - DNA, 6 bp, Unknown
  misc_feature (1)..( 6): Result.001 file - promoters60/1016915
acgaat

SEQ ID NO: 94975 - DNA, 6 bp, Unknown
  misc_feature (1)..( 6): Result.001 file - promoters60/1016915
acgaat

SEQ ID NO: 94976 - DNA, 6 bp, Unknown
  misc_feature (1)..( 6): Result.001 file - promoters60/1016915
gtacga

SEQ ID NO: 94977 - DNA, 6 bp, Unknown
  misc_feature (1)..( 6): Result.001 file - promoters60/1016915
gtacga

SEQ ID NO: 94978 - DNA, 7 bp, Unknown
  misc_feature (1)..( 7): Result.001 file - promoters60/1016915
atgaaaa

SEQ ID NO: 94979 - DNA, 7 bp, Unknown
  misc_feature (1)..( 7): Result.001 file - promoters60/1016915
atgaaaa

SEQ ID NO: 94980 - DNA, 8 bp, Unknown
  misc_feature (1)..( 8): Result.001 file - promoters60/1016915
gaatatat

SEQ ID NO: 94981 - DNA, 8 bp, Unknown
  misc_feature (1)..( 8): Result.001 file - promoters60/1016915
agatatat

SEQ ID NO: 94982 - DNA, 8 bp, Unknown
  misc_feature (1)..( 8): Result.001 file - promoters60/1016915
agagataa

SEQ ID NO: 94983 - DNA, 7 bp, Unknown
  misc_feature (1)..( 7): Result.001 file - promoters60/1016915
atgtttt

SEQ ID NO: 94984 - DNA, 7 bp, Unknown
  misc_feature (1)..( 7): Result.001 file - promoters60/1016915
atgtttt

SEQ ID NO: 94985 - DNA, 7 bp, Unknown
  misc_feature (1)..( 7): Result.001 file - promoters60/1016915
atttaat

SEQ ID NO: 94986 - DNA, 7 bp, Unknown
  misc_feature (1)..( 7): Result.001 file - promoters60/1016915
attaaat

SEQ ID NO: 94987 - DNA, 8 bp, Unknown
  misc_feature (1)..( 8): Result.001 file - promoters60/1016915
caaataat

SEQ ID NO: 94988 - DNA, 8 bp, Unknown
  misc_feature (1)..( 8): Result.001 file - promoters60/1016915
caaaaaat

SEQ ID NO: 94989 - DNA, 8 bp, Unknown
  misc_feature (1)..( 8): Result.001 file - promoters60/1016915
caattaaa

SEQ ID NO: 94990 - DNA, 6 bp, Unknown
  misc_feature (1)..( 6): Result.001 file - promoters60/1016915
aaatca

SEQ ID NO: 94991 - DNA, 6 bp, Unknown
  misc_feature (1)..( 6): Result.001 file - promoters60/1016915
aaatca

SEQ ID NO: 94992 - DNA, 7 bp, Unknown
  misc_feature (1)..( 7): Result.001 file - promoters60/1016915
caagtgt

SEQ ID NO: 94993 - DNA, 7 bp, Unknown
  misc_feature (1)..( 7): Result.001 file - promoters60/1016915
caaatgt

SEQ ID NO: 94994 - DNA, 6 bp, Unknown
  misc_feature (1)..( 6): Result.001 file - promoters60/1016915
aagatt

SEQ ID NO: 94995 - DNA, 6 bp, Unknown
  misc_feature (1)..( 6): Result.001 file - promoters60/1016915
aagatt

SEQ ID NO: 94996 - DNA, 6 bp, Unknown
  misc_feature (1)..( 6): Result.001 file - promoters60/1016915
aagaaa

SEQ ID NO: 94997 - DNA, 6 bp, Unknown
  misc_feature (1)..( 6): Result.001 file - promoters60/1016915
aagaaa

SEQ ID NO: 94998 - DNA, 6 bp, Unknown
  misc_feature (1)..( 6): Result.001 file - promoters60/1016915
aaaaag

SEQ ID NO: 94999 - DNA, 6 bp, Unknown
  misc_feature (1)..( 6): Result.001 file - promoters60/1016915
aaaaag

SEQ ID NO: 95000 - DNA, 8 bp, Unknown
  misc_feature (1)..( 8): Result.001 file - promoters60/1016915
caatcaaa

SEQ ID NO: 95001 - DNA, 8 bp, Unknown
  misc_feature (1)..( 8): Result.001 file - promoters60/1016915
caattaaa

SEQ ID NO: 95002 - DNA, 7 bp, Unknown
  misc_feature (1)..( 7): Result.001 file - promoters60/1016915
ttcgaaa

SEQ ID NO: 95003 - DNA, 7 bp, Unknown
  misc_feature (1)..( 7): Result.001 file - promoters60/1016915
ttcgaaa

SEQ ID NO: 95004 - DNA, 8 bp, Unknown
  misc_feature (1)..( 8): Result.001 file - promoters60/1016915
aaatgtcg

SEQ ID NO: 95005 - DNA, 8 bp, Unknown
  misc_feature (1)..( 8): Result.001 file - promoters60/1016915
aaatctcg

SEQ ID NO: 95006 - DNA, 6 bp, Unknown
  misc_feature (1)..( 6): Result.001 file - promoters60/1016915
tataaa

SEQ ID NO: 95007 - DNA, 6 bp, Unknown
  misc_feature (1)..( 6): Result.001 file - promoters60/1016915
tataaa

SEQ ID NO: 95008 - DNA, 8 bp, Unknown
  misc_feature (1)..( 8): Result.001 file - promoters60/1016915
taagttgt

SEQ ID NO: 95009 - DNA, 8 bp, Unknown
  misc_feature (1)..( 8): Result.001 file - promoters60/1016915
taaattgt

SEQ ID NO: 95010 - DNA, 6 bp, Unknown
  misc_feature (1)..( 6): Result.001 file - promoters60/1016915
atagat

SEQ ID NO: 95011 - DNA, 6 bp, Unknown
  misc_feature (1)..( 6): Result.001 file - promoters60/1016915
atagat

SEQ ID NO: 95012 - DNA, 6 bp, Unknown
  misc_feature (1)..( 6): Result.001 file - promoters60/1016915
ttttgg

SEQ ID NO: 95013 - DNA, 6 bp, Unknown
  misc_feature (1)..( 6): Result.001 file - promoters60/1016915
ttttgg

SEQ ID NO: 95014 - DNA, 6 bp, Unknown
  misc_feature (1)..( 6): Result.001 file - promoters60/1016915
taagat

SEQ ID NO: 95015 - DNA, 6 bp, Unknown
  misc_feature (1)..( 6): Result.001 file - promoters60/1016915
taagat

SEQ ID NO: 95016 - DNA, 6 bp, Unknown
  misc_feature (1)..( 6): Result.001 file - promoters60/1016915
aaagaa

SEQ ID NO: 95017 - DNA, 6 bp, Unknown
  misc_feature (1)..( 6): Result.001 file - promoters60/1016915
aaagaa

SEQ ID NO: 95018 - DNA, 12 bp, Unknown
  misc_feature (1)..( 12): Result.001 file - promoters60/1016915
aaaaacaaaaca

SEQ ID NO: 95019 - DNA, 12 bp, Unknown
  misc_feature (1)..( 12): Result.001 file - promoters60/1016915
aaacacaataca

SEQ ID NO: 95020 - DNA, 6 bp, Unknown
  misc_feature (1)..( 6): Result.001 file - promoters60/1016915
taaccc

SEQ ID NO: 95021 - DNA, 6 bp, Unknown
  misc_feature (1)..( 6): Result.001 file - promoters60/1016931
taaccc

SEQ ID NO: 95022 - DNA, 7 bp, Unknown
  misc_feature (1)..( 7): Result.001 file - promoters60/1016931
aaacaaa

SEQ ID NO: 95023 - DNA, 7 bp, Unknown
  misc_feature (1)..( 7): Result.001 file - promoters60/1016931
aaataaa

SEQ ID NO: 95024 - DNA, 7 bp, Unknown
  misc_feature (1)..( 7): Result.001 file - promoters60/1016931
gtatctt

SEQ ID NO: 95025 - DNA, 7 bp, Unknown
  misc_feature (1)..( 7): Result.001 file - promoters60/1016931
gtatctt

SEQ ID NO: 95026 - DNA, 6 bp, Unknown
  misc_feature (1)..( 6): Result.001 file - promoters60/1016931
ttatct

SEQ ID NO: 95027 - DNA, 6 bp, Unknown
  misc_feature (1)..( 6): Result.001 file - promoters60/1016931
ttatct

SEQ ID NO: 95028 - DNA, 6 bp, Unknown
  misc_feature (1)..( 6): Result.001 file - promoters60/1016931
ttatct

SEQ ID NO: 95029 - DNA, 8 bp, Unknown
  misc_feature (1)..( 8): Result.001 file - promoters60/1016931
aacaaatt

SEQ ID NO: 95030 - DNA, 8 bp, Unknown
  misc_feature (1)..( 8): Result.001 file - promoters60/1016931
aacgaatt

SEQ ID NO: 95031 - DNA, 7 bp, Unknown
  misc_feature (1)..( 7): Result.001 file - promoters60/1016931
tttgctt

SEQ ID NO: 95032 - DNA, 7 bp, Unknown
  misc_feature (1)..( 7): Result.001 file - promoters60/1016931
ttttctt

SEQ ID NO: 95033 - DNA, 10 bp, Unknown
  misc_feature (1)..( 10): Result.001 file - promoters60/1016931
atttttgtgt

SEQ ID NO: 95034 - DNA, 10 bp, Unknown
  misc_feature (1)..( 10): Result.001 file - promoters60/1016931
attattgttt

SEQ ID NO: 95035 - DNA, 10 bp, Unknown
  misc_feature (1)..( 10): Result.001 file - promoters60/1016931
gttactgttt

SEQ ID NO: 95036 - DNA, 6 bp, Unknown
  misc_feature (1)..( 6): Result.001 file - promoters60/1016931
tcagat

SEQ ID NO: 95037 - DNA, 6 bp, Unknown
  misc_feature (1)..( 6): Result.001 file - promoters60/1016931
tcagat

SEQ ID NO: 95038 - DNA, 7 bp, Unknown
  misc_feature (1)..( 7): Result.001 file - promoters60/1016931
taaataa

SEQ ID NO: 95039 - DNA, 7 bp, Unknown
  misc_feature (1)..( 7): Result.001 file - promoters60/1016931
taaataa

SEQ ID NO: 95040 - DNA, 6 bp, Unknown
  misc_feature (1)..( 6): Result.001 file - promoters60/1016931
ataaat

SEQ ID NO: 95041 - DNA, 6 bp, Unknown
  misc_feature (1)..( 6): Result.001 file - promoters60/1016931
ataaat

SEQ ID NO: 95042 - DNA, 7 bp, Unknown
  misc_feature (1)..( 7): Result.001 file - promoters60/1016931
tattttt

SEQ ID NO: 95043 - DNA, 7 bp, Unknown
  misc_feature (1)..( 7): Result.001 file - promoters60/1016931
tatgttt

SEQ ID NO: 95044 - DNA, 7 bp, Unknown
  misc_feature (1)..( 7): Result.001 file - promoters60/1016931
caaaaaa

SEQ ID NO: 95045 - DNA, 7 bp, Unknown
  misc_feature (1)..( 7): Result.001 file - promoters60/1016931
caaaaaa

SEQ ID NO: 95046 - DNA, 6 bp, Unknown
  misc_feature (1)..( 6): Result.001 file - promoters60/1016931
taaaca

SEQ ID NO: 95047 - DNA, 6 bp, Unknown
  misc_feature (1)..( 6): Result.001 file - promoters60/1016931
taaaca

SEQ ID NO: 95048 - DNA, 7 bp, Unknown
  misc_feature (1)..( 7): Result.001 file - promoters60/1016931
ttagatc

SEQ ID NO: 95049 - DNA, 7 bp, Unknown
  misc_feature (1)..( 7): Result.001 file - promoters60/1016931
ttagatc

SEQ ID NO: 95050 - DNA, 7 bp, Unknown
  misc_feature (1)..( 7): Result.001 file - promoters60/1016931
atcattt

SEQ ID NO: 95051 - DNA, 7 bp, Unknown
  misc_feature (1)..( 7): Result.001 file - promoters60/1016931
atctttt

SEQ ID NO: 95052 - DNA, 7 bp, Unknown
  misc_feature (1)..( 7): Result.001 file - promoters60/1016931
gatttat

SEQ ID NO: 95053 - DNA, 7 bp, Unknown
  misc_feature (1)..( 7): Result.001 file - promoters60/1016931
gatctat

SEQ ID NO: 95054 - DNA, 6 bp, Unknown
  misc_feature (1)..( 6): Result.001 file - promoters60/1016931
ttttca

SEQ ID NO: 95055 - DNA, 6 bp, Unknown
  misc_feature (1)..( 6): Result.001 file - promoters60/1016931
ttttca

SEQ ID NO: 95056 - DNA, 7 bp, Unknown
  misc_feature (1)..( 7): Result.001 file - promoters60/1016931
cgagcaa

SEQ ID NO: 95057 - DNA, 7 bp, Unknown
  misc_feature (1)..( 7): Result.001 file - promoters60/1016931
cgaacaa

SEQ ID NO: 95058 - DNA, 6 bp, Unknown
  misc_feature (1)..( 6): Result.001 file - promoters60/1016931
tatcta

SEQ ID NO: 95059 - DNA, 6 bp, Unknown
  misc_feature (1)..( 6): Result.001 file - promoters60/1016951
tatcta

SEQ ID NO: 95060 - DNA, 7 bp, Unknown
  misc_feature (1)..( 7): Result.001 file - promoters60/1016951
tgatttt

SEQ ID NO: 95061 - DNA, 7 bp, Unknown
  misc_feature (1)..( 7): Result.001 file - promoters60/1016951
agatttt

SEQ ID NO: 95062 - DNA, 7 bp, Unknown
  misc_feature (1)..( 7): Result.001 file - promoters60/1016951
agatttc

SEQ ID NO: 95063 - DNA, 7 bp, Unknown
  misc_feature (1)..( 7): Result.001 file - promoters60/1016951
caaacac

SEQ ID NO: 95064 - DNA, 7 bp, Unknown
  misc_feature (1)..( 7): Result.001 file - promoters60/1016951
caaacag

SEQ ID NO: 95065 - DNA, 7 bp, Unknown
  misc_feature (1)..( 7): Result.001 file - promoters60/1016951
aaaacac

SEQ ID NO: 95066 - DNA, 7 bp, Unknown
  misc_feature (1)..( 7): Result.001 file - promoters60/1016951
ttaaata

SEQ ID NO: 95067 - DNA, 7 bp, Unknown
  misc_feature (1)..( 7): Result.001 file - promoters60/1016951
ttatata

SEQ ID NO: 95068 - DNA, 7 bp, Unknown
  misc_feature (1)..( 7): Result.001 file - promoters60/1016951
atacata

SEQ ID NO: 95069 - DNA, 7 bp, Unknown
  misc_feature (1)..( 7): Result.001 file - promoters60/1016951
atatatt

SEQ ID NO: 95070 - DNA, 7 bp, Unknown
  misc_feature (1)..( 7): Result.001 file - promoters60/1016951
atatatc

SEQ ID NO: 95071 - DNA, 7 bp, Unknown
  misc_feature (1)..( 7): Result.001 file - promoters60/1016951
atacata

SEQ ID NO: 95072 - DNA, 6 bp, Unknown
  misc_feature (1)..( 6): Result.001 file - promoters60/1016951
aatttt

SEQ ID NO: 95073 - DNA, 6 bp, Unknown
  misc_feature (1)..( 6): Result.001 file - promoters60/1016951
aatttt

SEQ ID NO: 95074 - DNA, 7 bp, Unknown
  misc_feature (1)..( 7): Result.001 file - promoters60/1016951
aatgttt

SEQ ID NO: 95075 - DNA, 7 bp, Unknown
  misc_feature (1)..( 7): Result.001 file - promoters60/1016951
aacttaa

SEQ ID NO: 95076 - DNA, 7 bp, Unknown
  misc_feature (1)..( 7): Result.001 file - promoters60/1016951
aacgtaa

SEQ ID NO: 95077 - DNA, 7 bp, Unknown
  misc_feature (1)..( 7): Result.001 file - promoters60/1016951
aacataa

SEQ ID NO: 95078 - DNA, 8 bp, Unknown
  misc_feature (1)..( 8): Result.001 file - promoters60/1016951
atacataa

SEQ ID NO: 95079 - DNA, 8 bp, Unknown
  misc_feature (1)..( 8): Result.001 file - promoters60/1016951
ttacctaa

SEQ ID NO: 95080 - DNA, 8 bp, Unknown
  misc_feature (1)..( 8): Result.001 file - promoters60/1017020
atatatat

SEQ ID NO: 95081 - DNA, 9 bp, Unknown
  misc_feature (1)..( 9): Result.001 file - promoters60/1017020
caaaaacat

SEQ ID NO: 95082 - DNA, 9 bp, Unknown
  misc_feature (1)..( 9): Result.001 file - promoters60/1017020
gaaagacaa

SEQ ID NO: 95083 - DNA, 9 bp, Unknown
  misc_feature (1)..( 9): Result.001 file - promoters60/1017020
aaaagattt

SEQ ID NO: 95084 - DNA, 9 bp, Unknown
  misc_feature (1)..( 9): Result.001 file - promoters60/1017020
ataagattg

SEQ ID NO: 95085 - DNA, 8 bp, Unknown
  misc_feature (1)..( 8): Result.001 file - promoters60/1017020
ttaatatg

SEQ ID NO: 95086 - DNA, 8 bp, Unknown
  misc_feature (1)..( 8): Result.001 file - promoters60/1017020
ttaatagc

SEQ ID NO: 95087 - DNA, 8 bp, Unknown
  misc_feature (1)..( 8): Result.001 file - promoters60/1017020
gtaatagc

SEQ ID NO: 95088 - DNA, 14 bp, Unknown
  misc_feature (1)..( 14): Result.001 file - promoters60/1017020
tccagaaaaagttc

SEQ ID NO: 95089 - DNA, 14 bp, Unknown
  misc_feature (1)..( 14): Result.001 file - promoters60/1017020
ttgattcaaaattc

SEQ ID NO: 95090 - DNA, 14 bp, Unknown
  misc_feature (1)..( 14): Result.001 file - promoters60/1017020
ttgaatcaatattt

SEQ ID NO: 95091 - DNA, 10 bp, Unknown
  misc_feature (1)..( 10): Result.001 file - promoters60/1017020
ctatactttg

SEQ ID NO: 95092 - DNA, 10 bp, Unknown
  misc_feature (1)..( 10): Result.001 file - promoters60/1017020
caatatttta

SEQ ID NO: 95093 - DNA, 10 bp, Unknown
  misc_feature (1)..( 10): Result.001 file - promoters60/1017041
ctatgctttg

SEQ ID NO: 95094 - DNA, 8 bp, Unknown
  misc_feature (1)..( 8): Result.001 file - promoters60/1017041
caagtttc

SEQ ID NO: 95095 - DNA, 8 bp, Unknown
  misc_feature (1)..( 8): Result.001 file - promoters60/1017041
caattttt

SEQ ID NO: 95096 - DNA, 8 bp, Unknown
  misc_feature (1)..( 8): Result.001 file - promoters60/1017041
agagtttc

SEQ ID NO: 95097 - DNA, 6 bp, Unknown
  misc_feature (1)..( 6): Result.001 file - promoters60/1017041
attatg

SEQ ID NO: 95098 - DNA, 6 bp, Unknown
  misc_feature (1)..( 6): Result.001 file - promoters60/1017041
attatg

SEQ ID NO: 95099 - DNA, 7 bp, Unknown
  misc_feature (1)..( 7): Result.001 file - promoters60/1017041
attgggc

SEQ ID NO: 95100 - DNA, 7 bp, Unknown
  misc_feature (1)..( 7): Result.001 file - promoters60/1017041
attcggc

SEQ ID NO: 95101 - DNA, 9 bp, Unknown
  misc_feature (1)..( 9): Result.001 file - promoters60/1017041
ttctatgga

SEQ ID NO: 95102 - DNA, 9 bp, Unknown
  misc_feature (1)..( 9): Result.001 file - promoters60/1017041
ttccatgga

SEQ ID NO: 95103 - DNA, 6 bp, Unknown
  misc_feature (1)..( 6): Result.001 file - promoters60/1017041
aacagt

SEQ ID NO: 95104 - DNA, 6 bp, Unknown
  misc_feature (1)..( 6): Result.001 file - promoters60/1017041
aacagt

SEQ ID NO: 95105 - DNA, 8 bp, Unknown
  misc_feature (1)..( 8): Result.001 file - promoters60/1017041
cagtgatg

SEQ ID NO: 95106 - DNA, 8 bp, Unknown
  misc_feature (1)..( 8): Result.001 file - promoters60/1017041
cagagatg

SEQ ID NO: 95107 - DNA, 6 bp, Unknown
  misc_feature (1)..( 6): Result.001 file - promoters60/1017041
attaga

SEQ ID NO: 95108 - DNA, 6 bp, Unknown
  misc_feature (1)..( 6): Result.001 file - promoters60/1017041
attaga

SEQ ID NO: 95109 - DNA, 6 bp, Unknown
  misc_feature (1)..( 6): Result.001 file - promoters60/1017041
gaatca

SEQ ID NO: 95110 - DNA, 6 bp, Unknown
  misc_feature (1)..( 6): Result.001 file - promoters60/1017041
gaatca

SEQ ID NO: 95111 - DNA, 7 bp, Unknown
  misc_feature (1)..( 7): Result.001 file - promoters60/1017041
tccggtt

SEQ ID NO: 95112 - DNA, 7 bp, Unknown
  misc_feature (1)..( 7): Result.001 file - promoters60/1017041
tccagtt

SEQ ID NO: 95113 - DNA, 6 bp, Unknown
  misc_feature (1)..( 6): Result.001 file - promoters60/1017041
tttccg

SEQ ID NO: 95114 - DNA, 6 bp, Unknown
  misc_feature (1)..( 6): Result.001 file - promoters60/1017041
tttccg

SEQ ID NO: 95115 - DNA, 6 bp, Unknown
  misc_feature (1)..( 6): Result.001 file - promoters60/1017041
ataaat

SEQ ID NO: 95116 - DNA, 6 bp, Unknown
  misc_feature (1)..( 6): Result.001 file - promoters60/1017041
ataaat

SEQ ID NO: 95117 - DNA, 6 bp, Unknown
  misc_feature (1)..( 6): Result.001 file - promoters60/1017041
aaccct

SEQ ID NO: 95118 - DNA, 6 bp, Unknown
  misc_feature (1)..( 6): Result.001 file - promoters60/1017046
aaccct

SEQ ID NO: 95119 - DNA, 8 bp, Unknown
  misc_feature (1)..( 8): Result.001 file - promoters60/1017046
taatattt

SEQ ID NO: 95120 - DNA, 8 bp, Unknown
  misc_feature (1)..( 8): Result.001 file - promoters60/1017046
caattttt

SEQ ID NO: 95121 - DNA, 8 bp, Unknown
  misc_feature (1)..( 8): Result.001 file - promoters60/1017046
taatattt

SEQ ID NO: 95122 - DNA, 8 bp, Unknown
  misc_feature (1)..( 8): Result.001 file - promoters60/1017046
aatacttt

SEQ ID NO: 95123 - DNA, 8 bp, Unknown
  misc_feature (1)..( 8): Result.001 file - promoters60/1017046
attacttt

SEQ ID NO: 95124 - DNA, 8 bp, Unknown
  misc_feature (1)..( 8): Result.001 file - promoters60/1017046
aatatttt

SEQ ID NO: 95125 - DNA, 7 bp, Unknown
  misc_feature (1)..( 7): Result.001 file - promoters60/1017046
cttgaat

SEQ ID NO: 95126 - DNA, 7 bp, Unknown
  misc_feature (1)..( 7): Result.001 file - promoters60/1017046
cttgaat

SEQ ID NO: 95127 - DNA, 7 bp, Unknown
  misc_feature (1)..( 7): Result.001 file - promoters60/1017046
ttttttc

SEQ ID NO: 95128 - DNA, 7 bp, Unknown
  misc_feature (1)..( 7): Result.001 file - promoters60/1017046
tttattc

SEQ ID NO: 95129 - DNA, 6 bp, Unknown
  misc_feature (1)..( 6): Result.001 file - promoters60/1017046
ggtttt

SEQ ID NO: 95130 - DNA, 6 bp, Unknown
  misc_feature (1)..( 6): Result.001 file - promoters60/1017046
ggtttt

SEQ ID NO: 95131 - DNA, 9 bp, Unknown
  misc_feature (1)..( 9): Result.001 file - promoters60/1017046
cctttttac

SEQ ID NO: 95132 - DNA, 9 bp, Unknown
  misc_feature (1)..( 9): Result.001 file - promoters60/1017046
gttttctac

SEQ ID NO: 95133 - DNA, 9 bp, Unknown
  misc_feature (1)..( 9): Result.001 file - promoters60/1017046
cctttttct

SEQ ID NO: 95134 - DNA, 6 bp, Unknown
  misc_feature (1)..( 6): Result.001 file - promoters60/1017046
ttttaa

SEQ ID NO: 95135 - DNA, 6 bp, Unknown
  misc_feature (1)..( 6): Result.001 file - promoters60/1017046
ttttaa

SEQ ID NO: 95136 - DNA, 7 bp, Unknown
  misc_feature (1)..( 7): Result.001 file - promoters60/1017046
aaaaagt

SEQ ID NO: 95137 - DNA, 7 bp, Unknown
  misc_feature (1)..( 7): Result.001 file - promoters60/1017046
aaatagt

SEQ ID NO: 95138 - DNA, 8 bp, Unknown
  misc_feature (1)..( 8): Result.001 file - promoters60/1017046
taaattgg

SEQ ID NO: 95139 - DNA, 8 bp, Unknown
  misc_feature (1)..( 8): Result.001 file - promoters60/1017046
taaatttc

SEQ ID NO: 95140 - DNA, 8 bp, Unknown
  misc_feature (1)..( 8): Result.001 file - promoters60/1017046
taactttc

SEQ ID NO: 95141 - DNA, 7 bp, Unknown
  misc_feature (1)..( 7): Result.001 file - promoters60/1017046
agcaaca

SEQ ID NO: 95142 - DNA, 7 bp, Unknown
  misc_feature (1)..( 7): Result.001 file - promoters60/1017046
agccaca

SEQ ID NO: 95143 - DNA, 14 bp, Unknown
  misc_feature (1)..( 14): Result.001 file - promoters60/1017046
atttccgtttcttt

SEQ ID NO: 95144 - DNA, 14 bp, Unknown
  misc_feature (1)..( 14): Result.001 file - promoters60/1017046
ttaataatttattt

SEQ ID NO: 95145 - DNA, 14 bp, Unknown
  misc_feature (1)..( 14): Result.001 file - promoters60/1017046
ttaacaattttttt

SEQ ID NO: 95146 - DNA, 7 bp, Unknown
  misc_feature (1)..( 7): Result.001 file - promoters60/1017046
atatttt

SEQ ID NO: 95147 - DNA, 7 bp, Unknown
  misc_feature (1)..( 7): Result.001 file - promoters60/1017046
ataattt

SEQ ID NO: 95148 - DNA, 7 bp, Unknown
  misc_feature (1)..( 7): Result.001 file - promoters60/1017046
tttactt

SEQ ID NO: 95149 - DNA, 7 bp, Unknown
  misc_feature (1)..( 7): Result.001 file - promoters60/1017046
ttttctt

SEQ ID NO: 95150 - DNA, 7 bp, Unknown
  misc_feature (1)..( 7): Result.001 file - promoters60/1017046
aatattt

SEQ ID NO: 95151 - DNA, 7 bp, Unknown
  misc_feature (1)..( 7): Result.001 file - promoters60/1017046
aatattt

SEQ ID NO: 95152 - DNA, 7 bp, Unknown
  misc_feature (1)..( 7): Result.001 file - promoters60/1017046
ttttttt

SEQ ID NO: 95153 - DNA, 7 bp, Unknown
  misc_feature (1)..( 7): Result.001 file - promoters60/1017046
tttattt

SEQ ID NO: 95154 - DNA, 6 bp, Unknown
  misc_feature (1)..( 6): Result.001 file - promoters60/1017046
attttt

SEQ ID NO: 95155 - DNA, 6 bp, Unknown
  misc_feature (1)..( 6): Result.001 file - promoters60/1017046
attttt

SEQ ID NO: 95156 - DNA, 8 bp, Unknown
  misc_feature (1)..( 8): Result.001 file - promoters60/1017046
catttttt

SEQ ID NO: 95157 - DNA, 8 bp, Unknown
  misc_feature (1)..( 8): Result.001 file - promoters60/1017046
catctttt

SEQ ID NO: 95158 - DNA, 10 bp, Unknown
  misc_feature (1)..( 10): Result.001 file - promoters60/1017046
tcgggatgga

SEQ ID NO: 95159 - DNA, 10 bp, Unknown
  misc_feature (1)..( 10): Result.001 file - promoters60/1017046
atgggttgga

SEQ ID NO: 95160 - DNA, 10 bp, Unknown
  misc_feature (1)..( 10): Result.001 file - promoters60/1017046
atggcttgca

SEQ ID NO: 95161 - DNA, 10 bp, Unknown
  misc_feature (1)..( 10): Result.001 file - promoters60/1017046
aaacaatgga

SEQ ID NO: 95162 - DNA, 10 bp, Unknown
  misc_feature (1)..( 10): Result.001 file - promoters60/1017046
aaacaaagga

SEQ ID NO: 95163 - DNA, 12 bp, Unknown
  misc_feature (1)..( 12): Result.001 file - promoters60/1017046
tagatttattaa

SEQ ID NO: 95164 - DNA, 12 bp, Unknown
  misc_feature (1)..( 12): Result.001 file - promoters60/1017046
tagaattactaa

SEQ ID NO: 95165 - DNA, 7 bp, Unknown
  misc_feature (1)..( 7): Result.001 file - promoters60/1017046
taataat

SEQ ID NO: 95166 - DNA, 7 bp, Unknown
  misc_feature (1)..( 7): Result.001 file - promoters60/1017046
taataat

SEQ ID NO: 95167 - DNA, 6 bp, Unknown
  misc_feature (1)..( 6): Result.001 file - promoters60/1017046
atattt

SEQ ID NO: 95168 - DNA, 6 bp, Unknown
  misc_feature (1)..( 6): Result.001 file - promoters60/1017046
atattt

SEQ ID NO: 95169 - DNA, 7 bp, Unknown
  misc_feature (1)..( 7): Result.001 file - promoters60/1017046
tatccaa

SEQ ID NO: 95170 - DNA, 7 bp, Unknown
  misc_feature (1)..( 7): Result.001 file - promoters60/1017046
tatacaa

SEQ ID NO: 95171 - DNA, 7 bp, Unknown
  misc_feature (1)..( 7): Result.001 file - promoters60/1017046
tataatt

SEQ ID NO: 95172 - DNA, 7 bp, Unknown
  misc_feature (1)..( 7): Result.001 file - promoters60/1017046
tatgatt

SEQ ID NO: 95173 - DNA, 6 bp, Unknown
  misc_feature (1)..( 6): Result.001 file - promoters60/1017046
aaaaaa

SEQ ID NO: 95174 - DNA, 6 bp, Unknown
  misc_feature (1)..( 6): Result.001 file - promoters60/1017046
aaaaaa

SEQ ID NO: 95175 - DNA, 7 bp, Unknown
  misc_feature (1)..( 7): Result.001 file - promoters60/1017046
aagagaa

SEQ ID NO: 95176 - DNA, 7 bp, Unknown
  misc_feature (1)..( 7): Result.001 file - promoters60/1017050
aagtgaa

SEQ ID NO: 95177 - DNA, 7 bp, Unknown
  misc_feature (1)..( 7): Result.001 file - promoters60/1017050
ttattgt

SEQ ID NO: 95178 - DNA, 7 bp, Unknown
  misc_feature (1)..( 7): Result.001 file - promoters60/1017050
atattgt

SEQ ID NO: 95179 - DNA, 7 bp, Unknown
  misc_feature (1)..( 7): Result.001 file - promoters60/1017050
atattga

SEQ ID NO: 95180 - DNA, 7 bp, Unknown
  misc_feature (1)..( 7): Result.001 file - promoters60/1017050
agaatcg

SEQ ID NO: 95181 - DNA, 7 bp, Unknown
  misc_feature (1)..( 7): Result.001 file - promoters60/1017050
agaatcg

SEQ ID NO: 95182 - DNA, 7 bp, Unknown
  misc_feature (1)..( 7): Result.001 file - promoters60/1017050
tctaatg

SEQ ID NO: 95183 - DNA, 7 bp, Unknown
  misc_feature (1)..( 7): Result.001 file - promoters60/1017050
tctgatg

SEQ ID NO: 95184 - DNA, 12 bp, Unknown
  misc_feature (1)..( 12): Result.001 file - promoters60/1017050
atgattatatga

SEQ ID NO: 95185 - DNA, 12 bp, Unknown
  misc_feature (1)..( 12): Result.001 file - promoters60/1017050
ttgattacatga

SEQ ID NO: 95186 - DNA, 12 bp, Unknown
  misc_feature (1)..( 12): Result.001 file - promoters60/1017050
ttgatttagggt

SEQ ID NO: 95187 - DNA, 6 bp, Unknown
  misc_feature (1)..( 6): Result.001 file - promoters60/1017050
tacaca

SEQ ID NO: 95188 - DNA, 6 bp, Unknown
  misc_feature (1)..( 6): Result.001 file - promoters60/1017050
tacaca

SEQ ID NO: 95189 - DNA, 7 bp, Unknown
  misc_feature (1)..( 7): Result.001 file - promoters60/1017050
ttgaaat

SEQ ID NO: 95190 - DNA, 7 bp, Unknown
  misc_feature (1)..( 7): Result.001 file - promoters60/1017050
ttgcaat

SEQ ID NO: 95191 - DNA, 6 bp, Unknown
  misc_feature (1)..( 6): Result.001 file - promoters60/1017050
tgattt

SEQ ID NO: 95192 - DNA, 6 bp, Unknown
  misc_feature (1)..( 6): Result.001 file - promoters60/1017050
tgattt

SEQ ID NO: 95193 - DNA, 6 bp, Unknown
  misc_feature (1)..( 6): Result.001 file - promoters60/1017050
acttct

SEQ ID NO: 95194 - DNA, 6 bp, Unknown
  misc_feature (1)..( 6): Result.001 file - promoters60/1017050
acttct

SEQ ID NO: 95195 - DNA, 7 bp, Unknown
  misc_feature (1)..( 7): Result.001 file - promoters60/1017050
ttttggg

SEQ ID NO: 95196 - DNA, 7 bp, Unknown
  misc_feature (1)..( 7): Result.001 file - promoters60/1017050
tttaggg

SEQ ID NO: 95197 - DNA, 6 bp, Unknown
  misc_feature (1)..( 6): Result.001 file - promoters60/1017050
tacata

SEQ ID NO: 95198 - DNA, 6 bp, Unknown
  misc_feature (1)..( 6): Result.001 file - promoters60/1017050
tacata

SEQ ID NO: 95199 - DNA, 7 bp, Unknown
  misc_feature (1)..( 7): Result.001 file - promoters60/1017050
ttgatat

SEQ ID NO: 95200 - DNA, 7 bp, Unknown
  misc_feature (1)..( 7): Result.001 file - promoters60/1017050
ttgatat

SEQ ID NO: 95201 - DNA, 6 bp, Unknown
  misc_feature (1)..( 6): Result.001 file - promoters60/1017050
catctg

SEQ ID NO: 95202 - DNA, 6 bp, Unknown
  misc_feature (1)..( 6): Result.001 file - promoters60/1017050
catctg

SEQ ID NO: 95203 - DNA, 9 bp, Unknown
  misc_feature (1)..( 9): Result.001 file - promoters60/1017050
ttgctgtag

SEQ ID NO: 95204 - DNA, 9 bp, Unknown
  misc_feature (1)..( 9): Result.001 file - promoters60/1017050
ttgatgtag

SEQ ID NO: 95205 - DNA, 8 bp, Unknown
  misc_feature (1)..( 8): Result.001 file - promoters60/1017050
ttgagttt

SEQ ID NO: 95206 - DNA, 8 bp, Unknown
  misc_feature (1)..( 8): Result.001 file - promoters60/1017050
ttgagttt

SEQ ID NO: 95207 - DNA, 7 bp, Unknown
  misc_feature (1)..( 7): Result.001 file - promoters60/1017050
gttctgt

SEQ ID NO: 95208 - DNA, 7 bp, Unknown
  misc_feature (1)..( 7): Result.001 file - promoters60/1017094
gttttgt

SEQ ID NO: 95209 - DNA, 7 bp, Unknown
  misc_feature (1)..( 7): Result.001 file - promoters60/1017094
cgaaatt

SEQ ID NO: 95210 - DNA, 7 bp, Unknown
  misc_feature (1)..( 7): Result.001 file - promoters60/1017094
cgagatt

SEQ ID NO: 95211 - DNA, 7 bp, Unknown
  misc_feature (1)..( 7): Result.001 file - promoters60/1017094
cgatatt

SEQ ID NO: 95212 - DNA, 7 bp, Unknown
  misc_feature (1)..( 7): Result.001 file - promoters60/1017094
tgatatt

SEQ ID NO: 95213 - DNA, 8 bp, Unknown
  misc_feature (1)..( 8): Result.001 file - promoters60/1017094
aaaattaa

SEQ ID NO: 95214 - DNA, 8 bp, Unknown
  misc_feature (1)..( 8): Result.001 file - promoters60/1017094
aaaattcc

SEQ ID NO: 95215 - DNA, 8 bp, Unknown
  misc_feature (1)..( 8): Result.001 file - promoters60/1017094
aaaataat

SEQ ID NO: 95216 - DNA, 8 bp, Unknown
  misc_feature (1)..( 8): Result.001 file - promoters60/1017094
aaagttct

SEQ ID NO: 95217 - DNA, 8 bp, Unknown
  misc_feature (1)..( 8): Result.001 file - promoters60/1017094
aattatat

SEQ ID NO: 95218 - DNA, 8 bp, Unknown
  misc_feature (1)..( 8): Result.001 file - promoters60/1017094
tattgtat

SEQ ID NO: 95219 - DNA, 8 bp, Unknown
  misc_feature (1)..( 8): Result.001 file - promoters60/1017094
aattgtat

SEQ ID NO: 95220 - DNA, 8 bp, Unknown
  misc_feature (1)..( 8): Result.001 file - promoters60/1017094
tattatag

SEQ ID NO: 95221 - DNA, 13 bp, Unknown
  misc_feature (1)..( 13): Result.001 file - promoters60/1017094
ttaacagagacat

SEQ ID NO: 95222 - DNA, 13 bp, Unknown
  misc_feature (1)..( 13): Result.001 file - promoters60/1017094
ttcctagatacag

SEQ ID NO: 95223 - DNA, 13 bp, Unknown
  misc_feature (1)..( 13): Result.001 file - promoters60/1017094
gattccgatccag

SEQ ID NO: 95224 - DNA, 13 bp, Unknown
  misc_feature (1)..( 13): Result.001 file - promoters60/1017131
ttcttagctacgt

SEQ ID NO: 95225 - DNA, 10 bp, Unknown
  misc_feature (1)..( 10): Result.001 file - promoters60/1017131
attaataaag

SEQ ID NO: 95226 - DNA, 10 bp, Unknown
  misc_feature (1)..( 10): Result.001 file - promoters60/1017131
attaataaaa

SEQ ID NO: 95227 - DNA, 10 bp, Unknown
  misc_feature (1)..( 10): Result.001 file - promoters60/1017131
aacaataaaa

SEQ ID NO: 95228 - DNA, 10 bp, Unknown
  misc_feature (1)..( 10): Result.001 file - promoters60/1017131
actaaaaaaa

SEQ ID NO: 95229 - DNA, 12 bp, Unknown
  misc_feature (1)..( 12): Result.001 file - promoters60/1017131
tttggataaaac

SEQ ID NO: 95230 - DNA, 12 bp, Unknown
  misc_feature (1)..( 12): Result.001 file - promoters60/1017131
gaaaagtaaaac

SEQ ID NO: 95231 - DNA, 12 bp, Unknown
  misc_feature (1)..( 12): Result.001 file - promoters60/1017131
tttgaataaaag

SEQ ID NO: 95232 - DNA, 12 bp, Unknown
  misc_feature (1)..( 12): Result.001 file - promoters60/1017131
aagggataaaag

SEQ ID NO: 95233 - DNA, 12 bp, Unknown
  misc_feature (1)..( 12): Result.001 file - promoters60/1017131
cttggatataat

SEQ ID NO: 95234 - DNA, 10 bp, Unknown
  misc_feature (1)..( 10): Result.001 file - promoters60/1017131
ttggataaaa

SEQ ID NO: 95235 - DNA, 10 bp, Unknown
  misc_feature (1)..( 10): Result.001 file - promoters60/1017131
ttggatataa

SEQ ID NO: 95236 - DNA, 10 bp, Unknown
  misc_feature (1)..( 10): Result.001 file - promoters60/1017131
agggataaaa

SEQ ID NO: 95237 - DNA, 10 bp, Unknown
  misc_feature (1)..( 10): Result.001 file - promoters60/1017282
ttgaataaaa

SEQ ID NO: 95238 - DNA, 10 bp, Unknown
  misc_feature (1)..( 10): Result.001 file - promoters60/1017282
caatccaaag

SEQ ID NO: 95239 - DNA, 10 bp, Unknown
  misc_feature (1)..( 10): Result.001 file - promoters60/1017282
aaatcgaaat

SEQ ID NO: 95240 - DNA, 10 bp, Unknown
  misc_feature (1)..( 10): Result.001 file - promoters60/1017282
aaaaccaaag

SEQ ID NO: 95241 - DNA, 10 bp, Unknown
  misc_feature (1)..( 10): Result.001 file - promoters60/1017282
aaatcgttag

SEQ ID NO: 95242 - DNA, 10 bp, Unknown
  misc_feature (1)..( 10): Result.001 file - promoters60/1017282
gaatcgatag

SEQ ID NO: 95243 - DNA, 10 bp, Unknown
  misc_feature (1)..( 10): Result.001 file - promoters60/1017282
aaatagatat

SEQ ID NO: 95244 - DNA, 10 bp, Unknown
  misc_feature (1)..( 10): Result.001 file - promoters60/1017282
aaagagatta

SEQ ID NO: 95245 - DNA, 10 bp, Unknown
  misc_feature (1)..( 10): Result.001 file - promoters60/1017282
aaatcgttag

SEQ ID NO: 95246 - DNA, 10 bp, Unknown
  misc_feature (1)..( 10): Result.001 file - promoters60/1017282
gaatcgatag

SEQ ID NO: 95247 - DNA, 10 bp, Unknown
  misc_feature (1)..( 10): Result.001 file - promoters60/1017282
aaatcgaaat

SEQ ID NO: 95248 - DNA, 10 bp, Unknown
  misc_feature (1)..( 10): Result.001 file - promoters60/1017282
aaatagatat

SEQ ID NO: 95249 - DNA, 10 bp, Unknown
  misc_feature (1)..( 10): Result.001 file - promoters60/1017282
aaagagatta

SEQ ID NO: 95250 - DNA, 10 bp, Unknown
  misc_feature (1)..( 10): Result.001 file - promoters60/1017286
caagagaaga

SEQ ID NO: 95251 - DNA, 10 bp, Unknown
  misc_feature (1)..( 10): Result.001 file - promoters60/1017286
aaaaaaatca

SEQ ID NO: 95252 - DNA, 10 bp, Unknown
  misc_feature (1)..( 10): Result.001 file - promoters60/1017286
aaaagaatca

SEQ ID NO: 95253 - DNA, 10 bp, Unknown
  misc_feature (1)..( 10): Result.001 file - promoters60/1017286
aaaataatat

SEQ ID NO: 95254 - DNA, 10 bp, Unknown
  misc_feature (1)..( 10): Result.001 file - promoters60/1017286
aaaaaaattc

SEQ ID NO: 95255 - DNA, 8 bp, Unknown
  misc_feature (1)..( 8): Result.001 file - promoters60/1017286
taatatgc

SEQ ID NO: 95256 - DNA, 8 bp, Unknown
  misc_feature (1)..( 8): Result.001 file - promoters60/1017286
caatatgt

SEQ ID NO: 95257 - DNA, 8 bp, Unknown
  misc_feature (1)..( 8): Result.001 file - promoters60/1017286
caatattt

SEQ ID NO: 95258 - DNA, 8 bp, Unknown
  misc_feature (1)..( 8): Result.001 file - promoters60/1017286
atatatgt

SEQ ID NO: 95259 - DNA, 12 bp, Unknown
  misc_feature (1)..( 12): Result.001 file - promoters60/1017286
atcttaaacaat

SEQ ID NO: 95260 - DNA, 12 bp, Unknown
  misc_feature (1)..( 12): Result.001 file - promoters60/1017286
gaagaaaaaaat

SEQ ID NO: 95261 - DNA, 12 bp, Unknown
  misc_feature (1)..( 12): Result.001 file - promoters60/1017286
ttctaaaataat

SEQ ID NO: 95262 - DNA, 12 bp, Unknown
  misc_feature (1)..( 12): Result.001 file - promoters60/1017286
ttctaactatat

SEQ ID NO: 95263 - DNA, 10 bp, Unknown
  misc_feature (1)..( 10): Result.001 file - promoters60/1017286
acaaacttat

SEQ ID NO: 95264 - DNA, 10 bp, Unknown
  misc_feature (1)..( 10): Result.001 file - promoters60/1017286
tcaaaattat

SEQ ID NO: 95265 - DNA, 10 bp, Unknown
  misc_feature (1)..( 10): Result.001 file - promoters60/1017286
acaatatttg

SEQ ID NO: 95266 - DNA, 10 bp, Unknown
  misc_feature (1)..( 10): Result.001 file - promoters60/1017286
tcaatatgtg

SEQ ID NO: 95267 - DNA, 10 bp, Unknown
  misc_feature (1)..( 10): Result.001 file - promoters60/1017286
tcaatagatc

SEQ ID NO: 95268 - DNA, 12 bp, Unknown
  misc_feature (1)..( 12): Result.001 file - promoters60/1017286
gatcttttctcg

SEQ ID NO: 95269 - DNA, 12 bp, Unknown
  misc_feature (1)..( 12): Result.001 file - promoters60/1017286
gatttttttttt

SEQ ID NO: 95270 - DNA, 12 bp, Unknown
  misc_feature (1)..( 12): Result.001 file - promoters60/1017286
gaacttgtctcc

SEQ ID NO: 95271 - DNA, 12 bp, Unknown
  misc_feature (1)..( 12): Result.001 file - promoters60/1017286
agaaaagtctcc

SEQ ID NO: 95272 - DNA, 9 bp, Unknown
  misc_feature (1)..( 9): Result.001 file - promoters60/1017286
cttttctcg

SEQ ID NO: 95273 - DNA, 9 bp, Unknown
  misc_feature (1)..( 9): Result.001 file - promoters60/1017286
tttttttcg

SEQ ID NO: 95274 - DNA, 9 bp, Unknown
  misc_feature (1)..( 9): Result.001 file - promoters60/1017286
cttgtctcc

SEQ ID NO: 95275 - DNA, 9 bp, Unknown
  misc_feature (1)..( 9): Result.001 file - promoters60/1017316
aaagtctcc

SEQ ID NO: 95276 - DNA, 10 bp, Unknown
  misc_feature (1)..( 10): Result.001 file - promoters60/1017316
tcaatttgaa

SEQ ID NO: 95277 - DNA, 10 bp, Unknown
  misc_feature (1)..( 10): Result.001 file - promoters60/1017316
aaaatttgat

SEQ ID NO: 95278 - DNA, 10 bp, Unknown
  misc_feature (1)..( 10): Result.001 file - promoters60/1017316
ttcattttta

SEQ ID NO: 95279 - DNA, 10 bp, Unknown
  misc_feature (1)..( 10): Result.001 file - promoters60/1017316
aaaaattgat

SEQ ID NO: 95280 - DNA, 11 bp, Unknown
  misc_feature (1)..( 11): Result.001 file - promoters60/1017316
tgaaaatcatc

SEQ ID NO: 95281 - DNA, 11 bp, Unknown
  misc_feature (1)..( 11): Result.001 file - promoters60/1017316
agaaaatttga

SEQ ID NO: 95282 - DNA, 11 bp, Unknown
  misc_feature (1)..( 11): Result.001 file - promoters60/1017316
tataaattcat

SEQ ID NO: 95283 - DNA, 11 bp, Unknown
  misc_feature (1)..( 11): Result.001 file - promoters60/1017316
tgataataata

SEQ ID NO: 95284 - DNA, 10 bp, Unknown
  misc_feature (1)..( 10): Result.001 file - promoters60/1017316
tttgtgtgtt

SEQ ID NO: 95285 - DNA, 10 bp, Unknown
  misc_feature (1)..( 10): Result.001 file - promoters60/1017316
tttttgtttg

SEQ ID NO: 95286 - DNA, 10 bp, Unknown
  misc_feature (1)..( 10): Result.001 file - promoters60/1017316
tttgtctgtt

SEQ ID NO: 95287 - DNA, 12 bp, Unknown
  misc_feature (1)..( 12): Result.001 file - promoters60/1017316
aaactcttaatt

SEQ ID NO: 95288 - DNA, 12 bp, Unknown
  misc_feature (1)..( 12): Result.001 file - promoters60/1017316
ggtaaattaatt

SEQ ID NO: 95289 - DNA, 12 bp, Unknown
  misc_feature (1)..( 12): Result.001 file - promoters60/1017316
aaattcttaatg

SEQ ID NO: 95290 - DNA, 11 bp, Unknown
  misc_feature (1)..( 11): Result.001 file - promoters60/1017316
ttgggctatat

SEQ ID NO: 95291 - DNA, 11 bp, Unknown
  misc_feature (1)..( 11): Result.001 file - promoters60/1017316
atgggctttat

SEQ ID NO: 95292 - DNA, 11 bp, Unknown
  misc_feature (1)..( 11): Result.001 file - promoters60/1017316
atgggcttata

SEQ ID NO: 95293 - DNA, 11 bp, Unknown
  misc_feature (1)..( 11): Result.001 file - promoters60/1017316
atgggcaaaat

SEQ ID NO: 95294 - DNA, 9 bp, Unknown
  misc_feature (1)..( 9): Result.001 file - promoters60/1017316
tttttactt

SEQ ID NO: 95295 - DNA, 9 bp, Unknown
  misc_feature (1)..( 9): Result.001 file - promoters60/1017316
ctttgactc

SEQ ID NO: 95296 - DNA, 9 bp, Unknown
  misc_feature (1)..( 9): Result.001 file - promoters60/1017316
tttttactt

SEQ ID NO: 95297 - DNA, 7 bp, Unknown
  misc_feature (1)..( 7): Result.001 file - promoters60/1017316
ttacttt

SEQ ID NO: 95298 - DNA, 7 bp, Unknown
  misc_feature (1)..( 7): Result.001 file - promoters60/1017316
ttactta

SEQ ID NO: 95299 - DNA, 7 bp, Unknown
  misc_feature (1)..( 7): Result.001 file - promoters60/1017316
ttacttt

SEQ ID NO: 95300 - DNA, 9 bp, Unknown
  misc_feature (1)..( 9): Result.001 file - promoters60/1017316
taatttcaa

SEQ ID NO: 95301 - DNA, 9 bp, Unknown
  misc_feature (1)..( 9): Result.001 file - promoters60/1017316
atgtttcaa

SEQ ID NO: 95302 - DNA, 9 bp, Unknown
  misc_feature (1)..( 9): Result.001 file - promoters60/1017358
atgtgtcag

SEQ ID NO: 95303 - DNA, 11 bp, Unknown
  misc_feature (1)..( 11): Result.001 file - promoters60/1017358
cattatatata

SEQ ID NO: 95304 - DNA, 11 bp, Unknown
  misc_feature (1)..( 11): Result.001 file - promoters60/1017358
acatatataaa

SEQ ID NO: 95305 - DNA, 11 bp, Unknown
  misc_feature (1)..( 11): Result.001 file - promoters60/1017358
gcctatatata

SEQ ID NO: 95306 - DNA, 11 bp, Unknown
  misc_feature (1)..( 11): Result.001 file - promoters60/1017358
ccttataaata

SEQ ID NO: 95307 - DNA, 11 bp, Unknown
  misc_feature (1)..( 11): Result.001 file - promoters60/1017358
tcttatatctt

SEQ ID NO: 95308 - DNA, 11 bp, Unknown
  misc_feature (1)..( 11): Result.001 file - promoters60/1017358
tgagatataat

SEQ ID NO: 95309 - DNA, 11 bp, Unknown
  misc_feature (1)..( 11): Result.001 file - promoters60/1017434
ccttaaaaacc

SEQ ID NO: 95310 - DNA, 12 bp, Unknown
  misc_feature (1)..( 12): Result.001 file - promoters60/1017434
agaaaatacccg

SEQ ID NO: 95311 - DNA, 12 bp, Unknown
  misc_feature (1)..( 12): Result.001 file - promoters60/1017434
aaaaattactct

SEQ ID NO: 95312 - DNA, 12 bp, Unknown
  misc_feature (1)..( 12): Result.001 file - promoters60/1017434
aagaataaccgt

SEQ ID NO: 95313 - DNA, 12 bp, Unknown
  misc_feature (1)..( 12): Result.001 file - promoters60/1017434
agaaaattcttg

SEQ ID NO: 95314 - DNA, 12 bp, Unknown
  misc_feature (1)..( 12): Result.001 file - promoters60/1017434
aagaagtaaagg

SEQ ID NO: 95315 - DNA, 12 bp, Unknown
  misc_feature (1)..( 12): Result.001 file - promoters60/1017434
acaaactgttgg

SEQ ID NO: 95316 - DNA, 12 bp, Unknown
  misc_feature (1)..( 12): Result.001 file - promoters60/1017434
ggccataaaaag

SEQ ID NO: 95317 - DNA, 12 bp, Unknown
  misc_feature (1)..( 12): Result.001 file - promoters60/1017434
tttattaaaaaa

SEQ ID NO: 95318 - DNA, 12 bp, Unknown
  misc_feature (1)..( 12): Result.001 file - promoters60/1017434
tttcttaaaagc

SEQ ID NO: 95319 - DNA, 13 bp, Unknown
  misc_feature (1)..( 13): Result.001 file - promoters60/1017434
cgagctaataaag

SEQ ID NO: 95320 - DNA, 13 bp, Unknown
  misc_feature (1)..( 13): Result.001 file - promoters60/1017434
tattttaaaacaa

SEQ ID NO: 95321 - DNA, 13 bp, Unknown
  misc_feature (1)..( 13): Result.001 file - promoters60/1017476
cgtttcaataaag

SEQ ID NO: 95322 - DNA, 7 bp, Unknown
  misc_feature (1)..( 7): Result.001 file - promoters60/1017476
ttaaata

SEQ ID NO: 95323 - DNA, 7 bp, Unknown
  misc_feature (1)..( 7): Result.001 file - promoters60/1017476
ttatata

SEQ ID NO: 95324 - DNA, 12 bp, Unknown
  misc_feature (1)..( 12): Result.001 file - promoters60/1017476
ttggatttcttt

SEQ ID NO: 95325 - DNA, 12 bp, Unknown
  misc_feature (1)..( 12): Result.001 file - promoters60/1017476
aagaatttgttt

SEQ ID NO: 95326 - DNA, 12 bp, Unknown
  misc_feature (1)..( 12): Result.001 file - promoters60/1017476
agaaattgcgcc

SEQ ID NO: 95327 - DNA, 8 bp, Unknown
  misc_feature (1)..( 8): Result.001 file - promoters60/1017476
aaaaaact

SEQ ID NO: 95328 - DNA, 8 bp, Unknown
  misc_feature (1)..( 8): Result.001 file - promoters60/1017476
aaagaacg

SEQ ID NO: 95329 - DNA, 8 bp, Unknown
  misc_feature (1)..( 8): Result.001 file - promoters60/1017476
aaagaaac

SEQ ID NO: 95330 - DNA, 7 bp, Unknown
  misc_feature (1)..( 7): Result.001 file - promoters60/1017476
tttttga

SEQ ID NO: 95331 - DNA, 7 bp, Unknown
  misc_feature (1)..( 7): Result.001 file - promoters60/1017476
tttgtga

SEQ ID NO: 95332 - DNA, 6 bp, Unknown
  misc_feature (1)..( 6): Result.001 file - promoters60/1017476
gtttgg

SEQ ID NO: 95333 - DNA, 6 bp, Unknown
  misc_feature (1)..( 6): Result.001 file - promoters60/1017476
gtttgg

SEQ ID NO: 95334 - DNA, 8 bp, Unknown
  misc_feature (1)..( 8): Result.001 file - promoters60/1017476
aaggtttt

SEQ ID NO: 95335 - DNA, 8 bp, Unknown
  misc_feature (1)..( 8): Result.001 file - promoters60/1017476
aaggtttg

SEQ ID NO: 95336 - DNA, 8 bp, Unknown
  misc_feature (1)..( 8): Result.001 file - promoters60/1017476
ttggtttt

SEQ ID NO: 95337 - DNA, 9 bp, Unknown
  misc_feature (1)..( 9): Result.001 file - promoters60/1017476
ttttatttt

SEQ ID NO: 95338 - DNA, 9 bp, Unknown
  misc_feature (1)..( 9): Result.001 file - promoters60/1017476
tcatatttt

SEQ ID NO: 95339 - DNA, 9 bp, Unknown
  misc_feature (1)..( 9): Result.001 file - promoters60/1017476
tttcattta

SEQ ID NO: 95340 - DNA, 8 bp, Unknown
  misc_feature (1)..( 8): Result.001 file - promoters60/1017476
tgaaatta

SEQ ID NO: 95341 - DNA, 8 bp, Unknown
  misc_feature (1)..( 8): Result.001 file - promoters60/1017476
tgagatta

SEQ ID NO: 95342 - DNA, 6 bp, Unknown
  misc_feature (1)..( 6): Result.001 file - promoters60/1017476
gaaggt

SEQ ID NO: 95343 - DNA, 6 bp, Unknown
  misc_feature (1)..( 6): Result.001 file - promoters60/1017476
gaaggt

SEQ ID NO: 95344 - DNA, 8 bp, Unknown
  misc_feature (1)..( 8): Result.001 file - promoters60/1017476
aaaaaaaa

SEQ ID NO: 95345 - DNA, 8 bp, Unknown
  misc_feature (1)..( 8): Result.001 file - promoters60/1017476
aaaagaaa

SEQ ID NO: 95346 - DNA, 7 bp, Unknown
  misc_feature (1)..( 7): Result.001 file - promoters60/1017476
ttactct

SEQ ID NO: 95347 - DNA, 7 bp, Unknown
  misc_feature (1)..( 7): Result.001 file - promoters60/1017476
ttaatct

SEQ ID NO: 95348 - DNA, 6 bp, Unknown
  misc_feature (1)..( 6): Result.001 file - promoters60/1017476
atcaga

SEQ ID NO: 95349 - DNA, 6 bp, Unknown
  misc_feature (1)..( 6): Result.001 file - promoters60/1017476
atcaga

SEQ ID NO: 95350 - DNA, 6 bp, Unknown
  misc_feature (1)..( 6): Result.001 file - promoters60/1017476
acgaat

SEQ ID NO: 95351 - DNA, 6 bp, Unknown
  misc_feature (1)..( 6): Result.001 file - promoters60/1017476
acgaat

SEQ ID NO: 95352 - DNA, 7 bp, Unknown
  misc_feature (1)..( 7): Result.001 file - promoters60/1017476
gacatcg

SEQ ID NO: 95353 - DNA, 7 bp, Unknown
  misc_feature (1)..( 7): Result.001 file - promoters60/1017476
gacgtcg

SEQ ID NO: 95354 - DNA, 6 bp, Unknown
  misc_feature (1)..( 6): Result.001 file - promoters60/1017476
gaccat

SEQ ID NO: 95355 - DNA, 6 bp, Unknown
  misc_feature (1)..( 6): Result.001 file - promoters60/1017476
gaccat

SEQ ID NO: 95356 - DNA, 7 bp, Unknown
  misc_feature (1)..( 7): Result.001 file - promoters60/1017476
ttcgaga

SEQ ID NO: 95357 - DNA, 7 bp, Unknown
  misc_feature (1)..( 7): Result.001 file - promoters60/1017552
ttcgaga

SEQ ID NO: 95358 - DNA, 10 bp, Unknown
  misc_feature (1)..( 10): Result.001 file - promoters60/1017552
agaattataa

SEQ ID NO: 95359 - DNA, 10 bp, Unknown
  misc_feature (1)..( 10): Result.001 file - promoters60/1017552
aacattgtaa

SEQ ID NO: 95360 - DNA, 10 bp, Unknown
  misc_feature (1)..( 10): Result.001 file - promoters60/1017552
agagttatgc

SEQ ID NO: 95361 - DNA, 6 bp, Unknown
  misc_feature (1)..( 6): Result.001 file - promoters60/1017552
ggaaaa

SEQ ID NO: 95362 - DNA, 6 bp, Unknown
  misc_feature (1)..( 6): Result.001 file - promoters60/1017552
ggaaaa

SEQ ID NO: 95363 - DNA, 6 bp, Unknown
  misc_feature (1)..( 6): Result.001 file - promoters60/1017552
ggaaaa

SEQ ID NO: 95364 - DNA, 7 bp, Unknown
  misc_feature (1)..( 7): Result.001 file - promoters60/1017552
ttacaac

SEQ ID NO: 95365 - DNA, 7 bp, Unknown
  misc_feature (1)..( 7): Result.001 file - promoters60/1017552
ttagaac

SEQ ID NO: 95366 - DNA, 7 bp, Unknown
  misc_feature (1)..( 7): Result.001 file - promoters60/1017552
ttagaaa

SEQ ID NO: 95367 - DNA, 7 bp, Unknown
  misc_feature (1)..( 7): Result.001 file - promoters60/1017552
tacaaag

SEQ ID NO: 95368 - DNA, 7 bp, Unknown
  misc_feature (1)..( 7): Result.001 file - promoters60/1017552
gacaaag

SEQ ID NO: 95369 - DNA, 7 bp, Unknown
  misc_feature (1)..( 7): Result.001 file - promoters60/1017562
gacaaaa

SEQ ID NO: 95370 - DNA, 6 bp, Unknown
  misc_feature (1)..( 6): Result.001 file - promoters60/1017562
ttacta

SEQ ID NO: 95371 - DNA, 6 bp, Unknown
  misc_feature (1)..( 6): Result.001 file - promoters60/1017562
ttacta

SEQ ID NO: 95372 - DNA, 9 bp, Unknown
  misc_feature (1)..( 9): Result.001 file - promoters60/1017562
atatatatt

SEQ ID NO: 95373 - DNA, 9 bp, Unknown
  misc_feature (1)..( 9): Result.001 file - promoters60/1017562
ttatgtata

SEQ ID NO: 95374 - DNA, 9 bp, Unknown
  misc_feature (1)..( 9): Result.001 file - promoters60/1017562
atatatatt

SEQ ID NO: 95375 - DNA, 10 bp, Unknown
  misc_feature (1)..( 10): Result.001 file - promoters60/1017562
atatatatta

SEQ ID NO: 95376 - DNA, 10 bp, Unknown
  misc_feature (1)..( 10): Result.001 file - promoters60/1017562
tataatatta

SEQ ID NO: 95377 - DNA, 10 bp, Unknown
  misc_feature (1)..( 10): Result.001 file - promoters60/1017562
atatatattg

SEQ ID NO: 95378 - DNA, 7 bp, Unknown
  misc_feature (1)..( 7): Result.001 file - promoters60/1017562
tagactt

SEQ ID NO: 95379 - DNA, 7 bp, Unknown
  misc_feature (1)..( 7): Result.001 file - promoters60/1017562
tagcctt

SEQ ID NO: 95380 - DNA, 7 bp, Unknown
  misc_feature (1)..( 7): Result.001 file - promoters60/1017562
tgggtgg

SEQ ID NO: 95381 - DNA, 7 bp, Unknown
  misc_feature (1)..( 7): Result.001 file - promoters60/1017562
tggttgg

SEQ ID NO: 95382 - DNA, 9 bp, Unknown
  misc_feature (1)..( 9): Result.001 file - promoters60/1017562
aatcaaaca

SEQ ID NO: 95383 - DNA, 9 bp, Unknown
  misc_feature (1)..( 9): Result.001 file - promoters60/1017562
aatccaact

SEQ ID NO: 95384 - DNA, 9 bp, Unknown
  misc_feature (1)..( 9): Result.001 file - promoters60/1017562
aatcagaca

SEQ ID NO: 95385 - DNA, 6 bp, Unknown
  misc_feature (1)..( 6): Result.001 file - promoters60/1017562
ccaaaa

SEQ ID NO: 95386 - DNA, 6 bp, Unknown
  misc_feature (1)..( 6): Result.001 file - promoters60/1017562
ccaaaa

SEQ ID NO: 95387 - DNA, 8 bp, Unknown
  misc_feature (1)..( 8): Result.001 file - promoters60/1017562
cttagata

SEQ ID NO: 95388 - DNA, 8 bp, Unknown
  misc_feature (1)..( 8): Result.001 file - promoters60/1017562
cttagata

SEQ ID NO: 95389 - DNA, 6 bp, Unknown
  misc_feature (1)..( 6): Result.001 file - promoters60/1017562
atataa

SEQ ID NO: 95390 - DNA, 6 bp, Unknown
  misc_feature (1)..( 6): Result.001 file - promoters60/1017562
atataa

SEQ ID NO: 95391 - DNA, 9 bp, Unknown
  misc_feature (1)..( 9): Result.001 file - promoters60/1017562
ccattaaac

SEQ ID NO: 95392 - DNA, 9 bp, Unknown
  misc_feature (1)..( 9): Result.001 file - promoters60/1017562
ccatttaac

SEQ ID NO: 95393 - DNA, 8 bp, Unknown
  misc_feature (1)..( 8): Result.001 file - promoters60/1017562
caaagttt

SEQ ID NO: 95394 - DNA, 8 bp, Unknown
  misc_feature (1)..( 8): Result.001 file - promoters60/1017562
caacgttt

SEQ ID NO: 95395 - DNA, 6 bp, Unknown
  misc_feature (1)..( 6): Result.001 file - promoters60/1017562
ttgttt

SEQ ID NO: 95396 - DNA, 6 bp, Unknown
  misc_feature (1)..( 6): Result.001 file - promoters60/1017562
ttgttt

SEQ ID NO: 95397 - DNA, 9 bp, Unknown
  misc_feature (1)..( 9): Result.001 file - promoters60/1017562
aaaaagtgt

SEQ ID NO: 95398 - DNA, 9 bp, Unknown
  misc_feature (1)..( 9): Result.001 file - promoters60/1017562
aaaaactgt

SEQ ID NO: 95399 - DNA, 6 bp, Unknown
  misc_feature (1)..( 6): Result.001 file - promoters60/1017562
taacac

SEQ ID NO: 95400 - DNA, 6 bp, Unknown
  misc_feature (1)..( 6): Result.001 file - promoters60/1017562
taacac

SEQ ID NO: 95401 - DNA, 6 bp, Unknown
  misc_feature (1)..( 6): Result.001 file - promoters60/1017562
caaaaa

SEQ ID NO: 95402 - DNA, 6 bp, Unknown
  misc_feature (1)..( 6): Result.001 file - promoters60/1017562
caaaaa

SEQ ID NO: 95403 - DNA, 8 bp, Unknown
  misc_feature (1)..( 8): Result.001 file - promoters60/1017562
ataaatat

SEQ ID NO: 95404 - DNA, 8 bp, Unknown
  misc_feature (1)..( 8): Result.001 file - promoters60/1017562
atatatat

SEQ ID NO: 95405 - DNA, 7 bp, Unknown
  misc_feature (1)..( 7): Result.001 file - promoters60/1017562
aaatcag

SEQ ID NO: 95406 - DNA, 7 bp, Unknown
  misc_feature (1)..( 7): Result.001 file - promoters60/1017562
aaaccag

SEQ ID NO: 95407 - DNA, 7 bp, Unknown
  misc_feature (1)..( 7): Result.001 file - promoters60/1017562
gaataaa

SEQ ID NO: 95408 - DNA, 7 bp, Unknown
  misc_feature (1)..( 7): Result.001 file - promoters60/1017562
gaaaaaa

SEQ ID NO: 95409 - DNA, 7 bp, Unknown
  misc_feature (1)..( 7): Result.001 file - promoters60/1017562
acctcat

SEQ ID NO: 95410 - DNA, 7 bp, Unknown
  misc_feature (1)..( 7): Result.001 file - promoters60/1017562
accacat

SEQ ID NO: 95411 - DNA, 7 bp, Unknown
  misc_feature (1)..( 7): Result.001 file - promoters60/1017562
aaaagat

SEQ ID NO: 95412 - DNA, 7 bp, Unknown
  misc_feature (1)..( 7): Result.001 file - promoters60/1017618
aaatgat

SEQ ID NO: 95413 - DNA, 11 bp, Unknown
  misc_feature (1)..( 11): Result.001 file - promoters60/1017618
atatcatataa

SEQ ID NO: 95414 - DNA, 11 bp, Unknown
  misc_feature (1)..( 11): Result.001 file - promoters60/1017618
acgtcatattg

SEQ ID NO: 95415 - DNA, 11 bp, Unknown
  misc_feature (1)..( 11): Result.001 file - promoters60/1017618
atatcttattg

SEQ ID NO: 95416 - DNA, 11 bp, Unknown
  misc_feature (1)..( 11): Result.001 file - promoters60/1017618
tgataatatct

SEQ ID NO: 95417 - DNA, 13 bp, Unknown
  misc_feature (1)..( 13): Result.001 file - promoters60/1017618
tcctataataaat

SEQ ID NO: 95418 - DNA, 13 bp, Unknown
  misc_feature (1)..( 13): Result.001 file - promoters60/1017618
gcctttaaaaaag

SEQ ID NO: 95419 - DNA, 13 bp, Unknown
  misc_feature (1)..( 13): Result.001 file - promoters60/1017618
tcctataaatata

SEQ ID NO: 95420 - DNA, 13 bp, Unknown
  misc_feature (1)..( 13): Result.001 file - promoters60/1017618
aagatcaaaaagc

SEQ ID NO: 95421 - DNA, 8 bp, Unknown
  misc_feature (1)..( 8): Result.001 file - promoters60/1017618
ttaagaag

SEQ ID NO: 95422 - DNA, 8 bp, Unknown
  misc_feature (1)..( 8): Result.001 file - promoters60/1017618
ttatgaaa

SEQ ID NO: 95423 - DNA, 8 bp, Unknown
  misc_feature (1)..( 8): Result.001 file - promoters60/1017618
ctatgaac

SEQ ID NO: 95424 - DNA, 9 bp, Unknown
  misc_feature (1)..( 9): Result.001 file - promoters60/1017618
ccatgcaaa

SEQ ID NO: 95425 - DNA, 10 bp, Unknown
  misc_feature (1)..( 10): Result.001 file - promoters60/1017618
taatgtctcg

SEQ ID NO: 95426 - DNA, 10 bp, Unknown
  misc_feature (1)..( 10): Result.001 file - promoters60/1017618
taatatctca

SEQ ID NO: 95427 - DNA, 10 bp, Unknown
  misc_feature (1)..( 10): Result.001 file - promoters60/1017618
tgatggctcg

SEQ ID NO: 95428 - DNA, 10 bp, Unknown
  misc_feature (1)..( 10): Result.001 file - promoters60/1017626
taatataaaa

SEQ ID NO: 95429 - DNA, 10 bp, Unknown
  misc_feature (1)..( 10): Result.001 file - promoters60/1017626
tcagtaaaaa

SEQ ID NO: 95430 - DNA, 10 bp, Unknown
  misc_feature (1)..( 10): Result.001 file - promoters60/1017626
tcattaaaaa

SEQ ID NO: 95431 - DNA, 6 bp, Unknown
  misc_feature (1)..( 6): Result.001 file - promoters60/1017626
aaaaaa

SEQ ID NO: 95432 - DNA, 6 bp, Unknown
  misc_feature (1)..( 6): Result.001 file - promoters60/1017626
aaaaaa

SEQ ID NO: 95433 - DNA, 6 bp, Unknown
  misc_feature (1)..( 6): Result.001 file - promoters60/1017626
aattta

SEQ ID NO: 95434 - DNA, 6 bp, Unknown
  misc_feature (1)..( 6): Result.001 file - promoters60/1017626
aattta

SEQ ID NO: 95435 - DNA, 6 bp, Unknown
  misc_feature (1)..( 6): Result.001 file - promoters60/1017626
tttaat

SEQ ID NO: 95436 - DNA, 6 bp, Unknown
  misc_feature (1)..( 6): Result.001 file - promoters60/1017626
tttaat

SEQ ID NO: 95437 - DNA, 9 bp, Unknown
  misc_feature (1)..( 9): Result.001 file - promoters60/1017626
tttcataac

SEQ ID NO: 95438 - DNA, 9 bp, Unknown
  misc_feature (1)..( 9): Result.001 file - promoters60/1017626
ttttataat

SEQ ID NO: 95439 - DNA, 9 bp, Unknown
  misc_feature (1)..( 9): Result.001 file - promoters60/1017626
tattaaaat

SEQ ID NO: 95440 - DNA, 9 bp, Unknown
  misc_feature (1)..( 9): Result.001 file - promoters60/1017626
tatccggtt

SEQ ID NO: 95441 - DNA, 9 bp, Unknown
  misc_feature (1)..( 9): Result.001 file - promoters60/1017626
tatcgggtt

SEQ ID NO: 95442 - DNA, 6 bp, Unknown
  misc_feature (1)..( 6): Result.001 file - promoters60/1017626
ataagt

SEQ ID NO: 95443 - DNA, 6 bp, Unknown
  misc_feature (1)..( 6): Result.001 file - promoters60/1017626
ataagt

SEQ ID NO: 95444 - DNA, 7 bp, Unknown
  misc_feature (1)..( 7): Result.001 file - promoters60/1017626
tctctct

SEQ ID NO: 95445 - DNA, 7 bp, Unknown
  misc_feature (1)..( 7): Result.001 file - promoters60/1017626
tctctcg

SEQ ID NO: 95446 - DNA, 7 bp, Unknown
  misc_feature (1)..( 7): Result.001 file - promoters60/1017626
tctttct

SEQ ID NO: 95447 - DNA, 9 bp, Unknown
  misc_feature (1)..( 9): Result.001 file - promoters60/1017626
tcttcctct

SEQ ID NO: 95448 - DNA, 9 bp, Unknown
  misc_feature (1)..( 9): Result.001 file - promoters60/1017626
tcttcatct

SEQ ID NO: 95449 - DNA, 7 bp, Unknown
  misc_feature (1)..( 7): Result.001 file - promoters60/1017626
aaattgg

SEQ ID NO: 95450 - DNA, 7 bp, Unknown
  misc_feature (1)..( 7): Result.001 file - promoters60/1017626
aaattgg

SEQ ID NO: 95451 - DNA, 7 bp, Unknown
  misc_feature (1)..( 7): Result.001 file - promoters60/1017626
gaacaaa

SEQ ID NO: 95452 - DNA, 7 bp, Unknown
  misc_feature (1)..( 7): Result.001 file - promoters60/1017626
gaataaa

SEQ ID NO: 95453 - DNA, 7 bp, Unknown
  misc_feature (1)..( 7): Result.001 file - promoters60/1017626
atgaaat

SEQ ID NO: 95454 - DNA, 7 bp, Unknown
  misc_feature (1)..( 7): Result.001 file - promoters60/1017626
atgtaat

SEQ ID NO: 95455 - DNA, 8 bp, Unknown
  misc_feature (1)..( 8): Result.001 file - promoters60/1017626
ctttaaat

SEQ ID NO: 95456 - DNA, 8 bp, Unknown
  misc_feature (1)..( 8): Result.001 file - promoters60/1017626
cttgaaat

SEQ ID NO: 95457 - DNA, 6 bp, Unknown
  misc_feature (1)..( 6): Result.001 file - promoters60/1017626
aattag

SEQ ID NO: 95458 - DNA, 6 bp, Unknown
  misc_feature (1)..( 6): Result.001 file - promoters60/1017626
aattag

SEQ ID NO: 95459 - DNA, 7 bp, Unknown
  misc_feature (1)..( 7): Result.001 file - promoters60/1017626
ttttatc

SEQ ID NO: 95460 - DNA, 7 bp, Unknown
  misc_feature (1)..( 7): Result.001 file - promoters60/1017626
tttgatc

SEQ ID NO: 95461 - DNA, 6 bp, Unknown
  misc_feature (1)..( 6): Result.001 file - promoters60/1017626
aaatta

SEQ ID NO: 95462 - DNA, 6 bp, Unknown
  misc_feature (1)..( 6): Result.001 file - promoters60/1017626
aaatta

SEQ ID NO: 95463 - DNA, 7 bp, Unknown
  misc_feature (1)..( 7): Result.001 file - promoters60/1017626
ccatctc

SEQ ID NO: 95464 - DNA, 7 bp, Unknown
  misc_feature (1)..( 7): Result.001 file - promoters60/1017626
ccatcta

SEQ ID NO: 95465 - DNA, 7 bp, Unknown
  misc_feature (1)..( 7): Result.001 file - promoters60/1017626
ccaacta

SEQ ID NO: 95466 - DNA, 7 bp, Unknown
  misc_feature (1)..( 7): Result.001 file - promoters60/1017626
aaatcaa

SEQ ID NO: 95467 - DNA, 7 bp, Unknown
  misc_feature (1)..( 7): Result.001 file - promoters60/1017626
aaaccaa

SEQ ID NO: 95468 - DNA, 6 bp, Unknown
  misc_feature (1)..( 6): Result.001 file - promoters60/1017626
taataa

SEQ ID NO: 95469 - DNA, 6 bp, Unknown
  misc_feature (1)..( 6): Result.001 file - promoters60/1017626
taataa

SEQ ID NO: 95470 - DNA, 6 bp, Unknown
  misc_feature (1)..( 6): Result.001 file - promoters60/1017626
agttct

SEQ ID NO: 95471 - DNA, 6 bp, Unknown
  misc_feature (1)..( 6): Result.001 file - promoters60/1017626
agttct

SEQ ID NO: 95472 - DNA, 7 bp, Unknown
  misc_feature (1)..( 7): Result.001 file - promoters60/1017626
gaagact

SEQ ID NO: 95473 - DNA, 7 bp, Unknown
  misc_feature (1)..( 7): Result.001 file - promoters60/1017626
gaaaact

SEQ ID NO: 95474 - DNA, 6 bp, Unknown
  misc_feature (1)..( 6): Result.001 file - promoters60/1017626
actcat

SEQ ID NO: 95475 - DNA, 6 bp, Unknown
  misc_feature (1)..( 6): Result.001 file - promoters60/1017626
actcat

SEQ ID NO: 95476 - DNA, 7 bp, Unknown
  misc_feature (1)..( 7): Result.001 file - promoters60/1017626
gcctata

SEQ ID NO: 95477 - DNA, 7 bp, Unknown
  misc_feature (1)..( 7): Result.001 file - promoters60/1017626
gcctata

SEQ ID NO: 95478 - DNA, 7 bp, Unknown
  misc_feature (1)..( 7): Result.001 file - promoters60/1017626
tataaat

SEQ ID NO: 95479 - DNA, 7 bp, Unknown
  misc_feature (1)..( 7): Result.001 file - promoters60/1017649
tataaat

SEQ ID NO: 95480 - DNA, 6 bp, Unknown
  misc_feature (1)..( 6): Result.001 file - promoters60/1017649
caaaca

SEQ ID NO: 95481 - DNA, 6 bp, Unknown
  misc_feature (1)..( 6): Result.001 file - promoters60/1017649
caaaca

SEQ ID NO: 95482 - DNA, 8 bp, Unknown
  misc_feature (1)..( 8): Result.001 file - promoters60/1017649
caaataaa

SEQ ID NO: 95483 - DNA, 8 bp, Unknown
  misc_feature (1)..( 8): Result.001 file - promoters60/1017649
gaaagaaa

SEQ ID NO: 95484 - DNA, 8 bp, Unknown
  misc_feature (1)..( 8): Result.001 file - promoters60/1017649
caagtaat

SEQ ID NO: 95485 - DNA, 8 bp, Unknown
  misc_feature (1)..( 8): Result.001 file - promoters60/1017649
actactaa

SEQ ID NO: 95486 - DNA, 8 bp, Unknown
  misc_feature (1)..( 8): Result.001 file - promoters60/1017649
actactga

SEQ ID NO: 95487 - DNA, 8 bp, Unknown
  misc_feature (1)..( 8): Result.001 file - promoters60/1017649
actaatga

SEQ ID NO: 95488 - DNA, 7 bp, Unknown
  misc_feature (1)..( 7): Result.001 file - promoters60/1017649
ctttgaa

SEQ ID NO: 95489 - DNA, 7 bp, Unknown
  misc_feature (1)..( 7): Result.001 file - promoters60/1017649
ctttgaa

SEQ ID NO: 95490 - DNA, 9 bp, Unknown
  misc_feature (1)..( 9): Result.001 file - promoters60/1017649
taatctcta

SEQ ID NO: 95491 - DNA, 9 bp, Unknown
  misc_feature (1)..( 9): Result.001 file - promoters60/1017649
taaactcta

SEQ ID NO: 95492 - DNA, 8 bp, Unknown
  misc_feature (1)..( 8): Result.001 file - promoters60/1017649
aattttat

SEQ ID NO: 95493 - DNA, 8 bp, Unknown
  misc_feature (1)..( 8): Result.001 file - promoters60/1017649
aattttat

SEQ ID NO: 95494 - DNA, 7 bp, Unknown
  misc_feature (1)..( 7): Result.001 file - promoters60/1017649
attttag

SEQ ID NO: 95495 - DNA, 7 bp, Unknown
  misc_feature (1)..( 7): Result.001 file - promoters60/1017649
attatag

SEQ ID NO: 95496 - DNA, 7 bp, Unknown
  misc_feature (1)..( 7): Result.001 file - promoters60/1017649
atacaaa

SEQ ID NO: 95497 - DNA, 7 bp, Unknown
  misc_feature (1)..( 7): Result.001 file - promoters60/1017649
ataaaaa

SEQ ID NO: 95498 - DNA, 6 bp, Unknown
  misc_feature (1)..( 6): Result.001 file - promoters60/1017649
aaataa

SEQ ID NO: 95499 - DNA, 6 bp, Unknown
  misc_feature (1)..( 6): Result.001 file - promoters60/1017649
aaataa

SEQ ID NO: 95500 - DNA, 7 bp, Unknown
  misc_feature (1)..( 7): Result.001 file - promoters60/1017649
aacattt

SEQ ID NO: 95501 - DNA, 7 bp, Unknown
  misc_feature (1)..( 7): Result.001 file - promoters60/1017649
aactttt

SEQ ID NO: 95502 - DNA, 6 bp, Unknown
  misc_feature (1)..( 6): Result.001 file - promoters60/1017649
tttgat

SEQ ID NO: 95503 - DNA, 6 bp, Unknown
  misc_feature (1)..( 6): Result.001 file - promoters60/1017649
tttgat

SEQ ID NO: 95504 - DNA, 7 bp, Unknown
  misc_feature (1)..( 7): Result.001 file - promoters60/1017649
aaactca

SEQ ID NO: 95505 - DNA, 7 bp, Unknown
  misc_feature (1)..( 7): Result.001 file - promoters60/1017649
aaagtca

SEQ ID NO: 95506 - DNA, 8 bp, Unknown
  misc_feature (1)..( 8): Result.001 file - promoters60/1017649
aatttgat

SEQ ID NO: 95507 - DNA, 8 bp, Unknown
  misc_feature (1)..( 8): Result.001 file - promoters60/1017649
aatttgat

SEQ ID NO: 95508 - DNA, 7 bp, Unknown
  misc_feature (1)..( 7): Result.001 file - promoters60/1017649
ataagac

SEQ ID NO: 95509 - DNA, 7 bp, Unknown
  misc_feature (1)..( 7): Result.001 file - promoters60/1017649
ataggac

SEQ ID NO: 95510 - DNA, 7 bp, Unknown
  misc_feature (1)..( 7): Result.001 file - promoters60/1017649
caagaag

SEQ ID NO: 95511 - DNA, 7 bp, Unknown
  misc_feature (1)..( 7): Result.001 file - promoters60/1017649
caaaaag

SEQ ID NO: 95512 - DNA, 6 bp, Unknown
  misc_feature (1)..( 6): Result.001 file - promoters60/1017649
ttgatg

SEQ ID NO: 95513 - DNA, 6 bp, Unknown
  misc_feature (1)..( 6): Result.001 file - promoters60/1017649
ttgatg

SEQ ID NO: 95514 - DNA, 6 bp, Unknown
  misc_feature (1)..( 6): Result.001 file - promoters60/1017649
cacatc

SEQ ID NO: 95515 - DNA, 6 bp, Unknown
  misc_feature (1)..( 6): Result.001 file - promoters60/1017693
cacatc

SEQ ID NO: 95516 - DNA, 8 bp, Unknown
  misc_feature (1)..( 8): Result.001 file - promoters60/1017693
aatatagt

SEQ ID NO: 95517 - DNA, 8 bp, Unknown
  misc_feature (1)..( 8): Result.001 file - promoters60/1017693
aataaagt

SEQ ID NO: 95518 - DNA, 7 bp, Unknown
  misc_feature (1)..( 7): Result.001 file - promoters60/1017693
attggta

SEQ ID NO: 95519 - DNA, 7 bp, Unknown
  misc_feature (1)..( 7): Result.001 file - promoters60/1017693
atttgta

SEQ ID NO: 95520 - DNA, 9 bp, Unknown
  misc_feature (1)..( 9): Result.001 file - promoters60/1017693
atgtttttg

SEQ ID NO: 95521 - DNA, 9 bp, Unknown
  misc_feature (1)..( 9): Result.001 file - promoters60/1017693
atgtctttg

SEQ ID NO: 95522 - DNA, 6 bp, Unknown
  misc_feature (1)..( 6): Result.001 file - promoters60/1017693
aaaaac

SEQ ID NO: 95523 - DNA, 6 bp, Unknown
  misc_feature (1)..( 6): Result.001 file - promoters60/1017693
aaaaac

SEQ ID NO: 95524 - DNA, 6 bp, Unknown
  misc_feature (1)..( 6): Result.001 file - promoters60/1017693
tccaaa

SEQ ID NO: 95525 - DNA, 6 bp, Unknown
  misc_feature (1)..( 6): Result.001 file - promoters60/1017693
tccaaa

SEQ ID NO: 95526 - DNA, 7 bp, Unknown
  misc_feature (1)..( 7): Result.001 file - promoters60/1017693
aatctat

SEQ ID NO: 95527 - DNA, 7 bp, Unknown
  misc_feature (1)..( 7): Result.001 file - promoters60/1017693
aatctat

SEQ ID NO: 95528 - DNA, 6 bp, Unknown
  misc_feature (1)..( 6): Result.001 file - promoters60/1017693
tgtgtt

SEQ ID NO: 95529 - DNA, 6 bp, Unknown
  misc_feature (1)..( 6): Result.001 file - promoters60/1017693
tgtgtt

SEQ ID NO: 95530 - DNA, 10 bp, Unknown
  misc_feature (1)..( 10): Result.001 file - promoters60/1017693
ttttcttctc

SEQ ID NO: 95531 - DNA, 10 bp, Unknown
  misc_feature (1)..( 10): Result.001 file - promoters60/1017693
ttttcttctc

SEQ ID NO: 95532 - DNA, 6 bp, Unknown
  misc_feature (1)..( 6): Result.001 file - promoters60/1017693
tggtca

SEQ ID NO: 95533 - DNA, 6 bp, Unknown
  misc_feature (1)..( 6): Result.001 file - promoters60/1017693
tggtca

SEQ ID NO: 95534 - DNA, 6 bp, Unknown
  misc_feature (1)..( 6): Result.001 file - promoters60/1017693
tggaaa

SEQ ID NO: 95535 - DNA, 6 bp, Unknown
  misc_feature (1)..( 6): Result.001 file - promoters60/1017693
tggaaa

SEQ ID NO: 95536 - DNA, 7 bp, Unknown
  misc_feature (1)..( 7): Result.001 file - promoters60/1017693
aaccata

SEQ ID NO: 95537 - DNA, 7 bp, Unknown
  misc_feature (1)..( 7): Result.001 file - promoters60/1017693
aacgata

SEQ ID NO: 95538 - DNA, 8 bp, Unknown
  misc_feature (1)..( 8): Result.001 file - promoters60/1017693
aagccttt

SEQ ID NO: 95539 - DNA, 8 bp, Unknown
  misc_feature (1)..( 8): Result.001 file - promoters60/1017693
aagctttt

SEQ ID NO: 95540 - DNA, 7 bp, Unknown
  misc_feature (1)..( 7): Result.001 file - promoters60/1017693
caaagag

SEQ ID NO: 95541 - DNA, 7 bp, Unknown
  misc_feature (1)..( 7): Result.001 file - promoters60/1017693
caaggag

SEQ ID NO: 95542 - DNA, 10 bp, Unknown
  misc_feature (1)..( 10): Result.001 file - promoters60/1017693
ttttctgttg

SEQ ID NO: 95543 - DNA, 10 bp, Unknown
  misc_feature (1)..( 10): Result.001 file - promoters60/1017770
ttttcttttg

SEQ ID NO: 95544 - DNA, 14 bp, Unknown
  misc_feature (1)..( 14): Result.001 file - promoters60/1017770
tacttccttaaagg

SEQ ID NO: 95545 - DNA, 14 bp, Unknown
  misc_feature (1)..( 14): Result.001 file - promoters60/1017770
agcttacttcctta

SEQ ID NO: 95546 - DNA, 14 bp, Unknown
  misc_feature (1)..( 14): Result.001 file - promoters60/1017770
gacttccgcttgta

SEQ ID NO: 95547 - DNA, 14 bp, Unknown
  misc_feature (1)..( 14): Result.001 file - promoters60/1017770
tctttacttagatg

SEQ ID NO: 95548 - DNA, 14 bp, Unknown
  misc_feature (1)..( 14): Result.001 file - promoters60/1017770
tcttttcttctttc

SEQ ID NO: 95549 - DNA, 14 bp, Unknown
  misc_feature (1)..( 14): Result.001 file - promoters60/1017770
gtgtttcatctttc

SEQ ID NO: 95550 - DNA, 11 bp, Unknown
  misc_feature (1)..( 11): Result.001 file - promoters60/1017770
gcctatggtta

SEQ ID NO: 95551 - DNA, 11 bp, Unknown
  misc_feature (1)..( 11): Result.001 file - promoters60/1017770
agaaatgatta

SEQ ID NO: 95552 - DNA, 11 bp, Unknown
  misc_feature (1)..( 11): Result.001 file - promoters60/1017770
ttaaaggatta

SEQ ID NO: 95553 - DNA, 11 bp, Unknown
  misc_feature (1)..( 11): Result.001 file - promoters60/1017770
agtgatgatga

SEQ ID NO: 95554 - DNA, 11 bp, Unknown
  misc_feature (1)..( 11): Result.001 file - promoters60/1017770
ttaaaggtgtt

SEQ ID NO: 95555 - DNA, 11 bp, Unknown
  misc_feature (1)..( 11): Result.001 file - promoters60/1017770
aaaaatgtgaa

SEQ ID NO: 95556 - DNA, 11 bp, Unknown
  misc_feature (1)..( 11): Result.001 file - promoters60/1017770
caaaatgttat

SEQ ID NO: 95557 - DNA, 9 bp, Unknown
  misc_feature (1)..( 9): Result.001 file - promoters60/1017770
catatgtat

SEQ ID NO: 95558 - DNA, 9 bp, Unknown
  misc_feature (1)..( 9): Result.001 file - promoters60/1017770
gatatttat

SEQ ID NO: 95559 - DNA, 9 bp, Unknown
  misc_feature (1)..( 9): Result.001 file - promoters60/1017770
catatgtgt

SEQ ID NO: 95560 - DNA, 9 bp, Unknown
  misc_feature (1)..( 9): Result.001 file - promoters60/1017770
catatgtat

SEQ ID NO: 95561 - DNA, 9 bp, Unknown
  misc_feature (1)..( 9): Result.001 file - promoters60/1017770
tctatgtga

SEQ ID NO: 95562 - DNA, 9 bp, Unknown
  misc_feature (1)..( 9): Result.001 file - promoters60/1017777
aatctttgt

SEQ ID NO: 95563 - DNA, 14 bp, Unknown
  misc_feature (1)..( 14): Result.001 file - promoters60/1017777
aaagtgtatcctac

SEQ ID NO: 95564 - DNA, 14 bp, Unknown
  misc_feature (1)..( 14): Result.001 file - promoters60/1017777
tttttgtatccaat

SEQ ID NO: 95565 - DNA, 14 bp, Unknown
  misc_feature (1)..( 14): Result.001 file - promoters60/1017777
aaagggtatacaaa

SEQ ID NO: 95566 - DNA, 14 bp, Unknown
  misc_feature (1)..( 14): Result.001 file - promoters60/1017802
acgagatatctaat

SEQ ID NO: 95567 - DNA, 6 bp, Unknown
  misc_feature (1)..( 6): Result.001 file - promoters60/1017802
atattg

SEQ ID NO: 95568 - DNA, 6 bp, Unknown
  misc_feature (1)..( 6): Result.001 file - promoters60/1017802
atattg

SEQ ID NO: 95569 - DNA, 10 bp, Unknown
  misc_feature (1)..( 10): Result.001 file - promoters60/1017802
attacaatat

SEQ ID NO: 95570 - DNA, 10 bp, Unknown
  misc_feature (1)..( 10): Result.001 file - promoters60/1017802
attacaatat

SEQ ID NO: 95571 - DNA, 25 bp, Unknown
  misc_feature (1)..( 25): Result.001 file - promoters60/1017802
aaagttgcttcaaattatagattct

SEQ ID NO: 95572 - DNA, 25 bp, Unknown
  misc_feature (1)..( 25): Result.001 file - promoters60/1017802
aaagttgctacaaattatagattct

SEQ ID NO: 95573 - DNA, 25 bp, Unknown
  misc_feature (1)..( 25): Result.001 file - promoters60/1017802
gagtttgctagcatcaataatcaca

SEQ ID NO: 95574 - DNA, 22 bp, Unknown
  misc_feature (1)..( 22): Result.001 file - promoters60/1017802
tcttttctgattttgtttctca

SEQ ID NO: 95575 - DNA, 22 bp, Unknown
  misc_feature (1)..( 22): Result.001 file - promoters60/1017802
tcttttctgatattgtttctca

SEQ ID NO: 95576 - DNA, 22 bp, Unknown
  misc_feature (1)..( 22): Result.001 file - promoters60/1017802
atgtatcttattttgagaggtc

SEQ ID NO: 95577 - DNA, 7 bp, Unknown
  misc_feature (1)..( 7): Result.001 file - promoters60/1017802
taccaaa

SEQ ID NO: 95578 - DNA, 7 bp, Unknown
  misc_feature (1)..( 7): Result.001 file - promoters60/1017802
taccaaa

SEQ ID NO: 95579 - DNA, 8 bp, Unknown
  misc_feature (1)..( 8): Result.001 file - promoters60/1017802
caatgtga

SEQ ID NO: 95580 - DNA, 8 bp, Unknown
  misc_feature (1)..( 8): Result.001 file - promoters60/1017802
caatatga

SEQ ID NO: 95581 - DNA, 7 bp, Unknown
  misc_feature (1)..( 7): Result.001 file - promoters60/1017802
ctcaaat

SEQ ID NO: 95582 - DNA, 7 bp, Unknown
  misc_feature (1)..( 7): Result.001 file - promoters60/1017802
ctcaaat

SEQ ID NO: 95583 - DNA, 7 bp, Unknown
  misc_feature (1)..( 7): Result.001 file - promoters60/1017802
aaatata

SEQ ID NO: 95584 - DNA, 7 bp, Unknown
  misc_feature (1)..( 7): Result.001 file - promoters60/1017802
aaatata

SEQ ID NO: 95585 - DNA, 7 bp, Unknown
  misc_feature (1)..( 7): Result.001 file - promoters60/1017802
aaatata

SEQ ID NO: 95586 - DNA, 7 bp, Unknown
  misc_feature (1)..( 7): Result.001 file - promoters60/1017802
ttcaatg

SEQ ID NO: 95587 - DNA, 7 bp, Unknown
  misc_feature (1)..( 7): Result.001 file - promoters60/1017802
ttcaatg

SEQ ID NO: 95588 - DNA, 7 bp, Unknown
  misc_feature (1)..( 7): Result.001 file - promoters60/1017802
caattct

SEQ ID NO: 95589 - DNA, 7 bp, Unknown
  misc_feature (1)..( 7): Result.001 file - promoters60/1017802
caaatct

SEQ ID NO: 95590 - DNA, 7 bp, Unknown
  misc_feature (1)..( 7): Result.001 file - promoters60/1017802
aattctt

SEQ ID NO: 95591 - DNA, 7 bp, Unknown
  misc_feature (1)..( 7): Result.001 file - promoters60/1017802
aattctt

SEQ ID NO: 95592 - DNA, 8 bp, Unknown
  misc_feature (1)..( 8): Result.001 file - promoters60/1017802
tcttttct

SEQ ID NO: 95593 - DNA, 8 bp, Unknown
  misc_feature (1)..( 8): Result.001 file - promoters60/1017802
tcttttct

SEQ ID NO: 95594 - DNA, 8 bp, Unknown
  misc_feature (1)..( 8): Result.001 file - promoters60/1017802
aataaaat

SEQ ID NO: 95595 - DNA, 8 bp, Unknown
  misc_feature (1)..( 8): Result.001 file - promoters60/1017802
gataaaat

SEQ ID NO: 95596 - DNA, 8 bp, Unknown
  misc_feature (1)..( 8): Result.001 file - promoters60/1017802
gataaatt

SEQ ID NO: 95597 - DNA, 6 bp, Unknown
  misc_feature (1)..( 6): Result.001 file - promoters60/1017802
atagga

SEQ ID NO: 95598 - DNA, 6 bp, Unknown
  misc_feature (1)..( 6): Result.001 file - promoters60/1017802
atagga

SEQ ID NO: 95599 - DNA, 6 bp, Unknown
  misc_feature (1)..( 6): Result.001 file - promoters60/1017802
atagga

SEQ ID NO: 95600 - DNA, 6 bp, Unknown
  misc_feature (1)..( 6): Result.001 file - promoters60/1017802
atagga

SEQ ID NO: 95601 - DNA, 6 bp, Unknown
  misc_feature (1)..( 6): Result.001 file - promoters60/1017802
atagga

SEQ ID NO: 95602 - DNA, 8 bp, Unknown
  misc_feature (1)..( 8): Result.001 file - promoters60/1017802
ataatatt

SEQ ID NO: 95603 - DNA, 8 bp, Unknown
  misc_feature (1)..( 8): Result.001 file - promoters60/1017802
ataaaatt

SEQ ID NO: 95604 - DNA, 8 bp, Unknown
  misc_feature (1)..( 8): Result.001 file - promoters60/1017802
ataaaata

SEQ ID NO: 95605 - DNA, 6 bp, Unknown
  misc_feature (1)..( 6): Result.001 file - promoters60/1017802
aaaaaa

SEQ ID NO: 95606 - DNA, 6 bp, Unknown
  misc_feature (1)..( 6): Result.001 file - promoters60/1017802
aaaaaa

SEQ ID NO: 95607 - DNA, 12 bp, Unknown
  misc_feature (1)..( 12): Result.001 file - promoters60/1017802
aaaaaataaaaa

SEQ ID NO: 95608 - DNA, 12 bp, Unknown
  misc_feature (1)..( 12): Result.001 file - promoters60/1017802
aaaaattaaaaa

SEQ ID NO: 95609 - DNA, 12 bp, Unknown
  misc_feature (1)..( 12): Result.001 file - promoters60/1017802
ctcaaataaaat

SEQ ID NO: 95610 - DNA, 7 bp, Unknown
  misc_feature (1)..( 7): Result.001 file - promoters60/1017802
gcataaa

SEQ ID NO: 95611 - DNA, 7 bp, Unknown
  misc_feature (1)..( 7): Result.001 file - promoters60/1017802
gcacaaa

SEQ ID NO: 95612 - DNA, 6 bp, Unknown
  misc_feature (1)..( 6): Result.001 file - promoters60/1017802
ttgata

SEQ ID NO: 95613 - DNA, 6 bp, Unknown
  misc_feature (1)..( 6): Result.001 file - promoters60/1017802
ttgata

SEQ ID NO: 95614 - DNA, 7 bp, Unknown
  misc_feature (1)..( 7): Result.001 file - promoters60/1017802
tttccta

SEQ ID NO: 95615 - DNA, 7 bp, Unknown
  misc_feature (1)..( 7): Result.001 file - promoters60/1017802
tttgcta

SEQ ID NO: 95616 - DNA, 9 bp, Unknown
  misc_feature (1)..( 9): Result.001 file - promoters60/1017802
aaaaataaa

SEQ ID NO: 95617 - DNA, 9 bp, Unknown
  misc_feature (1)..( 9): Result.001 file - promoters60/1017802
aaatataaa

SEQ ID NO: 95618 - DNA, 9 bp, Unknown
  misc_feature (1)..( 9): Result.001 file - promoters60/1017802
aaataaaaa

SEQ ID NO: 95619 - DNA, 9 bp, Unknown
  misc_feature (1)..( 9): Result.001 file - promoters60/1017802
aaacaaaaa

SEQ ID NO: 95620 - DNA, 8 bp, Unknown
  misc_feature (1)..( 8): Result.001 file - promoters60/1017802
ctaaatat

SEQ ID NO: 95621 - DNA, 8 bp, Unknown
  misc_feature (1)..( 8): Result.001 file - promoters60/1017802
ctatatat

SEQ ID NO: 95622 - DNA, 6 bp, Unknown
  misc_feature (1)..( 6): Result.001 file - promoters60/1017802
aaatta

SEQ ID NO: 95623 - DNA, 6 bp, Unknown
  misc_feature (1)..( 6): Result.001 file - promoters60/1017883
aaatta

SEQ ID NO: 95624 - DNA, 7 bp, Unknown
  misc_feature (1)..( 7): Result.001 file - promoters60/1017883
caataaa

SEQ ID NO: 95625 - DNA, 7 bp, Unknown
  misc_feature (1)..( 7): Result.001 file - promoters60/1017883
caagaaa

SEQ ID NO: 95626 - DNA, 8 bp, Unknown
  misc_feature (1)..( 8): Result.001 file - promoters60/1017883
aaaggaaa

SEQ ID NO: 95627 - DNA, 8 bp, Unknown
  misc_feature (1)..( 8): Result.001 file - promoters60/1017883
tataaata

SEQ ID NO: 95628 - DNA, 8 bp, Unknown
  misc_feature (1)..( 8): Result.001 file - promoters60/1017883
tatatata

SEQ ID NO: 95629 - DNA, 8 bp, Unknown
  misc_feature (1)..( 8): Result.001 file - promoters60/1017883
tatatata

SEQ ID NO: 95630 - DNA, 8 bp, Unknown
  misc_feature (1)..( 8): Result.001 file - promoters60/1017883
aataaata

SEQ ID NO: 95631 - DNA, 13 bp, Unknown
  misc_feature (1)..( 13): Result.001 file - promoters60/1017883
gaccaagttatat

SEQ ID NO: 95632 - DNA, 13 bp, Unknown
  misc_feature (1)..( 13): Result.001 file - promoters60/1017883
aactaacttatat

SEQ ID NO: 95633 - DNA, 13 bp, Unknown
  misc_feature (1)..( 13): Result.001 file - promoters60/1017883
aacaaactgatag

SEQ ID NO: 95634 - DNA, 10 bp, Unknown
  misc_feature (1)..( 10): Result.001 file - promoters60/1017883
ctattatgtg

SEQ ID NO: 95635 - DNA, 10 bp, Unknown
  misc_feature (1)..( 10): Result.001 file - promoters60/1017883
ttattatgtg

SEQ ID NO: 95636 - DNA, 10 bp, Unknown
  misc_feature (1)..( 10): Result.001 file - promoters60/1017883
ttattatatt

SEQ ID NO: 95637 - DNA, 10 bp, Unknown
  misc_feature (1)..( 10): Result.001 file - promoters60/1017883
caaattgaca

SEQ ID NO: 95638 - DNA, 10 bp, Unknown
  misc_feature (1)..( 10): Result.001 file - promoters60/1017883
caaactgata

SEQ ID NO: 95639 - DNA, 10 bp, Unknown
  misc_feature (1)..( 10): Result.001 file - promoters60/1017883
ataactcata

SEQ ID NO: 95640 - DNA, 12 bp, Unknown
  misc_feature (1)..( 12): Result.001 file - promoters60/1017883
aaacaaatgttt

SEQ ID NO: 95641 - DNA, 12 bp, Unknown
  misc_feature (1)..( 12): Result.001 file - promoters60/1017883
aaacaattcttt

SEQ ID NO: 95642 - DNA, 12 bp, Unknown
  misc_feature (1)..( 12): Result.001 file - promoters60/1017883
aaataaattttt

SEQ ID NO: 95643 - DNA, 9 bp, Unknown
  misc_feature (1)..( 9): Result.001 file - promoters60/1017883
gaaaaagcg

SEQ ID NO: 95644 - DNA, 9 bp, Unknown
  misc_feature (1)..( 9): Result.001 file - promoters60/1017883
gaaaaacac

SEQ ID NO: 95645 - DNA, 9 bp, Unknown
  misc_feature (1)..( 9): Result.001 file - promoters60/1017883
gaaaaaaaa

SEQ ID NO: 95646 - DNA, 8 bp, Unknown
  misc_feature (1)..( 8): Result.001 file - promoters60/1017883
taatttga

SEQ ID NO: 95647 - DNA, 8 bp, Unknown
  misc_feature (1)..( 8): Result.001 file - promoters60/1017883
aaatttga

SEQ ID NO: 95648 - DNA, 8 bp, Unknown
  misc_feature (1)..( 8): Result.001 file - promoters60/1017964
aaatttac

SEQ ID NO: 95649 - DNA, 6 bp, Unknown
  misc_feature (1)..( 6): Result.001 file - promoters60/1017964
aactgt

SEQ ID NO: 95650 - DNA, 6 bp, Unknown
  misc_feature (1)..( 6): Result.001 file - promoters60/1017964
aactgt

SEQ ID NO: 95651 - DNA, 9 bp, Unknown
  misc_feature (1)..( 9): Result.001 file - promoters60/1017964
tgaaaagaa

SEQ ID NO: 95652 - DNA, 9 bp, Unknown
  misc_feature (1)..( 9): Result.001 file - promoters60/1017964
tgaacagaa

SEQ ID NO: 95653 - DNA, 7 bp, Unknown
  misc_feature (1)..( 7): Result.001 file - promoters60/1017964
tattgaa

SEQ ID NO: 95654 - DNA, 7 bp, Unknown
  misc_feature (1)..( 7): Result.001 file - promoters60/1017964
tattgaa

SEQ ID NO: 95655 - DNA, 6 bp, Unknown
  misc_feature (1)..( 6): Result.001 file - promoters60/1017964
atattc

SEQ ID NO: 95656 - DNA, 6 bp, Unknown
  misc_feature (1)..( 6): Result.001 file - promoters60/1017964
atattc

SEQ ID NO: 95657 - DNA, 6 bp, Unknown
  misc_feature (1)..( 6): Result.001 file - promoters60/1017964
tgatat

SEQ ID NO: 95658 - DNA, 6 bp, Unknown
  misc_feature (1)..( 6): Result.001 file - promoters60/1017964
tgatat

SEQ ID NO: 95659 - DNA, 7 bp, Unknown
  misc_feature (1)..( 7): Result.001 file - promoters60/1017964
ttgatga

SEQ ID NO: 95660 - DNA, 7 bp, Unknown
  misc_feature (1)..( 7): Result.001 file - promoters60/1017964
ttggtga

SEQ ID NO: 95661 - DNA, 7 bp, Unknown
  misc_feature (1)..( 7): Result.001 file - promoters60/1017964
ggaatga

SEQ ID NO: 95662 - DNA, 7 bp, Unknown
  misc_feature (1)..( 7): Result.001 file - promoters60/1017964
ggattga

SEQ ID NO: 95663 - DNA, 8 bp, Unknown
  misc_feature (1)..( 8): Result.001 file - promoters60/1017964
agtataaa

SEQ ID NO: 95664 - DNA, 8 bp, Unknown
  misc_feature (1)..( 8): Result.001 file - promoters60/1017964
agtttaaa

SEQ ID NO: 95665 - DNA, 6 bp, Unknown
  misc_feature (1)..( 6): Result.001 file - promoters60/1017964
gtcgaa

SEQ ID NO: 95666 - DNA, 6 bp, Unknown
  misc_feature (1)..( 6): Result.001 file - promoters60/1017964
gtcgaa

SEQ ID NO: 95667 - DNA, 6 bp, Unknown
  misc_feature (1)..( 6): Result.001 file - promoters60/1017964
aaaata

SEQ ID NO: 95668 - DNA, 6 bp, Unknown
  misc_feature (1)..( 6): Result.001 file - promoters60/1017964
aaaata

SEQ ID NO: 95669 - DNA, 6 bp, Unknown
  misc_feature (1)..( 6): Result.001 file - promoters60/1017964
ttgtat

SEQ ID NO: 95670 - DNA, 6 bp, Unknown
  misc_feature (1)..( 6): Result.001 file - promoters60/1017964
ttgtat

SEQ ID NO: 95671 - DNA, 7 bp, Unknown
  misc_feature (1)..( 7): Result.001 file - promoters60/1017964
cactgtc

SEQ ID NO: 95672 - DNA, 7 bp, Unknown
  misc_feature (1)..( 7): Result.001 file - promoters60/1017964
cacggtc

SEQ ID NO: 95673 - DNA, 6 bp, Unknown
  misc_feature (1)..( 6): Result.001 file - promoters60/1017964
tctgaa

SEQ ID NO: 95674 - DNA, 6 bp, Unknown
  misc_feature (1)..( 6): Result.001 file - promoters60/1017964
tctgaa

SEQ ID NO: 95675 - DNA, 6 bp, Unknown
  misc_feature (1)..( 6): Result.001 file - promoters60/1017964
ggttta

SEQ ID NO: 95676 - DNA, 6 bp, Unknown
  misc_feature (1)..( 6): Result.001 file - promoters60/1017964
ggttta

SEQ ID NO: 95677 - DNA, 6 bp, Unknown
  misc_feature (1)..( 6): Result.001 file - promoters60/1017964
ttgact

SEQ ID NO: 95678 - DNA, 6 bp, Unknown
  misc_feature (1)..( 6): Result.001 file - promoters60/1017964
ttgact

SEQ ID NO: 95679 - DNA, 6 bp, Unknown
  misc_feature (1)..( 6): Result.001 file - promoters60/1017964
ggctgt

SEQ ID NO: 95680 - DNA, 6 bp, Unknown
  misc_feature (1)..( 6): Result.001 file - promoters60/1018052
ggctgt

SEQ ID NO: 95681 - DNA, 9 bp, Unknown
  misc_feature (1)..( 9): Result.001 file - promoters60/1018052
ttcagtttc

SEQ ID NO: 95682 - DNA, 9 bp, Unknown
  misc_feature (1)..( 9): Result.001 file - promoters60/1018052
ctcagttga

SEQ ID NO: 95683 - DNA, 9 bp, Unknown
  misc_feature (1)..( 9): Result.001 file - promoters60/1018052
atcaatttt

SEQ ID NO: 95684 - DNA, 9 bp, Unknown
  misc_feature (1)..( 9): Result.001 file - promoters60/1018052
atcattttt

SEQ ID NO: 95685 - DNA, 8 bp, Unknown
  misc_feature (1)..( 8): Result.001 file - promoters60/1018052
cttgttgt

SEQ ID NO: 95686 - DNA, 8 bp, Unknown
  misc_feature (1)..( 8): Result.001 file - promoters60/1018052
attgatgt

SEQ ID NO: 95687 - DNA, 8 bp, Unknown
  misc_feature (1)..( 8): Result.001 file - promoters60/1018052
gttttttt

SEQ ID NO: 95688 - DNA, 8 bp, Unknown
  misc_feature (1)..( 8): Result.001 file - promoters60/1018052
tttgttta

SEQ ID NO: 95689 - DNA, 9 bp, Unknown
  misc_feature (1)..( 9): Result.001 file - promoters60/1018052
cttttcaaa

SEQ ID NO: 95690 - DNA, 9 bp, Unknown
  misc_feature (1)..( 9): Result.001 file - promoters60/1018052
atttccaat

SEQ ID NO: 95691 - DNA, 9 bp, Unknown
  misc_feature (1)..( 9): Result.001 file - promoters60/1018052
ttttccaat

SEQ ID NO: 95692 - DNA, 9 bp, Unknown
  misc_feature (1)..( 9): Result.001 file - promoters60/1018052
attaccaat

SEQ ID NO: 95693 - DNA, 8 bp, Unknown
  misc_feature (1)..( 8): Result.001 file - promoters60/1018052
agtgtcaa

SEQ ID NO: 95694 - DNA, 8 bp, Unknown
  misc_feature (1)..( 8): Result.001 file - promoters60/1018052
agtctcac

SEQ ID NO: 95695 - DNA, 8 bp, Unknown
  misc_feature (1)..( 8): Result.001 file - promoters60/1018052
agtttcat

SEQ ID NO: 95696 - DNA, 8 bp, Unknown
  misc_feature (1)..( 8): Result.001 file - promoters60/1018055
aatttcat

SEQ ID NO: 95697 - DNA, 6 bp, Unknown
  misc_feature (1)..( 6): Result.001 file - promoters60/1018055
tgattg

SEQ ID NO: 95698 - DNA, 6 bp, Unknown
  misc_feature (1)..( 6): Result.001 file - promoters60/1018055
tgattg

SEQ ID NO: 95699 - DNA, 7 bp, Unknown
  misc_feature (1)..( 7): Result.001 file - promoters60/1018055
ttaattt

SEQ ID NO: 95700 - DNA, 7 bp, Unknown
  misc_feature (1)..( 7): Result.001 file - promoters60/1018055
ttacttt

SEQ ID NO: 95701 - DNA, 7 bp, Unknown
  misc_feature (1)..( 7): Result.001 file - promoters60/1018055
ttttctt

SEQ ID NO: 95702 - DNA, 7 bp, Unknown
  misc_feature (1)..( 7): Result.001 file - promoters60/1018055
ttttctt

SEQ ID NO: 95703 - DNA, 7 bp, Unknown
  misc_feature (1)..( 7): Result.001 file - promoters60/1018055
ttatgtg

SEQ ID NO: 95704 - DNA, 7 bp, Unknown
  misc_feature (1)..( 7): Result.001 file - promoters60/1018055
ttatgtg

SEQ ID NO: 95705 - DNA, 6 bp, Unknown
  misc_feature (1)..( 6): Result.001 file - promoters60/1018055
tttctt

SEQ ID NO: 95706 - DNA, 6 bp, Unknown
  misc_feature (1)..( 6): Result.001 file - promoters60/1018055
tttctt

SEQ ID NO: 95707 - DNA, 8 bp, Unknown
  misc_feature (1)..( 8): Result.001 file - promoters60/1018055
aatgaatt

SEQ ID NO: 95708 - DNA, 8 bp, Unknown
  misc_feature (1)..( 8): Result.001 file - promoters60/1018055
aatcaatt

SEQ ID NO: 95709 - DNA, 6 bp, Unknown
  misc_feature (1)..( 6): Result.001 file - promoters60/1018055
ttattt

SEQ ID NO: 95710 - DNA, 6 bp, Unknown
  misc_feature (1)..( 6): Result.001 file - promoters60/1018055
ttattt

SEQ ID NO: 95711 - DNA, 11 bp, Unknown
  misc_feature (1)..( 11): Result.001 file - promoters60/1018055
aaagacaaaat

SEQ ID NO: 95712 - DNA, 11 bp, Unknown
  misc_feature (1)..( 11): Result.001 file - promoters60/1018055
aaagagaaaat

SEQ ID NO: 95713 - DNA, 8 bp, Unknown
  misc_feature (1)..( 8): Result.001 file - promoters60/1018055
gtagagaa

SEQ ID NO: 95714 - DNA, 8 bp, Unknown
  misc_feature (1)..( 8): Result.001 file - promoters60/1018055
gtagagaa

SEQ ID NO: 95715 - DNA, 6 bp, Unknown
  misc_feature (1)..( 6): Result.001 file - promoters60/1018055
agaaga

SEQ ID NO: 95716 - DNA, 6 bp, Unknown
  misc_feature (1)..( 6): Result.001 file - promoters60/1018055
agaaga

SEQ ID NO: 95717 - DNA, 6 bp, Unknown
  misc_feature (1)..( 6): Result.001 file - promoters60/1018055
gtgatt

SEQ ID NO: 95718 - DNA, 6 bp, Unknown
  misc_feature (1)..( 6): Result.001 file - promoters60/1018057
gtgatt

SEQ ID NO: 95719 - DNA, 7 bp, Unknown
  misc_feature (1)..( 7): Result.001 file - promoters60/1018057
caacgaa

SEQ ID NO: 95720 - DNA, 7 bp, Unknown
  misc_feature (1)..( 7): Result.001 file - promoters60/1018057
caatgaa

SEQ ID NO: 95721 - DNA, 8 bp, Unknown
  misc_feature (1)..( 8): Result.001 file - promoters60/1018057
aaatcgtt

SEQ ID NO: 95722 - DNA, 8 bp, Unknown
  misc_feature (1)..( 8): Result.001 file - promoters60/1018057
aaatggtt

SEQ ID NO: 95723 - DNA, 7 bp, Unknown
  misc_feature (1)..( 7): Result.001 file - promoters60/1018057
gattagc

SEQ ID NO: 95724 - DNA, 7 bp, Unknown
  misc_feature (1)..( 7): Result.001 file - promoters60/1018057
gataagc

SEQ ID NO: 95725 - DNA, 7 bp, Unknown
  misc_feature (1)..( 7): Result.001 file - promoters60/1018057
tggggac

SEQ ID NO: 95726 - DNA, 7 bp, Unknown
  misc_feature (1)..( 7): Result.001 file - promoters60/1018057
tggagac

SEQ ID NO: 95727 - DNA, 7 bp, Unknown
  misc_feature (1)..( 7): Result.001 file - promoters60/1018057
ggcgaag

SEQ ID NO: 95728 - DNA, 7 bp, Unknown
  misc_feature (1)..( 7): Result.001 file - promoters60/1018057
ggctaag

SEQ ID NO: 95729 - DNA, 7 bp, Unknown
  misc_feature (1)..( 7): Result.001 file - promoters60/1018057
aataagc

SEQ ID NO: 95730 - DNA, 7 bp, Unknown
  misc_feature (1)..( 7): Result.001 file - promoters60/1018057
aataagc

SEQ ID NO: 95731 - DNA, 13 bp, Unknown
  misc_feature (1)..( 13): Result.001 file - promoters60/1018057
caaacaggattat

SEQ ID NO: 95732 - DNA, 13 bp, Unknown
  misc_feature (1)..( 13): Result.001 file - promoters60/1018057
caaaccggagtat

SEQ ID NO: 95733 - DNA, 9 bp, Unknown
  misc_feature (1)..( 9): Result.001 file - promoters60/1018057
agttgattt

SEQ ID NO: 95734 - DNA, 9 bp, Unknown
  misc_feature (1)..( 9): Result.001 file - promoters60/1018057
agtagattt

SEQ ID NO: 95735 - DNA, 7 bp, Unknown
  misc_feature (1)..( 7): Result.001 file - promoters60/1018057
atggtat

SEQ ID NO: 95736 - DNA, 7 bp, Unknown
  misc_feature (1)..( 7): Result.001 file - promoters60/1018057
atgttat

SEQ ID NO: 95737 - DNA, 6 bp, Unknown
  misc_feature (1)..( 6): Result.001 file - promoters60/1018057
taaata

SEQ ID NO: 95738 - DNA, 6 bp, Unknown
  misc_feature (1)..( 6): Result.001 file - promoters60/1018057
taaata

SEQ ID NO: 95739 - DNA, 7 bp, Unknown
  misc_feature (1)..( 7): Result.001 file - promoters60/1018057
aacctta

SEQ ID NO: 95740 - DNA, 7 bp, Unknown
  misc_feature (1)..( 7): Result.001 file - promoters60/1018057
aacctta

SEQ ID NO: 95741 - DNA, 7 bp, Unknown
  misc_feature (1)..( 7): Result.001 file - promoters60/1018057
gaaatac

SEQ ID NO: 95742 - DNA, 7 bp, Unknown
  misc_feature (1)..( 7): Result.001 file - promoters60/1018057
gaaatac

SEQ ID NO: 95743 - DNA, 6 bp, Unknown
  misc_feature (1)..( 6): Result.001 file - promoters60/1018057
aaggag

SEQ ID NO: 95744 - DNA, 6 bp, Unknown
  misc_feature (1)..( 6): Result.001 file - promoters60/1018057
aaggag

SEQ ID NO: 95745 - DNA, 6 bp, Unknown
  misc_feature (1)..( 6): Result.001 file - promoters60/1018057
gtccca

SEQ ID NO: 95746 - DNA, 6 bp, Unknown
  misc_feature (1)..( 6): Result.001 file - promoters60/1018057
gtccca

SEQ ID NO: 95747 - DNA, 7 bp, Unknown
  misc_feature (1)..( 7): Result.001 file - promoters60/1018057
tcagttt

SEQ ID NO: 95748 - DNA, 7 bp, Unknown
  misc_feature (1)..( 7): Result.001 file - promoters60/1018057
tcagttt

SEQ ID NO: 95749 - DNA, 7 bp, Unknown
  misc_feature (1)..( 7): Result.001 file - promoters60/1018057
tttatat

SEQ ID NO: 95750 - DNA, 7 bp, Unknown
  misc_feature (1)..( 7): Result.001 file - promoters60/1018057
tttttat

SEQ ID NO: 95751 - DNA, 6 bp, Unknown
  misc_feature (1)..( 6): Result.001 file - promoters60/1018057
attatt

SEQ ID NO: 95752 - DNA, 6 bp, Unknown
  misc_feature (1)..( 6): Result.001 file - promoters60/1018159
attatt

SEQ ID NO: 95753 - DNA, 9 bp, Unknown
  misc_feature (1)..( 9): Result.001 file - promoters60/1018159
gttaaaaaa

SEQ ID NO: 95754 - DNA, 9 bp, Unknown
  misc_feature (1)..( 9): Result.001 file - promoters60/1018159
agtaagaaa

SEQ ID NO: 95755 - DNA, 9 bp, Unknown
  misc_feature (1)..( 9): Result.001 file - promoters60/1018159
agtaagaat

SEQ ID NO: 95756 - DNA, 6 bp, Unknown
  misc_feature (1)..( 6): Result.001 file - promoters60/1018159
gaaatc

SEQ ID NO: 95757 - DNA, 6 bp, Unknown
  misc_feature (1)..( 6): Result.001 file - promoters60/1018159
gaaatc

SEQ ID NO: 95758 - DNA, 7 bp, Unknown
  misc_feature (1)..( 7): Result.001 file - promoters60/1018159
tcagcct

SEQ ID NO: 95759 - DNA, 7 bp, Unknown
  misc_feature (1)..( 7): Result.001 file - promoters60/1018159
tcatcct

SEQ ID NO: 95760 - DNA, 7 bp, Unknown
  misc_feature (1)..( 7): Result.001 file - promoters60/1018159
aatatta

SEQ ID NO: 95761 - DNA, 7 bp, Unknown
  misc_feature (1)..( 7): Result.001 file - promoters60/1018159
aatttta

SEQ ID NO: 95762 - DNA, 9 bp, Unknown
  misc_feature (1)..( 9): Result.001 file - promoters60/1018159
atttaaacc

SEQ ID NO: 95763 - DNA, 9 bp, Unknown
  misc_feature (1)..( 9): Result.001 file - promoters60/1018159
atttatacc

SEQ ID NO: 95764 - DNA, 6 bp, Unknown
  misc_feature (1)..( 6): Result.001 file - promoters60/1018159
acatga

SEQ ID NO: 95765 - DNA, 6 bp, Unknown
  misc_feature (1)..( 6): Result.001 file - promoters60/1018159
acatga

SEQ ID NO: 95766 - DNA, 9 bp, Unknown
  misc_feature (1)..( 9): Result.001 file - promoters60/1018159
ggcaaggaa

SEQ ID NO: 95767 - DNA, 9 bp, Unknown
  misc_feature (1)..( 9): Result.001 file - promoters60/1018159
ggcgaggaa

SEQ ID NO: 95768 - DNA, 9 bp, Unknown
  misc_feature (1)..( 9): Result.001 file - promoters60/1018159
agaaacata

SEQ ID NO: 95769 - DNA, 9 bp, Unknown
  misc_feature (1)..( 9): Result.001 file - promoters60/1018159
agaatcata

SEQ ID NO: 95770 - DNA, 6 bp, Unknown
  misc_feature (1)..( 6): Result.001 file - promoters60/1018159
aggaag

SEQ ID NO: 95771 - DNA, 6 bp, Unknown
  misc_feature (1)..( 6): Result.001 file - promoters60/1018159
aggaag

SEQ ID NO: 95772 - DNA, 7 bp, Unknown
  misc_feature (1)..( 7): Result.001 file - promoters60/1018159
atatacc

SEQ ID NO: 95773 - DNA, 7 bp, Unknown
  misc_feature (1)..( 7): Result.001 file - promoters60/1018159
ataaacc

SEQ ID NO: 95774 - DNA, 8 bp, Unknown
  misc_feature (1)..( 8): Result.001 file - promoters60/1018159
taaggatt

SEQ ID NO: 95775 - DNA, 8 bp, Unknown
  misc_feature (1)..( 8): Result.001 file - promoters60/1018159
taaagatt

SEQ ID NO: 95776 - DNA, 6 bp, Unknown
  misc_feature (1)..( 6): Result.001 file - promoters60/1018159
attggg

SEQ ID NO: 95777 - DNA, 6 bp, Unknown
  misc_feature (1)..( 6): Result.001 file - promoters60/1018159
attggg

SEQ ID NO: 95778 - DNA, 6 bp, Unknown
  misc_feature (1)..( 6): Result.001 file - promoters60/1018159
ccattt

SEQ ID NO: 95779 - DNA, 6 bp, Unknown
  misc_feature (1)..( 6): Result.001 file - promoters60/1018159
ccattt

SEQ ID NO: 95780 - DNA, 7 bp, Unknown
  misc_feature (1)..( 7): Result.001 file - promoters60/1018159
aatggcg

SEQ ID NO: 95781 - DNA, 7 bp, Unknown
  misc_feature (1)..( 7): Result.001 file - promoters60/1018159
aatggcg

SEQ ID NO: 95782 - DNA, 6 bp, Unknown
  misc_feature (1)..( 6): Result.001 file - promoters60/1018159
aaatta

SEQ ID NO: 95783 - DNA, 6 bp, Unknown
  misc_feature (1)..( 6): Result.001 file - promoters60/1018159
aaatta

SEQ ID NO: 95784 - DNA, 6 bp, Unknown
  misc_feature (1)..( 6): Result.001 file - promoters60/1018159
taagag

SEQ ID NO: 95785 - DNA, 6 bp, Unknown
  misc_feature (1)..( 6): Result.001 file - promoters60/1018159
taagag

SEQ ID NO: 95786 - DNA, 7 bp, Unknown
  misc_feature (1)..( 7): Result.001 file - promoters60/1018159
taatttc

SEQ ID NO: 95787 - DNA, 7 bp, Unknown
  misc_feature (1)..( 7): Result.001 file - promoters60/1018159
taaattc

SEQ ID NO: 95788 - DNA, 9 bp, Unknown
  misc_feature (1)..( 9): Result.001 file - promoters60/1018159
cgattgaat

SEQ ID NO: 95789 - DNA, 9 bp, Unknown
  misc_feature (1)..( 9): Result.001 file - promoters60/1018159
cgattaaat

SEQ ID NO: 95790 - DNA, 9 bp, Unknown
  misc_feature (1)..( 9): Result.001 file - promoters60/1018159
aattttcga

SEQ ID NO: 95791 - DNA, 9 bp, Unknown
  misc_feature (1)..( 9): Result.001 file - promoters60/1018159
aatttgcga

SEQ ID NO: 95792 - DNA, 7 bp, Unknown
  misc_feature (1)..( 7): Result.001 file - promoters60/1018159
tttggaa

SEQ ID NO: 95793 - DNA, 7 bp, Unknown
  misc_feature (1)..( 7): Result.001 file - promoters60/1018159
tttagaa

SEQ ID NO: 95794 - DNA, 8 bp, Unknown
  misc_feature (1)..( 8): Result.001 file - promoters60/1018159
attttaat

SEQ ID NO: 95795 - DNA, 8 bp, Unknown
  misc_feature (1)..( 8): Result.001 file - promoters60/1018159
atttaaat

SEQ ID NO: 95796 - DNA, 12 bp, Unknown
  misc_feature (1)..( 12): Result.001 file - promoters60/1018159
tgaaatatttaa

SEQ ID NO: 95797 - DNA, 12 bp, Unknown
  misc_feature (1)..( 12): Result.001 file - promoters60/1018159
tgaaatagttaa

SEQ ID NO: 95798 - DNA, 6 bp, Unknown
  misc_feature (1)..( 6): Result.001 file - promoters60/1018159
caactt

SEQ ID NO: 95799 - DNA, 6 bp, Unknown
  misc_feature (1)..( 6): Result.001 file - promoters60/1018190
caactt

SEQ ID NO: 95800 - DNA, 10 bp, Unknown
  misc_feature (1)..( 10): Result.001 file - promoters60/1018190
atatttgttg

SEQ ID NO: 95801 - DNA, 10 bp, Unknown
  misc_feature (1)..( 10): Result.001 file - promoters60/1018190
ctgcttgttg

SEQ ID NO: 95802 - DNA, 10 bp, Unknown
  misc_feature (1)..( 10): Result.001 file - promoters60/1018190
gaatttgttt

SEQ ID NO: 95803 - DNA, 10 bp, Unknown
  misc_feature (1)..( 10): Result.001 file - promoters60/1018190
gaatttgatt

SEQ ID NO: 95804 - DNA, 9 bp, Unknown
  misc_feature (1)..( 9): Result.001 file - promoters60/1018190
attttttta

SEQ ID NO: 95805 - DNA, 9 bp, Unknown
  misc_feature (1)..( 9): Result.001 file - promoters60/1018190
atttttcag

SEQ ID NO: 95806 - DNA, 9 bp, Unknown
  misc_feature (1)..( 9): Result.001 file - promoters60/1018190
cttttttta

SEQ ID NO: 95807 - DNA, 9 bp, Unknown
  misc_feature (1)..( 9): Result.001 file - promoters60/1018190
ctttgtttg

SEQ ID NO: 95808 - DNA, 8 bp, Unknown
  misc_feature (1)..( 8): Result.001 file - promoters60/1018190
gaatctaa

SEQ ID NO: 95809 - DNA, 8 bp, Unknown
  misc_feature (1)..( 8): Result.001 file - promoters60/1018190
aaatataa

SEQ ID NO: 95810 - DNA, 9 bp, Unknown
  misc_feature (1)..( 9): Result.001 file - promoters60/1018190
taattatat

SEQ ID NO: 95811 - DNA, 9 bp, Unknown
  misc_feature (1)..( 9): Result.001 file - promoters60/1018190
acgttatat

SEQ ID NO: 95812 - DNA, 10 bp, Unknown
  misc_feature (1)..( 10): Result.001 file - promoters60/1018190
ttgttgattg

SEQ ID NO: 95813 - DNA, 10 bp, Unknown
  misc_feature (1)..( 10): Result.001 file - promoters60/1018190
tgtttgattg

SEQ ID NO: 95814 - DNA, 10 bp, Unknown
  misc_feature (1)..( 10): Result.001 file - promoters60/1018190
aatttgattt

SEQ ID NO: 95815 - DNA, 10 bp, Unknown
  misc_feature (1)..( 10): Result.001 file - promoters60/1018276
tgtttgatac

SEQ ID NO: 95816 - DNA, 14 bp, Unknown
  misc_feature (1)..( 14): Result.001 file - promoters60/1018276
tatttgttgattga

SEQ ID NO: 95817 - DNA, 14 bp, Unknown
  misc_feature (1)..( 14): Result.001 file - promoters60/1018276
caatggttggttgc

SEQ ID NO: 95818 - DNA, 14 bp, Unknown
  misc_feature (1)..( 14): Result.001 file - promoters60/1018276
aagaatttgtttga

SEQ ID NO: 95819 - DNA, 14 bp, Unknown
  misc_feature (1)..( 14): Result.001 file - promoters60/1018276
gcgaatttgatttt

SEQ ID NO: 95820 - DNA, 14 bp, Unknown
  misc_feature (1)..( 14): Result.001 file - promoters60/1018276
tgcttgttggtatg

SEQ ID NO: 95821 - DNA, 14 bp, Unknown
  misc_feature (1)..( 14): Result.001 file - promoters60/1018276
aatgtgttttactc

SEQ ID NO: 95822 - DNA, 10 bp, Unknown
  misc_feature (1)..( 10): Result.001 file - promoters60/1018276
atatttgttg

SEQ ID NO: 95823 - DNA, 10 bp, Unknown
  misc_feature (1)..( 10): Result.001 file - promoters60/1018276
ctgcttgttg

SEQ ID NO: 95824 - DNA, 10 bp, Unknown
  misc_feature (1)..( 10): Result.001 file - promoters60/1018276
gaatttgttt

SEQ ID NO: 95825 - DNA, 10 bp, Unknown
  misc_feature (1)..( 10): Result.001 file - promoters60/1018276
taatgtgttt

SEQ ID NO: 95826 - DNA, 10 bp, Unknown
  misc_feature (1)..( 10): Result.001 file - promoters60/1018276
gaatttgatt

SEQ ID NO: 95827 - DNA, 12 bp, Unknown
  misc_feature (1)..( 12): Result.001 file - promoters60/1018276
ctgattttttta

SEQ ID NO: 95828 - DNA, 12 bp, Unknown
  misc_feature (1)..( 12): Result.001 file - promoters60/1018276
aacatttttcag

SEQ ID NO: 95829 - DNA, 12 bp, Unknown
  misc_feature (1)..( 12): Result.001 file - promoters60/1018276
atccttttttta

SEQ ID NO: 95830 - DNA, 12 bp, Unknown
  misc_feature (1)..( 12): Result.001 file - promoters60/1018276
acaatttaaaaa

SEQ ID NO: 95831 - DNA, 10 bp, Unknown
  misc_feature (1)..( 10): Result.001 file - promoters60/1018276
ttgaatctaa

SEQ ID NO: 95832 - DNA, 10 bp, Unknown
  misc_feature (1)..( 10): Result.001 file - promoters60/1018276
cataatgtaa

SEQ ID NO: 95833 - DNA, 10 bp, Unknown
  misc_feature (1)..( 10): Result.001 file - promoters60/1018276
tatattgtgc

SEQ ID NO: 95834 - DNA, 10 bp, Unknown
  misc_feature (1)..( 10): Result.001 file - promoters60/1018276
tatactgttt

SEQ ID NO: 95835 - DNA, 7 bp, Unknown
  misc_feature (1)..( 7): Result.001 file - promoters60/1018276
atttgtt

SEQ ID NO: 95836 - DNA, 7 bp, Unknown
  misc_feature (1)..( 7): Result.001 file - promoters60/1018276
atttgta

SEQ ID NO: 95837 - DNA, 7 bp, Unknown
  misc_feature (1)..( 7): Result.001 file - promoters60/1018276
atttgtt

SEQ ID NO: 95838 - DNA, 7 bp, Unknown
  misc_feature (1)..( 7): Result.001 file - promoters60/1018276
atttgta

SEQ ID NO: 95839 - DNA, 13 bp, Unknown
  misc_feature (1)..( 13): Result.001 file - promoters60/1018276
gcaatggttggtt

SEQ ID NO: 95840 - DNA, 13 bp, Unknown
  misc_feature (1)..( 13): Result.001 file - promoters60/1018276
ggtatgtttgata

SEQ ID NO: 95841 - DNA, 13 bp, Unknown
  misc_feature (1)..( 13): Result.001 file - promoters60/1018276
aatttgtttgatt

SEQ ID NO: 95842 - DNA, 13 bp, Unknown
  misc_feature (1)..( 13): Result.001 file - promoters60/1018276
aatgtgttttact

SEQ ID NO: 95843 - DNA, 13 bp, Unknown
  misc_feature (1)..( 13): Result.001 file - promoters60/1018276
tttgattttcatt

SEQ ID NO: 95844 - DNA, 12 bp, Unknown
  misc_feature (1)..( 12): Result.001 file - promoters60/1018276
tgcttattacag

SEQ ID NO: 95845 - DNA, 12 bp, Unknown
  misc_feature (1)..( 12): Result.001 file - promoters60/1018276
taaatatcacag

SEQ ID NO: 95846 - DNA, 12 bp, Unknown
  misc_feature (1)..( 12): Result.001 file - promoters60/1018276
tctgtattgcag

SEQ ID NO: 95847 - DNA, 12 bp, Unknown
  misc_feature (1)..( 12): Result.001 file - promoters60/1018391
cttcaatctcat

SEQ ID NO: 95848 - DNA, 9 bp, Unknown
  misc_feature (1)..( 9): Result.001 file - promoters60/1018391
aaaagtggc

SEQ ID NO: 95849 - DNA, 9 bp, Unknown
  misc_feature (1)..( 9): Result.001 file - promoters60/1018391
aaaagttat

SEQ ID NO: 95850 - DNA, 9 bp, Unknown
  misc_feature (1)..( 9): Result.001 file - promoters60/1018391
aaaagtttc

SEQ ID NO: 95851 - DNA, 9 bp, Unknown
  misc_feature (1)..( 9): Result.001 file - promoters60/1018391
aaaagttat

SEQ ID NO: 95852 - DNA, 9 bp, Unknown
  misc_feature (1)..( 9): Result.001 file - promoters60/1018391
caaagaaag

SEQ ID NO: 95853 - DNA, 9 bp, Unknown
  misc_feature (1)..( 9): Result.001 file - promoters60/1018454
aaaattagc

SEQ ID NO: 95854 - DNA, 10 bp, Unknown
  misc_feature (1)..( 10): Result.001 file - promoters60/1018454
agaaaatggt

SEQ ID NO: 95855 - DNA, 10 bp, Unknown
  misc_feature (1)..( 10): Result.001 file - promoters60/1018454
tgaaaattat

SEQ ID NO: 95856 - DNA, 10 bp, Unknown
  misc_feature (1)..( 10): Result.001 file - promoters60/1018454
agacaataag

SEQ ID NO: 95857 - DNA, 10 bp, Unknown
  misc_feature (1)..( 10): Result.001 file - promoters60/1018454
ggaaaatttc

SEQ ID NO: 95858 - DNA, 10 bp, Unknown
  misc_feature (1)..( 10): Result.001 file - promoters60/1018454
caaaaatatt

SEQ ID NO: 95859 - DNA, 10 bp, Unknown
  misc_feature (1)..( 10): Result.001 file - promoters60/1018499
ttcaaatatg

SEQ ID NO: 95860 - DNA, 9 bp, Unknown
  misc_feature (1)..( 9): Result.001 file - promoters60/1018499
aattaaaat

SEQ ID NO: 95861 - DNA, 9 bp, Unknown
  misc_feature (1)..( 9): Result.001 file - promoters60/1018499
aataaaaat

SEQ ID NO: 95862 - DNA, 9 bp, Unknown
  misc_feature (1)..( 9): Result.001 file - promoters60/1018499
aacaaaaat

SEQ ID NO: 95863 - DNA, 7 bp, Unknown
  misc_feature (1)..( 7): Result.001 file - promoters60/1018499
cataaaa

SEQ ID NO: 95864 - DNA, 7 bp, Unknown
  misc_feature (1)..( 7): Result.001 file - promoters60/1018499
cataaac

SEQ ID NO: 95865 - DNA, 7 bp, Unknown
  misc_feature (1)..( 7): Result.001 file - promoters60/1018519
cattaac

SEQ ID NO: 95866 - DNA, 9 bp, Unknown
  misc_feature (1)..( 9): Result.001 file - promoters60/1018519
tcacaacca

SEQ ID NO: 95867 - DNA, 9 bp, Unknown
  misc_feature (1)..( 9): Result.001 file - promoters60/1018519
tcacaattg

SEQ ID NO: 95868 - DNA, 9 bp, Unknown
  misc_feature (1)..( 9): Result.001 file - promoters60/1018523
tcacatttg

SEQ ID NO: 95869 - DNA, 9 bp, Unknown
  misc_feature (1)..( 9): Result.001 file - promoters60/1018523
gaaaatatt

SEQ ID NO: 95870 - DNA, 9 bp, Unknown
  misc_feature (1)..( 9): Result.001 file - promoters60/1018523
aaaaataag

SEQ ID NO: 95871 - DNA, 9 bp, Unknown
  misc_feature (1)..( 9): Result.001 file - promoters60/1018523
aaaaattaa

SEQ ID NO: 95872 - DNA, 9 bp, Unknown
  misc_feature (1)..( 9): Result.001 file - promoters60/1018523
taaagtata

SEQ ID NO: 95873 - DNA, 9 bp, Unknown
  misc_feature (1)..( 9): Result.001 file - promoters60/1018523
aaagattta

SEQ ID NO: 95874 - DNA, 9 bp, Unknown
  misc_feature (1)..( 9): Result.001 file - promoters60/1018523
aaacatatt

SEQ ID NO: 95875 - DNA, 9 bp, Unknown
  misc_feature (1)..( 9): Result.001 file - promoters60/1018523
taaaatttc

SEQ ID NO: 95876 - DNA, 9 bp, Unknown
  misc_feature (1)..( 9): Result.001 file - promoters60/1018523
aaaataaat

SEQ ID NO: 95877 - DNA, 9 bp, Unknown
  misc_feature (1)..( 9): Result.001 file - promoters60/1018523
ttaataaag

SEQ ID NO: 95878 - DNA, 9 bp, Unknown
  misc_feature (1)..( 9): Result.001 file - promoters60/1018523
aaaattaat

SEQ ID NO: 95879 - DNA, 10 bp, Unknown
  misc_feature (1)..( 10): Result.001 file - promoters60/1018523
gaaatataag

SEQ ID NO: 95880 - DNA, 10 bp, Unknown
  misc_feature (1)..( 10): Result.001 file - promoters60/1018523
ataatatttc

SEQ ID NO: 95881 - DNA, 10 bp, Unknown
  misc_feature (1)..( 10): Result.001 file - promoters60/1018523
attataaaat

SEQ ID NO: 95882 - DNA, 10 bp, Unknown
  misc_feature (1)..( 10): Result.001 file - promoters60/1018523
aaaacaaacg

SEQ ID NO: 95883 - DNA, 10 bp, Unknown
  misc_feature (1)..( 10): Result.001 file - promoters60/1018523
aaaaaaaaga

SEQ ID NO: 95884 - DNA, 10 bp, Unknown
  misc_feature (1)..( 10): Result.001 file - promoters60/1018523
taaataaatt

SEQ ID NO: 95885 - DNA, 10 bp, Unknown
  misc_feature (1)..( 10): Result.001 file - promoters60/1018523
caaacaaatg

SEQ ID NO: 95886 - DNA, 10 bp, Unknown
  misc_feature (1)..( 10): Result.001 file - promoters60/1018523
taaaaaaaga

SEQ ID NO: 95887 - DNA, 10 bp, Unknown
  misc_feature (1)..( 10): Result.001 file - promoters60/1018523
gaaacaaatt

SEQ ID NO: 95888 - DNA, 10 bp, Unknown
  misc_feature (1)..( 10): Result.001 file - promoters60/1018523
ataatgaatt

SEQ ID NO: 95889 - DNA, 14 bp, Unknown
  misc_feature (1)..( 14): Result.001 file - promoters60/1018523
aattacaaaactac

SEQ ID NO: 95890 - DNA, 14 bp, Unknown
  misc_feature (1)..( 14): Result.001 file - promoters60/1018523
gtatacaaaaaaag

SEQ ID NO: 95891 - DNA, 14 bp, Unknown
  misc_feature (1)..( 14): Result.001 file - promoters60/1018523
caatactatctaat

SEQ ID NO: 95892 - DNA, 14 bp, Unknown
  misc_feature (1)..( 14): Result.001 file - promoters60/1018523
actcccaaaaataa

SEQ ID NO: 95893 - DNA, 14 bp, Unknown
  misc_feature (1)..( 14): Result.001 file - promoters60/1018523
aattcctaaaatca

SEQ ID NO: 95894 - DNA, 14 bp, Unknown
  misc_feature (1)..( 14): Result.001 file - promoters60/1018523
gacaaataaacata

SEQ ID NO: 95895 - DNA, 14 bp, Unknown
  misc_feature (1)..( 14): Result.001 file - promoters60/1018523
agttgcaaaaaacg

SEQ ID NO: 95896 - DNA, 14 bp, Unknown
  misc_feature (1)..( 14): Result.001 file - promoters60/1018523
atatacaagaacac

SEQ ID NO: 95897 - DNA, 13 bp, Unknown
  misc_feature (1)..( 13): Result.001 file - promoters60/1018523
aataaataaaagc

SEQ ID NO: 95898 - DNA, 13 bp, Unknown
  misc_feature (1)..( 13): Result.001 file - promoters60/1018523
aaacaataaaatt

SEQ ID NO: 95899 - DNA, 13 bp, Unknown
  misc_feature (1)..( 13): Result.001 file - promoters60/1018523
atgaaatataagt

SEQ ID NO: 95900 - DNA, 13 bp, Unknown
  misc_feature (1)..( 13): Result.001 file - promoters60/1018523
acattataaaata

SEQ ID NO: 95901 - DNA, 13 bp, Unknown
  misc_feature (1)..( 13): Result.001 file - promoters60/1018523
aaacagtaaaacc

SEQ ID NO: 95902 - DNA, 13 bp, Unknown
  misc_feature (1)..( 13): Result.001 file - promoters60/1018523
aggagataatatt

SEQ ID NO: 95903 - DNA, 10 bp, Unknown
  misc_feature (1)..( 10): Result.001 file - promoters60/1018523
atattattag

SEQ ID NO: 95904 - DNA, 10 bp, Unknown
  misc_feature (1)..( 10): Result.001 file - promoters60/1018523
atattattag

SEQ ID NO: 95905 - DNA, 10 bp, Unknown
  misc_feature (1)..( 10): Result.001 file - promoters60/1018523
ttattatatt

SEQ ID NO: 95906 - DNA, 10 bp, Unknown
  misc_feature (1)..( 10): Result.001 file - promoters60/1018523
atataattat

SEQ ID NO: 95907 - DNA, 10 bp, Unknown
  misc_feature (1)..( 10): Result.001 file - promoters60/1018523
aaattattta

SEQ ID NO: 95908 - DNA, 10 bp, Unknown
  misc_feature (1)..( 10): Result.001 file - promoters60/1018523
aactaattaa

SEQ ID NO: 95909 - DNA, 10 bp, Unknown
  misc_feature (1)..( 10): Result.001 file - promoters60/1018523
actacatatt

SEQ ID NO: 95910 - DNA, 10 bp, Unknown
  misc_feature (1)..( 10): Result.001 file - promoters60/1018523
taaacatatt

SEQ ID NO: 95911 - DNA, 10 bp, Unknown
  misc_feature (1)..( 10): Result.001 file - promoters60/1018523
tcaacatata

SEQ ID NO: 95912 - DNA, 10 bp, Unknown
  misc_feature (1)..( 10): Result.001 file - promoters60/1018523
caaaaataag

SEQ ID NO: 95913 - DNA, 10 bp, Unknown
  misc_feature (1)..( 10): Result.001 file - promoters60/1018523
caaaaaacga

SEQ ID NO: 95914 - DNA, 10 bp, Unknown
  misc_feature (1)..( 10): Result.001 file - promoters60/1018523
aaaaaaagct

SEQ ID NO: 95915 - DNA, 10 bp, Unknown
  misc_feature (1)..( 10): Result.001 file - promoters60/1018523
taaacatata

SEQ ID NO: 95916 - DNA, 11 bp, Unknown
  misc_feature (1)..( 11): Result.001 file - promoters60/1018523
atgaaaaacaa

SEQ ID NO: 95917 - DNA, 11 bp, Unknown
  misc_feature (1)..( 11): Result.001 file - promoters60/1018523
aagaaaaaata

SEQ ID NO: 95918 - DNA, 11 bp, Unknown
  misc_feature (1)..( 11): Result.001 file - promoters60/1018523
gggaaaaaaaa

SEQ ID NO: 95919 - DNA, 11 bp, Unknown
  misc_feature (1)..( 11): Result.001 file - promoters60/1018523
gttaaaaaata

SEQ ID NO: 95920 - DNA, 11 bp, Unknown
  misc_feature (1)..( 11): Result.001 file - promoters60/1018523
tttacaaacaa

SEQ ID NO: 95921 - DNA, 11 bp, Unknown
  misc_feature (1)..( 11): Result.001 file - promoters60/1018523
attaacaaact

SEQ ID NO: 95922 - DNA, 10 bp, Unknown
  misc_feature (1)..( 10): Result.001 file - promoters60/1018523
taagattagt

SEQ ID NO: 95923 - DNA, 10 bp, Unknown
  misc_feature (1)..( 10): Result.001 file - promoters60/1018523
taaaatttca

SEQ ID NO: 95924 - DNA, 10 bp, Unknown
  misc_feature (1)..( 10): Result.001 file - promoters60/1018523
aaaaattaaa

SEQ ID NO: 95925 - DNA, 11 bp, Unknown
  misc_feature (1)..( 11): Result.001 file - promoters60/1018523
taacaattcta

SEQ ID NO: 95926 - DNA, 11 bp, Unknown
  misc_feature (1)..( 11): Result.001 file - promoters60/1018523
ccaaaattcaa

SEQ ID NO: 95927 - DNA, 11 bp, Unknown
  misc_feature (1)..( 11): Result.001 file - promoters60/1018523
tgccaatacta

SEQ ID NO: 95928 - DNA, 11 bp, Unknown
  misc_feature (1)..( 11): Result.001 file - promoters60/1018529
gaacaagtctc

SEQ ID NO: 95929 - DNA, 14 bp, Unknown
  misc_feature (1)..( 14): Result.001 file - promoters60/1018529
tttttctatcctct

SEQ ID NO: 95930 - DNA, 14 bp, Unknown
  misc_feature (1)..( 14): Result.001 file - promoters60/1018529
ttcatctatcttct

SEQ ID NO: 95931 - DNA, 14 bp, Unknown
  misc_feature (1)..( 14): Result.001 file - promoters60/1018529
tttttttatcctcc

SEQ ID NO: 95932 - DNA, 14 bp, Unknown
  misc_feature (1)..( 14): Result.001 file - promoters60/1018536
gaaatttgtttttg

SEQ ID NO: 95933 - DNA, 14 bp, Unknown
  misc_feature (1)..( 14): Result.001 file - promoters60/1018536
tatttttgaagaat

SEQ ID NO: 95934 - DNA, 14 bp, Unknown
  misc_feature (1)..( 14): Result.001 file - promoters60/1018536
tatttatgacgagg

SEQ ID NO: 95935 - DNA, 14 bp, Unknown
  misc_feature (1)..( 14): Result.001 file - promoters60/1018536
caattttgatgaat

SEQ ID NO: 95936 - DNA, 14 bp, Unknown
  misc_feature (1)..( 14): Result.001 file - promoters60/1018536
tattttaattcatg

SEQ ID NO: 95937 - DNA, 14 bp, Unknown
  misc_feature (1)..( 14): Result.001 file - promoters60/1018536
tagatttgctgaat

SEQ ID NO: 95938 - DNA, 14 bp, Unknown
  misc_feature (1)..( 14): Result.001 file - promoters60/1018536
cccttgtgaatgtc

SEQ ID NO: 95939 - DNA, 10 bp, Unknown
  misc_feature (1)..( 10): Result.001 file - promoters60/1018536
aattttgaaa

SEQ ID NO: 95940 - DNA, 10 bp, Unknown
  misc_feature (1)..( 10): Result.001 file - promoters60/1018536
aatcttgaac

SEQ ID NO: 95941 - DNA, 10 bp, Unknown
  misc_feature (1)..( 10): Result.001 file - promoters60/1018536
aattttgatg

SEQ ID NO: 95942 - DNA, 12 bp, Unknown
  misc_feature (1)..( 12): Result.001 file - promoters60/1018536
gatttgctgaat

SEQ ID NO: 95943 - DNA, 9 bp, Unknown
  misc_feature (1)..( 9): Result.001 file - promoters60/1018536
aaaaagaaa

SEQ ID NO: 95944 - DNA, 9 bp, Unknown
  misc_feature (1)..( 9): Result.001 file - promoters60/1018536
aaaaagctg

SEQ ID NO: 95945 - DNA, 9 bp, Unknown
  misc_feature (1)..( 9): Result.001 file - promoters60/1018536
aaaatgcta

SEQ ID NO: 95946 - DNA, 9 bp, Unknown
  misc_feature (1)..( 9): Result.001 file - promoters60/1018536
ccaattcta

SEQ ID NO: 95947 - DNA, 8 bp, Unknown
  misc_feature (1)..( 8): Result.001 file - promoters60/1018536
atttaaaa

SEQ ID NO: 95948 - DNA, 8 bp, Unknown
  misc_feature (1)..( 8): Result.001 file - promoters60/1018536
attttaaa

SEQ ID NO: 95949 - DNA, 8 bp, Unknown
  misc_feature (1)..( 8): Result.001 file - promoters60/1018536
gtttcaaa

SEQ ID NO: 95950 - DNA, 8 bp, Unknown
  misc_feature (1)..( 8): Result.001 file - promoters60/1018536
attttaat

SEQ ID NO: 95951 - DNA, 8 bp, Unknown
  misc_feature (1)..( 8): Result.001 file - promoters60/1018536
attctaac

SEQ ID NO: 95952 - DNA, 8 bp, Unknown
  misc_feature (1)..( 8): Result.001 file - promoters60/1018536
ttttcaat

SEQ ID NO: 95953 - DNA, 8 bp, Unknown
  misc_feature (1)..( 8): Result.001 file - promoters60/1018536
attttaat

SEQ ID NO: 95954 - DNA, 8 bp, Unknown
  misc_feature (1)..( 8): Result.001 file - promoters60/1018536
attttaaa

SEQ ID NO: 95955 - DNA, 8 bp, Unknown
  misc_feature (1)..( 8): Result.001 file - promoters60/1018536
attctaac

SEQ ID NO: 95956 - DNA, 8 bp, Unknown
  misc_feature (1)..( 8): Result.001 file - promoters60/1018536
cttttaaa

SEQ ID NO: 95957 - DNA, 17 bp, Unknown
  misc_feature (1)..( 17): Result.001 file - promoters60/1018536
aaaatgttagataggaa

SEQ ID NO: 95958 - DNA, 17 bp, Unknown
  misc_feature (1)..( 17): Result.001 file - promoters60/1018536
taaattttaaaattatt

SEQ ID NO: 95959 - DNA, 17 bp, Unknown
  misc_feature (1)..( 17): Result.001 file - promoters60/1018536
taaattttgaaataatt

SEQ ID NO: 95960 - DNA, 17 bp, Unknown
  misc_feature (1)..( 17): Result.001 file - promoters60/1018536
taattgttaatcttttg

SEQ ID NO: 95961 - DNA, 10 bp, Unknown
  misc_feature (1)..( 10): Result.001 file - promoters60/1018536
tatataaaca

SEQ ID NO: 95962 - DNA, 10 bp, Unknown
  misc_feature (1)..( 10): Result.001 file - promoters60/1018536
tatataataa

SEQ ID NO: 95963 - DNA, 10 bp, Unknown
  misc_feature (1)..( 10): Result.001 file - promoters60/1018536
cctataaata

SEQ ID NO: 95964 - DNA, 10 bp, Unknown
  misc_feature (1)..( 10): Result.001 file - promoters60/1018536
acgataaata

SEQ ID NO: 95965 - DNA, 14 bp, Unknown
  misc_feature (1)..( 14): Result.001 file - promoters60/1018536
aaacttataattat

SEQ ID NO: 95966 - DNA, 14 bp, Unknown
  misc_feature (1)..( 14): Result.001 file - promoters60/1018536
atctttataagtat

SEQ ID NO: 95967 - DNA, 14 bp, Unknown
  misc_feature (1)..( 14): Result.001 file - promoters60/1018536
gctaatataagtaa

SEQ ID NO: 95968 - DNA, 14 bp, Unknown
  misc_feature (1)..( 14): Result.001 file - promoters60/1018536
aaatttgtaacttc

SEQ ID NO: 95969 - DNA, 14 bp, Unknown
  misc_feature (1)..( 14): Result.001 file - promoters60/1018536
cgttttaaaagtaa

SEQ ID NO: 95970 - DNA, 14 bp, Unknown
  misc_feature (1)..( 14): Result.001 file - promoters60/1018536
atctttatacaaaa

SEQ ID NO: 95971 - DNA, 8 bp, Unknown
  misc_feature (1)..( 8): Result.001 file - promoters60/1018536
gaaaatat

SEQ ID NO: 95972 - DNA, 8 bp, Unknown
  misc_feature (1)..( 8): Result.001 file - promoters60/1018536
caaattat

SEQ ID NO: 95973 - DNA, 8 bp, Unknown
  misc_feature (1)..( 8): Result.001 file - promoters60/1018536
aaaaatat

SEQ ID NO: 95974 - DNA, 8 bp, Unknown
  misc_feature (1)..( 8): Result.001 file - promoters60/1018536
caaattct

SEQ ID NO: 95975 - DNA, 11 bp, Unknown
  misc_feature (1)..( 11): Result.001 file - promoters60/1018536
taatataagta

SEQ ID NO: 95976 - DNA, 11 bp, Unknown
  misc_feature (1)..( 11): Result.001 file - promoters60/1018536
taatgtaattt

SEQ ID NO: 95977 - DNA, 11 bp, Unknown
  misc_feature (1)..( 11): Result.001 file - promoters60/1018536
ctttataagta

SEQ ID NO: 95978 - DNA, 11 bp, Unknown
  misc_feature (1)..( 11): Result.001 file - promoters60/1018536
gaatgtatata

SEQ ID NO: 95979 - DNA, 10 bp, Unknown
  misc_feature (1)..( 10): Result.001 file - promoters60/1018536
ttgattcatc

SEQ ID NO: 95980 - DNA, 10 bp, Unknown
  misc_feature (1)..( 10): Result.001 file - promoters60/1018536
taatttcatc

SEQ ID NO: 95981 - DNA, 10 bp, Unknown
  misc_feature (1)..( 10): Result.001 file - promoters60/1018536
attattcata

SEQ ID NO: 95982 - DNA, 10 bp, Unknown
  misc_feature (1)..( 10): Result.001 file - promoters60/1018536
attgttcatt

SEQ ID NO: 95983 - DNA, 13 bp, Unknown
  misc_feature (1)..( 13): Result.001 file - promoters60/1018536
aatataagtaaca

SEQ ID NO: 95984 - DNA, 13 bp, Unknown
  misc_feature (1)..( 13): Result.001 file - promoters60/1018536
agatgaagtcaca

SEQ ID NO: 95985 - DNA, 13 bp, Unknown
  misc_feature (1)..( 13): Result.001 file - promoters60/1018536
tttataagtataa

SEQ ID NO: 95986 - DNA, 13 bp, Unknown
  misc_feature (1)..( 13): Result.001 file - promoters60/1018536
gaaatttgtaact

SEQ ID NO: 95987 - DNA, 13 bp, Unknown
  misc_feature (1)..( 13): Result.001 file - promoters60/1018536
tttaaaagtaaga

SEQ ID NO: 95988 - DNA, 11 bp, Unknown
  misc_feature (1)..( 11): Result.001 file - promoters60/1018536
ataatattctc

SEQ ID NO: 95989 - DNA, 11 bp, Unknown
  misc_feature (1)..( 11): Result.001 file - promoters60/1018536
ataatatattt

SEQ ID NO: 95990 - DNA, 11 bp, Unknown
  misc_feature (1)..( 11): Result.001 file - promoters60/1018536
aaaatatgttt

SEQ ID NO: 95991 - DNA, 11 bp, Unknown
  misc_feature (1)..( 11): Result.001 file - promoters60/1018755
ttaacatataa

SEQ ID NO: 95992 - DNA, 13 bp, Unknown
  misc_feature (1)..( 13): Result.001 file - promoters60/1018755
gtaatcaatccta

SEQ ID NO: 95993 - DNA, 13 bp, Unknown
  misc_feature (1)..( 13): Result.001 file - promoters60/1018755
aaaatgaattctt

SEQ ID NO: 95994 - DNA, 13 bp, Unknown
  misc_feature (1)..( 13): Result.001 file - promoters60/1018755
caaatcaaatcga

SEQ ID NO: 95995 - DNA, 13 bp, Unknown
  misc_feature (1)..( 13): Result.001 file - promoters60/1018755
tgcatcaatgctt

SEQ ID NO: 95996 - DNA, 13 bp, Unknown
  misc_feature (1)..( 13): Result.001 file - promoters60/1018755
aaaacgaatggca

SEQ ID NO: 95997 - DNA, 13 bp, Unknown
  misc_feature (1)..( 13): Result.001 file - promoters60/1018755
aagacgaatctaa

SEQ ID NO: 95998 - DNA, 13 bp, Unknown
  misc_feature (1)..( 13): Result.001 file - promoters60/1018755
atcattaatcctt

SEQ ID NO: 95999 - DNA, 14 bp, Unknown
  misc_feature (1)..( 14): Result.001 file - promoters60/1018755
ggccttttagtttg

SEQ ID NO: 96000 - DNA, 14 bp, Unknown
  misc_feature (1)..( 14): Result.001 file - promoters60/1018755
gataatttagtgga

SEQ ID NO: 96001 - DNA, 14 bp, Unknown
  misc_feature (1)..( 14): Result.001 file - promoters60/1018755
taccctttcgtttg

SEQ ID NO: 96002 - DNA, 14 bp, Unknown
  misc_feature (1)..( 14): Result.001 file - promoters60/1018755
ggccttttaggatc

SEQ ID NO: 96003 - DNA, 14 bp, Unknown
  misc_feature (1)..( 14): Result.001 file - promoters60/1018755
gaaaaattattttc

SEQ ID NO: 96004 - DNA, 14 bp, Unknown
  misc_feature (1)..( 14): Result.001 file - promoters60/1018783
tcccttttgattta

SEQ ID NO: 96005 - DNA, 13 bp, Unknown
  misc_feature (1)..( 13): Result.001 file - promoters60/1018783
tgttcatactcga

SEQ ID NO: 96006 - DNA, 13 bp, Unknown
  misc_feature (1)..( 13): Result.001 file - promoters60/1018783
tgttaataattat

SEQ ID NO: 96007 - DNA, 13 bp, Unknown
  misc_feature (1)..( 13): Result.001 file - promoters60/1018783
tcttcataccaac

SEQ ID NO: 96008 - DNA, 13 bp, Unknown
  misc_feature (1)..( 13): Result.001 file - promoters60/1018783
ttataatcattat

SEQ ID NO: 96009 - DNA, 9 bp, Unknown
  misc_feature (1)..( 9): Result.001 file - promoters60/1018783
atgattaaa

SEQ ID NO: 96010 - DNA, 9 bp, Unknown
  misc_feature (1)..( 9): Result.001 file - promoters60/1018783
ccaattaaa

SEQ ID NO: 96011 - DNA, 9 bp, Unknown
  misc_feature (1)..( 9): Result.001 file - promoters60/1018783
ccacttaac

SEQ ID NO: 96012 - DNA, 10 bp, Unknown
  misc_feature (1)..( 10): Result.001 file - promoters60/1018783
attcaacgta

SEQ ID NO: 96013 - DNA, 10 bp, Unknown
  misc_feature (1)..( 10): Result.001 file - promoters60/1018783
attgaacgga

SEQ ID NO: 96014 - DNA, 10 bp, Unknown
  misc_feature (1)..( 10): Result.001 file - promoters60/1018798
gtacaaggta

SEQ ID NO: 96015 - DNA, 10 bp, Unknown
  misc_feature (1)..( 10): Result.001 file - promoters60/1018798
tcaaaatacc

SEQ ID NO: 96016 - DNA, 10 bp, Unknown
  misc_feature (1)..( 10): Result.001 file - promoters60/1018798
tcagaatctg

SEQ ID NO: 96017 - DNA, 10 bp, Unknown
  misc_feature (1)..( 10): Result.001 file - promoters60/1018798
ctaaaataat

SEQ ID NO: 96018 - DNA, 10 bp, Unknown
  misc_feature (1)..( 10): Result.001 file - promoters60/1018798
aaagaatcac

SEQ ID NO: 96019 - DNA, 10 bp, Unknown
  misc_feature (1)..( 10): Result.001 file - promoters60/1018798
ctataattgt

SEQ ID NO: 96020 - DNA, 10 bp, Unknown
  misc_feature (1)..( 10): Result.001 file - promoters60/1018798
ctataactga

SEQ ID NO: 96021 - DNA, 10 bp, Unknown
  misc_feature (1)..( 10): Result.001 file - promoters60/1018798
ttaagatagc

SEQ ID NO: 96022 - DNA, 10 bp, Unknown
  misc_feature (1)..( 10): Result.001 file - promoters60/1018798
agaaaaaaat

SEQ ID NO: 96023 - DNA, 13 bp, Unknown
  misc_feature (1)..( 13): Result.001 file - promoters60/1018798
gaatctttgatta

SEQ ID NO: 96024 - DNA, 13 bp, Unknown
  misc_feature (1)..( 13): Result.001 file - promoters60/1018798
ttaactttgaaag

SEQ ID NO: 96025 - DNA, 13 bp, Unknown
  misc_feature (1)..( 13): Result.001 file - promoters60/1018798
caatatttgtaat

SEQ ID NO: 96026 - DNA, 13 bp, Unknown
  misc_feature (1)..( 13): Result.001 file - promoters60/1018798
tagtatttataat

SEQ ID NO: 96027 - DNA, 13 bp, Unknown
  misc_feature (1)..( 13): Result.001 file - promoters60/1018798
caaaattatatcc

SEQ ID NO: 96028 - DNA, 13 bp, Unknown
  misc_feature (1)..( 13): Result.001 file - promoters60/1018831
caatatgtgcaac

SEQ ID NO: 96029 - DNA, 6 bp, Unknown
  misc_feature (1)..( 6): Result.001 file - promoters60/1018831
agaatc

SEQ ID NO: 96030 - DNA, 6 bp, Unknown
  misc_feature (1)..( 6): Result.001 file - promoters60/1018831
agaatc

SEQ ID NO: 96031 - DNA, 8 bp, Unknown
  misc_feature (1)..( 8): Result.001 file - promoters60/1018831
tccggagg

SEQ ID NO: 96032 - DNA, 8 bp, Unknown
  misc_feature (1)..( 8): Result.001 file - promoters60/1018831
tccgtagg

SEQ ID NO: 96033 - DNA, 6 bp, Unknown
  misc_feature (1)..( 6): Result.001 file - promoters60/1018831
gtactc

SEQ ID NO: 96034 - DNA, 6 bp, Unknown
  misc_feature (1)..( 6): Result.001 file - promoters60/1018831
gtactc

SEQ ID NO: 96035 - DNA, 6 bp, Unknown
  misc_feature (1)..( 6): Result.001 file - promoters60/1018831
aactct

SEQ ID NO: 96036 - DNA, 6 bp, Unknown
  misc_feature (1)..( 6): Result.001 file - promoters60/1018831
aactct

SEQ ID NO: 96037 - DNA, 10 bp, Unknown
  misc_feature (1)..( 10): Result.001 file - promoters60/1018831
gaatacattc

SEQ ID NO: 96038 - DNA, 10 bp, Unknown
  misc_feature (1)..( 10): Result.001 file - promoters60/1018831
gaaaacatac

SEQ ID NO: 96039 - DNA, 10 bp, Unknown
  misc_feature (1)..( 10): Result.001 file - promoters60/1018831
aaaaccatac

SEQ ID NO: 96040 - DNA, 7 bp, Unknown
  misc_feature (1)..( 7): Result.001 file - promoters60/1018831
caacagg

SEQ ID NO: 96041 - DNA, 7 bp, Unknown
  misc_feature (1)..( 7): Result.001 file - promoters60/1018831
caaaagg

SEQ ID NO: 96042 - DNA, 6 bp, Unknown
  misc_feature (1)..( 6): Result.001 file - promoters60/1018831
aatcat

SEQ ID NO: 96043 - DNA, 6 bp, Unknown
  misc_feature (1)..( 6): Result.001 file - promoters60/1018831
aatcat

SEQ ID NO: 96044 - DNA, 10 bp, Unknown
  misc_feature (1)..( 10): Result.001 file - promoters60/1018831
ttcacatgtt

SEQ ID NO: 96045 - DNA, 10 bp, Unknown
  misc_feature (1)..( 10): Result.001 file - promoters60/1018831
ttcacaggtt

SEQ ID NO: 96046 - DNA, 8 bp, Unknown
  misc_feature (1)..( 8): Result.001 file - promoters60/1018831
aagcaact

SEQ ID NO: 96047 - DNA, 8 bp, Unknown
  misc_feature (1)..( 8): Result.001 file - promoters60/1018831
aagcaact

SEQ ID NO: 96048 - DNA, 6 bp, Unknown
  misc_feature (1)..( 6): Result.001 file - promoters60/1018831
acaaaa

SEQ ID NO: 96049 - DNA, 6 bp, Unknown
  misc_feature (1)..( 6): Result.001 file - promoters60/1018831
acaaaa

SEQ ID NO: 96050 - DNA, 7 bp, Unknown
  misc_feature (1)..( 7): Result.001 file - promoters60/1018831
aagaaaa

SEQ ID NO: 96051 - DNA, 7 bp, Unknown
  misc_feature (1)..( 7): Result.001 file - promoters60/1018831
aaggaaa

SEQ ID NO: 96052 - DNA, 8 bp, Unknown
  misc_feature (1)..( 8): Result.001 file - promoters60/1018831
aaagtgtt

SEQ ID NO: 96053 - DNA, 8 bp, Unknown
  misc_feature (1)..( 8): Result.001 file - promoters60/1018831
aaactgtt

SEQ ID NO: 96054 - DNA, 6 bp, Unknown
  misc_feature (1)..( 6): Result.001 file - promoters60/1018831
ttggat

SEQ ID NO: 96055 - DNA, 6 bp, Unknown
  misc_feature (1)..( 6): Result.001 file - promoters60/1018831
ttggat

SEQ ID NO: 96056 - DNA, 6 bp, Unknown
  misc_feature (1)..( 6): Result.001 file - promoters60/1018831
tcaaca

SEQ ID NO: 96057 - DNA, 6 bp, Unknown
  misc_feature (1)..( 6): Result.001 file - promoters60/1018831
tcaaca

SEQ ID NO: 96058 - DNA, 6 bp, Unknown
  misc_feature (1)..( 6): Result.001 file - promoters60/1018831
gtttgt

SEQ ID NO: 96059 - DNA, 6 bp, Unknown
  misc_feature (1)..( 6): Result.001 file - promoters60/1018831
gtttgt

SEQ ID NO: 96060 - DNA, 6 bp, Unknown
  misc_feature (1)..( 6): Result.001 file - promoters60/1018831
cttcac

SEQ ID NO: 96061 - DNA, 6 bp, Unknown
  misc_feature (1)..( 6): Result.001 file - promoters60/1018835
cttcac

SEQ ID NO: 96062 - DNA, 7 bp, Unknown
  misc_feature (1)..( 7): Result.001 file - promoters60/1018835
cctttta

SEQ ID NO: 96063 - DNA, 7 bp, Unknown
  misc_feature (1)..( 7): Result.001 file - promoters60/1018835
cctttta

SEQ ID NO: 96064 - DNA, 7 bp, Unknown
  misc_feature (1)..( 7): Result.001 file - promoters60/1018835
ccttttc

SEQ ID NO: 96065 - DNA, 8 bp, Unknown
  misc_feature (1)..( 8): Result.001 file - promoters60/1018835
gttccaac

SEQ ID NO: 96066 - DNA, 8 bp, Unknown
  misc_feature (1)..( 8): Result.001 file - promoters60/1018835
gtttcaat

SEQ ID NO: 96067 - DNA, 8 bp, Unknown
  misc_feature (1)..( 8): Result.001 file - promoters60/1018835
atttaaat

SEQ ID NO: 96068 - DNA, 8 bp, Unknown
  misc_feature (1)..( 8): Result.001 file - promoters60/1018835
gaagtgcg

SEQ ID NO: 96069 - DNA, 8 bp, Unknown
  misc_feature (1)..( 8): Result.001 file - promoters60/1018835
gaaatgct

SEQ ID NO: 96070 - DNA, 8 bp, Unknown
  misc_feature (1)..( 8): Result.001 file - promoters60/1018835
ctaatgct

SEQ ID NO: 96071 - DNA, 8 bp, Unknown
  misc_feature (1)..( 8): Result.001 file - promoters60/1018835
ttgttaaa

SEQ ID NO: 96072 - DNA, 8 bp, Unknown
  misc_feature (1)..( 8): Result.001 file - promoters60/1018835
ttgttaat

SEQ ID NO: 96073 - DNA, 8 bp, Unknown
  misc_feature (1)..( 8): Result.001 file - promoters60/1018835
acgttaat

SEQ ID NO: 96074 - DNA, 10 bp, Unknown
  misc_feature (1)..( 10): Result.001 file - promoters60/1018835
tttctgaaag

SEQ ID NO: 96075 - DNA, 10 bp, Unknown
  misc_feature (1)..( 10): Result.001 file - promoters60/1018835
aggctggaag

SEQ ID NO: 96076 - DNA, 10 bp, Unknown
  misc_feature (1)..( 10): Result.001 file - promoters60/1018835
aggatggagc

SEQ ID NO: 96077 - DNA, 7 bp, Unknown
  misc_feature (1)..( 7): Result.001 file - promoters60/1018835
aaagcga

SEQ ID NO: 96078 - DNA, 7 bp, Unknown
  misc_feature (1)..( 7): Result.001 file - promoters60/1018835
gaagcga

SEQ ID NO: 96079 - DNA, 7 bp, Unknown
  misc_feature (1)..( 7): Result.001 file - promoters60/1018956
gaagcgc

SEQ ID NO: 96080 - DNA, 7 bp, Unknown
  misc_feature (1)..( 7): Result.001 file - promoters60/1018956
aatcaca

SEQ ID NO: 96081 - DNA, 7 bp, Unknown
  misc_feature (1)..( 7): Result.001 file - promoters60/1018956
aattaca

SEQ ID NO: 96082 - DNA, 10 bp, Unknown
  misc_feature (1)..( 10): Result.001 file - promoters60/1018956
ggaaaaagaa

SEQ ID NO: 96083 - DNA, 10 bp, Unknown
  misc_feature (1)..( 10): Result.001 file - promoters60/1018956
ggaaaagaaa

SEQ ID NO: 96084 - DNA, 10 bp, Unknown
  misc_feature (1)..( 10): Result.001 file - promoters60/1018956
ggaaatgaaa

SEQ ID NO: 96085 - DNA, 7 bp, Unknown
  misc_feature (1)..( 7): Result.001 file - promoters60/1018956
aaaagaa

SEQ ID NO: 96086 - DNA, 7 bp, Unknown
  misc_feature (1)..( 7): Result.001 file - promoters60/1018956
aaaagaa

SEQ ID NO: 96087 - DNA, 7 bp, Unknown
  misc_feature (1)..( 7): Result.001 file - promoters60/1018956
aaatgaa

SEQ ID NO: 96088 - DNA, 6 bp, Unknown
  misc_feature (1)..( 6): Result.001 file - promoters60/1018956
aatcaa

SEQ ID NO: 96089 - DNA, 6 bp, Unknown
  misc_feature (1)..( 6): Result.001 file - promoters60/1018956
aatcaa

SEQ ID NO: 96090 - DNA, 6 bp, Unknown
  misc_feature (1)..( 6): Result.001 file - promoters60/1018956
aactca

SEQ ID NO: 96091 - DNA, 6 bp, Unknown
  misc_feature (1)..( 6): Result.001 file - promoters60/1018956
aactca

SEQ ID NO: 96092 - DNA, 8 bp, Unknown
  misc_feature (1)..( 8): Result.001 file - promoters60/1018956
aatagcaa

SEQ ID NO: 96093 - DNA, 8 bp, Unknown
  misc_feature (1)..( 8): Result.001 file - promoters60/1018956
aattgcaa

SEQ ID NO: 96094 - DNA, 6 bp, Unknown
  misc_feature (1)..( 6): Result.001 file - promoters60/1018956
agagag

SEQ ID NO: 96095 - DNA, 6 bp, Unknown
  misc_feature (1)..( 6): Result.001 file - promoters60/1018956
agagag

SEQ ID NO: 96096 - DNA, 6 bp, Unknown
  misc_feature (1)..( 6): Result.001 file - promoters60/1018956
taaaaa

SEQ ID NO: 96097 - DNA, 6 bp, Unknown
  misc_feature (1)..( 6): Result.001 file - promoters60/1018956
taaaaa

SEQ ID NO: 96098 - DNA, 7 bp, Unknown
  misc_feature (1)..( 7): Result.001 file - promoters60/1018956
attatca

SEQ ID NO: 96099 - DNA, 7 bp, Unknown
  misc_feature (1)..( 7): Result.001 file - promoters60/1018956
attgtca

SEQ ID NO: 96100 - DNA, 6 bp, Unknown
  misc_feature (1)..( 6): Result.001 file - promoters60/1018956
agtaaa

SEQ ID NO: 96101 - DNA, 6 bp, Unknown
  misc_feature (1)..( 6): Result.001 file - promoters60/1018956
agtaaa

SEQ ID NO: 96102 - DNA, 7 bp, Unknown
  misc_feature (1)..( 7): Result.001 file - promoters60/1018956
aatcggg

SEQ ID NO: 96103 - DNA, 7 bp, Unknown
  misc_feature (1)..( 7): Result.001 file - promoters60/1018956
aattggg

SEQ ID NO: 96104 - DNA, 8 bp, Unknown
  misc_feature (1)..( 8): Result.001 file - promoters60/1018956
gaaagaaa

SEQ ID NO: 96105 - DNA, 8 bp, Unknown
  misc_feature (1)..( 8): Result.001 file - promoters60/1018956
gaaacaaa

SEQ ID NO: 96106 - DNA, 7 bp, Unknown
  misc_feature (1)..( 7): Result.001 file - promoters60/1018956
cccacta

SEQ ID NO: 96107 - DNA, 7 bp, Unknown
  misc_feature (1)..( 7): Result.001 file - promoters60/1018956
cccacta

SEQ ID NO: 96108 - DNA, 9 bp, Unknown
  misc_feature (1)..( 9): Result.001 file - promoters60/1018956
aaagaaaag

SEQ ID NO: 96109 - DNA, 9 bp, Unknown
  misc_feature (1)..( 9): Result.001 file - promoters60/1018956
aaagtaaag

SEQ ID NO: 96110 - DNA, 7 bp, Unknown
  misc_feature (1)..( 7): Result.001 file - promoters60/1018956
gtatata

SEQ ID NO: 96111 - DNA, 7 bp, Unknown
  misc_feature (1)..( 7): Result.001 file - promoters60/1018973
gtatata

SEQ ID NO: 96112 - DNA, 13 bp, Unknown
  misc_feature (1)..( 13): Result.001 file - promoters60/1018973
aaatgtttgtatt

SEQ ID NO: 96113 - DNA, 13 bp, Unknown
  misc_feature (1)..( 13): Result.001 file - promoters60/1018973
ccacaattgtatt

SEQ ID NO: 96114 - DNA, 13 bp, Unknown
  misc_feature (1)..( 13): Result.001 file - promoters60/1018973
caatctttgtatc

SEQ ID NO: 96115 - DNA, 13 bp, Unknown
  misc_feature (1)..( 13): Result.001 file - promoters60/1018973
caatctttgtttt

SEQ ID NO: 96116 - DNA, 9 bp, Unknown
  misc_feature (1)..( 9): Result.001 file - promoters60/1018973
tatttttga

SEQ ID NO: 96117 - DNA, 9 bp, Unknown
  misc_feature (1)..( 9): Result.001 file - promoters60/1018973
tatttatga

SEQ ID NO: 96118 - DNA, 9 bp, Unknown
  misc_feature (1)..( 9): Result.001 file - promoters60/1018973
tattttaat

SEQ ID NO: 96119 - DNA, 9 bp, Unknown
  misc_feature (1)..( 9): Result.001 file - promoters60/1018973
gattttaca

SEQ ID NO: 96120 - DNA, 9 bp, Unknown
  misc_feature (1)..( 9): Result.001 file - promoters60/1018973
gttcttcat

SEQ ID NO: 96121 - DNA, 9 bp, Unknown
  misc_feature (1)..( 9): Result.001 file - promoters60/1018973
attcatcac

SEQ ID NO: 96122 - DNA, 9 bp, Unknown
  misc_feature (1)..( 9): Result.001 file - promoters60/1018973
attctacat

SEQ ID NO: 96123 - DNA, 9 bp, Unknown
  misc_feature (1)..( 9): Result.001 file - promoters60/1018973
attctaaaa

SEQ ID NO: 96124 - DNA, 8 bp, Unknown
  misc_feature (1)..( 8): Result.001 file - promoters60/1018973
aaaaagaa

SEQ ID NO: 96125 - DNA, 8 bp, Unknown
  misc_feature (1)..( 8): Result.001 file - promoters60/1018973
aaaaagct

SEQ ID NO: 96126 - DNA, 8 bp, Unknown
  misc_feature (1)..( 8): Result.001 file - promoters60/1018973
aaaaaatt

SEQ ID NO: 96127 - DNA, 8 bp, Unknown
  misc_feature (1)..( 8): Result.001 file - promoters60/1018973
aaaatgct

SEQ ID NO: 96128 - DNA, 8 bp, Unknown
  misc_feature (1)..( 8): Result.001 file - promoters60/1018973
atctcttc

SEQ ID NO: 96129 - DNA, 8 bp, Unknown
  misc_feature (1)..( 8): Result.001 file - promoters60/1018973
ttctcttc

SEQ ID NO: 96130 - DNA, 8 bp, Unknown
  misc_feature (1)..( 8): Result.001 file - promoters60/1018973
ttcccttg

SEQ ID NO: 96131 - DNA, 8 bp, Unknown
  misc_feature (1)..( 8): Result.001 file - promoters60/1018973
ctcccttc

SEQ ID NO: 96132 - DNA, 11 bp, Unknown
  misc_feature (1)..( 11): Result.001 file - promoters60/1018973
ttataattatg

SEQ ID NO: 96133 - DNA, 11 bp, Unknown
  misc_feature (1)..( 11): Result.001 file - promoters60/1018973
atattattatt

SEQ ID NO: 96134 - DNA, 11 bp, Unknown
  misc_feature (1)..( 11): Result.001 file - promoters60/1018973
ttataagtata

SEQ ID NO: 96135 - DNA, 11 bp, Unknown
  misc_feature (1)..( 11): Result.001 file - promoters60/1018973
atataagtaac

SEQ ID NO: 96136 - DNA, 11 bp, Unknown
  misc_feature (1)..( 11): Result.001 file - promoters60/1018973
caatctttata

SEQ ID NO: 96137 - DNA, 10 bp, Unknown
  misc_feature (1)..( 10): Result.001 file - promoters60/1018973
tatataaaca

SEQ ID NO: 96138 - DNA, 10 bp, Unknown
  misc_feature (1)..( 10): Result.001 file - promoters60/1018973
tataaaaacc

SEQ ID NO: 96139 - DNA, 10 bp, Unknown
  misc_feature (1)..( 10): Result.001 file - promoters60/1018973
tataaatatc

SEQ ID NO: 96140 - DNA, 10 bp, Unknown
  misc_feature (1)..( 10): Result.001 file - promoters60/1018973
gataaatatc

SEQ ID NO: 96141 - DNA, 9 bp, Unknown
  misc_feature (1)..( 9): Result.001 file - promoters60/1018973
atttagttt

SEQ ID NO: 96142 - DNA, 9 bp, Unknown
  misc_feature (1)..( 9): Result.001 file - promoters60/1018973
atttagatt

SEQ ID NO: 96143 - DNA, 9 bp, Unknown
  misc_feature (1)..( 9): Result.001 file - promoters60/1018973
atataatta

SEQ ID NO: 96144 - DNA, 9 bp, Unknown
  misc_feature (1)..( 9): Result.001 file - promoters60/1019024
ctataattt

SEQ ID NO: 96145 - DNA, 9 bp, Unknown
  misc_feature (1)..( 9): Result.001 file - promoters60/1019024
acttatttg

SEQ ID NO: 96146 - DNA, 9 bp, Unknown
  misc_feature (1)..( 9): Result.001 file - promoters60/1019024
actaattta

SEQ ID NO: 96147 - DNA, 9 bp, Unknown
  misc_feature (1)..( 9): Result.001 file - promoters60/1019024
caatatttg

SEQ ID NO: 96148 - DNA, 11 bp, Unknown
  misc_feature (1)..( 11): Result.001 file - promoters60/1019024
atttaatttac

SEQ ID NO: 96149 - DNA, 11 bp, Unknown
  misc_feature (1)..( 11): Result.001 file - promoters60/1019024
atttaattctc

SEQ ID NO: 96150 - DNA, 11 bp, Unknown
  misc_feature (1)..( 11): Result.001 file - promoters60/1019024
atttatttata

SEQ ID NO: 96151 - DNA, 11 bp, Unknown
  misc_feature (1)..( 11): Result.001 file - promoters60/1019024
ttttaattaat

SEQ ID NO: 96152 - DNA, 9 bp, Unknown
  misc_feature (1)..( 9): Result.001 file - promoters60/1019024
gaaacaata

SEQ ID NO: 96153 - DNA, 9 bp, Unknown
  misc_feature (1)..( 9): Result.001 file - promoters60/1019024
gaagcaaat

SEQ ID NO: 96154 - DNA, 9 bp, Unknown
  misc_feature (1)..( 9): Result.001 file - promoters60/1019024
aaaataata

SEQ ID NO: 96155 - DNA, 12 bp, Unknown
  misc_feature (1)..( 12): Result.001 file - promoters60/1019024
ccaattttttta

SEQ ID NO: 96156 - DNA, 12 bp, Unknown
  misc_feature (1)..( 12): Result.001 file - promoters60/1019024
ataatattttta

SEQ ID NO: 96157 - DNA, 12 bp, Unknown
  misc_feature (1)..( 12): Result.001 file - promoters60/1019024
ccaatttgttat

SEQ ID NO: 96158 - DNA, 8 bp, Unknown
  misc_feature (1)..( 8): Result.001 file - promoters60/1019024
aataaata

SEQ ID NO: 96159 - DNA, 8 bp, Unknown
  misc_feature (1)..( 8): Result.001 file - promoters60/1019024
aatagata

SEQ ID NO: 96160 - DNA, 8 bp, Unknown
  misc_feature (1)..( 8): Result.001 file - promoters60/1019030
aataaaaa

SEQ ID NO: 96161 - DNA, 8 bp, Unknown
  misc_feature (1)..( 8): Result.001 file - promoters60/1019030
attttgaa

SEQ ID NO: 96162 - DNA, 8 bp, Unknown
  misc_feature (1)..( 8): Result.001 file - promoters60/1019030
attttgaa

SEQ ID NO: 96163 - DNA, 6 bp, Unknown
  misc_feature (1)..( 6): Result.001 file - promoters60/1019030
tatttt

SEQ ID NO: 96164 - DNA, 6 bp, Unknown
  misc_feature (1)..( 6): Result.001 file - promoters60/1019030
tatttt

SEQ ID NO: 96165 - DNA, 11 bp, Unknown
  misc_feature (1)..( 11): Result.001 file - promoters60/1019030
ttacaaaatta

SEQ ID NO: 96166 - DNA, 11 bp, Unknown
  misc_feature (1)..( 11): Result.001 file - promoters60/1019030
tttaaaaatta

SEQ ID NO: 96167 - DNA, 11 bp, Unknown
  misc_feature (1)..( 11): Result.001 file - promoters60/1019030
ttaccaaatat

SEQ ID NO: 96168 - DNA, 6 bp, Unknown
  misc_feature (1)..( 6): Result.001 file - promoters60/1019030
gaaaaa

SEQ ID NO: 96169 - DNA, 6 bp, Unknown
  misc_feature (1)..( 6): Result.001 file - promoters60/1019030
gaaaaa

SEQ ID NO: 96170 - DNA, 7 bp, Unknown
  misc_feature (1)..( 7): Result.001 file - promoters60/1019030
attttag

SEQ ID NO: 96171 - DNA, 7 bp, Unknown
  misc_feature (1)..( 7): Result.001 file - promoters60/1019030
tttttag

SEQ ID NO: 96172 - DNA, 7 bp, Unknown
  misc_feature (1)..( 7): Result.001 file - promoters60/1019030
attttaa

SEQ ID NO: 96173 - DNA, 7 bp, Unknown
  misc_feature (1)..( 7): Result.001 file - promoters60/1019030
tttttta

SEQ ID NO: 96174 - DNA, 7 bp, Unknown
  misc_feature (1)..( 7): Result.001 file - promoters60/1019030
tttctta

SEQ ID NO: 96175 - DNA, 7 bp, Unknown
  misc_feature (1)..( 7): Result.001 file - promoters60/1019030
ataaaaa

SEQ ID NO: 96176 - DNA, 7 bp, Unknown
  misc_feature (1)..( 7): Result.001 file - promoters60/1019030
ataaaaa

SEQ ID NO: 96177 - DNA, 7 bp, Unknown
  misc_feature (1)..( 7): Result.001 file - promoters60/1019030
ctaaaaa

SEQ ID NO: 96178 - DNA, 9 bp, Unknown
  misc_feature (1)..( 9): Result.001 file - promoters60/1019030
caaagaaaa

SEQ ID NO: 96179 - DNA, 9 bp, Unknown
  misc_feature (1)..( 9): Result.001 file - promoters60/1019030
aaaacaaaa

SEQ ID NO: 96180 - DNA, 9 bp, Unknown
  misc_feature (1)..( 9): Result.001 file - promoters60/1019030
aaaacatgt

SEQ ID NO: 96181 - DNA, 6 bp, Unknown
  misc_feature (1)..( 6): Result.001 file - promoters60/1019030
tatttt

SEQ ID NO: 96182 - DNA, 6 bp, Unknown
  misc_feature (1)..( 6): Result.001 file - promoters60/1019030
tatttt

SEQ ID NO: 96183 - DNA, 6 bp, Unknown
  misc_feature (1)..( 6): Result.001 file - promoters60/1019030
taaaaa

SEQ ID NO: 96184 - DNA, 6 bp, Unknown
  misc_feature (1)..( 6): Result.001 file - promoters60/1019030
taaaaa

SEQ ID NO: 96185 - DNA, 9 bp, Unknown
  misc_feature (1)..( 9): Result.001 file - promoters60/1019030
gaaaaatgt

SEQ ID NO: 96186 - DNA, 9 bp, Unknown
  misc_feature (1)..( 9): Result.001 file - promoters60/1019030
aaaacatgt

SEQ ID NO: 96187 - DNA, 9 bp, Unknown
  misc_feature (1)..( 9): Result.001 file - promoters60/1019030
aaaacaaaa

SEQ ID NO: 96188 - DNA, 6 bp, Unknown
  misc_feature (1)..( 6): Result.001 file - promoters60/1019030
tgtcaa

SEQ ID NO: 96189 - DNA, 6 bp, Unknown
  misc_feature (1)..( 6): Result.001 file - promoters60/1019030
tgtcaa

SEQ ID NO: 96190 - DNA, 7 bp, Unknown
  misc_feature (1)..( 7): Result.001 file - promoters60/1019030
cataaaa

SEQ ID NO: 96191 - DNA, 7 bp, Unknown
  misc_feature (1)..( 7): Result.001 file - promoters60/1019030
cattaaa

SEQ ID NO: 96192 - DNA, 8 bp, Unknown
  misc_feature (1)..( 8): Result.001 file - promoters60/1019030
aaagtatt

SEQ ID NO: 96193 - DNA, 8 bp, Unknown
  misc_feature (1)..( 8): Result.001 file - promoters60/1019030
aaagaatt

SEQ ID NO: 96194 - DNA, 6 bp, Unknown
  misc_feature (1)..( 6): Result.001 file - promoters60/1019030
attttt

SEQ ID NO: 96195 - DNA, 6 bp, Unknown
  misc_feature (1)..( 6): Result.001 file - promoters60/1019030
attttt

SEQ ID NO: 96196 - DNA, 6 bp, Unknown
  misc_feature (1)..( 6): Result.001 file - promoters60/1019030
ataaaa

SEQ ID NO: 96197 - DNA, 6 bp, Unknown
  misc_feature (1)..( 6): Result.001 file - promoters60/1019030
ataaaa

SEQ ID NO: 96198 - DNA, 7 bp, Unknown
  misc_feature (1)..( 7): Result.001 file - promoters60/1019030
tgtctaa

SEQ ID NO: 96199 - DNA, 7 bp, Unknown
  misc_feature (1)..( 7): Result.001 file - promoters60/1019030
tgtataa

SEQ ID NO: 96200 - DNA, 8 bp, Unknown
  misc_feature (1)..( 8): Result.001 file - promoters60/1019030
ctttaatt

SEQ ID NO: 96201 - DNA, 8 bp, Unknown
  misc_feature (1)..( 8): Result.001 file - promoters60/1019030
cttttatt

SEQ ID NO: 96202 - DNA, 6 bp, Unknown
  misc_feature (1)..( 6): Result.001 file - promoters60/1019030
aaaata

SEQ ID NO: 96203 - DNA, 6 bp, Unknown
  misc_feature (1)..( 6): Result.001 file - promoters60/1019030
aaaata

SEQ ID NO: 96204 - DNA, 7 bp, Unknown
  misc_feature (1)..( 7): Result.001 file - promoters60/1019030
ttcaagc

SEQ ID NO: 96205 - DNA, 7 bp, Unknown
  misc_feature (1)..( 7): Result.001 file - promoters60/1019030
ttctagc

SEQ ID NO: 96206 - DNA, 7 bp, Unknown
  misc_feature (1)..( 7): Result.001 file - promoters60/1019030
tctgttc

SEQ ID NO: 96207 - DNA, 7 bp, Unknown
  misc_feature (1)..( 7): Result.001 file - promoters60/1019105
tctcttc

SEQ ID NO: 96208 - DNA, 11 bp, Unknown
  misc_feature (1)..( 11): Result.001 file - promoters60/1019105
gctacgaaaat

SEQ ID NO: 96209 - DNA, 11 bp, Unknown
  misc_feature (1)..( 11): Result.001 file - promoters60/1019105
gcaacgaaaaa

SEQ ID NO: 96210 - DNA, 11 bp, Unknown
  misc_feature (1)..( 11): Result.001 file - promoters60/1019105
gctaccaaact

SEQ ID NO: 96211 - DNA, 11 bp, Unknown
  misc_feature (1)..( 11): Result.001 file - promoters60/1019105
ataactaaagc

SEQ ID NO: 96212 - DNA, 11 bp, Unknown
  misc_feature (1)..( 11): Result.001 file - promoters60/1019105
agtgggaaaaa

SEQ ID NO: 96213 - DNA, 11 bp, Unknown
  misc_feature (1)..( 11): Result.001 file - promoters60/1019111
ctaactagttt

SEQ ID NO: 96214 - DNA, 7 bp, Unknown
  misc_feature (1)..( 7): Result.001 file - promoters60/1019111
tatgttc

SEQ ID NO: 96215 - DNA, 7 bp, Unknown
  misc_feature (1)..( 7): Result.001 file - promoters60/1019111
tatgttc

SEQ ID NO: 96216 - DNA, 7 bp, Unknown
  misc_feature (1)..( 7): Result.001 file - promoters60/1019111
gttttag

SEQ ID NO: 96217 - DNA, 7 bp, Unknown
  misc_feature (1)..( 7): Result.001 file - promoters60/1019111
gttctag

SEQ ID NO: 96218 - DNA, 8 bp, Unknown
  misc_feature (1)..( 8): Result.001 file - promoters60/1019111
ataagata

SEQ ID NO: 96219 - DNA, 8 bp, Unknown
  misc_feature (1)..( 8): Result.001 file - promoters60/1019111
ataatata

SEQ ID NO: 96220 - DNA, 8 bp, Unknown
  misc_feature (1)..( 8): Result.001 file - promoters60/1019111
atatgatt

SEQ ID NO: 96221 - DNA, 6 bp, Unknown
  misc_feature (1)..( 6): Result.001 file - promoters60/1019111
ttttaa

SEQ ID NO: 96222 - DNA, 6 bp, Unknown
  misc_feature (1)..( 6): Result.001 file - promoters60/1019111
ttttaa

SEQ ID NO: 96223 - DNA, 8 bp, Unknown
  misc_feature (1)..( 8): Result.001 file - promoters60/1019111
aaaaaatg

SEQ ID NO: 96224 - DNA, 8 bp, Unknown
  misc_feature (1)..( 8): Result.001 file - promoters60/1019111
aaaatatg

SEQ ID NO: 96225 - DNA, 6 bp, Unknown
  misc_feature (1)..( 6): Result.001 file - promoters60/1019111
agaaat

SEQ ID NO: 96226 - DNA, 6 bp, Unknown
  misc_feature (1)..( 6): Result.001 file - promoters60/1019111
agaaat

SEQ ID NO: 96227 - DNA, 7 bp, Unknown
  misc_feature (1)..( 7): Result.001 file - promoters60/1019111
ataagat

SEQ ID NO: 96228 - DNA, 7 bp, Unknown
  misc_feature (1)..( 7): Result.001 file - promoters60/1019111
ataagat

SEQ ID NO: 96229 - DNA, 9 bp, Unknown
  misc_feature (1)..( 9): Result.001 file - promoters60/1019111
caagacaat

SEQ ID NO: 96230 - DNA, 9 bp, Unknown
  misc_feature (1)..( 9): Result.001 file - promoters60/1019111
caagataat

SEQ ID NO: 96231 - DNA, 6 bp, Unknown
  misc_feature (1)..( 6): Result.001 file - promoters60/1019111
atagta

SEQ ID NO: 96232 - DNA, 6 bp, Unknown
  misc_feature (1)..( 6): Result.001 file - promoters60/1019111
atagta

SEQ ID NO: 96233 - DNA, 6 bp, Unknown
  misc_feature (1)..( 6): Result.001 file - promoters60/1019111
gaaaaa

SEQ ID NO: 96234 - DNA, 6 bp, Unknown
  misc_feature (1)..( 6): Result.001 file - promoters60/1019111
gaaaaa

SEQ ID NO: 96235 - DNA, 8 bp, Unknown
  misc_feature (1)..( 8): Result.001 file - promoters60/1019111
tgatggtg

SEQ ID NO: 96236 - DNA, 8 bp, Unknown
  misc_feature (1)..( 8): Result.001 file - promoters60/1019111
tgaaggtg

SEQ ID NO: 96237 - DNA, 8 bp, Unknown
  misc_feature (1)..( 8): Result.001 file - promoters60/1019111
aaatgttt

SEQ ID NO: 96238 - DNA, 8 bp, Unknown
  misc_feature (1)..( 8): Result.001 file - promoters60/1019111
aaatattt

SEQ ID NO: 96239 - DNA, 9 bp, Unknown
  misc_feature (1)..( 9): Result.001 file - promoters60/1019111
caagctcta

SEQ ID NO: 96240 - DNA, 9 bp, Unknown
  misc_feature (1)..( 9): Result.001 file - promoters60/1019111
caatctcta

SEQ ID NO: 96241 - DNA, 8 bp, Unknown
  misc_feature (1)..( 8): Result.001 file - promoters60/1019111
attttcat

SEQ ID NO: 96242 - DNA, 8 bp, Unknown
  misc_feature (1)..( 8): Result.001 file - promoters60/1019111
attttcat

SEQ ID NO: 96243 - DNA, 8 bp, Unknown
  misc_feature (1)..( 8): Result.001 file - promoters60/1019111
attttttt

SEQ ID NO: 96244 - DNA, 8 bp, Unknown
  misc_feature (1)..( 8): Result.001 file - promoters60/1019111
attttttt

SEQ ID NO: 96245 - DNA, 6 bp, Unknown
  misc_feature (1)..( 6): Result.001 file - promoters60/1019111
tcatat

SEQ ID NO: 96246 - DNA, 6 bp, Unknown
  misc_feature (1)..( 6): Result.001 file - promoters60/1019111
tcatat

SEQ ID NO: 96247 - DNA, 6 bp, Unknown
  misc_feature (1)..( 6): Result.001 file - promoters60/1019111
agaaaa

SEQ ID NO: 96248 - DNA, 6 bp, Unknown
  misc_feature (1)..( 6): Result.001 file - promoters60/1019111
agaaaa

SEQ ID NO: 96249 - DNA, 6 bp, Unknown
  misc_feature (1)..( 6): Result.001 file - promoters60/1019111
tttcaa

SEQ ID NO: 96250 - DNA, 6 bp, Unknown
  misc_feature (1)..( 6): Result.001 file - promoters60/1019111
tttcaa

SEQ ID NO: 96251 - DNA, 8 bp, Unknown
  misc_feature (1)..( 8): Result.001 file - promoters60/1019111
atcaaaat

SEQ ID NO: 96252 - DNA, 8 bp, Unknown
  misc_feature (1)..( 8): Result.001 file - promoters60/1019257
atcacaat

SEQ ID NO: 96253 - DNA, 8 bp, Unknown
  misc_feature (1)..( 8): Result.001 file - promoters60/1019257
ggaatagt

SEQ ID NO: 96254 - DNA, 8 bp, Unknown
  misc_feature (1)..( 8): Result.001 file - promoters60/1019257
ggattagc

SEQ ID NO: 96255 - DNA, 8 bp, Unknown
  misc_feature (1)..( 8): Result.001 file - promoters60/1019257
agaataga

SEQ ID NO: 96256 - DNA, 8 bp, Unknown
  misc_feature (1)..( 8): Result.001 file - promoters60/1019257
tgaaaaga

SEQ ID NO: 96257 - DNA, 7 bp, Unknown
  misc_feature (1)..( 7): Result.001 file - promoters60/1019257
aaagaag

SEQ ID NO: 96258 - DNA, 7 bp, Unknown
  misc_feature (1)..( 7): Result.001 file - promoters60/1019257
aaaaaag

SEQ ID NO: 96259 - DNA, 7 bp, Unknown
  misc_feature (1)..( 7): Result.001 file - promoters60/1019257
aaataag

SEQ ID NO: 96260 - DNA, 7 bp, Unknown
  misc_feature (1)..( 7): Result.001 file - promoters60/1019257
aaaaata

SEQ ID NO: 96261 - DNA, 9 bp, Unknown
  misc_feature (1)..( 9): Result.001 file - promoters60/1019257
gttataaaa

SEQ ID NO: 96262 - DNA, 9 bp, Unknown
  misc_feature (1)..( 9): Result.001 file - promoters60/1019257
atcataaaa

SEQ ID NO: 96263 - DNA, 9 bp, Unknown
  misc_feature (1)..( 9): Result.001 file - promoters60/1019257
ttgataaaa

SEQ ID NO: 96264 - DNA, 9 bp, Unknown
  misc_feature (1)..( 9): Result.001 file - promoters60/1019257
tatataaat

SEQ ID NO: 96265 - DNA, 11 bp, Unknown
  misc_feature (1)..( 11): Result.001 file - promoters60/1019257
ttttgaatttt

SEQ ID NO: 96266 - DNA, 11 bp, Unknown
  misc_feature (1)..( 11): Result.001 file - promoters60/1019257
atttgaattaa

SEQ ID NO: 96267 - DNA, 11 bp, Unknown
  misc_feature (1)..( 11): Result.001 file - promoters60/1019257
acttgacttaa

SEQ ID NO: 96268 - DNA, 11 bp, Unknown
  misc_feature (1)..( 11): Result.001 file - promoters60/1019260
atttgagggta

SEQ ID NO: 96269 - DNA, 10 bp, Unknown
  misc_feature (1)..( 10): Result.001 file - promoters60/1019260
gttatgattt

SEQ ID NO: 96270 - DNA, 10 bp, Unknown
  misc_feature (1)..( 10): Result.001 file - promoters60/1019260
tttatgcttt

SEQ ID NO: 96271 - DNA, 10 bp, Unknown
  misc_feature (1)..( 10): Result.001 file - promoters60/1019260
gttatgctgg

SEQ ID NO: 96272 - DNA, 8 bp, Unknown
  misc_feature (1)..( 8): Result.001 file - promoters60/1019260
taaatctg

SEQ ID NO: 96273 - DNA, 8 bp, Unknown
  misc_feature (1)..( 8): Result.001 file - promoters60/1019260
aaaacctg

SEQ ID NO: 96274 - DNA, 8 bp, Unknown
  misc_feature (1)..( 8): Result.001 file - promoters60/1019278
aaaaccta

SEQ ID NO: 96275 - DNA, 7 bp, Unknown
  misc_feature (1)..( 7): Result.001 file - promoters60/1019278
gttgaga

SEQ ID NO: 96276 - DNA, 7 bp, Unknown
  misc_feature (1)..( 7): Result.001 file - promoters60/1019278
gttcaga

SEQ ID NO: 96277 - DNA, 8 bp, Unknown
  misc_feature (1)..( 8): Result.001 file - promoters60/1019278
tttttttg

SEQ ID NO: 96278 - DNA, 8 bp, Unknown
  misc_feature (1)..( 8): Result.001 file - promoters60/1019278
ttttattg

SEQ ID NO: 96279 - DNA, 6 bp, Unknown
  misc_feature (1)..( 6): Result.001 file - promoters60/1019278
ttactt

SEQ ID NO: 96280 - DNA, 6 bp, Unknown
  misc_feature (1)..( 6): Result.001 file - promoters60/1019278
ttactt

SEQ ID NO: 96281 - DNA, 11 bp, Unknown
  misc_feature (1)..( 11): Result.001 file - promoters60/1019278
aagacagaaca

SEQ ID NO: 96282 - DNA, 11 bp, Unknown
  misc_feature (1)..( 11): Result.001 file - promoters60/1019278
aagacagaaca

SEQ ID NO: 96283 - DNA, 7 bp, Unknown
  misc_feature (1)..( 7): Result.001 file - promoters60/1019278
acaaaaa

SEQ ID NO: 96284 - DNA, 7 bp, Unknown
  misc_feature (1)..( 7): Result.001 file - promoters60/1019278
acataaa

SEQ ID NO: 96285 - DNA, 9 bp, Unknown
  misc_feature (1)..( 9): Result.001 file - promoters60/1019278
aagacgaca

SEQ ID NO: 96286 - DNA, 9 bp, Unknown
  misc_feature (1)..( 9): Result.001 file - promoters60/1019278
aagaagaca

SEQ ID NO: 96287 - DNA, 7 bp, Unknown
  misc_feature (1)..( 7): Result.001 file - promoters60/1019278
atttata

SEQ ID NO: 96288 - DNA, 7 bp, Unknown
  misc_feature (1)..( 7): Result.001 file - promoters60/1019278
atttata

SEQ ID NO: 96289 - DNA, 10 bp, Unknown
  misc_feature (1)..( 10): Result.001 file - promoters60/1019278
aagctctgaa

SEQ ID NO: 96290 - DNA, 10 bp, Unknown
  misc_feature (1)..( 10): Result.001 file - promoters60/1019278
aagctgtgaa

SEQ ID NO: 96291 - DNA, 7 bp, Unknown
  misc_feature (1)..( 7): Result.001 file - promoters60/1019278
ttttgat

SEQ ID NO: 96292 - DNA, 7 bp, Unknown
  misc_feature (1)..( 7): Result.001 file - promoters60/1019278
tttggat

SEQ ID NO: 96293 - DNA, 9 bp, Unknown
  misc_feature (1)..( 9): Result.001 file - promoters60/1019278
agacagaac

SEQ ID NO: 96294 - DNA, 9 bp, Unknown
  misc_feature (1)..( 9): Result.001 file - promoters60/1019278
agacaaaac

SEQ ID NO: 96295 - DNA, 6 bp, Unknown
  misc_feature (1)..( 6): Result.001 file - promoters60/1019278
aaaaag

SEQ ID NO: 96296 - DNA, 6 bp, Unknown
  misc_feature (1)..( 6): Result.001 file - promoters60/1019278
aaaaag

SEQ ID NO: 96297 - DNA, 7 bp, Unknown
  misc_feature (1)..( 7): Result.001 file - promoters60/1019278
tgatgaa

SEQ ID NO: 96298 - DNA, 7 bp, Unknown
  misc_feature (1)..( 7): Result.001 file - promoters60/1019278
tgaagaa

SEQ ID NO: 96299 - DNA, 7 bp, Unknown
  misc_feature (1)..( 7): Result.001 file - promoters60/1019278
aactatc

SEQ ID NO: 96300 - DNA, 7 bp, Unknown
  misc_feature (1)..( 7): Result.001 file - promoters60/1019278
aactatc

SEQ ID NO: 96301 - DNA, 8 bp, Unknown
  misc_feature (1)..( 8): Result.001 file - promoters60/1019278
agagatga

SEQ ID NO: 96302 - DNA, 8 bp, Unknown
  misc_feature (1)..( 8): Result.001 file - promoters60/1019278
agacatga

SEQ ID NO: 96303 - DNA, 6 bp, Unknown
  misc_feature (1)..( 6): Result.001 file - promoters60/1019278
actttt

SEQ ID NO: 96304 - DNA, 6 bp, Unknown
  misc_feature (1)..( 6): Result.001 file - promoters60/1019278
actttt

SEQ ID NO: 96305 - DNA, 7 bp, Unknown
  misc_feature (1)..( 7): Result.001 file - promoters60/1019278
tttgatt

SEQ ID NO: 96306 - DNA, 7 bp, Unknown
  misc_feature (1)..( 7): Result.001 file - promoters60/1019278
ttttatt

SEQ ID NO: 96307 - DNA, 6 bp, Unknown
  misc_feature (1)..( 6): Result.001 file - promoters60/1019278
acaaaa

SEQ ID NO: 96308 - DNA, 6 bp, Unknown
  misc_feature (1)..( 6): Result.001 file - promoters60/1019498
acaaaa

SEQ ID NO: 96309 - DNA, 10 bp, Unknown
  misc_feature (1)..( 10): Result.001 file - promoters60/1019498
gcggtaacta

SEQ ID NO: 96310 - DNA, 10 bp, Unknown
  misc_feature (1)..( 10): Result.001 file - promoters60/1019498
gcggcaaccg

SEQ ID NO: 96311 - DNA, 10 bp, Unknown
  misc_feature (1)..( 10): Result.001 file - promoters60/1019498
caagtaccta

SEQ ID NO: 96312 - DNA, 15 bp, Unknown
  misc_feature (1)..( 15): Result.001 file - promoters60/1019498
caaagtatgaaaacg

SEQ ID NO: 96313 - DNA, 15 bp, Unknown
  misc_feature (1)..( 15): Result.001 file - promoters60/1019498
caaagtatattaaac

SEQ ID NO: 96314 - DNA, 15 bp, Unknown
  misc_feature (1)..( 15): Result.001 file - promoters60/1019498
tatagtataataaac

SEQ ID NO: 96315 - DNA, 9 bp, Unknown
  misc_feature (1)..( 9): Result.001 file - promoters60/1019498
tttattttg

SEQ ID NO: 96316 - DNA, 9 bp, Unknown
  misc_feature (1)..( 9): Result.001 file - promoters60/1019498
cttatttaa

SEQ ID NO: 96317 - DNA, 9 bp, Unknown
  misc_feature (1)..( 9): Result.001 file - promoters60/1019498
tttattata

SEQ ID NO: 96318 - DNA, 9 bp, Unknown
  misc_feature (1)..( 9): Result.001 file - promoters60/1019498
catatataa

SEQ ID NO: 96319 - DNA, 8 bp, Unknown
  misc_feature (1)..( 8): Result.001 file - promoters60/1019498
gtatatgt

SEQ ID NO: 96320 - DNA, 8 bp, Unknown
  misc_feature (1)..( 8): Result.001 file - promoters60/1019498
atatatgt

SEQ ID NO: 96321 - DNA, 8 bp, Unknown
  misc_feature (1)..( 8): Result.001 file - promoters60/1019498
atatataa

SEQ ID NO: 96322 - DNA, 10 bp, Unknown
  misc_feature (1)..( 10): Result.001 file - promoters60/1019498
tatcatatat

SEQ ID NO: 96323 - DNA, 10 bp, Unknown
  misc_feature (1)..( 10): Result.001 file - promoters60/1019498
aatcatgtat

SEQ ID NO: 96324 - DNA, 10 bp, Unknown
  misc_feature (1)..( 10): Result.001 file - promoters60/1019498
aataatgggc

SEQ ID NO: 96325 - DNA, 12 bp, Unknown
  misc_feature (1)..( 12): Result.001 file - promoters60/1019498
tttgaaattaac

SEQ ID NO: 96326 - DNA, 12 bp, Unknown
  misc_feature (1)..( 12): Result.001 file - promoters60/1019498
agtataataaac

SEQ ID NO: 96327 - DNA, 12 bp, Unknown
  misc_feature (1)..( 12): Result.001 file - promoters60/1019498
agtatattaaac

SEQ ID NO: 96328 - DNA, 8 bp, Unknown
  misc_feature (1)..( 8): Result.001 file - promoters60/1019498
atttttca

SEQ ID NO: 96329 - DNA, 8 bp, Unknown
  misc_feature (1)..( 8): Result.001 file - promoters60/1019498
ctttttca

SEQ ID NO: 96330 - DNA, 8 bp, Unknown
  misc_feature (1)..( 8): Result.001 file - promoters60/1019508
ctttttta

SEQ ID NO: 96331 - DNA, 11 bp, Unknown
  misc_feature (1)..( 11): Result.001 file - promoters60/1019508
tcattatggag

SEQ ID NO: 96332 - DNA, 11 bp, Unknown
  misc_feature (1)..( 11): Result.001 file - promoters60/1019508
tcattatgtca

SEQ ID NO: 96333 - DNA, 11 bp, Unknown
  misc_feature (1)..( 11): Result.001 file - promoters60/1019508
ggcttatgtct

SEQ ID NO: 96334 - DNA, 11 bp, Unknown
  misc_feature (1)..( 11): Result.001 file - promoters60/1019508
ttgacatgtct

SEQ ID NO: 96335 - DNA, 9 bp, Unknown
  misc_feature (1)..( 9): Result.001 file - promoters60/1019508
ttgtgtttc

SEQ ID NO: 96336 - DNA, 9 bp, Unknown
  misc_feature (1)..( 9): Result.001 file - promoters60/1019508
ttgtttttt

SEQ ID NO: 96337 - DNA, 10 bp, Unknown
  misc_feature (1)..( 10): Result.001 file - promoters60/1019508
ggatttatta

SEQ ID NO: 96338 - DNA, 7 bp, Unknown
  misc_feature (1)..( 7): Result.001 file - promoters60/1019508
gatggat

SEQ ID NO: 96339 - DNA, 7 bp, Unknown
  misc_feature (1)..( 7): Result.001 file - promoters60/1019508
gatcgat

SEQ ID NO: 96340 - DNA, 7 bp, Unknown
  misc_feature (1)..( 7): Result.001 file - promoters60/1019524
gatcgaa

SEQ ID NO: 96341 - DNA, 9 bp, Unknown
  misc_feature (1)..( 9): Result.001 file - promoters60/1019524
aaattgaaa

SEQ ID NO: 96342 - DNA, 9 bp, Unknown
  misc_feature (1)..( 9): Result.001 file - promoters60/1019524
taattgaaa

SEQ ID NO: 96343 - DNA, 9 bp, Unknown
  misc_feature (1)..( 9): Result.001 file - promoters60/1019524
gaatttaaa

SEQ ID NO: 96344 - DNA, 9 bp, Unknown
  misc_feature (1)..( 9): Result.001 file - promoters60/1019524
gaattttgg

SEQ ID NO: 96345 - DNA, 9 bp, Unknown
  misc_feature (1)..( 9): Result.001 file - promoters60/1019524
taattgtgt

SEQ ID NO: 96346 - DNA, 14 bp, Unknown
  misc_feature (1)..( 14): Result.001 file - promoters60/1019524
atggagaggaagaa

SEQ ID NO: 96347 - DNA, 14 bp, Unknown
  misc_feature (1)..( 14): Result.001 file - promoters60/1019524
gcacagatgaattt

SEQ ID NO: 96348 - DNA, 14 bp, Unknown
  misc_feature (1)..( 14): Result.001 file - promoters60/1019524
atgtagaggggctt

SEQ ID NO: 96349 - DNA, 14 bp, Unknown
  misc_feature (1)..( 14): Result.001 file - promoters60/1019524
tgagaaatgtattt

SEQ ID NO: 96350 - DNA, 14 bp, Unknown
  misc_feature (1)..( 14): Result.001 file - promoters60/1019537
gaagtcatgaatac

SEQ ID NO: 96351 - DNA, 8 bp, Unknown
  misc_feature (1)..( 8): Result.001 file - promoters60/1019537
atttttat

SEQ ID NO: 96352 - DNA, 8 bp, Unknown
  misc_feature (1)..( 8): Result.001 file - promoters60/1019537
atttttgc

SEQ ID NO: 96353 - DNA, 8 bp, Unknown
  misc_feature (1)..( 8): Result.001 file - promoters60/1019537
attttttt

SEQ ID NO: 96354 - DNA, 8 bp, Unknown
  misc_feature (1)..( 8): Result.001 file - promoters60/1019537
atttttgt

SEQ ID NO: 96355 - DNA, 8 bp, Unknown
  misc_feature (1)..( 8): Result.001 file - promoters60/1019537
attttttc

SEQ ID NO: 96356 - DNA, 8 bp, Unknown
  misc_feature (1)..( 8): Result.001 file - promoters60/1019537
gtttatgt

SEQ ID NO: 96357 - DNA, 8 bp, Unknown
  misc_feature (1)..( 8): Result.001 file - promoters60/1019537
ctttattt

SEQ ID NO: 96358 - DNA, 13 bp, Unknown
  misc_feature (1)..( 13): Result.001 file - promoters60/1019537
atatatgtaaacg

SEQ ID NO: 96359 - DNA, 13 bp, Unknown
  misc_feature (1)..( 13): Result.001 file - promoters60/1019537
ctttatttaaaaa

SEQ ID NO: 96360 - DNA, 13 bp, Unknown
  misc_feature (1)..( 13): Result.001 file - promoters60/1019537
atagatgtttcat

SEQ ID NO: 96361 - DNA, 13 bp, Unknown
  misc_feature (1)..( 13): Result.001 file - promoters60/1019537
agactagtaaaca

SEQ ID NO: 96362 - DNA, 13 bp, Unknown
  misc_feature (1)..( 13): Result.001 file - promoters60/1019537
aaagagagagatg

SEQ ID NO: 96363 - DNA, 13 bp, Unknown
  misc_feature (1)..( 13): Result.001 file - promoters60/1019537
tcgtatctaagac

SEQ ID NO: 96364 - DNA, 13 bp, Unknown
  misc_feature (1)..( 13): Result.001 file - promoters60/1019559
ttcgaaataaatg

SEQ ID NO: 96365 - DNA, 10 bp, Unknown
  misc_feature (1)..( 10): Result.001 file - promoters60/1019559
atttttcaaa

SEQ ID NO: 96366 - DNA, 10 bp, Unknown
  misc_feature (1)..( 10): Result.001 file - promoters60/1019559
aattttgaaa

SEQ ID NO: 96367 - DNA, 10 bp, Unknown
  misc_feature (1)..( 10): Result.001 file - promoters60/1019559
aattttgttg

SEQ ID NO: 96368 - DNA, 11 bp, Unknown
  misc_feature (1)..( 11): Result.001 file - promoters60/1019559
aaaagtcttca

SEQ ID NO: 96369 - DNA, 11 bp, Unknown
  misc_feature (1)..( 11): Result.001 file - promoters60/1019559
aaaagttgcag

SEQ ID NO: 96370 - DNA, 11 bp, Unknown
  misc_feature (1)..( 11): Result.001 file - promoters60/1019559
gaaatttgcag

SEQ ID NO: 96371 - DNA, 10 bp, Unknown
  misc_feature (1)..( 10): Result.001 file - promoters60/1019559
taaagtatga

SEQ ID NO: 96372 - DNA, 10 bp, Unknown
  misc_feature (1)..( 10): Result.001 file - promoters60/1019559
taaagtaaag

SEQ ID NO: 96373 - DNA, 10 bp, Unknown
  misc_feature (1)..( 10): Result.001 file - promoters60/1019559
aaaagaaaag

SEQ ID NO: 96374 - DNA, 9 bp, Unknown
  misc_feature (1)..( 9): Result.001 file - promoters60/1019559
ttcttagct

SEQ ID NO: 96375 - DNA, 9 bp, Unknown
  misc_feature (1)..( 9): Result.001 file - promoters60/1019559
ttcttatca

SEQ ID NO: 96376 - DNA, 9 bp, Unknown
  misc_feature (1)..( 9): Result.001 file - promoters60/1019559
atctgagct

SEQ ID NO: 96377 - DNA, 9 bp, Unknown
  misc_feature (1)..( 9): Result.001 file - promoters60/1019559
agaaagcgg

SEQ ID NO: 96378 - DNA, 9 bp, Unknown
  misc_feature (1)..( 9): Result.001 file - promoters60/1019559
agaaagctt

SEQ ID NO: 96379 - DNA, 9 bp, Unknown
  misc_feature (1)..( 9): Result.001 file - promoters60/1019559
tgaaacaaa

SEQ ID NO: 96380 - DNA, 8 bp, Unknown
  misc_feature (1)..( 8): Result.001 file - promoters60/1019559
gaaagatt

SEQ ID NO: 96381 - DNA, 8 bp, Unknown
  misc_feature (1)..( 8): Result.001 file - promoters60/1019559
gaaagaaa

SEQ ID NO: 96382 - DNA, 8 bp, Unknown
  misc_feature (1)..( 8): Result.001 file - promoters60/1019604
aaaacatt

SEQ ID NO: 96383 - DNA, 8 bp, Unknown
  misc_feature (1)..( 8): Result.001 file - promoters60/1019604
taaatcca

SEQ ID NO: 96384 - DNA, 8 bp, Unknown
  misc_feature (1)..( 8): Result.001 file - promoters60/1019604
taaatcca

SEQ ID NO: 96385 - DNA, 7 bp, Unknown
  misc_feature (1)..( 7): Result.001 file - promoters60/1019604
gaatgca

SEQ ID NO: 96386 - DNA, 7 bp, Unknown
  misc_feature (1)..( 7): Result.001 file - promoters60/1019604
gaaggca

SEQ ID NO: 96387 - DNA, 8 bp, Unknown
  misc_feature (1)..( 8): Result.001 file - promoters60/1019604
agggtata

SEQ ID NO: 96388 - DNA, 8 bp, Unknown
  misc_feature (1)..( 8): Result.001 file - promoters60/1019604
agggtata

SEQ ID NO: 96389 - DNA, 9 bp, Unknown
  misc_feature (1)..( 9): Result.001 file - promoters60/1019604
tttttgtaa

SEQ ID NO: 96390 - DNA, 9 bp, Unknown
  misc_feature (1)..( 9): Result.001 file - promoters60/1019604
attttataa

SEQ ID NO: 96391 - DNA, 9 bp, Unknown
  misc_feature (1)..( 9): Result.001 file - promoters60/1019604
attttacta

SEQ ID NO: 96392 - DNA, 12 bp, Unknown
  misc_feature (1)..( 12): Result.001 file - promoters60/1019604
aaagatagaaat

SEQ ID NO: 96393 - DNA, 12 bp, Unknown
  misc_feature (1)..( 12): Result.001 file - promoters60/1019604
aaagatacaaat

SEQ ID NO: 96394 - DNA, 12 bp, Unknown
  misc_feature (1)..( 12): Result.001 file - promoters60/1019604
aattctagaaac

SEQ ID NO: 96395 - DNA, 6 bp, Unknown
  misc_feature (1)..( 6): Result.001 file - promoters60/1019604
taataa

SEQ ID NO: 96396 - DNA, 6 bp, Unknown
  misc_feature (1)..( 6): Result.001 file - promoters60/1019604
taataa

SEQ ID NO: 96397 - DNA, 10 bp, Unknown
  misc_feature (1)..( 10): Result.001 file - promoters60/1019604
tgtctaaaaa

SEQ ID NO: 96398 - DNA, 10 bp, Unknown
  misc_feature (1)..( 10): Result.001 file - promoters60/1019604
tttctagaaa

SEQ ID NO: 96399 - DNA, 10 bp, Unknown
  misc_feature (1)..( 10): Result.001 file - promoters60/1019604
tgtttaaaag

SEQ ID NO: 96400 - DNA, 6 bp, Unknown
  misc_feature (1)..( 6): Result.001 file - promoters60/1019604
actaaa

SEQ ID NO: 96401 - DNA, 6 bp, Unknown
  misc_feature (1)..( 6): Result.001 file - promoters60/1019604
actaaa

SEQ ID NO: 96402 - DNA, 6 bp, Unknown
  misc_feature (1)..( 6): Result.001 file - promoters60/1019604
actaaa

SEQ ID NO: 96403 - DNA, 6 bp, Unknown
  misc_feature (1)..( 6): Result.001 file - promoters60/1019604
atataa

SEQ ID NO: 96404 - DNA, 6 bp, Unknown
  misc_feature (1)..( 6): Result.001 file - promoters60/1019604
atataa

SEQ ID NO: 96405 - DNA, 6 bp, Unknown
  misc_feature (1)..( 6): Result.001 file - promoters60/1019604
atataa

SEQ ID NO: 96406 - DNA, 10 bp, Unknown
  misc_feature (1)..( 10): Result.001 file - promoters60/1019604
ttgaattttt

SEQ ID NO: 96407 - DNA, 10 bp, Unknown
  misc_feature (1)..( 10): Result.001 file - promoters60/1019604
ttgaattttt

SEQ ID NO: 96408 - DNA, 9 bp, Unknown
  misc_feature (1)..( 9): Result.001 file - promoters60/1019604
tcaagattt

SEQ ID NO: 96409 - DNA, 9 bp, Unknown
  misc_feature (1)..( 9): Result.001 file - promoters60/1019604
tcaatattt

SEQ ID NO: 96410 - DNA, 8 bp, Unknown
  misc_feature (1)..( 8): Result.001 file - promoters60/1019604
ttgatttt

SEQ ID NO: 96411 - DNA, 8 bp, Unknown
  misc_feature (1)..( 8): Result.001 file - promoters60/1019604
ttgttttt

SEQ ID NO: 96412 - DNA, 8 bp, Unknown
  misc_feature (1)..( 8): Result.001 file - promoters60/1019604
aggtactt

SEQ ID NO: 96413 - DNA, 8 bp, Unknown
  misc_feature (1)..( 8): Result.001 file - promoters60/1019604
aggaactt

SEQ ID NO: 96414 - DNA, 6 bp, Unknown
  misc_feature (1)..( 6): Result.001 file - promoters60/1019604
tattta

SEQ ID NO: 96415 - DNA, 6 bp, Unknown
  misc_feature (1)..( 6): Result.001 file - promoters60/1019604
tattta

SEQ ID NO: 96416 - DNA, 7 bp, Unknown
  misc_feature (1)..( 7): Result.001 file - promoters60/1019604
caaaaca

SEQ ID NO: 96417 - DNA, 7 bp, Unknown
  misc_feature (1)..( 7): Result.001 file - promoters60/1019604
caagaca

SEQ ID NO: 96418 - DNA, 22 bp, Unknown
  misc_feature (1)..( 22): Result.001 file - promoters60/1019604
aaatttaaaaacctgttttctt

SEQ ID NO: 96419 - DNA, 22 bp, Unknown
  misc_feature (1)..( 22): Result.001 file - promoters60/1019604
aaatataaccaagtttgaaatc

SEQ ID NO: 96420 - DNA, 22 bp, Unknown
  misc_feature (1)..( 22): Result.001 file - promoters60/1019604
aaatataaccaactttgaaatc

SEQ ID NO: 96421 - DNA, 6 bp, Unknown
  misc_feature (1)..( 6): Result.001 file - promoters60/1019604
atgaaa

SEQ ID NO: 96422 - DNA, 6 bp, Unknown
  misc_feature (1)..( 6): Result.001 file - promoters60/1019604
atgaaa

SEQ ID NO: 96423 - DNA, 7 bp, Unknown
  misc_feature (1)..( 7): Result.001 file - promoters60/1019604
tatctat

SEQ ID NO: 96424 - DNA, 7 bp, Unknown
  misc_feature (1)..( 7): Result.001 file - promoters60/1019604
tatatat

SEQ ID NO: 96425 - DNA, 21 bp, Unknown
  misc_feature (1)..( 21): Result.001 file - promoters60/1019604
aaaaataacattcatttacta

SEQ ID NO: 96426 - DNA, 21 bp, Unknown
  misc_feature (1)..( 21): Result.001 file - promoters60/1019604
aaaaacaacattcatttacta

SEQ ID NO: 96427 - DNA, 6 bp, Unknown
  misc_feature (1)..( 6): Result.001 file - promoters60/1019604
atcatc

SEQ ID NO: 96428 - DNA, 6 bp, Unknown
  misc_feature (1)..( 6): Result.001 file - promoters60/1019604
atcatc

SEQ ID NO: 96429 - DNA, 6 bp, Unknown
  misc_feature (1)..( 6): Result.001 file - promoters60/1019604
atcatc

SEQ ID NO: 96430 - DNA, 6 bp, Unknown
  misc_feature (1)..( 6): Result.001 file - promoters60/1019648
atcatc

SEQ ID NO: 96431 - DNA, 11 bp, Unknown
  misc_feature (1)..( 11): Result.001 file - promoters60/1019648
gcctatggtta

SEQ ID NO: 96432 - DNA, 11 bp, Unknown
  misc_feature (1)..( 11): Result.001 file - promoters60/1019648
agaaatgatta

SEQ ID NO: 96433 - DNA, 11 bp, Unknown
  misc_feature (1)..( 11): Result.001 file - promoters60/1019648
ttaaaggatta

SEQ ID NO: 96434 - DNA, 11 bp, Unknown
  misc_feature (1)..( 11): Result.001 file - promoters60/1019648
gaaaaagatgg

SEQ ID NO: 96435 - DNA, 11 bp, Unknown
  misc_feature (1)..( 11): Result.001 file - promoters60/1019648
ttaaaggtgtt

SEQ ID NO: 96436 - DNA, 11 bp, Unknown
  misc_feature (1)..( 11): Result.001 file - promoters60/1019695
tagaaaaatgt

SEQ ID NO: 96437 - DNA, 6 bp, Unknown
  misc_feature (1)..( 6): Result.001 file - promoters60/1019695
gagctg

SEQ ID NO: 96438 - DNA, 6 bp, Unknown
  misc_feature (1)..( 6): Result.001 file - promoters60/1019695
gagctg

SEQ ID NO: 96439 - DNA, 6 bp, Unknown
  misc_feature (1)..( 6): Result.001 file - promoters60/1019695
gaaatc

SEQ ID NO: 96440 - DNA, 6 bp, Unknown
  misc_feature (1)..( 6): Result.001 file - promoters60/1019695
gaaatc

SEQ ID NO: 96441 - DNA, 10 bp, Unknown
  misc_feature (1)..( 10): Result.001 file - promoters60/1019695
aaaggattcc

SEQ ID NO: 96442 - DNA, 10 bp, Unknown
  misc_feature (1)..( 10): Result.001 file - promoters60/1019695
aaacgattcc

SEQ ID NO: 96443 - DNA, 7 bp, Unknown
  misc_feature (1)..( 7): Result.001 file - promoters60/1019695
attgtgt

SEQ ID NO: 96444 - DNA, 7 bp, Unknown
  misc_feature (1)..( 7): Result.001 file - promoters60/1019695
attttgt

SEQ ID NO: 96445 - DNA, 6 bp, Unknown
  misc_feature (1)..( 6): Result.001 file - promoters60/1019695
taaacc

SEQ ID NO: 96446 - DNA, 6 bp, Unknown
  misc_feature (1)..( 6): Result.001 file - promoters60/1019695
taaacc

SEQ ID NO: 96447 - DNA, 8 bp, Unknown
  misc_feature (1)..( 8): Result.001 file - promoters60/1019695
attagtta

SEQ ID NO: 96448 - DNA, 8 bp, Unknown
  misc_feature (1)..( 8): Result.001 file - promoters60/1019695
atttgtta

SEQ ID NO: 96449 - DNA, 8 bp, Unknown
  misc_feature (1)..( 8): Result.001 file - promoters60/1019695
atttttta

SEQ ID NO: 96450 - DNA, 6 bp, Unknown
  misc_feature (1)..( 6): Result.001 file - promoters60/1019695
aagacg

SEQ ID NO: 96451 - DNA, 6 bp, Unknown
  misc_feature (1)..( 6): Result.001 file - promoters60/1019695
aagacg

SEQ ID NO: 96452 - DNA, 6 bp, Unknown
  misc_feature (1)..( 6): Result.001 file - promoters60/1019695
agaaat

SEQ ID NO: 96453 - DNA, 6 bp, Unknown
  misc_feature (1)..( 6): Result.001 file - promoters60/1019695
agaaat

SEQ ID NO: 96454 - DNA, 6 bp, Unknown
  misc_feature (1)..( 6): Result.001 file - promoters60/1019695
cggttc

SEQ ID NO: 96455 - DNA, 6 bp, Unknown
  misc_feature (1)..( 6): Result.001 file - promoters60/1019695
cggttc

SEQ ID NO: 96456 - DNA, 7 bp, Unknown
  misc_feature (1)..( 7): Result.001 file - promoters60/1019695
tagggtt

SEQ ID NO: 96457 - DNA, 7 bp, Unknown
  misc_feature (1)..( 7): Result.001 file - promoters60/1019695
tagggtt

SEQ ID NO: 96458 - DNA, 9 bp, Unknown
  misc_feature (1)..( 9): Result.001 file - promoters60/1019695
tttaattaa

SEQ ID NO: 96459 - DNA, 9 bp, Unknown
  misc_feature (1)..( 9): Result.001 file - promoters60/1019695
tttacttaa

SEQ ID NO: 96460 - DNA, 6 bp, Unknown
  misc_feature (1)..( 6): Result.001 file - promoters60/1019695
gaaccc

SEQ ID NO: 96461 - DNA, 6 bp, Unknown
  misc_feature (1)..( 6): Result.001 file - promoters60/1019695
gaaccc

SEQ ID NO: 96462 - DNA, 7 bp, Unknown
  misc_feature (1)..( 7): Result.001 file - promoters60/1019695
attaata

SEQ ID NO: 96463 - DNA, 7 bp, Unknown
  misc_feature (1)..( 7): Result.001 file - promoters60/1019734
atttata

SEQ ID NO: 96464 - DNA, 8 bp, Unknown
  misc_feature (1)..( 8): Result.001 file - promoters60/1019734
attgattt

SEQ ID NO: 96465 - DNA, 8 bp, Unknown
  misc_feature (1)..( 8): Result.001 file - promoters60/1019734
atttattt

SEQ ID NO: 96466 - DNA, 10 bp, Unknown
  misc_feature (1)..( 10): Result.001 file - promoters60/1019734
attttaggat

SEQ ID NO: 96467 - DNA, 10 bp, Unknown
  misc_feature (1)..( 10): Result.001 file - promoters60/1019734
atttgaggat

SEQ ID NO: 96468 - DNA, 9 bp, Unknown
  misc_feature (1)..( 9): Result.001 file - promoters60/1019734
tttgaacat

SEQ ID NO: 96469 - DNA, 9 bp, Unknown
  misc_feature (1)..( 9): Result.001 file - promoters60/1019734
tttgaccat

SEQ ID NO: 96470 - DNA, 10 bp, Unknown
  misc_feature (1)..( 10): Result.001 file - promoters60/1019734
aaaacacgtg

SEQ ID NO: 96471 - DNA, 10 bp, Unknown
  misc_feature (1)..( 10): Result.001 file - promoters60/1019734
aaaactcgtg

SEQ ID NO: 96472 - DNA, 7 bp, Unknown
  misc_feature (1)..( 7): Result.001 file - promoters60/1019734
tctctat

SEQ ID NO: 96473 - DNA, 7 bp, Unknown
  misc_feature (1)..( 7): Result.001 file - promoters60/1019734
tctatat

SEQ ID NO: 96474 - DNA, 11 bp, Unknown
  misc_feature (1)..( 11): Result.001 file - promoters60/1019734
ataaattaatg

SEQ ID NO: 96475 - DNA, 11 bp, Unknown
  misc_feature (1)..( 11): Result.001 file - promoters60/1019734
atatattaatg

SEQ ID NO: 96476 - DNA, 9 bp, Unknown
  misc_feature (1)..( 9): Result.001 file - promoters60/1019734
actatcata

SEQ ID NO: 96477 - DNA, 9 bp, Unknown
  misc_feature (1)..( 9): Result.001 file - promoters60/1019734
tcaatcata

SEQ ID NO: 96478 - DNA, 9 bp, Unknown
  misc_feature (1)..( 9): Result.001 file - promoters60/1019734
tcaaccata

SEQ ID NO: 96479 - DNA, 9 bp, Unknown
  misc_feature (1)..( 9): Result.001 file - promoters60/1019734
aaatttcat

SEQ ID NO: 96480 - DNA, 9 bp, Unknown
  misc_feature (1)..( 9): Result.001 file - promoters60/1019734
taatttcat

SEQ ID NO: 96481 - DNA, 9 bp, Unknown
  misc_feature (1)..( 9): Result.001 file - promoters60/1019734
taatttatt

SEQ ID NO: 96482 - DNA, 7 bp, Unknown
  misc_feature (1)..( 7): Result.001 file - promoters60/1019734
taataaa

SEQ ID NO: 96483 - DNA, 7 bp, Unknown
  misc_feature (1)..( 7): Result.001 file - promoters60/1019734
taacaaa

SEQ ID NO: 96484 - DNA, 6 bp, Unknown
  misc_feature (1)..( 6): Result.001 file - promoters60/1019734
aaactc

SEQ ID NO: 96485 - DNA, 6 bp, Unknown
  misc_feature (1)..( 6): Result.001 file - promoters60/1019734
aaactc

SEQ ID NO: 96486 - DNA, 7 bp, Unknown
  misc_feature (1)..( 7): Result.001 file - promoters60/1019734
cctttat

SEQ ID NO: 96487 - DNA, 7 bp, Unknown
  misc_feature (1)..( 7): Result.001 file - promoters60/1019734
cctttat

SEQ ID NO: 96488 - DNA, 6 bp, Unknown
  misc_feature (1)..( 6): Result.001 file - promoters60/1019734
tcattt

SEQ ID NO: 96489 - DNA, 6 bp, Unknown
  misc_feature (1)..( 6): Result.001 file - promoters60/1019734
tcattt

SEQ ID NO: 96490 - DNA, 6 bp, Unknown
  misc_feature (1)..( 6): Result.001 file - promoters60/1019734
aaacat

SEQ ID NO: 96491 - DNA, 6 bp, Unknown
  misc_feature (1)..( 6): Result.001 file - promoters60/1019734
aaacat

SEQ ID NO: 96492 - DNA, 9 bp, Unknown
  misc_feature (1)..( 9): Result.001 file - promoters60/1019734
aaattaata

SEQ ID NO: 96493 - DNA, 9 bp, Unknown
  misc_feature (1)..( 9): Result.001 file - promoters60/1019734
aaaataata

SEQ ID NO: 96494 - DNA, 6 bp, Unknown
  misc_feature (1)..( 6): Result.001 file - promoters60/1019734
ataata

SEQ ID NO: 96495 - DNA, 6 bp, Unknown
  misc_feature (1)..( 6): Result.001 file - promoters60/1019734
ataata

SEQ ID NO: 96496 - DNA, 8 bp, Unknown
  misc_feature (1)..( 8): Result.001 file - promoters60/1019734
aaaaagaa

SEQ ID NO: 96497 - DNA, 8 bp, Unknown
  misc_feature (1)..( 8): Result.001 file - promoters60/1019734
aaatagaa

SEQ ID NO: 96498 - DNA, 7 bp, Unknown
  misc_feature (1)..( 7): Result.001 file - promoters60/1019734
aatttct

SEQ ID NO: 96499 - DNA, 7 bp, Unknown
  misc_feature (1)..( 7): Result.001 file - promoters60/1019734
aatatct

SEQ ID NO: 96500 - DNA, 6 bp, Unknown
  misc_feature (1)..( 6): Result.001 file - promoters60/1019734
tatttc

SEQ ID NO: 96501 - DNA, 6 bp, Unknown
  misc_feature (1)..( 6): Result.001 file - promoters60/1019776
tatttc

SEQ ID NO: 96502 - DNA, 7 bp, Unknown
  misc_feature (1)..( 7): Result.001 file - promoters60/1019776
ttcattt

SEQ ID NO: 96503 - DNA, 7 bp, Unknown
  misc_feature (1)..( 7): Result.001 file - promoters60/1019776
ttcgttt

SEQ ID NO: 96504 - DNA, 6 bp, Unknown
  misc_feature (1)..( 6): Result.001 file - promoters60/1019776
gtttca

SEQ ID NO: 96505 - DNA, 6 bp, Unknown
  misc_feature (1)..( 6): Result.001 file - promoters60/1019776
gtttca

SEQ ID NO: 96506 - DNA, 6 bp, Unknown
  misc_feature (1)..( 6): Result.001 file - promoters60/1019776
aaacat

SEQ ID NO: 96507 - DNA, 6 bp, Unknown
  misc_feature (1)..( 6): Result.001 file - promoters60/1019776
aaacat

SEQ ID NO: 96508 - DNA, 8 bp, Unknown
  misc_feature (1)..( 8): Result.001 file - promoters60/1019776
aattagta

SEQ ID NO: 96509 - DNA, 8 bp, Unknown
  misc_feature (1)..( 8): Result.001 file - promoters60/1019776
aataagta

SEQ ID NO: 96510 - DNA, 8 bp, Unknown
  misc_feature (1)..( 8): Result.001 file - promoters60/1019776
taagatcc

SEQ ID NO: 96511 - DNA, 8 bp, Unknown
  misc_feature (1)..( 8): Result.001 file - promoters60/1019776
taatatcc

SEQ ID NO: 96512 - DNA, 11 bp, Unknown
  misc_feature (1)..( 11): Result.001 file - promoters60/1019776
atactttgttt

SEQ ID NO: 96513 - DNA, 11 bp, Unknown
  misc_feature (1)..( 11): Result.001 file - promoters60/1019776
atattttcttt

SEQ ID NO: 96514 - DNA, 11 bp, Unknown
  misc_feature (1)..( 11): Result.001 file - promoters60/1019776
ccaatttgtta

SEQ ID NO: 96515 - DNA, 6 bp, Unknown
  misc_feature (1)..( 6): Result.001 file - promoters60/1019776
aaaacc

SEQ ID NO: 96516 - DNA, 6 bp, Unknown
  misc_feature (1)..( 6): Result.001 file - promoters60/1019776
aaaacc

SEQ ID NO: 96517 - DNA, 6 bp, Unknown
  misc_feature (1)..( 6): Result.001 file - promoters60/1019776
taaaaa

SEQ ID NO: 96518 - DNA, 6 bp, Unknown
  misc_feature (1)..( 6): Result.001 file - promoters60/1019776
taaaaa

SEQ ID NO: 96519 - DNA, 6 bp, Unknown
  misc_feature (1)..( 6): Result.001 file - promoters60/1019776
aaaaag

SEQ ID NO: 96520 - DNA, 6 bp, Unknown
  misc_feature (1)..( 6): Result.001 file - promoters60/1019776
aaaaag

SEQ ID NO: 96521 - DNA, 9 bp, Unknown
  misc_feature (1)..( 9): Result.001 file - promoters60/1019776
gaataaaaa

SEQ ID NO: 96522 - DNA, 9 bp, Unknown
  misc_feature (1)..( 9): Result.001 file - promoters60/1019776
gtatataaa

SEQ ID NO: 96523 - DNA, 9 bp, Unknown
  misc_feature (1)..( 9): Result.001 file - promoters60/1019776
gtatatatt

SEQ ID NO: 96524 - DNA, 6 bp, Unknown
  misc_feature (1)..( 6): Result.001 file - promoters60/1019776
aacatt

SEQ ID NO: 96525 - DNA, 6 bp, Unknown
  misc_feature (1)..( 6): Result.001 file - promoters60/1019776
aacatt

SEQ ID NO: 96526 - DNA, 8 bp, Unknown
  misc_feature (1)..( 8): Result.001 file - promoters60/1019776
ccaccaaa

SEQ ID NO: 96527 - DNA, 8 bp, Unknown
  misc_feature (1)..( 8): Result.001 file - promoters60/1019776
ccactaaa

SEQ ID NO: 96528 - DNA, 6 bp, Unknown
  misc_feature (1)..( 6): Result.001 file - promoters60/1019776
ataaaa

SEQ ID NO: 96529 - DNA, 6 bp, Unknown
  misc_feature (1)..( 6): Result.001 file - promoters60/1019776
ataaaa

SEQ ID NO: 96530 - DNA, 9 bp, Unknown
  misc_feature (1)..( 9): Result.001 file - promoters60/1019776
aaattaact

SEQ ID NO: 96531 - DNA, 9 bp, Unknown
  misc_feature (1)..( 9): Result.001 file - promoters60/1019776
aaagtaaag

SEQ ID NO: 96532 - DNA, 9 bp, Unknown
  misc_feature (1)..( 9): Result.001 file - promoters60/1019776
aaagaaaag

SEQ ID NO: 96533 - DNA, 6 bp, Unknown
  misc_feature (1)..( 6): Result.001 file - promoters60/1019776
agtaaa

SEQ ID NO: 96534 - DNA, 6 bp, Unknown
  misc_feature (1)..( 6): Result.001 file - promoters60/1019776
agtaaa

SEQ ID NO: 96535 - DNA, 7 bp, Unknown
  misc_feature (1)..( 7): Result.001 file - promoters60/1019776
aatcggg

SEQ ID NO: 96536 - DNA, 7 bp, Unknown
  misc_feature (1)..( 7): Result.001 file - promoters60/1019776
aattggg

SEQ ID NO: 96537 - DNA, 8 bp, Unknown
  misc_feature (1)..( 8): Result.001 file - promoters60/1019776
gaaagaaa

SEQ ID NO: 96538 - DNA, 8 bp, Unknown
  misc_feature (1)..( 8): Result.001 file - promoters60/1019776
gaaacaaa

SEQ ID NO: 96539 - DNA, 10 bp, Unknown
  misc_feature (1)..( 10): Result.001 file - promoters60/1019776
ggaaaagaaa

SEQ ID NO: 96540 - DNA, 10 bp, Unknown
  misc_feature (1)..( 10): Result.001 file - promoters60/1019776
ggaaatgaaa

SEQ ID NO: 96541 - DNA, 7 bp, Unknown
  misc_feature (1)..( 7): Result.001 file - promoters60/1019776
cccacta

SEQ ID NO: 96542 - DNA, 7 bp, Unknown
  misc_feature (1)..( 7): Result.001 file - promoters60/1019898
cccacta

SEQ ID NO: 96543 - DNA, 12 bp, Unknown
  misc_feature (1)..( 12): Result.001 file - promoters60/1019898
gatatgtatgca

SEQ ID NO: 96544 - DNA, 12 bp, Unknown
  misc_feature (1)..( 12): Result.001 file - promoters60/1019898
gctatggatgca

SEQ ID NO: 96545 - DNA, 12 bp, Unknown
  misc_feature (1)..( 12): Result.001 file - promoters60/1019898
cgtatagattag

SEQ ID NO: 96546 - DNA, 12 bp, Unknown
  misc_feature (1)..( 12): Result.001 file - promoters60/1019898
gaaatagatatt

SEQ ID NO: 96547 - DNA, 12 bp, Unknown
  misc_feature (1)..( 12): Result.001 file - promoters60/1019898
aatatataccgg

SEQ ID NO: 96548 - DNA, 9 bp, Unknown
  misc_feature (1)..( 9): Result.001 file - promoters60/1019898
cgtatagat

SEQ ID NO: 96549 - DNA, 9 bp, Unknown
  misc_feature (1)..( 9): Result.001 file - promoters60/1019898
aatatagag

SEQ ID NO: 96550 - DNA, 9 bp, Unknown
  misc_feature (1)..( 9): Result.001 file - promoters60/1019898
gctatggat

SEQ ID NO: 96551 - DNA, 9 bp, Unknown
  misc_feature (1)..( 9): Result.001 file - promoters60/1019898
gaaatagat

SEQ ID NO: 96552 - DNA, 9 bp, Unknown
  misc_feature (1)..( 9): Result.001 file - promoters60/1019898
aatatatac

SEQ ID NO: 96553 - DNA, 9 bp, Unknown
  misc_feature (1)..( 9): Result.001 file - promoters60/1019898
ctttttgtt

SEQ ID NO: 96554 - DNA, 9 bp, Unknown
  misc_feature (1)..( 9): Result.001 file - promoters60/1019898
ctttttttt

SEQ ID NO: 96555 - DNA, 9 bp, Unknown
  misc_feature (1)..( 9): Result.001 file - promoters60/1019898
ttttatgtt

SEQ ID NO: 96556 - DNA, 10 bp, Unknown
  misc_feature (1)..( 10): Result.001 file - promoters60/1019898
attctattaa

SEQ ID NO: 96557 - DNA, 10 bp, Unknown
  misc_feature (1)..( 10): Result.001 file - promoters60/1019898
tttctatatg

SEQ ID NO: 96558 - DNA, 8 bp, Unknown
  misc_feature (1)..( 8): Result.001 file - promoters60/1019898
ttttgttg

SEQ ID NO: 96559 - DNA, 8 bp, Unknown
  misc_feature (1)..( 8): Result.001 file - promoters60/1019898
gtttcttg

SEQ ID NO: 96560 - DNA, 9 bp, Unknown
  misc_feature (1)..( 9): Result.001 file - promoters60/1019898
tttatgttt

SEQ ID NO: 96561 - DNA, 9 bp, Unknown
  misc_feature (1)..( 9): Result.001 file - promoters60/1019898
atattctat

SEQ ID NO: 96562 - DNA, 9 bp, Unknown
  misc_feature (1)..( 9): Result.001 file - promoters60/1019898
tttttctat

SEQ ID NO: 96563 - DNA, 9 bp, Unknown
  misc_feature (1)..( 9): Result.001 file - promoters60/1019915
gttttatca

SEQ ID NO: 96564 - DNA, 7 bp, Unknown
  misc_feature (1)..( 7): Result.001 file - promoters60/1019915
aacaaga

SEQ ID NO: 96565 - DNA, 7 bp, Unknown
  misc_feature (1)..( 7): Result.001 file - promoters60/1019915
aactaga

SEQ ID NO: 96566 - DNA, 7 bp, Unknown
  misc_feature (1)..( 7): Result.001 file - promoters60/1019915
aactaga

SEQ ID NO: 96567 - DNA, 9 bp, Unknown
  misc_feature (1)..( 9): Result.001 file - promoters60/1019915
ctgcaaatt

SEQ ID NO: 96568 - DNA, 9 bp, Unknown
  misc_feature (1)..( 9): Result.001 file - promoters60/1019915
tgtcaaatt

SEQ ID NO: 96569 - DNA, 9 bp, Unknown
  misc_feature (1)..( 9): Result.001 file - promoters60/1019915
tgtcatatt

SEQ ID NO: 96570 - DNA, 10 bp, Unknown
  misc_feature (1)..( 10): Result.001 file - promoters60/1019915
gaccgaaaaa

SEQ ID NO: 96571 - DNA, 10 bp, Unknown
  misc_feature (1)..( 10): Result.001 file - promoters60/1019915
ttaagaaaaa

SEQ ID NO: 96572 - DNA, 10 bp, Unknown
  misc_feature (1)..( 10): Result.001 file - promoters60/1019915
ttaacaaaac

SEQ ID NO: 96573 - DNA, 8 bp, Unknown
  misc_feature (1)..( 8): Result.001 file - promoters60/1019915
ctaaaaac

SEQ ID NO: 96574 - DNA, 8 bp, Unknown
  misc_feature (1)..( 8): Result.001 file - promoters60/1019915
ttaaaaaa

SEQ ID NO: 96575 - DNA, 8 bp, Unknown
  misc_feature (1)..( 8): Result.001 file - promoters60/1019915
ctagaaac

SEQ ID NO: 96576 - DNA, 8 bp, Unknown
  misc_feature (1)..( 8): Result.001 file - promoters60/1019915
aaaataaa

SEQ ID NO: 96577 - DNA, 8 bp, Unknown
  misc_feature (1)..( 8): Result.001 file - promoters60/1019915
aaaacaaa

SEQ ID NO: 96578 - DNA, 8 bp, Unknown
  misc_feature (1)..( 8): Result.001 file - promoters60/1019915
aaaataaa

SEQ ID NO: 96579 - DNA, 8 bp, Unknown
  misc_feature (1)..( 8): Result.001 file - promoters60/1019915
tttctagt

SEQ ID NO: 96580 - DNA, 8 bp, Unknown
  misc_feature (1)..( 8): Result.001 file - promoters60/1019915
tttttagt

SEQ ID NO: 96581 - DNA, 8 bp, Unknown
  misc_feature (1)..( 8): Result.001 file - promoters60/1019915
attttaga

SEQ ID NO: 96582 - DNA, 12 bp, Unknown
  misc_feature (1)..( 12): Result.001 file - promoters60/1019915
ataacaccgtta

SEQ ID NO: 96583 - DNA, 12 bp, Unknown
  misc_feature (1)..( 12): Result.001 file - promoters60/1019915
ataaaaccatta

SEQ ID NO: 96584 - DNA, 12 bp, Unknown
  misc_feature (1)..( 12): Result.001 file - promoters60/1019915
attaaaccattc

SEQ ID NO: 96585 - DNA, 10 bp, Unknown
  misc_feature (1)..( 10): Result.001 file - promoters60/1019915
aaatagtgat

SEQ ID NO: 96586 - DNA, 10 bp, Unknown
  misc_feature (1)..( 10): Result.001 file - promoters60/1019915
ttatattgat

SEQ ID NO: 96587 - DNA, 10 bp, Unknown
  misc_feature (1)..( 10): Result.001 file - promoters60/1019928
ttatattgtt

SEQ ID NO: 96588 - DNA, 9 bp, Unknown
  misc_feature (1)..( 9): Result.001 file - promoters60/1019928
attagttct

SEQ ID NO: 96589 - DNA, 9 bp, Unknown
  misc_feature (1)..( 9): Result.001 file - promoters60/1019928
atttgttat

SEQ ID NO: 96590 - DNA, 9 bp, Unknown
  misc_feature (1)..( 9): Result.001 file - promoters60/1019928
attagttaa

SEQ ID NO: 96591 - DNA, 9 bp, Unknown
  misc_feature (1)..( 9): Result.001 file - promoters60/1019928
attagttaa

SEQ ID NO: 96592 - DNA, 9 bp, Unknown
  misc_feature (1)..( 9): Result.001 file - promoters60/1019928
attatttct

SEQ ID NO: 96593 - DNA, 9 bp, Unknown
  misc_feature (1)..( 9): Result.001 file - promoters60/1019928
aattgttaa

SEQ ID NO: 96594 - DNA, 14 bp, Unknown
  misc_feature (1)..( 14): Result.001 file - promoters60/1019928
aattcgaatttttc

SEQ ID NO: 96595 - DNA, 14 bp, Unknown
  misc_feature (1)..( 14): Result.001 file - promoters60/1019928
ggccggaattttag

SEQ ID NO: 96596 - DNA, 14 bp, Unknown
  misc_feature (1)..( 14): Result.001 file - promoters60/1019928
atttgaaattttca

SEQ ID NO: 96597 - DNA, 14 bp, Unknown
  misc_feature (1)..( 14): Result.001 file - promoters60/1019928
gaatgaaatctgtc

SEQ ID NO: 96598 - DNA, 14 bp, Unknown
  misc_feature (1)..( 14): Result.001 file - promoters60/1019928
cgcctaaataaaaa

SEQ ID NO: 96599 - DNA, 14 bp, Unknown
  misc_feature (1)..( 14): Result.001 file - promoters60/1019928
tttgaaaatttcat

SEQ ID NO: 96600 - DNA, 14 bp, Unknown
  misc_feature (1)..( 14): Result.001 file - promoters60/1019928
gcgctaaactttta

SEQ ID NO: 96601 - DNA, 20 bp, Unknown
  misc_feature (1)..( 20): Result.001 file - promoters60/1019928
attcgaatttttcaatattt

SEQ ID NO: 96602 - DNA, 20 bp, Unknown
  misc_feature (1)..( 20): Result.001 file - promoters60/1019928
tttagtctattttaattcgt

SEQ ID NO: 96603 - DNA, 20 bp, Unknown
  misc_feature (1)..( 20): Result.001 file - promoters60/1019928
atttgaaattttcataaact

SEQ ID NO: 96604 - DNA, 20 bp, Unknown
  misc_feature (1)..( 20): Result.001 file - promoters60/1019928
gcgctaaacttttaaaatgc

SEQ ID NO: 96605 - DNA, 20 bp, Unknown
  misc_feature (1)..( 20): Result.001 file - promoters60/1019928
ttagaaaagaatgaaatctg

SEQ ID NO: 96606 - DNA, 20 bp, Unknown
  misc_feature (1)..( 20): Result.001 file - promoters60/1019928
aaagacgcgcctaaataaaa

SEQ ID NO: 96607 - DNA, 20 bp, Unknown
  misc_feature (1)..( 20): Result.001 file - promoters60/1019928
ggcgcttatttgaaaatttc

SEQ ID NO: 96608 - DNA, 10 bp, Unknown
  misc_feature (1)..( 10): Result.001 file - promoters60/1019928
cagaaaattc

SEQ ID NO: 96609 - DNA, 10 bp, Unknown
  misc_feature (1)..( 10): Result.001 file - promoters60/1019928
tagaaaagaa

SEQ ID NO: 96610 - DNA, 10 bp, Unknown
  misc_feature (1)..( 10): Result.001 file - promoters60/1019928
ttgaaaattt

SEQ ID NO: 96611 - DNA, 10 bp, Unknown
  misc_feature (1)..( 10): Result.001 file - promoters60/1019928
tagtaaatga

SEQ ID NO: 96612 - DNA, 10 bp, Unknown
  misc_feature (1)..( 10): Result.001 file - promoters60/1019928
tttgaaattt

SEQ ID NO: 96613 - DNA, 10 bp, Unknown
  misc_feature (1)..( 10): Result.001 file - promoters60/1019928
taaaaaattg

SEQ ID NO: 96614 - DNA, 10 bp, Unknown
  misc_feature (1)..( 10): Result.001 file - promoters60/1019928
gctaaacttt

SEQ ID NO: 96615 - DNA, 12 bp, Unknown
  misc_feature (1)..( 12): Result.001 file - promoters60/1019928
tatataaacaaa

SEQ ID NO: 96616 - DNA, 12 bp, Unknown
  misc_feature (1)..( 12): Result.001 file - promoters60/1019928
tatataaatgac

SEQ ID NO: 96617 - DNA, 12 bp, Unknown
  misc_feature (1)..( 12): Result.001 file - promoters60/1019928
tatataaatgac

SEQ ID NO: 96618 - DNA, 12 bp, Unknown
  misc_feature (1)..( 12): Result.001 file - promoters60/1019928
tataaaaaccaa

SEQ ID NO: 96619 - DNA, 12 bp, Unknown
  misc_feature (1)..( 12): Result.001 file - promoters60/1019928
cctataaatatc

SEQ ID NO: 96620 - DNA, 12 bp, Unknown
  misc_feature (1)..( 12): Result.001 file - promoters60/1019928
cataaaagcagt

SEQ ID NO: 96621 - DNA, 12 bp, Unknown
  misc_feature (1)..( 12): Result.001 file - promoters60/1019928
acgataaatatc

SEQ ID NO: 96622 - DNA, 14 bp, Unknown
  misc_feature (1)..( 14): Result.001 file - promoters60/1019928
aaacttataattat

SEQ ID NO: 96623 - DNA, 14 bp, Unknown
  misc_feature (1)..( 14): Result.001 file - promoters60/1019928
aatgatattattat

SEQ ID NO: 96624 - DNA, 14 bp, Unknown
  misc_feature (1)..( 14): Result.001 file - promoters60/1019928
atctttataagtat

SEQ ID NO: 96625 - DNA, 14 bp, Unknown
  misc_feature (1)..( 14): Result.001 file - promoters60/1019928
aaatttgtaacttc

SEQ ID NO: 96626 - DNA, 14 bp, Unknown
  misc_feature (1)..( 14): Result.001 file - promoters60/1019928
atctttatacaaaa

SEQ ID NO: 96627 - DNA, 14 bp, Unknown
  misc_feature (1)..( 14): Result.001 file - promoters60/1019928
ctttatgttattag

SEQ ID NO: 96628 - DNA, 14 bp, Unknown
  misc_feature (1)..( 14): Result.001 file - promoters60/1019928
ctttatgttattag

SEQ ID NO: 96629 - DNA, 10 bp, Unknown
  misc_feature (1)..( 10): Result.001 file - promoters60/1019928
ttatgtaaat

SEQ ID NO: 96630 - DNA, 10 bp, Unknown
  misc_feature (1)..( 10): Result.001 file - promoters60/1019928
gtatttaagc

SEQ ID NO: 96631 - DNA, 10 bp, Unknown
  misc_feature (1)..( 10): Result.001 file - promoters60/1019928
ttatgttatt

SEQ ID NO: 96632 - DNA, 10 bp, Unknown
  misc_feature (1)..( 10): Result.001 file - promoters60/1019928
ttatgtattc

SEQ ID NO: 96633 - DNA, 10 bp, Unknown
  misc_feature (1)..( 10): Result.001 file - promoters60/1019928
aattgttaat

SEQ ID NO: 96634 - DNA, 10 bp, Unknown
  misc_feature (1)..( 10): Result.001 file - promoters60/1020023
ttatttactt

SEQ ID NO: 96635 - DNA, 12 bp, Unknown
  misc_feature (1)..( 12): Result.001 file - promoters60/1020023
atatttatataa

SEQ ID NO: 96636 - DNA, 12 bp, Unknown
  misc_feature (1)..( 12): Result.001 file - promoters60/1020023
caatttagataa

SEQ ID NO: 96637 - DNA, 12 bp, Unknown
  misc_feature (1)..( 12): Result.001 file - promoters60/1020023
caatttaatacc

SEQ ID NO: 96638 - DNA, 12 bp, Unknown
  misc_feature (1)..( 12): Result.001 file - promoters60/1020023
tgattaataatt

SEQ ID NO: 96639 - DNA, 12 bp, Unknown
  misc_feature (1)..( 12): Result.001 file - promoters60/1020023
gccttaatatcg

SEQ ID NO: 96640 - DNA, 12 bp, Unknown
  misc_feature (1)..( 12): Result.001 file - promoters60/1020023
tcctatatatca

SEQ ID NO: 96641 - DNA, 12 bp, Unknown
  misc_feature (1)..( 12): Result.001 file - promoters60/1020023
ttctatatatat

SEQ ID NO: 96642 - DNA, 12 bp, Unknown
  misc_feature (1)..( 12): Result.001 file - promoters60/1020023
tcctataaattg

SEQ ID NO: 96643 - DNA, 12 bp, Unknown
  misc_feature (1)..( 12): Result.001 file - promoters60/1020023
tcctataaatat

SEQ ID NO: 96644 - DNA, 12 bp, Unknown
  misc_feature (1)..( 12): Result.001 file - promoters60/1020023
aaatataaatat

SEQ ID NO: 96645 - DNA, 8 bp, Unknown
  misc_feature (1)..( 8): Result.001 file - promoters60/1020023
ataattag

SEQ ID NO: 96646 - DNA, 8 bp, Unknown
  misc_feature (1)..( 8): Result.001 file - promoters60/1020023
ctaattaa

SEQ ID NO: 96647 - DNA, 8 bp, Unknown
  misc_feature (1)..( 8): Result.001 file - promoters60/1020023
ataattag

SEQ ID NO: 96648 - DNA, 8 bp, Unknown
  misc_feature (1)..( 8): Result.001 file - promoters60/1020023
ataaataa

SEQ ID NO: 96649 - DNA, 11 bp, Unknown
  misc_feature (1)..( 11): Result.001 file - promoters60/1020023
tgatgatattc

SEQ ID NO: 96650 - DNA, 11 bp, Unknown
  misc_feature (1)..( 11): Result.001 file - promoters60/1020023
agataatagtc

SEQ ID NO: 96651 - DNA, 11 bp, Unknown
  misc_feature (1)..( 11): Result.001 file - promoters60/1020023
agaaaatttac

SEQ ID NO: 96652 - DNA, 11 bp, Unknown
  misc_feature (1)..( 11): Result.001 file - promoters60/1020023
actaaatttta

SEQ ID NO: 96653 - DNA, 11 bp, Unknown
  misc_feature (1)..( 11): Result.001 file - promoters60/1020023
attttatgcaa

SEQ ID NO: 96654 - DNA, 11 bp, Unknown
  misc_feature (1)..( 11): Result.001 file - promoters60/1020023
tttttatgtat

SEQ ID NO: 96655 - DNA, 11 bp, Unknown
  misc_feature (1)..( 11): Result.001 file - promoters60/1020023
tttttttgtat

SEQ ID NO: 96656 - DNA, 11 bp, Unknown
  misc_feature (1)..( 11): Result.001 file - promoters60/1020023
ctgttatgtct

SEQ ID NO: 96657 - DNA, 7 bp, Unknown
  misc_feature (1)..( 7): Result.001 file - promoters60/1020023
cttaatc

SEQ ID NO: 96658 - DNA, 7 bp, Unknown
  misc_feature (1)..( 7): Result.001 file - promoters60/1020023
cttaata

SEQ ID NO: 96659 - DNA, 7 bp, Unknown
  misc_feature (1)..( 7): Result.001 file - promoters60/1020023
cttaatg

SEQ ID NO: 96660 - DNA, 7 bp, Unknown
  misc_feature (1)..( 7): Result.001 file - promoters60/1020023
attaata

SEQ ID NO: 96661 - DNA, 10 bp, Unknown
  misc_feature (1)..( 10): Result.001 file - promoters60/1020023
ttaatagcct

SEQ ID NO: 96662 - DNA, 10 bp, Unknown
  misc_feature (1)..( 10): Result.001 file - promoters60/1020023
ttaataccct

SEQ ID NO: 96663 - DNA, 10 bp, Unknown
  misc_feature (1)..( 10): Result.001 file - promoters60/1020023
ttaataatta

SEQ ID NO: 96664 - DNA, 10 bp, Unknown
  misc_feature (1)..( 10): Result.001 file - promoters60/1020046
ttaatatcgg

SEQ ID NO: 96665 - DNA, 8 bp, Unknown
  misc_feature (1)..( 8): Result.001 file - promoters60/1020046
atatttat

SEQ ID NO: 96666 - DNA, 8 bp, Unknown
  misc_feature (1)..( 8): Result.001 file - promoters60/1020046
atagttat

SEQ ID NO: 96667 - DNA, 7 bp, Unknown
  misc_feature (1)..( 7): Result.001 file - promoters60/1020046
ctttttc

SEQ ID NO: 96668 - DNA, 7 bp, Unknown
  misc_feature (1)..( 7): Result.001 file - promoters60/1020046
ctttttc

SEQ ID NO: 96669 - DNA, 6 bp, Unknown
  misc_feature (1)..( 6): Result.001 file - promoters60/1020046
tttaac

SEQ ID NO: 96670 - DNA, 6 bp, Unknown
  misc_feature (1)..( 6): Result.001 file - promoters60/1020046
tttaac

SEQ ID NO: 96671 - DNA, 7 bp, Unknown
  misc_feature (1)..( 7): Result.001 file - promoters60/1020046
ttaattc

SEQ ID NO: 96672 - DNA, 7 bp, Unknown
  misc_feature (1)..( 7): Result.001 file - promoters60/1020046
ttatttc

SEQ ID NO: 96673 - DNA, 7 bp, Unknown
  misc_feature (1)..( 7): Result.001 file - promoters60/1020046
ttaatta

SEQ ID NO: 96674 - DNA, 7 bp, Unknown
  misc_feature (1)..( 7): Result.001 file - promoters60/1020046
tataaag

SEQ ID NO: 96675 - DNA, 7 bp, Unknown
  misc_feature (1)..( 7): Result.001 file - promoters60/1020046
tattaag

SEQ ID NO: 96676 - DNA, 6 bp, Unknown
  misc_feature (1)..( 6): Result.001 file - promoters60/1020046
acataa

SEQ ID NO: 96677 - DNA, 6 bp, Unknown
  misc_feature (1)..( 6): Result.001 file - promoters60/1020046
acataa

SEQ ID NO: 96678 - DNA, 13 bp, Unknown
  misc_feature (1)..( 13): Result.001 file - promoters60/1020046
aaaaagtaaagga

SEQ ID NO: 96679 - DNA, 13 bp, Unknown
  misc_feature (1)..( 13): Result.001 file - promoters60/1020046
aaaaaataaagga

SEQ ID NO: 96680 - DNA, 13 bp, Unknown
  misc_feature (1)..( 13): Result.001 file - promoters60/1020046
ggaaagtaaataa

SEQ ID NO: 96681 - DNA, 6 bp, Unknown
  misc_feature (1)..( 6): Result.001 file - promoters60/1020046
aaaata

SEQ ID NO: 96682 - DNA, 6 bp, Unknown
  misc_feature (1)..( 6): Result.001 file - promoters60/1020046
aaaata

SEQ ID NO: 96683 - DNA, 8 bp, Unknown
  misc_feature (1)..( 8): Result.001 file - promoters60/1020046
ttctctct

SEQ ID NO: 96684 - DNA, 8 bp, Unknown
  misc_feature (1)..( 8): Result.001 file - promoters60/1020046
ttctctct

SEQ ID NO: 96685 - DNA, 8 bp, Unknown
  misc_feature (1)..( 8): Result.001 file - promoters60/1020046
ctctctct

SEQ ID NO: 96686 - DNA, 8 bp, Unknown
  misc_feature (1)..( 8): Result.001 file - promoters60/1020046
taaagaca

SEQ ID NO: 96687 - DNA, 8 bp, Unknown
  misc_feature (1)..( 8): Result.001 file - promoters60/1020046
taaacaca

SEQ ID NO: 96688 - DNA, 6 bp, Unknown
  misc_feature (1)..( 6): Result.001 file - promoters60/1020046
ttataa

SEQ ID NO: 96689 - DNA, 6 bp, Unknown
  misc_feature (1)..( 6): Result.001 file - promoters60/1020046
ttataa

SEQ ID NO: 96690 - DNA, 8 bp, Unknown
  misc_feature (1)..( 8): Result.001 file - promoters60/1020046
gtatatat

SEQ ID NO: 96691 - DNA, 8 bp, Unknown
  misc_feature (1)..( 8): Result.001 file - promoters60/1020046
aaatatat

SEQ ID NO: 96692 - DNA, 8 bp, Unknown
  misc_feature (1)..( 8): Result.001 file - promoters60/1020046
aaacatat

SEQ ID NO: 96693 - DNA, 10 bp, Unknown
  misc_feature (1)..( 10): Result.001 file - promoters60/1020046
tatttttaga

SEQ ID NO: 96694 - DNA, 10 bp, Unknown
  misc_feature (1)..( 10): Result.001 file - promoters60/1020046
tatctttaat

SEQ ID NO: 96695 - DNA, 10 bp, Unknown
  misc_feature (1)..( 10): Result.001 file - promoters60/1020046
ttccttgaat

SEQ ID NO: 96696 - DNA, 19 bp, Unknown
  misc_feature (1)..( 19): Result.001 file - promoters60/1020046
ttagaaaagtcatgtttct

SEQ ID NO: 96697 - DNA, 19 bp, Unknown
  misc_feature (1)..( 19): Result.001 file - promoters60/1020046
taatcaaagacatttttct

SEQ ID NO: 96698 - DNA, 19 bp, Unknown
  misc_feature (1)..( 19): Result.001 file - promoters60/1020046
taattaaaaacaaattacc

SEQ ID NO: 96699 - DNA, 9 bp, Unknown
  misc_feature (1)..( 9): Result.001 file - promoters60/1020046
aaaattaga

SEQ ID NO: 96700 - DNA, 9 bp, Unknown
  misc_feature (1)..( 9): Result.001 file - promoters60/1020046
aaatttaga

SEQ ID NO: 96701 - DNA, 9 bp, Unknown
  misc_feature (1)..( 9): Result.001 file - promoters60/1020046
aaaattatt

SEQ ID NO: 96702 - DNA, 6 bp, Unknown
  misc_feature (1)..( 6): Result.001 file - promoters60/1020046
aaaata

SEQ ID NO: 96703 - DNA, 6 bp, Unknown
  misc_feature (1)..( 6): Result.001 file - promoters60/1020046
aaaata

SEQ ID NO: 96704 - DNA, 9 bp, Unknown
  misc_feature (1)..( 9): Result.001 file - promoters60/1020046
ttaaaagat

SEQ ID NO: 96705 - DNA, 9 bp, Unknown
  misc_feature (1)..( 9): Result.001 file - promoters60/1020046
ttacaagat

SEQ ID NO: 96706 - DNA, 8 bp, Unknown
  misc_feature (1)..( 8): Result.001 file - promoters60/1020046
taacaaaa

SEQ ID NO: 96707 - DNA, 8 bp, Unknown
  misc_feature (1)..( 8): Result.001 file - promoters60/1020046
taaaaaaa

SEQ ID NO: 96708 - DNA, 8 bp, Unknown
  misc_feature (1)..( 8): Result.001 file - promoters60/1020046
aaaacttt

SEQ ID NO: 96709 - DNA, 8 bp, Unknown
  misc_feature (1)..( 8): Result.001 file - promoters60/1020046
aaatcttt

SEQ ID NO: 96710 - DNA, 6 bp, Unknown
  misc_feature (1)..( 6): Result.001 file - promoters60/1020046
ttctat

SEQ ID NO: 96711 - DNA, 6 bp, Unknown
  misc_feature (1)..( 6): Result.001 file - promoters60/1020046
ttctat

SEQ ID NO: 96712 - DNA, 7 bp, Unknown
  misc_feature (1)..( 7): Result.001 file - promoters60/1020046
ataaatt

SEQ ID NO: 96713 - DNA, 7 bp, Unknown
  misc_feature (1)..( 7): Result.001 file - promoters60/1020046
ataaatt

SEQ ID NO: 96714 - DNA, 11 bp, Unknown
  misc_feature (1)..( 11): Result.001 file - promoters60/1020046
ttacaaattta

SEQ ID NO: 96715 - DNA, 11 bp, Unknown
  misc_feature (1)..( 11): Result.001 file - promoters60/1020046
ttataaaatta

SEQ ID NO: 96716 - DNA, 8 bp, Unknown
  misc_feature (1)..( 8): Result.001 file - promoters60/1020046
aaacatat

SEQ ID NO: 96717 - DNA, 8 bp, Unknown
  misc_feature (1)..( 8): Result.001 file - promoters60/1020046
aaaaatat

SEQ ID NO: 96718 - DNA, 6 bp, Unknown
  misc_feature (1)..( 6): Result.001 file - promoters60/1020046
caactt

SEQ ID NO: 96719 - DNA, 6 bp, Unknown
  misc_feature (1)..( 6): Result.001 file - promoters60/1020046
caactt

SEQ ID NO: 96720 - DNA, 6 bp, Unknown
  misc_feature (1)..( 6): Result.001 file - promoters60/1020046
aaataa

SEQ ID NO: 96721 - DNA, 6 bp, Unknown
  misc_feature (1)..( 6): Result.001 file - promoters60/1020046
aaataa

SEQ ID NO: 96722 - DNA, 6 bp, Unknown
  misc_feature (1)..( 6): Result.001 file - promoters60/1020046
aaaata

SEQ ID NO: 96723 - DNA, 6 bp, Unknown
  misc_feature (1)..( 6): Result.001 file - promoters60/1020046
aaaata

SEQ ID NO: 96724 - DNA, 6 bp, Unknown
  misc_feature (1)..( 6): Result.001 file - promoters60/1020046
aagatg

SEQ ID NO: 96725 - DNA, 6 bp, Unknown
  misc_feature (1)..( 6): Result.001 file - promoters60/1020046
aagatg

SEQ ID NO: 96726 - DNA, 6 bp, Unknown
  misc_feature (1)..( 6): Result.001 file - promoters60/1020046
cgcgtt

SEQ ID NO: 96727 - DNA, 6 bp, Unknown
  misc_feature (1)..( 6): Result.001 file - promoters60/1020069
cgcgtt

SEQ ID NO: 96728 - DNA, 9 bp, Unknown
  misc_feature (1)..( 9): Result.001 file - promoters60/1020069
aagaagaaa

SEQ ID NO: 96729 - DNA, 9 bp, Unknown
  misc_feature (1)..( 9): Result.001 file - promoters60/1020069
aagcagaaa

SEQ ID NO: 96730 - DNA, 9 bp, Unknown
  misc_feature (1)..( 9): Result.001 file - promoters60/1020069
aagaaaaaa

SEQ ID NO: 96731 - DNA, 9 bp, Unknown
  misc_feature (1)..( 9): Result.001 file - promoters60/1020069
aagaatttg

SEQ ID NO: 96732 - DNA, 12 bp, Unknown
  misc_feature (1)..( 12): Result.001 file - promoters60/1020069
gatcttttctcg

SEQ ID NO: 96733 - DNA, 12 bp, Unknown
  misc_feature (1)..( 12): Result.001 file - promoters60/1020069
gatttttttttt

SEQ ID NO: 96734 - DNA, 12 bp, Unknown
  misc_feature (1)..( 12): Result.001 file - promoters60/1020069
gaacttgtctcc

SEQ ID NO: 96735 - DNA, 12 bp, Unknown
  misc_feature (1)..( 12): Result.001 file - promoters60/1020069
agaaaagtctcc

SEQ ID NO: 96736 - DNA, 9 bp, Unknown
  misc_feature (1)..( 9): Result.001 file - promoters60/1020069
cttttctcg

SEQ ID NO: 96737 - DNA, 9 bp, Unknown
  misc_feature (1)..( 9): Result.001 file - promoters60/1020069
tttttttcg

SEQ ID NO: 96738 - DNA, 9 bp, Unknown
  misc_feature (1)..( 9): Result.001 file - promoters60/1020069
cttgtctcc

SEQ ID NO: 96739 - DNA, 9 bp, Unknown
  misc_feature (1)..( 9): Result.001 file - promoters60/1020223
aaagtctcc

SEQ ID NO: 96740 - DNA, 8 bp, Unknown
  misc_feature (1)..( 8): Result.001 file - promoters60/1020223
atcatatt

SEQ ID NO: 96741 - DNA, 8 bp, Unknown
  misc_feature (1)..( 8): Result.001 file - promoters60/1020223
atcatatt

SEQ ID NO: 96742 - DNA, 8 bp, Unknown
  misc_feature (1)..( 8): Result.001 file - promoters60/1020223
atcatatt

SEQ ID NO: 96743 - DNA, 9 bp, Unknown
  misc_feature (1)..( 9): Result.001 file - promoters60/1020223
tttgtagtg

SEQ ID NO: 96744 - DNA, 9 bp, Unknown
  misc_feature (1)..( 9): Result.001 file - promoters60/1020223
attgtagct

SEQ ID NO: 96745 - DNA, 9 bp, Unknown
  misc_feature (1)..( 9): Result.001 file - promoters60/1020223
tttgttgtg

SEQ ID NO: 96746 - DNA, 8 bp, Unknown
  misc_feature (1)..( 8): Result.001 file - promoters60/1020223
tgatttgt

SEQ ID NO: 96747 - DNA, 8 bp, Unknown
  misc_feature (1)..( 8): Result.001 file - promoters60/1020223
agatatgt

SEQ ID NO: 96748 - DNA, 8 bp, Unknown
  misc_feature (1)..( 8): Result.001 file - promoters60/1020223
tgatttgg

SEQ ID NO: 96749 - DNA, 6 bp, Unknown
  misc_feature (1)..( 6): Result.001 file - promoters60/1020223
atattt

SEQ ID NO: 96750 - DNA, 6 bp, Unknown
  misc_feature (1)..( 6): Result.001 file - promoters60/1020223
atattt

SEQ ID NO: 96751 - DNA, 7 bp, Unknown
  misc_feature (1)..( 7): Result.001 file - promoters60/1020223
gtttgtt

SEQ ID NO: 96752 - DNA, 7 bp, Unknown
  misc_feature (1)..( 7): Result.001 file - promoters60/1020223
gtttgtg

SEQ ID NO: 96753 - DNA, 7 bp, Unknown
  misc_feature (1)..( 7): Result.001 file - promoters60/1020223
ttttgtt

SEQ ID NO: 96754 - DNA, 6 bp, Unknown
  misc_feature (1)..( 6): Result.001 file - promoters60/1020223
tgatgt

SEQ ID NO: 96755 - DNA, 6 bp, Unknown
  misc_feature (1)..( 6): Result.001 file - promoters60/1020223
tgatgt

SEQ ID NO: 96756 - DNA, 8 bp, Unknown
  misc_feature (1)..( 8): Result.001 file - promoters60/1020223
tgtttgtt

SEQ ID NO: 96757 - DNA, 8 bp, Unknown
  misc_feature (1)..( 8): Result.001 file - promoters60/1020223
gatttgtt

SEQ ID NO: 96758 - DNA, 8 bp, Unknown
  misc_feature (1)..( 8): Result.001 file - promoters60/1020223
gatatgta

SEQ ID NO: 96759 - DNA, 7 bp, Unknown
  misc_feature (1)..( 7): Result.001 file - promoters60/1020223
gttttgt

SEQ ID NO: 96760 - DNA, 7 bp, Unknown
  misc_feature (1)..( 7): Result.001 file - promoters60/1020223
gttttgt

SEQ ID NO: 96761 - DNA, 7 bp, Unknown
  misc_feature (1)..( 7): Result.001 file - promoters60/1020223
aagaaca

SEQ ID NO: 96762 - DNA, 7 bp, Unknown
  misc_feature (1)..( 7): Result.001 file - promoters60/1020223
aagaaca

SEQ ID NO: 96763 - DNA, 6 bp, Unknown
  misc_feature (1)..( 6): Result.001 file - promoters60/1020223
tgtgat

SEQ ID NO: 96764 - DNA, 6 bp, Unknown
  misc_feature (1)..( 6): Result.001 file - promoters60/1020223
tgtgat

SEQ ID NO: 96765 - DNA, 8 bp, Unknown
  misc_feature (1)..( 8): Result.001 file - promoters60/1020223
atagtttg

SEQ ID NO: 96766 - DNA, 8 bp, Unknown
  misc_feature (1)..( 8): Result.001 file - promoters60/1020223
ataatttg

SEQ ID NO: 96767 - DNA, 8 bp, Unknown
  misc_feature (1)..( 8): Result.001 file - promoters60/1020223
agtatgtt

SEQ ID NO: 96768 - DNA, 8 bp, Unknown
  misc_feature (1)..( 8): Result.001 file - promoters60/1020223
agtttgtt

SEQ ID NO: 96769 - DNA, 6 bp, Unknown
  misc_feature (1)..( 6): Result.001 file - promoters60/1020223
tgtttg

SEQ ID NO: 96770 - DNA, 6 bp, Unknown
  misc_feature (1)..( 6): Result.001 file - promoters60/1020223
tgtttg

SEQ ID NO: 96771 - DNA, 6 bp, Unknown
  misc_feature (1)..( 6): Result.001 file - promoters60/1020223
gagttt

SEQ ID NO: 96772 - DNA, 6 bp, Unknown
  misc_feature (1)..( 6): Result.001 file - promoters60/1020223
gagttt

SEQ ID NO: 96773 - DNA, 6 bp, Unknown
  misc_feature (1)..( 6): Result.001 file - promoters60/1020223
ctgatt

SEQ ID NO: 96774 - DNA, 6 bp, Unknown
  misc_feature (1)..( 6): Result.001 file - promoters60/1020223
ctgatt

SEQ ID NO: 96775 - DNA, 6 bp, Unknown
  misc_feature (1)..( 6): Result.001 file - promoters60/1020223
ttagtt

SEQ ID NO: 96776 - DNA, 6 bp, Unknown
  misc_feature (1)..( 6): Result.001 file - promoters60/1020265
ttagtt

SEQ ID NO: 96777 - DNA, 8 bp, Unknown
  misc_feature (1)..( 8): Result.001 file - promoters60/1020265
atgactac

SEQ ID NO: 96778 - DNA, 8 bp, Unknown
  misc_feature (1)..( 8): Result.001 file - promoters60/1020265
atgactta

SEQ ID NO: 96779 - DNA, 8 bp, Unknown
  misc_feature (1)..( 8): Result.001 file - promoters60/1020265
ttgattta

SEQ ID NO: 96780 - DNA, 7 bp, Unknown
  misc_feature (1)..( 7): Result.001 file - promoters60/1020265
attgtgt

SEQ ID NO: 96781 - DNA, 7 bp, Unknown
  misc_feature (1)..( 7): Result.001 file - promoters60/1020265
attctgt

SEQ ID NO: 96782 - DNA, 7 bp, Unknown
  misc_feature (1)..( 7): Result.001 file - promoters60/1020265
tttgtgt

SEQ ID NO: 96783 - DNA, 8 bp, Unknown
  misc_feature (1)..( 8): Result.001 file - promoters60/1020265
atttttca

SEQ ID NO: 96784 - DNA, 8 bp, Unknown
  misc_feature (1)..( 8): Result.001 file - promoters60/1020265
attattct

SEQ ID NO: 96785 - DNA, 8 bp, Unknown
  misc_feature (1)..( 8): Result.001 file - promoters60/1020265
cttattct

SEQ ID NO: 96786 - DNA, 8 bp, Unknown
  misc_feature (1)..( 8): Result.001 file - promoters60/1020265
ggaataaa

SEQ ID NO: 96787 - DNA, 8 bp, Unknown
  misc_feature (1)..( 8): Result.001 file - promoters60/1020265
tgaagaaa

SEQ ID NO: 96788 - DNA, 8 bp, Unknown
  misc_feature (1)..( 8): Result.001 file - promoters60/1020313
tgaagaat

SEQ ID NO: 96789 - DNA, 13 bp, Unknown
  misc_feature (1)..( 13): Result.001 file - promoters60/1020313
tgtttattttact

SEQ ID NO: 96790 - DNA, 13 bp, Unknown
  misc_feature (1)..( 13): Result.001 file - promoters60/1020313
attttttttttag

SEQ ID NO: 96791 - DNA, 13 bp, Unknown
  misc_feature (1)..( 13): Result.001 file - promoters60/1020313
tgttaattgtctc

SEQ ID NO: 96792 - DNA, 13 bp, Unknown
  misc_feature (1)..( 13): Result.001 file - promoters60/1020313
tatttatttattt

SEQ ID NO: 96793 - DNA, 13 bp, Unknown
  misc_feature (1)..( 13): Result.001 file - promoters60/1020313
aaccaattttact

SEQ ID NO: 96794 - DNA, 13 bp, Unknown
  misc_feature (1)..( 13): Result.001 file - promoters60/1020364
tgtttattggcgt

SEQ ID NO: 96795 - DNA, 16 bp, Unknown
  misc_feature (1)..( 16): Result.001 file - promoters60/1020364
cataaaacaaaaatta

SEQ ID NO: 96796 - DNA, 16 bp, Unknown
  misc_feature (1)..( 16): Result.001 file - promoters60/1020364
aaaagaacaacaataa

SEQ ID NO: 96797 - DNA, 16 bp, Unknown
  misc_feature (1)..( 16): Result.001 file - promoters60/1020364
agtcatagaaaaatta

SEQ ID NO: 96798 - DNA, 16 bp, Unknown
  misc_feature (1)..( 16): Result.001 file - promoters60/1020364
gcttttccaaaaagta

SEQ ID NO: 96799 - DNA, 16 bp, Unknown
  misc_feature (1)..( 16): Result.001 file - promoters60/1020364
cttacgccaaaagaca

SEQ ID NO: 96800 - DNA, 16 bp, Unknown
  misc_feature (1)..( 16): Result.001 file - promoters60/1020430
cttttcccaaaagttt

SEQ ID NO: 96801 - DNA, 9 bp, Unknown
  misc_feature (1)..( 9): Result.001 file - promoters60/1020430
gcaactaac

SEQ ID NO: 96802 - DNA, 9 bp, Unknown
  misc_feature (1)..( 9): Result.001 file - promoters60/1020430
tgaactaac

SEQ ID NO: 96803 - DNA, 9 bp, Unknown
  misc_feature (1)..( 9): Result.001 file - promoters60/1020430
ctatctaac

SEQ ID NO: 96804 - DNA, 9 bp, Unknown
  misc_feature (1)..( 9): Result.001 file - promoters60/1020430
ctatttaat

SEQ ID NO: 96805 - DNA, 9 bp, Unknown
  misc_feature (1)..( 9): Result.001 file - promoters60/1020430
tcaaccaac

SEQ ID NO: 96806 - DNA, 9 bp, Unknown
  misc_feature (1)..( 9): Result.001 file - promoters60/1020430
ctaactaac

SEQ ID NO: 96807 - DNA, 9 bp, Unknown
  misc_feature (1)..( 9): Result.001 file - promoters60/1020430
ctatctaac

SEQ ID NO: 96808 - DNA, 9 bp, Unknown
  misc_feature (1)..( 9): Result.001 file - promoters60/1020430
ctatttaat

SEQ ID NO: 96809 - DNA, 9 bp, Unknown
  misc_feature (1)..( 9): Result.001 file - promoters60/1020430
atattatta

SEQ ID NO: 96810 - DNA, 9 bp, Unknown
  misc_feature (1)..( 9): Result.001 file - promoters60/1020430
atataatta

SEQ ID NO: 96811 - DNA, 9 bp, Unknown
  misc_feature (1)..( 9): Result.001 file - promoters60/1020430
ccttaatta

SEQ ID NO: 96812 - DNA, 9 bp, Unknown
  misc_feature (1)..( 9): Result.001 file - promoters60/1020442
gattaattc

SEQ ID NO: 96813 - DNA, 6 bp, Unknown
  misc_feature (1)..( 6): Result.001 file - promoters60/1020442
taatac

SEQ ID NO: 96814 - DNA, 6 bp, Unknown
  misc_feature (1)..( 6): Result.001 file - promoters60/1020442
taatac

SEQ ID NO: 96815 - DNA, 9 bp, Unknown
  misc_feature (1)..( 9): Result.001 file - promoters60/1020442
tttttattt

SEQ ID NO: 96816 - DNA, 9 bp, Unknown
  misc_feature (1)..( 9): Result.001 file - promoters60/1020442
tttttattt

SEQ ID NO: 96817 - DNA, 6 bp, Unknown
  misc_feature (1)..( 6): Result.001 file - promoters60/1020442
tcaagt

SEQ ID NO: 96818 - DNA, 6 bp, Unknown
  misc_feature (1)..( 6): Result.001 file - promoters60/1020442
tcaagt

SEQ ID NO: 96819 - DNA, 6 bp, Unknown
  misc_feature (1)..( 6): Result.001 file - promoters60/1020442
actagt

SEQ ID NO: 96820 - DNA, 6 bp, Unknown
  misc_feature (1)..( 6): Result.001 file - promoters60/1020442
actagt

SEQ ID NO: 96821 - DNA, 7 bp, Unknown
  misc_feature (1)..( 7): Result.001 file - promoters60/1020442
attattt

SEQ ID NO: 96822 - DNA, 7 bp, Unknown
  misc_feature (1)..( 7): Result.001 file - promoters60/1020442
atttttt

SEQ ID NO: 96823 - DNA, 9 bp, Unknown
  misc_feature (1)..( 9): Result.001 file - promoters60/1020442
gataataat

SEQ ID NO: 96824 - DNA, 9 bp, Unknown
  misc_feature (1)..( 9): Result.001 file - promoters60/1020442
gataacaat

SEQ ID NO: 96825 - DNA, 8 bp, Unknown
  misc_feature (1)..( 8): Result.001 file - promoters60/1020442
gcagcaac

SEQ ID NO: 96826 - DNA, 8 bp, Unknown
  misc_feature (1)..( 8): Result.001 file - promoters60/1020442
gcaacaac

SEQ ID NO: 96827 - DNA, 6 bp, Unknown
  misc_feature (1)..( 6): Result.001 file - promoters60/1020442
agcaaa

SEQ ID NO: 96828 - DNA, 6 bp, Unknown
  misc_feature (1)..( 6): Result.001 file - promoters60/1020442
agcaaa

SEQ ID NO: 96829 - DNA, 6 bp, Unknown
  misc_feature (1)..( 6): Result.001 file - promoters60/1020442
tttgaa

SEQ ID NO: 96830 - DNA, 6 bp, Unknown
  misc_feature (1)..( 6): Result.001 file - promoters60/1020442
tttgaa

SEQ ID NO: 96831 - DNA, 9 bp, Unknown
  misc_feature (1)..( 9): Result.001 file - promoters60/1020442
aaaagattt

SEQ ID NO: 96832 - DNA, 9 bp, Unknown
  misc_feature (1)..( 9): Result.001 file - promoters60/1020442
aaaagcttt

SEQ ID NO: 96833 - DNA, 7 bp, Unknown
  misc_feature (1)..( 7): Result.001 file - promoters60/1020442
gctggct

SEQ ID NO: 96834 - DNA, 7 bp, Unknown
  misc_feature (1)..( 7): Result.001 file - promoters60/1020442
gcttgct

SEQ ID NO: 96835 - DNA, 9 bp, Unknown
  misc_feature (1)..( 9): Result.001 file - promoters60/1020442
aagaagatg

SEQ ID NO: 96836 - DNA, 9 bp, Unknown
  misc_feature (1)..( 9): Result.001 file - promoters60/1020442
aagaagatg

SEQ ID NO: 96837 - DNA, 10 bp, Unknown
  misc_feature (1)..( 10): Result.001 file - promoters60/1020442
tgagaggttg

SEQ ID NO: 96838 - DNA, 10 bp, Unknown
  misc_feature (1)..( 10): Result.001 file - promoters60/1020442
tgagagattg

SEQ ID NO: 96839 - DNA, 7 bp, Unknown
  misc_feature (1)..( 7): Result.001 file - promoters60/1020442
ttgcaat

SEQ ID NO: 96840 - DNA, 7 bp, Unknown
  misc_feature (1)..( 7): Result.001 file - promoters60/1020442
ttgcaat

SEQ ID NO: 96841 - DNA, 8 bp, Unknown
  misc_feature (1)..( 8): Result.001 file - promoters60/1020442
tatatata

SEQ ID NO: 96842 - DNA, 8 bp, Unknown
  misc_feature (1)..( 8): Result.001 file - promoters60/1020460
tatatata

SEQ ID NO: 96843 - DNA, 8 bp, Unknown
  misc_feature (1)..( 8): Result.001 file - promoters60/1020460
gtatttgg

SEQ ID NO: 96844 - DNA, 8 bp, Unknown
  misc_feature (1)..( 8): Result.001 file - promoters60/1020460
gtatatgg

SEQ ID NO: 96845 - DNA, 11 bp, Unknown
  misc_feature (1)..( 11): Result.001 file - promoters60/1020460
agtgtatgtct

SEQ ID NO: 96846 - DNA, 11 bp, Unknown
  misc_feature (1)..( 11): Result.001 file - promoters60/1020460
agtgtatctct

SEQ ID NO: 96847 - DNA, 6 bp, Unknown
  misc_feature (1)..( 6): Result.001 file - promoters60/1020460
ttatga

SEQ ID NO: 96848 - DNA, 6 bp, Unknown
  misc_feature (1)..( 6): Result.001 file - promoters60/1020460
ttatga

SEQ ID NO: 96849 - DNA, 7 bp, Unknown
  misc_feature (1)..( 7): Result.001 file - promoters60/1020460
cttaata

SEQ ID NO: 96850 - DNA, 7 bp, Unknown
  misc_feature (1)..( 7): Result.001 file - promoters60/1020460
ctttata

SEQ ID NO: 96851 - DNA, 7 bp, Unknown
  misc_feature (1)..( 7): Result.001 file - promoters60/1020460
gtgtaaa

SEQ ID NO: 96852 - DNA, 7 bp, Unknown
  misc_feature (1)..( 7): Result.001 file - promoters60/1020460
gtgaaaa

SEQ ID NO: 96853 - DNA, 6 bp, Unknown
  misc_feature (1)..( 6): Result.001 file - promoters60/1020460
agacaa

SEQ ID NO: 96854 - DNA, 6 bp, Unknown
  misc_feature (1)..( 6): Result.001 file - promoters60/1020460
agacaa

SEQ ID NO: 96855 - DNA, 6 bp, Unknown
  misc_feature (1)..( 6): Result.001 file - promoters60/1020460
ttctta

SEQ ID NO: 96856 - DNA, 6 bp, Unknown
  misc_feature (1)..( 6): Result.001 file - promoters60/1020460
ttctta

SEQ ID NO: 96857 - DNA, 8 bp, Unknown
  misc_feature (1)..( 8): Result.001 file - promoters60/1020460
ataaacaa

SEQ ID NO: 96858 - DNA, 8 bp, Unknown
  misc_feature (1)..( 8): Result.001 file - promoters60/1020460
atatacaa

SEQ ID NO: 96859 - DNA, 7 bp, Unknown
  misc_feature (1)..( 7): Result.001 file - promoters60/1020460
aaatcca

SEQ ID NO: 96860 - DNA, 7 bp, Unknown
  misc_feature (1)..( 7): Result.001 file - promoters60/1020460
aaatcca

SEQ ID NO: 96861 - DNA, 6 bp, Unknown
  misc_feature (1)..( 6): Result.001 file - promoters60/1020460
tcaaac

SEQ ID NO: 96862 - DNA, 6 bp, Unknown
  misc_feature (1)..( 6): Result.001 file - promoters60/1020460
tcaaac

SEQ ID NO: 96863 - DNA, 7 bp, Unknown
  misc_feature (1)..( 7): Result.001 file - promoters60/1020460
attattc

SEQ ID NO: 96864 - DNA, 7 bp, Unknown
  misc_feature (1)..( 7): Result.001 file - promoters60/1020460
atttttc

SEQ ID NO: 96865 - DNA, 7 bp, Unknown
  misc_feature (1)..( 7): Result.001 file - promoters60/1020460
atgatat

SEQ ID NO: 96866 - DNA, 7 bp, Unknown
  misc_feature (1)..( 7): Result.001 file - promoters60/1020460
atggtat

SEQ ID NO: 96867 - DNA, 6 bp, Unknown
  misc_feature (1)..( 6): Result.001 file - promoters60/1020460
atctgg

SEQ ID NO: 96868 - DNA, 6 bp, Unknown
  misc_feature (1)..( 6): Result.001 file - promoters60/1020460
atctgg

SEQ ID NO: 96869 - DNA, 6 bp, Unknown
  misc_feature (1)..( 6): Result.001 file - promoters60/1020460
attatt

SEQ ID NO: 96870 - DNA, 6 bp, Unknown
  misc_feature (1)..( 6): Result.001 file - promoters60/1020460
attatt

SEQ ID NO: 96871 - DNA, 7 bp, Unknown
  misc_feature (1)..( 7): Result.001 file - promoters60/1020460
tctcaaa

SEQ ID NO: 96872 - DNA, 7 bp, Unknown
  misc_feature (1)..( 7): Result.001 file - promoters60/1020460
tctaaaa

SEQ ID NO: 96873 - DNA, 7 bp, Unknown
  misc_feature (1)..( 7): Result.001 file - promoters60/1020460
tgtttca

SEQ ID NO: 96874 - DNA, 7 bp, Unknown
  misc_feature (1)..( 7): Result.001 file - promoters60/1020508
tgtgtca

SEQ ID NO: 96875 - DNA, 7 bp, Unknown
  misc_feature (1)..( 7): Result.001 file - promoters60/1020508
ttaagaa

SEQ ID NO: 96876 - DNA, 7 bp, Unknown
  misc_feature (1)..( 7): Result.001 file - promoters60/1020508
ttatgaa

SEQ ID NO: 96877 - DNA, 6 bp, Unknown
  misc_feature (1)..( 6): Result.001 file - promoters60/1020508
gctaat

SEQ ID NO: 96878 - DNA, 6 bp, Unknown
  misc_feature (1)..( 6): Result.001 file - promoters60/1020508
gctaat

SEQ ID NO: 96879 - DNA, 6 bp, Unknown
  misc_feature (1)..( 6): Result.001 file - promoters60/1020508
taatga

SEQ ID NO: 96880 - DNA, 6 bp, Unknown
  misc_feature (1)..( 6): Result.001 file - promoters60/1020508
taatga

SEQ ID NO: 96881 - DNA, 9 bp, Unknown
  misc_feature (1)..( 9): Result.001 file - promoters60/1020508
acaacatta

SEQ ID NO: 96882 - DNA, 9 bp, Unknown
  misc_feature (1)..( 9): Result.001 file - promoters60/1020508
acaaaattg

SEQ ID NO: 96883 - DNA, 9 bp, Unknown
  misc_feature (1)..( 9): Result.001 file - promoters60/1020508
gatacatta

SEQ ID NO: 96884 - DNA, 6 bp, Unknown
  misc_feature (1)..( 6): Result.001 file - promoters60/1020508
tatatt

SEQ ID NO: 96885 - DNA, 6 bp, Unknown
  misc_feature (1)..( 6): Result.001 file - promoters60/1020508
tatatt

SEQ ID NO: 96886 - DNA, 11 bp, Unknown
  misc_feature (1)..( 11): Result.001 file - promoters60/1020508
tatttggattt

SEQ ID NO: 96887 - DNA, 11 bp, Unknown
  misc_feature (1)..( 11): Result.001 file - promoters60/1020508
tattttgattt

SEQ ID NO: 96888 - DNA, 6 bp, Unknown
  misc_feature (1)..( 6): Result.001 file - promoters60/1020508
ttcttc

SEQ ID NO: 96889 - DNA, 6 bp, Unknown
  misc_feature (1)..( 6): Result.001 file - promoters60/1020508
ttcttc

SEQ ID NO: 96890 - DNA, 6 bp, Unknown
  misc_feature (1)..( 6): Result.001 file - promoters60/1020508
tcattt

SEQ ID NO: 96891 - DNA, 6 bp, Unknown
  misc_feature (1)..( 6): Result.001 file - promoters60/1020508
tcattt

SEQ ID NO: 96892 - DNA, 6 bp, Unknown
  misc_feature (1)..( 6): Result.001 file - promoters60/1020508
aatgaa

SEQ ID NO: 96893 - DNA, 6 bp, Unknown
  misc_feature (1)..( 6): Result.001 file - promoters60/1020508
aatgaa

SEQ ID NO: 96894 - DNA, 7 bp, Unknown
  misc_feature (1)..( 7): Result.001 file - promoters60/1020508
caagtat

SEQ ID NO: 96895 - DNA, 7 bp, Unknown
  misc_feature (1)..( 7): Result.001 file - promoters60/1020508
caaatat

SEQ ID NO: 96896 - DNA, 7 bp, Unknown
  misc_feature (1)..( 7): Result.001 file - promoters60/1020508
tgcttac

SEQ ID NO: 96897 - DNA, 7 bp, Unknown
  misc_feature (1)..( 7): Result.001 file - promoters60/1020508
tgcatac

SEQ ID NO: 96898 - DNA, 6 bp, Unknown
  misc_feature (1)..( 6): Result.001 file - promoters60/1020508
cattat

SEQ ID NO: 96899 - DNA, 6 bp, Unknown
  misc_feature (1)..( 6): Result.001 file - promoters60/1020508
cattat

SEQ ID NO: 96900 - DNA, 8 bp, Unknown
  misc_feature (1)..( 8): Result.001 file - promoters60/1020508
ttactaca

SEQ ID NO: 96901 - DNA, 8 bp, Unknown
  misc_feature (1)..( 8): Result.001 file - promoters60/1020508
ttattaca

SEQ ID NO: 96902 - DNA, 8 bp, Unknown
  misc_feature (1)..( 8): Result.001 file - promoters60/1020508
atgttatt

SEQ ID NO: 96903 - DNA, 8 bp, Unknown
  misc_feature (1)..( 8): Result.001 file - promoters60/1020508
atgtcatt

SEQ ID NO: 96904 - DNA, 7 bp, Unknown
  misc_feature (1)..( 7): Result.001 file - promoters60/1020508
aaaagtt

SEQ ID NO: 96905 - DNA, 7 bp, Unknown
  misc_feature (1)..( 7): Result.001 file - promoters60/1020508
aaatgtt

SEQ ID NO: 96906 - DNA, 7 bp, Unknown
  misc_feature (1)..( 7): Result.001 file - promoters60/1020508
gaccctt

SEQ ID NO: 96907 - DNA, 7 bp, Unknown
  misc_feature (1)..( 7): Result.001 file - promoters60/1020508
gactctt

SEQ ID NO: 96908 - DNA, 7 bp, Unknown
  misc_feature (1)..( 7): Result.001 file - promoters60/1020508
atcgtaa

SEQ ID NO: 96909 - DNA, 7 bp, Unknown
  misc_feature (1)..( 7): Result.001 file - promoters60/1020508
atcttaa

SEQ ID NO: 96910 - DNA, 6 bp, Unknown
  misc_feature (1)..( 6): Result.001 file - promoters60/1020508
ataaat

SEQ ID NO: 96911 - DNA, 6 bp, Unknown
  misc_feature (1)..( 6): Result.001 file - promoters60/1020508
ataaat

SEQ ID NO: 96912 - DNA, 7 bp, Unknown
  misc_feature (1)..( 7): Result.001 file - promoters60/1020508
aacataa

SEQ ID NO: 96913 - DNA, 7 bp, Unknown
  misc_feature (1)..( 7): Result.001 file - promoters60/1020508
aacgtaa

SEQ ID NO: 96914 - DNA, 8 bp, Unknown
  misc_feature (1)..( 8): Result.001 file - promoters60/1020508
taaaatat

SEQ ID NO: 96915 - DNA, 8 bp, Unknown
  misc_feature (1)..( 8): Result.001 file - promoters60/1020512
taaaatat

SEQ ID NO: 96916 - DNA, 10 bp, Unknown
  misc_feature (1)..( 10): Result.001 file - promoters60/1020512
aactaatata

SEQ ID NO: 96917 - DNA, 10 bp, Unknown
  misc_feature (1)..( 10): Result.001 file - promoters60/1020512
aacaaatata

SEQ ID NO: 96918 - DNA, 10 bp, Unknown
  misc_feature (1)..( 10): Result.001 file - promoters60/1020512
ctctaatatg

SEQ ID NO: 96919 - DNA, 10 bp, Unknown
  misc_feature (1)..( 10): Result.001 file - promoters60/1020512
tgcaaagaaa

SEQ ID NO: 96920 - DNA, 10 bp, Unknown
  misc_feature (1)..( 10): Result.001 file - promoters60/1020512
taaagtcatc

SEQ ID NO: 96921 - DNA, 10 bp, Unknown
  misc_feature (1)..( 10): Result.001 file - promoters60/1020512
aaaagtctaa

SEQ ID NO: 96922 - DNA, 11 bp, Unknown
  misc_feature (1)..( 11): Result.001 file - promoters60/1020512
aaatagtttaa

SEQ ID NO: 96923 - DNA, 10 bp, Unknown
  misc_feature (1)..( 10): Result.001 file - promoters60/1020512
tattttccag

SEQ ID NO: 96924 - DNA, 10 bp, Unknown
  misc_feature (1)..( 10): Result.001 file - promoters60/1020512
tctttgccaa

SEQ ID NO: 96925 - DNA, 10 bp, Unknown
  misc_feature (1)..( 10): Result.001 file - promoters60/1020543
tatttttcag

SEQ ID NO: 96926 - DNA, 7 bp, Unknown
  misc_feature (1)..( 7): Result.001 file - promoters60/1020543
ttttttg

SEQ ID NO: 96927 - DNA, 7 bp, Unknown
  misc_feature (1)..( 7): Result.001 file - promoters60/1020543
tttgttg

SEQ ID NO: 96928 - DNA, 6 bp, Unknown
  misc_feature (1)..( 6): Result.001 file - promoters60/1020543
caaaaa

SEQ ID NO: 96929 - DNA, 6 bp, Unknown
  misc_feature (1)..( 6): Result.001 file - promoters60/1020543
caaaaa

SEQ ID NO: 96930 - DNA, 10 bp, Unknown
  misc_feature (1)..( 10): Result.001 file - promoters60/1020543
tttgaaaaga

SEQ ID NO: 96931 - DNA, 10 bp, Unknown
  misc_feature (1)..( 10): Result.001 file - promoters60/1020543
aaaaaaaaga

SEQ ID NO: 96932 - DNA, 11 bp, Unknown
  misc_feature (1)..( 11): Result.001 file - promoters60/1020543
gaagaaacaga

SEQ ID NO: 96933 - DNA, 8 bp, Unknown
  misc_feature (1)..( 8): Result.001 file - promoters60/1020543
caattatt

SEQ ID NO: 96934 - DNA, 8 bp, Unknown
  misc_feature (1)..( 8): Result.001 file - promoters60/1020543
caactatt

SEQ ID NO: 96935 - DNA, 7 bp, Unknown
  misc_feature (1)..( 7): Result.001 file - promoters60/1020543
ttttatg

SEQ ID NO: 96936 - DNA, 7 bp, Unknown
  misc_feature (1)..( 7): Result.001 file - promoters60/1020543
tttcatg

SEQ ID NO: 96937 - DNA, 6 bp, Unknown
  misc_feature (1)..( 6): Result.001 file - promoters60/1020543
taaaaa

SEQ ID NO: 96938 - DNA, 6 bp, Unknown
  misc_feature (1)..( 6): Result.001 file - promoters60/1020543
taaaaa

SEQ ID NO: 96939 - DNA, 8 bp, Unknown
  misc_feature (1)..( 8): Result.001 file - promoters60/1020543
tcgacatg

SEQ ID NO: 96940 - DNA, 8 bp, Unknown
  misc_feature (1)..( 8): Result.001 file - promoters60/1020543
tcgacatg

SEQ ID NO: 96941 - DNA, 7 bp, Unknown
  misc_feature (1)..( 7): Result.001 file - promoters60/1020543
acgtggt

SEQ ID NO: 96942 - DNA, 7 bp, Unknown
  misc_feature (1)..( 7): Result.001 file - promoters60/1020543
acgtggt

SEQ ID NO: 96943 - DNA, 6 bp, Unknown
  misc_feature (1)..( 6): Result.001 file - promoters60/1020543
ggtgga

SEQ ID NO: 96944 - DNA, 6 bp, Unknown
  misc_feature (1)..( 6): Result.001 file - promoters60/1020543
ggtgga

SEQ ID NO: 96945 - DNA, 6 bp, Unknown
  misc_feature (1)..( 6): Result.001 file - promoters60/1020543
aaagaa

SEQ ID NO: 96946 - DNA, 6 bp, Unknown
  misc_feature (1)..( 6): Result.001 file - promoters60/1020543
aaagaa

SEQ ID NO: 96947 - DNA, 6 bp, Unknown
  misc_feature (1)..( 6): Result.001 file - promoters60/1020543
acaaca

SEQ ID NO: 96948 - DNA, 6 bp, Unknown
  misc_feature (1)..( 6): Result.001 file - promoters60/1020543
acaaca

SEQ ID NO: 96949 - DNA, 12 bp, Unknown
  misc_feature (1)..( 12): Result.001 file - promoters60/1020543
tgaaaagatgaa

SEQ ID NO: 96950 - DNA, 12 bp, Unknown
  misc_feature (1)..( 12): Result.001 file - promoters60/1020543
acacaagaagaa

SEQ ID NO: 96951 - DNA, 12 bp, Unknown
  misc_feature (1)..( 12): Result.001 file - promoters60/1020543
gaaaaaaaagaa

SEQ ID NO: 96952 - DNA, 9 bp, Unknown
  misc_feature (1)..( 9): Result.001 file - promoters60/1020543
atgataaga

SEQ ID NO: 96953 - DNA, 9 bp, Unknown
  misc_feature (1)..( 9): Result.001 file - promoters60/1020543
atgatgaga

SEQ ID NO: 96954 - DNA, 6 bp, Unknown
  misc_feature (1)..( 6): Result.001 file - promoters60/1020543
aataaa

SEQ ID NO: 96955 - DNA, 6 bp, Unknown
  misc_feature (1)..( 6): Result.001 file - promoters60/1020543
aataaa

SEQ ID NO: 96956 - DNA, 6 bp, Unknown
  misc_feature (1)..( 6): Result.001 file - promoters60/1020543
aactag

SEQ ID NO: 96957 - DNA, 6 bp, Unknown
  misc_feature (1)..( 6): Result.001 file - promoters60/1020543
aactag

SEQ ID NO: 96958 - DNA, 7 bp, Unknown
  misc_feature (1)..( 7): Result.001 file - promoters60/1020543
aattttg

SEQ ID NO: 96959 - DNA, 7 bp, Unknown
  misc_feature (1)..( 7): Result.001 file - promoters60/1020543
aatgttg

SEQ ID NO: 96960 - DNA, 8 bp, Unknown
  misc_feature (1)..( 8): Result.001 file - promoters60/1020543
tggtaaag

SEQ ID NO: 96961 - DNA, 8 bp, Unknown
  misc_feature (1)..( 8): Result.001 file - promoters60/1020543
tggcaaag

SEQ ID NO: 96962 - DNA, 7 bp, Unknown
  misc_feature (1)..( 7): Result.001 file - promoters60/1020543
cgttttc

SEQ ID NO: 96963 - DNA, 7 bp, Unknown
  misc_feature (1)..( 7): Result.001 file - promoters60/1020557
cgtcttc

SEQ ID NO: 96964 - DNA, 6 bp, Unknown
  misc_feature (1)..( 6): Result.001 file - promoters60/1020557
atgaaa

SEQ ID NO: 96965 - DNA, 6 bp, Unknown
  misc_feature (1)..( 6): Result.001 file - promoters60/1020557
atgaaa

SEQ ID NO: 96966 - DNA, 6 bp, Unknown
  misc_feature (1)..( 6): Result.001 file - promoters60/1020557
atttta

SEQ ID NO: 96967 - DNA, 6 bp, Unknown
  misc_feature (1)..( 6): Result.001 file - promoters60/1020557
atttta

SEQ ID NO: 96968 - DNA, 7 bp, Unknown
  misc_feature (1)..( 7): Result.001 file - promoters60/1020557
tatctat

SEQ ID NO: 96969 - DNA, 7 bp, Unknown
  misc_feature (1)..( 7): Result.001 file - promoters60/1020557
tatatat

SEQ ID NO: 96970 - DNA, 21 bp, Unknown
  misc_feature (1)..( 21): Result.001 file - promoters60/1020557
aaaaataacattcatttacta

SEQ ID NO: 96971 - DNA, 21 bp, Unknown
  misc_feature (1)..( 21): Result.001 file - promoters60/1020557
aaaaacaacattcatttacta

SEQ ID NO: 96972 - DNA, 6 bp, Unknown
  misc_feature (1)..( 6): Result.001 file - promoters60/1020557
atcatc

SEQ ID NO: 96973 - DNA, 6 bp, Unknown
  misc_feature (1)..( 6): Result.001 file - promoters60/1020557
atcatc

SEQ ID NO: 96974 - DNA, 6 bp, Unknown
  misc_feature (1)..( 6): Result.001 file - promoters60/1020557
atcatc

SEQ ID NO: 96975 - DNA, 6 bp, Unknown
  misc_feature (1)..( 6): Result.001 file - promoters60/1020557
atcatc

SEQ ID NO: 96976 - DNA, 22 bp, Unknown
  misc_feature (1)..( 22): Result.001 file - promoters60/1020557
aaatataaccaactttgaaatc

SEQ ID NO: 96977 - DNA, 22 bp, Unknown
  misc_feature (1)..( 22): Result.001 file - promoters60/1020557
aaatataaccaagtttgaaatc

SEQ ID NO: 96978 - DNA, 15 bp, Unknown
  misc_feature (1)..( 15): Result.001 file - promoters60/1020557
tctctactatataaa

SEQ ID NO: 96979 - DNA, 15 bp, Unknown
  misc_feature (1)..( 15): Result.001 file - promoters60/1020557
tctctactatataaa

SEQ ID NO: 96980 - DNA, 15 bp, Unknown
  misc_feature (1)..( 15): Result.001 file - promoters60/1020557
tttctaatataaaac

SEQ ID NO: 96981 - DNA, 7 bp, Unknown
  misc_feature (1)..( 7): Result.001 file - promoters60/1020557
agagatc

SEQ ID NO: 96982 - DNA, 7 bp, Unknown
  misc_feature (1)..( 7): Result.001 file - promoters60/1020557
agagatc

SEQ ID NO: 96983 - DNA, 7 bp, Unknown
  misc_feature (1)..( 7): Result.001 file - promoters60/1020557
atcaaaa

SEQ ID NO: 96984 - DNA, 7 bp, Unknown
  misc_feature (1)..( 7): Result.001 file - promoters60/1020557
atccaaa

SEQ ID NO: 96985 - DNA, 6 bp, Unknown
  misc_feature (1)..( 6): Result.001 file - promoters60/1020557
tagaaa

SEQ ID NO: 96986 - DNA, 6 bp, Unknown
  misc_feature (1)..( 6): Result.001 file - promoters60/1020557
tagaaa

SEQ ID NO: 96987 - DNA, 6 bp, Unknown
  misc_feature (1)..( 6): Result.001 file - promoters60/1020557
attttt

SEQ ID NO: 96988 - DNA, 6 bp, Unknown
  misc_feature (1)..( 6): Result.001 file - promoters60/1020596
attttt

SEQ ID NO: 96989 - DNA, 10 bp, Unknown
  misc_feature (1)..( 10): Result.001 file - promoters60/1020596
tatcttacct

SEQ ID NO: 96990 - DNA, 10 bp, Unknown
  misc_feature (1)..( 10): Result.001 file - promoters60/1020596
tatcttttaa

SEQ ID NO: 96991 - DNA, 10 bp, Unknown
  misc_feature (1)..( 10): Result.001 file - promoters60/1020596
aatcttgcct

SEQ ID NO: 96992 - DNA, 10 bp, Unknown
  misc_feature (1)..( 10): Result.001 file - promoters60/1020596
aatcttttaa

SEQ ID NO: 96993 - DNA, 9 bp, Unknown
  misc_feature (1)..( 9): Result.001 file - promoters60/1020596
tatggaaag

SEQ ID NO: 96994 - DNA, 9 bp, Unknown
  misc_feature (1)..( 9): Result.001 file - promoters60/1020596
tattgaaag

SEQ ID NO: 96995 - DNA, 9 bp, Unknown
  misc_feature (1)..( 9): Result.001 file - promoters60/1020596
aatggaagt

SEQ ID NO: 96996 - DNA, 9 bp, Unknown
  misc_feature (1)..( 9): Result.001 file - promoters60/1020596
gaagaaatg

SEQ ID NO: 96997 - DNA, 9 bp, Unknown
  misc_feature (1)..( 9): Result.001 file - promoters60/1020596
gaagaattc

SEQ ID NO: 96998 - DNA, 9 bp, Unknown
  misc_feature (1)..( 9): Result.001 file - promoters60/1020596
aaagatatg

SEQ ID NO: 96999 - DNA, 8 bp, Unknown
  misc_feature (1)..( 8): Result.001 file - promoters60/1020596
ccgataaa

SEQ ID NO: 97000 - DNA, 8 bp, Unknown
  misc_feature (1)..( 8): Result.001 file - promoters60/1020596
ccgaaaaa

SEQ ID NO: 97001 - DNA, 8 bp, Unknown
  misc_feature (1)..( 8): Result.001 file - promoters60/1020619
cagaaaaa

SEQ ID NO: 97002 - DNA, 14 bp, Unknown
  misc_feature (1)..( 14): Result.001 file - promoters60/1020619
caatttaataccct

SEQ ID NO: 97003 - DNA, 14 bp, Unknown
  misc_feature (1)..( 14): Result.001 file - promoters60/1020619
gattttcataacaa

SEQ ID NO: 97004 - DNA, 14 bp, Unknown
  misc_feature (1)..( 14): Result.001 file - promoters60/1020619
aaattaaatcatct

SEQ ID NO: 97005 - DNA, 14 bp, Unknown
  misc_feature (1)..( 14): Result.001 file - promoters60/1020619
ctatttaaaagtat

SEQ ID NO: 97006 - DNA, 14 bp, Unknown
  misc_feature (1)..( 14): Result.001 file - promoters60/1020619
agagttaatagcct

SEQ ID NO: 97007 - DNA, 14 bp, Unknown
  misc_feature (1)..( 14): Result.001 file - promoters60/1020619
aaacttaatcctga

SEQ ID NO: 97008 - DNA, 14 bp, Unknown
  misc_feature (1)..( 14): Result.001 file - promoters60/1020619
agattaaaaacttt

SEQ ID NO: 97009 - DNA, 13 bp, Unknown
  misc_feature (1)..( 13): Result.001 file - promoters60/1020619
ctcctataaattg

SEQ ID NO: 97010 - DNA, 13 bp, Unknown
  misc_feature (1)..( 13): Result.001 file - promoters60/1020619
ggtgtataaattg

SEQ ID NO: 97011 - DNA, 13 bp, Unknown
  misc_feature (1)..( 13): Result.001 file - promoters60/1020619
agcctttaaaaaa

SEQ ID NO: 97012 - DNA, 13 bp, Unknown
  misc_feature (1)..( 13): Result.001 file - promoters60/1020619
ctcttatatattc

SEQ ID NO: 97013 - DNA, 13 bp, Unknown
  misc_feature (1)..( 13): Result.001 file - promoters60/1020619
ttcctatatatca

SEQ ID NO: 97014 - DNA, 13 bp, Unknown
  misc_feature (1)..( 13): Result.001 file - promoters60/1020619
cttctatatatat

SEQ ID NO: 97015 - DNA, 16 bp, Unknown
  misc_feature (1)..( 16): Result.001 file - promoters60/1020619
tctcttttttttttta

SEQ ID NO: 97016 - DNA, 16 bp, Unknown
  misc_feature (1)..( 16): Result.001 file - promoters60/1020619
tctcgtttatttactc

SEQ ID NO: 97017 - DNA, 16 bp, Unknown
  misc_feature (1)..( 16): Result.001 file - promoters60/1020619
gaaaaattattttcaa

SEQ ID NO: 97018 - DNA, 16 bp, Unknown
  misc_feature (1)..( 16): Result.001 file - promoters60/1020619
gaattggtatttacta

SEQ ID NO: 97019 - DNA, 16 bp, Unknown
  misc_feature (1)..( 16): Result.001 file - promoters60/1020619
aagtttttatttcatt

SEQ ID NO: 97020 - DNA, 16 bp, Unknown
  misc_feature (1)..( 16): Result.001 file - promoters60/1020619
gagcaatgatggctcg

SEQ ID NO: 97021 - DNA, 16 bp, Unknown
  misc_feature (1)..( 16): Result.001 file - promoters60/1020634
actctcctatggctaa

SEQ ID NO: 97022 - DNA, 10 bp, Unknown
  misc_feature (1)..( 10): Result.001 file - promoters60/1020634
taaagacttc

SEQ ID NO: 97023 - DNA, 10 bp, Unknown
  misc_feature (1)..( 10): Result.001 file - promoters60/1020634
aaaatactca

SEQ ID NO: 97024 - DNA, 10 bp, Unknown
  misc_feature (1)..( 10): Result.001 file - promoters60/1020634
attataatca

SEQ ID NO: 97025 - DNA, 10 bp, Unknown
  misc_feature (1)..( 10): Result.001 file - promoters60/1020634
aaaatagata

SEQ ID NO: 97026 - DNA, 10 bp, Unknown
  misc_feature (1)..( 10): Result.001 file - promoters60/1020634
aaaataacgc

SEQ ID NO: 97027 - DNA, 9 bp, Unknown
  misc_feature (1)..( 9): Result.001 file - promoters60/1020634
taacaaatt

SEQ ID NO: 97028 - DNA, 9 bp, Unknown
  misc_feature (1)..( 9): Result.001 file - promoters60/1020634
cgacaaatg

SEQ ID NO: 97029 - DNA, 9 bp, Unknown
  misc_feature (1)..( 9): Result.001 file - promoters60/1020634
tttcaaatt

SEQ ID NO: 97030 - DNA, 9 bp, Unknown
  misc_feature (1)..( 9): Result.001 file - promoters60/1020634
tgtcatatt

SEQ ID NO: 97031 - DNA, 9 bp, Unknown
  misc_feature (1)..( 9): Result.001 file - promoters60/1020634
gctcagatt

SEQ ID NO: 97032 - DNA, 9 bp, Unknown
  misc_feature (1)..( 9): Result.001 file - promoters60/1020634
gctcagatt

SEQ ID NO: 97033 - DNA, 9 bp, Unknown
  misc_feature (1)..( 9): Result.001 file - promoters60/1020634
cgaaaaaaa

SEQ ID NO: 97034 - DNA, 9 bp, Unknown
  misc_feature (1)..( 9): Result.001 file - promoters60/1020634
gttttaaaa

SEQ ID NO: 97035 - DNA, 9 bp, Unknown
  misc_feature (1)..( 9): Result.001 file - promoters60/1020634
cctttaaac

SEQ ID NO: 97036 - DNA, 9 bp, Unknown
  misc_feature (1)..( 9): Result.001 file - promoters60/1020634
tttttaaaa

SEQ ID NO: 97037 - DNA, 9 bp, Unknown
  misc_feature (1)..( 9): Result.001 file - promoters60/1020634
tttctaata

SEQ ID NO: 97038 - DNA, 9 bp, Unknown
  misc_feature (1)..( 9): Result.001 file - promoters60/1020634
actttaaaa

SEQ ID NO: 97039 - DNA, 14 bp, Unknown
  misc_feature (1)..( 14): Result.001 file - promoters60/1020634
gttttaaaatagta

SEQ ID NO: 97040 - DNA, 14 bp, Unknown
  misc_feature (1)..( 14): Result.001 file - promoters60/1020634
cttttcaaattgtg

SEQ ID NO: 97041 - DNA, 14 bp, Unknown
  misc_feature (1)..( 14): Result.001 file - promoters60/1020634
tgtttgaaactgat

SEQ ID NO: 97042 - DNA, 14 bp, Unknown
  misc_feature (1)..( 14): Result.001 file - promoters60/1020634
gatgtcatattcgt

SEQ ID NO: 97043 - DNA, 14 bp, Unknown
  misc_feature (1)..( 14): Result.001 file - promoters60/1020634
aagctcagattagt

SEQ ID NO: 97044 - DNA, 14 bp, Unknown
  misc_feature (1)..( 14): Result.001 file - promoters60/1020634
ggatagagataagt

SEQ ID NO: 97045 - DNA, 8 bp, Unknown
  misc_feature (1)..( 8): Result.001 file - promoters60/1020634
taaaaact

SEQ ID NO: 97046 - DNA, 8 bp, Unknown
  misc_feature (1)..( 8): Result.001 file - promoters60/1020634
taaaaatt

SEQ ID NO: 97047 - DNA, 8 bp, Unknown
  misc_feature (1)..( 8): Result.001 file - promoters60/1020634
taataatt

SEQ ID NO: 97048 - DNA, 8 bp, Unknown
  misc_feature (1)..( 8): Result.001 file - promoters60/1020634
taaacatt

SEQ ID NO: 97049 - DNA, 8 bp, Unknown
  misc_feature (1)..( 8): Result.001 file - promoters60/1020634
aaaagatt

SEQ ID NO: 97050 - DNA, 10 bp, Unknown
  misc_feature (1)..( 10): Result.001 file - promoters60/1020634
tttagaatcc

SEQ ID NO: 97051 - DNA, 10 bp, Unknown
  misc_feature (1)..( 10): Result.001 file - promoters60/1020634
aaaagattcc

SEQ ID NO: 97052 - DNA, 10 bp, Unknown
  misc_feature (1)..( 10): Result.001 file - promoters60/1020634
tttaaaatca

SEQ ID NO: 97053 - DNA, 10 bp, Unknown
  misc_feature (1)..( 10): Result.001 file - promoters60/1020634
atcgaaatca

SEQ ID NO: 97054 - DNA, 11 bp, Unknown
  misc_feature (1)..( 11): Result.001 file - promoters60/1020642
tttaaacatta

SEQ ID NO: 97055 - DNA, 6 bp, Unknown
  misc_feature (1)..( 6): Result.001 file - promoters60/1020642
ttttac

SEQ ID NO: 97056 - DNA, 6 bp, Unknown
  misc_feature (1)..( 6): Result.001 file - promoters60/1020642
ttttac

SEQ ID NO: 97057 - DNA, 9 bp, Unknown
  misc_feature (1)..( 9): Result.001 file - promoters60/1020642
aaacaaata

SEQ ID NO: 97058 - DNA, 9 bp, Unknown
  misc_feature (1)..( 9): Result.001 file - promoters60/1020642
aaataaata

SEQ ID NO: 97059 - DNA, 8 bp, Unknown
  misc_feature (1)..( 8): Result.001 file - promoters60/1020642
agagaaaa

SEQ ID NO: 97060 - DNA, 8 bp, Unknown
  misc_feature (1)..( 8): Result.001 file - promoters60/1020642
agaaaaaa

SEQ ID NO: 97061 - DNA, 8 bp, Unknown
  misc_feature (1)..( 8): Result.001 file - promoters60/1020642
aattcttg

SEQ ID NO: 97062 - DNA, 8 bp, Unknown
  misc_feature (1)..( 8): Result.001 file - promoters60/1020642
aatttttg

SEQ ID NO: 97063 - DNA, 7 bp, Unknown
  misc_feature (1)..( 7): Result.001 file - promoters60/1020642
ttgtttt

SEQ ID NO: 97064 - DNA, 7 bp, Unknown
  misc_feature (1)..( 7): Result.001 file - promoters60/1020642
ttgattt

SEQ ID NO: 97065 - DNA, 8 bp, Unknown
  misc_feature (1)..( 8): Result.001 file - promoters60/1020642
catcgtct

SEQ ID NO: 97066 - DNA, 8 bp, Unknown
  misc_feature (1)..( 8): Result.001 file - promoters60/1020642
catcttct

SEQ ID NO: 97067 - DNA, 6 bp, Unknown
  misc_feature (1)..( 6): Result.001 file - promoters60/1020642
tctaac

SEQ ID NO: 97068 - DNA, 6 bp, Unknown
  misc_feature (1)..( 6): Result.001 file - promoters60/1020642
tctaac

SEQ ID NO: 97069 - DNA, 9 bp, Unknown
  misc_feature (1)..( 9): Result.001 file - promoters60/1020642
ttttccgct

SEQ ID NO: 97070 - DNA, 9 bp, Unknown
  misc_feature (1)..( 9): Result.001 file - promoters60/1020646
ttttcagct

SEQ ID NO: 97071 - DNA, 11 bp, Unknown
  misc_feature (1)..( 11): Result.001 file - promoters60/1020646
aataatttgta

SEQ ID NO: 97072 - DNA, 11 bp, Unknown
  misc_feature (1)..( 11): Result.001 file - promoters60/1020646
aatattttagg

SEQ ID NO: 97073 - DNA, 11 bp, Unknown
  misc_feature (1)..( 11): Result.001 file - promoters60/1020646
aattattggta

SEQ ID NO: 97074 - DNA, 7 bp, Unknown
  misc_feature (1)..( 7): Result.001 file - promoters60/1020646
ttgtaac

SEQ ID NO: 97075 - DNA, 7 bp, Unknown
  misc_feature (1)..( 7): Result.001 file - promoters60/1020646
ttgtaac

SEQ ID NO: 97076 - DNA, 7 bp, Unknown
  misc_feature (1)..( 7): Result.001 file - promoters60/1020646
atagaaa

SEQ ID NO: 97077 - DNA, 7 bp, Unknown
  misc_feature (1)..( 7): Result.001 file - promoters60/1020646
atacaaa

SEQ ID NO: 97078 - DNA, 6 bp, Unknown
  misc_feature (1)..( 6): Result.001 file - promoters60/1020646
aaaaaa

SEQ ID NO: 97079 - DNA, 6 bp, Unknown
  misc_feature (1)..( 6): Result.001 file - promoters60/1020646
aaaaaa

SEQ ID NO: 97080 - DNA, 9 bp, Unknown
  misc_feature (1)..( 9): Result.001 file - promoters60/1020646
atcaatcat

SEQ ID NO: 97081 - DNA, 9 bp, Unknown
  misc_feature (1)..( 9): Result.001 file - promoters60/1020646
atctatcat

SEQ ID NO: 97082 - DNA, 8 bp, Unknown
  misc_feature (1)..( 8): Result.001 file - promoters60/1020646
ttagttta

SEQ ID NO: 97083 - DNA, 8 bp, Unknown
  misc_feature (1)..( 8): Result.001 file - promoters60/1020646
ttagttta

SEQ ID NO: 97084 - DNA, 7 bp, Unknown
  misc_feature (1)..( 7): Result.001 file - promoters60/1020646
aacagaa

SEQ ID NO: 97085 - DNA, 7 bp, Unknown
  misc_feature (1)..( 7): Result.001 file - promoters60/1020646
aacagaa

SEQ ID NO: 97086 - DNA, 6 bp, Unknown
  misc_feature (1)..( 6): Result.001 file - promoters60/1020646
ctctta

SEQ ID NO: 97087 - DNA, 6 bp, Unknown
  misc_feature (1)..( 6): Result.001 file - promoters60/1020646
ctctta

SEQ ID NO: 97088 - DNA, 6 bp, Unknown
  misc_feature (1)..( 6): Result.001 file - promoters60/1020646
atcatt

SEQ ID NO: 97089 - DNA, 6 bp, Unknown
  misc_feature (1)..( 6): Result.001 file - promoters60/1020646
atcatt

SEQ ID NO: 97090 - DNA, 6 bp, Unknown
  misc_feature (1)..( 6): Result.001 file - promoters60/1020646
cattat

SEQ ID NO: 97091 - DNA, 6 bp, Unknown
  misc_feature (1)..( 6): Result.001 file - promoters60/1020646
cattat

SEQ ID NO: 97092 - DNA, 7 bp, Unknown
  misc_feature (1)..( 7): Result.001 file - promoters60/1020646
gaacaaa

SEQ ID NO: 97093 - DNA, 7 bp, Unknown
  misc_feature (1)..( 7): Result.001 file - promoters60/1020646
gaaaaaa

SEQ ID NO: 97094 - DNA, 8 bp, Unknown
  misc_feature (1)..( 8): Result.001 file - promoters60/1020646
aacagtta

SEQ ID NO: 97095 - DNA, 8 bp, Unknown
  misc_feature (1)..( 8): Result.001 file - promoters60/1020646
aacggtta

SEQ ID NO: 97096 - DNA, 11 bp, Unknown
  misc_feature (1)..( 11): Result.001 file - promoters60/1020646
actaaccaaat

SEQ ID NO: 97097 - DNA, 11 bp, Unknown
  misc_feature (1)..( 11): Result.001 file - promoters60/1020646
actgacccaat

SEQ ID NO: 97098 - DNA, 7 bp, Unknown
  misc_feature (1)..( 7): Result.001 file - promoters60/1020646
ttattaa

SEQ ID NO: 97099 - DNA, 7 bp, Unknown
  misc_feature (1)..( 7): Result.001 file - promoters60/1020646
ttagtaa

SEQ ID NO: 97100 - DNA, 6 bp, Unknown
  misc_feature (1)..( 6): Result.001 file - promoters60/1020646
tttatt

SEQ ID NO: 97101 - DNA, 6 bp, Unknown
  misc_feature (1)..( 6): Result.001 file - promoters60/1020646
tttatt

SEQ ID NO: 97102 - DNA, 7 bp, Unknown
  misc_feature (1)..( 7): Result.001 file - promoters60/1020646
aaacaaa

SEQ ID NO: 97103 - DNA, 7 bp, Unknown
  misc_feature (1)..( 7): Result.001 file - promoters60/1020646
aaataaa

SEQ ID NO: 97104 - DNA, 6 bp, Unknown
  misc_feature (1)..( 6): Result.001 file - promoters60/1020646
catgaa

SEQ ID NO: 97105 - DNA, 6 bp, Unknown
  misc_feature (1)..( 6): Result.001 file - promoters60/1020646
catgaa

SEQ ID NO: 97106 - DNA, 6 bp, Unknown
  misc_feature (1)..( 6): Result.001 file - promoters60/1020646
tcccaa

SEQ ID NO: 97107 - DNA, 6 bp, Unknown
  misc_feature (1)..( 6): Result.001 file - promoters60/1020646
tcccaa

SEQ ID NO: 97108 - DNA, 6 bp, Unknown
  misc_feature (1)..( 6): Result.001 file - promoters60/1020646
agaaaa

SEQ ID NO: 97109 - DNA, 6 bp, Unknown
  misc_feature (1)..( 6): Result.001 file - promoters60/1020646
agaaaa

SEQ ID NO: 97110 - DNA, 8 bp, Unknown
  misc_feature (1)..( 8): Result.001 file - promoters60/1020646
gcatccaa

SEQ ID NO: 97111 - DNA, 8 bp, Unknown
  misc_feature (1)..( 8): Result.001 file - promoters60/1020666
gcattcaa

SEQ ID NO: 97112 - DNA, 10 bp, Unknown
  misc_feature (1)..( 10): Result.001 file - promoters60/1020666
agatatttag

SEQ ID NO: 97113 - DNA, 10 bp, Unknown
  misc_feature (1)..( 10): Result.001 file - promoters60/1020666
tgatctttag

SEQ ID NO: 97114 - DNA, 10 bp, Unknown
  misc_feature (1)..( 10): Result.001 file - promoters60/1020666
agaaattttt

SEQ ID NO: 97115 - DNA, 11 bp, Unknown
  misc_feature (1)..( 11): Result.001 file - promoters60/1020666
aataaatttag

SEQ ID NO: 97116 - DNA, 11 bp, Unknown
  misc_feature (1)..( 11): Result.001 file - promoters60/1020666
caaaagtttat

SEQ ID NO: 97117 - DNA, 11 bp, Unknown
  misc_feature (1)..( 11): Result.001 file - promoters60/1020666
taaaagtttta

SEQ ID NO: 97118 - DNA, 12 bp, Unknown
  misc_feature (1)..( 12): Result.001 file - promoters60/1020666
actcatagatac

SEQ ID NO: 97119 - DNA, 12 bp, Unknown
  misc_feature (1)..( 12): Result.001 file - promoters60/1020666
tatcaaagaata

SEQ ID NO: 97120 - DNA, 12 bp, Unknown
  misc_feature (1)..( 12): Result.001 file - promoters60/1020666
tataaaaacggg

SEQ ID NO: 97121 - DNA, 12 bp, Unknown
  misc_feature (1)..( 12): Result.001 file - promoters60/1020666
gcacaacgaata

SEQ ID NO: 97122 - DNA, 12 bp, Unknown
  misc_feature (1)..( 12): Result.001 file - promoters60/1020666
tattaaaatagt

SEQ ID NO: 97123 - DNA, 12 bp, Unknown
  misc_feature (1)..( 12): Result.001 file - promoters60/1020701
tatcaaaaccgt

SEQ ID NO: 97124 - DNA, 12 bp, Unknown
  misc_feature (1)..( 12): Result.001 file - promoters60/1020701
gcaataagaaat

SEQ ID NO: 97125 - DNA, 12 bp, Unknown
  misc_feature (1)..( 12): Result.001 file - promoters60/1020701
aaaatatgaaaa

SEQ ID NO: 97126 - DNA, 12 bp, Unknown
  misc_feature (1)..( 12): Result.001 file - promoters60/1020701
cgtgaaagtaat

SEQ ID NO: 97127 - DNA, 12 bp, Unknown
  misc_feature (1)..( 12): Result.001 file - promoters60/1020701
aaaacatgcact

SEQ ID NO: 97128 - DNA, 11 bp, Unknown
  misc_feature (1)..( 11): Result.001 file - promoters60/1020701
caagtctttgt

SEQ ID NO: 97129 - DNA, 11 bp, Unknown
  misc_feature (1)..( 11): Result.001 file - promoters60/1020701
caagtgttttg

SEQ ID NO: 97130 - DNA, 11 bp, Unknown
  misc_feature (1)..( 11): Result.001 file - promoters60/1020701
tgtctctatgt

SEQ ID NO: 97131 - DNA, 11 bp, Unknown
  misc_feature (1)..( 11): Result.001 file - promoters60/1020701
acattctatat

SEQ ID NO: 97132 - DNA, 10 bp, Unknown
  misc_feature (1)..( 10): Result.001 file - promoters60/1020701
atattaataa

SEQ ID NO: 97133 - DNA, 10 bp, Unknown
  misc_feature (1)..( 10): Result.001 file - promoters60/1020701
aaattaatgc

SEQ ID NO: 97134 - DNA, 10 bp, Unknown
  misc_feature (1)..( 10): Result.001 file - promoters60/1020701
atattaatgt

SEQ ID NO: 97135 - DNA, 10 bp, Unknown
  misc_feature (1)..( 10): Result.001 file - promoters60/1020701
tggttattgt

SEQ ID NO: 97136 - DNA, 10 bp, Unknown
  misc_feature (1)..( 10): Result.001 file - promoters60/1020701
aaatcatttt

SEQ ID NO: 97137 - DNA, 10 bp, Unknown
  misc_feature (1)..( 10): Result.001 file - promoters60/1020701
aaataatttt

SEQ ID NO: 97138 - DNA, 10 bp, Unknown
  misc_feature (1)..( 10): Result.001 file - promoters60/1020701
caatcatatt

SEQ ID NO: 97139 - DNA, 10 bp, Unknown
  misc_feature (1)..( 10): Result.001 file - promoters60/1020701
ctatcataat

SEQ ID NO: 97140 - DNA, 9 bp, Unknown
  misc_feature (1)..( 9): Result.001 file - promoters60/1020701
taatttatt

SEQ ID NO: 97141 - DNA, 9 bp, Unknown
  misc_feature (1)..( 9): Result.001 file - promoters60/1020701
taatttcat

SEQ ID NO: 97142 - DNA, 9 bp, Unknown
  misc_feature (1)..( 9): Result.001 file - promoters60/1020701
aaatttcat

SEQ ID NO: 97143 - DNA, 9 bp, Unknown
  misc_feature (1)..( 9): Result.001 file - promoters60/1020713
taattttca

SEQ ID NO: 97144 - DNA, 7 bp, Unknown
  misc_feature (1)..( 7): Result.001 file - promoters60/1020713
tttcttt

SEQ ID NO: 97145 - DNA, 7 bp, Unknown
  misc_feature (1)..( 7): Result.001 file - promoters60/1020713
tttattt

SEQ ID NO: 97146 - DNA, 7 bp, Unknown
  misc_feature (1)..( 7): Result.001 file - promoters60/1020713
ttattta

SEQ ID NO: 97147 - DNA, 7 bp, Unknown
  misc_feature (1)..( 7): Result.001 file - promoters60/1020713
ttagtta

SEQ ID NO: 97148 - DNA, 7 bp, Unknown
  misc_feature (1)..( 7): Result.001 file - promoters60/1020713
taattta

SEQ ID NO: 97149 - DNA, 7 bp, Unknown
  misc_feature (1)..( 7): Result.001 file - promoters60/1020713
taagtta

SEQ ID NO: 97150 - DNA, 7 bp, Unknown
  misc_feature (1)..( 7): Result.001 file - promoters60/1020713
gaagtta

SEQ ID NO: 97151 - DNA, 12 bp, Unknown
  misc_feature (1)..( 12): Result.001 file - promoters60/1020713
taaatatccgta

SEQ ID NO: 97152 - DNA, 12 bp, Unknown
  misc_feature (1)..( 12): Result.001 file - promoters60/1020713
taattatctgta

SEQ ID NO: 97153 - DNA, 6 bp, Unknown
  misc_feature (1)..( 6): Result.001 file - promoters60/1020713
gtttga

SEQ ID NO: 97154 - DNA, 6 bp, Unknown
  misc_feature (1)..( 6): Result.001 file - promoters60/1020713
gtttga

SEQ ID NO: 97155 - DNA, 7 bp, Unknown
  misc_feature (1)..( 7): Result.001 file - promoters60/1020713
gtttaat

SEQ ID NO: 97156 - DNA, 7 bp, Unknown
  misc_feature (1)..( 7): Result.001 file - promoters60/1020713
gttgaat

SEQ ID NO: 97157 - DNA, 7 bp, Unknown
  misc_feature (1)..( 7): Result.001 file - promoters60/1020713
ttcatac

SEQ ID NO: 97158 - DNA, 7 bp, Unknown
  misc_feature (1)..( 7): Result.001 file - promoters60/1020713
ttcttac

SEQ ID NO: 97159 - DNA, 7 bp, Unknown
  misc_feature (1)..( 7): Result.001 file - promoters60/1020713
taggtta

SEQ ID NO: 97160 - DNA, 7 bp, Unknown
  misc_feature (1)..( 7): Result.001 file - promoters60/1020713
tagttta

SEQ ID NO: 97161 - DNA, 7 bp, Unknown
  misc_feature (1)..( 7): Result.001 file - promoters60/1020713
ttctata

SEQ ID NO: 97162 - DNA, 7 bp, Unknown
  misc_feature (1)..( 7): Result.001 file - promoters60/1020713
ttccata

SEQ ID NO: 97163 - DNA, 7 bp, Unknown
  misc_feature (1)..( 7): Result.001 file - promoters60/1020713
atcttct

SEQ ID NO: 97164 - DNA, 7 bp, Unknown
  misc_feature (1)..( 7): Result.001 file - promoters60/1020713
atcttct

SEQ ID NO: 97165 - DNA, 8 bp, Unknown
  misc_feature (1)..( 8): Result.001 file - promoters60/1020713
taagaaaa

SEQ ID NO: 97166 - DNA, 8 bp, Unknown
  misc_feature (1)..( 8): Result.001 file - promoters60/1020713
ccagaaaa

SEQ ID NO: 97167 - DNA, 8 bp, Unknown
  misc_feature (1)..( 8): Result.001 file - promoters60/1020713
gaagaaat

SEQ ID NO: 97168 - DNA, 7 bp, Unknown
  misc_feature (1)..( 7): Result.001 file - promoters60/1020713
aaatttg

SEQ ID NO: 97169 - DNA, 7 bp, Unknown
  misc_feature (1)..( 7): Result.001 file - promoters60/1020713
aaatttc

SEQ ID NO: 97170 - DNA, 7 bp, Unknown
  misc_feature (1)..( 7): Result.001 file - promoters60/1020713
gaatttt

SEQ ID NO: 97171 - DNA, 6 bp, Unknown
  misc_feature (1)..( 6): Result.001 file - promoters60/1020713
aagctt

SEQ ID NO: 97172 - DNA, 6 bp, Unknown
  misc_feature (1)..( 6): Result.001 file - promoters60/1020713
aagctt

SEQ ID NO: 97173 - DNA, 6 bp, Unknown
  misc_feature (1)..( 6): Result.001 file - promoters60/1020713
tacgtt

SEQ ID NO: 97174 - DNA, 6 bp, Unknown
  misc_feature (1)..( 6): Result.001 file - promoters60/1020713
tacgtt

SEQ ID NO: 97175 - DNA, 8 bp, Unknown
  misc_feature (1)..( 8): Result.001 file - promoters60/1020713
atccaatt

SEQ ID NO: 97176 - DNA, 8 bp, Unknown
  misc_feature (1)..( 8): Result.001 file - promoters60/1020713
atctaatt

SEQ ID NO: 97177 - DNA, 6 bp, Unknown
  misc_feature (1)..( 6): Result.001 file - promoters60/1020713
cgtgag

SEQ ID NO: 97178 - DNA, 6 bp, Unknown
  misc_feature (1)..( 6): Result.001 file - promoters60/1020713
cgtgag

SEQ ID NO: 97179 - DNA, 7 bp, Unknown
  misc_feature (1)..( 7): Result.001 file - promoters60/1020713
atttaaa

SEQ ID NO: 97180 - DNA, 7 bp, Unknown
  misc_feature (1)..( 7): Result.001 file - promoters60/1020713
atttaaa

SEQ ID NO: 97181 - DNA, 6 bp, Unknown
  misc_feature (1)..( 6): Result.001 file - promoters60/1020713
aaaaaa

SEQ ID NO: 97182 - DNA, 6 bp, Unknown
  misc_feature (1)..( 6): Result.001 file - promoters60/1020713
aaaaaa

SEQ ID NO: 97183 - DNA, 6 bp, Unknown
  misc_feature (1)..( 6): Result.001 file - promoters60/1020713
gaacac

SEQ ID NO: 97184 - DNA, 6 bp, Unknown
  misc_feature (1)..( 6): Result.001 file - promoters60/1020713
gaacac

SEQ ID NO: 97185 - DNA, 7 bp, Unknown
  misc_feature (1)..( 7): Result.001 file - promoters60/1020713
ttttaaa

SEQ ID NO: 97186 - DNA, 7 bp, Unknown
  misc_feature (1)..( 7): Result.001 file - promoters60/1020713
ttttaaa

SEQ ID NO: 97187 - DNA, 7 bp, Unknown
  misc_feature (1)..( 7): Result.001 file - promoters60/1020713
gaaataa

SEQ ID NO: 97188 - DNA, 7 bp, Unknown
  misc_feature (1)..( 7): Result.001 file - promoters60/1020786
gaattaa

SEQ ID NO: 97189 - DNA, 10 bp, Unknown
  misc_feature (1)..( 10): Result.001 file - promoters60/1020786
caaaaataag

SEQ ID NO: 97190 - DNA, 10 bp, Unknown
  misc_feature (1)..( 10): Result.001 file - promoters60/1020786
caaaaaaagc

SEQ ID NO: 97191 - DNA, 10 bp, Unknown
  misc_feature (1)..( 10): Result.001 file - promoters60/1020786
caaaaaaggt

SEQ ID NO: 97192 - DNA, 11 bp, Unknown
  misc_feature (1)..( 11): Result.001 file - promoters60/1020786
aaaataaatat

SEQ ID NO: 97193 - DNA, 11 bp, Unknown
  misc_feature (1)..( 11): Result.001 file - promoters60/1020786
catataatata

SEQ ID NO: 97194 - DNA, 12 bp, Unknown
  misc_feature (1)..( 12): Result.001 file - promoters60/1020786
aaaacagtaaaa

SEQ ID NO: 97195 - DNA, 12 bp, Unknown
  misc_feature (1)..( 12): Result.001 file - promoters60/1020786
caaacaataaaa

SEQ ID NO: 97196 - DNA, 13 bp, Unknown
  misc_feature (1)..( 13): Result.001 file - promoters60/1020786
aaatacataaatt

SEQ ID NO: 97197 - DNA, 13 bp, Unknown
  misc_feature (1)..( 13): Result.001 file - promoters60/1020786
ttcgtcaaaaaac

SEQ ID NO: 97198 - DNA, 13 bp, Unknown
  misc_feature (1)..( 13): Result.001 file - promoters60/1020786
aattaaattaaag

SEQ ID NO: 97199 - DNA, 13 bp, Unknown
  misc_feature (1)..( 13): Result.001 file - promoters60/1020786
cgatgaaatataa

SEQ ID NO: 97200 - DNA, 13 bp, Unknown
  misc_feature (1)..( 13): Result.001 file - promoters60/1020786
cacataattatga

SEQ ID NO: 97201 - DNA, 10 bp, Unknown
  misc_feature (1)..( 10): Result.001 file - promoters60/1020786
atattaataa

SEQ ID NO: 97202 - DNA, 10 bp, Unknown
  misc_feature (1)..( 10): Result.001 file - promoters60/1020786
aaattaatat

SEQ ID NO: 97203 - DNA, 10 bp, Unknown
  misc_feature (1)..( 10): Result.001 file - promoters60/1020786
aaattaatgc

SEQ ID NO: 97204 - DNA, 10 bp, Unknown
  misc_feature (1)..( 10): Result.001 file - promoters60/1020786
atattaataa

SEQ ID NO: 97205 - DNA, 10 bp, Unknown
  misc_feature (1)..( 10): Result.001 file - promoters60/1020786
actttattat

SEQ ID NO: 97206 - DNA, 10 bp, Unknown
  misc_feature (1)..( 10): Result.001 file - promoters60/1020786
aaatttatgt

SEQ ID NO: 97207 - DNA, 10 bp, Unknown
  misc_feature (1)..( 10): Result.001 file - promoters60/1020786
ccatttatgg

SEQ ID NO: 97208 - DNA, 16 bp, Unknown
  misc_feature (1)..( 16): Result.001 file - promoters60/1020786
agaccaatcacaacat

SEQ ID NO: 97209 - DNA, 16 bp, Unknown
  misc_feature (1)..( 16): Result.001 file - promoters60/1020786
aaaccaatgtttattt

SEQ ID NO: 97210 - DNA, 16 bp, Unknown
  misc_feature (1)..( 16): Result.001 file - promoters60/1020786
aaaacaagggacaagt

SEQ ID NO: 97211 - DNA, 16 bp, Unknown
  misc_feature (1)..( 16): Result.001 file - promoters60/1020786
ccaacaacaaaaaaag

SEQ ID NO: 97212 - DNA, 16 bp, Unknown
  misc_feature (1)..( 16): Result.001 file - promoters60/1020786
tgatcaacaaaaattg

SEQ ID NO: 97213 - DNA, 8 bp, Unknown
  misc_feature (1)..( 8): Result.001 file - promoters60/1020786
aaaaataa

SEQ ID NO: 97214 - DNA, 8 bp, Unknown
  misc_feature (1)..( 8): Result.001 file - promoters60/1020786
taaaatat

SEQ ID NO: 97215 - DNA, 8 bp, Unknown
  misc_feature (1)..( 8): Result.001 file - promoters60/1020786
caaaaaag

SEQ ID NO: 97216 - DNA, 8 bp, Unknown
  misc_feature (1)..( 8): Result.001 file - promoters60/1020786
aaaaaaag

SEQ ID NO: 97217 - DNA, 8 bp, Unknown
  misc_feature (1)..( 8): Result.001 file - promoters60/1020786
taaagtat

SEQ ID NO: 97218 - DNA, 14 bp, Unknown
  misc_feature (1)..( 14): Result.001 file - promoters60/1020786
aaagacaaacggtc

SEQ ID NO: 97219 - DNA, 14 bp, Unknown
  misc_feature (1)..( 14): Result.001 file - promoters60/1020786
attaacaaactaat

SEQ ID NO: 97220 - DNA, 14 bp, Unknown
  misc_feature (1)..( 14): Result.001 file - promoters60/1020786
agttaaaaaatatt

SEQ ID NO: 97221 - DNA, 14 bp, Unknown
  misc_feature (1)..( 14): Result.001 file - promoters60/1020786
gtttaaattaatta

SEQ ID NO: 97222 - DNA, 14 bp, Unknown
  misc_feature (1)..( 14): Result.001 file - promoters60/1020786
atttaaaatcgtca

SEQ ID NO: 97223 - DNA, 14 bp, Unknown
  misc_feature (1)..( 14): Result.001 file - promoters60/1020786
tcaatcaaattaat

SEQ ID NO: 97224 - DNA, 11 bp, Unknown
  misc_feature (1)..( 11): Result.001 file - promoters60/1020786
ccaaaaacagt

SEQ ID NO: 97225 - DNA, 11 bp, Unknown
  misc_feature (1)..( 11): Result.001 file - promoters60/1020786
tcaaaaaactt

SEQ ID NO: 97226 - DNA, 12 bp, Unknown
  misc_feature (1)..( 12): Result.001 file - promoters60/1020786
acaataaaatta

SEQ ID NO: 97227 - DNA, 13 bp, Unknown
  misc_feature (1)..( 13): Result.001 file - promoters60/1020786
ataattaaattaa

SEQ ID NO: 97228 - DNA, 13 bp, Unknown
  misc_feature (1)..( 13): Result.001 file - promoters60/1020786
taaattaatgcca

SEQ ID NO: 97229 - DNA, 13 bp, Unknown
  misc_feature (1)..( 13): Result.001 file - promoters60/1020786
gcaaaaattatta

SEQ ID NO: 97230 - DNA, 13 bp, Unknown
  misc_feature (1)..( 13): Result.001 file - promoters60/1020786
ataattatgaaca

SEQ ID NO: 97231 - DNA, 10 bp, Unknown
  misc_feature (1)..( 10): Result.001 file - promoters60/1020786
taaataaatt

SEQ ID NO: 97232 - DNA, 10 bp, Unknown
  misc_feature (1)..( 10): Result.001 file - promoters60/1020786
aaaaaaaagg

SEQ ID NO: 97233 - DNA, 10 bp, Unknown
  misc_feature (1)..( 10): Result.001 file - promoters60/1020786
ataatgaatt

SEQ ID NO: 97234 - DNA, 10 bp, Unknown
  misc_feature (1)..( 10): Result.001 file - promoters60/1020786
taaattaatt

SEQ ID NO: 97235 - DNA, 10 bp, Unknown
  misc_feature (1)..( 10): Result.001 file - promoters60/1020786
taactaattt

SEQ ID NO: 97236 - DNA, 10 bp, Unknown
  misc_feature (1)..( 10): Result.001 file - promoters60/1020786
ataaaaagtt

SEQ ID NO: 97237 - DNA, 15 bp, Unknown
  misc_feature (1)..( 15): Result.001 file - promoters60/1020786
atttctttaaactat

SEQ ID NO: 97238 - DNA, 15 bp, Unknown
  misc_feature (1)..( 15): Result.001 file - promoters60/1020786
atttgtttgaactaa

SEQ ID NO: 97239 - DNA, 15 bp, Unknown
  misc_feature (1)..( 15): Result.001 file - promoters60/1020786
tgggttacaaaatat

SEQ ID NO: 97240 - DNA, 15 bp, Unknown
  misc_feature (1)..( 15): Result.001 file - promoters60/1020786
aactttttaaataca

SEQ ID NO: 97241 - DNA, 15 bp, Unknown
  misc_feature (1)..( 15): Result.001 file - promoters60/1020786
aattgtttaacgagt

SEQ ID NO: 97242 - DNA, 9 bp, Unknown
  misc_feature (1)..( 9): Result.001 file - promoters60/1020786
taaaaatta

SEQ ID NO: 97243 - DNA, 9 bp, Unknown
  misc_feature (1)..( 9): Result.001 file - promoters60/1020786
caaaaatta

SEQ ID NO: 97244 - DNA, 9 bp, Unknown
  misc_feature (1)..( 9): Result.001 file - promoters60/1020786
caaagatta

SEQ ID NO: 97245 - DNA, 9 bp, Unknown
  misc_feature (1)..( 9): Result.001 file - promoters60/1020786
atgagatta

SEQ ID NO: 97246 - DNA, 9 bp, Unknown
  misc_feature (1)..( 9): Result.001 file - promoters60/1020786
caaaaaact

SEQ ID NO: 97247 - DNA, 9 bp, Unknown
  misc_feature (1)..( 9): Result.001 file - promoters60/1020786
ctataaata

SEQ ID NO: 97248 - DNA, 9 bp, Unknown
  misc_feature (1)..( 9): Result.001 file - promoters60/1020786
atataaaca

SEQ ID NO: 97249 - DNA, 9 bp, Unknown
  misc_feature (1)..( 9): Result.001 file - promoters60/1020786
atatgaacc

SEQ ID NO: 97250 - DNA, 9 bp, Unknown
  misc_feature (1)..( 9): Result.001 file - promoters60/1020786
atataacaa

SEQ ID NO: 97251 - DNA, 9 bp, Unknown
  misc_feature (1)..( 9): Result.001 file - promoters60/1020786
tgataaaaa

SEQ ID NO: 97252 - DNA, 9 bp, Unknown
  misc_feature (1)..( 9): Result.001 file - promoters60/1020818
acaaaaagt

SEQ ID NO: 97253 - DNA, 11 bp, Unknown
  misc_feature (1)..( 11): Result.001 file - promoters60/1020818
caaaaattaag

SEQ ID NO: 97254 - DNA, 11 bp, Unknown
  misc_feature (1)..( 11): Result.001 file - promoters60/1020818
aaaacatttat

SEQ ID NO: 97255 - DNA, 11 bp, Unknown
  misc_feature (1)..( 11): Result.001 file - promoters60/1020818
caataattttt

SEQ ID NO: 97256 - DNA, 11 bp, Unknown
  misc_feature (1)..( 11): Result.001 file - promoters60/1020818
acataatgttt

SEQ ID NO: 97257 - DNA, 13 bp, Unknown
  misc_feature (1)..( 13): Result.001 file - promoters60/1020818
aactttttttctt

SEQ ID NO: 97258 - DNA, 13 bp, Unknown
  misc_feature (1)..( 13): Result.001 file - promoters60/1020818
ataatttttcctt

SEQ ID NO: 97259 - DNA, 13 bp, Unknown
  misc_feature (1)..( 13): Result.001 file - promoters60/1020818
ataatgtttgagt

SEQ ID NO: 97260 - DNA, 10 bp, Unknown
  misc_feature (1)..( 10): Result.001 file - promoters60/1020818
taaaaaagaa

SEQ ID NO: 97261 - DNA, 10 bp, Unknown
  misc_feature (1)..( 10): Result.001 file - promoters60/1020818
taaaaaaggg

SEQ ID NO: 97262 - DNA, 10 bp, Unknown
  misc_feature (1)..( 10): Result.001 file - promoters60/1020818
tataaaagaa

SEQ ID NO: 97263 - DNA, 9 bp, Unknown
  misc_feature (1)..( 9): Result.001 file - promoters60/1020818
ctcaaaaaa

SEQ ID NO: 97264 - DNA, 9 bp, Unknown
  misc_feature (1)..( 9): Result.001 file - promoters60/1020818
gtcaaaaaa

SEQ ID NO: 97265 - DNA, 9 bp, Unknown
  misc_feature (1)..( 9): Result.001 file - promoters60/1020826
gtcaaatcc

SEQ ID NO: 97266 - DNA, 6 bp, Unknown
  misc_feature (1)..( 6): Result.001 file - promoters60/1020826
acatag

SEQ ID NO: 97267 - DNA, 6 bp, Unknown
  misc_feature (1)..( 6): Result.001 file - promoters60/1020826
acatag

SEQ ID NO: 97268 - DNA, 9 bp, Unknown
  misc_feature (1)..( 9): Result.001 file - promoters60/1020826
tttatcttg

SEQ ID NO: 97269 - DNA, 9 bp, Unknown
  misc_feature (1)..( 9): Result.001 file - promoters60/1020826
tttttcttt

SEQ ID NO: 97270 - DNA, 9 bp, Unknown
  misc_feature (1)..( 9): Result.001 file - promoters60/1020826
gcttccttc

SEQ ID NO: 97271 - DNA, 6 bp, Unknown
  misc_feature (1)..( 6): Result.001 file - promoters60/1020826
tagaat

SEQ ID NO: 97272 - DNA, 6 bp, Unknown
  misc_feature (1)..( 6): Result.001 file - promoters60/1020826
tagaat

SEQ ID NO: 97273 - DNA, 6 bp, Unknown
  misc_feature (1)..( 6): Result.001 file - promoters60/1020826
attttc

SEQ ID NO: 97274 - DNA, 6 bp, Unknown
  misc_feature (1)..( 6): Result.001 file - promoters60/1020826
attttc

SEQ ID NO: 97275 - DNA, 6 bp, Unknown
  misc_feature (1)..( 6): Result.001 file - promoters60/1020826
taaatt

SEQ ID NO: 97276 - DNA, 6 bp, Unknown
  misc_feature (1)..( 6): Result.001 file - promoters60/1020826
taaatt

SEQ ID NO: 97277 - DNA, 6 bp, Unknown
  misc_feature (1)..( 6): Result.001 file - promoters60/1020826
aatata

SEQ ID NO: 97278 - DNA, 6 bp, Unknown
  misc_feature (1)..( 6): Result.001 file - promoters60/1020826
aatata

SEQ ID NO: 97279 - DNA, 8 bp, Unknown
  misc_feature (1)..( 8): Result.001 file - promoters60/1020826
gactattc

SEQ ID NO: 97280 - DNA, 8 bp, Unknown
  misc_feature (1)..( 8): Result.001 file - promoters60/1020826
gaccattg

SEQ ID NO: 97281 - DNA, 8 bp, Unknown
  misc_feature (1)..( 8): Result.001 file - promoters60/1020826
atccattg

SEQ ID NO: 97282 - DNA, 7 bp, Unknown
  misc_feature (1)..( 7): Result.001 file - promoters60/1020826
ctctaat

SEQ ID NO: 97283 - DNA, 7 bp, Unknown
  misc_feature (1)..( 7): Result.001 file - promoters60/1020826
ctcaaat

SEQ ID NO: 97284 - DNA, 7 bp, Unknown
  misc_feature (1)..( 7): Result.001 file - promoters60/1020826
ctatgtc

SEQ ID NO: 97285 - DNA, 7 bp, Unknown
  misc_feature (1)..( 7): Result.001 file - promoters60/1020826
ctacgtc

SEQ ID NO: 97286 - DNA, 7 bp, Unknown
  misc_feature (1)..( 7): Result.001 file - promoters60/1020826
gaataaa

SEQ ID NO: 97287 - DNA, 7 bp, Unknown
  misc_feature (1)..( 7): Result.001 file - promoters60/1020826
gaagaaa

SEQ ID NO: 97288 - DNA, 6 bp, Unknown
  misc_feature (1)..( 6): Result.001 file - promoters60/1020826
tttcat

SEQ ID NO: 97289 - DNA, 6 bp, Unknown
  misc_feature (1)..( 6): Result.001 file - promoters60/1020826
tttcat

SEQ ID NO: 97290 - DNA, 7 bp, Unknown
  misc_feature (1)..( 7): Result.001 file - promoters60/1020826
gtcttaa

SEQ ID NO: 97291 - DNA, 7 bp, Unknown
  misc_feature (1)..( 7): Result.001 file - promoters60/1020826
gtcataa

SEQ ID NO: 97292 - DNA, 11 bp, Unknown
  misc_feature (1)..( 11): Result.001 file - promoters60/1020826
attataacctc

SEQ ID NO: 97293 - DNA, 11 bp, Unknown
  misc_feature (1)..( 11): Result.001 file - promoters60/1020826
attattacctc

SEQ ID NO: 97294 - DNA, 6 bp, Unknown
  misc_feature (1)..( 6): Result.001 file - promoters60/1020826
aagtat

SEQ ID NO: 97295 - DNA, 6 bp, Unknown
  misc_feature (1)..( 6): Result.001 file - promoters60/1020826
aagtat

SEQ ID NO: 97296 - DNA, 6 bp, Unknown
  misc_feature (1)..( 6): Result.001 file - promoters60/1020826
tgagaa

SEQ ID NO: 97297 - DNA, 6 bp, Unknown
  misc_feature (1)..( 6): Result.001 file - promoters60/1020826
tgagaa

SEQ ID NO: 97298 - DNA, 7 bp, Unknown
  misc_feature (1)..( 7): Result.001 file - promoters60/1020826
aagaaaa

SEQ ID NO: 97299 - DNA, 7 bp, Unknown
  misc_feature (1)..( 7): Result.001 file - promoters60/1020834
aaggaaa

SEQ ID NO: 97300 - DNA, 8 bp, Unknown
  misc_feature (1)..( 8): Result.001 file - promoters60/1020834
agactacc

SEQ ID NO: 97301 - DNA, 8 bp, Unknown
  misc_feature (1)..( 8): Result.001 file - promoters60/1020834
agaatacc

SEQ ID NO: 97302 - DNA, 8 bp, Unknown
  misc_feature (1)..( 8): Result.001 file - promoters60/1020834
agaataga

SEQ ID NO: 97303 - DNA, 6 bp, Unknown
  misc_feature (1)..( 6): Result.001 file - promoters60/1020834
gcacat

SEQ ID NO: 97304 - DNA, 6 bp, Unknown
  misc_feature (1)..( 6): Result.001 file - promoters60/1020834
gcacat

SEQ ID NO: 97305 - DNA, 6 bp, Unknown
  misc_feature (1)..( 6): Result.001 file - promoters60/1020834
cagaag

SEQ ID NO: 97306 - DNA, 6 bp, Unknown
  misc_feature (1)..( 6): Result.001 file - promoters60/1020834
cagaag

SEQ ID NO: 97307 - DNA, 9 bp, Unknown
  misc_feature (1)..( 9): Result.001 file - promoters60/1020834
ttatcaaaa

SEQ ID NO: 97308 - DNA, 9 bp, Unknown
  misc_feature (1)..( 9): Result.001 file - promoters60/1020834
ttattaaaa

SEQ ID NO: 97309 - DNA, 6 bp, Unknown
  misc_feature (1)..( 6): Result.001 file - promoters60/1020834
tagatt

SEQ ID NO: 97310 - DNA, 6 bp, Unknown
  misc_feature (1)..( 6): Result.001 file - promoters60/1020834
tagatt

SEQ ID NO: 97311 - DNA, 7 bp, Unknown
  misc_feature (1)..( 7): Result.001 file - promoters60/1020834
ttgtact

SEQ ID NO: 97312 - DNA, 7 bp, Unknown
  misc_feature (1)..( 7): Result.001 file - promoters60/1020834
ttggact

SEQ ID NO: 97313 - DNA, 6 bp, Unknown
  misc_feature (1)..( 6): Result.001 file - promoters60/1020834
cactta

SEQ ID NO: 97314 - DNA, 6 bp, Unknown
  misc_feature (1)..( 6): Result.001 file - promoters60/1020834
cactta

SEQ ID NO: 97315 - DNA, 7 bp, Unknown
  misc_feature (1)..( 7): Result.001 file - promoters60/1020834
aaattca

SEQ ID NO: 97316 - DNA, 7 bp, Unknown
  misc_feature (1)..( 7): Result.001 file - promoters60/1020834
aaaatca

SEQ ID NO: 97317 - DNA, 6 bp, Unknown
  misc_feature (1)..( 6): Result.001 file - promoters60/1020834
tgagat

SEQ ID NO: 97318 - DNA, 6 bp, Unknown
  misc_feature (1)..( 6): Result.001 file - promoters60/1020834
tgagat

SEQ ID NO: 97319 - DNA, 8 bp, Unknown
  misc_feature (1)..( 8): Result.001 file - promoters60/1020834
agattttc

SEQ ID NO: 97320 - DNA, 8 bp, Unknown
  misc_feature (1)..( 8): Result.001 file - promoters60/1020834
agatcttc

SEQ ID NO: 97321 - DNA, 8 bp, Unknown
  misc_feature (1)..( 8): Result.001 file - promoters60/1020834
ttcattga

SEQ ID NO: 97322 - DNA, 8 bp, Unknown
  misc_feature (1)..( 8): Result.001 file - promoters60/1020838
ttcactga

SEQ ID NO: 97323 - DNA, 6 bp, Unknown
  misc_feature (1)..( 6): Result.001 file - promoters60/1020838
atagaa

SEQ ID NO: 97324 - DNA, 6 bp, Unknown
  misc_feature (1)..( 6): Result.001 file - promoters60/1020838
atagaa

SEQ ID NO: 97325 - DNA, 9 bp, Unknown
  misc_feature (1)..( 9): Result.001 file - promoters60/1020838
cattgcaaa

SEQ ID NO: 97326 - DNA, 9 bp, Unknown
  misc_feature (1)..( 9): Result.001 file - promoters60/1020838
cattggaaa

SEQ ID NO: 97327 - DNA, 8 bp, Unknown
  misc_feature (1)..( 8): Result.001 file - promoters60/1020838
accaacta

SEQ ID NO: 97328 - DNA, 8 bp, Unknown
  misc_feature (1)..( 8): Result.001 file - promoters60/1020838
accaccta

SEQ ID NO: 97329 - DNA, 6 bp, Unknown
  misc_feature (1)..( 6): Result.001 file - promoters60/1020838
tatata

SEQ ID NO: 97330 - DNA, 6 bp, Unknown
  misc_feature (1)..( 6): Result.001 file - promoters60/1020838
tatata

SEQ ID NO: 97331 - DNA, 9 bp, Unknown
  misc_feature (1)..( 9): Result.001 file - promoters60/1020838
aatgtcttt

SEQ ID NO: 97332 - DNA, 9 bp, Unknown
  misc_feature (1)..( 9): Result.001 file - promoters60/1020838
aatgtgttt

SEQ ID NO: 97333 - DNA, 7 bp, Unknown
  misc_feature (1)..( 7): Result.001 file - promoters60/1020838
tttgaag

SEQ ID NO: 97334 - DNA, 7 bp, Unknown
  misc_feature (1)..( 7): Result.001 file - promoters60/1020838
tttcaag

SEQ ID NO: 97335 - DNA, 6 bp, Unknown
  misc_feature (1)..( 6): Result.001 file - promoters60/1020838
gaacaa

SEQ ID NO: 97336 - DNA, 6 bp, Unknown
  misc_feature (1)..( 6): Result.001 file - promoters60/1020838
gaacaa

SEQ ID NO: 97337 - DNA, 8 bp, Unknown
  misc_feature (1)..( 8): Result.001 file - promoters60/1020838
attacatg

SEQ ID NO: 97338 - DNA, 8 bp, Unknown
  misc_feature (1)..( 8): Result.001 file - promoters60/1020838
attacatg

SEQ ID NO: 97339 - DNA, 6 bp, Unknown
  misc_feature (1)..( 6): Result.001 file - promoters60/1020838
tagatg

SEQ ID NO: 97340 - DNA, 6 bp, Unknown
  misc_feature (1)..( 6): Result.001 file - promoters60/1020838
tagatg

SEQ ID NO: 97341 - DNA, 8 bp, Unknown
  misc_feature (1)..( 8): Result.001 file - promoters60/1020838
aaaaggtt

SEQ ID NO: 97342 - DNA, 8 bp, Unknown
  misc_feature (1)..( 8): Result.001 file - promoters60/1020838
aaaacgtt

SEQ ID NO: 97343 - DNA, 7 bp, Unknown
  misc_feature (1)..( 7): Result.001 file - promoters60/1020838
caagaag

SEQ ID NO: 97344 - DNA, 7 bp, Unknown
  misc_feature (1)..( 7): Result.001 file - promoters60/1020838
caaaaag

SEQ ID NO: 97345 - DNA, 7 bp, Unknown
  misc_feature (1)..( 7): Result.001 file - promoters60/1020838
atacaag

SEQ ID NO: 97346 - DNA, 7 bp, Unknown
  misc_feature (1)..( 7): Result.001 file - promoters60/1020838
ataaaag

SEQ ID NO: 97347 - DNA, 7 bp, Unknown
  misc_feature (1)..( 7): Result.001 file - promoters60/1020838
ttgaagg

SEQ ID NO: 97348 - DNA, 7 bp, Unknown
  misc_feature (1)..( 7): Result.001 file - promoters60/1020838
ttgcagg

SEQ ID NO: 97349 - DNA, 6 bp, Unknown
  misc_feature (1)..( 6): Result.001 file - promoters60/1020838
ggagaa

SEQ ID NO: 97350 - DNA, 6 bp, Unknown
  misc_feature (1)..( 6): Result.001 file - promoters60/1020838
ggagaa

SEQ ID NO: 97351 - DNA, 7 bp, Unknown
  misc_feature (1)..( 7): Result.001 file - promoters60/1020838
gaaggaa

SEQ ID NO: 97352 - DNA, 7 bp, Unknown
  misc_feature (1)..( 7): Result.001 file - promoters60/1020838
gaaagaa

SEQ ID NO: 97353 - DNA, 8 bp, Unknown
  misc_feature (1)..( 8): Result.001 file - promoters60/1020838
cttttgaa

SEQ ID NO: 97354 - DNA, 8 bp, Unknown
  misc_feature (1)..( 8): Result.001 file - promoters60/1020838
ctttggaa

SEQ ID NO: 97355 - DNA, 6 bp, Unknown
  misc_feature (1)..( 6): Result.001 file - promoters60/1020838
aatgaa

SEQ ID NO: 97356 - DNA, 6 bp, Unknown
  misc_feature (1)..( 6): Result.001 file - promoters60/1020838
aatgaa

SEQ ID NO: 97357 - DNA, 7 bp, Unknown
  misc_feature (1)..( 7): Result.001 file - promoters60/1020838
ttcctaa

SEQ ID NO: 97358 - DNA, 7 bp, Unknown
  misc_feature (1)..( 7): Result.001 file - promoters60/1020838
ttcctaa

SEQ ID NO: 97359 - DNA, 7 bp, Unknown
  misc_feature (1)..( 7): Result.001 file - promoters60/1020838
aaatcaa

SEQ ID NO: 97360 - DNA, 7 bp, Unknown
  misc_feature (1)..( 7): Result.001 file - promoters60/1020838
aaatcaa

SEQ ID NO: 97361 - DNA, 7 bp, Unknown
  misc_feature (1)..( 7): Result.001 file - promoters60/1020838
aaggtaa

SEQ ID NO: 97362 - DNA, 7 bp, Unknown
  misc_feature (1)..( 7): Result.001 file - promoters60/1020838
aagttaa

SEQ ID NO: 97363 - DNA, 9 bp, Unknown
  misc_feature (1)..( 9): Result.001 file - promoters60/1020838
aaaaaaaaa

SEQ ID NO: 97364 - DNA, 9 bp, Unknown
  misc_feature (1)..( 9): Result.001 file - promoters60/1020838
aaaaagaaa

SEQ ID NO: 97365 - DNA, 6 bp, Unknown
  misc_feature (1)..( 6): Result.001 file - promoters60/1020838
acatag

SEQ ID NO: 97366 - DNA, 6 bp, Unknown
  misc_feature (1)..( 6): Result.001 file - promoters60/1020838
acatag

SEQ ID NO: 97367 - DNA, 8 bp, Unknown
  misc_feature (1)..( 8): Result.001 file - promoters60/1020838
acactttc

SEQ ID NO: 97368 - DNA, 8 bp, Unknown
  misc_feature (1)..( 8): Result.001 file - promoters60/1020838
acattttc

SEQ ID NO: 97369 - DNA, 6 bp, Unknown
  misc_feature (1)..( 6): Result.001 file - promoters60/1020838
tcagat

SEQ ID NO: 97370 - DNA, 6 bp, Unknown
  misc_feature (1)..( 6): Result.001 file - promoters60/1020838
tcagat

SEQ ID NO: 97371 - DNA, 7 bp, Unknown
  misc_feature (1)..( 7): Result.001 file - promoters60/1020838
tttttaa

SEQ ID NO: 97372 - DNA, 7 bp, Unknown
  misc_feature (1)..( 7): Result.001 file - promoters60/1020838
tttgtaa

SEQ ID NO: 97373 - DNA, 6 bp, Unknown
  misc_feature (1)..( 6): Result.001 file - promoters60/1020838
aataaa

SEQ ID NO: 97374 - DNA, 6 bp, Unknown
  misc_feature (1)..( 6): Result.001 file - promoters60/1020838
aataaa

SEQ ID NO: 97375 - DNA, 7 bp, Unknown
  misc_feature (1)..( 7): Result.001 file - promoters60/1020838
tttttgt

SEQ ID NO: 97376 - DNA, 7 bp, Unknown
  misc_feature (1)..( 7): Result.001 file - promoters60/1020838
tttatgt

SEQ ID NO: 97377 - DNA, 7 bp, Unknown
  misc_feature (1)..( 7): Result.001 file - promoters60/1020838
tatgtat

SEQ ID NO: 97378 - DNA, 7 bp, Unknown
  misc_feature (1)..( 7): Result.001 file - promoters60/1020838
tatttat

SEQ ID NO: 97379 - DNA, 8 bp, Unknown
  misc_feature (1)..( 8): Result.001 file - promoters60/1020838
taacaccg

SEQ ID NO: 97380 - DNA, 8 bp, Unknown
  misc_feature (1)..( 8): Result.001 file - promoters60/1020848
taaaaccg

SEQ ID NO: 97381 - DNA, 8 bp, Unknown
  misc_feature (1)..( 8): Result.001 file - promoters60/1020848
ttttcaaa

SEQ ID NO: 97382 - DNA, 8 bp, Unknown
  misc_feature (1)..( 8): Result.001 file - promoters60/1020848
ttttgaaa

SEQ ID NO: 97383 - DNA, 8 bp, Unknown
  misc_feature (1)..( 8): Result.001 file - promoters60/1020848
ttttgatg

SEQ ID NO: 97384 - DNA, 9 bp, Unknown
  misc_feature (1)..( 9): Result.001 file - promoters60/1020848
aacacatat

SEQ ID NO: 97385 - DNA, 9 bp, Unknown
  misc_feature (1)..( 9): Result.001 file - promoters60/1020848
aacaaatat

SEQ ID NO: 97386 - DNA, 7 bp, Unknown
  misc_feature (1)..( 7): Result.001 file - promoters60/1020848
atatatg

SEQ ID NO: 97387 - DNA, 7 bp, Unknown
  misc_feature (1)..( 7): Result.001 file - promoters60/1020848
atatatg

SEQ ID NO: 97388 - DNA, 6 bp, Unknown
  misc_feature (1)..( 6): Result.001 file - promoters60/1020848
aattgg

SEQ ID NO: 97389 - DNA, 6 bp, Unknown
  misc_feature (1)..( 6): Result.001 file - promoters60/1020848
aattgg

SEQ ID NO: 97390 - DNA, 6 bp, Unknown
  misc_feature (1)..( 6): Result.001 file - promoters60/1020848
gtaata

SEQ ID NO: 97391 - DNA, 6 bp, Unknown
  misc_feature (1)..( 6): Result.001 file - promoters60/1020848
gtaata

SEQ ID NO: 97392 - DNA, 8 bp, Unknown
  misc_feature (1)..( 8): Result.001 file - promoters60/1020848
aacttatt

SEQ ID NO: 97393 - DNA, 8 bp, Unknown
  misc_feature (1)..( 8): Result.001 file - promoters60/1020848
aacttatt

SEQ ID NO: 97394 - DNA, 6 bp, Unknown
  misc_feature (1)..( 6): Result.001 file - promoters60/1020848
tatttt

SEQ ID NO: 97395 - DNA, 6 bp, Unknown
  misc_feature (1)..( 6): Result.001 file - promoters60/1020848
tatttt

SEQ ID NO: 97396 - DNA, 7 bp, Unknown
  misc_feature (1)..( 7): Result.001 file - promoters60/1020848
attatat

SEQ ID NO: 97397 - DNA, 7 bp, Unknown
  misc_feature (1)..( 7): Result.001 file - promoters60/1020848
attttat

SEQ ID NO: 97398 - DNA, 7 bp, Unknown
  misc_feature (1)..( 7): Result.001 file - promoters60/1020848
agaatat

SEQ ID NO: 97399 - DNA, 7 bp, Unknown
  misc_feature (1)..( 7): Result.001 file - promoters60/1020848
agattat

SEQ ID NO: 97400 - DNA, 7 bp, Unknown
  misc_feature (1)..( 7): Result.001 file - promoters60/1020848
ttaaaac

SEQ ID NO: 97401 - DNA, 7 bp, Unknown
  misc_feature (1)..( 7): Result.001 file - promoters60/1020848
ttacaac

SEQ ID NO: 97402 - DNA, 7 bp, Unknown
  misc_feature (1)..( 7): Result.001 file - promoters60/1020848
tttcaaa

SEQ ID NO: 97403 - DNA, 7 bp, Unknown
  misc_feature (1)..( 7): Result.001 file - promoters60/1020848
tttcaaa

SEQ ID NO: 97404 - DNA, 7 bp, Unknown
  misc_feature (1)..( 7): Result.001 file - promoters60/1020848
aactatt

SEQ ID NO: 97405 - DNA, 7 bp, Unknown
  misc_feature (1)..( 7): Result.001 file - promoters60/1020848
aaccatt

SEQ ID NO: 97406 - DNA, 7 bp, Unknown
  misc_feature (1)..( 7): Result.001 file - promoters60/1020848
atgtgag

SEQ ID NO: 97407 - DNA, 7 bp, Unknown
  misc_feature (1)..( 7): Result.001 file - promoters60/1020848
atgggag

SEQ ID NO: 97408 - DNA, 8 bp, Unknown
  misc_feature (1)..( 8): Result.001 file - promoters60/1020848
caattcaa

SEQ ID NO: 97409 - DNA, 8 bp, Unknown
  misc_feature (1)..( 8): Result.001 file - promoters60/1020848
caaatcaa

SEQ ID NO: 97410 - DNA, 7 bp, Unknown
  misc_feature (1)..( 7): Result.001 file - promoters60/1020848
attcaat

SEQ ID NO: 97411 - DNA, 7 bp, Unknown
  misc_feature (1)..( 7): Result.001 file - promoters60/1020848
atttaat

SEQ ID NO: 97412 - DNA, 8 bp, Unknown
  misc_feature (1)..( 8): Result.001 file - promoters60/1020848
atatcaat

SEQ ID NO: 97413 - DNA, 8 bp, Unknown
  misc_feature (1)..( 8): Result.001 file - promoters60/1020848
atagcaat

SEQ ID NO: 97414 - DNA, 6 bp, Unknown
  misc_feature (1)..( 6): Result.001 file - promoters60/1020848
ttttat

SEQ ID NO: 97415 - DNA, 6 bp, Unknown
  misc_feature (1)..( 6): Result.001 file - promoters60/1020848
ttttat

SEQ ID NO: 97416 - DNA, 6 bp, Unknown
  misc_feature (1)..( 6): Result.001 file - promoters60/1020848
atattt

SEQ ID NO: 97417 - DNA, 6 bp, Unknown
  misc_feature (1)..( 6): Result.001 file - promoters60/1020848
atattt

SEQ ID NO: 97418 - DNA, 7 bp, Unknown
  misc_feature (1)..( 7): Result.001 file - promoters60/1020848
tttcatg

SEQ ID NO: 97419 - DNA, 7 bp, Unknown
  misc_feature (1)..( 7): Result.001 file - promoters60/1020848
tttgatg

SEQ ID NO: 97420 - DNA, 6 bp, Unknown
  misc_feature (1)..( 6): Result.001 file - promoters60/1020848
gatcat

SEQ ID NO: 97421 - DNA, 6 bp, Unknown
  misc_feature (1)..( 6): Result.001 file - promoters60/1020848
gatcat

SEQ ID NO: 97422 - DNA, 6 bp, Unknown
  misc_feature (1)..( 6): Result.001 file - promoters60/1020848
aaattt

SEQ ID NO: 97423 - DNA, 6 bp, Unknown
  misc_feature (1)..( 6): Result.001 file - promoters60/1020848
aaattt

SEQ ID NO: 97424 - DNA, 6 bp, Unknown
  misc_feature (1)..( 6): Result.001 file - promoters60/1020848
tgtttt

SEQ ID NO: 97425 - DNA, 6 bp, Unknown
  misc_feature (1)..( 6): Result.001 file - promoters60/1020848
tgtttt

SEQ ID NO: 97426 - DNA, 6 bp, Unknown
  misc_feature (1)..( 6): Result.001 file - promoters60/1020848
atgcaa

SEQ ID NO: 97427 - DNA, 6 bp, Unknown
  misc_feature (1)..( 6): Result.001 file - promoters60/1020848
atgcaa

SEQ ID NO: 97428 - DNA, 7 bp, Unknown
  misc_feature (1)..( 7): Result.001 file - promoters60/1020848
tactttt

SEQ ID NO: 97429 - DNA, 7 bp, Unknown
  misc_feature (1)..( 7): Result.001 file - promoters60/1020863
tacattt

SEQ ID NO: 97430 - DNA, 9 bp, Unknown
  misc_feature (1)..( 9): Result.001 file - promoters60/1020863
gaaaatatt

SEQ ID NO: 97431 - DNA, 9 bp, Unknown
  misc_feature (1)..( 9): Result.001 file - promoters60/1020863
aaaaataag

SEQ ID NO: 97432 - DNA, 9 bp, Unknown
  misc_feature (1)..( 9): Result.001 file - promoters60/1020863
aaaaattaa

SEQ ID NO: 97433 - DNA, 9 bp, Unknown
  misc_feature (1)..( 9): Result.001 file - promoters60/1020863
aaacatatt

SEQ ID NO: 97434 - DNA, 9 bp, Unknown
  misc_feature (1)..( 9): Result.001 file - promoters60/1020863
taaaatttc

SEQ ID NO: 97435 - DNA, 9 bp, Unknown
  misc_feature (1)..( 9): Result.001 file - promoters60/1020863
caaaattga

SEQ ID NO: 97436 - DNA, 11 bp, Unknown
  misc_feature (1)..( 11): Result.001 file - promoters60/1020863
aaaataaataa

SEQ ID NO: 97437 - DNA, 11 bp, Unknown
  misc_feature (1)..( 11): Result.001 file - promoters60/1020863
ttaataaagct

SEQ ID NO: 97438 - DNA, 11 bp, Unknown
  misc_feature (1)..( 11): Result.001 file - promoters60/1020863
aaaattaatat

SEQ ID NO: 97439 - DNA, 11 bp, Unknown
  misc_feature (1)..( 11): Result.001 file - promoters60/1020863
gagataatatt

SEQ ID NO: 97440 - DNA, 11 bp, Unknown
  misc_feature (1)..( 11): Result.001 file - promoters60/1020863
attataaaata

SEQ ID NO: 97441 - DNA, 11 bp, Unknown
  misc_feature (1)..( 11): Result.001 file - promoters60/1020863
taaattagagt

SEQ ID NO: 97442 - DNA, 8 bp, Unknown
  misc_feature (1)..( 8): Result.001 file - promoters60/1020863
aaaacaaa

SEQ ID NO: 97443 - DNA, 8 bp, Unknown
  misc_feature (1)..( 8): Result.001 file - promoters60/1020863
aaaaaaaa

SEQ ID NO: 97444 - DNA, 8 bp, Unknown
  misc_feature (1)..( 8): Result.001 file - promoters60/1020863
ggaacaaa

SEQ ID NO: 97445 - DNA, 8 bp, Unknown
  misc_feature (1)..( 8): Result.001 file - promoters60/1020863
taaataaa

SEQ ID NO: 97446 - DNA, 8 bp, Unknown
  misc_feature (1)..( 8): Result.001 file - promoters60/1020863
caaacaaa

SEQ ID NO: 97447 - DNA, 8 bp, Unknown
  misc_feature (1)..( 8): Result.001 file - promoters60/1020863
taaaaaaa

SEQ ID NO: 97448 - DNA, 8 bp, Unknown
  misc_feature (1)..( 8): Result.001 file - promoters60/1020863
aaaataaa

SEQ ID NO: 97449 - DNA, 14 bp, Unknown
  misc_feature (1)..( 14): Result.001 file - promoters60/1020863
aaattgggactaaa

SEQ ID NO: 97450 - DNA, 14 bp, Unknown
  misc_feature (1)..( 14): Result.001 file - promoters60/1020863
ttatttggataaaa

SEQ ID NO: 97451 - DNA, 14 bp, Unknown
  misc_feature (1)..( 14): Result.001 file - promoters60/1020863
tcctttgaataaaa

SEQ ID NO: 97452 - DNA, 14 bp, Unknown
  misc_feature (1)..( 14): Result.001 file - promoters60/1020863
tccgttgacacgta

SEQ ID NO: 97453 - DNA, 14 bp, Unknown
  misc_feature (1)..( 14): Result.001 file - promoters60/1020863
ccaattaaaaagga

SEQ ID NO: 97454 - DNA, 14 bp, Unknown
  misc_feature (1)..( 14): Result.001 file - promoters60/1020863
aaaggtcaataaat

SEQ ID NO: 97455 - DNA, 14 bp, Unknown
  misc_feature (1)..( 14): Result.001 file - promoters60/1020863
ataacccaataatg

SEQ ID NO: 97456 - DNA, 9 bp, Unknown
  misc_feature (1)..( 9): Result.001 file - promoters60/1020863
ttgagttta

SEQ ID NO: 97457 - DNA, 9 bp, Unknown
  misc_feature (1)..( 9): Result.001 file - promoters60/1020863
ttgactttt

SEQ ID NO: 97458 - DNA, 9 bp, Unknown
  misc_feature (1)..( 9): Result.001 file - promoters60/1020863
gatagttta

SEQ ID NO: 97459 - DNA, 9 bp, Unknown
  misc_feature (1)..( 9): Result.001 file - promoters60/1020863
ttgaatttt

SEQ ID NO: 97460 - DNA, 9 bp, Unknown
  misc_feature (1)..( 9): Result.001 file - promoters60/1020863
ttggcttct

SEQ ID NO: 97461 - DNA, 9 bp, Unknown
  misc_feature (1)..( 9): Result.001 file - promoters60/1020863
tctaatttt

SEQ ID NO: 97462 - DNA, 11 bp, Unknown
  misc_feature (1)..( 11): Result.001 file - promoters60/1020863
tacaaaactac

SEQ ID NO: 97463 - DNA, 11 bp, Unknown
  misc_feature (1)..( 11): Result.001 file - promoters60/1020863
tacaaaaaaag

SEQ ID NO: 97464 - DNA, 11 bp, Unknown
  misc_feature (1)..( 11): Result.001 file - promoters60/1020863
cccaaaaataa

SEQ ID NO: 97465 - DNA, 11 bp, Unknown
  misc_feature (1)..( 11): Result.001 file - promoters60/1020863
tcctaaaatca

SEQ ID NO: 97466 - DNA, 11 bp, Unknown
  misc_feature (1)..( 11): Result.001 file - promoters60/1020863
aaataaacata

SEQ ID NO: 97467 - DNA, 11 bp, Unknown
  misc_feature (1)..( 11): Result.001 file - promoters60/1020863
cccaaaattga

SEQ ID NO: 97468 - DNA, 13 bp, Unknown
  misc_feature (1)..( 13): Result.001 file - promoters60/1020863
aataaataaaagc

SEQ ID NO: 97469 - DNA, 13 bp, Unknown
  misc_feature (1)..( 13): Result.001 file - promoters60/1020863
aaacaataaaatt

SEQ ID NO: 97470 - DNA, 13 bp, Unknown
  misc_feature (1)..( 13): Result.001 file - promoters60/1020863
acattataaaata

SEQ ID NO: 97471 - DNA, 13 bp, Unknown
  misc_feature (1)..( 13): Result.001 file - promoters60/1020863
aaacagtaaaacc

SEQ ID NO: 97472 - DNA, 13 bp, Unknown
  misc_feature (1)..( 13): Result.001 file - promoters60/1020863
aggagataatatt

SEQ ID NO: 97473 - DNA, 13 bp, Unknown
  misc_feature (1)..( 13): Result.001 file - promoters60/1020863
ttcttagaaaaat

SEQ ID NO: 97474 - DNA, 10 bp, Unknown
  misc_feature (1)..( 10): Result.001 file - promoters60/1020863
atattattag

SEQ ID NO: 97475 - DNA, 10 bp, Unknown
  misc_feature (1)..( 10): Result.001 file - promoters60/1020863
atattattag

SEQ ID NO: 97476 - DNA, 10 bp, Unknown
  misc_feature (1)..( 10): Result.001 file - promoters60/1020863
ttattatatt

SEQ ID NO: 97477 - DNA, 10 bp, Unknown
  misc_feature (1)..( 10): Result.001 file - promoters60/1020863
atataattat

SEQ ID NO: 97478 - DNA, 10 bp, Unknown
  misc_feature (1)..( 10): Result.001 file - promoters60/1020863
ccttaattac

SEQ ID NO: 97479 - DNA, 11 bp, Unknown
  misc_feature (1)..( 11): Result.001 file - promoters60/1020863
ggattaattct

SEQ ID NO: 97480 - DNA, 10 bp, Unknown
  misc_feature (1)..( 10): Result.001 file - promoters60/1020863
gaaaaacaaa

SEQ ID NO: 97481 - DNA, 10 bp, Unknown
  misc_feature (1)..( 10): Result.001 file - promoters60/1020863
gaaaaaatag

SEQ ID NO: 97482 - DNA, 10 bp, Unknown
  misc_feature (1)..( 10): Result.001 file - promoters60/1020863
gaaaaaaaag

SEQ ID NO: 97483 - DNA, 11 bp, Unknown
  misc_feature (1)..( 11): Result.001 file - promoters60/1020863
gaacaaaaccg

SEQ ID NO: 97484 - DNA, 11 bp, Unknown
  misc_feature (1)..( 11): Result.001 file - promoters60/1020863
taaaaaatatt

SEQ ID NO: 97485 - DNA, 11 bp, Unknown
  misc_feature (1)..( 11): Result.001 file - promoters60/1020863
aagaaaatata

SEQ ID NO: 97486 - DNA, 7 bp, Unknown
  misc_feature (1)..( 7): Result.001 file - promoters60/1020863
taagatt

SEQ ID NO: 97487 - DNA, 7 bp, Unknown
  misc_feature (1)..( 7): Result.001 file - promoters60/1020863
taaaatt

SEQ ID NO: 97488 - DNA, 7 bp, Unknown
  misc_feature (1)..( 7): Result.001 file - promoters60/1020863
aaaaatt

SEQ ID NO: 97489 - DNA, 8 bp, Unknown
  misc_feature (1)..( 8): Result.001 file - promoters60/1020863
taacaatt

SEQ ID NO: 97490 - DNA, 8 bp, Unknown
  misc_feature (1)..( 8): Result.001 file - promoters60/1020863
ccaaaatt

SEQ ID NO: 97491 - DNA, 8 bp, Unknown
  misc_feature (1)..( 8): Result.001 file - promoters60/1020863
acacaatt

SEQ ID NO: 97492 - DNA, 8 bp, Unknown
  misc_feature (1)..( 8): Result.001 file - promoters60/1020863
atttattt

SEQ ID NO: 97493 - DNA, 8 bp, Unknown
  misc_feature (1)..( 8): Result.001 file - promoters60/1020863
attcattt

SEQ ID NO: 97494 - DNA, 8 bp, Unknown
  misc_feature (1)..( 8): Result.001 file - promoters60/1020863
ttttattc

SEQ ID NO: 97495 - DNA, 8 bp, Unknown
  misc_feature (1)..( 8): Result.001 file - promoters60/1020863
attttttt

SEQ ID NO: 97496 - DNA, 8 bp, Unknown
  misc_feature (1)..( 8): Result.001 file - promoters60/1020863
gttttttc

SEQ ID NO: 97497 - DNA, 8 bp, Unknown
  misc_feature (1)..( 8): Result.001 file - promoters60/1020892
tttcattt

SEQ ID NO: 97498 - DNA, 8 bp, Unknown
  misc_feature (1)..( 8): Result.001 file - promoters60/1020892
gtttcatc

SEQ ID NO: 97499 - DNA, 8 bp, Unknown
  misc_feature (1)..( 8): Result.001 file - promoters60/1020892
gtttcaca

SEQ ID NO: 97500 - DNA, 8 bp, Unknown
  misc_feature (1)..( 8): Result.001 file - promoters60/1020892
gtttcatg

SEQ ID NO: 97501 - DNA, 8 bp, Unknown
  misc_feature (1)..( 8): Result.001 file - promoters60/1020892
tttttaca

SEQ ID NO: 97502 - DNA, 9 bp, Unknown
  misc_feature (1)..( 9): Result.001 file - promoters60/1020892
gttattaaa

SEQ ID NO: 97503 - DNA, 9 bp, Unknown
  misc_feature (1)..( 9): Result.001 file - promoters60/1020892
atttttaac

SEQ ID NO: 97504 - DNA, 11 bp, Unknown
  misc_feature (1)..( 11): Result.001 file - promoters60/1020892
ttactgaaaaa

SEQ ID NO: 97505 - DNA, 11 bp, Unknown
  misc_feature (1)..( 11): Result.001 file - promoters60/1020892
gctatgaaaag

SEQ ID NO: 97506 - DNA, 12 bp, Unknown
  misc_feature (1)..( 12): Result.001 file - promoters60/1020892
ttacagaacaat

SEQ ID NO: 97507 - DNA, 12 bp, Unknown
  misc_feature (1)..( 12): Result.001 file - promoters60/1020892
ctacagacagta

SEQ ID NO: 97508 - DNA, 12 bp, Unknown
  misc_feature (1)..( 12): Result.001 file - promoters60/1020892
ttactgaagccc

SEQ ID NO: 97509 - DNA, 12 bp, Unknown
  misc_feature (1)..( 12): Result.001 file - promoters60/1020940
ctgctgcagcac

SEQ ID NO: 97510 - DNA, 8 bp, Unknown
  misc_feature (1)..( 8): Result.001 file - promoters60/1020940
taaaatgt

SEQ ID NO: 97511 - DNA, 8 bp, Unknown
  misc_feature (1)..( 8): Result.001 file - promoters60/1020940
taaaattg

SEQ ID NO: 97512 - DNA, 8 bp, Unknown
  misc_feature (1)..( 8): Result.001 file - promoters60/1020940
taacatga

SEQ ID NO: 97513 - DNA, 8 bp, Unknown
  misc_feature (1)..( 8): Result.001 file - promoters60/1020940
taagattg

SEQ ID NO: 97514 - DNA, 10 bp, Unknown
  misc_feature (1)..( 10): Result.001 file - promoters60/1020940
acaaaataga

SEQ ID NO: 97515 - DNA, 10 bp, Unknown
  misc_feature (1)..( 10): Result.001 file - promoters60/1020940
gaaaaaaaga

SEQ ID NO: 97516 - DNA, 10 bp, Unknown
  misc_feature (1)..( 10): Result.001 file - promoters60/1020940
acaaaattag

SEQ ID NO: 97517 - DNA, 10 bp, Unknown
  misc_feature (1)..( 10): Result.001 file - promoters60/1020940
gttaaataaa

SEQ ID NO: 97518 - DNA, 9 bp, Unknown
  misc_feature (1)..( 9): Result.001 file - promoters60/1020940
caacaaaat

SEQ ID NO: 97519 - DNA, 9 bp, Unknown
  misc_feature (1)..( 9): Result.001 file - promoters60/1020940
aaacaaaga

SEQ ID NO: 97520 - DNA, 9 bp, Unknown
  misc_feature (1)..( 9): Result.001 file - promoters60/1020940
atacaaaat

SEQ ID NO: 97521 - DNA, 9 bp, Unknown
  misc_feature (1)..( 9): Result.001 file - promoters60/1020940
aaataaagc

SEQ ID NO: 97522 - DNA, 7 bp, Unknown
  misc_feature (1)..( 7): Result.001 file - promoters60/1020940
aaattaa

SEQ ID NO: 97523 - DNA, 7 bp, Unknown
  misc_feature (1)..( 7): Result.001 file - promoters60/1020940
aaattat

SEQ ID NO: 97524 - DNA, 7 bp, Unknown
  misc_feature (1)..( 7): Result.001 file - promoters60/1020940
aaatatt

SEQ ID NO: 97525 - DNA, 10 bp, Unknown
  misc_feature (1)..( 10): Result.001 file - promoters60/1020940
tatatatacc

SEQ ID NO: 97526 - DNA, 10 bp, Unknown
  misc_feature (1)..( 10): Result.001 file - promoters60/1020940
tatataaacc

SEQ ID NO: 97527 - DNA, 10 bp, Unknown
  misc_feature (1)..( 10): Result.001 file - promoters60/1020940
tatataaagg

SEQ ID NO: 97528 - DNA, 10 bp, Unknown
  misc_feature (1)..( 10): Result.001 file - promoters60/1020940
tatttaaaca

SEQ ID NO: 97529 - DNA, 7 bp, Unknown
  misc_feature (1)..( 7): Result.001 file - promoters60/1020940
aaaatag

SEQ ID NO: 97530 - DNA, 7 bp, Unknown
  misc_feature (1)..( 7): Result.001 file - promoters60/1020940
aaattag

SEQ ID NO: 97531 - DNA, 7 bp, Unknown
  misc_feature (1)..( 7): Result.001 file - promoters60/1020940
aaaattg

SEQ ID NO: 97532 - DNA, 9 bp, Unknown
  misc_feature (1)..( 9): Result.001 file - promoters60/1020940
tgagtaatc

SEQ ID NO: 97533 - DNA, 9 bp, Unknown
  misc_feature (1)..( 9): Result.001 file - promoters60/1020940
tgaataatg

SEQ ID NO: 97534 - DNA, 9 bp, Unknown
  misc_feature (1)..( 9): Result.001 file - promoters60/1020940
tgtataatg

SEQ ID NO: 97535 - DNA, 10 bp, Unknown
  misc_feature (1)..( 10): Result.001 file - promoters60/1020940
atagtaaacg

SEQ ID NO: 97536 - DNA, 10 bp, Unknown
  misc_feature (1)..( 10): Result.001 file - promoters60/1020940
ataataaata

SEQ ID NO: 97537 - DNA, 10 bp, Unknown
  misc_feature (1)..( 10): Result.001 file - promoters60/1020968
aagataaata

SEQ ID NO: 97538 - DNA, 10 bp, Unknown
  misc_feature (1)..( 10): Result.001 file - promoters60/1020968
gtaatttaat

SEQ ID NO: 97539 - DNA, 10 bp, Unknown
  misc_feature (1)..( 10): Result.001 file - promoters60/1020968
gtaatttaaa

SEQ ID NO: 97540 - DNA, 10 bp, Unknown
  misc_feature (1)..( 10): Result.001 file - promoters60/1020968
atcatttaag

SEQ ID NO: 97541 - DNA, 10 bp, Unknown
  misc_feature (1)..( 10): Result.001 file - promoters60/1020968
gaaatgtaac

SEQ ID NO: 97542 - DNA, 10 bp, Unknown
  misc_feature (1)..( 10): Result.001 file - promoters60/1020968
cgaattcaaa

SEQ ID NO: 97543 - DNA, 12 bp, Unknown
  misc_feature (1)..( 12): Result.001 file - promoters60/1020968
gatattaggttt

SEQ ID NO: 97544 - DNA, 12 bp, Unknown
  misc_feature (1)..( 12): Result.001 file - promoters60/1020968
tcatttaagttt

SEQ ID NO: 97545 - DNA, 11 bp, Unknown
  misc_feature (1)..( 11): Result.001 file - promoters60/1020968
tatttgagtta

SEQ ID NO: 97546 - DNA, 12 bp, Unknown
  misc_feature (1)..( 12): Result.001 file - promoters60/1020968
attcttaaattt

SEQ ID NO: 97547 - DNA, 12 bp, Unknown
  misc_feature (1)..( 12): Result.001 file - promoters60/1020968
aattctaaaatc

SEQ ID NO: 97548 - DNA, 12 bp, Unknown
  misc_feature (1)..( 12): Result.001 file - promoters60/1020968
ttttaatttttt

SEQ ID NO: 97549 - DNA, 12 bp, Unknown
  misc_feature (1)..( 12): Result.001 file - promoters60/1020968
aggaaattttca

SEQ ID NO: 97550 - DNA, 12 bp, Unknown
  misc_feature (1)..( 12): Result.001 file - promoters60/1020968
cttaaatttaaa

SEQ ID NO: 97551 - DNA, 12 bp, Unknown
  misc_feature (1)..( 12): Result.001 file - promoters60/1020968
atataatattca

SEQ ID NO: 97552 - DNA, 12 bp, Unknown
  misc_feature (1)..( 12): Result.001 file - promoters60/1020968
attcaattaact

SEQ ID NO: 97553 - DNA, 11 bp, Unknown
  misc_feature (1)..( 11): Result.001 file - promoters60/1020968
ttttttgaaat

SEQ ID NO: 97554 - DNA, 11 bp, Unknown
  misc_feature (1)..( 11): Result.001 file - promoters60/1020968
aattttcaaat

SEQ ID NO: 97555 - DNA, 11 bp, Unknown
  misc_feature (1)..( 11): Result.001 file - promoters60/1020968
aaatttaaaaa

SEQ ID NO: 97556 - DNA, 11 bp, Unknown
  misc_feature (1)..( 11): Result.001 file - promoters60/1020968
aatattcagtt

SEQ ID NO: 97557 - DNA, 11 bp, Unknown
  misc_feature (1)..( 11): Result.001 file - promoters60/1020968
ccggttcaaac

SEQ ID NO: 97558 - DNA, 9 bp, Unknown
  misc_feature (1)..( 9): Result.001 file - promoters60/1020968
ttaaaatat

SEQ ID NO: 97559 - DNA, 9 bp, Unknown
  misc_feature (1)..( 9): Result.001 file - promoters60/1020968
ataaaatga

SEQ ID NO: 97560 - DNA, 9 bp, Unknown
  misc_feature (1)..( 9): Result.001 file - promoters60/1020968
ttaaaatat

SEQ ID NO: 97561 - DNA, 9 bp, Unknown
  misc_feature (1)..( 9): Result.001 file - promoters60/1020968
ttaatatac

SEQ ID NO: 97562 - DNA, 9 bp, Unknown
  misc_feature (1)..( 9): Result.001 file - promoters60/1020968
gtaaaattt

SEQ ID NO: 97563 - DNA, 9 bp, Unknown
  misc_feature (1)..( 9): Result.001 file - promoters60/1020968
ggaaacttt

SEQ ID NO: 97564 - DNA, 14 bp, Unknown
  misc_feature (1)..( 14): Result.001 file - promoters60/1020968
gacaaattaccttt

SEQ ID NO: 97565 - DNA, 14 bp, Unknown
  misc_feature (1)..( 14): Result.001 file - promoters60/1020968
ttataattacgctt

SEQ ID NO: 97566 - DNA, 14 bp, Unknown
  misc_feature (1)..( 14): Result.001 file - promoters60/1020968
ttatagttaatggt

SEQ ID NO: 97567 - DNA, 14 bp, Unknown
  misc_feature (1)..( 14): Result.001 file - promoters60/1020968
atatatttatatga

SEQ ID NO: 97568 - DNA, 14 bp, Unknown
  misc_feature (1)..( 14): Result.001 file - promoters60/1020968
atgtgattaaatat

SEQ ID NO: 97569 - DNA, 13 bp, Unknown
  misc_feature (1)..( 13): Result.001 file - promoters60/1020968
taggtttaaattt

SEQ ID NO: 97570 - DNA, 13 bp, Unknown
  misc_feature (1)..( 13): Result.001 file - promoters60/1020968
tgtgattaaatat

SEQ ID NO: 97571 - DNA, 13 bp, Unknown
  misc_feature (1)..( 13): Result.001 file - promoters60/1020968
aattcttaaattt

SEQ ID NO: 97572 - DNA, 13 bp, Unknown
  misc_feature (1)..( 13): Result.001 file - promoters60/1020968
atcatttaagttt

SEQ ID NO: 97573 - DNA, 13 bp, Unknown
  misc_feature (1)..( 13): Result.001 file - promoters60/1020968
aattctaaaatct

SEQ ID NO: 97574 - DNA, 8 bp, Unknown
  misc_feature (1)..( 8): Result.001 file - promoters60/1020968
aaagtaat

SEQ ID NO: 97575 - DNA, 8 bp, Unknown
  misc_feature (1)..( 8): Result.001 file - promoters60/1020968
aaaataaa

SEQ ID NO: 97576 - DNA, 8 bp, Unknown
  misc_feature (1)..( 8): Result.001 file - promoters60/1020968
aaaataaa

SEQ ID NO: 97577 - DNA, 8 bp, Unknown
  misc_feature (1)..( 8): Result.001 file - promoters60/1020968
tcaataaa

SEQ ID NO: 97578 - DNA, 8 bp, Unknown
  misc_feature (1)..( 8): Result.001 file - promoters60/1020968
tcaataaa

SEQ ID NO: 97579 - DNA, 8 bp, Unknown
  misc_feature (1)..( 8): Result.001 file - promoters60/1020968
caaataaa

SEQ ID NO: 97580 - DNA, 8 bp, Unknown
  misc_feature (1)..( 8): Result.001 file - promoters60/1021001
aaaatatt

SEQ ID NO: 97581 - DNA, 11 bp, Unknown
  misc_feature (1)..( 11): Result.001 file - promoters60/1021001
gagaaaaaaag

SEQ ID NO: 97582 - DNA, 11 bp, Unknown
  misc_feature (1)..( 11): Result.001 file - promoters60/1021001
atcaaacaaat

SEQ ID NO: 97583 - DNA, 11 bp, Unknown
  misc_feature (1)..( 11): Result.001 file - promoters60/1021001
accaaagaaag

SEQ ID NO: 97584 - DNA, 11 bp, Unknown
  misc_feature (1)..( 11): Result.001 file - promoters60/1021001
ctgaaacaaca

SEQ ID NO: 97585 - DNA, 11 bp, Unknown
  misc_feature (1)..( 11): Result.001 file - promoters60/1021001
tacaaggaaag

SEQ ID NO: 97586 - DNA, 11 bp, Unknown
  misc_feature (1)..( 11): Result.001 file - promoters60/1021047
taccaggaggt

SEQ ID NO: 97587 - DNA, 6 bp, Unknown
  misc_feature (1)..( 6): Result.001 file - promoters60/1021047
tcaatg

SEQ ID NO: 97588 - DNA, 6 bp, Unknown
  misc_feature (1)..( 6): Result.001 file - promoters60/1021047
tcaatg

SEQ ID NO: 97589 - DNA, 8 bp, Unknown
  misc_feature (1)..( 8): Result.001 file - promoters60/1021047
cacatcct

SEQ ID NO: 97590 - DNA, 8 bp, Unknown
  misc_feature (1)..( 8): Result.001 file - promoters60/1021047
cacaccct

SEQ ID NO: 97591 - DNA, 10 bp, Unknown
  misc_feature (1)..( 10): Result.001 file - promoters60/1021047
gttatattaa

SEQ ID NO: 97592 - DNA, 10 bp, Unknown
  misc_feature (1)..( 10): Result.001 file - promoters60/1021047
attattttaa

SEQ ID NO: 97593 - DNA, 11 bp, Unknown
  misc_feature (1)..( 11): Result.001 file - promoters60/1021047
tttgattttta

SEQ ID NO: 97594 - DNA, 10 bp, Unknown
  misc_feature (1)..( 10): Result.001 file - promoters60/1021047
taaaatgttg

SEQ ID NO: 97595 - DNA, 10 bp, Unknown
  misc_feature (1)..( 10): Result.001 file - promoters60/1021047
tttaattttg

SEQ ID NO: 97596 - DNA, 10 bp, Unknown
  misc_feature (1)..( 10): Result.001 file - promoters60/1021047
tttgattttt

SEQ ID NO: 97597 - DNA, 7 bp, Unknown
  misc_feature (1)..( 7): Result.001 file - promoters60/1021047
ttatgta

SEQ ID NO: 97598 - DNA, 7 bp, Unknown
  misc_feature (1)..( 7): Result.001 file - promoters60/1021047
ttaagta

SEQ ID NO: 97599 - DNA, 8 bp, Unknown
  misc_feature (1)..( 8): Result.001 file - promoters60/1021047
aaatttta

SEQ ID NO: 97600 - DNA, 8 bp, Unknown
  misc_feature (1)..( 8): Result.001 file - promoters60/1021047
aaatatta

SEQ ID NO: 97601 - DNA, 8 bp, Unknown
  misc_feature (1)..( 8): Result.001 file - promoters60/1021047
atatttta

SEQ ID NO: 97602 - DNA, 6 bp, Unknown
  misc_feature (1)..( 6): Result.001 file - promoters60/1021047
aaactt

SEQ ID NO: 97603 - DNA, 6 bp, Unknown
  misc_feature (1)..( 6): Result.001 file - promoters60/1021047
aaactt

SEQ ID NO: 97604 - DNA, 10 bp, Unknown
  misc_feature (1)..( 10): Result.001 file - promoters60/1021047
agatattttg

SEQ ID NO: 97605 - DNA, 10 bp, Unknown
  misc_feature (1)..( 10): Result.001 file - promoters60/1021047
agatattttg

SEQ ID NO: 97606 - DNA, 7 bp, Unknown
  misc_feature (1)..( 7): Result.001 file - promoters60/1021047
tttttta

SEQ ID NO: 97607 - DNA, 7 bp, Unknown
  misc_feature (1)..( 7): Result.001 file - promoters60/1021047
tttctta

SEQ ID NO: 97608 - DNA, 6 bp, Unknown
  misc_feature (1)..( 6): Result.001 file - promoters60/1021047
atatta

SEQ ID NO: 97609 - DNA, 6 bp, Unknown
  misc_feature (1)..( 6): Result.001 file - promoters60/1021047
atatta

SEQ ID NO: 97610 - DNA, 6 bp, Unknown
  misc_feature (1)..( 6): Result.001 file - promoters60/1021047
aatgtt

SEQ ID NO: 97611 - DNA, 6 bp, Unknown
  misc_feature (1)..( 6): Result.001 file - promoters60/1021047
aatgtt

SEQ ID NO: 97612 - DNA, 8 bp, Unknown
  misc_feature (1)..( 8): Result.001 file - promoters60/1021047
tatataaa

SEQ ID NO: 97613 - DNA, 8 bp, Unknown
  misc_feature (1)..( 8): Result.001 file - promoters60/1021047
tatttaaa

SEQ ID NO: 97614 - DNA, 6 bp, Unknown
  misc_feature (1)..( 6): Result.001 file - promoters60/1021047
taattt

SEQ ID NO: 97615 - DNA, 6 bp, Unknown
  misc_feature (1)..( 6): Result.001 file - promoters60/1021047
taattt

SEQ ID NO: 97616 - DNA, 7 bp, Unknown
  misc_feature (1)..( 7): Result.001 file - promoters60/1021047
tttattt

SEQ ID NO: 97617 - DNA, 7 bp, Unknown
  misc_feature (1)..( 7): Result.001 file - promoters60/1021047
tttattt

SEQ ID NO: 97618 - DNA, 6 bp, Unknown
  misc_feature (1)..( 6): Result.001 file - promoters60/1021047
tcatcc

SEQ ID NO: 97619 - DNA, 6 bp, Unknown
  misc_feature (1)..( 6): Result.001 file - promoters60/1021047
tcatcc

SEQ ID NO: 97620 - DNA, 6 bp, Unknown
  misc_feature (1)..( 6): Result.001 file - promoters60/1021047
tttttt

SEQ ID NO: 97621 - DNA, 6 bp, Unknown
  misc_feature (1)..( 6): Result.001 file - promoters60/1021047
tttttt

SEQ ID NO: 97622 - DNA, 14 bp, Unknown
  misc_feature (1)..( 14): Result.001 file - promoters60/1021047
aaaattaagttcaa

SEQ ID NO: 97623 - DNA, 14 bp, Unknown
  misc_feature (1)..( 14): Result.001 file - promoters60/1021047
aaacttaatttcaa

SEQ ID NO: 97624 - DNA, 9 bp, Unknown
  misc_feature (1)..( 9): Result.001 file - promoters60/1021047
aagaaaaaa

SEQ ID NO: 97625 - DNA, 9 bp, Unknown
  misc_feature (1)..( 9): Result.001 file - promoters60/1021047
aagagaaaa

SEQ ID NO: 97626 - DNA, 6 bp, Unknown
  misc_feature (1)..( 6): Result.001 file - promoters60/1021047
aaaaca

SEQ ID NO: 97627 - DNA, 6 bp, Unknown
  misc_feature (1)..( 6): Result.001 file - promoters60/1021047
aaaaca

SEQ ID NO: 97628 - DNA, 6 bp, Unknown
  misc_feature (1)..( 6): Result.001 file - promoters60/1021047
ctaaga

SEQ ID NO: 97629 - DNA, 6 bp, Unknown
  misc_feature (1)..( 6): Result.001 file - promoters60/1021047
ctaaga

SEQ ID NO: 97630 - DNA, 6 bp, Unknown
  misc_feature (1)..( 6): Result.001 file - promoters60/1021047
aataat

SEQ ID NO: 97631 - DNA, 6 bp, Unknown
  misc_feature (1)..( 6): Result.001 file - promoters60/1021079
aataat

SEQ ID NO: 97632 - DNA, 9 bp, Unknown
  misc_feature (1)..( 9): Result.001 file - promoters60/1021079
taaaatata

SEQ ID NO: 97633 - DNA, 9 bp, Unknown
  misc_feature (1)..( 9): Result.001 file - promoters60/1021079
taaaatatt

SEQ ID NO: 97634 - DNA, 9 bp, Unknown
  misc_feature (1)..( 9): Result.001 file - promoters60/1021079
caatttatc

SEQ ID NO: 97635 - DNA, 9 bp, Unknown
  misc_feature (1)..( 9): Result.001 file - promoters60/1021079
gaaaacata

SEQ ID NO: 97636 - DNA, 9 bp, Unknown
  misc_feature (1)..( 9): Result.001 file - promoters60/1021079
aaaaataca

SEQ ID NO: 97637 - DNA, 9 bp, Unknown
  misc_feature (1)..( 9): Result.001 file - promoters60/1021079
gtaaatacg

SEQ ID NO: 97638 - DNA, 13 bp, Unknown
  misc_feature (1)..( 13): Result.001 file - promoters60/1021079
tcatttttatttt

SEQ ID NO: 97639 - DNA, 13 bp, Unknown
  misc_feature (1)..( 13): Result.001 file - promoters60/1021079
aaaattttgtttt

SEQ ID NO: 97640 - DNA, 13 bp, Unknown
  misc_feature (1)..( 13): Result.001 file - promoters60/1021079
tggtatttgtttt

SEQ ID NO: 97641 - DNA, 13 bp, Unknown
  misc_feature (1)..( 13): Result.001 file - promoters60/1021079
gacattttttttt

SEQ ID NO: 97642 - DNA, 13 bp, Unknown
  misc_feature (1)..( 13): Result.001 file - promoters60/1021079
aaaattttgcact

SEQ ID NO: 97643 - DNA, 13 bp, Unknown
  misc_feature (1)..( 13): Result.001 file - promoters60/1021079
acaactgtgttta

SEQ ID NO: 97644 - DNA, 13 bp, Unknown
  misc_feature (1)..( 13): Result.001 file - promoters60/1021079
aaaatttatacgc

SEQ ID NO: 97645 - DNA, 12 bp, Unknown
  misc_feature (1)..( 12): Result.001 file - promoters60/1021079
taattaagttta

SEQ ID NO: 97646 - DNA, 12 bp, Unknown
  misc_feature (1)..( 12): Result.001 file - promoters60/1021079
tgcttaagatta

SEQ ID NO: 97647 - DNA, 12 bp, Unknown
  misc_feature (1)..( 12): Result.001 file - promoters60/1021079
ctattcagtgca

SEQ ID NO: 97648 - DNA, 12 bp, Unknown
  misc_feature (1)..( 12): Result.001 file - promoters60/1021079
aacttaagataa

SEQ ID NO: 97649 - DNA, 12 bp, Unknown
  misc_feature (1)..( 12): Result.001 file - promoters60/1021079
tttttaatatat

SEQ ID NO: 97650 - DNA, 12 bp, Unknown
  misc_feature (1)..( 12): Result.001 file - promoters60/1021079
tttttaatttct

SEQ ID NO: 97651 - DNA, 15 bp, Unknown
  misc_feature (1)..( 15): Result.001 file - promoters60/1021079
aaatttatagtacta

SEQ ID NO: 97652 - DNA, 15 bp, Unknown
  misc_feature (1)..( 15): Result.001 file - promoters60/1021079
atatatatagtatgg

SEQ ID NO: 97653 - DNA, 15 bp, Unknown
  misc_feature (1)..( 15): Result.001 file - promoters60/1021079
ataaaaataatattc

SEQ ID NO: 97654 - DNA, 15 bp, Unknown
  misc_feature (1)..( 15): Result.001 file - promoters60/1021079
ataaaaataatttta

SEQ ID NO: 97655 - DNA, 15 bp, Unknown
  misc_feature (1)..( 15): Result.001 file - promoters60/1021079
atttaaataatatta

SEQ ID NO: 97656 - DNA, 15 bp, Unknown
  misc_feature (1)..( 15): Result.001 file - promoters60/1021079
ctttgcttaagatta

SEQ ID NO: 97657 - DNA, 9 bp, Unknown
  misc_feature (1)..( 9): Result.001 file - promoters60/1021079
taaaaactt

SEQ ID NO: 97658 - DNA, 9 bp, Unknown
  misc_feature (1)..( 9): Result.001 file - promoters60/1021079
ttaaaacta

SEQ ID NO: 97659 - DNA, 9 bp, Unknown
  misc_feature (1)..( 9): Result.001 file - promoters60/1021079
taaaaacaa

SEQ ID NO: 97660 - DNA, 9 bp, Unknown
  misc_feature (1)..( 9): Result.001 file - promoters60/1021079
aaaatacaa

SEQ ID NO: 97661 - DNA, 9 bp, Unknown
  misc_feature (1)..( 9): Result.001 file - promoters60/1021079
taaaaagaa

SEQ ID NO: 97662 - DNA, 9 bp, Unknown
  misc_feature (1)..( 9): Result.001 file - promoters60/1021079
aaaagacat

SEQ ID NO: 97663 - DNA, 10 bp, Unknown
  misc_feature (1)..( 10): Result.001 file - promoters60/1021079
ttgaaacacc

SEQ ID NO: 97664 - DNA, 10 bp, Unknown
  misc_feature (1)..( 10): Result.001 file - promoters60/1021079
ttgaatcact

SEQ ID NO: 97665 - DNA, 10 bp, Unknown
  misc_feature (1)..( 10): Result.001 file - promoters60/1021079
ttgatacaca

SEQ ID NO: 97666 - DNA, 10 bp, Unknown
  misc_feature (1)..( 10): Result.001 file - promoters60/1021079
tgcaatcaca

SEQ ID NO: 97667 - DNA, 10 bp, Unknown
  misc_feature (1)..( 10): Result.001 file - promoters60/1021079
gagaattact

SEQ ID NO: 97668 - DNA, 10 bp, Unknown
  misc_feature (1)..( 10): Result.001 file - promoters60/1021079
tttactcatg

SEQ ID NO: 97669 - DNA, 10 bp, Unknown
  misc_feature (1)..( 10): Result.001 file - promoters60/1021079
tcataaaaac

SEQ ID NO: 97670 - DNA, 10 bp, Unknown
  misc_feature (1)..( 10): Result.001 file - promoters60/1021079
tcataaaata

SEQ ID NO: 97671 - DNA, 10 bp, Unknown
  misc_feature (1)..( 10): Result.001 file - promoters60/1021079
gtttaaaaag

SEQ ID NO: 97672 - DNA, 10 bp, Unknown
  misc_feature (1)..( 10): Result.001 file - promoters60/1021079
tagtaaaaac

SEQ ID NO: 97673 - DNA, 10 bp, Unknown
  misc_feature (1)..( 10): Result.001 file - promoters60/1021079
gattaaaact

SEQ ID NO: 97674 - DNA, 10 bp, Unknown
  misc_feature (1)..( 10): Result.001 file - promoters60/1021079
atgtaaaatg

SEQ ID NO: 97675 - DNA, 12 bp, Unknown
  misc_feature (1)..( 12): Result.001 file - promoters60/1021079
cataaaattttg

SEQ ID NO: 97676 - DNA, 12 bp, Unknown
  misc_feature (1)..( 12): Result.001 file - promoters60/1021079
cctaaaatcatg

SEQ ID NO: 97677 - DNA, 12 bp, Unknown
  misc_feature (1)..( 12): Result.001 file - promoters60/1021079
ttgaaaatttat

SEQ ID NO: 97678 - DNA, 12 bp, Unknown
  misc_feature (1)..( 12): Result.001 file - promoters60/1021079
accaaaattttg

SEQ ID NO: 97679 - DNA, 12 bp, Unknown
  misc_feature (1)..( 12): Result.001 file - promoters60/1021079
cctataatttgg

SEQ ID NO: 97680 - DNA, 12 bp, Unknown
  misc_feature (1)..( 12): Result.001 file - promoters60/1021104
ttagtaatttag

SEQ ID NO: 97681 - DNA, 11 bp, Unknown
  misc_feature (1)..( 11): Result.001 file - promoters60/1021104
gaaattcttcc

SEQ ID NO: 97682 - DNA, 11 bp, Unknown
  misc_feature (1)..( 11): Result.001 file - promoters60/1021104
tcaatccttta

SEQ ID NO: 97683 - DNA, 11 bp, Unknown
  misc_feature (1)..( 11): Result.001 file - promoters60/1021104
gaaattctggt

SEQ ID NO: 97684 - DNA, 11 bp, Unknown
  misc_feature (1)..( 11): Result.001 file - promoters60/1021104
gattttcttct

SEQ ID NO: 97685 - DNA, 11 bp, Unknown
  misc_feature (1)..( 11): Result.001 file - promoters60/1021104
catgttcctct

SEQ ID NO: 97686 - DNA, 9 bp, Unknown
  misc_feature (1)..( 9): Result.001 file - promoters60/1021104
agaattcat

SEQ ID NO: 97687 - DNA, 9 bp, Unknown
  misc_feature (1)..( 9): Result.001 file - promoters60/1021104
agaagtcaa

SEQ ID NO: 97688 - DNA, 9 bp, Unknown
  misc_feature (1)..( 9): Result.001 file - promoters60/1021104
ggaagtcat

SEQ ID NO: 97689 - DNA, 9 bp, Unknown
  misc_feature (1)..( 9): Result.001 file - promoters60/1021104
gcaattcaa

SEQ ID NO: 97690 - DNA, 9 bp, Unknown
  misc_feature (1)..( 9): Result.001 file - promoters60/1021104
tgaacaaga

SEQ ID NO: 97691 - DNA, 13 bp, Unknown
  misc_feature (1)..( 13): Result.001 file - promoters60/1021104
agttttgtaataa

SEQ ID NO: 97692 - DNA, 13 bp, Unknown
  misc_feature (1)..( 13): Result.001 file - promoters60/1021104
ccttttgtgttcg

SEQ ID NO: 97693 - DNA, 13 bp, Unknown
  misc_feature (1)..( 13): Result.001 file - promoters60/1021104
agtcttggtttct

SEQ ID NO: 97694 - DNA, 13 bp, Unknown
  misc_feature (1)..( 13): Result.001 file - promoters60/1021104
aatttcgtaataa

SEQ ID NO: 97695 - DNA, 13 bp, Unknown
  misc_feature (1)..( 13): Result.001 file - promoters60/1021136
tgattcgtaagtt

SEQ ID NO: 97696 - DNA, 7 bp, Unknown
  misc_feature (1)..( 7): Result.001 file - promoters60/1021136
aatgttt

SEQ ID NO: 97697 - DNA, 7 bp, Unknown
  misc_feature (1)..( 7): Result.001 file - promoters60/1021136
aatgttt

SEQ ID NO: 97698 - DNA, 6 bp, Unknown
  misc_feature (1)..( 6): Result.001 file - promoters60/1021136
atgttt

SEQ ID NO: 97699 - DNA, 6 bp, Unknown
  misc_feature (1)..( 6): Result.001 file - promoters60/1021136
tttgtt

SEQ ID NO: 97700 - DNA, 6 bp, Unknown
  misc_feature (1)..( 6): Result.001 file - promoters60/1021136
tttgtt

SEQ ID NO: 97701 - DNA, 6 bp, Unknown
  misc_feature (1)..( 6): Result.001 file - promoters60/1021136
ctctca

SEQ ID NO: 97702 - DNA, 6 bp, Unknown
  misc_feature (1)..( 6): Result.001 file - promoters60/1021136
ctctca

SEQ ID NO: 97703 - DNA, 6 bp, Unknown
  misc_feature (1)..( 6): Result.001 file - promoters60/1021136
ttcaat

SEQ ID NO: 97704 - DNA, 6 bp, Unknown
  misc_feature (1)..( 6): Result.001 file - promoters60/1021136
ttcaat

SEQ ID NO: 97705 - DNA, 9 bp, Unknown
  misc_feature (1)..( 9): Result.001 file - promoters60/1021136
ttgttaaaa

SEQ ID NO: 97706 - DNA, 9 bp, Unknown
  misc_feature (1)..( 9): Result.001 file - promoters60/1021136
ttgataaaa

SEQ ID NO: 97707 - DNA, 9 bp, Unknown
  misc_feature (1)..( 9): Result.001 file - promoters60/1021136
attttaaaa

SEQ ID NO: 97708 - DNA, 7 bp, Unknown
  misc_feature (1)..( 7): Result.001 file - promoters60/1021136
taatata

SEQ ID NO: 97709 - DNA, 7 bp, Unknown
  misc_feature (1)..( 7): Result.001 file - promoters60/1021136
taatatg

SEQ ID NO: 97710 - DNA, 7 bp, Unknown
  misc_feature (1)..( 7): Result.001 file - promoters60/1021136
taaaatg

SEQ ID NO: 97711 - DNA, 8 bp, Unknown
  misc_feature (1)..( 8): Result.001 file - promoters60/1021136
caagaaaa

SEQ ID NO: 97712 - DNA, 8 bp, Unknown
  misc_feature (1)..( 8): Result.001 file - promoters60/1021136
aaagaaaa

SEQ ID NO: 97713 - DNA, 8 bp, Unknown
  misc_feature (1)..( 8): Result.001 file - promoters60/1021136
aaagtaaa

SEQ ID NO: 97714 - DNA, 9 bp, Unknown
  misc_feature (1)..( 9): Result.001 file - promoters60/1021136
actgtattt

SEQ ID NO: 97715 - DNA, 9 bp, Unknown
  misc_feature (1)..( 9): Result.001 file - promoters60/1021136
actttattt

SEQ ID NO: 97716 - DNA, 9 bp, Unknown
  misc_feature (1)..( 9): Result.001 file - promoters60/1021136
ttaaaaata

SEQ ID NO: 97717 - DNA, 9 bp, Unknown
  misc_feature (1)..( 9): Result.001 file - promoters60/1021136
ataataata

SEQ ID NO: 97718 - DNA, 9 bp, Unknown
  misc_feature (1)..( 9): Result.001 file - promoters60/1021136
ttaaaaatc

SEQ ID NO: 97719 - DNA, 10 bp, Unknown
  misc_feature (1)..( 10): Result.001 file - promoters60/1021136
tatatattct

SEQ ID NO: 97720 - DNA, 10 bp, Unknown
  misc_feature (1)..( 10): Result.001 file - promoters60/1021136
tatttattct

SEQ ID NO: 97721 - DNA, 8 bp, Unknown
  misc_feature (1)..( 8): Result.001 file - promoters60/1021136
aaaaacaa

SEQ ID NO: 97722 - DNA, 8 bp, Unknown
  misc_feature (1)..( 8): Result.001 file - promoters60/1021136
aaaatcaa

SEQ ID NO: 97723 - DNA, 7 bp, Unknown
  misc_feature (1)..( 7): Result.001 file - promoters60/1021136
aatttaa

SEQ ID NO: 97724 - DNA, 7 bp, Unknown
  misc_feature (1)..( 7): Result.001 file - promoters60/1021136
aatctaa

SEQ ID NO: 97725 - DNA, 11 bp, Unknown
  misc_feature (1)..( 11): Result.001 file - promoters60/1021136
aaattaatgca

SEQ ID NO: 97726 - DNA, 11 bp, Unknown
  misc_feature (1)..( 11): Result.001 file - promoters60/1021136
aaatcaatgca

SEQ ID NO: 97727 - DNA, 6 bp, Unknown
  misc_feature (1)..( 6): Result.001 file - promoters60/1021136
taaatt

SEQ ID NO: 97728 - DNA, 6 bp, Unknown
  misc_feature (1)..( 6): Result.001 file - promoters60/1021136
taaatt

SEQ ID NO: 97729 - DNA, 6 bp, Unknown
  misc_feature (1)..( 6): Result.001 file - promoters60/1021136
aaagaa

SEQ ID NO: 97730 - DNA, 6 bp, Unknown
  misc_feature (1)..( 6): Result.001 file - promoters60/1021136
aaagaa

SEQ ID NO: 97731 - DNA, 7 bp, Unknown
  misc_feature (1)..( 7): Result.001 file - promoters60/1021136
aattgaa

SEQ ID NO: 97732 - DNA, 7 bp, Unknown
  misc_feature (1)..( 7): Result.001 file - promoters60/1021136
aatagaa

SEQ ID NO: 97733 - DNA, 8 bp, Unknown
  misc_feature (1)..( 8): Result.001 file - promoters60/1021136
atatcaga

SEQ ID NO: 97734 - DNA, 8 bp, Unknown
  misc_feature (1)..( 8): Result.001 file - promoters60/1021136
atataaga

SEQ ID NO: 97735 - DNA, 6 bp, Unknown
  misc_feature (1)..( 6): Result.001 file - promoters60/1021136
aatctt

SEQ ID NO: 97736 - DNA, 6 bp, Unknown
  misc_feature (1)..( 6): Result.001 file - promoters60/1021136
aatctt

SEQ ID NO: 97737 - DNA, 7 bp, Unknown
  misc_feature (1)..( 7): Result.001 file - promoters60/1021136
atttatt

SEQ ID NO: 97738 - DNA, 7 bp, Unknown
  misc_feature (1)..( 7): Result.001 file - promoters60/1021136
attaatt

SEQ ID NO: 97739 - DNA, 6 bp, Unknown
  misc_feature (1)..( 6): Result.001 file - promoters60/1021136
aaaaat

SEQ ID NO: 97740 - DNA, 6 bp, Unknown
  misc_feature (1)..( 6): Result.001 file - promoters60/1021136
aaaaat

SEQ ID NO: 97741 - DNA, 8 bp, Unknown
  misc_feature (1)..( 8): Result.001 file - promoters60/1021136
aaattaaa

SEQ ID NO: 97742 - DNA, 8 bp, Unknown
  misc_feature (1)..( 8): Result.001 file - promoters60/1021136
aaagtaaa

SEQ ID NO: 97743 - DNA, 7 bp, Unknown
  misc_feature (1)..( 7): Result.001 file - promoters60/1021136
atcatca

SEQ ID NO: 97744 - DNA, 7 bp, Unknown
  misc_feature (1)..( 7): Result.001 file - promoters60/1021148
atcttca

SEQ ID NO: 97745 - DNA, 10 bp, Unknown
  misc_feature (1)..( 10): Result.001 file - promoters60/1021148
ttatttaacg

SEQ ID NO: 97746 - DNA, 10 bp, Unknown
  misc_feature (1)..( 10): Result.001 file - promoters60/1021148
accttttacg

SEQ ID NO: 97747 - DNA, 10 bp, Unknown
  misc_feature (1)..( 10): Result.001 file - promoters60/1021148
ttattttact

SEQ ID NO: 97748 - DNA, 10 bp, Unknown
  misc_feature (1)..( 10): Result.001 file - promoters60/1021148
ttattttata

SEQ ID NO: 97749 - DNA, 10 bp, Unknown
  misc_feature (1)..( 10): Result.001 file - promoters60/1021148
gttatagagt

SEQ ID NO: 97750 - DNA, 10 bp, Unknown
  misc_feature (1)..( 10): Result.001 file - promoters60/1021148
cttaaagagt

SEQ ID NO: 97751 - DNA, 10 bp, Unknown
  misc_feature (1)..( 10): Result.001 file - promoters60/1021148
cctaaaatta

SEQ ID NO: 97752 - DNA, 10 bp, Unknown
  misc_feature (1)..( 10): Result.001 file - promoters60/1021218
actaaaataa

SEQ ID NO: 97753 - DNA, 13 bp, Unknown
  misc_feature (1)..( 13): Result.001 file - promoters60/1021218
agagagaaagaaa

SEQ ID NO: 97754 - DNA, 13 bp, Unknown
  misc_feature (1)..( 13): Result.001 file - promoters60/1021218
taagaaaaaccct

SEQ ID NO: 97755 - DNA, 13 bp, Unknown
  misc_feature (1)..( 13): Result.001 file - promoters60/1021218
atagaggaagtga

SEQ ID NO: 97756 - DNA, 13 bp, Unknown
  misc_feature (1)..( 13): Result.001 file - promoters60/1021218
aaagaaaaaattc

SEQ ID NO: 97757 - DNA, 13 bp, Unknown
  misc_feature (1)..( 13): Result.001 file - promoters60/1021218
aaataaaacattg

SEQ ID NO: 97758 - DNA, 13 bp, Unknown
  misc_feature (1)..( 13): Result.001 file - promoters60/1021239
ggatgatacattg

SEQ ID NO: 97759 - DNA, 9 bp, Unknown
  misc_feature (1)..( 9): Result.001 file - promoters60/1021239
taccaaaaa

SEQ ID NO: 97760 - DNA, 9 bp, Unknown
  misc_feature (1)..( 9): Result.001 file - promoters60/1021239
tactaaaaa

SEQ ID NO: 97761 - DNA, 9 bp, Unknown
  misc_feature (1)..( 9): Result.001 file - promoters60/1021239
aagaaaaat

SEQ ID NO: 97762 - DNA, 9 bp, Unknown
  misc_feature (1)..( 9): Result.001 file - promoters60/1021239
aagaagaat

SEQ ID NO: 97763 - DNA, 6 bp, Unknown
  misc_feature (1)..( 6): Result.001 file - promoters60/1021239
aaatgt

SEQ ID NO: 97764 - DNA, 6 bp, Unknown
  misc_feature (1)..( 6): Result.001 file - promoters60/1021239
aaatgt

SEQ ID NO: 97765 - DNA, 7 bp, Unknown
  misc_feature (1)..( 7): Result.001 file - promoters60/1021239
tcagttt

SEQ ID NO: 97766 - DNA, 7 bp, Unknown
  misc_feature (1)..( 7): Result.001 file - promoters60/1021239
tcagttt

SEQ ID NO: 97767 - DNA, 9 bp, Unknown
  misc_feature (1)..( 9): Result.001 file - promoters60/1021239
aaaaacaaa

SEQ ID NO: 97768 - DNA, 9 bp, Unknown
  misc_feature (1)..( 9): Result.001 file - promoters60/1021239
aaaaataaa

SEQ ID NO: 97769 - DNA, 7 bp, Unknown
  misc_feature (1)..( 7): Result.001 file - promoters60/1021239
aaaataa

SEQ ID NO: 97770 - DNA, 7 bp, Unknown
  misc_feature (1)..( 7): Result.001 file - promoters60/1021239
aaattaa

SEQ ID NO: 97771 - DNA, 7 bp, Unknown
  misc_feature (1)..( 7): Result.001 file - promoters60/1021239
gaaagtt

SEQ ID NO: 97772 - DNA, 7 bp, Unknown
  misc_feature (1)..( 7): Result.001 file - promoters60/1021239
gaaagtt

SEQ ID NO: 97773 - DNA, 8 bp, Unknown
  misc_feature (1)..( 8): Result.001 file - promoters60/1021239
agagccca

SEQ ID NO: 97774 - DNA, 8 bp, Unknown
  misc_feature (1)..( 8): Result.001 file - promoters60/1021239
agatccca

SEQ ID NO: 97775 - DNA, 7 bp, Unknown
  misc_feature (1)..( 7): Result.001 file - promoters60/1021239
cacttaa

SEQ ID NO: 97776 - DNA, 7 bp, Unknown
  misc_feature (1)..( 7): Result.001 file - promoters60/1021239
cacttaa

SEQ ID NO: 97777 - DNA, 9 bp, Unknown
  misc_feature (1)..( 9): Result.001 file - promoters60/1021239
ttaaaagaa

SEQ ID NO: 97778 - DNA, 9 bp, Unknown
  misc_feature (1)..( 9): Result.001 file - promoters60/1021239
ttaaaagaa

SEQ ID NO: 97779 - DNA, 6 bp, Unknown
  misc_feature (1)..( 6): Result.001 file - promoters60/1021239
tttttc

SEQ ID NO: 97780 - DNA, 6 bp, Unknown
  misc_feature (1)..( 6): Result.001 file - promoters60/1021239
tttttc

SEQ ID NO: 97781 - DNA, 8 bp, Unknown
  misc_feature (1)..( 8): Result.001 file - promoters60/1021239
gcaaatgg

SEQ ID NO: 97782 - DNA, 8 bp, Unknown
  misc_feature (1)..( 8): Result.001 file - promoters60/1021239
gcaagtgg

SEQ ID NO: 97783 - DNA, 6 bp, Unknown
  misc_feature (1)..( 6): Result.001 file - promoters60/1021239
agaaac

SEQ ID NO: 97784 - DNA, 6 bp, Unknown
  misc_feature (1)..( 6): Result.001 file - promoters60/1021239
agaaac

SEQ ID NO: 97785 - DNA, 8 bp, Unknown
  misc_feature (1)..( 8): Result.001 file - promoters60/1021239
ttacatca

SEQ ID NO: 97786 - DNA, 8 bp, Unknown
  misc_feature (1)..( 8): Result.001 file - promoters60/1021239
ttacctca

SEQ ID NO: 97787 - DNA, 7 bp, Unknown
  misc_feature (1)..( 7): Result.001 file - promoters60/1021239
taaccaa

SEQ ID NO: 97788 - DNA, 7 bp, Unknown
  misc_feature (1)..( 7): Result.001 file - promoters60/1021239
taaacaa

SEQ ID NO: 97789 - DNA, 7 bp, Unknown
  misc_feature (1)..( 7): Result.001 file - promoters60/1021239
tttgtta

SEQ ID NO: 97790 - DNA, 7 bp, Unknown
  misc_feature (1)..( 7): Result.001 file - promoters60/1021242
tttttta

SEQ ID NO: 97791 - DNA, 7 bp, Unknown
  misc_feature (1)..( 7): Result.001 file - promoters60/1021242
attggtt

SEQ ID NO: 97792 - DNA, 7 bp, Unknown
  misc_feature (1)..( 7): Result.001 file - promoters60/1021242
atttgtt

SEQ ID NO: 97793 - DNA, 7 bp, Unknown
  misc_feature (1)..( 7): Result.001 file - promoters60/1021242
atcgtca

SEQ ID NO: 97794 - DNA, 7 bp, Unknown
  misc_feature (1)..( 7): Result.001 file - promoters60/1021242
atcttca

SEQ ID NO: 97795 - DNA, 8 bp, Unknown
  misc_feature (1)..( 8): Result.001 file - promoters60/1021242
gattgtcc

SEQ ID NO: 97796 - DNA, 8 bp, Unknown
  misc_feature (1)..( 8): Result.001 file - promoters60/1021242
gattttcc

SEQ ID NO: 97797 - DNA, 7 bp, Unknown
  misc_feature (1)..( 7): Result.001 file - promoters60/1021242
ttaagaa

SEQ ID NO: 97798 - DNA, 7 bp, Unknown
  misc_feature (1)..( 7): Result.001 file - promoters60/1021242
ttaagaa

SEQ ID NO: 97799 - DNA, 6 bp, Unknown
  misc_feature (1)..( 6): Result.001 file - promoters60/1021242
tactgt

SEQ ID NO: 97800 - DNA, 6 bp, Unknown
  misc_feature (1)..( 6): Result.001 file - promoters60/1021242
tactgt

SEQ ID NO: 97801 - DNA, 6 bp, Unknown
  misc_feature (1)..( 6): Result.001 file - promoters60/1021242
cacaga

SEQ ID NO: 97802 - DNA, 6 bp, Unknown
  misc_feature (1)..( 6): Result.001 file - promoters60/1021242
cacaga

SEQ ID NO: 97803 - DNA, 7 bp, Unknown
  misc_feature (1)..( 7): Result.001 file - promoters60/1021242
taacaaa

SEQ ID NO: 97804 - DNA, 7 bp, Unknown
  misc_feature (1)..( 7): Result.001 file - promoters60/1021242
taaaaaa

SEQ ID NO: 97805 - DNA, 7 bp, Unknown
  misc_feature (1)..( 7): Result.001 file - promoters60/1021242
attatac

SEQ ID NO: 97806 - DNA, 7 bp, Unknown
  misc_feature (1)..( 7): Result.001 file - promoters60/1021242
attttac

SEQ ID NO: 97807 - DNA, 8 bp, Unknown
  misc_feature (1)..( 8): Result.001 file - promoters60/1021242
caaaattt

SEQ ID NO: 97808 - DNA, 8 bp, Unknown
  misc_feature (1)..( 8): Result.001 file - promoters60/1021242
caagattt

SEQ ID NO: 97809 - DNA, 7 bp, Unknown
  misc_feature (1)..( 7): Result.001 file - promoters60/1021242
caaagtc

SEQ ID NO: 97810 - DNA, 7 bp, Unknown
  misc_feature (1)..( 7): Result.001 file - promoters60/1021242
caaagtc

SEQ ID NO: 97811 - DNA, 7 bp, Unknown
  misc_feature (1)..( 7): Result.001 file - promoters60/1021242
tataaaa

SEQ ID NO: 97812 - DNA, 7 bp, Unknown
  misc_feature (1)..( 7): Result.001 file - promoters60/1021242
tataaaa

SEQ ID NO: 97813 - DNA, 7 bp, Unknown
  misc_feature (1)..( 7): Result.001 file - promoters60/1021242
gcccaaa

SEQ ID NO: 97814 - DNA, 7 bp, Unknown
  misc_feature (1)..( 7): Result.001 file - promoters60/1021246
gccgaaa

SEQ ID NO: 97815 - DNA, 6 bp, Unknown
  misc_feature (1)..( 6): Result.001 file - promoters60/1021246
ataata

SEQ ID NO: 97816 - DNA, 6 bp, Unknown
  misc_feature (1)..( 6): Result.001 file - promoters60/1021246
ataata

SEQ ID NO: 97817 - DNA, 6 bp, Unknown
  misc_feature (1)..( 6): Result.001 file - promoters60/1021246
tttgac

SEQ ID NO: 97818 - DNA, 6 bp, Unknown
  misc_feature (1)..( 6): Result.001 file - promoters60/1021246
tttgac

SEQ ID NO: 97819 - DNA, 7 bp, Unknown
  misc_feature (1)..( 7): Result.001 file - promoters60/1021246
cgaatgg

SEQ ID NO: 97820 - DNA, 7 bp, Unknown
  misc_feature (1)..( 7): Result.001 file - promoters60/1021246
cgaatgg

SEQ ID NO: 97821 - DNA, 8 bp, Unknown
  misc_feature (1)..( 8): Result.001 file - promoters60/1021246
tgccattt

SEQ ID NO: 97822 - DNA, 8 bp, Unknown
  misc_feature (1)..( 8): Result.001 file - promoters60/1021246
tgcctttt

SEQ ID NO: 97823 - DNA, 6 bp, Unknown
  misc_feature (1)..( 6): Result.001 file - promoters60/1021246
cggctc

SEQ ID NO: 97824 - DNA, 6 bp, Unknown
  misc_feature (1)..( 6): Result.001 file - promoters60/1021246
cggctc

SEQ ID NO: 97825 - DNA, 11 bp, Unknown
  misc_feature (1)..( 11): Result.001 file - promoters60/1021246
ttattttcata

SEQ ID NO: 97826 - DNA, 11 bp, Unknown
  misc_feature (1)..( 11): Result.001 file - promoters60/1021246
ttagtttcata

SEQ ID NO: 97827 - DNA, 6 bp, Unknown
  misc_feature (1)..( 6): Result.001 file - promoters60/1021246
agtatg

SEQ ID NO: 97828 - DNA, 6 bp, Unknown
  misc_feature (1)..( 6): Result.001 file - promoters60/1021246
agtatg

SEQ ID NO: 97829 - DNA, 6 bp, Unknown
  misc_feature (1)..( 6): Result.001 file - promoters60/1021246
aaaaga

SEQ ID NO: 97830 - DNA, 6 bp, Unknown
  misc_feature (1)..( 6): Result.001 file - promoters60/1021246
aaaaga

SEQ ID NO: 97831 - DNA, 6 bp, Unknown
  misc_feature (1)..( 6): Result.001 file - promoters60/1021246
agaaaa

SEQ ID NO: 97832 - DNA, 6 bp, Unknown
  misc_feature (1)..( 6): Result.001 file - promoters60/1021246
agaaaa

SEQ ID NO: 97833 - DNA, 7 bp, Unknown
  misc_feature (1)..( 7): Result.001 file - promoters60/1021246
aaagaag

SEQ ID NO: 97834 - DNA, 7 bp, Unknown
  misc_feature (1)..( 7): Result.001 file - promoters60/1021246
aaaaaag

SEQ ID NO: 97835 - DNA, 6 bp, Unknown
  misc_feature (1)..( 6): Result.001 file - promoters60/1021246
actcca

SEQ ID NO: 97836 - DNA, 6 bp, Unknown
  misc_feature (1)..( 6): Result.001 file - promoters60/1021246
actcca

SEQ ID NO: 97837 - DNA, 8 bp, Unknown
  misc_feature (1)..( 8): Result.001 file - promoters60/1021246
aagagaag

SEQ ID NO: 97838 - DNA, 8 bp, Unknown
  misc_feature (1)..( 8): Result.001 file - promoters60/1021246
aagcgaag

SEQ ID NO: 97839 - DNA, 7 bp, Unknown
  misc_feature (1)..( 7): Result.001 file - promoters60/1021246
tatcatt

SEQ ID NO: 97840 - DNA, 7 bp, Unknown
  misc_feature (1)..( 7): Result.001 file - promoters60/1021246
tatgatt

SEQ ID NO: 97841 - DNA, 7 bp, Unknown
  misc_feature (1)..( 7): Result.001 file - promoters60/1021246
gaatttg

SEQ ID NO: 97842 - DNA, 7 bp, Unknown
  misc_feature (1)..( 7): Result.001 file - promoters60/1021246
gaatttg

SEQ ID NO: 97843 - DNA, 7 bp, Unknown
  misc_feature (1)..( 7): Result.001 file - promoters60/1021246
tttgatt

SEQ ID NO: 97844 - DNA, 7 bp, Unknown
  misc_feature (1)..( 7): Result.001 file - promoters60/1021246
tttgatt

SEQ ID NO: 97845 - DNA, 7 bp, Unknown
  misc_feature (1)..( 7): Result.001 file - promoters60/1021246
ttagatc

SEQ ID NO: 97846 - DNA, 7 bp, Unknown
  misc_feature (1)..( 7): Result.001 file - promoters60/1021246
ttatatc

SEQ ID NO: 97847 - DNA, 6 bp, Unknown
  misc_feature (1)..( 6): Result.001 file - promoters60/1021246
catttg

SEQ ID NO: 97848 - DNA, 6 bp, Unknown
  misc_feature (1)..( 6): Result.001 file - promoters60/1021323
catttg

SEQ ID NO: 97849 - DNA, 6 bp, Unknown
  misc_feature (1)..( 6): Result.001 file - promoters60/1021323
taacaa

SEQ ID NO: 97850 - DNA, 6 bp, Unknown
  misc_feature (1)..( 6): Result.001 file - promoters60/1021323
taacaa

SEQ ID NO: 97851 - DNA, 6 bp, Unknown
  misc_feature (1)..( 6): Result.001 file - promoters60/1021323
tttatt

SEQ ID NO: 97852 - DNA, 6 bp, Unknown
  misc_feature (1)..( 6): Result.001 file - promoters60/1021323
tttatt

SEQ ID NO: 97853 - DNA, 7 bp, Unknown
  misc_feature (1)..( 7): Result.001 file - promoters60/1021323
attgttt

SEQ ID NO: 97854 - DNA, 7 bp, Unknown
  misc_feature (1)..( 7): Result.001 file - promoters60/1021323
atttttt

SEQ ID NO: 97855 - DNA, 9 bp, Unknown
  misc_feature (1)..( 9): Result.001 file - promoters60/1021323
tttcttaaa

SEQ ID NO: 97856 - DNA, 9 bp, Unknown
  misc_feature (1)..( 9): Result.001 file - promoters60/1021323
tttctaaaa

SEQ ID NO: 97857 - DNA, 6 bp, Unknown
  misc_feature (1)..( 6): Result.001 file - promoters60/1021323
tgttgc

SEQ ID NO: 97858 - DNA, 6 bp, Unknown
  misc_feature (1)..( 6): Result.001 file - promoters60/1021323
tgttgc

SEQ ID NO: 97859 - DNA, 6 bp, Unknown
  misc_feature (1)..( 6): Result.001 file - promoters60/1021323
gttaat

SEQ ID NO: 97860 - DNA, 6 bp, Unknown
  misc_feature (1)..( 6): Result.001 file - promoters60/1021323
gttaat

SEQ ID NO: 97861 - DNA, 6 bp, Unknown
  misc_feature (1)..( 6): Result.001 file - promoters60/1021323
atattt

SEQ ID NO: 97862 - DNA, 6 bp, Unknown
  misc_feature (1)..( 6): Result.001 file - promoters60/1021323
atattt

SEQ ID NO: 97863 - DNA, 8 bp, Unknown
  misc_feature (1)..( 8): Result.001 file - promoters60/1021323
attttgtt

SEQ ID NO: 97864 - DNA, 8 bp, Unknown
  misc_feature (1)..( 8): Result.001 file - promoters60/1021323
atttggtt

SEQ ID NO: 97865 - DNA, 7 bp, Unknown
  misc_feature (1)..( 7): Result.001 file - promoters60/1021323
aatcatg

SEQ ID NO: 97866 - DNA, 7 bp, Unknown
  misc_feature (1)..( 7): Result.001 file - promoters60/1021323
aattatg

SEQ ID NO: 97867 - DNA, 9 bp, Unknown
  misc_feature (1)..( 9): Result.001 file - promoters60/1021323
gaaacctaa

SEQ ID NO: 97868 - DNA, 9 bp, Unknown
  misc_feature (1)..( 9): Result.001 file - promoters60/1021323
gaaacgtaa

SEQ ID NO: 97869 - DNA, 6 bp, Unknown
  misc_feature (1)..( 6): Result.001 file - promoters60/1021323
taaaca

SEQ ID NO: 97870 - DNA, 6 bp, Unknown
  misc_feature (1)..( 6): Result.001 file - promoters60/1021323
taaaca

SEQ ID NO: 97871 - DNA, 6 bp, Unknown
  misc_feature (1)..( 6): Result.001 file - promoters60/1021323
aagagt

SEQ ID NO: 97872 - DNA, 6 bp, Unknown
  misc_feature (1)..( 6): Result.001 file - promoters60/1021323
aagagt

SEQ ID NO: 97873 - DNA, 8 bp, Unknown
  misc_feature (1)..( 8): Result.001 file - promoters60/1021323
acacaaag

SEQ ID NO: 97874 - DNA, 8 bp, Unknown
  misc_feature (1)..( 8): Result.001 file - promoters60/1021323
acaccaag

SEQ ID NO: 97875 - DNA, 7 bp, Unknown
  misc_feature (1)..( 7): Result.001 file - promoters60/1021323
agtcttc

SEQ ID NO: 97876 - DNA, 7 bp, Unknown
  misc_feature (1)..( 7): Result.001 file - promoters60/1021323
agttttc

SEQ ID NO: 97877 - DNA, 6 bp, Unknown
  misc_feature (1)..( 6): Result.001 file - promoters60/1021323
aaaata

SEQ ID NO: 97878 - DNA, 6 bp, Unknown
  misc_feature (1)..( 6): Result.001 file - promoters60/1021323
aaaata

SEQ ID NO: 97879 - DNA, 6 bp, Unknown
  misc_feature (1)..( 6): Result.001 file - promoters60/1021323
accgtt

SEQ ID NO: 97880 - DNA, 6 bp, Unknown
  misc_feature (1)..( 6): Result.001 file - promoters60/1021323
accgtt

SEQ ID NO: 97881 - DNA, 6 bp, Unknown
  misc_feature (1)..( 6): Result.001 file - promoters60/1021323
gaatca

SEQ ID NO: 97882 - DNA, 6 bp, Unknown
  misc_feature (1)..( 6): Result.001 file - promoters60/1021323
gaatca

SEQ ID NO: 97883 - DNA, 7 bp, Unknown
  misc_feature (1)..( 7): Result.001 file - promoters60/1021323
tccggtt

SEQ ID NO: 97884 - DNA, 7 bp, Unknown
  misc_feature (1)..( 7): Result.001 file - promoters60/1021323
tccagtt

SEQ ID NO: 97885 - DNA, 6 bp, Unknown
  misc_feature (1)..( 6): Result.001 file - promoters60/1021323
tttccg

SEQ ID NO: 97886 - DNA, 6 bp, Unknown
  misc_feature (1)..( 6): Result.001 file - promoters60/1021323
tttccg

SEQ ID NO: 97887 - DNA, 6 bp, Unknown
  misc_feature (1)..( 6): Result.001 file - promoters60/1021323
ataaat

SEQ ID NO: 97888 - DNA, 6 bp, Unknown
  misc_feature (1)..( 6): Result.001 file - promoters60/1021323
ataaat

SEQ ID NO: 97889 - DNA, 6 bp, Unknown
  misc_feature (1)..( 6): Result.001 file - promoters60/1021323
aaccct

SEQ ID NO: 97890 - DNA, 6 bp, Unknown
  misc_feature (1)..( 6): Result.001 file - promoters60/1021326
aaccct

SEQ ID NO: 97891 - DNA, 6 bp, Unknown
  misc_feature (1)..( 6): Result.001 file - promoters60/1021326
caaaat

SEQ ID NO: 97892 - DNA, 6 bp, Unknown
  misc_feature (1)..( 6): Result.001 file - promoters60/1021326
caaaat

SEQ ID NO: 97893 - DNA, 7 bp, Unknown
  misc_feature (1)..( 7): Result.001 file - promoters60/1021326
agaattc

SEQ ID NO: 97894 - DNA, 7 bp, Unknown
  misc_feature (1)..( 7): Result.001 file - promoters60/1021326
agatttc

SEQ ID NO: 97895 - DNA, 6 bp, Unknown
  misc_feature (1)..( 6): Result.001 file - promoters60/1021326
gtaatc

SEQ ID NO: 97896 - DNA, 6 bp, Unknown
  misc_feature (1)..( 6): Result.001 file - promoters60/1021326
gtaatc

SEQ ID NO: 97897 - DNA, 6 bp, Unknown
  misc_feature (1)..( 6): Result.001 file - promoters60/1021326
acaaaa

SEQ ID NO: 97898 - DNA, 6 bp, Unknown
  misc_feature (1)..( 6): Result.001 file - promoters60/1021326
acaaaa

SEQ ID NO: 97899 - DNA, 7 bp, Unknown
  misc_feature (1)..( 7): Result.001 file - promoters60/1021326
actgaat

SEQ ID NO: 97900 - DNA, 7 bp, Unknown
  misc_feature (1)..( 7): Result.001 file - promoters60/1021326
actaaat

SEQ ID NO: 97901 - DNA, 7 bp, Unknown
  misc_feature (1)..( 7): Result.001 file - promoters60/1021326
ggttgtt

SEQ ID NO: 97902 - DNA, 7 bp, Unknown
  misc_feature (1)..( 7): Result.001 file - promoters60/1021326
ggtagtt

SEQ ID NO: 97903 - DNA, 7 bp, Unknown
  misc_feature (1)..( 7): Result.001 file - promoters60/1021326
gttaatt

SEQ ID NO: 97904 - DNA, 7 bp, Unknown
  misc_feature (1)..( 7): Result.001 file - promoters60/1021326
gttgatt

SEQ ID NO: 97905 - DNA, 6 bp, Unknown
  misc_feature (1)..( 6): Result.001 file - promoters60/1021326
tattta

SEQ ID NO: 97906 - DNA, 6 bp, Unknown
  misc_feature (1)..( 6): Result.001 file - promoters60/1021419
tattta

SEQ ID NO: 97907 - DNA, 12 bp, Unknown
  misc_feature (1)..( 12): Result.001 file - promoters60/1021419
ctttttataatg

SEQ ID NO: 97908 - DNA, 12 bp, Unknown
  misc_feature (1)..( 12): Result.001 file - promoters60/1021419
atttttaaattt

SEQ ID NO: 97909 - DNA, 12 bp, Unknown
  misc_feature (1)..( 12): Result.001 file - promoters60/1021419
ctttttgacaca

SEQ ID NO: 97910 - DNA, 12 bp, Unknown
  misc_feature (1)..( 12): Result.001 file - promoters60/1021419
aattttacattt

SEQ ID NO: 97911 - DNA, 12 bp, Unknown
  misc_feature (1)..( 12): Result.001 file - promoters60/1021419
aattttaataac

SEQ ID NO: 97912 - DNA, 12 bp, Unknown
  misc_feature (1)..( 12): Result.001 file - promoters60/1021419
tcgtctacatta

SEQ ID NO: 97913 - DNA, 11 bp, Unknown
  misc_feature (1)..( 11): Result.001 file - promoters60/1021419
atttatgtgtg

SEQ ID NO: 97914 - DNA, 11 bp, Unknown
  misc_feature (1)..( 11): Result.001 file - promoters60/1021419
gtctatgtgaa

SEQ ID NO: 97915 - DNA, 11 bp, Unknown
  misc_feature (1)..( 11): Result.001 file - promoters60/1021419
gtctatatgaa

SEQ ID NO: 97916 - DNA, 11 bp, Unknown
  misc_feature (1)..( 11): Result.001 file - promoters60/1021419
atttattaaat

SEQ ID NO: 97917 - DNA, 11 bp, Unknown
  misc_feature (1)..( 11): Result.001 file - promoters60/1021419
atctttgttct

SEQ ID NO: 97918 - DNA, 11 bp, Unknown
  misc_feature (1)..( 11): Result.001 file - promoters60/1021419
aataatttaat

SEQ ID NO: 97919 - DNA, 9 bp, Unknown
  misc_feature (1)..( 9): Result.001 file - promoters60/1021419
ggtaaatgc

SEQ ID NO: 97920 - DNA, 9 bp, Unknown
  misc_feature (1)..( 9): Result.001 file - promoters60/1021419
tgtaaatct

SEQ ID NO: 97921 - DNA, 9 bp, Unknown
  misc_feature (1)..( 9): Result.001 file - promoters60/1021419
attaaatga

SEQ ID NO: 97922 - DNA, 9 bp, Unknown
  misc_feature (1)..( 9): Result.001 file - promoters60/1021419
gttaattct

SEQ ID NO: 97923 - DNA, 9 bp, Unknown
  misc_feature (1)..( 9): Result.001 file - promoters60/1021419
gggaaatga

SEQ ID NO: 97924 - DNA, 9 bp, Unknown
  misc_feature (1)..( 9): Result.001 file - promoters60/1021445
atttaatcc

SEQ ID NO: 97925 - DNA, 13 bp, Unknown
  misc_feature (1)..( 13): Result.001 file - promoters60/1021445
ctcaaaaaagctg

SEQ ID NO: 97926 - DNA, 13 bp, Unknown
  misc_feature (1)..( 13): Result.001 file - promoters60/1021445
ttttaaaaaggga

SEQ ID NO: 97927 - DNA, 13 bp, Unknown
  misc_feature (1)..( 13): Result.001 file - promoters60/1021445
cactaaaaaggtt

SEQ ID NO: 97928 - DNA, 13 bp, Unknown
  misc_feature (1)..( 13): Result.001 file - promoters60/1021445
aaacaaaaagaac

SEQ ID NO: 97929 - DNA, 13 bp, Unknown
  misc_feature (1)..( 13): Result.001 file - promoters60/1021445
ttttagaaattac

SEQ ID NO: 97930 - DNA, 13 bp, Unknown
  misc_feature (1)..( 13): Result.001 file - promoters60/1021445
aattaaaaaaaaa

SEQ ID NO: 97931 - DNA, 13 bp, Unknown
  misc_feature (1)..( 13): Result.001 file - promoters60/1021445
actacaaaagtta

SEQ ID NO: 97932 - DNA, 13 bp, Unknown
  misc_feature (1)..( 13): Result.001 file - promoters60/1021445
aatcaaacttggt

SEQ ID NO: 97933 - DNA, 13 bp, Unknown
  misc_feature (1)..( 13): Result.001 file - promoters60/1021445
agttttaaagttt

SEQ ID NO: 97934 - DNA, 13 bp, Unknown
  misc_feature (1)..( 13): Result.001 file - promoters60/1021445
agtattaaaaatg

SEQ ID NO: 97935 - DNA, 13 bp, Unknown
  misc_feature (1)..( 13): Result.001 file - promoters60/1021445
cgttttatatttc

SEQ ID NO: 97936 - DNA, 13 bp, Unknown
  misc_feature (1)..( 13): Result.001 file - promoters60/1021445
tgtttgaaatttt

SEQ ID NO: 97937 - DNA, 13 bp, Unknown
  misc_feature (1)..( 13): Result.001 file - promoters60/1021445
accattaaagctc

SEQ ID NO: 97938 - DNA, 13 bp, Unknown
  misc_feature (1)..( 13): Result.001 file - promoters60/1021445
tttattgaagact

SEQ ID NO: 97939 - DNA, 13 bp, Unknown
  misc_feature (1)..( 13): Result.001 file - promoters60/1021445
cacataaacattt

SEQ ID NO: 97940 - DNA, 13 bp, Unknown
  misc_feature (1)..( 13): Result.001 file - promoters60/1021445
ttcataaatcaca

SEQ ID NO: 97941 - DNA, 13 bp, Unknown
  misc_feature (1)..( 13): Result.001 file - promoters60/1021445
ttcttaaaagaaa

SEQ ID NO: 97942 - DNA, 13 bp, Unknown
  misc_feature (1)..( 13): Result.001 file - promoters60/1021445
caattaaaaaaaa

SEQ ID NO: 97943 - DNA, 13 bp, Unknown
  misc_feature (1)..( 13): Result.001 file - promoters60/1021445
taatcaaacttgg

SEQ ID NO: 97944 - DNA, 13 bp, Unknown
  misc_feature (1)..( 13): Result.001 file - promoters60/1021445
gaatcaaatactt

SEQ ID NO: 97945 - DNA, 8 bp, Unknown
  misc_feature (1)..( 8): Result.001 file - promoters60/1021445
tgggccga

SEQ ID NO: 97946 - DNA, 8 bp, Unknown
  misc_feature (1)..( 8): Result.001 file - promoters60/1021445
tgggcctt

SEQ ID NO: 97947 - DNA, 8 bp, Unknown
  misc_feature (1)..( 8): Result.001 file - promoters60/1021445
tgggcctg

SEQ ID NO: 97948 - DNA, 8 bp, Unknown
  misc_feature (1)..( 8): Result.001 file - promoters60/1021445
tgggcctt

SEQ ID NO: 97949 - DNA, 8 bp, Unknown
  misc_feature (1)..( 8): Result.001 file - promoters60/1021445
tggccctg

SEQ ID NO: 97950 - DNA, 8 bp, Unknown
  misc_feature (1)..( 8): Result.001 file - promoters60/1021445
tgggccta

SEQ ID NO: 97951 - DNA, 9 bp, Unknown
  misc_feature (1)..( 9): Result.001 file - promoters60/1021445
tatcaaaac

SEQ ID NO: 97952 - DNA, 9 bp, Unknown
  misc_feature (1)..( 9): Result.001 file - promoters60/1021445
tataaaaag

SEQ ID NO: 97953 - DNA, 9 bp, Unknown
  misc_feature (1)..( 9): Result.001 file - promoters60/1021445
tataaaact

SEQ ID NO: 97954 - DNA, 9 bp, Unknown
  misc_feature (1)..( 9): Result.001 file - promoters60/1021445
tatataaag

SEQ ID NO: 97955 - DNA, 9 bp, Unknown
  misc_feature (1)..( 9): Result.001 file - promoters60/1021445
tataaacgc

SEQ ID NO: 97956 - DNA, 9 bp, Unknown
  misc_feature (1)..( 9): Result.001 file - promoters60/1021445
tataaattg

SEQ ID NO: 97957 - DNA, 9 bp, Unknown
  misc_feature (1)..( 9): Result.001 file - promoters60/1021549
tataaactc

SEQ ID NO: 97958 - DNA, 14 bp, Unknown
  misc_feature (1)..( 14): Result.001 file - promoters60/1021549
acatatatacttag

SEQ ID NO: 97959 - DNA, 14 bp, Unknown
  misc_feature (1)..( 14): Result.001 file - promoters60/1021549
gtatatatataaaa

SEQ ID NO: 97960 - DNA, 14 bp, Unknown
  misc_feature (1)..( 14): Result.001 file - promoters60/1021549
atttatatagataa

SEQ ID NO: 97961 - DNA, 14 bp, Unknown
  misc_feature (1)..( 14): Result.001 file - promoters60/1021549
tggtatataaattc

SEQ ID NO: 97962 - DNA, 14 bp, Unknown
  misc_feature (1)..( 14): Result.001 file - promoters60/1021549
aaaaatatttgtat

SEQ ID NO: 97963 - DNA, 14 bp, Unknown
  misc_feature (1)..( 14): Result.001 file - promoters60/1021549
cccaataaaaagca

SEQ ID NO: 97964 - DNA, 11 bp, Unknown
  misc_feature (1)..( 11): Result.001 file - promoters60/1021549
taatcttttgg

SEQ ID NO: 97965 - DNA, 11 bp, Unknown
  misc_feature (1)..( 11): Result.001 file - promoters60/1021549
aactcttttga

SEQ ID NO: 97966 - DNA, 11 bp, Unknown
  misc_feature (1)..( 11): Result.001 file - promoters60/1021549
taatttttttc

SEQ ID NO: 97967 - DNA, 11 bp, Unknown
  misc_feature (1)..( 11): Result.001 file - promoters60/1021549
aactcttttga

SEQ ID NO: 97968 - DNA, 11 bp, Unknown
  misc_feature (1)..( 11): Result.001 file - promoters60/1021549
caatctttttt

SEQ ID NO: 97969 - DNA, 11 bp, Unknown
  misc_feature (1)..( 11): Result.001 file - promoters60/1021563
ttttttttttt

SEQ ID NO: 97970 - DNA, 7 bp, Unknown
  misc_feature (1)..( 7): Result.001 file - promoters60/1021563
ctggatc

SEQ ID NO: 97971 - DNA, 7 bp, Unknown
  misc_feature (1)..( 7): Result.001 file - promoters60/1021563
ctggata

SEQ ID NO: 97972 - DNA, 7 bp, Unknown
  misc_feature (1)..( 7): Result.001 file - promoters60/1021563
atggata

SEQ ID NO: 97973 - DNA, 9 bp, Unknown
  misc_feature (1)..( 9): Result.001 file - promoters60/1021563
catcttctt

SEQ ID NO: 97974 - DNA, 9 bp, Unknown
  misc_feature (1)..( 9): Result.001 file - promoters60/1021563
catcgtctg

SEQ ID NO: 97975 - DNA, 9 bp, Unknown
  misc_feature (1)..( 9): Result.001 file - promoters60/1021563
tgtcgactg

SEQ ID NO: 97976 - DNA, 9 bp, Unknown
  misc_feature (1)..( 9): Result.001 file - promoters60/1021563
gttttgctt

SEQ ID NO: 97977 - DNA, 9 bp, Unknown
  misc_feature (1)..( 9): Result.001 file - promoters60/1021563
gtttagctc

SEQ ID NO: 97978 - DNA, 9 bp, Unknown
  misc_feature (1)..( 9): Result.001 file - promoters60/1021563
cgctagctc

SEQ ID NO: 97979 - DNA, 10 bp, Unknown
  misc_feature (1)..( 10): Result.001 file - promoters60/1021563
agcgacggag

SEQ ID NO: 97980 - DNA, 10 bp, Unknown
  misc_feature (1)..( 10): Result.001 file - promoters60/1021563
agcggcggag

SEQ ID NO: 97981 - DNA, 10 bp, Unknown
  misc_feature (1)..( 10): Result.001 file - promoters60/1021655
gtcggcgaag

SEQ ID NO: 97982 - DNA, 11 bp, Unknown
  misc_feature (1)..( 11): Result.001 file - promoters60/1021655
ctacgaaaatg

SEQ ID NO: 97983 - DNA, 11 bp, Unknown
  misc_feature (1)..( 11): Result.001 file - promoters60/1021655
ttactaaaagt

SEQ ID NO: 97984 - DNA, 11 bp, Unknown
  misc_feature (1)..( 11): Result.001 file - promoters60/1021655
ccaggaagatg

SEQ ID NO: 97985 - DNA, 11 bp, Unknown
  misc_feature (1)..( 11): Result.001 file - promoters60/1021655
agacgaaacaa

SEQ ID NO: 97986 - DNA, 11 bp, Unknown
  misc_feature (1)..( 11): Result.001 file - promoters60/1021655
ttactaaggtg

SEQ ID NO: 97987 - DNA, 11 bp, Unknown
  misc_feature (1)..( 11): Result.001 file - promoters60/1021764
cgacgaagctc

SEQ ID NO: 97988 - DNA, 7 bp, Unknown
  misc_feature (1)..( 7): Result.001 file - promoters60/1021764
aaataat

SEQ ID NO: 97989 - DNA, 7 bp, Unknown
  misc_feature (1)..( 7): Result.001 file - promoters60/1021764
aaaaaat

SEQ ID NO: 97990 - DNA, 7 bp, Unknown
  misc_feature (1)..( 7): Result.001 file - promoters60/1021764
atacaaa

SEQ ID NO: 97991 - DNA, 7 bp, Unknown
  misc_feature (1)..( 7): Result.001 file - promoters60/1021764
atacaaa

SEQ ID NO: 97992 - DNA, 7 bp, Unknown
  misc_feature (1)..( 7): Result.001 file - promoters60/1021764
aaatttt

SEQ ID NO: 97993 - DNA, 7 bp, Unknown
  misc_feature (1)..( 7): Result.001 file - promoters60/1021764
aaatttt

SEQ ID NO: 97994 - DNA, 6 bp, Unknown
  misc_feature (1)..( 6): Result.001 file - promoters60/1021764
ttttat

SEQ ID NO: 97995 - DNA, 6 bp, Unknown
  misc_feature (1)..( 6): Result.001 file - promoters60/1021764
ttttat

SEQ ID NO: 97996 - DNA, 8 bp, Unknown
  misc_feature (1)..( 8): Result.001 file - promoters60/1021764
ataacatt

SEQ ID NO: 97997 - DNA, 8 bp, Unknown
  misc_feature (1)..( 8): Result.001 file - promoters60/1021764
ataccatt

SEQ ID NO: 97998 - DNA, 6 bp, Unknown
  misc_feature (1)..( 6): Result.001 file - promoters60/1021764
ttaatt

SEQ ID NO: 97999 - DNA, 6 bp, Unknown
  misc_feature (1)..( 6): Result.001 file - promoters60/1021764
ttaatt

SEQ ID NO: 98000 - DNA, 8 bp, Unknown
  misc_feature (1)..( 8): Result.001 file - promoters60/1021764
atatcaaa

SEQ ID NO: 98001 - DNA, 8 bp, Unknown
  misc_feature (1)..( 8): Result.001 file - promoters60/1021764
atattaaa

SEQ ID NO: 98002 - DNA, 6 bp, Unknown
  misc_feature (1)..( 6): Result.001 file - promoters60/1021764
tttgaa

SEQ ID NO: 98003 - DNA, 6 bp, Unknown
  misc_feature (1)..( 6): Result.001 file - promoters60/1021764
tttgaa

SEQ ID NO: 98004 - DNA, 8 bp, Unknown
  misc_feature (1)..( 8): Result.001 file - promoters60/1021764
aactttca

SEQ ID NO: 98005 - DNA, 8 bp, Unknown
  misc_feature (1)..( 8): Result.001 file - promoters60/1021764
aacattca

SEQ ID NO: 98006 - DNA, 6 bp, Unknown
  misc_feature (1)..( 6): Result.001 file - promoters60/1021764
ctctat

SEQ ID NO: 98007 - DNA, 6 bp, Unknown
  misc_feature (1)..( 6): Result.001 file - promoters60/1021764
ctctat

SEQ ID NO: 98008 - DNA, 8 bp, Unknown
  misc_feature (1)..( 8): Result.001 file - promoters60/1021764
atttggta

SEQ ID NO: 98009 - DNA, 8 bp, Unknown
  misc_feature (1)..( 8): Result.001 file - promoters60/1021764
atttagta

SEQ ID NO: 98010 - DNA, 7 bp, Unknown
  misc_feature (1)..( 7): Result.001 file - promoters60/1021764
taactat

SEQ ID NO: 98011 - DNA, 7 bp, Unknown
  misc_feature (1)..( 7): Result.001 file - promoters60/1021764
taaatat

SEQ ID NO: 98012 - DNA, 7 bp, Unknown
  misc_feature (1)..( 7): Result.001 file - promoters60/1021764
gtttctt

SEQ ID NO: 98013 - DNA, 7 bp, Unknown
  misc_feature (1)..( 7): Result.001 file - promoters60/1021764
gtttctt

SEQ ID NO: 98014 - DNA, 8 bp, Unknown
  misc_feature (1)..( 8): Result.001 file - promoters60/1021764
caaacaca

SEQ ID NO: 98015 - DNA, 8 bp, Unknown
  misc_feature (1)..( 8): Result.001 file - promoters60/1021764
caatcaca

SEQ ID NO: 98016 - DNA, 6 bp, Unknown
  misc_feature (1)..( 6): Result.001 file - promoters60/1021764
tatttt

SEQ ID NO: 98017 - DNA, 6 bp, Unknown
  misc_feature (1)..( 6): Result.001 file - promoters60/1021764
tatttt

SEQ ID NO: 98018 - DNA, 11 bp, Unknown
  misc_feature (1)..( 11): Result.001 file - promoters60/1021764
ttttgtctttt

SEQ ID NO: 98019 - DNA, 11 bp, Unknown
  misc_feature (1)..( 11): Result.001 file - promoters60/1021764
ttttgtatttt

SEQ ID NO: 98020 - DNA, 6 bp, Unknown
  misc_feature (1)..( 6): Result.001 file - promoters60/1021764
ttattt

SEQ ID NO: 98021 - DNA, 6 bp, Unknown
  misc_feature (1)..( 6): Result.001 file - promoters60/1021764
ttattt

SEQ ID NO: 98022 - DNA, 8 bp, Unknown
  misc_feature (1)..( 8): Result.001 file - promoters60/1021764
ctactaac

SEQ ID NO: 98023 - DNA, 8 bp, Unknown
  misc_feature (1)..( 8): Result.001 file - promoters60/1021764
ctacaaac

SEQ ID NO: 98024 - DNA, 6 bp, Unknown
  misc_feature (1)..( 6): Result.001 file - promoters60/1021764
ctaaaa

SEQ ID NO: 98025 - DNA, 6 bp, Unknown
  misc_feature (1)..( 6): Result.001 file - promoters60/1021764
ctaaaa

SEQ ID NO: 98026 - DNA, 10 bp, Unknown
  misc_feature (1)..( 10): Result.001 file - promoters60/1021764
aaaatattac

SEQ ID NO: 98027 - DNA, 10 bp, Unknown
  misc_feature (1)..( 10): Result.001 file - promoters60/1021764
aaaatattac

SEQ ID NO: 98028 - DNA, 6 bp, Unknown
  misc_feature (1)..( 6): Result.001 file - promoters60/1021764
caataa

SEQ ID NO: 98029 - DNA, 6 bp, Unknown
  misc_feature (1)..( 6): Result.001 file - promoters60/1021764
caataa

SEQ ID NO: 98030 - DNA, 7 bp, Unknown
  misc_feature (1)..( 7): Result.001 file - promoters60/1021764
ctattta

SEQ ID NO: 98031 - DNA, 7 bp, Unknown
  misc_feature (1)..( 7): Result.001 file - promoters60/1021764
ctattta

SEQ ID NO: 98032 - DNA, 7 bp, Unknown
  misc_feature (1)..( 7): Result.001 file - promoters60/1021764
aaatata

SEQ ID NO: 98033 - DNA, 7 bp, Unknown
  misc_feature (1)..( 7): Result.001 file - promoters60/1021764
aaagata

SEQ ID NO: 98034 - DNA, 7 bp, Unknown
  misc_feature (1)..( 7): Result.001 file - promoters60/1021764
ttaatag

SEQ ID NO: 98035 - DNA, 7 bp, Unknown
  misc_feature (1)..( 7): Result.001 file - promoters60/1021764
ttattag

SEQ ID NO: 98036 - DNA, 7 bp, Unknown
  misc_feature (1)..( 7): Result.001 file - promoters60/1021764
ttagttt

SEQ ID NO: 98037 - DNA, 7 bp, Unknown
  misc_feature (1)..( 7): Result.001 file - promoters60/1021764
ttatttt

SEQ ID NO: 98038 - DNA, 7 bp, Unknown
  misc_feature (1)..( 7): Result.001 file - promoters60/1021764
agattct

SEQ ID NO: 98039 - DNA, 7 bp, Unknown
  misc_feature (1)..( 7): Result.001 file - promoters60/1021764
agagtct

SEQ ID NO: 98040 - DNA, 6 bp, Unknown
  misc_feature (1)..( 6): Result.001 file - promoters60/1021764
acaaat

SEQ ID NO: 98041 - DNA, 6 bp, Unknown
  misc_feature (1)..( 6): Result.001 file - promoters60/1021764
acaaat

SEQ ID NO: 98042 - DNA, 7 bp, Unknown
  misc_feature (1)..( 7): Result.001 file - promoters60/1021764
cttcttt

SEQ ID NO: 98043 - DNA, 7 bp, Unknown
  misc_feature (1)..( 7): Result.001 file - promoters60/1021833
cttgttt

SEQ ID NO: 98044 - DNA, 7 bp, Unknown
  misc_feature (1)..( 7): Result.001 file - promoters60/1021833
taaatta

SEQ ID NO: 98045 - DNA, 7 bp, Unknown
  misc_feature (1)..( 7): Result.001 file - promoters60/1021833
aaaatta

SEQ ID NO: 98046 - DNA, 7 bp, Unknown
  misc_feature (1)..( 7): Result.001 file - promoters60/1021833
taaatta

SEQ ID NO: 98047 - DNA, 6 bp, Unknown
  misc_feature (1)..( 6): Result.001 file - promoters60/1021833
attttt

SEQ ID NO: 98048 - DNA, 6 bp, Unknown
  misc_feature (1)..( 6): Result.001 file - promoters60/1021833
attttt

SEQ ID NO: 98049 - DNA, 7 bp, Unknown
  misc_feature (1)..( 7): Result.001 file - promoters60/1021833
attgttt

SEQ ID NO: 98050 - DNA, 9 bp, Unknown
  misc_feature (1)..( 9): Result.001 file - promoters60/1021833
aaaaaaatt

SEQ ID NO: 98051 - DNA, 9 bp, Unknown
  misc_feature (1)..( 9): Result.001 file - promoters60/1021833
aaaacaatt

SEQ ID NO: 98052 - DNA, 9 bp, Unknown
  misc_feature (1)..( 9): Result.001 file - promoters60/1021833
aacgaaacc

SEQ ID NO: 98053 - DNA, 9 bp, Unknown
  misc_feature (1)..( 9): Result.001 file - promoters60/1021833
ttatgtatt

SEQ ID NO: 98054 - DNA, 9 bp, Unknown
  misc_feature (1)..( 9): Result.001 file - promoters60/1021833
ttatatata

SEQ ID NO: 98055 - DNA, 9 bp, Unknown
  misc_feature (1)..( 9): Result.001 file - promoters60/1021833
atatctatt

SEQ ID NO: 98056 - DNA, 8 bp, Unknown
  misc_feature (1)..( 8): Result.001 file - promoters60/1021833
aatttttg

SEQ ID NO: 98057 - DNA, 8 bp, Unknown
  misc_feature (1)..( 8): Result.001 file - promoters60/1021833
aattttta

SEQ ID NO: 98058 - DNA, 8 bp, Unknown
  misc_feature (1)..( 8): Result.001 file - promoters60/1021833
ggttttta

SEQ ID NO: 98059 - DNA, 10 bp, Unknown
  misc_feature (1)..( 10): Result.001 file - promoters60/1021833
gttttagttt

SEQ ID NO: 98060 - DNA, 10 bp, Unknown
  misc_feature (1)..( 10): Result.001 file - promoters60/1021833
tttttacttt

SEQ ID NO: 98061 - DNA, 10 bp, Unknown
  misc_feature (1)..( 10): Result.001 file - promoters60/1021862
tttttatttc

SEQ ID NO: 98062 - DNA, 12 bp, Unknown
  misc_feature (1)..( 12): Result.001 file - promoters60/1021862
ttttaatttttt

SEQ ID NO: 98063 - DNA, 12 bp, Unknown
  misc_feature (1)..( 12): Result.001 file - promoters60/1021862
aggaaattttca

SEQ ID NO: 98064 - DNA, 12 bp, Unknown
  misc_feature (1)..( 12): Result.001 file - promoters60/1021862
cttaaatttaaa

SEQ ID NO: 98065 - DNA, 12 bp, Unknown
  misc_feature (1)..( 12): Result.001 file - promoters60/1021862
atataatattca

SEQ ID NO: 98066 - DNA, 12 bp, Unknown
  misc_feature (1)..( 12): Result.001 file - promoters60/1021862
ataaaattagtc

SEQ ID NO: 98067 - DNA, 12 bp, Unknown
  misc_feature (1)..( 12): Result.001 file - promoters60/1021862
ttgcaatttaga

SEQ ID NO: 98068 - DNA, 9 bp, Unknown
  misc_feature (1)..( 9): Result.001 file - promoters60/1021862
tttaatttt

SEQ ID NO: 98069 - DNA, 9 bp, Unknown
  misc_feature (1)..( 9): Result.001 file - promoters60/1021862
gttaattaa

SEQ ID NO: 98070 - DNA, 10 bp, Unknown
  misc_feature (1)..( 10): Result.001 file - promoters60/1021862
cttaaattta

SEQ ID NO: 98071 - DNA, 10 bp, Unknown
  misc_feature (1)..( 10): Result.001 file - promoters60/1021862
agtaaatagt

SEQ ID NO: 98072 - DNA, 10 bp, Unknown
  misc_feature (1)..( 10): Result.001 file - promoters60/1021862
taataattag

SEQ ID NO: 98073 - DNA, 10 bp, Unknown
  misc_feature (1)..( 10): Result.001 file - promoters60/1021862
ttgcaattta

SEQ ID NO: 98074 - DNA, 15 bp, Unknown
  misc_feature (1)..( 15): Result.001 file - promoters60/1021862
gaaaaaaaaaaaaaa

SEQ ID NO: 98075 - DNA, 15 bp, Unknown
  misc_feature (1)..( 15): Result.001 file - promoters60/1021862
aaaacaaaataaaaa

SEQ ID NO: 98076 - DNA, 15 bp, Unknown
  misc_feature (1)..( 15): Result.001 file - promoters60/1021862
gaagaaagacgaagg

SEQ ID NO: 98077 - DNA, 15 bp, Unknown
  misc_feature (1)..( 15): Result.001 file - promoters60/1021862
caaataaataacagt

SEQ ID NO: 98078 - DNA, 15 bp, Unknown
  misc_feature (1)..( 15): Result.001 file - promoters60/1021862
caaattaagtacaca

SEQ ID NO: 98079 - DNA, 15 bp, Unknown
  misc_feature (1)..( 15): Result.001 file - promoters60/1021870
caaatttgagtgtta

SEQ ID NO: 98080 - DNA, 9 bp, Unknown
  misc_feature (1)..( 9): Result.001 file - promoters60/1021870
aaaatcgta

SEQ ID NO: 98081 - DNA, 9 bp, Unknown
  misc_feature (1)..( 9): Result.001 file - promoters60/1021870
aaaatctgg

SEQ ID NO: 98082 - DNA, 9 bp, Unknown
  misc_feature (1)..( 9): Result.001 file - promoters60/1021870
taaatttgg

SEQ ID NO: 98083 - DNA, 12 bp, Unknown
  misc_feature (1)..( 12): Result.001 file - promoters60/1021870
attcccaaaatc

SEQ ID NO: 98084 - DNA, 12 bp, Unknown
  misc_feature (1)..( 12): Result.001 file - promoters60/1021870
tggaccataatt

SEQ ID NO: 98085 - DNA, 12 bp, Unknown
  misc_feature (1)..( 12): Result.001 file - promoters60/1021870
atttccaaaatt

SEQ ID NO: 98086 - DNA, 12 bp, Unknown
  misc_feature (1)..( 12): Result.001 file - promoters60/1021987
ctaaaaataatt

SEQ ID NO: 98087 - DNA, 11 bp, Unknown
  misc_feature (1)..( 11): Result.001 file - promoters60/1021987
ttttgcgaaaa

SEQ ID NO: 98088 - DNA, 11 bp, Unknown
  misc_feature (1)..( 11): Result.001 file - promoters60/1021987
ttttgctaaaa

SEQ ID NO: 98089 - DNA, 11 bp, Unknown
  misc_feature (1)..( 11): Result.001 file - promoters60/1021987
atctgctaatg

SEQ ID NO: 98090 - DNA, 9 bp, Unknown
  misc_feature (1)..( 9): Result.001 file - promoters60/1021987
ttttggttt

SEQ ID NO: 98091 - DNA, 9 bp, Unknown
  misc_feature (1)..( 9): Result.001 file - promoters60/1021987
atttgattt

SEQ ID NO: 98092 - DNA, 9 bp, Unknown
  misc_feature (1)..( 9): Result.001 file - promoters60/1021987
atttaattt

SEQ ID NO: 98093 - DNA, 7 bp, Unknown
  misc_feature (1)..( 7): Result.001 file - promoters60/1021987
tattatc

SEQ ID NO: 98094 - DNA, 7 bp, Unknown
  misc_feature (1)..( 7): Result.001 file - promoters60/1021987
tattata

SEQ ID NO: 98095 - DNA, 7 bp, Unknown
  misc_feature (1)..( 7): Result.001 file - promoters60/1021987
aattata

SEQ ID NO: 98096 - DNA, 8 bp, Unknown
  misc_feature (1)..( 8): Result.001 file - promoters60/1021987
caaaccca

SEQ ID NO: 98097 - DNA, 8 bp, Unknown
  misc_feature (1)..( 8): Result.001 file - promoters60/1021987
caaacctg

SEQ ID NO: 98098 - DNA, 8 bp, Unknown
  misc_feature (1)..( 8): Result.001 file - promoters60/1021987
gaaagctg

SEQ ID NO: 98099 - DNA, 8 bp, Unknown
  misc_feature (1)..( 8): Result.001 file - promoters60/1021987
agagacat

SEQ ID NO: 98100 - DNA, 8 bp, Unknown
  misc_feature (1)..( 8): Result.001 file - promoters60/1021987
agatacag

SEQ ID NO: 98101 - DNA, 8 bp, Unknown
  misc_feature (1)..( 8): Result.001 file - promoters60/1021987
cgatccag

SEQ ID NO: 98102 - DNA, 9 bp, Unknown
  misc_feature (1)..( 9): Result.001 file - promoters60/1021987
tttaaagct

SEQ ID NO: 98103 - DNA, 9 bp, Unknown
  misc_feature (1)..( 9): Result.001 file - promoters60/1021987
tttcaagtt

SEQ ID NO: 98104 - DNA, 9 bp, Unknown
  misc_feature (1)..( 9): Result.001 file - promoters60/1022111
tctcacgtt

SEQ ID NO: 98105 - DNA, 8 bp, Unknown
  misc_feature (1)..( 8): Result.001 file - promoters60/1022111
gcggtaac

SEQ ID NO: 98106 - DNA, 8 bp, Unknown
  misc_feature (1)..( 8): Result.001 file - promoters60/1022111
gcggcaac

SEQ ID NO: 98107 - DNA, 7 bp, Unknown
  misc_feature (1)..( 7): Result.001 file - promoters60/1022111
tactttt

SEQ ID NO: 98108 - DNA, 7 bp, Unknown
  misc_feature (1)..( 7): Result.001 file - promoters60/1022111
tacattt

SEQ ID NO: 98109 - DNA, 9 bp, Unknown
  misc_feature (1)..( 9): Result.001 file - promoters60/1022111
ttattctaa

SEQ ID NO: 98110 - DNA, 9 bp, Unknown
  misc_feature (1)..( 9): Result.001 file - promoters60/1022111
ttattttaa

SEQ ID NO: 98111 - DNA, 8 bp, Unknown
  misc_feature (1)..( 8): Result.001 file - promoters60/1022111
caaagtat

SEQ ID NO: 98112 - DNA, 8 bp, Unknown
  misc_feature (1)..( 8): Result.001 file - promoters60/1022111
caaagtat

SEQ ID NO: 98113 - DNA, 8 bp, Unknown
  misc_feature (1)..( 8): Result.001 file - promoters60/1022111
ttattttg

SEQ ID NO: 98114 - DNA, 8 bp, Unknown
  misc_feature (1)..( 8): Result.001 file - promoters60/1022111
ttatttaa

SEQ ID NO: 98115 - DNA, 8 bp, Unknown
  misc_feature (1)..( 8): Result.001 file - promoters60/1022111
atatataa

SEQ ID NO: 98116 - DNA, 7 bp, Unknown
  misc_feature (1)..( 7): Result.001 file - promoters60/1022111
agagatt

SEQ ID NO: 98117 - DNA, 7 bp, Unknown
  misc_feature (1)..( 7): Result.001 file - promoters60/1022111
agaaatt

SEQ ID NO: 98118 - DNA, 7 bp, Unknown
  misc_feature (1)..( 7): Result.001 file - promoters60/1022111
tctcaaa

SEQ ID NO: 98119 - DNA, 7 bp, Unknown
  misc_feature (1)..( 7): Result.001 file - promoters60/1022111
tctaaaa

SEQ ID NO: 98120 - DNA, 6 bp, Unknown
  misc_feature (1)..( 6): Result.001 file - promoters60/1022111
ttagta

SEQ ID NO: 98121 - DNA, 6 bp, Unknown
  misc_feature (1)..( 6): Result.001 file - promoters60/1022111
ttagta

SEQ ID NO: 98122 - DNA, 9 bp, Unknown
  misc_feature (1)..( 9): Result.001 file - promoters60/1022111
atcatatat

SEQ ID NO: 98123 - DNA, 9 bp, Unknown
  misc_feature (1)..( 9): Result.001 file - promoters60/1022111
atcatgtat

SEQ ID NO: 98124 - DNA, 8 bp, Unknown
  misc_feature (1)..( 8): Result.001 file - promoters60/1022111
ttaataat

SEQ ID NO: 98125 - DNA, 8 bp, Unknown
  misc_feature (1)..( 8): Result.001 file - promoters60/1022111
ttattaat

SEQ ID NO: 98126 - DNA, 8 bp, Unknown
  misc_feature (1)..( 8): Result.001 file - promoters60/1022111
taacatat

SEQ ID NO: 98127 - DNA, 8 bp, Unknown
  misc_feature (1)..( 8): Result.001 file - promoters60/1022111
taacttat

SEQ ID NO: 98128 - DNA, 7 bp, Unknown
  misc_feature (1)..( 7): Result.001 file - promoters60/1022111
aataaac

SEQ ID NO: 98129 - DNA, 7 bp, Unknown
  misc_feature (1)..( 7): Result.001 file - promoters60/1022111
aataaac

SEQ ID NO: 98130 - DNA, 6 bp, Unknown
  misc_feature (1)..( 6): Result.001 file - promoters60/1022111
tatgca

SEQ ID NO: 98131 - DNA, 6 bp, Unknown
  misc_feature (1)..( 6): Result.001 file - promoters60/1022131
tatgca

SEQ ID NO: 98132 - DNA, 14 bp, Unknown
  misc_feature (1)..( 14): Result.001 file - promoters60/1022131
cgattagaaacaga

SEQ ID NO: 98133 - DNA, 14 bp, Unknown
  misc_feature (1)..( 14): Result.001 file - promoters60/1022131
attttaaaaaaaga

SEQ ID NO: 98134 - DNA, 14 bp, Unknown
  misc_feature (1)..( 14): Result.001 file - promoters60/1022131
tttttaaacgagtt

SEQ ID NO: 98135 - DNA, 14 bp, Unknown
  misc_feature (1)..( 14): Result.001 file - promoters60/1022131
aatttaaaagacca

SEQ ID NO: 98136 - DNA, 14 bp, Unknown
  misc_feature (1)..( 14): Result.001 file - promoters60/1022131
tacttaaaatggat

SEQ ID NO: 98137 - DNA, 10 bp, Unknown
  misc_feature (1)..( 10): Result.001 file - promoters60/1022131
taattttatt

SEQ ID NO: 98138 - DNA, 10 bp, Unknown
  misc_feature (1)..( 10): Result.001 file - promoters60/1022131
taattttcta

SEQ ID NO: 98139 - DNA, 10 bp, Unknown
  misc_feature (1)..( 10): Result.001 file - promoters60/1022131
atattttatt

SEQ ID NO: 98140 - DNA, 12 bp, Unknown
  misc_feature (1)..( 12): Result.001 file - promoters60/1022135
taatatgttagc

SEQ ID NO: 98141 - DNA, 9 bp, Unknown
  misc_feature (1)..( 9): Result.001 file - promoters60/1022135
ctcttgctg

SEQ ID NO: 98142 - DNA, 9 bp, Unknown
  misc_feature (1)..( 9): Result.001 file - promoters60/1022135
cccttactg

SEQ ID NO: 98143 - DNA, 9 bp, Unknown
  misc_feature (1)..( 9): Result.001 file - promoters60/1022135
ctctttctg

SEQ ID NO: 98144 - DNA, 8 bp, Unknown
  misc_feature (1)..( 8): Result.001 file - promoters60/1022135
agaatttc

SEQ ID NO: 98145 - DNA, 8 bp, Unknown
  misc_feature (1)..( 8): Result.001 file - promoters60/1022135
agagtttc

SEQ ID NO: 98146 - DNA, 8 bp, Unknown
  misc_feature (1)..( 8): Result.001 file - promoters60/1022170
tgagttta

SEQ ID NO: 98147 - DNA, 7 bp, Unknown
  misc_feature (1)..( 7): Result.001 file - promoters60/1022170
tgggcct

SEQ ID NO: 98148 - DNA, 7 bp, Unknown
  misc_feature (1)..( 7): Result.001 file - promoters60/1022170
tgggcct

SEQ ID NO: 98149 - DNA, 7 bp, Unknown
  misc_feature (1)..( 7): Result.001 file - promoters60/1022170
tgggcct

SEQ ID NO: 98150 - DNA, 11 bp, Unknown
  misc_feature (1)..( 11): Result.001 file - promoters60/1022170
ctacagaaaca

SEQ ID NO: 98151 - DNA, 11 bp, Unknown
  misc_feature (1)..( 11): Result.001 file - promoters60/1022170
ctaaagaaaaa

SEQ ID NO: 98152 - DNA, 10 bp, Unknown
  misc_feature (1)..( 10): Result.001 file - promoters60/1022170
tggagaaaaa

SEQ ID NO: 98153 - DNA, 9 bp, Unknown
  misc_feature (1)..( 9): Result.001 file - promoters60/1022170
cgagaaaag

SEQ ID NO: 98154 - DNA, 8 bp, Unknown
  misc_feature (1)..( 8): Result.001 file - promoters60/1022170
gagaaaaa

SEQ ID NO: 98155 - DNA, 8 bp, Unknown
  misc_feature (1)..( 8): Result.001 file - promoters60/1022170
gagaaaag

SEQ ID NO: 98156 - DNA, 8 bp, Unknown
  misc_feature (1)..( 8): Result.001 file - promoters60/1022192
aagaaaaa

SEQ ID NO: 98157 - DNA, 8 bp, Unknown
  misc_feature (1)..( 8): Result.001 file - promoters60/1022192
aaacgcat

SEQ ID NO: 98158 - DNA, 8 bp, Unknown
  misc_feature (1)..( 8): Result.001 file - promoters60/1022192
aaactcat

SEQ ID NO: 98159 - DNA, 7 bp, Unknown
  misc_feature (1)..( 7): Result.001 file - promoters60/1022192
aaaattg

SEQ ID NO: 98160 - DNA, 7 bp, Unknown
  misc_feature (1)..( 7): Result.001 file - promoters60/1022192
aaacttg

SEQ ID NO: 98161 - DNA, 7 bp, Unknown
  misc_feature (1)..( 7): Result.001 file - promoters60/1022192
aaaacta

SEQ ID NO: 98162 - DNA, 7 bp, Unknown
  misc_feature (1)..( 7): Result.001 file - promoters60/1022192
aaatcta

SEQ ID NO: 98163 - DNA, 7 bp, Unknown
  misc_feature (1)..( 7): Result.001 file - promoters60/1022192
ttgttta

SEQ ID NO: 98164 - DNA, 7 bp, Unknown
  misc_feature (1)..( 7): Result.001 file - promoters60/1022192
ttgttta

SEQ ID NO: 98165 - DNA, 6 bp, Unknown
  misc_feature (1)..( 6): Result.001 file - promoters60/1022192
aaacta

SEQ ID NO: 98166 - DNA, 6 bp, Unknown
  misc_feature (1)..( 6): Result.001 file - promoters60/1022192
aaacta

SEQ ID NO: 98167 - DNA, 6 bp, Unknown
  misc_feature (1)..( 6): Result.001 file - promoters60/1022192
taaaaa

SEQ ID NO: 98168 - DNA, 6 bp, Unknown
  misc_feature (1)..( 6): Result.001 file - promoters60/1022192
taaaaa

SEQ ID NO: 98169 - DNA, 7 bp, Unknown
  misc_feature (1)..( 7): Result.001 file - promoters60/1022192
tcatagt

SEQ ID NO: 98170 - DNA, 7 bp, Unknown
  misc_feature (1)..( 7): Result.001 file - promoters60/1022192
tcaaagt

SEQ ID NO: 98171 - DNA, 8 bp, Unknown
  misc_feature (1)..( 8): Result.001 file - promoters60/1022192
aaaatgtc

SEQ ID NO: 98172 - DNA, 8 bp, Unknown
  misc_feature (1)..( 8): Result.001 file - promoters60/1022192
aaaatgtc

SEQ ID NO: 98173 - DNA, 8 bp, Unknown
  misc_feature (1)..( 8): Result.001 file - promoters60/1022192
ttttcttc

SEQ ID NO: 98174 - DNA, 8 bp, Unknown
  misc_feature (1)..( 8): Result.001 file - promoters60/1022192
tttgcttc

SEQ ID NO: 98175 - DNA, 6 bp, Unknown
  misc_feature (1)..( 6): Result.001 file - promoters60/1022192
tattta

SEQ ID NO: 98176 - DNA, 6 bp, Unknown
  misc_feature (1)..( 6): Result.001 file - promoters60/1022192
tattta

SEQ ID NO: 98177 - DNA, 6 bp, Unknown
  misc_feature (1)..( 6): Result.001 file - promoters60/1022192
aattta

SEQ ID NO: 98178 - DNA, 6 bp, Unknown
  misc_feature (1)..( 6): Result.001 file - promoters60/1022192
aattta

SEQ ID NO: 98179 - DNA, 6 bp, Unknown
  misc_feature (1)..( 6): Result.001 file - promoters60/1022192
aactta

SEQ ID NO: 98180 - DNA, 6 bp, Unknown
  misc_feature (1)..( 6): Result.001 file - promoters60/1022192
aactta

SEQ ID NO: 98181 - DNA, 9 bp, Unknown
  misc_feature (1)..( 9): Result.001 file - promoters60/1022192
ctttttaaa

SEQ ID NO: 98182 - DNA, 9 bp, Unknown
  misc_feature (1)..( 9): Result.001 file - promoters60/1022192
cttttgaaa

SEQ ID NO: 98183 - DNA, 6 bp, Unknown
  misc_feature (1)..( 6): Result.001 file - promoters60/1022192
tatatt

SEQ ID NO: 98184 - DNA, 6 bp, Unknown
  misc_feature (1)..( 6): Result.001 file - promoters60/1022192
tatatt

SEQ ID NO: 98185 - DNA, 10 bp, Unknown
  misc_feature (1)..( 10): Result.001 file - promoters60/1022192
ttctaatcaa

SEQ ID NO: 98186 - DNA, 10 bp, Unknown
  misc_feature (1)..( 10): Result.001 file - promoters60/1022192
ttctagtcaa

SEQ ID NO: 98187 - DNA, 8 bp, Unknown
  misc_feature (1)..( 8): Result.001 file - promoters60/1022192
ctaaaaag

SEQ ID NO: 98188 - DNA, 8 bp, Unknown
  misc_feature (1)..( 8): Result.001 file - promoters60/1022245
ctaaaaag

SEQ ID NO: 98189 - DNA, 7 bp, Unknown
  misc_feature (1)..( 7): Result.001 file - promoters60/1022245
aaaatca

SEQ ID NO: 98190 - DNA, 7 bp, Unknown
  misc_feature (1)..( 7): Result.001 file - promoters60/1022245
aaattca

SEQ ID NO: 98191 - DNA, 7 bp, Unknown
  misc_feature (1)..( 7): Result.001 file - promoters60/1022245
aaaatcc

SEQ ID NO: 98192 - DNA, 7 bp, Unknown
  misc_feature (1)..( 7): Result.001 file - promoters60/1022252
aaagtca

SEQ ID NO: 98193 - DNA, 7 bp, Unknown
  misc_feature (1)..( 7): Result.001 file - promoters60/1022252
ggcactt

SEQ ID NO: 98194 - DNA, 7 bp, Unknown
  misc_feature (1)..( 7): Result.001 file - promoters60/1022252
ggctctt

SEQ ID NO: 98195 - DNA, 8 bp, Unknown
  misc_feature (1)..( 8): Result.001 file - promoters60/1022252
ttatcttt

SEQ ID NO: 98196 - DNA, 8 bp, Unknown
  misc_feature (1)..( 8): Result.001 file - promoters60/1022252
ttattttt

SEQ ID NO: 98197 - DNA, 7 bp, Unknown
  misc_feature (1)..( 7): Result.001 file - promoters60/1022252
tttgaag

SEQ ID NO: 98198 - DNA, 7 bp, Unknown
  misc_feature (1)..( 7): Result.001 file - promoters60/1022252
ttttaag

SEQ ID NO: 98199 - DNA, 8 bp, Unknown
  misc_feature (1)..( 8): Result.001 file - promoters60/1022252
taaaaatt

SEQ ID NO: 98200 - DNA, 8 bp, Unknown
  misc_feature (1)..( 8): Result.001 file - promoters60/1022252
aaaaaatt

SEQ ID NO: 98201 - DNA, 8 bp, Unknown
  misc_feature (1)..( 8): Result.001 file - promoters60/1022252
taataatt

SEQ ID NO: 98202 - DNA, 6 bp, Unknown
  misc_feature (1)..( 6): Result.001 file - promoters60/1022252
tacaaa

SEQ ID NO: 98203 - DNA, 6 bp, Unknown
  misc_feature (1)..( 6): Result.001 file - promoters60/1022252
tacaaa

SEQ ID NO: 98204 - DNA, 6 bp, Unknown
  misc_feature (1)..( 6): Result.001 file - promoters60/1022252
agaaaa

SEQ ID NO: 98205 - DNA, 6 bp, Unknown
  misc_feature (1)..( 6): Result.001 file - promoters60/1022252
agaaaa

SEQ ID NO: 98206 - DNA, 6 bp, Unknown
  misc_feature (1)..( 6): Result.001 file - promoters60/1022252
aaagta

SEQ ID NO: 98207 - DNA, 6 bp, Unknown
  misc_feature (1)..( 6): Result.001 file - promoters60/1022252
aaagta

SEQ ID NO: 98208 - DNA, 8 bp, Unknown
  misc_feature (1)..( 8): Result.001 file - promoters60/1022252
aaaaaaat

SEQ ID NO: 98209 - DNA, 8 bp, Unknown
  misc_feature (1)..( 8): Result.001 file - promoters60/1022252
aaaaaaaa

SEQ ID NO: 98210 - DNA, 8 bp, Unknown
  misc_feature (1)..( 8): Result.001 file - promoters60/1022252
aaaagatt

SEQ ID NO: 98211 - DNA, 7 bp, Unknown
  misc_feature (1)..( 7): Result.001 file - promoters60/1022252
aaaatta

SEQ ID NO: 98212 - DNA, 7 bp, Unknown
  misc_feature (1)..( 7): Result.001 file - promoters60/1022252
gaaatta

SEQ ID NO: 98213 - DNA, 7 bp, Unknown
  misc_feature (1)..( 7): Result.001 file - promoters60/1022252
aaaattt

SEQ ID NO: 98214 - DNA, 10 bp, Unknown
  misc_feature (1)..( 10): Result.001 file - promoters60/1022252
taaatgtatt

SEQ ID NO: 98215 - DNA, 10 bp, Unknown
  misc_feature (1)..( 10): Result.001 file - promoters60/1022252
taaatctatt

SEQ ID NO: 98216 - DNA, 7 bp, Unknown
  misc_feature (1)..( 7): Result.001 file - promoters60/1022252
ataaaag

SEQ ID NO: 98217 - DNA, 7 bp, Unknown
  misc_feature (1)..( 7): Result.001 file - promoters60/1022252
ataaaag

SEQ ID NO: 98218 - DNA, 6 bp, Unknown
  misc_feature (1)..( 6): Result.001 file - promoters60/1022252
aaaaag

SEQ ID NO: 98219 - DNA, 6 bp, Unknown
  misc_feature (1)..( 6): Result.001 file - promoters60/1022252
aaaaag

SEQ ID NO: 98220 - DNA, 7 bp, Unknown
  misc_feature (1)..( 7): Result.001 file - promoters60/1022252
aattatt

SEQ ID NO: 98221 - DNA, 7 bp, Unknown
  misc_feature (1)..( 7): Result.001 file - promoters60/1022252
aattatt

SEQ ID NO: 98222 - DNA, 6 bp, Unknown
  misc_feature (1)..( 6): Result.001 file - promoters60/1022252
atggaa

SEQ ID NO: 98223 - DNA, 6 bp, Unknown
  misc_feature (1)..( 6): Result.001 file - promoters60/1022252
atggaa

SEQ ID NO: 98224 - DNA, 6 bp, Unknown
  misc_feature (1)..( 6): Result.001 file - promoters60/1022252
ttattt

SEQ ID NO: 98225 - DNA, 6 bp, Unknown
  misc_feature (1)..( 6): Result.001 file - promoters60/1022252
ttattt

SEQ ID NO: 98226 - DNA, 6 bp, Unknown
  misc_feature (1)..( 6): Result.001 file - promoters60/1022252
cacaat

SEQ ID NO: 98227 - DNA, 6 bp, Unknown
  misc_feature (1)..( 6): Result.001 file - promoters60/1022252
cacaat

SEQ ID NO: 98228 - DNA, 7 bp, Unknown
  misc_feature (1)..( 7): Result.001 file - promoters60/1022252
aatcaca

SEQ ID NO: 98229 - DNA, 7 bp, Unknown
  misc_feature (1)..( 7): Result.001 file - promoters60/1022252
aattaca

SEQ ID NO: 98230 - DNA, 6 bp, Unknown
  misc_feature (1)..( 6): Result.001 file - promoters60/1022252
ttttaa

SEQ ID NO: 98231 - DNA, 6 bp, Unknown
  misc_feature (1)..( 6): Result.001 file - promoters60/1022252
ttttaa

SEQ ID NO: 98232 - DNA, 7 bp, Unknown
  misc_feature (1)..( 7): Result.001 file - promoters60/1022252
aaggttt

SEQ ID NO: 98233 - DNA, 7 bp, Unknown
  misc_feature (1)..( 7): Result.001 file - promoters60/1022252
aagattt

SEQ ID NO: 98234 - DNA, 8 bp, Unknown
  misc_feature (1)..( 8): Result.001 file - promoters60/1022252
aacttttt

SEQ ID NO: 98235 - DNA, 8 bp, Unknown
  misc_feature (1)..( 8): Result.001 file - promoters60/1022252
aacatttt

SEQ ID NO: 98236 - DNA, 11 bp, Unknown
  misc_feature (1)..( 11): Result.001 file - promoters60/1022252
atataaacaaa

SEQ ID NO: 98237 - DNA, 11 bp, Unknown
  misc_feature (1)..( 11): Result.001 file - promoters60/1022252
atataatcaaa

SEQ ID NO: 98238 - DNA, 7 bp, Unknown
  misc_feature (1)..( 7): Result.001 file - promoters60/1022252
ccaaaaa

SEQ ID NO: 98239 - DNA, 7 bp, Unknown
  misc_feature (1)..( 7): Result.001 file - promoters60/1022256
ccaaaaa

SEQ ID NO: 98240 - DNA, 7 bp, Unknown
  misc_feature (1)..( 7): Result.001 file - promoters60/1022256
aaaagaa

SEQ ID NO: 98241 - DNA, 7 bp, Unknown
  misc_feature (1)..( 7): Result.001 file - promoters60/1022256
aaaagac

SEQ ID NO: 98242 - DNA, 7 bp, Unknown
  misc_feature (1)..( 7): Result.001 file - promoters60/1022256
aaaaact

SEQ ID NO: 98243 - DNA, 11 bp, Unknown
  misc_feature (1)..( 11): Result.001 file - promoters60/1022256
aaatattaaat

SEQ ID NO: 98244 - DNA, 11 bp, Unknown
  misc_feature (1)..( 11): Result.001 file - promoters60/1022256
aaacatttaat

SEQ ID NO: 98245 - DNA, 11 bp, Unknown
  misc_feature (1)..( 11): Result.001 file - promoters60/1022256
atttattaatt

SEQ ID NO: 98246 - DNA, 10 bp, Unknown
  misc_feature (1)..( 10): Result.001 file - promoters60/1022256
agataatgag

SEQ ID NO: 98247 - DNA, 10 bp, Unknown
  misc_feature (1)..( 10): Result.001 file - promoters60/1022256
ttataaagag

SEQ ID NO: 98248 - DNA, 10 bp, Unknown
  misc_feature (1)..( 10): Result.001 file - promoters60/1022256
agataatttt

SEQ ID NO: 98249 - DNA, 8 bp, Unknown
  misc_feature (1)..( 8): Result.001 file - promoters60/1022256
ttttttca

SEQ ID NO: 98250 - DNA, 8 bp, Unknown
  misc_feature (1)..( 8): Result.001 file - promoters60/1022256
ttttatca

SEQ ID NO: 98251 - DNA, 8 bp, Unknown
  misc_feature (1)..( 8): Result.001 file - promoters60/1022256
ttttattt

SEQ ID NO: 98252 - DNA, 11 bp, Unknown
  misc_feature (1)..( 11): Result.001 file - promoters60/1022256
tatatatatac

SEQ ID NO: 98253 - DNA, 11 bp, Unknown
  misc_feature (1)..( 11): Result.001 file - promoters60/1022256
tatataaatac

SEQ ID NO: 98254 - DNA, 11 bp, Unknown
  misc_feature (1)..( 11): Result.001 file - promoters60/1022256
gttataaaacc

SEQ ID NO: 98255 - DNA, 8 bp, Unknown
  misc_feature (1)..( 8): Result.001 file - promoters60/1022256
taaattaa

SEQ ID NO: 98256 - DNA, 8 bp, Unknown
  misc_feature (1)..( 8): Result.001 file - promoters60/1022256
aaaactaa

SEQ ID NO: 98257 - DNA, 9 bp, Unknown
  misc_feature (1)..( 9): Result.001 file - promoters60/1022268
aaagactga

SEQ ID NO: 98258 - DNA, 6 bp, Unknown
  misc_feature (1)..( 6): Result.001 file - promoters60/1022268
aaacca

SEQ ID NO: 98259 - DNA, 6 bp, Unknown
  misc_feature (1)..( 6): Result.001 file - promoters60/1022268
aaacca

SEQ ID NO: 98260 - DNA, 6 bp, Unknown
  misc_feature (1)..( 6): Result.001 file - promoters60/1022268
aagatt

SEQ ID NO: 98261 - DNA, 6 bp, Unknown
  misc_feature (1)..( 6): Result.001 file - promoters60/1022268
aagatt

SEQ ID NO: 98262 - DNA, 9 bp, Unknown
  misc_feature (1)..( 9): Result.001 file - promoters60/1022268
atcctccga

SEQ ID NO: 98263 - DNA, 9 bp, Unknown
  misc_feature (1)..( 9): Result.001 file - promoters60/1022268
ctccgccga

SEQ ID NO: 98264 - DNA, 9 bp, Unknown
  misc_feature (1)..( 9): Result.001 file - promoters60/1022268
ctccggcga

SEQ ID NO: 98265 - DNA, 6 bp, Unknown
  misc_feature (1)..( 6): Result.001 file - promoters60/1022268
tcacca

SEQ ID NO: 98266 - DNA, 6 bp, Unknown
  misc_feature (1)..( 6): Result.001 file - promoters60/1022268
tcacca

SEQ ID NO: 98267 - DNA, 6 bp, Unknown
  misc_feature (1)..( 6): Result.001 file - promoters60/1022268
aaaccg

SEQ ID NO: 98268 - DNA, 6 bp, Unknown
  misc_feature (1)..( 6): Result.001 file - promoters60/1022268
aaaccg

SEQ ID NO: 98269 - DNA, 9 bp, Unknown
  misc_feature (1)..( 9): Result.001 file - promoters60/1022268
ctaaaccgg

SEQ ID NO: 98270 - DNA, 9 bp, Unknown
  misc_feature (1)..( 9): Result.001 file - promoters60/1022268
ctaaaccgg

SEQ ID NO: 98271 - DNA, 8 bp, Unknown
  misc_feature (1)..( 8): Result.001 file - promoters60/1022268
atcactgg

SEQ ID NO: 98272 - DNA, 8 bp, Unknown
  misc_feature (1)..( 8): Result.001 file - promoters60/1022268
atcgctgg

SEQ ID NO: 98273 - DNA, 6 bp, Unknown
  misc_feature (1)..( 6): Result.001 file - promoters60/1022268
tctaca

SEQ ID NO: 98274 - DNA, 6 bp, Unknown
  misc_feature (1)..( 6): Result.001 file - promoters60/1022268
tctaca

SEQ ID NO: 98275 - DNA, 6 bp, Unknown
  misc_feature (1)..( 6): Result.001 file - promoters60/1022268
tctccg

SEQ ID NO: 98276 - DNA, 6 bp, Unknown
  misc_feature (1)..( 6): Result.001 file - promoters60/1022268
tctccg

SEQ ID NO: 98277 - DNA, 7 bp, Unknown
  misc_feature (1)..( 7): Result.001 file - promoters60/1022268
gattcca

SEQ ID NO: 98278 - DNA, 7 bp, Unknown
  misc_feature (1)..( 7): Result.001 file - promoters60/1022292
gatacca

SEQ ID NO: 98279 - DNA, 7 bp, Unknown
  misc_feature (1)..( 7): Result.001 file - promoters60/1022292
gaaattt

SEQ ID NO: 98280 - DNA, 7 bp, Unknown
  misc_feature (1)..( 7): Result.001 file - promoters60/1022292
aaaattt

SEQ ID NO: 98281 - DNA, 8 bp, Unknown
  misc_feature (1)..( 8): Result.001 file - promoters60/1022292
aaagatta

SEQ ID NO: 98282 - DNA, 8 bp, Unknown
  misc_feature (1)..( 8): Result.001 file - promoters60/1022292
aaagatcc

SEQ ID NO: 98283 - DNA, 8 bp, Unknown
  misc_feature (1)..( 8): Result.001 file - promoters60/1022292
caaaattt

SEQ ID NO: 98284 - DNA, 8 bp, Unknown
  misc_feature (1)..( 8): Result.001 file - promoters60/1022292
gaaaattt

SEQ ID NO: 98285 - DNA, 13 bp, Unknown
  misc_feature (1)..( 13): Result.001 file - promoters60/1022292
tttaaaaacttct

SEQ ID NO: 98286 - DNA, 13 bp, Unknown
  misc_feature (1)..( 13): Result.001 file - promoters60/1022292
gttaaaaataaac

SEQ ID NO: 98287 - DNA, 13 bp, Unknown
  misc_feature (1)..( 13): Result.001 file - promoters60/1022292
tgtaaaaattata

SEQ ID NO: 98288 - DNA, 13 bp, Unknown
  misc_feature (1)..( 13): Result.001 file - promoters60/1022292
cttcaaacaaaac

SEQ ID NO: 98289 - DNA, 13 bp, Unknown
  misc_feature (1)..( 13): Result.001 file - promoters60/1022292
atgaaaagcttct

SEQ ID NO: 98290 - DNA, 13 bp, Unknown
  misc_feature (1)..( 13): Result.001 file - promoters60/1022296
tttaaaaacttct

SEQ ID NO: 98291 - DNA, 10 bp, Unknown
  misc_feature (1)..( 10): Result.001 file - promoters60/1022296
cagaaggaaa

SEQ ID NO: 98292 - DNA, 10 bp, Unknown
  misc_feature (1)..( 10): Result.001 file - promoters60/1022296
cagatggaat

SEQ ID NO: 98293 - DNA, 9 bp, Unknown
  misc_feature (1)..( 9): Result.001 file - promoters60/1022296
tgaatgaat

SEQ ID NO: 98294 - DNA, 10 bp, Unknown
  misc_feature (1)..( 10): Result.001 file - promoters60/1022324
acaatggaat

SEQ ID NO: 98295 - DNA, 11 bp, Unknown
  misc_feature (1)..( 11): Result.001 file - promoters60/1022324
taattctcgtt

SEQ ID NO: 98296 - DNA, 11 bp, Unknown
  misc_feature (1)..( 11): Result.001 file - promoters60/1022324
aaattctgagg

SEQ ID NO: 98297 - DNA, 11 bp, Unknown
  misc_feature (1)..( 11): Result.001 file - promoters60/1022324
cgattctgtaa

SEQ ID NO: 98298 - DNA, 11 bp, Unknown
  misc_feature (1)..( 11): Result.001 file - promoters60/1022324
gaattcttaga

SEQ ID NO: 98299 - DNA, 11 bp, Unknown
  misc_feature (1)..( 11): Result.001 file - promoters60/1022324
gaaatctccct

SEQ ID NO: 98300 - DNA, 11 bp, Unknown
  misc_feature (1)..( 11): Result.001 file - promoters60/1022383
cccttctttaa

SEQ ID NO: 98301 - DNA, 6 bp, Unknown
  misc_feature (1)..( 6): Result.001 file - promoters60/1022383
attgcc

SEQ ID NO: 98302 - DNA, 6 bp, Unknown
  misc_feature (1)..( 6): Result.001 file - promoters60/1022383
attgcc

SEQ ID NO: 98303 - DNA, 6 bp, Unknown
  misc_feature (1)..( 6): Result.001 file - promoters60/1022383
tttcaa

SEQ ID NO: 98304 - DNA, 6 bp, Unknown
  misc_feature (1)..( 6): Result.001 file - promoters60/1022383
tttcaa

SEQ ID NO: 98305 - DNA, 6 bp, Unknown
  misc_feature (1)..( 6): Result.001 file - promoters60/1022383
ctcatt

SEQ ID NO: 98306 - DNA, 6 bp, Unknown
  misc_feature (1)..( 6): Result.001 file - promoters60/1022383
ctcatt

SEQ ID NO: 98307 - DNA, 7 bp, Unknown
  misc_feature (1)..( 7): Result.001 file - promoters60/1022383
ctcttcc

SEQ ID NO: 98308 - DNA, 7 bp, Unknown
  misc_feature (1)..( 7): Result.001 file - promoters60/1022383
ctcctcc

SEQ ID NO: 98309 - DNA, 6 bp, Unknown
  misc_feature (1)..( 6): Result.001 file - promoters60/1022383
taagtt

SEQ ID NO: 98310 - DNA, 6 bp, Unknown
  misc_feature (1)..( 6): Result.001 file - promoters60/1022383
taagtt

SEQ ID NO: 98311 - DNA, 9 bp, Unknown
  misc_feature (1)..( 9): Result.001 file - promoters60/1022383
tcaaatgaa

SEQ ID NO: 98312 - DNA, 9 bp, Unknown
  misc_feature (1)..( 9): Result.001 file - promoters60/1022383
caaaatgaa

SEQ ID NO: 98313 - DNA, 9 bp, Unknown
  misc_feature (1)..( 9): Result.001 file - promoters60/1022383
caaaatgta

SEQ ID NO: 98314 - DNA, 6 bp, Unknown
  misc_feature (1)..( 6): Result.001 file - promoters60/1022383
tatcca

SEQ ID NO: 98315 - DNA, 6 bp, Unknown
  misc_feature (1)..( 6): Result.001 file - promoters60/1022383
tatcca

SEQ ID NO: 98316 - DNA, 7 bp, Unknown
  misc_feature (1)..( 7): Result.001 file - promoters60/1022383
cttgatt

SEQ ID NO: 98317 - DNA, 7 bp, Unknown
  misc_feature (1)..( 7): Result.001 file - promoters60/1022383
ctttatt

SEQ ID NO: 98318 - DNA, 7 bp, Unknown
  misc_feature (1)..( 7): Result.001 file - promoters60/1022383
cactaca

SEQ ID NO: 98319 - DNA, 7 bp, Unknown
  misc_feature (1)..( 7): Result.001 file - promoters60/1022383
caccaca

SEQ ID NO: 98320 - DNA, 7 bp, Unknown
  misc_feature (1)..( 7): Result.001 file - promoters60/1022383
agatctc

SEQ ID NO: 98321 - DNA, 7 bp, Unknown
  misc_feature (1)..( 7): Result.001 file - promoters60/1022383
agatctc

SEQ ID NO: 98322 - DNA, 6 bp, Unknown
  misc_feature (1)..( 6): Result.001 file - promoters60/1022383
aattaa

SEQ ID NO: 98323 - DNA, 6 bp, Unknown
  misc_feature (1)..( 6): Result.001 file - promoters60/1022383
aattaa

SEQ ID NO: 98324 - DNA, 6 bp, Unknown
  misc_feature (1)..( 6): Result.001 file - promoters60/1022383
tactaa

SEQ ID NO: 98325 - DNA, 6 bp, Unknown
  misc_feature (1)..( 6): Result.001 file - promoters60/1022383
tactaa

SEQ ID NO: 98326 - DNA, 6 bp, Unknown
  misc_feature (1)..( 6): Result.001 file - promoters60/1022383
aaaata

SEQ ID NO: 98327 - DNA, 6 bp, Unknown
  misc_feature (1)..( 6): Result.001 file - promoters60/1022383
aaaata

SEQ ID NO: 98328 - DNA, 8 bp, Unknown
  misc_feature (1)..( 8): Result.001 file - promoters60/1022383
ttaagttt

SEQ ID NO: 98329 - DNA, 8 bp, Unknown
  misc_feature (1)..( 8): Result.001 file - promoters60/1022383
ttaaattt

SEQ ID NO: 98330 - DNA, 8 bp, Unknown
  misc_feature (1)..( 8): Result.001 file - promoters60/1022383
ttcaaaaa

SEQ ID NO: 98331 - DNA, 8 bp, Unknown
  misc_feature (1)..( 8): Result.001 file - promoters60/1022401
ttcacaaa

SEQ ID NO: 98332 - DNA, 11 bp, Unknown
  misc_feature (1)..( 11): Result.001 file - promoters60/1022401
acatatatact

SEQ ID NO: 98333 - DNA, 11 bp, Unknown
  misc_feature (1)..( 11): Result.001 file - promoters60/1022401
gtatatatata

SEQ ID NO: 98334 - DNA, 11 bp, Unknown
  misc_feature (1)..( 11): Result.001 file - promoters60/1022401
tggtatataaa

SEQ ID NO: 98335 - DNA, 11 bp, Unknown
  misc_feature (1)..( 11): Result.001 file - promoters60/1022401
tgatatataaa

SEQ ID NO: 98336 - DNA, 11 bp, Unknown
  misc_feature (1)..( 11): Result.001 file - promoters60/1022401
cccaataaaaa

SEQ ID NO: 98337 - DNA, 11 bp, Unknown
  misc_feature (1)..( 11): Result.001 file - promoters60/1022401
taatataaagg

SEQ ID NO: 98338 - DNA, 11 bp, Unknown
  misc_feature (1)..( 11): Result.001 file - promoters60/1022401
acataaagaca

SEQ ID NO: 98339 - DNA, 11 bp, Unknown
  misc_feature (1)..( 11): Result.001 file - promoters60/1022401
tcataaatttt

SEQ ID NO: 98340 - DNA, 11 bp, Unknown
  misc_feature (1)..( 11): Result.001 file - promoters60/1022401
tcataaacatg

SEQ ID NO: 98341 - DNA, 11 bp, Unknown
  misc_feature (1)..( 11): Result.001 file - promoters60/1022401
aaataaatatc

SEQ ID NO: 98342 - DNA, 11 bp, Unknown
  misc_feature (1)..( 11): Result.001 file - promoters60/1022401
ctctaaaaaaa

SEQ ID NO: 98343 - DNA, 11 bp, Unknown
  misc_feature (1)..( 11): Result.001 file - promoters60/1022401
tcttaaagata

SEQ ID NO: 98344 - DNA, 11 bp, Unknown
  misc_feature (1)..( 11): Result.001 file - promoters60/1022401
taatcttttgg

SEQ ID NO: 98345 - DNA, 11 bp, Unknown
  misc_feature (1)..( 11): Result.001 file - promoters60/1022401
taatgtttttc

SEQ ID NO: 98346 - DNA, 11 bp, Unknown
  misc_feature (1)..( 11): Result.001 file - promoters60/1022401
atttcttttca

SEQ ID NO: 98347 - DNA, 11 bp, Unknown
  misc_feature (1)..( 11): Result.001 file - promoters60/1022401
aactcttttga

SEQ ID NO: 98348 - DNA, 11 bp, Unknown
  misc_feature (1)..( 11): Result.001 file - promoters60/1022401
ttttttttttt

SEQ ID NO: 98349 - DNA, 11 bp, Unknown
  misc_feature (1)..( 11): Result.001 file - promoters60/1022401
ggttcttcttc

SEQ ID NO: 98350 - DNA, 21 bp, Unknown
  misc_feature (1)..( 21): Result.001 file - promoters60/1022401
taattattattttaattagag

SEQ ID NO: 98351 - DNA, 21 bp, Unknown
  misc_feature (1)..( 21): Result.001 file - promoters60/1022401
taaagcccattataatgatcc

SEQ ID NO: 98352 - DNA, 21 bp, Unknown
  misc_feature (1)..( 21): Result.001 file - promoters60/1022401
tttatgggcctttatttatta

SEQ ID NO: 98353 - DNA, 21 bp, Unknown
  misc_feature (1)..( 21): Result.001 file - promoters60/1022401
taaagcccaatatactgctcg

SEQ ID NO: 98354 - DNA, 21 bp, Unknown
  misc_feature (1)..( 21): Result.001 file - promoters60/1022401
gttaaaatcgtataattcagg

SEQ ID NO: 98355 - DNA, 21 bp, Unknown
  misc_feature (1)..( 21): Result.001 file - promoters60/1022401
ccattactggtaaatttgaag

SEQ ID NO: 98356 - DNA, 21 bp, Unknown
  misc_feature (1)..( 21): Result.001 file - promoters60/1022474
agcttcgattaaaatttgggt

SEQ ID NO: 98357 - DNA, 7 bp, Unknown
  misc_feature (1)..( 7): Result.001 file - promoters60/1022474
gcacagc

SEQ ID NO: 98358 - DNA, 7 bp, Unknown
  misc_feature (1)..( 7): Result.001 file - promoters60/1022474
gcagagc

SEQ ID NO: 98359 - DNA, 8 bp, Unknown
  misc_feature (1)..( 8): Result.001 file - promoters60/1022474
aaatcggg

SEQ ID NO: 98360 - DNA, 8 bp, Unknown
  misc_feature (1)..( 8): Result.001 file - promoters60/1022474
aaattggg

SEQ ID NO: 98361 - DNA, 7 bp, Unknown
  misc_feature (1)..( 7): Result.001 file - promoters60/1022474
ttagagt

SEQ ID NO: 98362 - DNA, 7 bp, Unknown
  misc_feature (1)..( 7): Result.001 file - promoters60/1022474
ttaaagt

SEQ ID NO: 98363 - DNA, 9 bp, Unknown
  misc_feature (1)..( 9): Result.001 file - promoters60/1022474
atggctgaa

SEQ ID NO: 98364 - DNA, 9 bp, Unknown
  misc_feature (1)..( 9): Result.001 file - promoters60/1022474
atggttgaa

SEQ ID NO: 98365 - DNA, 7 bp, Unknown
  misc_feature (1)..( 7): Result.001 file - promoters60/1022474
aagtaaa

SEQ ID NO: 98366 - DNA, 7 bp, Unknown
  misc_feature (1)..( 7): Result.001 file - promoters60/1022546
aagaaaa

SEQ ID NO: 98367 - DNA, 6 bp, Unknown
  misc_feature (1)..( 6): Result.001 file - promoters60/1022546
actgtt

SEQ ID NO: 98368 - DNA, 6 bp, Unknown
  misc_feature (1)..( 6): Result.001 file - promoters60/1022546
actgtt

SEQ ID NO: 98369 - DNA, 8 bp, Unknown
  misc_feature (1)..( 8): Result.001 file - promoters60/1022546
tcgatttt

SEQ ID NO: 98370 - DNA, 8 bp, Unknown
  misc_feature (1)..( 8): Result.001 file - promoters60/1022546
aagatttt

SEQ ID NO: 98371 - DNA, 8 bp, Unknown
  misc_feature (1)..( 8): Result.001 file - promoters60/1022546
aagattta

SEQ ID NO: 98372 - DNA, 6 bp, Unknown
  misc_feature (1)..( 6): Result.001 file - promoters60/1022546
gtttag

SEQ ID NO: 98373 - DNA, 6 bp, Unknown
  misc_feature (1)..( 6): Result.001 file - promoters60/1022546
gtttag

SEQ ID NO: 98374 - DNA, 6 bp, Unknown
  misc_feature (1)..( 6): Result.001 file - promoters60/1022546
ttattt

SEQ ID NO: 98375 - DNA, 6 bp, Unknown
  misc_feature (1)..( 6): Result.001 file - promoters60/1022546
ttattt

SEQ ID NO: 98376 - DNA, 6 bp, Unknown
  misc_feature (1)..( 6): Result.001 file - promoters60/1022546
tttgac

SEQ ID NO: 98377 - DNA, 6 bp, Unknown
  misc_feature (1)..( 6): Result.001 file - promoters60/1022546
tttgac

SEQ ID NO: 98378 - DNA, 8 bp, Unknown
  misc_feature (1)..( 8): Result.001 file - promoters60/1022546
caaccaat

SEQ ID NO: 98379 - DNA, 8 bp, Unknown
  misc_feature (1)..( 8): Result.001 file - promoters60/1022546
caaccaat

SEQ ID NO: 98380 - DNA, 8 bp, Unknown
  misc_feature (1)..( 8): Result.001 file - promoters60/1022546
aaaccaaa

SEQ ID NO: 98381 - DNA, 7 bp, Unknown
  misc_feature (1)..( 7): Result.001 file - promoters60/1022546
aatttca

SEQ ID NO: 98382 - DNA, 7 bp, Unknown
  misc_feature (1)..( 7): Result.001 file - promoters60/1022546
aatttca

SEQ ID NO: 98383 - DNA, 7 bp, Unknown
  misc_feature (1)..( 7): Result.001 file - promoters60/1022546
atctcaa

SEQ ID NO: 98384 - DNA, 7 bp, Unknown
  misc_feature (1)..( 7): Result.001 file - promoters60/1022546
atctcaa

SEQ ID NO: 98385 - DNA, 6 bp, Unknown
  misc_feature (1)..( 6): Result.001 file - promoters60/1022546
ctttat

SEQ ID NO: 98386 - DNA, 6 bp, Unknown
  misc_feature (1)..( 6): Result.001 file - promoters60/1022546
ctttat

SEQ ID NO: 98387 - DNA, 7 bp, Unknown
  misc_feature (1)..( 7): Result.001 file - promoters60/1022546
ttcccac

SEQ ID NO: 98388 - DNA, 7 bp, Unknown
  misc_feature (1)..( 7): Result.001 file - promoters60/1022546
ttcacac

SEQ ID NO: 98389 - DNA, 7 bp, Unknown
  misc_feature (1)..( 7): Result.001 file - promoters60/1022546
tttccgt

SEQ ID NO: 98390 - DNA, 7 bp, Unknown
  misc_feature (1)..( 7): Result.001 file - promoters60/1022546
tttgcgt

SEQ ID NO: 98391 - DNA, 7 bp, Unknown
  misc_feature (1)..( 7): Result.001 file - promoters60/1022546
accaaaa

SEQ ID NO: 98392 - DNA, 7 bp, Unknown
  misc_feature (1)..( 7): Result.001 file - promoters60/1022546
accaaaa

SEQ ID NO: 98393 - DNA, 9 bp, Unknown
  misc_feature (1)..( 9): Result.001 file - promoters60/1022546
atttcccat

SEQ ID NO: 98394 - DNA, 9 bp, Unknown
  misc_feature (1)..( 9): Result.001 file - promoters60/1022546
atttcacat

SEQ ID NO: 98395 - DNA, 6 bp, Unknown
  misc_feature (1)..( 6): Result.001 file - promoters60/1022546
aaccac

SEQ ID NO: 98396 - DNA, 6 bp, Unknown
  misc_feature (1)..( 6): Result.001 file - promoters60/1022546
aaccac

SEQ ID NO: 98397 - DNA, 6 bp, Unknown
  misc_feature (1)..( 6): Result.001 file - promoters60/1022546
aggctt

SEQ ID NO: 98398 - DNA, 6 bp, Unknown
  misc_feature (1)..( 6): Result.001 file - promoters60/1022546
aggctt

SEQ ID NO: 98399 - DNA, 6 bp, Unknown
  misc_feature (1)..( 6): Result.001 file - promoters60/1022546
caaaaa

SEQ ID NO: 98400 - DNA, 6 bp, Unknown
  misc_feature (1)..( 6): Result.001 file - promoters60/1022546
caaaaa

SEQ ID NO: 98401 - DNA, 7 bp, Unknown
  misc_feature (1)..( 7): Result.001 file - promoters60/1022546
taacata

SEQ ID NO: 98402 - DNA, 7 bp, Unknown
  misc_feature (1)..( 7): Result.001 file - promoters60/1022546
taaaata

SEQ ID NO: 98403 - DNA, 6 bp, Unknown
  misc_feature (1)..( 6): Result.001 file - promoters60/1022546
aaaaaa

SEQ ID NO: 98404 - DNA, 6 bp, Unknown
  misc_feature (1)..( 6): Result.001 file - promoters60/1022546
aaaaaa

SEQ ID NO: 98405 - DNA, 6 bp, Unknown
  misc_feature (1)..( 6): Result.001 file - promoters60/1022546
ctctct

SEQ ID NO: 98406 - DNA, 6 bp, Unknown
  misc_feature (1)..( 6): Result.001 file - promoters60/1022546
ctctct

SEQ ID NO: 98407 - DNA, 7 bp, Unknown
  misc_feature (1)..( 7): Result.001 file - promoters60/1022546
tctcttt

SEQ ID NO: 98408 - DNA, 7 bp, Unknown
  misc_feature (1)..( 7): Result.001 file - promoters60/1022546
tctattt

SEQ ID NO: 98409 - DNA, 6 bp, Unknown
  misc_feature (1)..( 6): Result.001 file - promoters60/1022546
tttaca

SEQ ID NO: 98410 - DNA, 6 bp, Unknown
  misc_feature (1)..( 6): Result.001 file - promoters60/1022546
tttaca

SEQ ID NO: 98411 - DNA, 6 bp, Unknown
  misc_feature (1)..( 6): Result.001 file - promoters60/1022546
caaact

SEQ ID NO: 98412 - DNA, 6 bp, Unknown
  misc_feature (1)..( 6): Result.001 file - promoters60/1022546
caaact

SEQ ID NO: 98413 - DNA, 6 bp, Unknown
  misc_feature (1)..( 6): Result.001 file - promoters60/1022546
ttcaaa

SEQ ID NO: 98414 - DNA, 6 bp, Unknown
  misc_feature (1)..( 6): Result.001 file - promoters60/1022586
ttcaaa

SEQ ID NO: 98415 - DNA, 6 bp, Unknown
  misc_feature (1)..( 6): Result.001 file - promoters60/1022586
tttttg

SEQ ID NO: 98416 - DNA, 6 bp, Unknown
  misc_feature (1)..( 6): Result.001 file - promoters60/1022586
tttttg

SEQ ID NO: 98417 - DNA, 8 bp, Unknown
  misc_feature (1)..( 8): Result.001 file - promoters60/1022586
tttgtctt

SEQ ID NO: 98418 - DNA, 8 bp, Unknown
  misc_feature (1)..( 8): Result.001 file - promoters60/1022586
tttatctt

SEQ ID NO: 98419 - DNA, 6 bp, Unknown
  misc_feature (1)..( 6): Result.001 file - promoters60/1022586
ttttat

SEQ ID NO: 98420 - DNA, 6 bp, Unknown
  misc_feature (1)..( 6): Result.001 file - promoters60/1022586
ttttat

SEQ ID NO: 98421 - DNA, 6 bp, Unknown
  misc_feature (1)..( 6): Result.001 file - promoters60/1022586
atttta

SEQ ID NO: 98422 - DNA, 6 bp, Unknown
  misc_feature (1)..( 6): Result.001 file - promoters60/1022586
atttta

SEQ ID NO: 98423 - DNA, 6 bp, Unknown
  misc_feature (1)..( 6): Result.001 file - promoters60/1022586
aaattc

SEQ ID NO: 98424 - DNA, 6 bp, Unknown
  misc_feature (1)..( 6): Result.001 file - promoters60/1022586
aaattc

SEQ ID NO: 98425 - DNA, 6 bp, Unknown
  misc_feature (1)..( 6): Result.001 file - promoters60/1022586
agagag

SEQ ID NO: 98426 - DNA, 6 bp, Unknown
  misc_feature (1)..( 6): Result.001 file - promoters60/1022586
agagag

SEQ ID NO: 98427 - DNA, 7 bp, Unknown
  misc_feature (1)..( 7): Result.001 file - promoters60/1022586
acatttc

SEQ ID NO: 98428 - DNA, 7 bp, Unknown
  misc_feature (1)..( 7): Result.001 file - promoters60/1022586
acaattc

SEQ ID NO: 98429 - DNA, 9 bp, Unknown
  misc_feature (1)..( 9): Result.001 file - promoters60/1022586
ttgaataat

SEQ ID NO: 98430 - DNA, 9 bp, Unknown
  misc_feature (1)..( 9): Result.001 file - promoters60/1022586
ttgcataat

SEQ ID NO: 98431 - DNA, 8 bp, Unknown
  misc_feature (1)..( 8): Result.001 file - promoters60/1022586
aaaaatat

SEQ ID NO: 98432 - DNA, 8 bp, Unknown
  misc_feature (1)..( 8): Result.001 file - promoters60/1022586
aaaattat

SEQ ID NO: 98433 - DNA, 8 bp, Unknown
  misc_feature (1)..( 8): Result.001 file - promoters60/1022586
acgagtct

SEQ ID NO: 98434 - DNA, 8 bp, Unknown
  misc_feature (1)..( 8): Result.001 file - promoters60/1022586
acgactct

SEQ ID NO: 98435 - DNA, 6 bp, Unknown
  misc_feature (1)..( 6): Result.001 file - promoters60/1022586
tataaa

SEQ ID NO: 98436 - DNA, 6 bp, Unknown
  misc_feature (1)..( 6): Result.001 file - promoters60/1022586
tataaa

SEQ ID NO: 98437 - DNA, 7 bp, Unknown
  misc_feature (1)..( 7): Result.001 file - promoters60/1022586
tttctct

SEQ ID NO: 98438 - DNA, 7 bp, Unknown
  misc_feature (1)..( 7): Result.001 file - promoters60/1022586
tttgtct

SEQ ID NO: 98439 - DNA, 6 bp, Unknown
  misc_feature (1)..( 6): Result.001 file - promoters60/1022586
ttttct

SEQ ID NO: 98440 - DNA, 6 bp, Unknown
  misc_feature (1)..( 6): Result.001 file - promoters60/1022586
ttttct

SEQ ID NO: 98441 - DNA, 7 bp, Unknown
  misc_feature (1)..( 7): Result.001 file - promoters60/1022586
aaattcc

SEQ ID NO: 98442 - DNA, 7 bp, Unknown
  misc_feature (1)..( 7): Result.001 file - promoters60/1022586
aaaatcc

SEQ ID NO: 98443 - DNA, 6 bp, Unknown
  misc_feature (1)..( 6): Result.001 file - promoters60/1022586
atatct

SEQ ID NO: 98444 - DNA, 6 bp, Unknown
  misc_feature (1)..( 6): Result.001 file - promoters60/1022586
atatct

SEQ ID NO: 98445 - DNA, 7 bp, Unknown
  misc_feature (1)..( 7): Result.001 file - promoters60/1022586
ttacttt

SEQ ID NO: 98446 - DNA, 7 bp, Unknown
  misc_feature (1)..( 7): Result.001 file - promoters60/1022586
ttagttt

SEQ ID NO: 98447 - DNA, 7 bp, Unknown
  misc_feature (1)..( 7): Result.001 file - promoters60/1022586
aacgcaa

SEQ ID NO: 98448 - DNA, 7 bp, Unknown
  misc_feature (1)..( 7): Result.001 file - promoters60/1022586
aacccaa

SEQ ID NO: 98449 - DNA, 7 bp, Unknown
  misc_feature (1)..( 7): Result.001 file - promoters60/1022586
tttaaag

SEQ ID NO: 98450 - DNA, 7 bp, Unknown
  misc_feature (1)..( 7): Result.001 file - promoters60/1022586
ttttaag

SEQ ID NO: 98451 - DNA, 7 bp, Unknown
  misc_feature (1)..( 7): Result.001 file - promoters60/1022586
aatattt

SEQ ID NO: 98452 - DNA, 7 bp, Unknown
  misc_feature (1)..( 7): Result.001 file - promoters60/1022586
aatgttt

SEQ ID NO: 98453 - DNA, 6 bp, Unknown
  misc_feature (1)..( 6): Result.001 file - promoters60/1022586
aaaaag

SEQ ID NO: 98454 - DNA, 6 bp, Unknown
  misc_feature (1)..( 6): Result.001 file - promoters60/1022586
aaaaag

SEQ ID NO: 98455 - DNA, 6 bp, Unknown
  misc_feature (1)..( 6): Result.001 file - promoters60/1022586
tttgta

SEQ ID NO: 98456 - DNA, 6 bp, Unknown
  misc_feature (1)..( 6): Result.001 file - promoters60/1022598
tttgta

SEQ ID NO: 98457 - DNA, 8 bp, Unknown
  misc_feature (1)..( 8): Result.001 file - promoters60/1022598
caaaaatc

SEQ ID NO: 98458 - DNA, 8 bp, Unknown
  misc_feature (1)..( 8): Result.001 file - promoters60/1022598
taaatatc

SEQ ID NO: 98459 - DNA, 8 bp, Unknown
  misc_feature (1)..( 8): Result.001 file - promoters60/1022598
taagtatc

SEQ ID NO: 98460 - DNA, 11 bp, Unknown
  misc_feature (1)..( 11): Result.001 file - promoters60/1022598
tatcagtgtct

SEQ ID NO: 98461 - DNA, 11 bp, Unknown
  misc_feature (1)..( 11): Result.001 file - promoters60/1022598
gatcaatgtgg

SEQ ID NO: 98462 - DNA, 11 bp, Unknown
  misc_feature (1)..( 11): Result.001 file - promoters60/1022610
tataagtatct

SEQ ID NO: 98463 - DNA, 11 bp, Unknown
  misc_feature (1)..( 11): Result.001 file - promoters60/1022610
ttattattata

SEQ ID NO: 98464 - DNA, 11 bp, Unknown
  misc_feature (1)..( 11): Result.001 file - promoters60/1022610
taattattata

SEQ ID NO: 98465 - DNA, 11 bp, Unknown
  misc_feature (1)..( 11): Result.001 file - promoters60/1022610
atataattgca

SEQ ID NO: 98466 - DNA, 11 bp, Unknown
  misc_feature (1)..( 11): Result.001 file - promoters60/1022610
tgattatttta

SEQ ID NO: 98467 - DNA, 11 bp, Unknown
  misc_feature (1)..( 11): Result.001 file - promoters60/1022610
attttattttc

SEQ ID NO: 98468 - DNA, 13 bp, Unknown
  misc_feature (1)..( 13): Result.001 file - promoters60/1022610
caaaaatgtatat

SEQ ID NO: 98469 - DNA, 13 bp, Unknown
  misc_feature (1)..( 13): Result.001 file - promoters60/1022610
agaaagtgtcaaa

SEQ ID NO: 98470 - DNA, 13 bp, Unknown
  misc_feature (1)..( 13): Result.001 file - promoters60/1022610
aaaaaatttatat

SEQ ID NO: 98471 - DNA, 13 bp, Unknown
  misc_feature (1)..( 13): Result.001 file - promoters60/1022610
aatgaatttatta

SEQ ID NO: 98472 - DNA, 13 bp, Unknown
  misc_feature (1)..( 13): Result.001 file - promoters60/1022662
aaacaattattaa

SEQ ID NO: 98473 - DNA, 13 bp, Unknown
  misc_feature (1)..( 13): Result.001 file - promoters60/1022662
aacgttttaagat

SEQ ID NO: 98474 - DNA, 13 bp, Unknown
  misc_feature (1)..( 13): Result.001 file - promoters60/1022662
aactttttagggt

SEQ ID NO: 98475 - DNA, 13 bp, Unknown
  misc_feature (1)..( 13): Result.001 file - promoters60/1022662
ttcgttttttttt

SEQ ID NO: 98476 - DNA, 13 bp, Unknown
  misc_feature (1)..( 13): Result.001 file - promoters60/1022662
tgctttttaaccg

SEQ ID NO: 98477 - DNA, 13 bp, Unknown
  misc_feature (1)..( 13): Result.001 file - promoters60/1022662
ctctttttttttt

SEQ ID NO: 98478 - DNA, 13 bp, Unknown
  misc_feature (1)..( 13): Result.001 file - promoters60/1022662
ttggttttagttt

SEQ ID NO: 98479 - DNA, 15 bp, Unknown
  misc_feature (1)..( 15): Result.001 file - promoters60/1022662
gaaaccaaccaatca

SEQ ID NO: 98480 - DNA, 15 bp, Unknown
  misc_feature (1)..( 15): Result.001 file - promoters60/1022662
aaaatcaaccaatca

SEQ ID NO: 98481 - DNA, 15 bp, Unknown
  misc_feature (1)..( 15): Result.001 file - promoters60/1022662
ccaacaaactctagc

SEQ ID NO: 98482 - DNA, 15 bp, Unknown
  misc_feature (1)..( 15): Result.001 file - promoters60/1022662
agagccatccattgt

SEQ ID NO: 98483 - DNA, 15 bp, Unknown
  misc_feature (1)..( 15): Result.001 file - promoters60/1022662
aaaatcttcttctgc

SEQ ID NO: 98484 - DNA, 15 bp, Unknown
  misc_feature (1)..( 15): Result.001 file - promoters60/1022662
gaaatctatccacga

SEQ ID NO: 98485 - DNA, 15 bp, Unknown
  misc_feature (1)..( 15): Result.001 file - promoters60/1022687
ctaatctaatctgag

SEQ ID NO: 98486 - DNA, 7 bp, Unknown
  misc_feature (1)..( 7): Result.001 file - promoters60/1022687
ttagtaa

SEQ ID NO: 98487 - DNA, 7 bp, Unknown
  misc_feature (1)..( 7): Result.001 file - promoters60/1022687
ttaataa

SEQ ID NO: 98488 - DNA, 7 bp, Unknown
  misc_feature (1)..( 7): Result.001 file - promoters60/1022687
ttagtat

SEQ ID NO: 98489 - DNA, 11 bp, Unknown
  misc_feature (1)..( 11): Result.001 file - promoters60/1022687
aaaattattaa

SEQ ID NO: 98490 - DNA, 11 bp, Unknown
  misc_feature (1)..( 11): Result.001 file - promoters60/1022687
aaatttagtaa

SEQ ID NO: 98491 - DNA, 11 bp, Unknown
  misc_feature (1)..( 11): Result.001 file - promoters60/1022687
ataattataat

SEQ ID NO: 98492 - DNA, 11 bp, Unknown
  misc_feature (1)..( 11): Result.001 file - promoters60/1022687
aaaatactaga

SEQ ID NO: 98493 - DNA, 11 bp, Unknown
  misc_feature (1)..( 11): Result.001 file - promoters60/1022687
gaaatattaga

SEQ ID NO: 98494 - DNA, 11 bp, Unknown
  misc_feature (1)..( 11): Result.001 file - promoters60/1022687
gaaatattgat

SEQ ID NO: 98495 - DNA, 8 bp, Unknown
  misc_feature (1)..( 8): Result.001 file - promoters60/1022687
caagattc

SEQ ID NO: 98496 - DNA, 8 bp, Unknown
  misc_feature (1)..( 8): Result.001 file - promoters60/1022687
caatatta

SEQ ID NO: 98497 - DNA, 8 bp, Unknown
  misc_feature (1)..( 8): Result.001 file - promoters60/1022810
aaatctta

SEQ ID NO: 98498 - DNA, 6 bp, Unknown
  misc_feature (1)..( 6): Result.001 file - promoters60/1022810
ttttaa

SEQ ID NO: 98499 - DNA, 6 bp, Unknown
  misc_feature (1)..( 6): Result.001 file - promoters60/1022810
ttttaa

SEQ ID NO: 98500 - DNA, 6 bp, Unknown
  misc_feature (1)..( 6): Result.001 file - promoters60/1022810
taatat

SEQ ID NO: 98501 - DNA, 6 bp, Unknown
  misc_feature (1)..( 6): Result.001 file - promoters60/1022810
taatat

SEQ ID NO: 98502 - DNA, 8 bp, Unknown
  misc_feature (1)..( 8): Result.001 file - promoters60/1022810
aaagacaa

SEQ ID NO: 98503 - DNA, 8 bp, Unknown
  misc_feature (1)..( 8): Result.001 file - promoters60/1022810
aaacacaa

SEQ ID NO: 98504 - DNA, 7 bp, Unknown
  misc_feature (1)..( 7): Result.001 file - promoters60/1022810
ataacaa

SEQ ID NO: 98505 - DNA, 7 bp, Unknown
  misc_feature (1)..( 7): Result.001 file - promoters60/1022810
atatcaa

SEQ ID NO: 98506 - DNA, 7 bp, Unknown
  misc_feature (1)..( 7): Result.001 file - promoters60/1022810
tctgcga

SEQ ID NO: 98507 - DNA, 7 bp, Unknown
  misc_feature (1)..( 7): Result.001 file - promoters60/1022810
tcttcga

SEQ ID NO: 98508 - DNA, 7 bp, Unknown
  misc_feature (1)..( 7): Result.001 file - promoters60/1022810
aatcatt

SEQ ID NO: 98509 - DNA, 7 bp, Unknown
  misc_feature (1)..( 7): Result.001 file - promoters60/1022810
aatgatt

SEQ ID NO: 98510 - DNA, 7 bp, Unknown
  misc_feature (1)..( 7): Result.001 file - promoters60/1022810
ttacaat

SEQ ID NO: 98511 - DNA, 7 bp, Unknown
  misc_feature (1)..( 7): Result.001 file - promoters60/1022810
ttataat

SEQ ID NO: 98512 - DNA, 7 bp, Unknown
  misc_feature (1)..( 7): Result.001 file - promoters60/1022810
aatctgt

SEQ ID NO: 98513 - DNA, 7 bp, Unknown
  misc_feature (1)..( 7): Result.001 file - promoters60/1022824
aatctgt

SEQ ID NO: 98514 - DNA, 7 bp, Unknown
  misc_feature (1)..( 7): Result.001 file - promoters60/1022824
agaagca

SEQ ID NO: 98515 - DNA, 7 bp, Unknown
  misc_feature (1)..( 7): Result.001 file - promoters60/1022824
agaagca

SEQ ID NO: 98516 - DNA, 8 bp, Unknown
  misc_feature (1)..( 8): Result.001 file - promoters60/1022824
ttttattt

SEQ ID NO: 98517 - DNA, 8 bp, Unknown
  misc_feature (1)..( 8): Result.001 file - promoters60/1022824
tttgattt

SEQ ID NO: 98518 - DNA, 9 bp, Unknown
  misc_feature (1)..( 9): Result.001 file - promoters60/1022824
agttccata

SEQ ID NO: 98519 - DNA, 9 bp, Unknown
  misc_feature (1)..( 9): Result.001 file - promoters60/1022824
agtttcata

SEQ ID NO: 98520 - DNA, 7 bp, Unknown
  misc_feature (1)..( 7): Result.001 file - promoters60/1022824
tctttta

SEQ ID NO: 98521 - DNA, 7 bp, Unknown
  misc_feature (1)..( 7): Result.001 file - promoters60/1022824
tctttta

SEQ ID NO: 98522 - DNA, 9 bp, Unknown
  misc_feature (1)..( 9): Result.001 file - promoters60/1022824
tctctggtg

SEQ ID NO: 98523 - DNA, 9 bp, Unknown
  misc_feature (1)..( 9): Result.001 file - promoters60/1022824
tctctcgtg

SEQ ID NO: 98524 - DNA, 6 bp, Unknown
  misc_feature (1)..( 6): Result.001 file - promoters60/1022824
tagact

SEQ ID NO: 98525 - DNA, 6 bp, Unknown
  misc_feature (1)..( 6): Result.001 file - promoters60/1022824
tagact

SEQ ID NO: 98526 - DNA, 6 bp, Unknown
  misc_feature (1)..( 6): Result.001 file - promoters60/1022824
atgttg

SEQ ID NO: 98527 - DNA, 6 bp, Unknown
  misc_feature (1)..( 6): Result.001 file - promoters60/1022824
atgttg

SEQ ID NO: 98528 - DNA, 6 bp, Unknown
  misc_feature (1)..( 6): Result.001 file - promoters60/1022824
gtggtt

SEQ ID NO: 98529 - DNA, 6 bp, Unknown
  misc_feature (1)..( 6): Result.001 file - promoters60/1022824
gtggtt

SEQ ID NO: 98530 - DNA, 6 bp, Unknown
  misc_feature (1)..( 6): Result.001 file - promoters60/1022824
tacaga

SEQ ID NO: 98531 - DNA, 6 bp, Unknown
  misc_feature (1)..( 6): Result.001 file - promoters60/1022824
tacaga

SEQ ID NO: 98532 - DNA, 7 bp, Unknown
  misc_feature (1)..( 7): Result.001 file - promoters60/1022824
ataaact

SEQ ID NO: 98533 - DNA, 7 bp, Unknown
  misc_feature (1)..( 7): Result.001 file - promoters60/1022824
ataaact

SEQ ID NO: 98534 - DNA, 7 bp, Unknown
  misc_feature (1)..( 7): Result.001 file - promoters60/1022824
gagaaga

SEQ ID NO: 98535 - DNA, 7 bp, Unknown
  misc_feature (1)..( 7): Result.001 file - promoters60/1022824
gagaaga

SEQ ID NO: 98536 - DNA, 7 bp, Unknown
  misc_feature (1)..( 7): Result.001 file - promoters60/1022824
aaacagc

SEQ ID NO: 98537 - DNA, 7 bp, Unknown
  misc_feature (1)..( 7): Result.001 file - promoters60/1022824
aaatagc

SEQ ID NO: 98538 - DNA, 7 bp, Unknown
  misc_feature (1)..( 7): Result.001 file - promoters60/1022824
ttctttg

SEQ ID NO: 98539 - DNA, 7 bp, Unknown
  misc_feature (1)..( 7): Result.001 file - promoters60/1022824
ttctttg

SEQ ID NO: 98540 - DNA, 7 bp, Unknown
  misc_feature (1)..( 7): Result.001 file - promoters60/1022824
actcatt

SEQ ID NO: 98541 - DNA, 7 bp, Unknown
  misc_feature (1)..( 7): Result.001 file - promoters60/1022824
actaatt

SEQ ID NO: 98542 - DNA, 6 bp, Unknown
  misc_feature (1)..( 6): Result.001 file - promoters60/1022824
tcgttt

SEQ ID NO: 98543 - DNA, 6 bp, Unknown
  misc_feature (1)..( 6): Result.001 file - promoters60/1022932
tcgttt

SEQ ID NO: 98544 - DNA, 10 bp, Unknown
  misc_feature (1)..( 10): Result.001 file - promoters60/1022932
tttatgtagg

SEQ ID NO: 98545 - DNA, 10 bp, Unknown
  misc_feature (1)..( 10): Result.001 file - promoters60/1022932
catatttagc

SEQ ID NO: 98546 - DNA, 10 bp, Unknown
  misc_feature (1)..( 10): Result.001 file - promoters60/1022932
tatatatagt

SEQ ID NO: 98547 - DNA, 10 bp, Unknown
  misc_feature (1)..( 10): Result.001 file - promoters60/1022932
gttatgttat

SEQ ID NO: 98548 - DNA, 10 bp, Unknown
  misc_feature (1)..( 10): Result.001 file - promoters60/1022932
caaataaagt

SEQ ID NO: 98549 - DNA, 10 bp, Unknown
  misc_feature (1)..( 10): Result.001 file - promoters60/1022932
catttttatc

SEQ ID NO: 98550 - DNA, 10 bp, Unknown
  misc_feature (1)..( 10): Result.001 file - promoters60/1022932
gttgtgttct

SEQ ID NO: 98551 - DNA, 10 bp, Unknown
  misc_feature (1)..( 10): Result.001 file - promoters60/1022932
tatctaatgc

SEQ ID NO: 98552 - DNA, 10 bp, Unknown
  misc_feature (1)..( 10): Result.001 file - promoters60/1022932
tatttaatga

SEQ ID NO: 98553 - DNA, 10 bp, Unknown
  misc_feature (1)..( 10): Result.001 file - promoters60/1022932
gttctcatgg

SEQ ID NO: 98554 - DNA, 10 bp, Unknown
  misc_feature (1)..( 10): Result.001 file - promoters60/1022932
gattaaatgt

SEQ ID NO: 98555 - DNA, 10 bp, Unknown
  misc_feature (1)..( 10): Result.001 file - promoters60/1022932
gctttaatta

SEQ ID NO: 98556 - DNA, 10 bp, Unknown
  misc_feature (1)..( 10): Result.001 file - promoters60/1022983
attcgcattt

SEQ ID NO: 98557 - DNA, 11 bp, Unknown
  misc_feature (1)..( 11): Result.001 file - promoters60/1022983
aaattaaaatc

SEQ ID NO: 98558 - DNA, 11 bp, Unknown
  misc_feature (1)..( 11): Result.001 file - promoters60/1022983
ccgttaaaaat

SEQ ID NO: 98559 - DNA, 11 bp, Unknown
  misc_feature (1)..( 11): Result.001 file - promoters60/1022983
caatcaaaaaa

SEQ ID NO: 98560 - DNA, 11 bp, Unknown
  misc_feature (1)..( 11): Result.001 file - promoters60/1022983
catataaaaat

SEQ ID NO: 98561 - DNA, 11 bp, Unknown
  misc_feature (1)..( 11): Result.001 file - promoters60/1022983
cgtttaaataa

SEQ ID NO: 98562 - DNA, 11 bp, Unknown
  misc_feature (1)..( 11): Result.001 file - promoters60/1022983
ttatgaaattt

SEQ ID NO: 98563 - DNA, 10 bp, Unknown
  misc_feature (1)..( 10): Result.001 file - promoters60/1022983
aattaaaatc

SEQ ID NO: 98564 - DNA, 10 bp, Unknown
  misc_feature (1)..( 10): Result.001 file - promoters60/1022983
gttaaaaatc

SEQ ID NO: 98565 - DNA, 10 bp, Unknown
  misc_feature (1)..( 10): Result.001 file - promoters60/1022983
tataaaaatt

SEQ ID NO: 98566 - DNA, 10 bp, Unknown
  misc_feature (1)..( 10): Result.001 file - promoters60/1022983
aataagaata

SEQ ID NO: 98567 - DNA, 10 bp, Unknown
  misc_feature (1)..( 10): Result.001 file - promoters60/1022983
tcaaaaaatt

SEQ ID NO: 98568 - DNA, 10 bp, Unknown
  misc_feature (1)..( 10): Result.001 file - promoters60/1022983
tatgaaattt

SEQ ID NO: 98569 - DNA, 10 bp, Unknown
  misc_feature (1)..( 10): Result.001 file - promoters60/1022983
tataggaaat

SEQ ID NO: 98570 - DNA, 14 bp, Unknown
  misc_feature (1)..( 14): Result.001 file - promoters60/1022983
ccgatagaagccga

SEQ ID NO: 98571 - DNA, 14 bp, Unknown
  misc_feature (1)..( 14): Result.001 file - promoters60/1022983
tttatacaagaaaa

SEQ ID NO: 98572 - DNA, 14 bp, Unknown
  misc_feature (1)..( 14): Result.001 file - promoters60/1022983
taaataaaagaatt

SEQ ID NO: 98573 - DNA, 14 bp, Unknown
  misc_feature (1)..( 14): Result.001 file - promoters60/1022983
gagaaaaaaaaagt

SEQ ID NO: 98574 - DNA, 14 bp, Unknown
  misc_feature (1)..( 14): Result.001 file - promoters60/1022983
aagaaaaaaaaaaa

SEQ ID NO: 98575 - DNA, 14 bp, Unknown
  misc_feature (1)..( 14): Result.001 file - promoters60/1022983
attaaaaataaaca

SEQ ID NO: 98576 - DNA, 13 bp, Unknown
  misc_feature (1)..( 13): Result.001 file - promoters60/1022983
tatccaaaattaa

SEQ ID NO: 98577 - DNA, 13 bp, Unknown
  misc_feature (1)..( 13): Result.001 file - promoters60/1022983
atataaaaatttc

SEQ ID NO: 98578 - DNA, 13 bp, Unknown
  misc_feature (1)..( 13): Result.001 file - promoters60/1022983
tataggaaattaa

SEQ ID NO: 98579 - DNA, 13 bp, Unknown
  misc_feature (1)..( 13): Result.001 file - promoters60/1022983
tgaacaacattta

SEQ ID NO: 98580 - DNA, 13 bp, Unknown
  misc_feature (1)..( 13): Result.001 file - promoters60/1022983
atcaaaaaattaa

SEQ ID NO: 98581 - DNA, 13 bp, Unknown
  misc_feature (1)..( 13): Result.001 file - promoters60/1022983
cgttaaaaatctc

SEQ ID NO: 98582 - DNA, 13 bp, Unknown
  misc_feature (1)..( 13): Result.001 file - promoters60/1022983
cgtttaaataaga

SEQ ID NO: 98583 - DNA, 11 bp, Unknown
  misc_feature (1)..( 11): Result.001 file - promoters60/1022983
aatcaagaata

SEQ ID NO: 98584 - DNA, 11 bp, Unknown
  misc_feature (1)..( 11): Result.001 file - promoters60/1022983
aaataagaata

SEQ ID NO: 98585 - DNA, 11 bp, Unknown
  misc_feature (1)..( 11): Result.001 file - promoters60/1022983
cgttaaaaatc

SEQ ID NO: 98586 - DNA, 11 bp, Unknown
  misc_feature (1)..( 11): Result.001 file - promoters60/1022983
ctataaaaaaa

SEQ ID NO: 98587 - DNA, 11 bp, Unknown
  misc_feature (1)..( 11): Result.001 file - promoters60/1022983
atataaaaatt

SEQ ID NO: 98588 - DNA, 11 bp, Unknown
  misc_feature (1)..( 11): Result.001 file - promoters60/1022983
atataggaaat

SEQ ID NO: 98589 - DNA, 12 bp, Unknown
  misc_feature (1)..( 12): Result.001 file - promoters60/1022983
acaagaaaactc

SEQ ID NO: 98590 - DNA, 12 bp, Unknown
  misc_feature (1)..( 12): Result.001 file - promoters60/1022983
tcaaaaaaaaaa

SEQ ID NO: 98591 - DNA, 12 bp, Unknown
  misc_feature (1)..( 12): Result.001 file - promoters60/1022983
taaataaaagaa

SEQ ID NO: 98592 - DNA, 12 bp, Unknown
  misc_feature (1)..( 12): Result.001 file - promoters60/1022983
ataagaaaaaaa

SEQ ID NO: 98593 - DNA, 12 bp, Unknown
  misc_feature (1)..( 12): Result.001 file - promoters60/1022983
agaaaaaaaaag

SEQ ID NO: 98594 - DNA, 12 bp, Unknown
  misc_feature (1)..( 12): Result.001 file - promoters60/1022987
tcaaaatagaca

SEQ ID NO: 98595 - DNA, 13 bp, Unknown
  misc_feature (1)..( 13): Result.001 file - promoters60/1022987
tttgatgaagact

SEQ ID NO: 98596 - DNA, 13 bp, Unknown
  misc_feature (1)..( 13): Result.001 file - promoters60/1022987
tttaatgagctgt

SEQ ID NO: 98597 - DNA, 13 bp, Unknown
  misc_feature (1)..( 13): Result.001 file - promoters60/1022987
tttaatgagctgt

SEQ ID NO: 98598 - DNA, 13 bp, Unknown
  misc_feature (1)..( 13): Result.001 file - promoters60/1022987
attgataaagaga

SEQ ID NO: 98599 - DNA, 13 bp, Unknown
  misc_feature (1)..( 13): Result.001 file - promoters60/1022987
gaaaattagccaa

SEQ ID NO: 98600 - DNA, 13 bp, Unknown
  misc_feature (1)..( 13): Result.001 file - promoters60/1023029
gttgcaaaacaga

SEQ ID NO: 98601 - DNA, 8 bp, Unknown
  misc_feature (1)..( 8): Result.001 file - promoters60/1023029
ctttttta

SEQ ID NO: 98602 - DNA, 8 bp, Unknown
  misc_feature (1)..( 8): Result.001 file - promoters60/1023029
ctttgtta

SEQ ID NO: 98603 - DNA, 9 bp, Unknown
  misc_feature (1)..( 9): Result.001 file - promoters60/1023029
tatagcaat

SEQ ID NO: 98604 - DNA, 9 bp, Unknown
  misc_feature (1)..( 9): Result.001 file - promoters60/1023029
tataccaat

SEQ ID NO: 98605 - DNA, 6 bp, Unknown
  misc_feature (1)..( 6): Result.001 file - promoters60/1023029
ttatga

SEQ ID NO: 98606 - DNA, 6 bp, Unknown
  misc_feature (1)..( 6): Result.001 file - promoters60/1023029
ttatga

SEQ ID NO: 98607 - DNA, 7 bp, Unknown
  misc_feature (1)..( 7): Result.001 file - promoters60/1023029
aataatt

SEQ ID NO: 98608 - DNA, 7 bp, Unknown
  misc_feature (1)..( 7): Result.001 file - promoters60/1023029
aataatt

SEQ ID NO: 98609 - DNA, 8 bp, Unknown
  misc_feature (1)..( 8): Result.001 file - promoters60/1023029
aattttaa

SEQ ID NO: 98610 - DNA, 8 bp, Unknown
  misc_feature (1)..( 8): Result.001 file - promoters60/1023029
aatcttaa

SEQ ID NO: 98611 - DNA, 6 bp, Unknown
  misc_feature (1)..( 6): Result.001 file - promoters60/1023029
cgtata

SEQ ID NO: 98612 - DNA, 6 bp, Unknown
  misc_feature (1)..( 6): Result.001 file - promoters60/1023029
cgtata

SEQ ID NO: 98613 - DNA, 7 bp, Unknown
  misc_feature (1)..( 7): Result.001 file - promoters60/1023029
ataggtt

SEQ ID NO: 98614 - DNA, 7 bp, Unknown
  misc_feature (1)..( 7): Result.001 file - promoters60/1023029
atatgtt

SEQ ID NO: 98615 - DNA, 6 bp, Unknown
  misc_feature (1)..( 6): Result.001 file - promoters60/1023029
atttta

SEQ ID NO: 98616 - DNA, 6 bp, Unknown
  misc_feature (1)..( 6): Result.001 file - promoters60/1023029
atttta

SEQ ID NO: 98617 - DNA, 6 bp, Unknown
  misc_feature (1)..( 6): Result.001 file - promoters60/1023029
ccaata

SEQ ID NO: 98618 - DNA, 6 bp, Unknown
  misc_feature (1)..( 6): Result.001 file - promoters60/1023029
ccaata

SEQ ID NO: 98619 - DNA, 11 bp, Unknown
  misc_feature (1)..( 11): Result.001 file - promoters60/1023029
agaagatgagt

SEQ ID NO: 98620 - DNA, 11 bp, Unknown
  misc_feature (1)..( 11): Result.001 file - promoters60/1023029
agacgattagt

SEQ ID NO: 98621 - DNA, 8 bp, Unknown
  misc_feature (1)..( 8): Result.001 file - promoters60/1023029
tatatgaa

SEQ ID NO: 98622 - DNA, 8 bp, Unknown
  misc_feature (1)..( 8): Result.001 file - promoters60/1023029
tatatgaa

SEQ ID NO: 98623 - DNA, 8 bp, Unknown
  misc_feature (1)..( 8): Result.001 file - promoters60/1023029
attacttc

SEQ ID NO: 98624 - DNA, 8 bp, Unknown
  misc_feature (1)..( 8): Result.001 file - promoters60/1023029
attatttc

SEQ ID NO: 98625 - DNA, 9 bp, Unknown
  misc_feature (1)..( 9): Result.001 file - promoters60/1023029
caatataaa

SEQ ID NO: 98626 - DNA, 9 bp, Unknown
  misc_feature (1)..( 9): Result.001 file - promoters60/1023029
caatataaa

SEQ ID NO: 98627 - DNA, 6 bp, Unknown
  misc_feature (1)..( 6): Result.001 file - promoters60/1023029
ctcttt

SEQ ID NO: 98628 - DNA, 6 bp, Unknown
  misc_feature (1)..( 6): Result.001 file - promoters60/1023029
ctcttt

SEQ ID NO: 98629 - DNA, 7 bp, Unknown
  misc_feature (1)..( 7): Result.001 file - promoters60/1023029
actccta

SEQ ID NO: 98630 - DNA, 7 bp, Unknown
  misc_feature (1)..( 7): Result.001 file - promoters60/1023029
acttcta

SEQ ID NO: 98631 - DNA, 6 bp, Unknown
  misc_feature (1)..( 6): Result.001 file - promoters60/1023029
caactt

SEQ ID NO: 98632 - DNA, 6 bp, Unknown
  misc_feature (1)..( 6): Result.001 file - promoters60/1023029
caactt

SEQ ID NO: 98633 - DNA, 7 bp, Unknown
  misc_feature (1)..( 7): Result.001 file - promoters60/1023029
gatgctt

SEQ ID NO: 98634 - DNA, 7 bp, Unknown
  misc_feature (1)..( 7): Result.001 file - promoters60/1023029
gattctt

SEQ ID NO: 98635 - DNA, 8 bp, Unknown
  misc_feature (1)..( 8): Result.001 file - promoters60/1023029
tttatatt

SEQ ID NO: 98636 - DNA, 8 bp, Unknown
  misc_feature (1)..( 8): Result.001 file - promoters60/1023029
tttaaatt

SEQ ID NO: 98637 - DNA, 7 bp, Unknown
  misc_feature (1)..( 7): Result.001 file - promoters60/1023029
tggttca

SEQ ID NO: 98638 - DNA, 7 bp, Unknown
  misc_feature (1)..( 7): Result.001 file - promoters60/1023029
tggatca

SEQ ID NO: 98639 - DNA, 8 bp, Unknown
  misc_feature (1)..( 8): Result.001 file - promoters60/1023029
aattctta

SEQ ID NO: 98640 - DNA, 8 bp, Unknown
  misc_feature (1)..( 8): Result.001 file - promoters60/1023037
aattatta

SEQ ID NO: 98641 - DNA, 9 bp, Unknown
  misc_feature (1)..( 9): Result.001 file - promoters60/1023037
tgattcact

SEQ ID NO: 98642 - DNA, 9 bp, Unknown
  misc_feature (1)..( 9): Result.001 file - promoters60/1023037
aaattcact

SEQ ID NO: 98643 - DNA, 9 bp, Unknown
  misc_feature (1)..( 9): Result.001 file - promoters60/1023037
aaatgcacc

SEQ ID NO: 98644 - DNA, 6 bp, Unknown
  misc_feature (1)..( 6): Result.001 file - promoters60/1023037
taaaga

SEQ ID NO: 98645 - DNA, 6 bp, Unknown
  misc_feature (1)..( 6): Result.001 file - promoters60/1023037
taaaga

SEQ ID NO: 98646 - DNA, 11 bp, Unknown
  misc_feature (1)..( 11): Result.001 file - promoters60/1023037
acagtttataa

SEQ ID NO: 98647 - DNA, 11 bp, Unknown
  misc_feature (1)..( 11): Result.001 file - promoters60/1023037
acaatttataa

SEQ ID NO: 98648 - DNA, 11 bp, Unknown
  misc_feature (1)..( 11): Result.001 file - promoters60/1023037
agagtatatta

SEQ ID NO: 98649 - DNA, 7 bp, Unknown
  misc_feature (1)..( 7): Result.001 file - promoters60/1023037
gtaacta

SEQ ID NO: 98650 - DNA, 7 bp, Unknown
  misc_feature (1)..( 7): Result.001 file - promoters60/1023037
gtaacta

SEQ ID NO: 98651 - DNA, 7 bp, Unknown
  misc_feature (1)..( 7): Result.001 file - promoters60/1023037
aattttt

SEQ ID NO: 98652 - DNA, 7 bp, Unknown
  misc_feature (1)..( 7): Result.001 file - promoters60/1023037
aattttt

SEQ ID NO: 98653 - DNA, 9 bp, Unknown
  misc_feature (1)..( 9): Result.001 file - promoters60/1023037
gggcatatt

SEQ ID NO: 98654 - DNA, 9 bp, Unknown
  misc_feature (1)..( 9): Result.001 file - promoters60/1023037
gggtatata

SEQ ID NO: 98655 - DNA, 9 bp, Unknown
  misc_feature (1)..( 9): Result.001 file - promoters60/1023037
tggtagata

SEQ ID NO: 98656 - DNA, 6 bp, Unknown
  misc_feature (1)..( 6): Result.001 file - promoters60/1023037
agtaat

SEQ ID NO: 98657 - DNA, 6 bp, Unknown
  misc_feature (1)..( 6): Result.001 file - promoters60/1023037
agtaat

SEQ ID NO: 98658 - DNA, 6 bp, Unknown
  misc_feature (1)..( 6): Result.001 file - promoters60/1023037
tttata

SEQ ID NO: 98659 - DNA, 6 bp, Unknown
  misc_feature (1)..( 6): Result.001 file - promoters60/1023037
tttata

SEQ ID NO: 98660 - DNA, 6 bp, Unknown
  misc_feature (1)..( 6): Result.001 file - promoters60/1023037
ttaaaa

SEQ ID NO: 98661 - DNA, 6 bp, Unknown
  misc_feature (1)..( 6): Result.001 file - promoters60/1023037
ttaaaa

SEQ ID NO: 98662 - DNA, 8 bp, Unknown
  misc_feature (1)..( 8): Result.001 file - promoters60/1023037
ctatttat

SEQ ID NO: 98663 - DNA, 8 bp, Unknown
  misc_feature (1)..( 8): Result.001 file - promoters60/1023037
ctaattat

SEQ ID NO: 98664 - DNA, 6 bp, Unknown
  misc_feature (1)..( 6): Result.001 file - promoters60/1023037
tttact

SEQ ID NO: 98665 - DNA, 6 bp, Unknown
  misc_feature (1)..( 6): Result.001 file - promoters60/1023037
tttact

SEQ ID NO: 98666 - DNA, 9 bp, Unknown
  misc_feature (1)..( 9): Result.001 file - promoters60/1023037
gaaactatc

SEQ ID NO: 98667 - DNA, 9 bp, Unknown
  misc_feature (1)..( 9): Result.001 file - promoters60/1023037
gaaaatatc

SEQ ID NO: 98668 - DNA, 6 bp, Unknown
  misc_feature (1)..( 6): Result.001 file - promoters60/1023037
acacaa

SEQ ID NO: 98669 - DNA, 6 bp, Unknown
  misc_feature (1)..( 6): Result.001 file - promoters60/1023037
acacaa

SEQ ID NO: 98670 - DNA, 6 bp, Unknown
  misc_feature (1)..( 6): Result.001 file - promoters60/1023037
gagaga

SEQ ID NO: 98671 - DNA, 6 bp, Unknown
  misc_feature (1)..( 6): Result.001 file - promoters60/1023062
gagaga

SEQ ID NO: 98672 - DNA, 8 bp, Unknown
  misc_feature (1)..( 8): Result.001 file - promoters60/1023062
taaaaaat

SEQ ID NO: 98673 - DNA, 8 bp, Unknown
  misc_feature (1)..( 8): Result.001 file - promoters60/1023062
taaaaaaa

SEQ ID NO: 98674 - DNA, 8 bp, Unknown
  misc_feature (1)..( 8): Result.001 file - promoters60/1023062
taaagaat

SEQ ID NO: 98675 - DNA, 8 bp, Unknown
  misc_feature (1)..( 8): Result.001 file - promoters60/1023062
tgaaaaat

SEQ ID NO: 98676 - DNA, 9 bp, Unknown
  misc_feature (1)..( 9): Result.001 file - promoters60/1023062
aattccaaa

SEQ ID NO: 98677 - DNA, 9 bp, Unknown
  misc_feature (1)..( 9): Result.001 file - promoters60/1023062
aatttcaag

SEQ ID NO: 98678 - DNA, 9 bp, Unknown
  misc_feature (1)..( 9): Result.001 file - promoters60/1023062
aattcaaaa

SEQ ID NO: 98679 - DNA, 9 bp, Unknown
  misc_feature (1)..( 9): Result.001 file - promoters60/1023062
tacatgaca

SEQ ID NO: 98680 - DNA, 9 bp, Unknown
  misc_feature (1)..( 9): Result.001 file - promoters60/1023062
tttatgaca

SEQ ID NO: 98681 - DNA, 9 bp, Unknown
  misc_feature (1)..( 9): Result.001 file - promoters60/1023062
tttgtgaca

SEQ ID NO: 98682 - DNA, 10 bp, Unknown
  misc_feature (1)..( 10): Result.001 file - promoters60/1023062
tttgcatttt

SEQ ID NO: 98683 - DNA, 10 bp, Unknown
  misc_feature (1)..( 10): Result.001 file - promoters60/1023062
cttgaattca

SEQ ID NO: 98684 - DNA, 10 bp, Unknown
  misc_feature (1)..( 10): Result.001 file - promoters60/1023062
tttgaatttt

SEQ ID NO: 98685 - DNA, 8 bp, Unknown
  misc_feature (1)..( 8): Result.001 file - promoters60/1023062
aattttgg

SEQ ID NO: 98686 - DNA, 8 bp, Unknown
  misc_feature (1)..( 8): Result.001 file - promoters60/1023062
aattttat

SEQ ID NO: 98687 - DNA, 8 bp, Unknown
  misc_feature (1)..( 8): Result.001 file - promoters60/1023062
tattttat

SEQ ID NO: 98688 - DNA, 13 bp, Unknown
  misc_feature (1)..( 13): Result.001 file - promoters60/1023062
taatggatctaca

SEQ ID NO: 98689 - DNA, 13 bp, Unknown
  misc_feature (1)..( 13): Result.001 file - promoters60/1023062
taatggctctttt

SEQ ID NO: 98690 - DNA, 13 bp, Unknown
  misc_feature (1)..( 13): Result.001 file - promoters60/1023062
atcttgatgtaca

SEQ ID NO: 98691 - DNA, 10 bp, Unknown
  misc_feature (1)..( 10): Result.001 file - promoters60/1023062
taaaaaatag

SEQ ID NO: 98692 - DNA, 10 bp, Unknown
  misc_feature (1)..( 10): Result.001 file - promoters60/1023062
acaaaattag

SEQ ID NO: 98693 - DNA, 10 bp, Unknown
  misc_feature (1)..( 10): Result.001 file - promoters60/1023079
acagaatttt

SEQ ID NO: 98694 - DNA, 7 bp, Unknown
  misc_feature (1)..( 7): Result.001 file - promoters60/1023079
agttatt

SEQ ID NO: 98695 - DNA, 7 bp, Unknown
  misc_feature (1)..( 7): Result.001 file - promoters60/1023079
agtcatt

SEQ ID NO: 98696 - DNA, 6 bp, Unknown
  misc_feature (1)..( 6): Result.001 file - promoters60/1023079
tttcct

SEQ ID NO: 98697 - DNA, 6 bp, Unknown
  misc_feature (1)..( 6): Result.001 file - promoters60/1023079
tttcct

SEQ ID NO: 98698 - DNA, 6 bp, Unknown
  misc_feature (1)..( 6): Result.001 file - promoters60/1023079
agaaaa

SEQ ID NO: 98699 - DNA, 6 bp, Unknown
  misc_feature (1)..( 6): Result.001 file - promoters60/1023079
agaaaa

SEQ ID NO: 98700 - DNA, 7 bp, Unknown
  misc_feature (1)..( 7): Result.001 file - promoters60/1023079
aaagttt

SEQ ID NO: 98701 - DNA, 7 bp, Unknown
  misc_feature (1)..( 7): Result.001 file - promoters60/1023079
aaagttt

SEQ ID NO: 98702 - DNA, 8 bp, Unknown
  misc_feature (1)..( 8): Result.001 file - promoters60/1023079
ccaatctc

SEQ ID NO: 98703 - DNA, 8 bp, Unknown
  misc_feature (1)..( 8): Result.001 file - promoters60/1023079
ccaaactc

SEQ ID NO: 98704 - DNA, 6 bp, Unknown
  misc_feature (1)..( 6): Result.001 file - promoters60/1023079
atttta

SEQ ID NO: 98705 - DNA, 6 bp, Unknown
  misc_feature (1)..( 6): Result.001 file - promoters60/1023079
atttta

SEQ ID NO: 98706 - DNA, 7 bp, Unknown
  misc_feature (1)..( 7): Result.001 file - promoters60/1023079
caacttt

SEQ ID NO: 98707 - DNA, 7 bp, Unknown
  misc_feature (1)..( 7): Result.001 file - promoters60/1023079
caaattt

SEQ ID NO: 98708 - DNA, 8 bp, Unknown
  misc_feature (1)..( 8): Result.001 file - promoters60/1023079
tttgtttg

SEQ ID NO: 98709 - DNA, 8 bp, Unknown
  misc_feature (1)..( 8): Result.001 file - promoters60/1023079
tttcttta

SEQ ID NO: 98710 - DNA, 8 bp, Unknown
  misc_feature (1)..( 8): Result.001 file - promoters60/1023079
aatcttta

SEQ ID NO: 98711 - DNA, 8 bp, Unknown
  misc_feature (1)..( 8): Result.001 file - promoters60/1023079
taatgcat

SEQ ID NO: 98712 - DNA, 8 bp, Unknown
  misc_feature (1)..( 8): Result.001 file - promoters60/1023079
taatacat

SEQ ID NO: 98713 - DNA, 6 bp, Unknown
  misc_feature (1)..( 6): Result.001 file - promoters60/1023079
tttaat

SEQ ID NO: 98714 - DNA, 6 bp, Unknown
  misc_feature (1)..( 6): Result.001 file - promoters60/1023079
tttaat

SEQ ID NO: 98715 - DNA, 7 bp, Unknown
  misc_feature (1)..( 7): Result.001 file - promoters60/1023079
taaatta

SEQ ID NO: 98716 - DNA, 7 bp, Unknown
  misc_feature (1)..( 7): Result.001 file - promoters60/1023079
taattta

SEQ ID NO: 98717 - DNA, 6 bp, Unknown
  misc_feature (1)..( 6): Result.001 file - promoters60/1023079
aattag

SEQ ID NO: 98718 - DNA, 6 bp, Unknown
  misc_feature (1)..( 6): Result.001 file - promoters60/1023079
aattag

SEQ ID NO: 98719 - DNA, 9 bp, Unknown
  misc_feature (1)..( 9): Result.001 file - promoters60/1023079
ttaaataat

SEQ ID NO: 98720 - DNA, 9 bp, Unknown
  misc_feature (1)..( 9): Result.001 file - promoters60/1023079
ttatataat

SEQ ID NO: 98721 - DNA, 7 bp, Unknown
  misc_feature (1)..( 7): Result.001 file - promoters60/1023079
taaaatt

SEQ ID NO: 98722 - DNA, 7 bp, Unknown
  misc_feature (1)..( 7): Result.001 file - promoters60/1023079
taacatt

SEQ ID NO: 98723 - DNA, 7 bp, Unknown
  misc_feature (1)..( 7): Result.001 file - promoters60/1023079
ttagaat

SEQ ID NO: 98724 - DNA, 7 bp, Unknown
  misc_feature (1)..( 7): Result.001 file - promoters60/1023079
ttataat

SEQ ID NO: 98725 - DNA, 7 bp, Unknown
  misc_feature (1)..( 7): Result.001 file - promoters60/1023079
aaatata

SEQ ID NO: 98726 - DNA, 7 bp, Unknown
  misc_feature (1)..( 7): Result.001 file - promoters60/1023079
aaacata

SEQ ID NO: 98727 - DNA, 8 bp, Unknown
  misc_feature (1)..( 8): Result.001 file - promoters60/1023079
tttcttaa

SEQ ID NO: 98728 - DNA, 8 bp, Unknown
  misc_feature (1)..( 8): Result.001 file - promoters60/1023079
tttattaa

SEQ ID NO: 98729 - DNA, 6 bp, Unknown
  misc_feature (1)..( 6): Result.001 file - promoters60/1023079
ttaatt

SEQ ID NO: 98730 - DNA, 6 bp, Unknown
  misc_feature (1)..( 6): Result.001 file - promoters60/1023079
ttaatt

SEQ ID NO: 98731 - DNA, 7 bp, Unknown
  misc_feature (1)..( 7): Result.001 file - promoters60/1023079
aattctt

SEQ ID NO: 98732 - DNA, 7 bp, Unknown
  misc_feature (1)..( 7): Result.001 file - promoters60/1023089
aattctt

SEQ ID NO: 98733 - DNA, 6 bp, Unknown
  misc_feature (1)..( 6): Result.001 file - promoters60/1023089
ttctag

SEQ ID NO: 98734 - DNA, 6 bp, Unknown
  misc_feature (1)..( 6): Result.001 file - promoters60/1023089
ttctag

SEQ ID NO: 98735 - DNA, 6 bp, Unknown
  misc_feature (1)..( 6): Result.001 file - promoters60/1023089
ttcaaa

SEQ ID NO: 98736 - DNA, 6 bp, Unknown
  misc_feature (1)..( 6): Result.001 file - promoters60/1023089
ttcaaa

SEQ ID NO: 98737 - DNA, 7 bp, Unknown
  misc_feature (1)..( 7): Result.001 file - promoters60/1023089
aaaaaac

SEQ ID NO: 98738 - DNA, 7 bp, Unknown
  misc_feature (1)..( 7): Result.001 file - promoters60/1023089
aaaaaac

SEQ ID NO: 98739 - DNA, 8 bp, Unknown
  misc_feature (1)..( 8): Result.001 file - promoters60/1023089
tttctttt

SEQ ID NO: 98740 - DNA, 8 bp, Unknown
  misc_feature (1)..( 8): Result.001 file - promoters60/1023089
tttgtttt

SEQ ID NO: 98741 - DNA, 7 bp, Unknown
  misc_feature (1)..( 7): Result.001 file - promoters60/1023089
tttcttt

SEQ ID NO: 98742 - DNA, 7 bp, Unknown
  misc_feature (1)..( 7): Result.001 file - promoters60/1023089
tttgttt

SEQ ID NO: 98743 - DNA, 11 bp, Unknown
  misc_feature (1)..( 11): Result.001 file - promoters60/1023089
cacaaattctt

SEQ ID NO: 98744 - DNA, 11 bp, Unknown
  misc_feature (1)..( 11): Result.001 file - promoters60/1023089
gattaatactt

SEQ ID NO: 98745 - DNA, 11 bp, Unknown
  misc_feature (1)..( 11): Result.001 file - promoters60/1023089
gattaatacat

SEQ ID NO: 98746 - DNA, 6 bp, Unknown
  misc_feature (1)..( 6): Result.001 file - promoters60/1023089
tatttt

SEQ ID NO: 98747 - DNA, 6 bp, Unknown
  misc_feature (1)..( 6): Result.001 file - promoters60/1023089
tatttt

SEQ ID NO: 98748 - DNA, 6 bp, Unknown
  misc_feature (1)..( 6): Result.001 file - promoters60/1023089
tttgat

SEQ ID NO: 98749 - DNA, 6 bp, Unknown
  misc_feature (1)..( 6): Result.001 file - promoters60/1023089
tttgat

SEQ ID NO: 98750 - DNA, 6 bp, Unknown
  misc_feature (1)..( 6): Result.001 file - promoters60/1023089
aaattg

SEQ ID NO: 98751 - DNA, 6 bp, Unknown
  misc_feature (1)..( 6): Result.001 file - promoters60/1023089
aaattg

SEQ ID NO: 98752 - DNA, 6 bp, Unknown
  misc_feature (1)..( 6): Result.001 file - promoters60/1023089
taatta

SEQ ID NO: 98753 - DNA, 6 bp, Unknown
  misc_feature (1)..( 6): Result.001 file - promoters60/1023089
taatta

SEQ ID NO: 98754 - DNA, 9 bp, Unknown
  misc_feature (1)..( 9): Result.001 file - promoters60/1023089
tactaaaat

SEQ ID NO: 98755 - DNA, 9 bp, Unknown
  misc_feature (1)..( 9): Result.001 file - promoters60/1023124
tacaaaaat

SEQ ID NO: 98756 - DNA, 11 bp, Unknown
  misc_feature (1)..( 11): Result.001 file - promoters60/1023124
aaattttgatt

SEQ ID NO: 98757 - DNA, 11 bp, Unknown
  misc_feature (1)..( 11): Result.001 file - promoters60/1023124
aaattatgatt

SEQ ID NO: 98758 - DNA, 7 bp, Unknown
  misc_feature (1)..( 7): Result.001 file - promoters60/1023124
tttttaa

SEQ ID NO: 98759 - DNA, 7 bp, Unknown
  misc_feature (1)..( 7): Result.001 file - promoters60/1023124
tttttaa

SEQ ID NO: 98760 - DNA, 7 bp, Unknown
  misc_feature (1)..( 7): Result.001 file - promoters60/1023124
ttcctac

SEQ ID NO: 98761 - DNA, 7 bp, Unknown
  misc_feature (1)..( 7): Result.001 file - promoters60/1023124
ttcatac

SEQ ID NO: 98762 - DNA, 6 bp, Unknown
  misc_feature (1)..( 6): Result.001 file - promoters60/1023124
catgtt

SEQ ID NO: 98763 - DNA, 6 bp, Unknown
  misc_feature (1)..( 6): Result.001 file - promoters60/1023124
catgtt

SEQ ID NO: 98764 - DNA, 8 bp, Unknown
  misc_feature (1)..( 8): Result.001 file - promoters60/1023124
taaacaat

SEQ ID NO: 98765 - DNA, 8 bp, Unknown
  misc_feature (1)..( 8): Result.001 file - promoters60/1023124
taaccaat

SEQ ID NO: 98766 - DNA, 8 bp, Unknown
  misc_feature (1)..( 8): Result.001 file - promoters60/1023124
aaattatt

SEQ ID NO: 98767 - DNA, 8 bp, Unknown
  misc_feature (1)..( 8): Result.001 file - promoters60/1023124
aaataatt

SEQ ID NO: 98768 - DNA, 6 bp, Unknown
  misc_feature (1)..( 6): Result.001 file - promoters60/1023124
gtttaa

SEQ ID NO: 98769 - DNA, 6 bp, Unknown
  misc_feature (1)..( 6): Result.001 file - promoters60/1023124
gtttaa

SEQ ID NO: 98770 - DNA, 6 bp, Unknown
  misc_feature (1)..( 6): Result.001 file - promoters60/1023124
tataaa

SEQ ID NO: 98771 - DNA, 6 bp, Unknown
  misc_feature (1)..( 6): Result.001 file - promoters60/1023124
tataaa

SEQ ID NO: 98772 - DNA, 6 bp, Unknown
  misc_feature (1)..( 6): Result.001 file - promoters60/1023124
aatata

SEQ ID NO: 98773 - DNA, 6 bp, Unknown
  misc_feature (1)..( 6): Result.001 file - promoters60/1023124
aatata

SEQ ID NO: 98774 - DNA, 8 bp, Unknown
  misc_feature (1)..( 8): Result.001 file - promoters60/1023124
atgaatcc

SEQ ID NO: 98775 - DNA, 8 bp, Unknown
  misc_feature (1)..( 8): Result.001 file - promoters60/1023124
atgaatat

SEQ ID NO: 98776 - DNA, 8 bp, Unknown
  misc_feature (1)..( 8): Result.001 file - promoters60/1023124
ttgaatat

SEQ ID NO: 98777 - DNA, 6 bp, Unknown
  misc_feature (1)..( 6): Result.001 file - promoters60/1023124
ctcgtg

SEQ ID NO: 98778 - DNA, 6 bp, Unknown
  misc_feature (1)..( 6): Result.001 file - promoters60/1023124
ctcgtg

SEQ ID NO: 98779 - DNA, 7 bp, Unknown
  misc_feature (1)..( 7): Result.001 file - promoters60/1023124
ttaatat

SEQ ID NO: 98780 - DNA, 7 bp, Unknown
  misc_feature (1)..( 7): Result.001 file - promoters60/1023124
ttattat

SEQ ID NO: 98781 - DNA, 8 bp, Unknown
  misc_feature (1)..( 8): Result.001 file - promoters60/1023124
tataattt

SEQ ID NO: 98782 - DNA, 8 bp, Unknown
  misc_feature (1)..( 8): Result.001 file - promoters60/1023124
tattattt

SEQ ID NO: 98783 - DNA, 8 bp, Unknown
  misc_feature (1)..( 8): Result.001 file - promoters60/1023124
gtaaatgt

SEQ ID NO: 98784 - DNA, 8 bp, Unknown
  misc_feature (1)..( 8): Result.001 file - promoters60/1023124
gtaaatgt

SEQ ID NO: 98785 - DNA, 6 bp, Unknown
  misc_feature (1)..( 6): Result.001 file - promoters60/1023124
ctctaa

SEQ ID NO: 98786 - DNA, 6 bp, Unknown
  misc_feature (1)..( 6): Result.001 file - promoters60/1023124
ctctaa

SEQ ID NO: 98787 - DNA, 6 bp, Unknown
  misc_feature (1)..( 6): Result.001 file - promoters60/1023124
ttaaaa

SEQ ID NO: 98788 - DNA, 6 bp, Unknown
  misc_feature (1)..( 6): Result.001 file - promoters60/1023124
ttaaaa

SEQ ID NO: 98789 - DNA, 9 bp, Unknown
  misc_feature (1)..( 9): Result.001 file - promoters60/1023124
atttttttt

SEQ ID NO: 98790 - DNA, 9 bp, Unknown
  misc_feature (1)..( 9): Result.001 file - promoters60/1023124
atttttttt

SEQ ID NO: 98791 - DNA, 6 bp, Unknown
  misc_feature (1)..( 6): Result.001 file - promoters60/1023124
tgttgt

SEQ ID NO: 98792 - DNA, 6 bp, Unknown
  misc_feature (1)..( 6): Result.001 file - promoters60/1023124
tgttgt

SEQ ID NO: 98793 - DNA, 15 bp, Unknown
  misc_feature (1)..( 15): Result.001 file - promoters60/1023124
tgtcaaaaaaaaaaa

SEQ ID NO: 98794 - DNA, 15 bp, Unknown
  misc_feature (1)..( 15): Result.001 file - promoters60/1023124
ttttaaaaaaaaaaa

SEQ ID NO: 98795 - DNA, 15 bp, Unknown
  misc_feature (1)..( 15): Result.001 file - promoters60/1023124
ttttaaaacaatgaa

SEQ ID NO: 98796 - DNA, 8 bp, Unknown
  misc_feature (1)..( 8): Result.001 file - promoters60/1023124
taaataat

SEQ ID NO: 98797 - DNA, 8 bp, Unknown
  misc_feature (1)..( 8): Result.001 file - promoters60/1023124
taactaat

SEQ ID NO: 98798 - DNA, 7 bp, Unknown
  misc_feature (1)..( 7): Result.001 file - promoters60/1023124
atatata

SEQ ID NO: 98799 - DNA, 7 bp, Unknown
  misc_feature (1)..( 7): Result.001 file - promoters60/1023124
atatata

SEQ ID NO: 98800 - DNA, 6 bp, Unknown
  misc_feature (1)..( 6): Result.001 file - promoters60/1023124
tatata

SEQ ID NO: 98801 - DNA, 6 bp, Unknown
  misc_feature (1)..( 6): Result.001 file - promoters60/1023124
tatata

SEQ ID NO: 98802 - DNA, 6 bp, Unknown
  misc_feature (1)..( 6): Result.001 file - promoters60/1023124
gagaac

SEQ ID NO: 98803 - DNA, 6 bp, Unknown
  misc_feature (1)..( 6): Result.001 file - promoters60/1023124
gagaac

SEQ ID NO: 98804 - DNA, 7 bp, Unknown
  misc_feature (1)..( 7): Result.001 file - promoters60/1023124
atgttgc

SEQ ID NO: 98805 - DNA, 7 bp, Unknown
  misc_feature (1)..( 7): Result.001 file - promoters60/1023124
atgctgc

SEQ ID NO: 98806 - DNA, 6 bp, Unknown
  misc_feature (1)..( 6): Result.001 file - promoters60/1023124
tttaaa

SEQ ID NO: 98807 - DNA, 6 bp, Unknown
  misc_feature (1)..( 6): Result.001 file - promoters60/1023124
tttaaa

SEQ ID NO: 98808 - DNA, 14 bp, Unknown
  misc_feature (1)..( 14): Result.001 file - promoters60/1023124
tctaaaaaaaaaaa

SEQ ID NO: 98809 - DNA, 14 bp, Unknown
  misc_feature (1)..( 14): Result.001 file - promoters60/1023124
tctcaaaaagaaaa

SEQ ID NO: 98810 - DNA, 7 bp, Unknown
  misc_feature (1)..( 7): Result.001 file - promoters60/1023124
caatatc

SEQ ID NO: 98811 - DNA, 7 bp, Unknown
  misc_feature (1)..( 7): Result.001 file - promoters60/1023143
caaaatc

SEQ ID NO: 98812 - DNA, 7 bp, Unknown
  misc_feature (1)..( 7): Result.001 file - promoters60/1023143
tttgata

SEQ ID NO: 98813 - DNA, 7 bp, Unknown
  misc_feature (1)..( 7): Result.001 file - promoters60/1023143
ttttata

SEQ ID NO: 98814 - DNA, 8 bp, Unknown
  misc_feature (1)..( 8): Result.001 file - promoters60/1023143
ttgtaaat

SEQ ID NO: 98815 - DNA, 8 bp, Unknown
  misc_feature (1)..( 8): Result.001 file - promoters60/1023143
ttgcaaat

SEQ ID NO: 98816 - DNA, 6 bp, Unknown
  misc_feature (1)..( 6): Result.001 file - promoters60/1023143
acattg

SEQ ID NO: 98817 - DNA, 6 bp, Unknown
  misc_feature (1)..( 6): Result.001 file - promoters60/1023143
acattg

SEQ ID NO: 98818 - DNA, 8 bp, Unknown
  misc_feature (1)..( 8): Result.001 file - promoters60/1023143
tttagtat

SEQ ID NO: 98819 - DNA, 8 bp, Unknown
  misc_feature (1)..( 8): Result.001 file - promoters60/1023143
ttttgtat

SEQ ID NO: 98820 - DNA, 7 bp, Unknown
  misc_feature (1)..( 7): Result.001 file - promoters60/1023143
aattatg

SEQ ID NO: 98821 - DNA, 7 bp, Unknown
  misc_feature (1)..( 7): Result.001 file - promoters60/1023143
tattatg

SEQ ID NO: 98822 - DNA, 7 bp, Unknown
  misc_feature (1)..( 7): Result.001 file - promoters60/1023143
tattata

SEQ ID NO: 98823 - DNA, 11 bp, Unknown
  misc_feature (1)..( 11): Result.001 file - promoters60/1023143
atgaaaactgt

SEQ ID NO: 98824 - DNA, 11 bp, Unknown
  misc_feature (1)..( 11): Result.001 file - promoters60/1023143
atgaaacctgt

SEQ ID NO: 98825 - DNA, 6 bp, Unknown
  misc_feature (1)..( 6): Result.001 file - promoters60/1023143
atacca

SEQ ID NO: 98826 - DNA, 6 bp, Unknown
  misc_feature (1)..( 6): Result.001 file - promoters60/1023143
atacca

SEQ ID NO: 98827 - DNA, 7 bp, Unknown
  misc_feature (1)..( 7): Result.001 file - promoters60/1023143
atgtctt

SEQ ID NO: 98828 - DNA, 7 bp, Unknown
  misc_feature (1)..( 7): Result.001 file - promoters60/1023143
atgactt

SEQ ID NO: 98829 - DNA, 6 bp, Unknown
  misc_feature (1)..( 6): Result.001 file - promoters60/1023143
ttcata

SEQ ID NO: 98830 - DNA, 6 bp, Unknown
  misc_feature (1)..( 6): Result.001 file - promoters60/1023143
ttcata

SEQ ID NO: 98831 - DNA, 9 bp, Unknown
  misc_feature (1)..( 9): Result.001 file - promoters60/1023143
ttttcagta

SEQ ID NO: 98832 - DNA, 9 bp, Unknown
  misc_feature (1)..( 9): Result.001 file - promoters60/1023143
ttttctgta

SEQ ID NO: 98833 - DNA, 6 bp, Unknown
  misc_feature (1)..( 6): Result.001 file - promoters60/1023143
tgcaaa

SEQ ID NO: 98834 - DNA, 6 bp, Unknown
  misc_feature (1)..( 6): Result.001 file - promoters60/1023143
tgcaaa

SEQ ID NO: 98835 - DNA, 8 bp, Unknown
  misc_feature (1)..( 8): Result.001 file - promoters60/1023143
tatcaaac

SEQ ID NO: 98836 - DNA, 8 bp, Unknown
  misc_feature (1)..( 8): Result.001 file - promoters60/1023143
tatcaaac

SEQ ID NO: 98837 - DNA, 6 bp, Unknown
  misc_feature (1)..( 6): Result.001 file - promoters60/1023143
aaaata

SEQ ID NO: 98838 - DNA, 6 bp, Unknown
  misc_feature (1)..( 6): Result.001 file - promoters60/1023143
aaaata

SEQ ID NO: 98839 - DNA, 7 bp, Unknown
  misc_feature (1)..( 7): Result.001 file - promoters60/1023143
ttatcaa

SEQ ID NO: 98840 - DNA, 7 bp, Unknown
  misc_feature (1)..( 7): Result.001 file - promoters60/1023143
ttaccaa

SEQ ID NO: 98841 - DNA, 9 bp, Unknown
  misc_feature (1)..( 9): Result.001 file - promoters60/1023143
tctttttct

SEQ ID NO: 98842 - DNA, 9 bp, Unknown
  misc_feature (1)..( 9): Result.001 file - promoters60/1023143
tctttttct

SEQ ID NO: 98843 - DNA, 9 bp, Unknown
  misc_feature (1)..( 9): Result.001 file - promoters60/1023143
ataattttt

SEQ ID NO: 98844 - DNA, 9 bp, Unknown
  misc_feature (1)..( 9): Result.001 file - promoters60/1023143
ataatgttt

SEQ ID NO: 98845 - DNA, 7 bp, Unknown
  misc_feature (1)..( 7): Result.001 file - promoters60/1023143
atagata

SEQ ID NO: 98846 - DNA, 7 bp, Unknown
  misc_feature (1)..( 7): Result.001 file - promoters60/1023143
atatata

SEQ ID NO: 98847 - DNA, 7 bp, Unknown
  misc_feature (1)..( 7): Result.001 file - promoters60/1023143
atgtaat

SEQ ID NO: 98848 - DNA, 7 bp, Unknown
  misc_feature (1)..( 7): Result.002 file - promoters60/1023143
atggaat

SEQ ID NO: 98849 - DNA, 7 bp, Unknown
  misc_feature (1)..( 7): Result.002 file - promoters60/1023143
acctaat

SEQ ID NO: 98850 - DNA, 7 bp, Unknown
  misc_feature (1)..( 7): Result.002 file - promoters60/1023143
accaaat

SEQ ID NO: 98851 - DNA, 6 bp, Unknown
  misc_feature (1)..( 6): Result.002 file - promoters60/1023143
aaaaaa

SEQ ID NO: 98852 - DNA, 6 bp, Unknown
  misc_feature (1)..( 6): Result.002 file - promoters60/1023143
aaaaaa

SEQ ID NO: 98853 - DNA, 6 bp, Unknown
  misc_feature (1)..( 6): Result.002 file - promoters60/1023143
gtcaaa

SEQ ID NO: 98854 - DNA, 6 bp, Unknown
  misc_feature (1)..( 6): Result.002 file - promoters60/1023143
gtcaaa

SEQ ID NO: 98855 - DNA, 6 bp, Unknown
  misc_feature (1)..( 6): Result.002 file - promoters60/1023143
ggcgag

SEQ ID NO: 98856 - DNA, 6 bp, Unknown
  misc_feature (1)..( 6): Result.002 file - promoters60/1023143
ggcgag

SEQ ID NO: 98857 - DNA, 8 bp, Unknown
  misc_feature (1)..( 8): Result.002 file - promoters60/1023210
caataaaa

SEQ ID NO: 98858 - DNA, 8 bp, Unknown
  misc_feature (1)..( 8): Result.002 file - promoters60/1023210
caaaaaaa

SEQ ID NO: 98859 - DNA, 6 bp, Unknown
  misc_feature (1)..( 6): Result.002 file - promoters60/1023210
aaaaca

SEQ ID NO: 98860 - DNA, 6 bp, Unknown
  misc_feature (1)..( 6): Result.002 file - promoters60/1023210
aaaaca

SEQ ID NO: 98861 - DNA, 8 bp, Unknown
  misc_feature (1)..( 8): Result.002 file - promoters60/1023210
gaattaaa

SEQ ID NO: 98862 - DNA, 8 bp, Unknown
  misc_feature (1)..( 8): Result.002 file - promoters60/1023210
gaaataaa

SEQ ID NO: 98863 - DNA, 7 bp, Unknown
  misc_feature (1)..( 7): Result.002 file - promoters60/1023210
caaattt

SEQ ID NO: 98864 - DNA, 7 bp, Unknown
  misc_feature (1)..( 7): Result.002 file - promoters60/1023210
caatttt

SEQ ID NO: 98865 - DNA, 6 bp, Unknown
  misc_feature (1)..( 6): Result.002 file - promoters60/1023210
ttaaaa

SEQ ID NO: 98866 - DNA, 6 bp, Unknown
  misc_feature (1)..( 6): Result.002 file - promoters60/1023210
ttaaaa

SEQ ID NO: 98867 - DNA, 6 bp, Unknown
  misc_feature (1)..( 6): Result.002 file - promoters60/1023210
gtaacg

SEQ ID NO: 98868 - DNA, 6 bp, Unknown
  misc_feature (1)..( 6): Result.002 file - promoters60/1023210
gtaacg

SEQ ID NO: 98869 - DNA, 7 bp, Unknown
  misc_feature (1)..( 7): Result.002 file - promoters60/1023210
gtggtta

SEQ ID NO: 98870 - DNA, 7 bp, Unknown
  misc_feature (1)..( 7): Result.002 file - promoters60/1023210
gtgttta

SEQ ID NO: 98871 - DNA, 10 bp, Unknown
  misc_feature (1)..( 10): Result.002 file - promoters60/1023210
tacgtgtcaa

SEQ ID NO: 98872 - DNA, 10 bp, Unknown
  misc_feature (1)..( 10): Result.002 file - promoters60/1023210
cacgtgtcat

SEQ ID NO: 98873 - DNA, 10 bp, Unknown
  misc_feature (1)..( 10): Result.002 file - promoters60/1023210
tacgtgtcaa

SEQ ID NO: 98874 - DNA, 20 bp, Unknown
  misc_feature (1)..( 20): Result.002 file - promoters60/1023210
ttggttattgcttcaccgcc

SEQ ID NO: 98875 - DNA, 20 bp, Unknown
  misc_feature (1)..( 20): Result.002 file - promoters60/1023210
ttagctattgcttcaccgcc

SEQ ID NO: 98876 - DNA, 20 bp, Unknown
  misc_feature (1)..( 20): Result.002 file - promoters60/1023210
ttggctattgcttccacgcc

SEQ ID NO: 98877 - DNA, 22 bp, Unknown
  misc_feature (1)..( 22): Result.002 file - promoters60/1023210
tctcgtgaccgactcgtcctcg

SEQ ID NO: 98878 - DNA, 22 bp, Unknown
  misc_feature (1)..( 22): Result.002 file - promoters60/1023210
gacctagtcgtcctcgtctttt

SEQ ID NO: 98879 - DNA, 22 bp, Unknown
  misc_feature (1)..( 22): Result.002 file - promoters60/1023210
gaccgagtcgtcctcgtctttt

SEQ ID NO: 98880 - DNA, 16 bp, Unknown
  misc_feature (1)..( 16): Result.002 file - promoters60/1023210
ttcttcttctataaat

SEQ ID NO: 98881 - DNA, 16 bp, Unknown
  misc_feature (1)..( 16): Result.002 file - promoters60/1023210
ttcttcttctataaaa

SEQ ID NO: 98882 - DNA, 16 bp, Unknown
  misc_feature (1)..( 16): Result.002 file - promoters60/1023210
ttttgcttctataaat

SEQ ID NO: 98883 - DNA, 6 bp, Unknown
  misc_feature (1)..( 6): Result.002 file - promoters60/1023210
gcttct

SEQ ID NO: 98884 - DNA, 6 bp, Unknown
  misc_feature (1)..( 6): Result.002 file - promoters60/1023210
gcttct

SEQ ID NO: 98885 - DNA, 8 bp, Unknown
  misc_feature (1)..( 8): Result.002 file - promoters60/1023210
ttctggcc

SEQ ID NO: 98886 - DNA, 8 bp, Unknown
  misc_feature (1)..( 8): Result.002 file - promoters60/1023210
ttcttgcc

SEQ ID NO: 98887 - DNA, 7 bp, Unknown
  misc_feature (1)..( 7): Result.002 file - promoters60/1023210
tacatat

SEQ ID NO: 98888 - DNA, 7 bp, Unknown
  misc_feature (1)..( 7): Result.002 file - promoters60/1023210
tacttat

SEQ ID NO: 98889 - DNA, 15 bp, Unknown
  misc_feature (1)..( 15): Result.002 file - promoters60/1023210
cgccttagctttctc

SEQ ID NO: 98890 - DNA, 15 bp, Unknown
  misc_feature (1)..( 15): Result.002 file - promoters60/1023210
cgccttagctttctc

SEQ ID NO: 98891 - DNA, 15 bp, Unknown
  misc_feature (1)..( 15): Result.002 file - promoters60/1023210
cgccttagctttctc

SEQ ID NO: 98892 - DNA, 6 bp, Unknown
  misc_feature (1)..( 6): Result.002 file - promoters60/1023210
tttttt

SEQ ID NO: 98893 - DNA, 6 bp, Unknown
  misc_feature (1)..( 6): Result.002 file - promoters60/1023210
tttttt

SEQ ID NO: 98894 - DNA, 9 bp, Unknown
  misc_feature (1)..( 9): Result.002 file - promoters60/1023210
acaaaaagg

SEQ ID NO: 98895 - DNA, 9 bp, Unknown
  misc_feature (1)..( 9): Result.002 file - promoters60/1023210
acacaaagg

SEQ ID NO: 98896 - DNA, 7 bp, Unknown
  misc_feature (1)..( 7): Result.002 file - promoters60/1023210
acgaaga

SEQ ID NO: 98897 - DNA, 7 bp, Unknown
  misc_feature (1)..( 7): Result.002 file - promoters60/1023210
acgcaga

SEQ ID NO: 98898 - DNA, 6 bp, Unknown
  misc_feature (1)..( 6): Result.002 file - promoters60/1023210
gttcaa

SEQ ID NO: 98899 - DNA, 6 bp, Unknown
  misc_feature (1)..( 6): Result.002 file - promoters60/1023210
gttcaa

SEQ ID NO: 98900 - DNA, 6 bp, Unknown
  misc_feature (1)..( 6): Result.002 file - promoters60/1023210
gtatat

SEQ ID NO: 98901 - DNA, 6 bp, Unknown
  misc_feature (1)..( 6): Result.002 file - promoters60/1023210
gtatat

SEQ ID NO: 98902 - DNA, 9 bp, Unknown
  misc_feature (1)..( 9): Result.002 file - promoters60/1023210
atcttatga

SEQ ID NO: 98903 - DNA, 9 bp, Unknown
  misc_feature (1)..( 9): Result.002 file - promoters60/1023210
atctaatga

SEQ ID NO: 98904 - DNA, 6 bp, Unknown
  misc_feature (1)..( 6): Result.002 file - promoters60/1023210
tcagta

SEQ ID NO: 98905 - DNA, 6 bp, Unknown
  misc_feature (1)..( 6): Result.002 file - promoters60/1023210
tcagta

SEQ ID NO: 98906 - DNA, 10 bp, Unknown
  misc_feature (1)..( 10): Result.002 file - promoters60/1023210
tttatcaact

SEQ ID NO: 98907 - DNA, 10 bp, Unknown
  misc_feature (1)..( 10): Result.002 file - promoters60/1023210
tttaacaact

SEQ ID NO: 98908 - DNA, 15 bp, Unknown
  misc_feature (1)..( 15): Result.002 file - promoters60/1023210
aaatacttttcctca

SEQ ID NO: 98909 - DNA, 15 bp, Unknown
  misc_feature (1)..( 15): Result.002 file - promoters60/1023210
aaatacttttcctca

SEQ ID NO: 98910 - DNA, 6 bp, Unknown
  misc_feature (1)..( 6): Result.002 file - promoters60/1023210
aacaac

SEQ ID NO: 98911 - DNA, 6 bp, Unknown
  misc_feature (1)..( 6): Result.002 file - promoters60/1023210
aacaac

SEQ ID NO: 98912 - DNA, 15 bp, Unknown
  misc_feature (1)..( 15): Result.002 file - promoters60/1023210
aatacccaaagagct

SEQ ID NO: 98913 - DNA, 15 bp, Unknown
  misc_feature (1)..( 15): Result.002 file - promoters60/1023210
aatacccaaagagct

SEQ ID NO: 98914 - DNA, 15 bp, Unknown
  misc_feature (1)..( 15): Result.002 file - promoters60/1023221
aaataaaattaatgt

SEQ ID NO: 98915 - DNA, 15 bp, Unknown
  misc_feature (1)..( 15): Result.002 file - promoters60/1023221
aaacaaaaactcata

SEQ ID NO: 98916 - DNA, 15 bp, Unknown
  misc_feature (1)..( 15): Result.002 file - promoters60/1023221
ctctaaaatctaata

SEQ ID NO: 98917 - DNA, 15 bp, Unknown
  misc_feature (1)..( 15): Result.002 file - promoters60/1023221
ctataacattaccga

SEQ ID NO: 98918 - DNA, 16 bp, Unknown
  misc_feature (1)..( 16): Result.002 file - promoters60/1023221
aactacacatagtgac

SEQ ID NO: 98919 - DNA, 16 bp, Unknown
  misc_feature (1)..( 16): Result.002 file - promoters60/1023221
aacgaaacaacatata

SEQ ID NO: 98920 - DNA, 16 bp, Unknown
  misc_feature (1)..( 16): Result.002 file - promoters60/1023221
aatctaacagcattag

SEQ ID NO: 98921 - DNA, 14 bp, Unknown
  misc_feature (1)..( 14): Result.002 file - promoters60/1023221
aaacatccttaata

SEQ ID NO: 98922 - DNA, 14 bp, Unknown
  misc_feature (1)..( 14): Result.002 file - promoters60/1023221
agacattcttaaat

SEQ ID NO: 98923 - DNA, 14 bp, Unknown
  misc_feature (1)..( 14): Result.002 file - promoters60/1023221
atacagacttaaaa

SEQ ID NO: 98924 - DNA, 14 bp, Unknown
  misc_feature (1)..( 14): Result.002 file - promoters60/1023221
taacattcgtgaac

SEQ ID NO: 98925 - DNA, 14 bp, Unknown
  misc_feature (1)..( 14): Result.002 file - promoters60/1023221
taacattaccgagg

SEQ ID NO: 98926 - DNA, 14 bp, Unknown
  misc_feature (1)..( 14): Result.002 file - promoters60/1023221
cattgctctaaaat

SEQ ID NO: 98927 - DNA, 11 bp, Unknown
  misc_feature (1)..( 11): Result.002 file - promoters60/1023237
aaattttctca

SEQ ID NO: 98928 - DNA, 11 bp, Unknown
  misc_feature (1)..( 11): Result.002 file - promoters60/1023237
ttcttttttca

SEQ ID NO: 98929 - DNA, 11 bp, Unknown
  misc_feature (1)..( 11): Result.002 file - promoters60/1023237
tctatttctct

SEQ ID NO: 98930 - DNA, 11 bp, Unknown
  misc_feature (1)..( 11): Result.002 file - promoters60/1023237
aggttttctac

SEQ ID NO: 98931 - DNA, 11 bp, Unknown
  misc_feature (1)..( 11): Result.002 file - promoters60/1023237
gttgtttcttc

SEQ ID NO: 98932 - DNA, 11 bp, Unknown
  misc_feature (1)..( 11): Result.002 file - promoters60/1023237
ttctttttttg

SEQ ID NO: 98933 - DNA, 12 bp, Unknown
  misc_feature (1)..( 12): Result.002 file - promoters60/1023237
atatttattttt

SEQ ID NO: 98934 - DNA, 12 bp, Unknown
  misc_feature (1)..( 12): Result.002 file - promoters60/1023237
attatttttatt

SEQ ID NO: 98935 - DNA, 12 bp, Unknown
  misc_feature (1)..( 12): Result.002 file - promoters60/1023237
agcttttttaat

SEQ ID NO: 98936 - DNA, 12 bp, Unknown
  misc_feature (1)..( 12): Result.002 file - promoters60/1023237
attcttttttac

SEQ ID NO: 98937 - DNA, 13 bp, Unknown
  misc_feature (1)..( 13): Result.002 file - promoters60/1023237
tttgtttcttaag

SEQ ID NO: 98938 - DNA, 13 bp, Unknown
  misc_feature (1)..( 13): Result.002 file - promoters60/1023237
accttcttttaaa

SEQ ID NO: 98939 - DNA, 13 bp, Unknown
  misc_feature (1)..( 13): Result.002 file - promoters60/1023237
agatcatttgaat

SEQ ID NO: 98940 - DNA, 16 bp, Unknown
  misc_feature (1)..( 16): Result.002 file - promoters60/1023237
aaaagttttgcaagaa

SEQ ID NO: 98941 - DNA, 16 bp, Unknown
  misc_feature (1)..( 16): Result.002 file - promoters60/1023237
aaatgttttgttgttt

SEQ ID NO: 98942 - DNA, 16 bp, Unknown
  misc_feature (1)..( 16): Result.002 file - promoters60/1023237
gttgattttgaaagaa

SEQ ID NO: 98943 - DNA, 16 bp, Unknown
  misc_feature (1)..( 16): Result.002 file - promoters60/1023237
gtatggttttaaatgt

SEQ ID NO: 98944 - DNA, 16 bp, Unknown
  misc_feature (1)..( 16): Result.002 file - promoters60/1023237
tctttttttggtggac

SEQ ID NO: 98945 - DNA, 16 bp, Unknown
  misc_feature (1)..( 16): Result.002 file - promoters60/1023237
tttatttttgtaggtc

SEQ ID NO: 98946 - DNA, 16 bp, Unknown
  misc_feature (1)..( 16): Result.002 file - promoters60/1023237
tgtgtgtttctttttt

SEQ ID NO: 98947 - DNA, 16 bp, Unknown
  misc_feature (1)..( 16): Result.002 file - promoters60/1023237
ttgttgtttcttctcc

SEQ ID NO: 98948 - DNA, 16 bp, Unknown
  misc_feature (1)..( 16): Result.002 file - promoters60/1023237
tcaaggcttctttttt

SEQ ID NO: 98949 - DNA, 16 bp, Unknown
  misc_feature (1)..( 16): Result.002 file - promoters60/1023237
cataagtttctgatat

SEQ ID NO: 98950 - DNA, 16 bp, Unknown
  misc_feature (1)..( 16): Result.002 file - promoters60/1023237
ttgttgtttacgttgt

SEQ ID NO: 98951 - DNA, 16 bp, Unknown
  misc_feature (1)..( 16): Result.002 file - promoters60/1023237
cgcttggttccagaag

SEQ ID NO: 98952 - DNA, 9 bp, Unknown
  misc_feature (1)..( 9): Result.002 file - promoters60/1023278
taatattta

SEQ ID NO: 98953 - DNA, 9 bp, Unknown
  misc_feature (1)..( 9): Result.002 file - promoters60/1023278
gaatttttg

SEQ ID NO: 98954 - DNA, 9 bp, Unknown
  misc_feature (1)..( 9): Result.002 file - promoters60/1023278
gcctattta

SEQ ID NO: 98955 - DNA, 9 bp, Unknown
  misc_feature (1)..( 9): Result.002 file - promoters60/1023278
aggtttttg

SEQ ID NO: 98956 - DNA, 9 bp, Unknown
  misc_feature (1)..( 9): Result.002 file - promoters60/1023278
gaagtttct

SEQ ID NO: 98957 - DNA, 9 bp, Unknown
  misc_feature (1)..( 9): Result.002 file - promoters60/1023278
taattttat

SEQ ID NO: 98958 - DNA, 15 bp, Unknown
  misc_feature (1)..( 15): Result.002 file - promoters60/1023278
acaatgggctgggcc

SEQ ID NO: 98959 - DNA, 15 bp, Unknown
  misc_feature (1)..( 15): Result.002 file - promoters60/1023278
attttgggcttctta

SEQ ID NO: 98960 - DNA, 15 bp, Unknown
  misc_feature (1)..( 15): Result.002 file - promoters60/1023278
gaaataggcccaaca

SEQ ID NO: 98961 - DNA, 15 bp, Unknown
  misc_feature (1)..( 15): Result.002 file - promoters60/1023278
taattgggcttttta

SEQ ID NO: 98962 - DNA, 15 bp, Unknown
  misc_feature (1)..( 15): Result.002 file - promoters60/1023278
taaaaaggcccatta

SEQ ID NO: 98963 - DNA, 15 bp, Unknown
  misc_feature (1)..( 15): Result.002 file - promoters60/1023278
taaaaaatatctgaa

SEQ ID NO: 98964 - DNA, 10 bp, Unknown
  misc_feature (1)..( 10): Result.002 file - promoters60/1023299
aaataaaacg

SEQ ID NO: 98965 - DNA, 10 bp, Unknown
  misc_feature (1)..( 10): Result.002 file - promoters60/1023299
aaattaaagg

SEQ ID NO: 98966 - DNA, 10 bp, Unknown
  misc_feature (1)..( 10): Result.002 file - promoters60/1023299
gtataaaata

SEQ ID NO: 98967 - DNA, 10 bp, Unknown
  misc_feature (1)..( 10): Result.002 file - promoters60/1023299
gcttaacatt

SEQ ID NO: 98968 - DNA, 9 bp, Unknown
  misc_feature (1)..( 9): Result.002 file - promoters60/1023299
tttcatttt

SEQ ID NO: 98969 - DNA, 9 bp, Unknown
  misc_feature (1)..( 9): Result.002 file - promoters60/1023299
attcattgt

SEQ ID NO: 98970 - DNA, 9 bp, Unknown
  misc_feature (1)..( 9): Result.002 file - promoters60/1023299
tttcatctc

SEQ ID NO: 98971 - DNA, 10 bp, Unknown
  misc_feature (1)..( 10): Result.002 file - promoters60/1023299
tttccatttt

SEQ ID NO: 98972 - DNA, 9 bp, Unknown
  misc_feature (1)..( 9): Result.002 file - promoters60/1023299
acttctata

SEQ ID NO: 98973 - DNA, 9 bp, Unknown
  misc_feature (1)..( 9): Result.002 file - promoters60/1023299
ttttcaata

SEQ ID NO: 98974 - DNA, 10 bp, Unknown
  misc_feature (1)..( 10): Result.002 file - promoters60/1023299
atttacaatt

SEQ ID NO: 98975 - DNA, 10 bp, Unknown
  misc_feature (1)..( 10): Result.002 file - promoters60/1023299
atttaccgtt

SEQ ID NO: 98976 - DNA, 9 bp, Unknown
  misc_feature (1)..( 9): Result.002 file - promoters60/1023299
cattttatt

SEQ ID NO: 98977 - DNA, 9 bp, Unknown
  misc_feature (1)..( 9): Result.002 file - promoters60/1023299
cattttata

SEQ ID NO: 98978 - DNA, 9 bp, Unknown
  misc_feature (1)..( 9): Result.002 file - promoters60/1023299
cattttcca

SEQ ID NO: 98979 - DNA, 9 bp, Unknown
  misc_feature (1)..( 9): Result.002 file - promoters60/1023299
ttgtttata

SEQ ID NO: 98980 - DNA, 11 bp, Unknown
  misc_feature (1)..( 11): Result.002 file - promoters60/1023299
ctataaataca

SEQ ID NO: 98981 - DNA, 11 bp, Unknown
  misc_feature (1)..( 11): Result.002 file - promoters60/1023299
atggaaacaca

SEQ ID NO: 98982 - DNA, 11 bp, Unknown
  misc_feature (1)..( 11): Result.002 file - promoters60/1023299
ctataaatatc

SEQ ID NO: 98983 - DNA, 11 bp, Unknown
  misc_feature (1)..( 11): Result.002 file - promoters60/1023299
ctttaaatacc

SEQ ID NO: 98984 - DNA, 10 bp, Unknown
  misc_feature (1)..( 10): Result.002 file - promoters60/1023299
gtaatattac

SEQ ID NO: 98985 - DNA, 10 bp, Unknown
  misc_feature (1)..( 10): Result.002 file - promoters60/1023299
cgtttattac

SEQ ID NO: 98986 - DNA, 10 bp, Unknown
  misc_feature (1)..( 10): Result.002 file - promoters60/1023299
acaattttaa

SEQ ID NO: 98987 - DNA, 10 bp, Unknown
  misc_feature (1)..( 10): Result.002 file - promoters60/1023299
acaatttgta

SEQ ID NO: 98988 - DNA, 8 bp, Unknown
  misc_feature (1)..( 8): Result.002 file - promoters60/1023397
gattttcc

SEQ ID NO: 98989 - DNA, 8 bp, Unknown
  misc_feature (1)..( 8): Result.002 file - promoters60/1023397
aattatcc

SEQ ID NO: 98990 - DNA, 8 bp, Unknown
  misc_feature (1)..( 8): Result.002 file - promoters60/1023397
gatattcg

SEQ ID NO: 98991 - DNA, 15 bp, Unknown
  misc_feature (1)..( 15): Result.002 file - promoters60/1023397
ctttttttggttttt

SEQ ID NO: 98992 - DNA, 15 bp, Unknown
  misc_feature (1)..( 15): Result.002 file - promoters60/1023397
cttctttttggttaa

SEQ ID NO: 98993 - DNA, 15 bp, Unknown
  misc_feature (1)..( 15): Result.002 file - promoters60/1023397
ctttttttggttttt

SEQ ID NO: 98994 - DNA, 15 bp, Unknown
  misc_feature (1)..( 15): Result.002 file - promoters60/1023397
ctttttttttttggt

SEQ ID NO: 98995 - DNA, 12 bp, Unknown
  misc_feature (1)..( 12): Result.002 file - promoters60/1023397
tctgtttttgtt

SEQ ID NO: 98996 - DNA, 12 bp, Unknown
  misc_feature (1)..( 12): Result.002 file - promoters60/1023397
tctgtttatgtt

SEQ ID NO: 98997 - DNA, 12 bp, Unknown
  misc_feature (1)..( 12): Result.002 file - promoters60/1023397
tctgtttccgga

SEQ ID NO: 98998 - DNA, 15 bp, Unknown
  misc_feature (1)..( 15): Result.002 file - promoters60/1023397
tctggagagattttg

SEQ ID NO: 98999 - DNA, 15 bp, Unknown
  misc_feature (1)..( 15): Result.002 file - promoters60/1023397
tctggagagattttg

SEQ ID NO: 99000 - DNA, 15 bp, Unknown
  misc_feature (1)..( 15): Result.002 file - promoters60/1023397
tatgatctgatttta

SEQ ID NO: 99001 - DNA, 8 bp, Unknown
  misc_feature (1)..( 8): Result.002 file - promoters60/1023397
gattttga

SEQ ID NO: 99002 - DNA, 8 bp, Unknown
  misc_feature (1)..( 8): Result.002 file - promoters60/1023397
gattttcc

SEQ ID NO: 99003 - DNA, 9 bp, Unknown
  misc_feature (1)..( 9): Result.002 file - promoters60/1023397
gatgttttt

SEQ ID NO: 99004 - DNA, 15 bp, Unknown
  misc_feature (1)..( 15): Result.002 file - promoters60/1023397
tttctttttttggtt

SEQ ID NO: 99005 - DNA, 15 bp, Unknown
  misc_feature (1)..( 15): Result.002 file - promoters60/1023397
attctttcttttttt

SEQ ID NO: 99006 - DNA, 15 bp, Unknown
  misc_feature (1)..( 15): Result.002 file - promoters60/1023397
ctttttttttttggt

SEQ ID NO: 99007 - DNA, 15 bp, Unknown
  misc_feature (1)..( 15): Result.002 file - promoters60/1023397
cttctttttggttaa

SEQ ID NO: 99008 - DNA, 7 bp, Unknown
  misc_feature (1)..( 7): Result.002 file - promoters60/1023397
ttaaatt

SEQ ID NO: 99009 - DNA, 7 bp, Unknown
  misc_feature (1)..( 7): Result.002 file - promoters60/1023397
ttatatt

SEQ ID NO: 99010 - DNA, 7 bp, Unknown
  misc_feature (1)..( 7): Result.002 file - promoters60/1023397
ttaaatt

SEQ ID NO: 99011 - DNA, 12 bp, Unknown
  misc_feature (1)..( 12): Result.002 file - promoters60/1023407
caaaaatgagaa

SEQ ID NO: 99012 - DNA, 12 bp, Unknown
  misc_feature (1)..( 12): Result.002 file - promoters60/1023407
caaaaattgaag

SEQ ID NO: 99013 - DNA, 12 bp, Unknown
  misc_feature (1)..( 12): Result.002 file - promoters60/1023407
taaaaatgtgaa

SEQ ID NO: 99014 - DNA, 12 bp, Unknown
  misc_feature (1)..( 12): Result.002 file - promoters60/1023407
tcaaaattaatt

SEQ ID NO: 99015 - DNA, 12 bp, Unknown
  misc_feature (1)..( 12): Result.002 file - promoters60/1023407
aaaatattgact

SEQ ID NO: 99016 - DNA, 12 bp, Unknown
  misc_feature (1)..( 12): Result.002 file - promoters60/1023407
gaaatatctttc

SEQ ID NO: 99017 - DNA, 16 bp, Unknown
  misc_feature (1)..( 16): Result.002 file - promoters60/1023407
tgggcttaatacctaa

SEQ ID NO: 99018 - DNA, 16 bp, Unknown
  misc_feature (1)..( 16): Result.002 file - promoters60/1023407
cacttgtaatacataa

SEQ ID NO: 99019 - DNA, 16 bp, Unknown
  misc_feature (1)..( 16): Result.002 file - promoters60/1023407
ctctaataatacatca

SEQ ID NO: 99020 - DNA, 16 bp, Unknown
  misc_feature (1)..( 16): Result.002 file - promoters60/1023407
cctgaatcatatgggc

SEQ ID NO: 99021 - DNA, 16 bp, Unknown
  misc_feature (1)..( 16): Result.002 file - promoters60/1023407
ttgcgataatatacaa

SEQ ID NO: 99022 - DNA, 16 bp, Unknown
  misc_feature (1)..( 16): Result.002 file - promoters60/1023407
ttctgctaatttacca

SEQ ID NO: 99023 - DNA, 8 bp, Unknown
  misc_feature (1)..( 8): Result.002 file - promoters60/1023528
aaaacatg

SEQ ID NO: 99024 - DNA, 8 bp, Unknown
  misc_feature (1)..( 8): Result.002 file - promoters60/1023528
aaaacaga

SEQ ID NO: 99025 - DNA, 9 bp, Unknown
  misc_feature (1)..( 9): Result.002 file - promoters60/1023528
aaaatcaga

SEQ ID NO: 99026 - DNA, 9 bp, Unknown
  misc_feature (1)..( 9): Result.002 file - promoters60/1023528
aaaaactta

SEQ ID NO: 99027 - DNA, 8 bp, Unknown
  misc_feature (1)..( 8): Result.002 file - promoters60/1023528
gattaaag

SEQ ID NO: 99028 - DNA, 8 bp, Unknown
  misc_feature (1)..( 8): Result.002 file - promoters60/1023528
tattaaag

SEQ ID NO: 99029 - DNA, 8 bp, Unknown
  misc_feature (1)..( 8): Result.002 file - promoters60/1023528
gattaacg

SEQ ID NO: 99030 - DNA, 7 bp, Unknown
  misc_feature (1)..( 7): Result.002 file - promoters60/1023583
aattaga

SEQ ID NO: 99031 - DNA, 7 bp, Unknown
  misc_feature (1)..( 7): Result.002 file - promoters60/1023583
aataaga

SEQ ID NO: 99032 - DNA, 9 bp, Unknown
  misc_feature (1)..( 9): Result.002 file - promoters60/1023583
gtttttaag

SEQ ID NO: 99033 - DNA, 9 bp, Unknown
  misc_feature (1)..( 9): Result.002 file - promoters60/1023583
gtttataag

SEQ ID NO: 99034 - DNA, 10 bp, Unknown
  misc_feature (1)..( 10): Result.002 file - promoters60/1023583
acaaaacaaa

SEQ ID NO: 99035 - DNA, 10 bp, Unknown
  misc_feature (1)..( 10): Result.002 file - promoters60/1023583
tgaaaagaaa

SEQ ID NO: 99036 - DNA, 10 bp, Unknown
  misc_feature (1)..( 10): Result.002 file - promoters60/1023583
tgagaagagc

SEQ ID NO: 99037 - DNA, 10 bp, Unknown
  misc_feature (1)..( 10): Result.002 file - promoters60/1023583
tgaaaaatat

SEQ ID NO: 99038 - DNA, 10 bp, Unknown
  misc_feature (1)..( 10): Result.002 file - promoters60/1023583
tgaaaattat

SEQ ID NO: 99039 - DNA, 6 bp, Unknown
  misc_feature (1)..( 6): Result.002 file - promoters60/1023583
aatatg

SEQ ID NO: 99040 - DNA, 6 bp, Unknown
  misc_feature (1)..( 6): Result.002 file - promoters60/1023583
aatatg

SEQ ID NO: 99041 - DNA, 6 bp, Unknown
  misc_feature (1)..( 6): Result.002 file - promoters60/1023583
ttttaa

SEQ ID NO: 99042 - DNA, 6 bp, Unknown
  misc_feature (1)..( 6): Result.002 file - promoters60/1023583
ttttaa

SEQ ID NO: 99043 - DNA, 7 bp, Unknown
  misc_feature (1)..( 7): Result.002 file - promoters60/1023583
aaaactg

SEQ ID NO: 99044 - DNA, 7 bp, Unknown
  misc_feature (1)..( 7): Result.002 file - promoters60/1023583
aaagctg

SEQ ID NO: 99045 - DNA, 8 bp, Unknown
  misc_feature (1)..( 8): Result.002 file - promoters60/1023583
gtttttat

SEQ ID NO: 99046 - DNA, 8 bp, Unknown
  misc_feature (1)..( 8): Result.002 file - promoters60/1023583
gttattat

SEQ ID NO: 99047 - DNA, 6 bp, Unknown
  misc_feature (1)..( 6): Result.002 file - promoters60/1023583
cgtctt

SEQ ID NO: 99048 - DNA, 6 bp, Unknown
  misc_feature (1)..( 6): Result.002 file - promoters60/1023583
cgtctt

SEQ ID NO: 99049 - DNA, 8 bp, Unknown
  misc_feature (1)..( 8): Result.002 file - promoters60/1023583
caaatttc

SEQ ID NO: 99050 - DNA, 8 bp, Unknown
  misc_feature (1)..( 8): Result.002 file - promoters60/1023583
caagtttc

SEQ ID NO: 99051 - DNA, 6 bp, Unknown
  misc_feature (1)..( 6): Result.002 file - promoters60/1023583
tggttc

SEQ ID NO: 99052 - DNA, 6 bp, Unknown
  misc_feature (1)..( 6): Result.002 file - promoters60/1023583
tggttc

SEQ ID NO: 99053 - DNA, 6 bp, Unknown
  misc_feature (1)..( 6): Result.002 file - promoters60/1023583
attata

SEQ ID NO: 99054 - DNA, 6 bp, Unknown
  misc_feature (1)..( 6): Result.002 file - promoters60/1023583
attata

SEQ ID NO: 99055 - DNA, 9 bp, Unknown
  misc_feature (1)..( 9): Result.002 file - promoters60/1023594
caaaataat

SEQ ID NO: 99056 - DNA, 9 bp, Unknown
  misc_feature (1)..( 9): Result.002 file - promoters60/1023594
tcaaataat

SEQ ID NO: 99057 - DNA, 9 bp, Unknown
  misc_feature (1)..( 9): Result.002 file - promoters60/1023594
caaaacaat

SEQ ID NO: 99058 - DNA, 11 bp, Unknown
  misc_feature (1)..( 11): Result.002 file - promoters60/1023594
caacttgtcaa

SEQ ID NO: 99059 - DNA, 11 bp, Unknown
  misc_feature (1)..( 11): Result.002 file - promoters60/1023594
caactagtcaa

SEQ ID NO: 99060 - DNA, 11 bp, Unknown
  misc_feature (1)..( 11): Result.002 file - promoters60/1023594
aaactagaaaa

SEQ ID NO: 99061 - DNA, 9 bp, Unknown
  misc_feature (1)..( 9): Result.002 file - promoters60/1023594
taaaaaatg

SEQ ID NO: 99062 - DNA, 9 bp, Unknown
  misc_feature (1)..( 9): Result.002 file - promoters60/1023594
tgaaaaatt

SEQ ID NO: 99063 - DNA, 9 bp, Unknown
  misc_feature (1)..( 9): Result.002 file - promoters60/1023594
tgagaaatt

SEQ ID NO: 99064 - DNA, 9 bp, Unknown
  misc_feature (1)..( 9): Result.002 file - promoters60/1023594
acaaagatt

SEQ ID NO: 99065 - DNA, 10 bp, Unknown
  misc_feature (1)..( 10): Result.002 file - promoters60/1023594
ctataaatat

SEQ ID NO: 99066 - DNA, 10 bp, Unknown
  misc_feature (1)..( 10): Result.002 file - promoters60/1023594
tcatatatat

SEQ ID NO: 99067 - DNA, 10 bp, Unknown
  misc_feature (1)..( 10): Result.002 file - promoters60/1023594
ctataaaagg

SEQ ID NO: 99068 - DNA, 9 bp, Unknown
  misc_feature (1)..( 9): Result.002 file - promoters60/1023619
aattgatga

SEQ ID NO: 99069 - DNA, 9 bp, Unknown
  misc_feature (1)..( 9): Result.002 file - promoters60/1023619
aattgattc

SEQ ID NO: 99070 - DNA, 9 bp, Unknown
  misc_feature (1)..( 9): Result.002 file - promoters60/1023619
atttgattg

SEQ ID NO: 99071 - DNA, 9 bp, Unknown
  misc_feature (1)..( 9): Result.002 file - promoters60/1023619
aattgagca

SEQ ID NO: 99072 - DNA, 9 bp, Unknown
  misc_feature (1)..( 9): Result.002 file - promoters60/1023619
aatttattt

SEQ ID NO: 99073 - DNA, 9 bp, Unknown
  misc_feature (1)..( 9): Result.002 file - promoters60/1023619
ctttgattt

SEQ ID NO: 99074 - DNA, 9 bp, Unknown
  misc_feature (1)..( 9): Result.002 file - promoters60/1023619
cattggttt

SEQ ID NO: 99075 - DNA, 8 bp, Unknown
  misc_feature (1)..( 8): Result.002 file - promoters60/1023619
tttttttt

SEQ ID NO: 99076 - DNA, 8 bp, Unknown
  misc_feature (1)..( 8): Result.002 file - promoters60/1023619
gatttttt

SEQ ID NO: 99077 - DNA, 9 bp, Unknown
  misc_feature (1)..( 9): Result.002 file - promoters60/1023619
aatttattt

SEQ ID NO: 99078 - DNA, 9 bp, Unknown
  misc_feature (1)..( 9): Result.002 file - promoters60/1023619
aattgattc

SEQ ID NO: 99079 - DNA, 9 bp, Unknown
  misc_feature (1)..( 9): Result.002 file - promoters60/1023619
ctttgattt

SEQ ID NO: 99080 - DNA, 9 bp, Unknown
  misc_feature (1)..( 9): Result.002 file - promoters60/1023619
cattggttt

SEQ ID NO: 99081 - DNA, 8 bp, Unknown
  misc_feature (1)..( 8): Result.002 file - promoters60/1023619
tttaattg

SEQ ID NO: 99082 - DNA, 8 bp, Unknown
  misc_feature (1)..( 8): Result.002 file - promoters60/1023619
tttgattt

SEQ ID NO: 99083 - DNA, 8 bp, Unknown
  misc_feature (1)..( 8): Result.002 file - promoters60/1023619
tttgattg

SEQ ID NO: 99084 - DNA, 8 bp, Unknown
  misc_feature (1)..( 8): Result.002 file - promoters60/1023619
attgattc

SEQ ID NO: 99085 - DNA, 8 bp, Unknown
  misc_feature (1)..( 8): Result.002 file - promoters60/1023619
attggttt

SEQ ID NO: 99086 - DNA, 8 bp, Unknown
  misc_feature (1)..( 8): Result.002 file - promoters60/1023619
agtgattt

SEQ ID NO: 99087 - DNA, 9 bp, Unknown
  misc_feature (1)..( 9): Result.002 file - promoters60/1023634
atttgagag

SEQ ID NO: 99088 - DNA, 9 bp, Unknown
  misc_feature (1)..( 9): Result.002 file - promoters60/1023634
ttttgagtg

SEQ ID NO: 99089 - DNA, 9 bp, Unknown
  misc_feature (1)..( 9): Result.002 file - promoters60/1023634
atttgaaat

SEQ ID NO: 99090 - DNA, 9 bp, Unknown
  misc_feature (1)..( 9): Result.002 file - promoters60/1023634
acttgggag

SEQ ID NO: 99091 - DNA, 9 bp, Unknown
  misc_feature (1)..( 9): Result.002 file - promoters60/1023634
atttgattc

SEQ ID NO: 99092 - DNA, 9 bp, Unknown
  misc_feature (1)..( 9): Result.002 file - promoters60/1023634
ctttgaagc

SEQ ID NO: 99093 - DNA, 9 bp, Unknown
  misc_feature (1)..( 9): Result.002 file - promoters60/1023634
gttttagag

SEQ ID NO: 99094 - DNA, 6 bp, Unknown
  misc_feature (1)..( 6): Result.002 file - promoters60/1023698
tatttt

SEQ ID NO: 99095 - DNA, 6 bp, Unknown
  misc_feature (1)..( 6): Result.002 file - promoters60/1023698
tatttt

SEQ ID NO: 99096 - DNA, 6 bp, Unknown
  misc_feature (1)..( 6): Result.002 file - promoters60/1023698
ttttta

SEQ ID NO: 99097 - DNA, 6 bp, Unknown
  misc_feature (1)..( 6): Result.002 file - promoters60/1023698
ttttta

SEQ ID NO: 99098 - DNA, 7 bp, Unknown
  misc_feature (1)..( 7): Result.002 file - promoters60/1023698
taaaatt

SEQ ID NO: 99099 - DNA, 7 bp, Unknown
  misc_feature (1)..( 7): Result.002 file - promoters60/1023698
taaaatt

SEQ ID NO: 99100 - DNA, 8 bp, Unknown
  misc_feature (1)..( 8): Result.002 file - promoters60/1023698
tacagtat

SEQ ID NO: 99101 - DNA, 8 bp, Unknown
  misc_feature (1)..( 8): Result.002 file - promoters60/1023698
tacattat

SEQ ID NO: 99102 - DNA, 7 bp, Unknown
  misc_feature (1)..( 7): Result.002 file - promoters60/1023698
ttatttt

SEQ ID NO: 99103 - DNA, 7 bp, Unknown
  misc_feature (1)..( 7): Result.002 file - promoters60/1023698
ttatttt

SEQ ID NO: 99104 - DNA, 9 bp, Unknown
  misc_feature (1)..( 9): Result.002 file - promoters60/1023698
aagtaaaaa

SEQ ID NO: 99105 - DNA, 9 bp, Unknown
  misc_feature (1)..( 9): Result.002 file - promoters60/1023698
aagcaaaaa

SEQ ID NO: 99106 - DNA, 9 bp, Unknown
  misc_feature (1)..( 9): Result.002 file - promoters60/1023698
aagcaaaaa

SEQ ID NO: 99107 - DNA, 8 bp, Unknown
  misc_feature (1)..( 8): Result.002 file - promoters60/1023698
ctttattt

SEQ ID NO: 99108 - DNA, 8 bp, Unknown
  misc_feature (1)..( 8): Result.002 file - promoters60/1023698
ctttatag

SEQ ID NO: 99109 - DNA, 8 bp, Unknown
  misc_feature (1)..( 8): Result.002 file - promoters60/1023698
ttttattt

SEQ ID NO: 99110 - DNA, 7 bp, Unknown
  misc_feature (1)..( 7): Result.002 file - promoters60/1023698
atttttt

SEQ ID NO: 99111 - DNA, 7 bp, Unknown
  misc_feature (1)..( 7): Result.002 file - promoters60/1023698
atttttt

SEQ ID NO: 99112 - DNA, 7 bp, Unknown
  misc_feature (1)..( 7): Result.002 file - promoters60/1023698
atttttt

SEQ ID NO: 99113 - DNA, 8 bp, Unknown
  misc_feature (1)..( 8): Result.002 file - promoters60/1023698
ataaaaat

SEQ ID NO: 99114 - DNA, 8 bp, Unknown
  misc_feature (1)..( 8): Result.002 file - promoters60/1023698
atagaaat

SEQ ID NO: 99115 - DNA, 10 bp, Unknown
  misc_feature (1)..( 10): Result.002 file - promoters60/1023698
aaaaataaaa

SEQ ID NO: 99116 - DNA, 10 bp, Unknown
  misc_feature (1)..( 10): Result.002 file - promoters60/1023698
gaaattaatt

SEQ ID NO: 99117 - DNA, 10 bp, Unknown
  misc_feature (1)..( 10): Result.002 file - promoters60/1023698
taaaatataa

SEQ ID NO: 99118 - DNA, 8 bp, Unknown
  misc_feature (1)..( 8): Result.002 file - promoters60/1023698
tttcaaaa

SEQ ID NO: 99119 - DNA, 8 bp, Unknown
  misc_feature (1)..( 8): Result.002 file - promoters60/1023698
tttcgaaa

SEQ ID NO: 99120 - DNA, 9 bp, Unknown
  misc_feature (1)..( 9): Result.002 file - promoters60/1023698
tcttaatag

SEQ ID NO: 99121 - DNA, 9 bp, Unknown
  misc_feature (1)..( 9): Result.002 file - promoters60/1023698
tcttaattt

SEQ ID NO: 99122 - DNA, 9 bp, Unknown
  misc_feature (1)..( 9): Result.002 file - promoters60/1023698
ttttaattt

SEQ ID NO: 99123 - DNA, 10 bp, Unknown
  misc_feature (1)..( 10): Result.002 file - promoters60/1023698
atatttagtt

SEQ ID NO: 99124 - DNA, 10 bp, Unknown
  misc_feature (1)..( 10): Result.002 file - promoters60/1023698
taattttgtt

SEQ ID NO: 99125 - DNA, 10 bp, Unknown
  misc_feature (1)..( 10): Result.002 file - promoters60/1023698
atatttagta

SEQ ID NO: 99126 - DNA, 7 bp, Unknown
  misc_feature (1)..( 7): Result.002 file - promoters60/1023698
acattat

SEQ ID NO: 99127 - DNA, 7 bp, Unknown
  misc_feature (1)..( 7): Result.002 file - promoters60/1023698
acattat

SEQ ID NO: 99128 - DNA, 8 bp, Unknown
  misc_feature (1)..( 8): Result.002 file - promoters60/1023698
taaacaat

SEQ ID NO: 99129 - DNA, 8 bp, Unknown
  misc_feature (1)..( 8): Result.002 file - promoters60/1023698
taaagaat

SEQ ID NO: 99130 - DNA, 8 bp, Unknown
  misc_feature (1)..( 8): Result.002 file - promoters60/1023698
aagattaa

SEQ ID NO: 99131 - DNA, 8 bp, Unknown
  misc_feature (1)..( 8): Result.002 file - promoters60/1023698
aagtttaa

SEQ ID NO: 99132 - DNA, 6 bp, Unknown
  misc_feature (1)..( 6): Result.002 file - promoters60/1023698
aaaact

SEQ ID NO: 99133 - DNA, 6 bp, Unknown
  misc_feature (1)..( 6): Result.002 file - promoters60/1023698
aaaact

SEQ ID NO: 99134 - DNA, 8 bp, Unknown
  misc_feature (1)..( 8): Result.002 file - promoters60/1023698
ctatgtgg

SEQ ID NO: 99135 - DNA, 8 bp, Unknown
  misc_feature (1)..( 8): Result.002 file - promoters60/1023698
ctatgtgg

SEQ ID NO: 99136 - DNA, 15 bp, Unknown
  misc_feature (1)..( 15): Result.002 file - promoters60/1023698
ggcatgaggtgtaaa

SEQ ID NO: 99137 - DNA, 15 bp, Unknown
  misc_feature (1)..( 15): Result.002 file - promoters60/1023698
ggcatgaggtgtaaa

SEQ ID NO: 99138 - DNA, 20 bp, Unknown
  misc_feature (1)..( 20): Result.002 file - promoters60/1023698
ttttatatataagcaaaaaa

SEQ ID NO: 99139 - DNA, 20 bp, Unknown
  misc_feature (1)..( 20): Result.002 file - promoters60/1023698
ttttttatataagcaaaaaa

SEQ ID NO: 99140 - DNA, 8 bp, Unknown
  misc_feature (1)..( 8): Result.002 file - promoters60/1023698
atcatcat

SEQ ID NO: 99141 - DNA, 8 bp, Unknown
  misc_feature (1)..( 8): Result.002 file - promoters60/1023698
atcatcat

SEQ ID NO: 99142 - DNA, 8 bp, Unknown
  misc_feature (1)..( 8): Result.002 file - promoters60/1023698
aaactaat

SEQ ID NO: 99143 - DNA, 8 bp, Unknown
  misc_feature (1)..( 8): Result.002 file - promoters60/1023698
aaattaat

SEQ ID NO: 99144 - DNA, 7 bp, Unknown
  misc_feature (1)..( 7): Result.002 file - promoters60/1023698
taatttt

SEQ ID NO: 99145 - DNA, 7 bp, Unknown
  misc_feature (1)..( 7): Result.002 file - promoters60/1023698
taatttt

SEQ ID NO: 99146 - DNA, 11 bp, Unknown
  misc_feature (1)..( 11): Result.002 file - promoters60/1023698
ttattgtaaac

SEQ ID NO: 99147 - DNA, 11 bp, Unknown
  misc_feature (1)..( 11): Result.002 file - promoters60/1023698
ttattgtaaac

SEQ ID NO: 99148 - DNA, 15 bp, Unknown
  misc_feature (1)..( 15): Result.002 file - promoters60/1023698
tttgcttctactata

SEQ ID NO: 99149 - DNA, 15 bp, Unknown
  misc_feature (1)..( 15): Result.002 file - promoters60/1023698
tttgcttctactata

SEQ ID NO: 99150 - DNA, 19 bp, Unknown
  misc_feature (1)..( 19): Result.002 file - promoters60/1023698
ctcatcttgatcaaatctc

SEQ ID NO: 99151 - DNA, 19 bp, Unknown
  misc_feature (1)..( 19): Result.002 file - promoters60/1023698
ctcctcttgatcaaatctc

SEQ ID NO: 99152 - DNA, 6 bp, Unknown
  misc_feature (1)..( 6): Result.002 file - promoters60/1023698
aatttc

SEQ ID NO: 99153 - DNA, 6 bp, Unknown
  misc_feature (1)..( 6): Result.002 file - promoters60/1023698
aatttc

SEQ ID NO: 99154 - DNA, 7 bp, Unknown
  misc_feature (1)..( 7): Result.002 file - promoters60/1023698
taattta

SEQ ID NO: 99155 - DNA, 7 bp, Unknown
  misc_feature (1)..( 7): Result.002 file - promoters60/1023698
taattta

SEQ ID NO: 99156 - DNA, 6 bp, Unknown
  misc_feature (1)..( 6): Result.002 file - promoters60/1023698
aaatct

SEQ ID NO: 99157 - DNA, 6 bp, Unknown
  misc_feature (1)..( 6): Result.002 file - promoters60/1023698
aaatct

SEQ ID NO: 99158 - DNA, 12 bp, Unknown
  misc_feature (1)..( 12): Result.002 file - promoters60/1023698
tacactattttt

SEQ ID NO: 99159 - DNA, 12 bp, Unknown
  misc_feature (1)..( 12): Result.002 file - promoters60/1023698
tacattattttt

SEQ ID NO: 99160 - DNA, 10 bp, Unknown
  misc_feature (1)..( 10): Result.002 file - promoters60/1023782
aaaataatct

SEQ ID NO: 99161 - DNA, 10 bp, Unknown
  misc_feature (1)..( 10): Result.002 file - promoters60/1023782
aaaataaaat

SEQ ID NO: 99162 - DNA, 11 bp, Unknown
  misc_feature (1)..( 11): Result.002 file - promoters60/1023782
gaaatgaaata

SEQ ID NO: 99163 - DNA, 7 bp, Unknown
  misc_feature (1)..( 7): Result.002 file - promoters60/1023782
ttaaaac

SEQ ID NO: 99164 - DNA, 7 bp, Unknown
  misc_feature (1)..( 7): Result.002 file - promoters60/1023782
gtaaaac

SEQ ID NO: 99165 - DNA, 7 bp, Unknown
  misc_feature (1)..( 7): Result.002 file - promoters60/1023782
gtaaaac

SEQ ID NO: 99166 - DNA, 10 bp, Unknown
  misc_feature (1)..( 10): Result.002 file - promoters60/1023782
ataaatcaaa

SEQ ID NO: 99167 - DNA, 10 bp, Unknown
  misc_feature (1)..( 10): Result.002 file - promoters60/1023782
ggaaatgaaa

SEQ ID NO: 99168 - DNA, 10 bp, Unknown
  misc_feature (1)..( 10): Result.002 file - promoters60/1023782
ggaaaagaaa

SEQ ID NO: 99169 - DNA, 7 bp, Unknown
  misc_feature (1)..( 7): Result.002 file - promoters60/1023782
aaaccca

SEQ ID NO: 99170 - DNA, 7 bp, Unknown
  misc_feature (1)..( 7): Result.002 file - promoters60/1023782
gaaccca

SEQ ID NO: 99171 - DNA, 7 bp, Unknown
  misc_feature (1)..( 7): Result.002 file - promoters60/1023782
gaacccg

SEQ ID NO: 99172 - DNA, 10 bp, Unknown
  misc_feature (1)..( 10): Result.002 file - promoters60/1023782
gatacttaaa

SEQ ID NO: 99173 - DNA, 10 bp, Unknown
  misc_feature (1)..( 10): Result.002 file - promoters60/1023782
gatatttata

SEQ ID NO: 99174 - DNA, 10 bp, Unknown
  misc_feature (1)..( 10): Result.002 file - promoters60/1023782
ccgattaata

SEQ ID NO: 99175 - DNA, 10 bp, Unknown
  misc_feature (1)..( 10): Result.002 file - promoters60/1023782
atattttctt

SEQ ID NO: 99176 - DNA, 10 bp, Unknown
  misc_feature (1)..( 10): Result.002 file - promoters60/1023782
atatttttta

SEQ ID NO: 99177 - DNA, 10 bp, Unknown
  misc_feature (1)..( 10): Result.002 file - promoters60/1023782
caatttgtta

SEQ ID NO: 99178 - DNA, 6 bp, Unknown
  misc_feature (1)..( 6): Result.002 file - promoters60/1023891
ttatat

SEQ ID NO: 99179 - DNA, 6 bp, Unknown
  misc_feature (1)..( 6): Result.002 file - promoters60/1023891
ttatat

SEQ ID NO: 99180 - DNA, 7 bp, Unknown
  misc_feature (1)..( 7): Result.002 file - promoters60/1023891
tatactc

SEQ ID NO: 99181 - DNA, 7 bp, Unknown
  misc_feature (1)..( 7): Result.002 file - promoters60/1023891
tatcctc

SEQ ID NO: 99182 - DNA, 9 bp, Unknown
  misc_feature (1)..( 9): Result.002 file - promoters60/1023891
ttatatttt

SEQ ID NO: 99183 - DNA, 9 bp, Unknown
  misc_feature (1)..( 9): Result.002 file - promoters60/1023891
taataattt

SEQ ID NO: 99184 - DNA, 9 bp, Unknown
  misc_feature (1)..( 9): Result.002 file - promoters60/1023891
taaaaattt

SEQ ID NO: 99185 - DNA, 8 bp, Unknown
  misc_feature (1)..( 8): Result.002 file - promoters60/1023891
aaaggaaa

SEQ ID NO: 99186 - DNA, 8 bp, Unknown
  misc_feature (1)..( 8): Result.002 file - promoters60/1023891
aaaagaaa

SEQ ID NO: 99187 - DNA, 12 bp, Unknown
  misc_feature (1)..( 12): Result.002 file - promoters60/1023891
agtcaacaaaag

SEQ ID NO: 99188 - DNA, 12 bp, Unknown
  misc_feature (1)..( 12): Result.002 file - promoters60/1023891
agtcaataaaag

SEQ ID NO: 99189 - DNA, 6 bp, Unknown
  misc_feature (1)..( 6): Result.002 file - promoters60/1023891
gtaacg

SEQ ID NO: 99190 - DNA, 6 bp, Unknown
  misc_feature (1)..( 6): Result.002 file - promoters60/1023891
gtaacg

SEQ ID NO: 99191 - DNA, 9 bp, Unknown
  misc_feature (1)..( 9): Result.002 file - promoters60/1023891
ctttctata

SEQ ID NO: 99192 - DNA, 9 bp, Unknown
  misc_feature (1)..( 9): Result.002 file - promoters60/1023891
ctttatata

SEQ ID NO: 99193 - DNA, 6 bp, Unknown
  misc_feature (1)..( 6): Result.002 file - promoters60/1023891
aaaaac

SEQ ID NO: 99194 - DNA, 6 bp, Unknown
  misc_feature (1)..( 6): Result.002 file - promoters60/1023891
aaaaac

SEQ ID NO: 99195 - DNA, 7 bp, Unknown
  misc_feature (1)..( 7): Result.002 file - promoters60/1023891
aaattca

SEQ ID NO: 99196 - DNA, 7 bp, Unknown
  misc_feature (1)..( 7): Result.002 file - promoters60/1023891
aaaatca

SEQ ID NO: 99197 - DNA, 8 bp, Unknown
  misc_feature (1)..( 8): Result.002 file - promoters60/1023891
cattcaaa

SEQ ID NO: 99198 - DNA, 8 bp, Unknown
  misc_feature (1)..( 8): Result.002 file - promoters60/1023891
catttaaa

SEQ ID NO: 99199 - DNA, 7 bp, Unknown
  misc_feature (1)..( 7): Result.002 file - promoters60/1023891
attcatt

SEQ ID NO: 99200 - DNA, 7 bp, Unknown
  misc_feature (1)..( 7): Result.002 file - promoters60/1023891
atttatt

SEQ ID NO: 99201 - DNA, 6 bp, Unknown
  misc_feature (1)..( 6): Result.002 file - promoters60/1023891
actaaa

SEQ ID NO: 99202 - DNA, 6 bp, Unknown
  misc_feature (1)..( 6): Result.002 file - promoters60/1023891
actaaa

SEQ ID NO: 99203 - DNA, 10 bp, Unknown
  misc_feature (1)..( 10): Result.002 file - promoters60/1023891
aaagttttaa

SEQ ID NO: 99204 - DNA, 10 bp, Unknown
  misc_feature (1)..( 10): Result.002 file - promoters60/1023891
aaaattttaa

SEQ ID NO: 99205 - DNA, 10 bp, Unknown
  misc_feature (1)..( 10): Result.002 file - promoters60/1023891
gatattttat

SEQ ID NO: 99206 - DNA, 6 bp, Unknown
  misc_feature (1)..( 6): Result.002 file - promoters60/1023891
aatgtc

SEQ ID NO: 99207 - DNA, 6 bp, Unknown
  misc_feature (1)..( 6): Result.002 file - promoters60/1023891
aatgtc

SEQ ID NO: 99208 - DNA, 6 bp, Unknown
  misc_feature (1)..( 6): Result.002 file - promoters60/1023891
tagaat

SEQ ID NO: 99209 - DNA, 6 bp, Unknown
  misc_feature (1)..( 6): Result.002 file - promoters60/1023891
tagaat

SEQ ID NO: 99210 - DNA, 11 bp, Unknown
  misc_feature (1)..( 11): Result.002 file - promoters60/1023891
ataagagaaga

SEQ ID NO: 99211 - DNA, 11 bp, Unknown
  misc_feature (1)..( 11): Result.002 file - promoters60/1023891
ataagataaga

SEQ ID NO: 99212 - DNA, 6 bp, Unknown
  misc_feature (1)..( 6): Result.002 file - promoters60/1023891
aaaaag

SEQ ID NO: 99213 - DNA, 6 bp, Unknown
  misc_feature (1)..( 6): Result.002 file - promoters60/1023891
aaaaag

SEQ ID NO: 99214 - DNA, 6 bp, Unknown
  misc_feature (1)..( 6): Result.002 file - promoters60/1023891
acacaa

SEQ ID NO: 99215 - DNA, 6 bp, Unknown
  misc_feature (1)..( 6): Result.002 file - promoters60/1023891
acacaa

SEQ ID NO: 99216 - DNA, 6 bp, Unknown
  misc_feature (1)..( 6): Result.002 file - promoters60/1023891
tgtcac

SEQ ID NO: 99217 - DNA, 6 bp, Unknown
  misc_feature (1)..( 6): Result.002 file - promoters60/1023891
tgtcac

SEQ ID NO: 99218 - DNA, 6 bp, Unknown
  misc_feature (1)..( 6): Result.002 file - promoters60/1023891
acattt

SEQ ID NO: 99219 - DNA, 6 bp, Unknown
  misc_feature (1)..( 6): Result.002 file - promoters60/1023891
acattt

SEQ ID NO: 99220 - DNA, 8 bp, Unknown
  misc_feature (1)..( 8): Result.002 file - promoters60/1023891
agtagcca

SEQ ID NO: 99221 - DNA, 8 bp, Unknown
  misc_feature (1)..( 8): Result.002 file - promoters60/1023891
agtaacca

SEQ ID NO: 99222 - DNA, 12 bp, Unknown
  misc_feature (1)..( 12): Result.002 file - promoters60/1023963
cgctacaaataa

SEQ ID NO: 99223 - DNA, 12 bp, Unknown
  misc_feature (1)..( 12): Result.002 file - promoters60/1023963
aagaacacataa

SEQ ID NO: 99224 - DNA, 12 bp, Unknown
  misc_feature (1)..( 12): Result.002 file - promoters60/1023963
ttttacaaatgt

SEQ ID NO: 99225 - DNA, 12 bp, Unknown
  misc_feature (1)..( 12): Result.002 file - promoters60/1023963
gaaaacacataa

SEQ ID NO: 99226 - DNA, 12 bp, Unknown
  misc_feature (1)..( 12): Result.002 file - promoters60/1023963
gaagacaactat

SEQ ID NO: 99227 - DNA, 12 bp, Unknown
  misc_feature (1)..( 12): Result.002 file - promoters60/1023963
gaagactgacga

SEQ ID NO: 99228 - DNA, 12 bp, Unknown
  misc_feature (1)..( 12): Result.002 file - promoters60/1023963
acattaaaaaaa

SEQ ID NO: 99229 - DNA, 12 bp, Unknown
  misc_feature (1)..( 12): Result.002 file - promoters60/1023963
attttagaaaag

SEQ ID NO: 99230 - DNA, 12 bp, Unknown
  misc_feature (1)..( 12): Result.002 file - promoters60/1023963
acattgaaatgt

SEQ ID NO: 99231 - DNA, 12 bp, Unknown
  misc_feature (1)..( 12): Result.002 file - promoters60/1023963
agagtaaataat

SEQ ID NO: 99232 - DNA, 12 bp, Unknown
  misc_feature (1)..( 12): Result.002 file - promoters60/1023963
acagtgatcatc

SEQ ID NO: 99233 - DNA, 12 bp, Unknown
  misc_feature (1)..( 12): Result.002 file - promoters60/1023963
aacgtatatatg

SEQ ID NO: 99234 - DNA, 6 bp, Unknown
  misc_feature (1)..( 6): Result.002 file - promoters60/1024037
ttacaa

SEQ ID NO: 99235 - DNA, 6 bp, Unknown
  misc_feature (1)..( 6): Result.002 file - promoters60/1024037
ttacaa

SEQ ID NO: 99236 - DNA, 6 bp, Unknown
  misc_feature (1)..( 6): Result.002 file - promoters60/1024037
tattat

SEQ ID NO: 99237 - DNA, 6 bp, Unknown
  misc_feature (1)..( 6): Result.002 file - promoters60/1024037
tattat

SEQ ID NO: 99238 - DNA, 8 bp, Unknown
  misc_feature (1)..( 8): Result.002 file - promoters60/1024037
aaactctt

SEQ ID NO: 99239 - DNA, 8 bp, Unknown
  misc_feature (1)..( 8): Result.002 file - promoters60/1024037
aaaatctt

SEQ ID NO: 99240 - DNA, 8 bp, Unknown
  misc_feature (1)..( 8): Result.002 file - promoters60/1024037
atattatt

SEQ ID NO: 99241 - DNA, 8 bp, Unknown
  misc_feature (1)..( 8): Result.002 file - promoters60/1024037
atactatt

SEQ ID NO: 99242 - DNA, 7 bp, Unknown
  misc_feature (1)..( 7): Result.002 file - promoters60/1024037
ttaatac

SEQ ID NO: 99243 - DNA, 7 bp, Unknown
  misc_feature (1)..( 7): Result.002 file - promoters60/1024037
ttaatac

SEQ ID NO: 99244 - DNA, 7 bp, Unknown
  misc_feature (1)..( 7): Result.002 file - promoters60/1024037
attaata

SEQ ID NO: 99245 - DNA, 7 bp, Unknown
  misc_feature (1)..( 7): Result.002 file - promoters60/1024037
attgata

SEQ ID NO: 99246 - DNA, 11 bp, Unknown
  misc_feature (1)..( 11): Result.002 file - promoters60/1024037
taagtatgtat

SEQ ID NO: 99247 - DNA, 11 bp, Unknown
  misc_feature (1)..( 11): Result.002 file - promoters60/1024037
taattatatat

SEQ ID NO: 99248 - DNA, 6 bp, Unknown
  misc_feature (1)..( 6): Result.002 file - promoters60/1024037
agactt

SEQ ID NO: 99249 - DNA, 6 bp, Unknown
  misc_feature (1)..( 6): Result.002 file - promoters60/1024037
agactt

SEQ ID NO: 99250 - DNA, 6 bp, Unknown
  misc_feature (1)..( 6): Result.002 file - promoters60/1024037
aagcca

SEQ ID NO: 99251 - DNA, 6 bp, Unknown
  misc_feature (1)..( 6): Result.002 file - promoters60/1024037
aagcca

SEQ ID NO: 99252 - DNA, 7 bp, Unknown
  misc_feature (1)..( 7): Result.002 file - promoters60/1024037
acaattt

SEQ ID NO: 99253 - DNA, 7 bp, Unknown
  misc_feature (1)..( 7): Result.002 file - promoters60/1024037
acaattt

SEQ ID NO: 99254 - DNA, 7 bp, Unknown
  misc_feature (1)..( 7): Result.002 file - promoters60/1024037
atgcatg

SEQ ID NO: 99255 - DNA, 7 bp, Unknown
  misc_feature (1)..( 7): Result.002 file - promoters60/1024037
atgtatg

SEQ ID NO: 99256 - DNA, 7 bp, Unknown
  misc_feature (1)..( 7): Result.002 file - promoters60/1024037
aatttag

SEQ ID NO: 99257 - DNA, 7 bp, Unknown
  misc_feature (1)..( 7): Result.002 file - promoters60/1024037
aatttag

SEQ ID NO: 99258 - DNA, 7 bp, Unknown
  misc_feature (1)..( 7): Result.002 file - promoters60/1024037
gatttag

SEQ ID NO: 99259 - DNA, 6 bp, Unknown
  misc_feature (1)..( 6): Result.002 file - promoters60/1024037
gctgac

SEQ ID NO: 99260 - DNA, 6 bp, Unknown
  misc_feature (1)..( 6): Result.002 file - promoters60/1024037
gctgac

SEQ ID NO: 99261 - DNA, 7 bp, Unknown
  misc_feature (1)..( 7): Result.002 file - promoters60/1024037
ttcgtca

SEQ ID NO: 99262 - DNA, 7 bp, Unknown
  misc_feature (1)..( 7): Result.002 file - promoters60/1024037
ttcttca

SEQ ID NO: 99263 - DNA, 6 bp, Unknown
  misc_feature (1)..( 6): Result.002 file - promoters60/1024037
ataaca

SEQ ID NO: 99264 - DNA, 6 bp, Unknown
  misc_feature (1)..( 6): Result.002 file - promoters60/1024037
ataaca

SEQ ID NO: 99265 - DNA, 6 bp, Unknown
  misc_feature (1)..( 6): Result.002 file - promoters60/1024037
tggttg

SEQ ID NO: 99266 - DNA, 6 bp, Unknown
  misc_feature (1)..( 6): Result.002 file - promoters60/1024037
tggttg

SEQ ID NO: 99267 - DNA, 10 bp, Unknown
  misc_feature (1)..( 10): Result.002 file - promoters60/1024060
taatgataat

SEQ ID NO: 99268 - DNA, 10 bp, Unknown
  misc_feature (1)..( 10): Result.002 file - promoters60/1024060
aaattataag

SEQ ID NO: 99269 - DNA, 10 bp, Unknown
  misc_feature (1)..( 10): Result.002 file - promoters60/1024060
cccggataat

SEQ ID NO: 99270 - DNA, 10 bp, Unknown
  misc_feature (1)..( 10): Result.002 file - promoters60/1024060
aaactatata

SEQ ID NO: 99271 - DNA, 11 bp, Unknown
  misc_feature (1)..( 11): Result.002 file - promoters60/1024083
ttccttttttt

SEQ ID NO: 99272 - DNA, 11 bp, Unknown
  misc_feature (1)..( 11): Result.002 file - promoters60/1024083
ttcgttttttt

SEQ ID NO: 99273 - DNA, 11 bp, Unknown
  misc_feature (1)..( 11): Result.002 file - promoters60/1024083
tataggtttta

SEQ ID NO: 99274 - DNA, 11 bp, Unknown
  misc_feature (1)..( 11): Result.002 file - promoters60/1024083
attagattttt

SEQ ID NO: 99275 - DNA, 12 bp, Unknown
  misc_feature (1)..( 12): Result.002 file - promoters60/1024083
attcgatctttt

SEQ ID NO: 99276 - DNA, 9 bp, Unknown
  misc_feature (1)..( 9): Result.002 file - promoters60/1024083
tagactaaa

SEQ ID NO: 99277 - DNA, 9 bp, Unknown
  misc_feature (1)..( 9): Result.002 file - promoters60/1024083
tagaataaa

SEQ ID NO: 99278 - DNA, 8 bp, Unknown
  misc_feature (1)..( 8): Result.002 file - promoters60/1024083
aaaagtaa

SEQ ID NO: 99279 - DNA, 8 bp, Unknown
  misc_feature (1)..( 8): Result.002 file - promoters60/1024083
aaaattaa

SEQ ID NO: 99280 - DNA, 8 bp, Unknown
  misc_feature (1)..( 8): Result.002 file - promoters60/1024083
taaattag

SEQ ID NO: 99281 - DNA, 6 bp, Unknown
  misc_feature (1)..( 6): Result.002 file - promoters60/1024083
acattt

SEQ ID NO: 99282 - DNA, 6 bp, Unknown
  misc_feature (1)..( 6): Result.002 file - promoters60/1024083
acattt

SEQ ID NO: 99283 - DNA, 7 bp, Unknown
  misc_feature (1)..( 7): Result.002 file - promoters60/1024083
atttaca

SEQ ID NO: 99284 - DNA, 7 bp, Unknown
  misc_feature (1)..( 7): Result.002 file - promoters60/1024083
atttaca

SEQ ID NO: 99285 - DNA, 7 bp, Unknown
  misc_feature (1)..( 7): Result.002 file - promoters60/1024083
tttaaaa

SEQ ID NO: 99286 - DNA, 7 bp, Unknown
  misc_feature (1)..( 7): Result.002 file - promoters60/1024083
tttaaaa

SEQ ID NO: 99287 - DNA, 6 bp, Unknown
  misc_feature (1)..( 6): Result.002 file - promoters60/1024083
agtttg

SEQ ID NO: 99288 - DNA, 6 bp, Unknown
  misc_feature (1)..( 6): Result.002 file - promoters60/1024083
agtttg

SEQ ID NO: 99289 - DNA, 7 bp, Unknown
  misc_feature (1)..( 7): Result.002 file - promoters60/1024083
attaata

SEQ ID NO: 99290 - DNA, 7 bp, Unknown
  misc_feature (1)..( 7): Result.002 file - promoters60/1024083
attaata

SEQ ID NO: 99291 - DNA, 6 bp, Unknown
  misc_feature (1)..( 6): Result.002 file - promoters60/1024083
tctttt

SEQ ID NO: 99292 - DNA, 6 bp, Unknown
  misc_feature (1)..( 6): Result.002 file - promoters60/1024083
tctttt

SEQ ID NO: 99293 - DNA, 8 bp, Unknown
  misc_feature (1)..( 8): Result.002 file - promoters60/1024083
atattttt

SEQ ID NO: 99294 - DNA, 8 bp, Unknown
  misc_feature (1)..( 8): Result.002 file - promoters60/1024083
atattttt

SEQ ID NO: 99295 - DNA, 6 bp, Unknown
  misc_feature (1)..( 6): Result.002 file - promoters60/1024083
acaaaa

SEQ ID NO: 99296 - DNA, 6 bp, Unknown
  misc_feature (1)..( 6): Result.002 file - promoters60/1024083
acaaaa

SEQ ID NO: 99297 - DNA, 8 bp, Unknown
  misc_feature (1)..( 8): Result.002 file - promoters60/1024083
ttattctt

SEQ ID NO: 99298 - DNA, 8 bp, Unknown
  misc_feature (1)..( 8): Result.002 file - promoters60/1024083
ttatcctt

SEQ ID NO: 99299 - DNA, 7 bp, Unknown
  misc_feature (1)..( 7): Result.002 file - promoters60/1024083
attctat

SEQ ID NO: 99300 - DNA, 7 bp, Unknown
  misc_feature (1)..( 7): Result.002 file - promoters60/1024083
attttat

SEQ ID NO: 99301 - DNA, 7 bp, Unknown
  misc_feature (1)..( 7): Result.002 file - promoters60/1024083
aaaacaa

SEQ ID NO: 99302 - DNA, 7 bp, Unknown
  misc_feature (1)..( 7): Result.002 file - promoters60/1024083
aaaacaa

SEQ ID NO: 99303 - DNA, 7 bp, Unknown
  misc_feature (1)..( 7): Result.002 file - promoters60/1024083
atagtta

SEQ ID NO: 99304 - DNA, 7 bp, Unknown
  misc_feature (1)..( 7): Result.002 file - promoters60/1024083
atattta

SEQ ID NO: 99305 - DNA, 8 bp, Unknown
  misc_feature (1)..( 8): Result.002 file - promoters60/1024083
ttacttat

SEQ ID NO: 99306 - DNA, 8 bp, Unknown
  misc_feature (1)..( 8): Result.002 file - promoters60/1024083
ttacttat

SEQ ID NO: 99307 - DNA, 7 bp, Unknown
  misc_feature (1)..( 7): Result.002 file - promoters60/1024083
attagaa

SEQ ID NO: 99308 - DNA, 7 bp, Unknown
  misc_feature (1)..( 7): Result.002 file - promoters60/1024083
attagaa

SEQ ID NO: 99309 - DNA, 6 bp, Unknown
  misc_feature (1)..( 6): Result.002 file - promoters60/1024083
tttgat

SEQ ID NO: 99310 - DNA, 6 bp, Unknown
  misc_feature (1)..( 6): Result.002 file - promoters60/1024083
tttgat

SEQ ID NO: 99311 - DNA, 6 bp, Unknown
  misc_feature (1)..( 6): Result.002 file - promoters60/1024083
attttg

SEQ ID NO: 99312 - DNA, 6 bp, Unknown
  misc_feature (1)..( 6): Result.002 file - promoters60/1024083
attttg

SEQ ID NO: 99313 - DNA, 6 bp, Unknown
  misc_feature (1)..( 6): Result.002 file - promoters60/1024083
aaaaat

SEQ ID NO: 99314 - DNA, 6 bp, Unknown
  misc_feature (1)..( 6): Result.002 file - promoters60/1024083
aaaaat

SEQ ID NO: 99315 - DNA, 6 bp, Unknown
  misc_feature (1)..( 6): Result.002 file - promoters60/1024083
ggtctc

SEQ ID NO: 99316 - DNA, 6 bp, Unknown
  misc_feature (1)..( 6): Result.002 file - promoters60/1024083
ggtctc

SEQ ID NO: 99317 - DNA, 8 bp, Unknown
  misc_feature (1)..( 8): Result.002 file - promoters60/1024083
taaaatcc

SEQ ID NO: 99318 - DNA, 8 bp, Unknown
  misc_feature (1)..( 8): Result.002 file - promoters60/1024083
taaactcc

SEQ ID NO: 99319 - DNA, 12 bp, Unknown
  misc_feature (1)..( 12): Result.002 file - promoters60/1024126
taaatcactcct

SEQ ID NO: 99320 - DNA, 12 bp, Unknown
  misc_feature (1)..( 12): Result.002 file - promoters60/1024126
tcaatctctcta

SEQ ID NO: 99321 - DNA, 12 bp, Unknown
  misc_feature (1)..( 12): Result.002 file - promoters60/1024126
atgatcactggt

SEQ ID NO: 99322 - DNA, 12 bp, Unknown
  misc_feature (1)..( 12): Result.002 file - promoters60/1024126
cgtatcaatggt

SEQ ID NO: 99323 - DNA, 12 bp, Unknown
  misc_feature (1)..( 12): Result.002 file - promoters60/1024126
gtaacaaactgt

SEQ ID NO: 99324 - DNA, 12 bp, Unknown
  misc_feature (1)..( 12): Result.002 file - promoters60/1024126
ataagaaatata

SEQ ID NO: 99325 - DNA, 12 bp, Unknown
  misc_feature (1)..( 12): Result.002 file - promoters60/1024126
attatcgatgat

SEQ ID NO: 99326 - DNA, 8 bp, Unknown
  misc_feature (1)..( 8): Result.002 file - promoters60/1024126
ataaaagt

SEQ ID NO: 99327 - DNA, 8 bp, Unknown
  misc_feature (1)..( 8): Result.002 file - promoters60/1024126
ctaaaaga

SEQ ID NO: 99328 - DNA, 8 bp, Unknown
  misc_feature (1)..( 8): Result.002 file - promoters60/1024126
aaaaaagt

SEQ ID NO: 99329 - DNA, 8 bp, Unknown
  misc_feature (1)..( 8): Result.002 file - promoters60/1024126
aaaaaagc

SEQ ID NO: 99330 - DNA, 8 bp, Unknown
  misc_feature (1)..( 8): Result.002 file - promoters60/1024126
aaaaaaaa

SEQ ID NO: 99331 - DNA, 8 bp, Unknown
  misc_feature (1)..( 8): Result.002 file - promoters60/1024126
taaaaagg

SEQ ID NO: 99332 - DNA, 9 bp, Unknown
  misc_feature (1)..( 9): Result.002 file - promoters60/1024126
aaaacacat

SEQ ID NO: 99333 - DNA, 9 bp, Unknown
  misc_feature (1)..( 9): Result.002 file - promoters60/1024126
aaaacagaa

SEQ ID NO: 99334 - DNA, 9 bp, Unknown
  misc_feature (1)..( 9): Result.002 file - promoters60/1024126
aaatcacaa

SEQ ID NO: 99335 - DNA, 9 bp, Unknown
  misc_feature (1)..( 9): Result.002 file - promoters60/1024126
gaaaccgaa

SEQ ID NO: 99336 - DNA, 9 bp, Unknown
  misc_feature (1)..( 9): Result.002 file - promoters60/1024126
aaatcatgt

SEQ ID NO: 99337 - DNA, 9 bp, Unknown
  misc_feature (1)..( 9): Result.002 file - promoters60/1024126
aaatcatgt

SEQ ID NO: 99338 - DNA, 9 bp, Unknown
  misc_feature (1)..( 9): Result.002 file - promoters60/1024145
gagcgatga

SEQ ID NO: 99339 - DNA, 9 bp, Unknown
  misc_feature (1)..( 9): Result.002 file - promoters60/1024145
gagcgctga

SEQ ID NO: 99340 - DNA, 7 bp, Unknown
  misc_feature (1)..( 7): Result.002 file - promoters60/1024145
tgagaga

SEQ ID NO: 99341 - DNA, 7 bp, Unknown
  misc_feature (1)..( 7): Result.002 file - promoters60/1024145
tgaaaga

SEQ ID NO: 99342 - DNA, 8 bp, Unknown
  misc_feature (1)..( 8): Result.002 file - promoters60/1024145
aaatctaa

SEQ ID NO: 99343 - DNA, 8 bp, Unknown
  misc_feature (1)..( 8): Result.002 file - promoters60/1024145
aaatgtaa

SEQ ID NO: 99344 - DNA, 6 bp, Unknown
  misc_feature (1)..( 6): Result.002 file - promoters60/1024145
ccggtt

SEQ ID NO: 99345 - DNA, 6 bp, Unknown
  misc_feature (1)..( 6): Result.002 file - promoters60/1024145
ccggtt

SEQ ID NO: 99346 - DNA, 11 bp, Unknown
  misc_feature (1)..( 11): Result.002 file - promoters60/1024145
tctggtcaaac

SEQ ID NO: 99347 - DNA, 11 bp, Unknown
  misc_feature (1)..( 11): Result.002 file - promoters60/1024145
tctggtcaaac

SEQ ID NO: 99348 - DNA, 6 bp, Unknown
  misc_feature (1)..( 6): Result.002 file - promoters60/1024145
attatt

SEQ ID NO: 99349 - DNA, 6 bp, Unknown
  misc_feature (1)..( 6): Result.002 file - promoters60/1024145
attatt

SEQ ID NO: 99350 - DNA, 8 bp, Unknown
  misc_feature (1)..( 8): Result.002 file - promoters60/1024145
gtgtcaaa

SEQ ID NO: 99351 - DNA, 8 bp, Unknown
  misc_feature (1)..( 8): Result.002 file - promoters60/1024145
gtgacaaa

SEQ ID NO: 99352 - DNA, 7 bp, Unknown
  misc_feature (1)..( 7): Result.002 file - promoters60/1024145
attcttt

SEQ ID NO: 99353 - DNA, 7 bp, Unknown
  misc_feature (1)..( 7): Result.002 file - promoters60/1024145
atttttt

SEQ ID NO: 99354 - DNA, 8 bp, Unknown
  misc_feature (1)..( 8): Result.002 file - promoters60/1024145
gttttcct

SEQ ID NO: 99355 - DNA, 8 bp, Unknown
  misc_feature (1)..( 8): Result.002 file - promoters60/1024145
gtttccct

SEQ ID NO: 99356 - DNA, 11 bp, Unknown
  misc_feature (1)..( 11): Result.002 file - promoters60/1024166
ataacaaaaaa

SEQ ID NO: 99357 - DNA, 11 bp, Unknown
  misc_feature (1)..( 11): Result.002 file - promoters60/1024166
ttaaaaaaaaa

SEQ ID NO: 99358 - DNA, 11 bp, Unknown
  misc_feature (1)..( 11): Result.002 file - promoters60/1024166
aaaccaaaaaa

SEQ ID NO: 99359 - DNA, 11 bp, Unknown
  misc_feature (1)..( 11): Result.002 file - promoters60/1024166
ggaagaaaaaa

SEQ ID NO: 99360 - DNA, 11 bp, Unknown
  misc_feature (1)..( 11): Result.002 file - promoters60/1024166
attataaacaa

SEQ ID NO: 99361 - DNA, 11 bp, Unknown
  misc_feature (1)..( 11): Result.002 file - promoters60/1024166
gttccaaaagt

SEQ ID NO: 99362 - DNA, 10 bp, Unknown
  misc_feature (1)..( 10): Result.002 file - promoters60/1024166
aggaatgatt

SEQ ID NO: 99363 - DNA, 10 bp, Unknown
  misc_feature (1)..( 10): Result.002 file - promoters60/1024166
atgaatgaac

SEQ ID NO: 99364 - DNA, 10 bp, Unknown
  misc_feature (1)..( 10): Result.002 file - promoters60/1024166
agaaatcatt

SEQ ID NO: 99365 - DNA, 10 bp, Unknown
  misc_feature (1)..( 10): Result.002 file - promoters60/1024166
atcaataaac

SEQ ID NO: 99366 - DNA, 10 bp, Unknown
  misc_feature (1)..( 10): Result.002 file - promoters60/1024166
atctataaaa

SEQ ID NO: 99367 - DNA, 11 bp, Unknown
  misc_feature (1)..( 11): Result.002 file - promoters60/1024166
agttatgtttt

SEQ ID NO: 99368 - DNA, 11 bp, Unknown
  misc_feature (1)..( 11): Result.002 file - promoters60/1024166
agtcatgcaac

SEQ ID NO: 99369 - DNA, 11 bp, Unknown
  misc_feature (1)..( 11): Result.002 file - promoters60/1024166
atttatgtata

SEQ ID NO: 99370 - DNA, 11 bp, Unknown
  misc_feature (1)..( 11): Result.002 file - promoters60/1024166
tattatttttt

SEQ ID NO: 99371 - DNA, 11 bp, Unknown
  misc_feature (1)..( 11): Result.002 file - promoters60/1024166
taatatatatt

SEQ ID NO: 99372 - DNA, 10 bp, Unknown
  misc_feature (1)..( 10): Result.002 file - promoters60/1024189
taaaaatgaa

SEQ ID NO: 99373 - DNA, 10 bp, Unknown
  misc_feature (1)..( 10): Result.002 file - promoters60/1024189
taaaaagtct

SEQ ID NO: 99374 - DNA, 10 bp, Unknown
  misc_feature (1)..( 10): Result.002 file - promoters60/1024189
aaaaaaagaa

SEQ ID NO: 99375 - DNA, 10 bp, Unknown
  misc_feature (1)..( 10): Result.002 file - promoters60/1024189
gaaaaagggt

SEQ ID NO: 99376 - DNA, 12 bp, Unknown
  misc_feature (1)..( 12): Result.002 file - promoters60/1024189
atataataaata

SEQ ID NO: 99377 - DNA, 12 bp, Unknown
  misc_feature (1)..( 12): Result.002 file - promoters60/1024189
gcataaaaaata

SEQ ID NO: 99378 - DNA, 12 bp, Unknown
  misc_feature (1)..( 12): Result.002 file - promoters60/1024189
ttattatacttc

SEQ ID NO: 99379 - DNA, 12 bp, Unknown
  misc_feature (1)..( 12): Result.002 file - promoters60/1024189
atataattatct

SEQ ID NO: 99380 - DNA, 12 bp, Unknown
  misc_feature (1)..( 12): Result.002 file - promoters60/1024189
ctaaaatataat

SEQ ID NO: 99381 - DNA, 10 bp, Unknown
  misc_feature (1)..( 10): Result.002 file - promoters60/1024189
gtatatatat

SEQ ID NO: 99382 - DNA, 10 bp, Unknown
  misc_feature (1)..( 10): Result.002 file - promoters60/1024189
aaataaatag

SEQ ID NO: 99383 - DNA, 10 bp, Unknown
  misc_feature (1)..( 10): Result.002 file - promoters60/1024189
aaatatataa

SEQ ID NO: 99384 - DNA, 10 bp, Unknown
  misc_feature (1)..( 10): Result.002 file - promoters60/1024189
taaaatataa

SEQ ID NO: 99385 - DNA, 12 bp, Unknown
  misc_feature (1)..( 12): Result.002 file - promoters60/1024189
tagaaattaata

SEQ ID NO: 99386 - DNA, 12 bp, Unknown
  misc_feature (1)..( 12): Result.002 file - promoters60/1024189
agataattaagt

SEQ ID NO: 99387 - DNA, 11 bp, Unknown
  misc_feature (1)..( 11): Result.002 file - promoters60/1024189
taaaatcaata

SEQ ID NO: 99388 - DNA, 11 bp, Unknown
  misc_feature (1)..( 11): Result.002 file - promoters60/1024189
tttaattatta

SEQ ID NO: 99389 - DNA, 12 bp, Unknown
  misc_feature (1)..( 12): Result.002 file - promoters60/1024189
ataacatcactt

SEQ ID NO: 99390 - DNA, 6 bp, Unknown
  misc_feature (1)..( 6): Result.002 file - promoters60/1024189
aaatat

SEQ ID NO: 99391 - DNA, 6 bp, Unknown
  misc_feature (1)..( 6): Result.002 file - promoters60/1024189
aaatat

SEQ ID NO: 99392 - DNA, 6 bp, Unknown
  misc_feature (1)..( 6): Result.002 file - promoters60/1024189
aaatat

SEQ ID NO: 99393 - DNA, 7 bp, Unknown
  misc_feature (1)..( 7): Result.002 file - promoters60/1024189
aaattat

SEQ ID NO: 99394 - DNA, 12 bp, Unknown
  misc_feature (1)..( 12): Result.002 file - promoters60/1024189
ttttatcacaag

SEQ ID NO: 99395 - DNA, 12 bp, Unknown
  misc_feature (1)..( 12): Result.002 file - promoters60/1024189
ttttgtcaacga

SEQ ID NO: 99396 - DNA, 12 bp, Unknown
  misc_feature (1)..( 12): Result.002 file - promoters60/1024189
cggtgtaaacga

SEQ ID NO: 99397 - DNA, 12 bp, Unknown
  misc_feature (1)..( 12): Result.002 file - promoters60/1024189
gggtgtaatgct

SEQ ID NO: 99398 - DNA, 12 bp, Unknown
  misc_feature (1)..( 12): Result.002 file - promoters60/1024189
ttttgtatctaa

SEQ ID NO: 99399 - DNA, 8 bp, Unknown
  misc_feature (1)..( 8): Result.002 file - promoters60/1024189
atatatat

SEQ ID NO: 99400 - DNA, 8 bp, Unknown
  misc_feature (1)..( 8): Result.002 file - promoters60/1024189
atatttat

SEQ ID NO: 99401 - DNA, 8 bp, Unknown
  misc_feature (1)..( 8): Result.002 file - promoters60/1024189
caatttat

SEQ ID NO: 99402 - DNA, 8 bp, Unknown
  misc_feature (1)..( 8): Result.002 file - promoters60/1024189
taatttat

SEQ ID NO: 99403 - DNA, 8 bp, Unknown
  misc_feature (1)..( 8): Result.002 file - promoters60/1024189
aatcaaaa

SEQ ID NO: 99404 - DNA, 8 bp, Unknown
  misc_feature (1)..( 8): Result.002 file - promoters60/1024189
aatcaaat

SEQ ID NO: 99405 - DNA, 9 bp, Unknown
  misc_feature (1)..( 9): Result.002 file - promoters60/1024189
gatccaaac

SEQ ID NO: 99406 - DNA, 9 bp, Unknown
  misc_feature (1)..( 9): Result.002 file - promoters60/1024189
tatcctaac

SEQ ID NO: 99407 - DNA, 11 bp, Unknown
  misc_feature (1)..( 11): Result.002 file - promoters60/1024189
ctagacacgta

SEQ ID NO: 99408 - DNA, 11 bp, Unknown
  misc_feature (1)..( 11): Result.002 file - promoters60/1024189
atcaacacgta

SEQ ID NO: 99409 - DNA, 11 bp, Unknown
  misc_feature (1)..( 11): Result.002 file - promoters60/1024189
aaagagacgaa

SEQ ID NO: 99410 - DNA, 11 bp, Unknown
  misc_feature (1)..( 11): Result.002 file - promoters60/1024189
aaaaagaatac

SEQ ID NO: 99411 - DNA, 10 bp, Unknown
  misc_feature (1)..( 10): Result.002 file - promoters60/1024189
gtgcaaaaat

SEQ ID NO: 99412 - DNA, 10 bp, Unknown
  misc_feature (1)..( 10): Result.002 file - promoters60/1024189
gaccaaaaaa

SEQ ID NO: 99413 - DNA, 10 bp, Unknown
  misc_feature (1)..( 10): Result.002 file - promoters60/1024189
gaccaagaat

SEQ ID NO: 99414 - DNA, 10 bp, Unknown
  misc_feature (1)..( 10): Result.002 file - promoters60/1024189
gacgaaaaag

SEQ ID NO: 99415 - DNA, 8 bp, Unknown
  misc_feature (1)..( 8): Result.002 file - promoters60/1024189
ttataatg

SEQ ID NO: 99416 - DNA, 8 bp, Unknown
  misc_feature (1)..( 8): Result.002 file - promoters60/1024189
atataata

SEQ ID NO: 99417 - DNA, 8 bp, Unknown
  misc_feature (1)..( 8): Result.002 file - promoters60/1024189
ttattata

SEQ ID NO: 99418 - DNA, 8 bp, Unknown
  misc_feature (1)..( 8): Result.002 file - promoters60/1024189
ataaaatc

SEQ ID NO: 99419 - DNA, 10 bp, Unknown
  misc_feature (1)..( 10): Result.002 file - promoters60/1024199
gaggaaaaca

SEQ ID NO: 99420 - DNA, 10 bp, Unknown
  misc_feature (1)..( 10): Result.002 file - promoters60/1024199
ccacaaaaca

SEQ ID NO: 99421 - DNA, 10 bp, Unknown
  misc_feature (1)..( 10): Result.002 file - promoters60/1024199
acataaaaca

SEQ ID NO: 99422 - DNA, 10 bp, Unknown
  misc_feature (1)..( 10): Result.002 file - promoters60/1024199
agagaataca

SEQ ID NO: 99423 - DNA, 10 bp, Unknown
  misc_feature (1)..( 10): Result.002 file - promoters60/1024199
aaataaaatt

SEQ ID NO: 99424 - DNA, 10 bp, Unknown
  misc_feature (1)..( 10): Result.002 file - promoters60/1024199
ctataagaca

SEQ ID NO: 99425 - DNA, 7 bp, Unknown
  misc_feature (1)..( 7): Result.002 file - promoters60/1024203
aggggag

SEQ ID NO: 99426 - DNA, 7 bp, Unknown
  misc_feature (1)..( 7): Result.002 file - promoters60/1024203
aggagag

SEQ ID NO: 99427 - DNA, 6 bp, Unknown
  misc_feature (1)..( 6): Result.002 file - promoters60/1024203
aagaag

SEQ ID NO: 99428 - DNA, 6 bp, Unknown
  misc_feature (1)..( 6): Result.002 file - promoters60/1024203
aagaag

SEQ ID NO: 99429 - DNA, 7 bp, Unknown
  misc_feature (1)..( 7): Result.002 file - promoters60/1024203
gtgttca

SEQ ID NO: 99430 - DNA, 7 bp, Unknown
  misc_feature (1)..( 7): Result.002 file - promoters60/1024203
gtggtca

SEQ ID NO: 99431 - DNA, 9 bp, Unknown
  misc_feature (1)..( 9): Result.002 file - promoters60/1024203
agaaaagac

SEQ ID NO: 99432 - DNA, 9 bp, Unknown
  misc_feature (1)..( 9): Result.002 file - promoters60/1024203
agacaagcg

SEQ ID NO: 99433 - DNA, 9 bp, Unknown
  misc_feature (1)..( 9): Result.002 file - promoters60/1024203
gaacaggcg

SEQ ID NO: 99434 - DNA, 9 bp, Unknown
  misc_feature (1)..( 9): Result.002 file - promoters60/1024203
aacatggga

SEQ ID NO: 99435 - DNA, 9 bp, Unknown
  misc_feature (1)..( 9): Result.002 file - promoters60/1024203
aacacggga

SEQ ID NO: 99436 - DNA, 6 bp, Unknown
  misc_feature (1)..( 6): Result.002 file - promoters60/1024203
gaacac

SEQ ID NO: 99437 - DNA, 6 bp, Unknown
  misc_feature (1)..( 6): Result.002 file - promoters60/1024203
gaacac

SEQ ID NO: 99438 - DNA, 7 bp, Unknown
  misc_feature (1)..( 7): Result.002 file - promoters60/1024203
gaatgaa

SEQ ID NO: 99439 - DNA, 7 bp, Unknown
  misc_feature (1)..( 7): Result.002 file - promoters60/1024203
gaatgaa

SEQ ID NO: 99440 - DNA, 8 bp, Unknown
  misc_feature (1)..( 8): Result.002 file - promoters60/1024203
ccatatac

SEQ ID NO: 99441 - DNA, 8 bp, Unknown
  misc_feature (1)..( 8): Result.002 file - promoters60/1024203
ccatctac

SEQ ID NO: 99442 - DNA, 8 bp, Unknown
  misc_feature (1)..( 8): Result.002 file - promoters60/1024203
ctctttcg

SEQ ID NO: 99443 - DNA, 8 bp, Unknown
  misc_feature (1)..( 8): Result.002 file - promoters60/1024203
ctctctcg

SEQ ID NO: 99444 - DNA, 7 bp, Unknown
  misc_feature (1)..( 7): Result.002 file - promoters60/1024203
acaagcg

SEQ ID NO: 99445 - DNA, 7 bp, Unknown
  misc_feature (1)..( 7): Result.002 file - promoters60/1024203
acaggcg

SEQ ID NO: 99446 - DNA, 7 bp, Unknown
  misc_feature (1)..( 7): Result.002 file - promoters60/1024203
acaagcg

SEQ ID NO: 99447 - DNA, 7 bp, Unknown
  misc_feature (1)..( 7): Result.002 file - promoters60/1024203
tcgatga

SEQ ID NO: 99448 - DNA, 7 bp, Unknown
  misc_feature (1)..( 7): Result.002 file - promoters60/1024203
tcgatga

SEQ ID NO: 99449 - DNA, 7 bp, Unknown
  misc_feature (1)..( 7): Result.002 file - promoters60/1024203
tcgatga

SEQ ID NO: 99450 - DNA, 7 bp, Unknown
  misc_feature (1)..( 7): Result.002 file - promoters60/1024203
gaattca

SEQ ID NO: 99451 - DNA, 7 bp, Unknown
  misc_feature (1)..( 7): Result.002 file - promoters60/1024203
gaagtca

SEQ ID NO: 99452 - DNA, 6 bp, Unknown
  misc_feature (1)..( 6): Result.002 file - promoters60/1024203
tgttct

SEQ ID NO: 99453 - DNA, 6 bp, Unknown
  misc_feature (1)..( 6): Result.002 file - promoters60/1024203
tgttct

SEQ ID NO: 99454 - DNA, 9 bp, Unknown
  misc_feature (1)..( 9): Result.002 file - promoters60/1024214
aattgatga

SEQ ID NO: 99455 - DNA, 9 bp, Unknown
  misc_feature (1)..( 9): Result.002 file - promoters60/1024214
aattgattc

SEQ ID NO: 99456 - DNA, 9 bp, Unknown
  misc_feature (1)..( 9): Result.002 file - promoters60/1024214
aattgattt

SEQ ID NO: 99457 - DNA, 9 bp, Unknown
  misc_feature (1)..( 9): Result.002 file - promoters60/1024214
atttgattg

SEQ ID NO: 99458 - DNA, 9 bp, Unknown
  misc_feature (1)..( 9): Result.002 file - promoters60/1024214
aattgagca

SEQ ID NO: 99459 - DNA, 9 bp, Unknown
  misc_feature (1)..( 9): Result.002 file - promoters60/1024214
aatttattt

SEQ ID NO: 99460 - DNA, 9 bp, Unknown
  misc_feature (1)..( 9): Result.002 file - promoters60/1024214
ctttgattt

SEQ ID NO: 99461 - DNA, 9 bp, Unknown
  misc_feature (1)..( 9): Result.002 file - promoters60/1024214
cattggttt

SEQ ID NO: 99462 - DNA, 8 bp, Unknown
  misc_feature (1)..( 8): Result.002 file - promoters60/1024214
tttttttt

SEQ ID NO: 99463 - DNA, 8 bp, Unknown
  misc_feature (1)..( 8): Result.002 file - promoters60/1024214
gatttttt

SEQ ID NO: 99464 - DNA, 9 bp, Unknown
  misc_feature (1)..( 9): Result.002 file - promoters60/1024214
aatttattt

SEQ ID NO: 99465 - DNA, 9 bp, Unknown
  misc_feature (1)..( 9): Result.002 file - promoters60/1024214
aattgattc

SEQ ID NO: 99466 - DNA, 9 bp, Unknown
  misc_feature (1)..( 9): Result.002 file - promoters60/1024214
ctttgattt

SEQ ID NO: 99467 - DNA, 9 bp, Unknown
  misc_feature (1)..( 9): Result.002 file - promoters60/1024214
cattggttt

SEQ ID NO: 99468 - DNA, 8 bp, Unknown
  misc_feature (1)..( 8): Result.002 file - promoters60/1024214
tttaattg

SEQ ID NO: 99469 - DNA, 8 bp, Unknown
  misc_feature (1)..( 8): Result.002 file - promoters60/1024214
tttgattt

SEQ ID NO: 99470 - DNA, 8 bp, Unknown
  misc_feature (1)..( 8): Result.002 file - promoters60/1024214
tttgattg

SEQ ID NO: 99471 - DNA, 8 bp, Unknown
  misc_feature (1)..( 8): Result.002 file - promoters60/1024214
attgattc

SEQ ID NO: 99472 - DNA, 8 bp, Unknown
  misc_feature (1)..( 8): Result.002 file - promoters60/1024214
attggttt

SEQ ID NO: 99473 - DNA, 8 bp, Unknown
  misc_feature (1)..( 8): Result.002 file - promoters60/1024214
agtgattt

SEQ ID NO: 99474 - DNA, 8 bp, Unknown
  misc_feature (1)..( 8): Result.002 file - promoters60/1024214
attgattt

SEQ ID NO: 99475 - DNA, 7 bp, Unknown
  misc_feature (1)..( 7): Result.002 file - promoters60/1024234
caaaatt

SEQ ID NO: 99476 - DNA, 7 bp, Unknown
  misc_feature (1)..( 7): Result.002 file - promoters60/1024234
caaaatc

SEQ ID NO: 99477 - DNA, 7 bp, Unknown
  misc_feature (1)..( 7): Result.002 file - promoters60/1024234
aaaaatc

SEQ ID NO: 99478 - DNA, 8 bp, Unknown
  misc_feature (1)..( 8): Result.002 file - promoters60/1024234
taacaatt

SEQ ID NO: 99479 - DNA, 19 bp, Unknown
  misc_feature (1)..( 19): Result.002 file - promoters60/1024234
ataaaacaaaaattatact

SEQ ID NO: 99480 - DNA, 19 bp, Unknown
  misc_feature (1)..( 19): Result.002 file - promoters60/1024234
gaattactaaatttaaaaa

SEQ ID NO: 99481 - DNA, 19 bp, Unknown
  misc_feature (1)..( 19): Result.002 file - promoters60/1024234
cgagaccaaaaattaaact

SEQ ID NO: 99482 - DNA, 19 bp, Unknown
  misc_feature (1)..( 19): Result.002 file - promoters60/1024234
attgattcaaaattctcta

SEQ ID NO: 99483 - DNA, 19 bp, Unknown
  misc_feature (1)..( 19): Result.002 file - promoters60/1024234
ttgaatcaatattttatca

SEQ ID NO: 99484 - DNA, 9 bp, Unknown
  misc_feature (1)..( 9): Result.002 file - promoters60/1024234
ctatatagc

SEQ ID NO: 99485 - DNA, 9 bp, Unknown
  misc_feature (1)..( 9): Result.002 file - promoters60/1024234
ttatataat

SEQ ID NO: 99486 - DNA, 9 bp, Unknown
  misc_feature (1)..( 9): Result.002 file - promoters60/1024234
ttagatatg

SEQ ID NO: 99487 - DNA, 9 bp, Unknown
  misc_feature (1)..( 9): Result.002 file - promoters60/1024234
tgagagatg

SEQ ID NO: 99488 - DNA, 16 bp, Unknown
  misc_feature (1)..( 16): Result.002 file - promoters60/1024234
caatttgaatgaaact

SEQ ID NO: 99489 - DNA, 16 bp, Unknown
  misc_feature (1)..( 16): Result.002 file - promoters60/1024234
caatatgaaagaaatt

SEQ ID NO: 99490 - DNA, 16 bp, Unknown
  misc_feature (1)..( 16): Result.002 file - promoters60/1024234
aaaggcgaaagaatag

SEQ ID NO: 99491 - DNA, 16 bp, Unknown
  misc_feature (1)..( 16): Result.002 file - promoters60/1024234
ctaacagaataaaaac

SEQ ID NO: 99492 - DNA, 16 bp, Unknown
  misc_feature (1)..( 16): Result.002 file - promoters60/1024234
tgatttgagggtacac

SEQ ID NO: 99493 - DNA, 17 bp, Unknown
  misc_feature (1)..( 17): Result.002 file - promoters60/1024234
gcactaaaacagagtaa

SEQ ID NO: 99494 - DNA, 9 bp, Unknown
  misc_feature (1)..( 9): Result.002 file - promoters60/1024234
taggtgcga

SEQ ID NO: 99495 - DNA, 9 bp, Unknown
  misc_feature (1)..( 9): Result.002 file - promoters60/1024234
gtggttcga

SEQ ID NO: 99496 - DNA, 9 bp, Unknown
  misc_feature (1)..( 9): Result.002 file - promoters60/1024234
ccggttcgg

SEQ ID NO: 99497 - DNA, 9 bp, Unknown
  misc_feature (1)..( 9): Result.002 file - promoters60/1024234
ccggatcgt

SEQ ID NO: 99498 - DNA, 9 bp, Unknown
  misc_feature (1)..( 9): Result.002 file - promoters60/1024234
tgtaacagt

SEQ ID NO: 99499 - DNA, 9 bp, Unknown
  misc_feature (1)..( 9): Result.002 file - promoters60/1024234
tctaacagt

SEQ ID NO: 99500 - DNA, 9 bp, Unknown
  misc_feature (1)..( 9): Result.002 file - promoters60/1024234
tgtaacatg

SEQ ID NO: 99501 - DNA, 9 bp, Unknown
  misc_feature (1)..( 9): Result.002 file - promoters60/1024234
actaacact

SEQ ID NO: 99502 - DNA, 10 bp, Unknown
  misc_feature (1)..( 10): Result.002 file - promoters60/1024257
tttctaaatc

SEQ ID NO: 99503 - DNA, 10 bp, Unknown
  misc_feature (1)..( 10): Result.002 file - promoters60/1024257
attctaacta

SEQ ID NO: 99504 - DNA, 10 bp, Unknown
  misc_feature (1)..( 10): Result.002 file - promoters60/1024257
tttctaaaat

SEQ ID NO: 99505 - DNA, 10 bp, Unknown
  misc_feature (1)..( 10): Result.002 file - promoters60/1024257
aatctaacaa

SEQ ID NO: 99506 - DNA, 10 bp, Unknown
  misc_feature (1)..( 10): Result.002 file - promoters60/1024257
ggcctacaat

SEQ ID NO: 99507 - DNA, 9 bp, Unknown
  misc_feature (1)..( 9): Result.002 file - promoters60/1024355
ctatactct

SEQ ID NO: 99508 - DNA, 9 bp, Unknown
  misc_feature (1)..( 9): Result.002 file - promoters60/1024355
atatacttt

SEQ ID NO: 99509 - DNA, 9 bp, Unknown
  misc_feature (1)..( 9): Result.002 file - promoters60/1024355
ctatgctct

SEQ ID NO: 99510 - DNA, 6 bp, Unknown
  misc_feature (1)..( 6): Result.002 file - promoters60/1024355
tactcg

SEQ ID NO: 99511 - DNA, 6 bp, Unknown
  misc_feature (1)..( 6): Result.002 file - promoters60/1024355
tactcg

SEQ ID NO: 99512 - DNA, 7 bp, Unknown
  misc_feature (1)..( 7): Result.002 file - promoters60/1024355
tgagctc

SEQ ID NO: 99513 - DNA, 7 bp, Unknown
  misc_feature (1)..( 7): Result.002 file - promoters60/1024355
tgatctc

SEQ ID NO: 99514 - DNA, 7 bp, Unknown
  misc_feature (1)..( 7): Result.002 file - promoters60/1024355
aaagtaa

SEQ ID NO: 99515 - DNA, 7 bp, Unknown
  misc_feature (1)..( 7): Result.002 file - promoters60/1024355
aaactaa

SEQ ID NO: 99516 - DNA, 6 bp, Unknown
  misc_feature (1)..( 6): Result.002 file - promoters60/1024355
ttaatc

SEQ ID NO: 99517 - DNA, 6 bp, Unknown
  misc_feature (1)..( 6): Result.002 file - promoters60/1024355
ttaatc

SEQ ID NO: 99518 - DNA, 6 bp, Unknown
  misc_feature (1)..( 6): Result.002 file - promoters60/1024355
gattta

SEQ ID NO: 99519 - DNA, 6 bp, Unknown
  misc_feature (1)..( 6): Result.002 file - promoters60/1024355
gattta

SEQ ID NO: 99520 - DNA, 6 bp, Unknown
  misc_feature (1)..( 6): Result.002 file - promoters60/1024355
atcttt

SEQ ID NO: 99521 - DNA, 6 bp, Unknown
  misc_feature (1)..( 6): Result.002 file - promoters60/1024355
atcttt

SEQ ID NO: 99522 - DNA, 8 bp, Unknown
  misc_feature (1)..( 8): Result.002 file - promoters60/1024355
atactaaa

SEQ ID NO: 99523 - DNA, 8 bp, Unknown
  misc_feature (1)..( 8): Result.002 file - promoters60/1024355
atagtaaa

SEQ ID NO: 99524 - DNA, 6 bp, Unknown
  misc_feature (1)..( 6): Result.002 file - promoters60/1024355
aaagcg

SEQ ID NO: 99525 - DNA, 6 bp, Unknown
  misc_feature (1)..( 6): Result.002 file - promoters60/1024355
aaagcg

SEQ ID NO: 99526 - DNA, 8 bp, Unknown
  misc_feature (1)..( 8): Result.002 file - promoters60/1024355
aagaagct

SEQ ID NO: 99527 - DNA, 8 bp, Unknown
  misc_feature (1)..( 8): Result.002 file - promoters60/1024355
aagcagct

SEQ ID NO: 99528 - DNA, 6 bp, Unknown
  misc_feature (1)..( 6): Result.002 file - promoters60/1024355
acttcc

SEQ ID NO: 99529 - DNA, 6 bp, Unknown
  misc_feature (1)..( 6): Result.002 file - promoters60/1024355
acttcc

SEQ ID NO: 99530 - DNA, 7 bp, Unknown
  misc_feature (1)..( 7): Result.002 file - promoters60/1024355
cactctc

SEQ ID NO: 99531 - DNA, 7 bp, Unknown
  misc_feature (1)..( 7): Result.002 file - promoters60/1024355
caccctc

SEQ ID NO: 99532 - DNA, 6 bp, Unknown
  misc_feature (1)..( 6): Result.002 file - promoters60/1024355
gattaa

SEQ ID NO: 99533 - DNA, 6 bp, Unknown
  misc_feature (1)..( 6): Result.002 file - promoters60/1024355
gattaa

SEQ ID NO: 99534 - DNA, 6 bp, Unknown
  misc_feature (1)..( 6): Result.002 file - promoters60/1024355
tttgat

SEQ ID NO: 99535 - DNA, 6 bp, Unknown
  misc_feature (1)..( 6): Result.002 file - promoters60/1024355
tttgat

SEQ ID NO: 99536 - DNA, 8 bp, Unknown
  misc_feature (1)..( 8): Result.002 file - promoters60/1024355
cttcatat

SEQ ID NO: 99537 - DNA, 8 bp, Unknown
  misc_feature (1)..( 8): Result.002 file - promoters60/1024355
cttcttat

SEQ ID NO: 99538 - DNA, 8 bp, Unknown
  misc_feature (1)..( 8): Result.002 file - promoters60/1024355
atttttca

SEQ ID NO: 99539 - DNA, 8 bp, Unknown
  misc_feature (1)..( 8): Result.002 file - promoters60/1024355
attgttca

SEQ ID NO: 99540 - DNA, 8 bp, Unknown
  misc_feature (1)..( 8): Result.002 file - promoters60/1024355
tttgacaa

SEQ ID NO: 99541 - DNA, 8 bp, Unknown
  misc_feature (1)..( 8): Result.002 file - promoters60/1024355
tttaacaa

SEQ ID NO: 99542 - DNA, 14 bp, Unknown
  misc_feature (1)..( 14): Result.002 file - promoters60/1024367
agacaaaataaaga

SEQ ID NO: 99543 - DNA, 14 bp, Unknown
  misc_feature (1)..( 14): Result.002 file - promoters60/1024367
gttgagtctaaaga

SEQ ID NO: 99544 - DNA, 14 bp, Unknown
  misc_feature (1)..( 14): Result.002 file - promoters60/1024367
cattaaaataaaag

SEQ ID NO: 99545 - DNA, 14 bp, Unknown
  misc_feature (1)..( 14): Result.002 file - promoters60/1024367
aaaagaaataaatc

SEQ ID NO: 99546 - DNA, 14 bp, Unknown
  misc_feature (1)..( 14): Result.002 file - promoters60/1024367
taaaataataaatg

SEQ ID NO: 99547 - DNA, 15 bp, Unknown
  misc_feature (1)..( 15): Result.002 file - promoters60/1024367
gaatataatataatg

SEQ ID NO: 99548 - DNA, 12 bp, Unknown
  misc_feature (1)..( 12): Result.002 file - promoters60/1024367
ccactatataag

SEQ ID NO: 99549 - DNA, 12 bp, Unknown
  misc_feature (1)..( 12): Result.002 file - promoters60/1024367
ccattatatata

SEQ ID NO: 99550 - DNA, 12 bp, Unknown
  misc_feature (1)..( 12): Result.002 file - promoters60/1024367
cgcctatatata

SEQ ID NO: 99551 - DNA, 12 bp, Unknown
  misc_feature (1)..( 12): Result.002 file - promoters60/1024367
cttttatatata

SEQ ID NO: 99552 - DNA, 12 bp, Unknown
  misc_feature (1)..( 12): Result.002 file - promoters60/1024367
cttgtatatata

SEQ ID NO: 99553 - DNA, 12 bp, Unknown
  misc_feature (1)..( 12): Result.002 file - promoters60/1024367
gtgagatataat

SEQ ID NO: 99554 - DNA, 12 bp, Unknown
  misc_feature (1)..( 12): Result.002 file - promoters60/1024367
acaaaatataaa

SEQ ID NO: 99555 - DNA, 12 bp, Unknown
  misc_feature (1)..( 12): Result.002 file - promoters60/1024367
gcgctatttaag

SEQ ID NO: 99556 - DNA, 12 bp, Unknown
  misc_feature (1)..( 12): Result.002 file - promoters60/1024367
agacaaaataaa

SEQ ID NO: 99557 - DNA, 12 bp, Unknown
  misc_feature (1)..( 12): Result.002 file - promoters60/1024367
cattaaaataaa

SEQ ID NO: 99558 - DNA, 12 bp, Unknown
  misc_feature (1)..( 12): Result.002 file - promoters60/1024367
tcttaaaataat

SEQ ID NO: 99559 - DNA, 12 bp, Unknown
  misc_feature (1)..( 12): Result.002 file - promoters60/1024367
aaaagaaataaa

SEQ ID NO: 99560 - DNA, 12 bp, Unknown
  misc_feature (1)..( 12): Result.002 file - promoters60/1024367
atataatataat

SEQ ID NO: 99561 - DNA, 12 bp, Unknown
  misc_feature (1)..( 12): Result.002 file - promoters60/1024367
atttaaaatgct

SEQ ID NO: 99562 - DNA, 10 bp, Unknown
  misc_feature (1)..( 10): Result.002 file - promoters60/1024367
ttaactttga

SEQ ID NO: 99563 - DNA, 10 bp, Unknown
  misc_feature (1)..( 10): Result.002 file - promoters60/1024367
ataagtttca

SEQ ID NO: 99564 - DNA, 10 bp, Unknown
  misc_feature (1)..( 10): Result.002 file - promoters60/1024367
ataaatttgt

SEQ ID NO: 99565 - DNA, 10 bp, Unknown
  misc_feature (1)..( 10): Result.002 file - promoters60/1024367
tgaagtatca

SEQ ID NO: 99566 - DNA, 10 bp, Unknown
  misc_feature (1)..( 10): Result.002 file - promoters60/1024367
atatgtttat

SEQ ID NO: 99567 - DNA, 10 bp, Unknown
  misc_feature (1)..( 10): Result.002 file - promoters60/1024367
ccaaaattga

SEQ ID NO: 99568 - DNA, 10 bp, Unknown
  misc_feature (1)..( 10): Result.002 file - promoters60/1024367
ttaaacaaaa

SEQ ID NO: 99569 - DNA, 10 bp, Unknown
  misc_feature (1)..( 10): Result.002 file - promoters60/1024367
ataaacaaat

SEQ ID NO: 99570 - DNA, 10 bp, Unknown
  misc_feature (1)..( 10): Result.002 file - promoters60/1024367
taaaacaaag

SEQ ID NO: 99571 - DNA, 10 bp, Unknown
  misc_feature (1)..( 10): Result.002 file - promoters60/1024367
aaagacaaaa

SEQ ID NO: 99572 - DNA, 10 bp, Unknown
  misc_feature (1)..( 10): Result.002 file - promoters60/1024367
atagacaata

SEQ ID NO: 99573 - DNA, 10 bp, Unknown
  misc_feature (1)..( 10): Result.002 file - promoters60/1024367
tcagactata

SEQ ID NO: 99574 - DNA, 8 bp, Unknown
  misc_feature (1)..( 8): Result.002 file - promoters60/1024375
atgtaaat

SEQ ID NO: 99575 - DNA, 8 bp, Unknown
  misc_feature (1)..( 8): Result.002 file - promoters60/1024375
ctgtcaat

SEQ ID NO: 99576 - DNA, 8 bp, Unknown
  misc_feature (1)..( 8): Result.002 file - promoters60/1024375
atgtaatt

SEQ ID NO: 99577 - DNA, 9 bp, Unknown
  misc_feature (1)..( 9): Result.002 file - promoters60/1024375
cagtgaaag

SEQ ID NO: 99578 - DNA, 9 bp, Unknown
  misc_feature (1)..( 9): Result.002 file - promoters60/1024375
cagagaaga

SEQ ID NO: 99579 - DNA, 9 bp, Unknown
  misc_feature (1)..( 9): Result.002 file - promoters60/1024375
gagtgaaag

SEQ ID NO: 99580 - DNA, 9 bp, Unknown
  misc_feature (1)..( 9): Result.002 file - promoters60/1024375
ctttgaaag

SEQ ID NO: 99581 - DNA, 7 bp, Unknown
  misc_feature (1)..( 7): Result.002 file - promoters60/1024375
taaacat

SEQ ID NO: 99582 - DNA, 7 bp, Unknown
  misc_feature (1)..( 7): Result.002 file - promoters60/1024375
taaacat

SEQ ID NO: 99583 - DNA, 7 bp, Unknown
  misc_feature (1)..( 7): Result.002 file - promoters60/1024375
aaaacat

SEQ ID NO: 99584 - DNA, 7 bp, Unknown
  misc_feature (1)..( 7): Result.002 file - promoters60/1024375
aaaatat

SEQ ID NO: 99585 - DNA, 7 bp, Unknown
  misc_feature (1)..( 7): Result.002 file - promoters60/1024375
aaattat

SEQ ID NO: 99586 - DNA, 7 bp, Unknown
  misc_feature (1)..( 7): Result.002 file - promoters60/1024375
taataat

SEQ ID NO: 99587 - DNA, 11 bp, Unknown
  misc_feature (1)..( 11): Result.002 file - promoters60/1024375
agtgaaagcaa

SEQ ID NO: 99588 - DNA, 11 bp, Unknown
  misc_feature (1)..( 11): Result.002 file - promoters60/1024375
tttgaaagcaa

SEQ ID NO: 99589 - DNA, 11 bp, Unknown
  misc_feature (1)..( 11): Result.002 file - promoters60/1024375
agtgaaagata

SEQ ID NO: 99590 - DNA, 8 bp, Unknown
  misc_feature (1)..( 8): Result.002 file - promoters60/1024375
aatatgta

SEQ ID NO: 99591 - DNA, 8 bp, Unknown
  misc_feature (1)..( 8): Result.002 file - promoters60/1024375
aatttgtt

SEQ ID NO: 99592 - DNA, 8 bp, Unknown
  misc_feature (1)..( 8): Result.002 file - promoters60/1024375
ggtttgtt

SEQ ID NO: 99593 - DNA, 9 bp, Unknown
  misc_feature (1)..( 9): Result.002 file - promoters60/1024375
atatataaa

SEQ ID NO: 99594 - DNA, 9 bp, Unknown
  misc_feature (1)..( 9): Result.002 file - promoters60/1024375
ttatataaa

SEQ ID NO: 99595 - DNA, 9 bp, Unknown
  misc_feature (1)..( 9): Result.002 file - promoters60/1024375
atatattta

SEQ ID NO: 99596 - DNA, 8 bp, Unknown
  misc_feature (1)..( 8): Result.002 file - promoters60/1024375
gtgaaaca

SEQ ID NO: 99597 - DNA, 8 bp, Unknown
  misc_feature (1)..( 8): Result.002 file - promoters60/1024375
ttgaaaca

SEQ ID NO: 99598 - DNA, 8 bp, Unknown
  misc_feature (1)..( 8): Result.002 file - promoters60/1024375
ttgaaatt

SEQ ID NO: 99599 - DNA, 9 bp, Unknown
  misc_feature (1)..( 9): Result.002 file - promoters60/1024375
aagacaaaa

SEQ ID NO: 99600 - DNA, 9 bp, Unknown
  misc_feature (1)..( 9): Result.002 file - promoters60/1024375
aagaaaaaa

SEQ ID NO: 99601 - DNA, 9 bp, Unknown
  misc_feature (1)..( 9): Result.002 file - promoters60/1024375
aagaaaata

SEQ ID NO: 99602 - DNA, 8 bp, Unknown
  misc_feature (1)..( 8): Result.002 file - promoters60/1024392
gttataaa

SEQ ID NO: 99603 - DNA, 8 bp, Unknown
  misc_feature (1)..( 8): Result.002 file - promoters60/1024392
tttataat

SEQ ID NO: 99604 - DNA, 8 bp, Unknown
  misc_feature (1)..( 8): Result.002 file - promoters60/1024392
attacaaa

SEQ ID NO: 99605 - DNA, 8 bp, Unknown
  misc_feature (1)..( 8): Result.002 file - promoters60/1024392
tttttaaa

SEQ ID NO: 99606 - DNA, 8 bp, Unknown
  misc_feature (1)..( 8): Result.002 file - promoters60/1024392
tttttaac

SEQ ID NO: 99607 - DNA, 8 bp, Unknown
  misc_feature (1)..( 8): Result.002 file - promoters60/1024392
tgtttaac

SEQ ID NO: 99608 - DNA, 6 bp, Unknown
  misc_feature (1)..( 6): Result.002 file - promoters60/1024431
ttttta

SEQ ID NO: 99609 - DNA, 6 bp, Unknown
  misc_feature (1)..( 6): Result.002 file - promoters60/1024431
ttttta

SEQ ID NO: 99610 - DNA, 6 bp, Unknown
  misc_feature (1)..( 6): Result.002 file - promoters60/1024431
ataatt

SEQ ID NO: 99611 - DNA, 6 bp, Unknown
  misc_feature (1)..( 6): Result.002 file - promoters60/1024431
ataatt

SEQ ID NO: 99612 - DNA, 7 bp, Unknown
  misc_feature (1)..( 7): Result.002 file - promoters60/1024431
ttttctt

SEQ ID NO: 99613 - DNA, 7 bp, Unknown
  misc_feature (1)..( 7): Result.002 file - promoters60/1024431
tttcctt

SEQ ID NO: 99614 - DNA, 7 bp, Unknown
  misc_feature (1)..( 7): Result.002 file - promoters60/1024431
aaaagac

SEQ ID NO: 99615 - DNA, 7 bp, Unknown
  misc_feature (1)..( 7): Result.002 file - promoters60/1024431
aaaagac

SEQ ID NO: 99616 - DNA, 6 bp, Unknown
  misc_feature (1)..( 6): Result.002 file - promoters60/1024431
aaactg

SEQ ID NO: 99617 - DNA, 6 bp, Unknown
  misc_feature (1)..( 6): Result.002 file - promoters60/1024431
aaactg

SEQ ID NO: 99618 - DNA, 15 bp, Unknown
  misc_feature (1)..( 15): Result.002 file - promoters60/1024431
aattccttatttata

SEQ ID NO: 99619 - DNA, 15 bp, Unknown
  misc_feature (1)..( 15): Result.002 file - promoters60/1024431
aatacctcatttata

SEQ ID NO: 99620 - DNA, 8 bp, Unknown
  misc_feature (1)..( 8): Result.002 file - promoters60/1024431
ttcaaaac

SEQ ID NO: 99621 - DNA, 8 bp, Unknown
  misc_feature (1)..( 8): Result.002 file - promoters60/1024431
ttcataac

SEQ ID NO: 99622 - DNA, 11 bp, Unknown
  misc_feature (1)..( 11): Result.002 file - promoters60/1024431
aaataactcac

SEQ ID NO: 99623 - DNA, 11 bp, Unknown
  misc_feature (1)..( 11): Result.002 file - promoters60/1024431
aaataaatcac

SEQ ID NO: 99624 - DNA, 6 bp, Unknown
  misc_feature (1)..( 6): Result.002 file - promoters60/1024431
tactaa

SEQ ID NO: 99625 - DNA, 6 bp, Unknown
  misc_feature (1)..( 6): Result.002 file - promoters60/1024431
tactaa

SEQ ID NO: 99626 - DNA, 7 bp, Unknown
  misc_feature (1)..( 7): Result.002 file - promoters60/1024431
aaaacaa

SEQ ID NO: 99627 - DNA, 7 bp, Unknown
  misc_feature (1)..( 7): Result.002 file - promoters60/1024431
aaaccaa

SEQ ID NO: 99628 - DNA, 6 bp, Unknown
  misc_feature (1)..( 6): Result.002 file - promoters60/1024431
atattc

SEQ ID NO: 99629 - DNA, 6 bp, Unknown
  misc_feature (1)..( 6): Result.002 file - promoters60/1024431
atattc

SEQ ID NO: 99630 - DNA, 6 bp, Unknown
  misc_feature (1)..( 6): Result.002 file - promoters60/1024431
tgtaaa

SEQ ID NO: 99631 - DNA, 6 bp, Unknown
  misc_feature (1)..( 6): Result.002 file - promoters60/1024431
tgtaaa

SEQ ID NO: 99632 - DNA, 6 bp, Unknown
  misc_feature (1)..( 6): Result.002 file - promoters60/1024431
attaat

SEQ ID NO: 99633 - DNA, 6 bp, Unknown
  misc_feature (1)..( 6): Result.002 file - promoters60/1024431
attaat

SEQ ID NO: 99634 - DNA, 10 bp, Unknown
  misc_feature (1)..( 10): Result.002 file - promoters60/1024431
atttatattg

SEQ ID NO: 99635 - DNA, 10 bp, Unknown
  misc_feature (1)..( 10): Result.002 file - promoters60/1024431
attaatattg

SEQ ID NO: 99636 - DNA, 8 bp, Unknown
  misc_feature (1)..( 8): Result.002 file - promoters60/1024431
taaataaa

SEQ ID NO: 99637 - DNA, 8 bp, Unknown
  misc_feature (1)..( 8): Result.002 file - promoters60/1024431
taaaaaaa

SEQ ID NO: 99638 - DNA, 7 bp, Unknown
  misc_feature (1)..( 7): Result.002 file - promoters60/1024431
acattat

SEQ ID NO: 99639 - DNA, 7 bp, Unknown
  misc_feature (1)..( 7): Result.002 file - promoters60/1024431
acattat

SEQ ID NO: 99640 - DNA, 7 bp, Unknown
  misc_feature (1)..( 7): Result.002 file - promoters60/1024431
ttatagt

SEQ ID NO: 99641 - DNA, 7 bp, Unknown
  misc_feature (1)..( 7): Result.002 file - promoters60/1024431
ttacagt

SEQ ID NO: 99642 - DNA, 11 bp, Unknown
  misc_feature (1)..( 11): Result.002 file - promoters60/1024431
gttgttaaaaa

SEQ ID NO: 99643 - DNA, 11 bp, Unknown
  misc_feature (1)..( 11): Result.002 file - promoters60/1024431
gttattaaaaa

SEQ ID NO: 99644 - DNA, 14 bp, Unknown
  misc_feature (1)..( 14): Result.002 file - promoters60/1024499
agatatttttttta

SEQ ID NO: 99645 - DNA, 14 bp, Unknown
  misc_feature (1)..( 14): Result.002 file - promoters60/1024499
ccacattgttttta

SEQ ID NO: 99646 - DNA, 14 bp, Unknown
  misc_feature (1)..( 14): Result.002 file - promoters60/1024499
aaaaatatatttat

SEQ ID NO: 99647 - DNA, 14 bp, Unknown
  misc_feature (1)..( 14): Result.002 file - promoters60/1024499
taaaatactttatc

SEQ ID NO: 99648 - DNA, 13 bp, Unknown
  misc_feature (1)..( 13): Result.002 file - promoters60/1024499
ttcatataaataa

SEQ ID NO: 99649 - DNA, 13 bp, Unknown
  misc_feature (1)..( 13): Result.002 file - promoters60/1024499
ggtatataaataa

SEQ ID NO: 99650 - DNA, 13 bp, Unknown
  misc_feature (1)..( 13): Result.002 file - promoters60/1024499
taactataaatag

SEQ ID NO: 99651 - DNA, 13 bp, Unknown
  misc_feature (1)..( 13): Result.002 file - promoters60/1024499
tatatataaatag

SEQ ID NO: 99652 - DNA, 13 bp, Unknown
  misc_feature (1)..( 13): Result.002 file - promoters60/1024499
aatctataaaaaa

SEQ ID NO: 99653 - DNA, 10 bp, Unknown
  misc_feature (1)..( 10): Result.002 file - promoters60/1024499
aacatttcat

SEQ ID NO: 99654 - DNA, 10 bp, Unknown
  misc_feature (1)..( 10): Result.002 file - promoters60/1024499
aacattaata

SEQ ID NO: 99655 - DNA, 10 bp, Unknown
  misc_feature (1)..( 10): Result.002 file - promoters60/1024499
tacattttgt

SEQ ID NO: 99656 - DNA, 10 bp, Unknown
  misc_feature (1)..( 10): Result.002 file - promoters60/1024499
gacaataata

SEQ ID NO: 99657 - DNA, 10 bp, Unknown
  misc_feature (1)..( 10): Result.002 file - promoters60/1024562
gggccaaatt

SEQ ID NO: 99658 - DNA, 10 bp, Unknown
  misc_feature (1)..( 10): Result.002 file - promoters60/1024562
aggcccaatt

SEQ ID NO: 99659 - DNA, 10 bp, Unknown
  misc_feature (1)..( 10): Result.002 file - promoters60/1024562
aggcccaata

SEQ ID NO: 99660 - DNA, 10 bp, Unknown
  misc_feature (1)..( 10): Result.002 file - promoters60/1024562
aggaccattc

SEQ ID NO: 99661 - DNA, 10 bp, Unknown
  misc_feature (1)..( 10): Result.002 file - promoters60/1024562
taactacagt

SEQ ID NO: 99662 - DNA, 10 bp, Unknown
  misc_feature (1)..( 10): Result.002 file - promoters60/1024562
taacaacaga

SEQ ID NO: 99663 - DNA, 10 bp, Unknown
  misc_feature (1)..( 10): Result.002 file - promoters60/1024562
cttcaataga

SEQ ID NO: 99664 - DNA, 10 bp, Unknown
  misc_feature (1)..( 10): Result.002 file - promoters60/1024562
aggaaataga

SEQ ID NO: 99665 - DNA, 8 bp, Unknown
  misc_feature (1)..( 8): Result.002 file - promoters60/1024562
gaagcttg

SEQ ID NO: 99666 - DNA, 8 bp, Unknown
  misc_feature (1)..( 8): Result.002 file - promoters60/1024562
caagcttc

SEQ ID NO: 99667 - DNA, 8 bp, Unknown
  misc_feature (1)..( 8): Result.002 file - promoters60/1024562
gaatcttt

SEQ ID NO: 99668 - DNA, 8 bp, Unknown
  misc_feature (1)..( 8): Result.002 file - promoters60/1024562
aaattttt

SEQ ID NO: 99669 - DNA, 13 bp, Unknown
  misc_feature (1)..( 13): Result.002 file - promoters60/1024562
agaacaaaacaaa

SEQ ID NO: 99670 - DNA, 13 bp, Unknown
  misc_feature (1)..( 13): Result.002 file - promoters60/1024562
atctccaaacaat

SEQ ID NO: 99671 - DNA, 13 bp, Unknown
  misc_feature (1)..( 13): Result.002 file - promoters60/1024562
tagtaaaaagaaa

SEQ ID NO: 99672 - DNA, 13 bp, Unknown
  misc_feature (1)..( 13): Result.002 file - promoters60/1024562
taggaaaaagctg

SEQ ID NO: 99673 - DNA, 10 bp, Unknown
  misc_feature (1)..( 10): Result.002 file - promoters60/1024611
tcaaaatagc

SEQ ID NO: 99674 - DNA, 10 bp, Unknown
  misc_feature (1)..( 10): Result.002 file - promoters60/1024611
tcaaaagctt

SEQ ID NO: 99675 - DNA, 10 bp, Unknown
  misc_feature (1)..( 10): Result.002 file - promoters60/1024611
ccaaaagagc

SEQ ID NO: 99676 - DNA, 6 bp, Unknown
  misc_feature (1)..( 6): Result.002 file - promoters60/1024611
atgaaa

SEQ ID NO: 99677 - DNA, 6 bp, Unknown
  misc_feature (1)..( 6): Result.002 file - promoters60/1024611
atgaaa

SEQ ID NO: 99678 - DNA, 8 bp, Unknown
  misc_feature (1)..( 8): Result.002 file - promoters60/1024611
ttgaaaca

SEQ ID NO: 99679 - DNA, 8 bp, Unknown
  misc_feature (1)..( 8): Result.002 file - promoters60/1024611
ttgaaaca

SEQ ID NO: 99680 - DNA, 6 bp, Unknown
  misc_feature (1)..( 6): Result.002 file - promoters60/1024611
aagact

SEQ ID NO: 99681 - DNA, 6 bp, Unknown
  misc_feature (1)..( 6): Result.002 file - promoters60/1024611
aagact

SEQ ID NO: 99682 - DNA, 7 bp, Unknown
  misc_feature (1)..( 7): Result.002 file - promoters60/1024611
agataaa

SEQ ID NO: 99683 - DNA, 7 bp, Unknown
  misc_feature (1)..( 7): Result.002 file - promoters60/1024611
agacaaa

SEQ ID NO: 99684 - DNA, 7 bp, Unknown
  misc_feature (1)..( 7): Result.002 file - promoters60/1024611
ctaatcc

SEQ ID NO: 99685 - DNA, 7 bp, Unknown
  misc_feature (1)..( 7): Result.002 file - promoters60/1024611
ctactcc

SEQ ID NO: 99686 - DNA, 6 bp, Unknown
  misc_feature (1)..( 6): Result.002 file - promoters60/1024611
gaaagt

SEQ ID NO: 99687 - DNA, 6 bp, Unknown
  misc_feature (1)..( 6): Result.002 file - promoters60/1024611
gaaagt

SEQ ID NO: 99688 - DNA, 7 bp, Unknown
  misc_feature (1)..( 7): Result.002 file - promoters60/1024611
tacctga

SEQ ID NO: 99689 - DNA, 7 bp, Unknown
  misc_feature (1)..( 7): Result.002 file - promoters60/1024611
tacttga

SEQ ID NO: 99690 - DNA, 7 bp, Unknown
  misc_feature (1)..( 7): Result.002 file - promoters60/1024611
atgctaa

SEQ ID NO: 99691 - DNA, 7 bp, Unknown
  misc_feature (1)..( 7): Result.002 file - promoters60/1024611
atggtaa

SEQ ID NO: 99692 - DNA, 8 bp, Unknown
  misc_feature (1)..( 8): Result.002 file - promoters60/1024611
cggaaatt

SEQ ID NO: 99693 - DNA, 8 bp, Unknown
  misc_feature (1)..( 8): Result.002 file - promoters60/1024611
cggcaatt

SEQ ID NO: 99694 - DNA, 10 bp, Unknown
  misc_feature (1)..( 10): Result.002 file - promoters60/1024611
tttgttttgt

SEQ ID NO: 99695 - DNA, 10 bp, Unknown
  misc_feature (1)..( 10): Result.002 file - promoters60/1024611
tttgttttgt

SEQ ID NO: 99696 - DNA, 6 bp, Unknown
  misc_feature (1)..( 6): Result.002 file - promoters60/1024611
aaagaa

SEQ ID NO: 99697 - DNA, 6 bp, Unknown
  misc_feature (1)..( 6): Result.002 file - promoters60/1024611
aaagaa

SEQ ID NO: 99698 - DNA, 7 bp, Unknown
  misc_feature (1)..( 7): Result.002 file - promoters60/1024611
tagagaa

SEQ ID NO: 99699 - DNA, 7 bp, Unknown
  misc_feature (1)..( 7): Result.002 file - promoters60/1024611
tagagaa

SEQ ID NO: 99700 - DNA, 7 bp, Unknown
  misc_feature (1)..( 7): Result.002 file - promoters60/1024611
aaggaga

SEQ ID NO: 99701 - DNA, 7 bp, Unknown
  misc_feature (1)..( 7): Result.002 file - promoters60/1024611
aagtaga

SEQ ID NO: 99702 - DNA, 7 bp, Unknown
  misc_feature (1)..( 7): Result.002 file - promoters60/1024611
aaagaag

SEQ ID NO: 99703 - DNA, 7 bp, Unknown
  misc_feature (1)..( 7): Result.002 file - promoters60/1024611
aaagaag

SEQ ID NO: 99704 - DNA, 6 bp, Unknown
  misc_feature (1)..( 6): Result.002 file - promoters60/1024611
caacac

SEQ ID NO: 99705 - DNA, 6 bp, Unknown
  misc_feature (1)..( 6): Result.002 file - promoters60/1024611
caacac

SEQ ID NO: 99706 - DNA, 6 bp, Unknown
  misc_feature (1)..( 6): Result.002 file - promoters60/1024611
ttgaag

SEQ ID NO: 99707 - DNA, 6 bp, Unknown
  misc_feature (1)..( 6): Result.002 file - promoters60/1024611
ttgaag

SEQ ID NO: 99708 - DNA, 7 bp, Unknown
  misc_feature (1)..( 7): Result.002 file - promoters60/1024611
ctctatt

SEQ ID NO: 99709 - DNA, 7 bp, Unknown
  misc_feature (1)..( 7): Result.002 file - promoters60/1024611
ctccatt

SEQ ID NO: 99710 - DNA, 18 bp, Unknown
  misc_feature (1)..( 18): Result.002 file - promoters60/1024662
ataagaaaattgacaaaa

SEQ ID NO: 99711 - DNA, 18 bp, Unknown
  misc_feature (1)..( 18): Result.002 file - promoters60/1024662
accggaaaatttatctca

SEQ ID NO: 99712 - DNA, 18 bp, Unknown
  misc_feature (1)..( 18): Result.002 file - promoters60/1024662
ataataaaacattggatg

SEQ ID NO: 99713 - DNA, 18 bp, Unknown
  misc_feature (1)..( 18): Result.002 file - promoters60/1024662
agtataaaaacgggtcca

SEQ ID NO: 99714 - DNA, 18 bp, Unknown
  misc_feature (1)..( 18): Result.002 file - promoters60/1024662
tcaattaaattatacaaa

SEQ ID NO: 99715 - DNA, 18 bp, Unknown
  misc_feature (1)..( 18): Result.002 file - promoters60/1024662
aaacacaaattaggctat

SEQ ID NO: 99716 - DNA, 9 bp, Unknown
  misc_feature (1)..( 9): Result.002 file - promoters60/1024713
caaattttc

SEQ ID NO: 99717 - DNA, 9 bp, Unknown
  misc_feature (1)..( 9): Result.002 file - promoters60/1024713
gaaatttgc

SEQ ID NO: 99718 - DNA, 9 bp, Unknown
  misc_feature (1)..( 9): Result.002 file - promoters60/1024713
gaactttgc

SEQ ID NO: 99719 - DNA, 7 bp, Unknown
  misc_feature (1)..( 7): Result.002 file - promoters60/1024713
ttgttaa

SEQ ID NO: 99720 - DNA, 7 bp, Unknown
  misc_feature (1)..( 7): Result.002 file - promoters60/1024713
ttgataa

SEQ ID NO: 99721 - DNA, 6 bp, Unknown
  misc_feature (1)..( 6): Result.002 file - promoters60/1024713
gtatat

SEQ ID NO: 99722 - DNA, 6 bp, Unknown
  misc_feature (1)..( 6): Result.002 file - promoters60/1024713
gtatat

SEQ ID NO: 99723 - DNA, 8 bp, Unknown
  misc_feature (1)..( 8): Result.002 file - promoters60/1024713
acaaaagt

SEQ ID NO: 99724 - DNA, 8 bp, Unknown
  misc_feature (1)..( 8): Result.002 file - promoters60/1024713
acaacagt

SEQ ID NO: 99725 - DNA, 8 bp, Unknown
  misc_feature (1)..( 8): Result.002 file - promoters60/1024713
aaaacgtt

SEQ ID NO: 99726 - DNA, 8 bp, Unknown
  misc_feature (1)..( 8): Result.002 file - promoters60/1024713
aaaaggtt

SEQ ID NO: 99727 - DNA, 11 bp, Unknown
  misc_feature (1)..( 11): Result.002 file - promoters60/1024713
aaattttcctt

SEQ ID NO: 99728 - DNA, 11 bp, Unknown
  misc_feature (1)..( 11): Result.002 file - promoters60/1024713
gaactttgctt

SEQ ID NO: 99729 - DNA, 11 bp, Unknown
  misc_feature (1)..( 11): Result.002 file - promoters60/1024713
gaaatttgcag

SEQ ID NO: 99730 - DNA, 10 bp, Unknown
  misc_feature (1)..( 10): Result.002 file - promoters60/1024713
taatttgttt

SEQ ID NO: 99731 - DNA, 10 bp, Unknown
  misc_feature (1)..( 10): Result.002 file - promoters60/1024713
aaatttattt

SEQ ID NO: 99732 - DNA, 10 bp, Unknown
  misc_feature (1)..( 10): Result.002 file - promoters60/1024713
aaatttgcag

SEQ ID NO: 99733 - DNA, 6 bp, Unknown
  misc_feature (1)..( 6): Result.002 file - promoters60/1024713
accttt

SEQ ID NO: 99734 - DNA, 6 bp, Unknown
  misc_feature (1)..( 6): Result.002 file - promoters60/1024713
accttt

SEQ ID NO: 99735 - DNA, 7 bp, Unknown
  misc_feature (1)..( 7): Result.002 file - promoters60/1024713
tggttca

SEQ ID NO: 99736 - DNA, 7 bp, Unknown
  misc_feature (1)..( 7): Result.002 file - promoters60/1024713
tggatca

SEQ ID NO: 99737 - DNA, 6 bp, Unknown
  misc_feature (1)..( 6): Result.002 file - promoters60/1024713
tatttt

SEQ ID NO: 99738 - DNA, 6 bp, Unknown
  misc_feature (1)..( 6): Result.002 file - promoters60/1024713
tatttt

SEQ ID NO: 99739 - DNA, 6 bp, Unknown
  misc_feature (1)..( 6): Result.002 file - promoters60/1024713
tttggt

SEQ ID NO: 99740 - DNA, 6 bp, Unknown
  misc_feature (1)..( 6): Result.002 file - promoters60/1024713
tttggt

SEQ ID NO: 99741 - DNA, 7 bp, Unknown
  misc_feature (1)..( 7): Result.002 file - promoters60/1024713
ctgtatc

SEQ ID NO: 99742 - DNA, 7 bp, Unknown
  misc_feature (1)..( 7): Result.002 file - promoters60/1024713
ctgtatc

SEQ ID NO: 99743 - DNA, 7 bp, Unknown
  misc_feature (1)..( 7): Result.002 file - promoters60/1024713
tctttga

SEQ ID NO: 99744 - DNA, 7 bp, Unknown
  misc_feature (1)..( 7): Result.002 file - promoters60/1024713
tctctga

SEQ ID NO: 99745 - DNA, 9 bp, Unknown
  misc_feature (1)..( 9): Result.002 file - promoters60/1024713
tccatgaat

SEQ ID NO: 99746 - DNA, 9 bp, Unknown
  misc_feature (1)..( 9): Result.002 file - promoters60/1024713
tccataaat

SEQ ID NO: 99747 - DNA, 8 bp, Unknown
  misc_feature (1)..( 8): Result.002 file - promoters60/1024713
aatctgat

SEQ ID NO: 99748 - DNA, 8 bp, Unknown
  misc_feature (1)..( 8): Result.002 file - promoters60/1024713
aatttgat

SEQ ID NO: 99749 - DNA, 6 bp, Unknown
  misc_feature (1)..( 6): Result.002 file - promoters60/1024713
gaaaaa

SEQ ID NO: 99750 - DNA, 6 bp, Unknown
  misc_feature (1)..( 6): Result.002 file - promoters60/1024713
gaaaaa

SEQ ID NO: 99751 - DNA, 6 bp, Unknown
  misc_feature (1)..( 6): Result.002 file - promoters60/1024713
aacctt

SEQ ID NO: 99752 - DNA, 6 bp, Unknown
  misc_feature (1)..( 6): Result.002 file - promoters60/1024713
aacctt

SEQ ID NO: 99753 - DNA, 8 bp, Unknown
  misc_feature (1)..( 8): Result.002 file - promoters60/1024713
ggtatgaa

SEQ ID NO: 99754 - DNA, 8 bp, Unknown
  misc_feature (1)..( 8): Result.002 file - promoters60/1024713
ggtaggaa

SEQ ID NO: 99755 - DNA, 7 bp, Unknown
  misc_feature (1)..( 7): Result.002 file - promoters60/1024737
attgaaa

SEQ ID NO: 99756 - DNA, 7 bp, Unknown
  misc_feature (1)..( 7): Result.002 file - promoters60/1024737
attaaaa

SEQ ID NO: 99757 - DNA, 6 bp, Unknown
  misc_feature (1)..( 6): Result.002 file - promoters60/1024737
tattta

SEQ ID NO: 99758 - DNA, 6 bp, Unknown
  misc_feature (1)..( 6): Result.002 file - promoters60/1024737
tattta

SEQ ID NO: 99759 - DNA, 7 bp, Unknown
  misc_feature (1)..( 7): Result.002 file - promoters60/1024737
gatattc

SEQ ID NO: 99760 - DNA, 7 bp, Unknown
  misc_feature (1)..( 7): Result.002 file - promoters60/1024737
gatcttc

SEQ ID NO: 99761 - DNA, 6 bp, Unknown
  misc_feature (1)..( 6): Result.002 file - promoters60/1024737
aaaaca

SEQ ID NO: 99762 - DNA, 6 bp, Unknown
  misc_feature (1)..( 6): Result.002 file - promoters60/1024737
aaaaca

SEQ ID NO: 99763 - DNA, 10 bp, Unknown
  misc_feature (1)..( 10): Result.002 file - promoters60/1024737
agaaaacaaa

SEQ ID NO: 99764 - DNA, 10 bp, Unknown
  misc_feature (1)..( 10): Result.002 file - promoters60/1024737
agaaaaaaaa

SEQ ID NO: 99765 - DNA, 6 bp, Unknown
  misc_feature (1)..( 6): Result.002 file - promoters60/1024737
ataata

SEQ ID NO: 99766 - DNA, 6 bp, Unknown
  misc_feature (1)..( 6): Result.002 file - promoters60/1024737
ataata

SEQ ID NO: 99767 - DNA, 7 bp, Unknown
  misc_feature (1)..( 7): Result.002 file - promoters60/1024737
aaacaca

SEQ ID NO: 99768 - DNA, 7 bp, Unknown
  misc_feature (1)..( 7): Result.002 file - promoters60/1024737
aaataca

SEQ ID NO: 99769 - DNA, 7 bp, Unknown
  misc_feature (1)..( 7): Result.002 file - promoters60/1024737
actttag

SEQ ID NO: 99770 - DNA, 7 bp, Unknown
  misc_feature (1)..( 7): Result.002 file - promoters60/1024737
actatag

SEQ ID NO: 99771 - DNA, 6 bp, Unknown
  misc_feature (1)..( 6): Result.002 file - promoters60/1024737
actata

SEQ ID NO: 99772 - DNA, 6 bp, Unknown
  misc_feature (1)..( 6): Result.002 file - promoters60/1024737
actata

SEQ ID NO: 99773 - DNA, 7 bp, Unknown
  misc_feature (1)..( 7): Result.002 file - promoters60/1024737
acattta

SEQ ID NO: 99774 - DNA, 7 bp, Unknown
  misc_feature (1)..( 7): Result.002 file - promoters60/1024737
acagtta

SEQ ID NO: 99775 - DNA, 6 bp, Unknown
  misc_feature (1)..( 6): Result.002 file - promoters60/1024737
ttaatc

SEQ ID NO: 99776 - DNA, 6 bp, Unknown
  misc_feature (1)..( 6): Result.002 file - promoters60/1024737
ttaatc

SEQ ID NO: 99777 - DNA, 8 bp, Unknown
  misc_feature (1)..( 8): Result.002 file - promoters60/1024737
taccaaaa

SEQ ID NO: 99778 - DNA, 8 bp, Unknown
  misc_feature (1)..( 8): Result.002 file - promoters60/1024737
tacaaaaa

SEQ ID NO: 99779 - DNA, 6 bp, Unknown
  misc_feature (1)..( 6): Result.002 file - promoters60/1024737
aattat

SEQ ID NO: 99780 - DNA, 6 bp, Unknown
  misc_feature (1)..( 6): Result.002 file - promoters60/1024737
aattat

SEQ ID NO: 99781 - DNA, 7 bp, Unknown
  misc_feature (1)..( 7): Result.002 file - promoters60/1024737
taatcac

SEQ ID NO: 99782 - DNA, 7 bp, Unknown
  misc_feature (1)..( 7): Result.002 file - promoters60/1024737
taaacac

SEQ ID NO: 99783 - DNA, 6 bp, Unknown
  misc_feature (1)..( 6): Result.002 file - promoters60/1024737
caaaac

SEQ ID NO: 99784 - DNA, 6 bp, Unknown
  misc_feature (1)..( 6): Result.002 file - promoters60/1024737
caaaac

SEQ ID NO: 99785 - DNA, 8 bp, Unknown
  misc_feature (1)..( 8): Result.002 file - promoters60/1024737
tactattt

SEQ ID NO: 99786 - DNA, 8 bp, Unknown
  misc_feature (1)..( 8): Result.002 file - promoters60/1024737
tacaattt

SEQ ID NO: 99787 - DNA, 9 bp, Unknown
  misc_feature (1)..( 9): Result.002 file - promoters60/1024737
cagcttttt

SEQ ID NO: 99788 - DNA, 9 bp, Unknown
  misc_feature (1)..( 9): Result.002 file - promoters60/1024737
cagtttttt

SEQ ID NO: 99789 - DNA, 6 bp, Unknown
  misc_feature (1)..( 6): Result.002 file - promoters60/1024737
acaact

SEQ ID NO: 99790 - DNA, 6 bp, Unknown
  misc_feature (1)..( 6): Result.002 file - promoters60/1024737
acaact

SEQ ID NO: 99791 - DNA, 7 bp, Unknown
  misc_feature (1)..( 7): Result.002 file - promoters60/1024737
tttctaa

SEQ ID NO: 99792 - DNA, 7 bp, Unknown
  misc_feature (1)..( 7): Result.002 file - promoters60/1024737
tttctaa

SEQ ID NO: 99793 - DNA, 6 bp, Unknown
  misc_feature (1)..( 6): Result.002 file - promoters60/1024737
ctccaa

SEQ ID NO: 99794 - DNA, 6 bp, Unknown
  misc_feature (1)..( 6): Result.002 file - promoters60/1024737
ctccaa

SEQ ID NO: 99795 - DNA, 7 bp, Unknown
  misc_feature (1)..( 7): Result.002 file - promoters60/1024737
tactatt

SEQ ID NO: 99796 - DNA, 7 bp, Unknown
  misc_feature (1)..( 7): Result.002 file - promoters60/1024737
tacaatt

SEQ ID NO: 99797 - DNA, 7 bp, Unknown
  misc_feature (1)..( 7): Result.002 file - promoters60/1024737
acataaa

SEQ ID NO: 99798 - DNA, 7 bp, Unknown
  misc_feature (1)..( 7): Result.002 file - promoters60/1024737
acataaa

SEQ ID NO: 99799 - DNA, 7 bp, Unknown
  misc_feature (1)..( 7): Result.002 file - promoters60/1024737
aaatttt

SEQ ID NO: 99800 - DNA, 7 bp, Unknown
  misc_feature (1)..( 7): Result.002 file - promoters60/1024737
aaacttt

SEQ ID NO: 99801 - DNA, 6 bp, Unknown
  misc_feature (1)..( 6): Result.002 file - promoters60/1024737
taaata

SEQ ID NO: 99802 - DNA, 6 bp, Unknown
  misc_feature (1)..( 6): Result.002 file - promoters60/1024737
taaata

SEQ ID NO: 99803 - DNA, 9 bp, Unknown
  misc_feature (1)..( 9): Result.002 file - promoters60/1024756
gggattttt

SEQ ID NO: 99804 - DNA, 9 bp, Unknown
  misc_feature (1)..( 9): Result.002 file - promoters60/1024756
ataattttt

SEQ ID NO: 99805 - DNA, 9 bp, Unknown
  misc_feature (1)..( 9): Result.002 file - promoters60/1024756
ataatgttt

SEQ ID NO: 99806 - DNA, 14 bp, Unknown
  misc_feature (1)..( 14): Result.002 file - promoters60/1024756
taacagtcaaaccg

SEQ ID NO: 99807 - DNA, 14 bp, Unknown
  misc_feature (1)..( 14): Result.002 file - promoters60/1024756
gtcaggtcaaatcc

SEQ ID NO: 99808 - DNA, 14 bp, Unknown
  misc_feature (1)..( 14): Result.002 file - promoters60/1024756
taacagtcaaaaaa

SEQ ID NO: 99809 - DNA, 14 bp, Unknown
  misc_feature (1)..( 14): Result.002 file - promoters60/1024756
aaaatctcaaaaaa

SEQ ID NO: 99810 - DNA, 8 bp, Unknown
  misc_feature (1)..( 8): Result.002 file - promoters60/1024756
ttatcaag

SEQ ID NO: 99811 - DNA, 8 bp, Unknown
  misc_feature (1)..( 8): Result.002 file - promoters60/1024756
ttaccaaa

SEQ ID NO: 99812 - DNA, 9 bp, Unknown
  misc_feature (1)..( 9): Result.002 file - promoters60/1024756
acacctaat

SEQ ID NO: 99813 - DNA, 8 bp, Unknown
  misc_feature (1)..( 8): Result.002 file - promoters60/1024840
gataacat

SEQ ID NO: 99814 - DNA, 8 bp, Unknown
  misc_feature (1)..( 8): Result.002 file - promoters60/1024840
gatcacat

SEQ ID NO: 99815 - DNA, 7 bp, Unknown
  misc_feature (1)..( 7): Result.002 file - promoters60/1024840
acaactt

SEQ ID NO: 99816 - DNA, 7 bp, Unknown
  misc_feature (1)..( 7): Result.002 file - promoters60/1024840
acatctt

SEQ ID NO: 99817 - DNA, 8 bp, Unknown
  misc_feature (1)..( 8): Result.002 file - promoters60/1024840
ttcctttg

SEQ ID NO: 99818 - DNA, 8 bp, Unknown
  misc_feature (1)..( 8): Result.002 file - promoters60/1024840
ttcttttg

SEQ ID NO: 99819 - DNA, 6 bp, Unknown
  misc_feature (1)..( 6): Result.002 file - promoters60/1024840
aaaaca

SEQ ID NO: 99820 - DNA, 6 bp, Unknown
  misc_feature (1)..( 6): Result.002 file - promoters60/1024840
aaaaca

SEQ ID NO: 99821 - DNA, 7 bp, Unknown
  misc_feature (1)..( 7): Result.002 file - promoters60/1024840
cataaga

SEQ ID NO: 99822 - DNA, 7 bp, Unknown
  misc_feature (1)..( 7): Result.002 file - promoters60/1024840
cataagt

SEQ ID NO: 99823 - DNA, 7 bp, Unknown
  misc_feature (1)..( 7): Result.002 file - promoters60/1024840
tataaga

SEQ ID NO: 99824 - DNA, 11 bp, Unknown
  misc_feature (1)..( 11): Result.002 file - promoters60/1024840
gaataaagtat

SEQ ID NO: 99825 - DNA, 11 bp, Unknown
  misc_feature (1)..( 11): Result.002 file - promoters60/1024840
agatacagtat

SEQ ID NO: 99826 - DNA, 11 bp, Unknown
  misc_feature (1)..( 11): Result.002 file - promoters60/1024840
gaagaaaaaag

SEQ ID NO: 99827 - DNA, 7 bp, Unknown
  misc_feature (1)..( 7): Result.002 file - promoters60/1024840
aaaatca

SEQ ID NO: 99828 - DNA, 7 bp, Unknown
  misc_feature (1)..( 7): Result.002 file - promoters60/1024840
aaaatca

SEQ ID NO: 99829 - DNA, 7 bp, Unknown
  misc_feature (1)..( 7): Result.002 file - promoters60/1024840
gaataat

SEQ ID NO: 99830 - DNA, 7 bp, Unknown
  misc_feature (1)..( 7): Result.002 file - promoters60/1024840
taataat

SEQ ID NO: 99831 - DNA, 7 bp, Unknown
  misc_feature (1)..( 7): Result.002 file - promoters60/1024840
taaaaat

SEQ ID NO: 99832 - DNA, 10 bp, Unknown
  misc_feature (1)..( 10): Result.002 file - promoters60/1024840
tttatgcaaa

SEQ ID NO: 99833 - DNA, 10 bp, Unknown
  misc_feature (1)..( 10): Result.002 file - promoters60/1024840
tttatacaaa

SEQ ID NO: 99834 - DNA, 8 bp, Unknown
  misc_feature (1)..( 8): Result.002 file - promoters60/1024840
aaaataaa

SEQ ID NO: 99835 - DNA, 8 bp, Unknown
  misc_feature (1)..( 8): Result.002 file - promoters60/1024840
aaaataaa

SEQ ID NO: 99836 - DNA, 7 bp, Unknown
  misc_feature (1)..( 7): Result.002 file - promoters60/1024840
aatgatg

SEQ ID NO: 99837 - DNA, 7 bp, Unknown
  misc_feature (1)..( 7): Result.002 file - promoters60/1024840
aataatg

SEQ ID NO: 99838 - DNA, 7 bp, Unknown
  misc_feature (1)..( 7): Result.002 file - promoters60/1024840
taaattg

SEQ ID NO: 99839 - DNA, 7 bp, Unknown
  misc_feature (1)..( 7): Result.002 file - promoters60/1024840
taaattg

SEQ ID NO: 99840 - DNA, 7 bp, Unknown
  misc_feature (1)..( 7): Result.002 file - promoters60/1024840
ctagaaa

SEQ ID NO: 99841 - DNA, 7 bp, Unknown
  misc_feature (1)..( 7): Result.002 file - promoters60/1024840
ctaaaaa

SEQ ID NO: 99842 - DNA, 6 bp, Unknown
  misc_feature (1)..( 6): Result.002 file - promoters60/1024840
aagtaa

SEQ ID NO: 99843 - DNA, 6 bp, Unknown
  misc_feature (1)..( 6): Result.002 file - promoters60/1024840
aagtaa

SEQ ID NO: 99844 - DNA, 6 bp, Unknown
  misc_feature (1)..( 6): Result.002 file - promoters60/1024840
cattta

SEQ ID NO: 99845 - DNA, 6 bp, Unknown
  misc_feature (1)..( 6): Result.002 file - promoters60/1024840
cattta

SEQ ID NO: 99846 - DNA, 8 bp, Unknown
  misc_feature (1)..( 8): Result.002 file - promoters60/1024840
aaaatgaa

SEQ ID NO: 99847 - DNA, 8 bp, Unknown
  misc_feature (1)..( 8): Result.002 file - promoters60/1024840
aaaaagaa

SEQ ID NO: 99848 - DNA, 9 bp, Unknown
  misc_feature (1)..( 9): Result.002 file - promoters60/1024840
aagaaagat

SEQ ID NO: 99849 - DNA, 9 bp, Unknown
  misc_feature (1)..( 9): Result.002 file - promoters60/1024840
acatgaacg

SEQ ID NO: 99850 - DNA, 9 bp, Unknown
  misc_feature (1)..( 9): Result.002 file - promoters60/1024840
acatgaacg

SEQ ID NO: 99851 - DNA, 12 bp, Unknown
  misc_feature (1)..( 12): Result.002 file - promoters60/1024889
ggtagaagattt

SEQ ID NO: 99852 - DNA, 12 bp, Unknown
  misc_feature (1)..( 12): Result.002 file - promoters60/1024889
tttgaaaggttt

SEQ ID NO: 99853 - DNA, 11 bp, Unknown
  misc_feature (1)..( 11): Result.002 file - promoters60/1024889
gtataagatat

SEQ ID NO: 99854 - DNA, 11 bp, Unknown
  misc_feature (1)..( 11): Result.002 file - promoters60/1024889
tatgaaaatta

SEQ ID NO: 99855 - DNA, 12 bp, Unknown
  misc_feature (1)..( 12): Result.002 file - promoters60/1024889
gtttacatatac

SEQ ID NO: 99856 - DNA, 12 bp, Unknown
  misc_feature (1)..( 12): Result.002 file - promoters60/1024889
tgatacacatct

SEQ ID NO: 99857 - DNA, 9 bp, Unknown
  misc_feature (1)..( 9): Result.002 file - promoters60/1024889
taccaaaat

SEQ ID NO: 99858 - DNA, 9 bp, Unknown
  misc_feature (1)..( 9): Result.002 file - promoters60/1024889
gaacaaaat

SEQ ID NO: 99859 - DNA, 9 bp, Unknown
  misc_feature (1)..( 9): Result.002 file - promoters60/1024889
gaaaaaaat

SEQ ID NO: 99860 - DNA, 9 bp, Unknown
  misc_feature (1)..( 9): Result.002 file - promoters60/1024889
aaacaaaat

SEQ ID NO: 99861 - DNA, 9 bp, Unknown
  misc_feature (1)..( 9): Result.002 file - promoters60/1024889
acacacaat

SEQ ID NO: 99862 - DNA, 9 bp, Unknown
  misc_feature (1)..( 9): Result.002 file - promoters60/1024889
taacaaata

SEQ ID NO: 99863 - DNA, 15 bp, Unknown
  misc_feature (1)..( 15): Result.002 file - promoters60/1024889
gtttgtttgttactt

SEQ ID NO: 99864 - DNA, 15 bp, Unknown
  misc_feature (1)..( 15): Result.002 file - promoters60/1024889
taatgtttgagtgga

SEQ ID NO: 99865 - DNA, 15 bp, Unknown
  misc_feature (1)..( 15): Result.002 file - promoters60/1024889
atttattttccaatt

SEQ ID NO: 99866 - DNA, 15 bp, Unknown
  misc_feature (1)..( 15): Result.002 file - promoters60/1024889
ttatgtttggtgtcg

SEQ ID NO: 99867 - DNA, 15 bp, Unknown
  misc_feature (1)..( 15): Result.002 file - promoters60/1024889
ttttatttttaatta

SEQ ID NO: 99868 - DNA, 15 bp, Unknown
  misc_feature (1)..( 15): Result.002 file - promoters60/1024889
taatgttagagtgga

SEQ ID NO: 99869 - DNA, 10 bp, Unknown
  misc_feature (1)..( 10): Result.002 file - promoters60/1024889
catgtttaat

SEQ ID NO: 99870 - DNA, 10 bp, Unknown
  misc_feature (1)..( 10): Result.002 file - promoters60/1024889
gttgtttata

SEQ ID NO: 99871 - DNA, 10 bp, Unknown
  misc_feature (1)..( 10): Result.002 file - promoters60/1024889
aaagttaaat

SEQ ID NO: 99872 - DNA, 10 bp, Unknown
  misc_feature (1)..( 10): Result.002 file - promoters60/1024889
catatttagc

SEQ ID NO: 99873 - DNA, 10 bp, Unknown
  misc_feature (1)..( 10): Result.002 file - promoters60/1024889
tgagttcata

SEQ ID NO: 99874 - DNA, 10 bp, Unknown
  misc_feature (1)..( 10): Result.002 file - promoters60/1024889
caagtaaaag

SEQ ID NO: 99875 - DNA, 10 bp, Unknown
  misc_feature (1)..( 10): Result.002 file - promoters60/1024889
gaatttaaat

SEQ ID NO: 99876 - DNA, 9 bp, Unknown
  misc_feature (1)..( 9): Result.002 file - promoters60/1024889
ccaattttt

SEQ ID NO: 99877 - DNA, 9 bp, Unknown
  misc_feature (1)..( 9): Result.002 file - promoters60/1024889
gatattttt

SEQ ID NO: 99878 - DNA, 9 bp, Unknown
  misc_feature (1)..( 9): Result.002 file - promoters60/1024889
aacattttt

SEQ ID NO: 99879 - DNA, 10 bp, Unknown
  misc_feature (1)..( 10): Result.002 file - promoters60/1024889
ttaattattt

SEQ ID NO: 99880 - DNA, 10 bp, Unknown
  misc_feature (1)..( 10): Result.002 file - promoters60/1024889
ccaatatttt

SEQ ID NO: 99881 - DNA, 10 bp, Unknown
  misc_feature (1)..( 10): Result.002 file - promoters60/1024889
ccaacattct

SEQ ID NO: 99882 - DNA, 9 bp, Unknown
  misc_feature (1)..( 9): Result.002 file - promoters60/1024940
aaagtaaat

SEQ ID NO: 99883 - DNA, 9 bp, Unknown
  misc_feature (1)..( 9): Result.002 file - promoters60/1024940
caagaaaag

SEQ ID NO: 99884 - DNA, 9 bp, Unknown
  misc_feature (1)..( 9): Result.002 file - promoters60/1024940
aaattaaat

SEQ ID NO: 99885 - DNA, 8 bp, Unknown
  misc_feature (1)..( 8): Result.002 file - promoters60/1024940
aaatctat

SEQ ID NO: 99886 - DNA, 8 bp, Unknown
  misc_feature (1)..( 8): Result.002 file - promoters60/1024940
aaatatat

SEQ ID NO: 99887 - DNA, 8 bp, Unknown
  misc_feature (1)..( 8): Result.002 file - promoters60/1024940
aaatataa

SEQ ID NO: 99888 - DNA, 7 bp, Unknown
  misc_feature (1)..( 7): Result.002 file - promoters60/1024961
aaacaat

SEQ ID NO: 99889 - DNA, 7 bp, Unknown
  misc_feature (1)..( 7): Result.002 file - promoters60/1024961
gaacaat

SEQ ID NO: 99890 - DNA, 7 bp, Unknown
  misc_feature (1)..( 7): Result.002 file - promoters60/1024961
aaaaaat

SEQ ID NO: 99891 - DNA, 7 bp, Unknown
  misc_feature (1)..( 7): Result.002 file - promoters60/1024961
atatttg

SEQ ID NO: 99892 - DNA, 7 bp, Unknown
  misc_feature (1)..( 7): Result.002 file - promoters60/1024961
ataattg

SEQ ID NO: 99893 - DNA, 14 bp, Unknown
  misc_feature (1)..( 14): Result.002 file - promoters60/1024961
cttggttttgcttg

SEQ ID NO: 99894 - DNA, 14 bp, Unknown
  misc_feature (1)..( 14): Result.002 file - promoters60/1024961
cttggtcttgccgt

SEQ ID NO: 99895 - DNA, 14 bp, Unknown
  misc_feature (1)..( 14): Result.002 file - promoters60/1024961
cttgattttacttg

SEQ ID NO: 99896 - DNA, 7 bp, Unknown
  misc_feature (1)..( 7): Result.002 file - promoters60/1024961
aaaaaag

SEQ ID NO: 99897 - DNA, 7 bp, Unknown
  misc_feature (1)..( 7): Result.002 file - promoters60/1024961
aaataag

SEQ ID NO: 99898 - DNA, 7 bp, Unknown
  misc_feature (1)..( 7): Result.002 file - promoters60/1024961
aaaaaat

SEQ ID NO: 99899 - DNA, 6 bp, Unknown
  misc_feature (1)..( 6): Result.002 file - promoters60/1024961
gagttt

SEQ ID NO: 99900 - DNA, 6 bp, Unknown
  misc_feature (1)..( 6): Result.002 file - promoters60/1024961
gagttt

SEQ ID NO: 99901 - DNA, 8 bp, Unknown
  misc_feature (1)..( 8): Result.002 file - promoters60/1024961
ttctcttc

SEQ ID NO: 99902 - DNA, 8 bp, Unknown
  misc_feature (1)..( 8): Result.002 file - promoters60/1024961
ttctattc

SEQ ID NO: 99903 - DNA, 9 bp, Unknown
  misc_feature (1)..( 9): Result.002 file - promoters60/1024961
atctcactt

SEQ ID NO: 99904 - DNA, 9 bp, Unknown
  misc_feature (1)..( 9): Result.002 file - promoters60/1024961
atctcactt

SEQ ID NO: 99905 - DNA, 11 bp, Unknown
  misc_feature (1)..( 11): Result.002 file - promoters60/1024961
agagagcatct

SEQ ID NO: 99906 - DNA, 11 bp, Unknown
  misc_feature (1)..( 11): Result.002 file - promoters60/1024961
agagagtatct

SEQ ID NO: 99907 - DNA, 7 bp, Unknown
  misc_feature (1)..( 7): Result.002 file - promoters60/1024961
agagaga

SEQ ID NO: 99908 - DNA, 7 bp, Unknown
  misc_feature (1)..( 7): Result.002 file - promoters60/1024961
agagaga

SEQ ID NO: 99909 - DNA, 7 bp, Unknown
  misc_feature (1)..( 7): Result.002 file - promoters60/1024961
tgagaaa

SEQ ID NO: 99910 - DNA, 7 bp, Unknown
  misc_feature (1)..( 7): Result.002 file - promoters60/1024961
tgagaaa

SEQ ID NO: 99911 - DNA, 6 bp, Unknown
  misc_feature (1)..( 6): Result.002 file - promoters60/1024961
tttcca

SEQ ID NO: 99912 - DNA, 6 bp, Unknown
  misc_feature (1)..( 6): Result.002 file - promoters60/1024961
tttcca

SEQ ID NO: 99913 - DNA, 8 bp, Unknown
  misc_feature (1)..( 8): Result.002 file - promoters60/1024961
aaagaaat

SEQ ID NO: 99914 - DNA, 8 bp, Unknown
  misc_feature (1)..( 8): Result.002 file - promoters60/1024961
aaataaat

SEQ ID NO: 99915 - DNA, 8 bp, Unknown
  misc_feature (1)..( 8): Result.002 file - promoters60/1024961
aaataact

SEQ ID NO: 99916 - DNA, 6 bp, Unknown
  misc_feature (1)..( 6): Result.002 file - promoters60/1024961
ttaatt

SEQ ID NO: 99917 - DNA, 6 bp, Unknown
  misc_feature (1)..( 6): Result.002 file - promoters60/1024961
ttaatt

SEQ ID NO: 99918 - DNA, 6 bp, Unknown
  misc_feature (1)..( 6): Result.002 file - promoters60/1024961
aatttt

SEQ ID NO: 99919 - DNA, 6 bp, Unknown
  misc_feature (1)..( 6): Result.002 file - promoters60/1024961
aatttt

SEQ ID NO: 99920 - DNA, 6 bp, Unknown
  misc_feature (1)..( 6): Result.002 file - promoters60/1024961
ttatat

SEQ ID NO: 99921 - DNA, 6 bp, Unknown
  misc_feature (1)..( 6): Result.002 file - promoters60/1024961
ttatat

SEQ ID NO: 99922 - DNA, 7 bp, Unknown
  misc_feature (1)..( 7): Result.002 file - promoters60/1024961
aatgaaa

SEQ ID NO: 99923 - DNA, 7 bp, Unknown
  misc_feature (1)..( 7): Result.002 file - promoters60/1024961
aataaaa

SEQ ID NO: 99924 - DNA, 8 bp, Unknown
  misc_feature (1)..( 8): Result.002 file - promoters60/1024961
aattaata

SEQ ID NO: 99925 - DNA, 8 bp, Unknown
  misc_feature (1)..( 8): Result.002 file - promoters60/1024961
aataaata

SEQ ID NO: 99926 - DNA, 8 bp, Unknown
  misc_feature (1)..( 8): Result.002 file - promoters60/1024961
gaatctta

SEQ ID NO: 99927 - DNA, 8 bp, Unknown
  misc_feature (1)..( 8): Result.002 file - promoters60/1024961
gaaactta

SEQ ID NO: 99928 - DNA, 8 bp, Unknown
  misc_feature (1)..( 8): Result.002 file - promoters60/1024961
ctttatat

SEQ ID NO: 99929 - DNA, 8 bp, Unknown
  misc_feature (1)..( 8): Result.002 file - promoters60/1024961
ctttatat

SEQ ID NO: 99930 - DNA, 7 bp, Unknown
  misc_feature (1)..( 7): Result.002 file - promoters60/1024961
ttaaaat

SEQ ID NO: 99931 - DNA, 7 bp, Unknown
  misc_feature (1)..( 7): Result.002 file - promoters60/1024961
ttaaaat

SEQ ID NO: 99932 - DNA, 7 bp, Unknown
  misc_feature (1)..( 7): Result.002 file - promoters60/1024961
ttaaaat

SEQ ID NO: 99933 - DNA, 7 bp, Unknown
  misc_feature (1)..( 7): Result.002 file - promoters60/1024961
ttaaaat

SEQ ID NO: 99934 - DNA, 7 bp, Unknown
  misc_feature (1)..( 7): Result.002 file - promoters60/1024961
atatagc

SEQ ID NO: 99935 - DNA, 7 bp, Unknown
  misc_feature (1)..( 7): Result.002 file - promoters60/1024961
atatagc

SEQ ID NO: 99936 - DNA, 9 bp, Unknown
  misc_feature (1)..( 9): Result.002 file - promoters60/1024969
agaaagtag

SEQ ID NO: 99937 - DNA, 9 bp, Unknown
  misc_feature (1)..( 9): Result.002 file - promoters60/1024969
agaaagtag

SEQ ID NO: 99938 - DNA, 7 bp, Unknown
  misc_feature (1)..( 7): Result.002 file - promoters60/1024969
aaaatca

SEQ ID NO: 99939 - DNA, 7 bp, Unknown
  misc_feature (1)..( 7): Result.002 file - promoters60/1024969
aaaatca

SEQ ID NO: 99940 - DNA, 8 bp, Unknown
  misc_feature (1)..( 8): Result.002 file - promoters60/1024969
gttactta

SEQ ID NO: 99941 - DNA, 8 bp, Unknown
  misc_feature (1)..( 8): Result.002 file - promoters60/1024969
gtttctta

SEQ ID NO: 99942 - DNA, 6 bp, Unknown
  misc_feature (1)..( 6): Result.002 file - promoters60/1024969
gacttt

SEQ ID NO: 99943 - DNA, 6 bp, Unknown
  misc_feature (1)..( 6): Result.002 file - promoters60/1024969
gacttt

SEQ ID NO: 99944 - DNA, 8 bp, Unknown
  misc_feature (1)..( 8): Result.002 file - promoters60/1024969
ttaacata

SEQ ID NO: 99945 - DNA, 8 bp, Unknown
  misc_feature (1)..( 8): Result.002 file - promoters60/1024969
ttaacata

SEQ ID NO: 99946 - DNA, 8 bp, Unknown
  misc_feature (1)..( 8): Result.002 file - promoters60/1024969
gtttttaa

SEQ ID NO: 99947 - DNA, 8 bp, Unknown
  misc_feature (1)..( 8): Result.002 file - promoters60/1024969
gttcttaa

SEQ ID NO: 99948 - DNA, 7 bp, Unknown
  misc_feature (1)..( 7): Result.002 file - promoters60/1024969
atcttct

SEQ ID NO: 99949 - DNA, 7 bp, Unknown
  misc_feature (1)..( 7): Result.002 file - promoters60/1024969
atcttct

SEQ ID NO: 99950 - DNA, 8 bp, Unknown
  misc_feature (1)..( 8): Result.002 file - promoters60/1024969
aaaaatat

SEQ ID NO: 99951 - DNA, 8 bp, Unknown
  misc_feature (1)..( 8): Result.002 file - promoters60/1024969
aaaactat

SEQ ID NO: 99952 - DNA, 6 bp, Unknown
  misc_feature (1)..( 6): Result.002 file - promoters60/1024969
ggaaaa

SEQ ID NO: 99953 - DNA, 6 bp, Unknown
  misc_feature (1)..( 6): Result.002 file - promoters60/1024969
ggaaaa

SEQ ID NO: 99954 - DNA, 6 bp, Unknown
  misc_feature (1)..( 6): Result.002 file - promoters60/1024969
gatggt

SEQ ID NO: 99955 - DNA, 6 bp, Unknown
  misc_feature (1)..( 6): Result.002 file - promoters60/1024969
gatggt

SEQ ID NO: 99956 - DNA, 7 bp, Unknown
  misc_feature (1)..( 7): Result.002 file - promoters60/1024969
tctgttg

SEQ ID NO: 99957 - DNA, 7 bp, Unknown
  misc_feature (1)..( 7): Result.002 file - promoters60/1024969
tctcttg

SEQ ID NO: 99958 - DNA, 7 bp, Unknown
  misc_feature (1)..( 7): Result.002 file - promoters60/1024969
tttactc

SEQ ID NO: 99959 - DNA, 7 bp, Unknown
  misc_feature (1)..( 7): Result.002 file - promoters60/1024969
tttgctc

SEQ ID NO: 99960 - DNA, 7 bp, Unknown
  misc_feature (1)..( 7): Result.002 file - promoters60/1024969
ctgaaac

SEQ ID NO: 99961 - DNA, 7 bp, Unknown
  misc_feature (1)..( 7): Result.002 file - promoters60/1024969
ctgcaac

SEQ ID NO: 99962 - DNA, 8 bp, Unknown
  misc_feature (1)..( 8): Result.002 file - promoters60/1025087
attttgaa

SEQ ID NO: 99963 - DNA, 8 bp, Unknown
  misc_feature (1)..( 8): Result.002 file - promoters60/1025087
tttttgaa

SEQ ID NO: 99964 - DNA, 8 bp, Unknown
  misc_feature (1)..( 8): Result.002 file - promoters60/1025087
tttttggc

SEQ ID NO: 99965 - DNA, 8 bp, Unknown
  misc_feature (1)..( 8): Result.002 file - promoters60/1025087
aagttttt

SEQ ID NO: 99966 - DNA, 8 bp, Unknown
  misc_feature (1)..( 8): Result.002 file - promoters60/1025087
aagttttt

SEQ ID NO: 99967 - DNA, 8 bp, Unknown
  misc_feature (1)..( 8): Result.002 file - promoters60/1025087
aggttttt

SEQ ID NO: 99968 - DNA, 7 bp, Unknown
  misc_feature (1)..( 7): Result.002 file - promoters60/1025087
ttgtaat

SEQ ID NO: 99969 - DNA, 7 bp, Unknown
  misc_feature (1)..( 7): Result.002 file - promoters60/1025087
ttgaaat

SEQ ID NO: 99970 - DNA, 6 bp, Unknown
  misc_feature (1)..( 6): Result.002 file - promoters60/1025087
agattt

SEQ ID NO: 99971 - DNA, 6 bp, Unknown
  misc_feature (1)..( 6): Result.002 file - promoters60/1025087
agattt

SEQ ID NO: 99972 - DNA, 9 bp, Unknown
  misc_feature (1)..( 9): Result.002 file - promoters60/1025087
aaggataaa

SEQ ID NO: 99973 - DNA, 9 bp, Unknown
  misc_feature (1)..( 9): Result.002 file - promoters60/1025087
ttcgataaa

SEQ ID NO: 99974 - DNA, 9 bp, Unknown
  misc_feature (1)..( 9): Result.002 file - promoters60/1025087
ttcgataat

SEQ ID NO: 99975 - DNA, 7 bp, Unknown
  misc_feature (1)..( 7): Result.002 file - promoters60/1025087
cttagtt

SEQ ID NO: 99976 - DNA, 7 bp, Unknown
  misc_feature (1)..( 7): Result.002 file - promoters60/1025087
cttcgtt

SEQ ID NO: 99977 - DNA, 9 bp, Unknown
  misc_feature (1)..( 9): Result.002 file - promoters60/1025087
gaattaaaa

SEQ ID NO: 99978 - DNA, 9 bp, Unknown
  misc_feature (1)..( 9): Result.002 file - promoters60/1025087
gaaataaaa

SEQ ID NO: 99979 - DNA, 9 bp, Unknown
  misc_feature (1)..( 9): Result.002 file - promoters60/1025087
gaaataagc

SEQ ID NO: 99980 - DNA, 7 bp, Unknown
  misc_feature (1)..( 7): Result.002 file - promoters60/1025087
aaataaa

SEQ ID NO: 99981 - DNA, 7 bp, Unknown
  misc_feature (1)..( 7): Result.002 file - promoters60/1025087
aaataaa

SEQ ID NO: 99982 - DNA, 6 bp, Unknown
  misc_feature (1)..( 6): Result.002 file - promoters60/1025087
caattt

SEQ ID NO: 99983 - DNA, 6 bp, Unknown
  misc_feature (1)..( 6): Result.002 file - promoters60/1025087
caattt

SEQ ID NO: 99984 - DNA, 6 bp, Unknown
  misc_feature (1)..( 6): Result.002 file - promoters60/1025087
tctttt

SEQ ID NO: 99985 - DNA, 6 bp, Unknown
  misc_feature (1)..( 6): Result.002 file - promoters60/1025087
tctttt

SEQ ID NO: 99986 - DNA, 7 bp, Unknown
  misc_feature (1)..( 7): Result.002 file - promoters60/1025087
aacaatc

SEQ ID NO: 99987 - DNA, 7 bp, Unknown
  misc_feature (1)..( 7): Result.002 file - promoters60/1025087
aacaatc

SEQ ID NO: 99988 - DNA, 8 bp, Unknown
  misc_feature (1)..( 8): Result.002 file - promoters60/1025087
aatcccaa

SEQ ID NO: 99989 - DNA, 8 bp, Unknown
  misc_feature (1)..( 8): Result.002 file - promoters60/1025087
aataccaa

SEQ ID NO: 99990 - DNA, 6 bp, Unknown
  misc_feature (1)..( 6): Result.002 file - promoters60/1025087
tttttt

SEQ ID NO: 99991 - DNA, 6 bp, Unknown
  misc_feature (1)..( 6): Result.002 file - promoters60/1025087
tttttt

SEQ ID NO: 99992 - DNA, 6 bp, Unknown
  misc_feature (1)..( 6): Result.002 file - promoters60/1025087
atagaa

SEQ ID NO: 99993 - DNA, 6 bp, Unknown
  misc_feature (1)..( 6): Result.002 file - promoters60/1025087
atagaa

SEQ ID NO: 99994 - DNA, 6 bp, Unknown
  misc_feature (1)..( 6): Result.002 file - promoters60/1025087
taagta

SEQ ID NO: 99995 - DNA, 6 bp, Unknown
  misc_feature (1)..( 6): Result.002 file - promoters60/1025087
taagta

SEQ ID NO: 99996 - DNA, 9 bp, Unknown
  misc_feature (1)..( 9): Result.002 file - promoters60/1025087
aaaagaaaa

SEQ ID NO: 99997 - DNA, 9 bp, Unknown
  misc_feature (1)..( 9): Result.002 file - promoters60/1025087
aaacgaaaa

SEQ ID NO: 99998 - DNA, 6 bp, Unknown
  misc_feature (1)..( 6): Result.002 file - promoters60/1025087
aattaa

SEQ ID NO: 99999 - DNA, 6 bp, Unknown
  misc_feature (1)..( 6): Result.002 file - promoters60/1025087
aattaa

SEQ ID NO: 100000 - DNA, 7 bp, Unknown
  misc_feature (1)..( 7): Result.002 file - promoters60/1025100
caaaaat

SEQ ID NO: 100001 - DNA, 7 bp, Unknown
  misc_feature (1)..( 7): Result.002 file - promoters60/1025100
caataat

SEQ ID NO: 100002 - DNA, 13 bp, Unknown
  misc_feature (1)..( 13): Result.002 file - promoters60/1025100
gataaaaaaaata

SEQ ID NO: 100003 - DNA, 13 bp, Unknown
  misc_feature (1)..( 13): Result.002 file - promoters60/1025100
gataaaaaatata

SEQ ID NO: 100004 - DNA, 13 bp, Unknown
  misc_feature (1)..( 13): Result.002 file - promoters60/1025100
aatagaaatacaa

SEQ ID NO: 100005 - DNA, 7 bp, Unknown
  misc_feature (1)..( 7): Result.002 file - promoters60/1025100
ataatta

SEQ ID NO: 100006 - DNA, 7 bp, Unknown
  misc_feature (1)..( 7): Result.002 file - promoters60/1025100
atagtta

SEQ ID NO: 100007 - DNA, 9 bp, Unknown
  misc_feature (1)..( 9): Result.002 file - promoters60/1025100
aaattgtat

SEQ ID NO: 100008 - DNA, 9 bp, Unknown
  misc_feature (1)..( 9): Result.002 file - promoters60/1025100
aaattgtat

SEQ ID NO: 100009 - DNA, 6 bp, Unknown
  misc_feature (1)..( 6): Result.002 file - promoters60/1025100
tagttg

SEQ ID NO: 100010 - DNA, 6 bp, Unknown
  misc_feature (1)..( 6): Result.002 file - promoters60/1025100
tagttg

SEQ ID NO: 100011 - DNA, 6 bp, Unknown
  misc_feature (1)..( 6): Result.002 file - promoters60/1025100
tcaacc

SEQ ID NO: 100012 - DNA, 6 bp, Unknown
  misc_feature (1)..( 6): Result.002 file - promoters60/1025100
tcaacc

SEQ ID NO: 100013 - DNA, 6 bp, Unknown
  misc_feature (1)..( 6): Result.002 file - promoters60/1025100
aaatca

SEQ ID NO: 100014 - DNA, 6 bp, Unknown
  misc_feature (1)..( 6): Result.002 file - promoters60/1025100
aaatca

SEQ ID NO: 100015 - DNA, 9 bp, Unknown
  misc_feature (1)..( 9): Result.002 file - promoters60/1025100
tattgatca

SEQ ID NO: 100016 - DNA, 9 bp, Unknown
  misc_feature (1)..( 9): Result.002 file - promoters60/1025100
tatagatca

SEQ ID NO: 100017 - DNA, 6 bp, Unknown
  misc_feature (1)..( 6): Result.002 file - promoters60/1025100
tttgaa

SEQ ID NO: 100018 - DNA, 6 bp, Unknown
  misc_feature (1)..( 6): Result.002 file - promoters60/1025100
tttgaa

SEQ ID NO: 100019 - DNA, 9 bp, Unknown
  misc_feature (1)..( 9): Result.002 file - promoters60/1025100
atagagata

SEQ ID NO: 100020 - DNA, 9 bp, Unknown
  misc_feature (1)..( 9): Result.002 file - promoters60/1025100
atagaaata

SEQ ID NO: 100021 - DNA, 6 bp, Unknown
  misc_feature (1)..( 6): Result.002 file - promoters60/1025100
aatttt

SEQ ID NO: 100022 - DNA, 6 bp, Unknown
  misc_feature (1)..( 6): Result.002 file - promoters60/1025100
aatttt

SEQ ID NO: 100023 - DNA, 8 bp, Unknown
  misc_feature (1)..( 8): Result.002 file - promoters60/1025100
tcaatttt

SEQ ID NO: 100024 - DNA, 8 bp, Unknown
  misc_feature (1)..( 8): Result.002 file - promoters60/1025100
acaatttt

SEQ ID NO: 100025 - DNA, 8 bp, Unknown
  misc_feature (1)..( 8): Result.002 file - promoters60/1025100
acacttta

SEQ ID NO: 100026 - DNA, 7 bp, Unknown
  misc_feature (1)..( 7): Result.002 file - promoters60/1025100
ttataaa

SEQ ID NO: 100027 - DNA, 7 bp, Unknown
  misc_feature (1)..( 7): Result.002 file - promoters60/1025100
ttataaa

SEQ ID NO: 100028 - DNA, 9 bp, Unknown
  misc_feature (1)..( 9): Result.002 file - promoters60/1025100
atttattca

SEQ ID NO: 100029 - DNA, 9 bp, Unknown
  misc_feature (1)..( 9): Result.002 file - promoters60/1025100
attaattca

SEQ ID NO: 100030 - DNA, 6 bp, Unknown
  misc_feature (1)..( 6): Result.002 file - promoters60/1025100
attcga

SEQ ID NO: 100031 - DNA, 6 bp, Unknown
  misc_feature (1)..( 6): Result.002 file - promoters60/1025100
attcga

SEQ ID NO: 100032 - DNA, 7 bp, Unknown
  misc_feature (1)..( 7): Result.002 file - promoters60/1025100
atataat

SEQ ID NO: 100033 - DNA, 7 bp, Unknown
  misc_feature (1)..( 7): Result.002 file - promoters60/1025100
atacaat

SEQ ID NO: 100034 - DNA, 7 bp, Unknown
  misc_feature (1)..( 7): Result.002 file - promoters60/1025100
acacaaa

SEQ ID NO: 100035 - DNA, 7 bp, Unknown
  misc_feature (1)..( 7): Result.002 file - promoters60/1025100
acaaaaa

SEQ ID NO: 100036 - DNA, 8 bp, Unknown
  misc_feature (1)..( 8): Result.002 file - promoters60/1025117
tttattat

SEQ ID NO: 100037 - DNA, 8 bp, Unknown
  misc_feature (1)..( 8): Result.002 file - promoters60/1025117
ttttttaa

SEQ ID NO: 100038 - DNA, 8 bp, Unknown
  misc_feature (1)..( 8): Result.002 file - promoters60/1025117
tattttaa

SEQ ID NO: 100039 - DNA, 14 bp, Unknown
  misc_feature (1)..( 14): Result.002 file - promoters60/1025117
ttatttcatggcgt

SEQ ID NO: 100040 - DNA, 14 bp, Unknown
  misc_feature (1)..( 14): Result.002 file - promoters60/1025117
ttgtttaatgtttt

SEQ ID NO: 100041 - DNA, 14 bp, Unknown
  misc_feature (1)..( 14): Result.002 file - promoters60/1025117
ttgttcaatatttt

SEQ ID NO: 100042 - DNA, 9 bp, Unknown
  misc_feature (1)..( 9): Result.002 file - promoters60/1025117
atagagttt

SEQ ID NO: 100043 - DNA, 9 bp, Unknown
  misc_feature (1)..( 9): Result.002 file - promoters60/1025117
atatagttt

SEQ ID NO: 100044 - DNA, 8 bp, Unknown
  misc_feature (1)..( 8): Result.002 file - promoters60/1025117
tttggtct

SEQ ID NO: 100045 - DNA, 8 bp, Unknown
  misc_feature (1)..( 8): Result.002 file - promoters60/1025117
tttgttct

SEQ ID NO: 100046 - DNA, 6 bp, Unknown
  misc_feature (1)..( 6): Result.002 file - promoters60/1025117
agaaaa

SEQ ID NO: 100047 - DNA, 6 bp, Unknown
  misc_feature (1)..( 6): Result.002 file - promoters60/1025117
agaaaa

SEQ ID NO: 100048 - DNA, 10 bp, Unknown
  misc_feature (1)..( 10): Result.002 file - promoters60/1025117
tattaaaata

SEQ ID NO: 100049 - DNA, 10 bp, Unknown
  misc_feature (1)..( 10): Result.002 file - promoters60/1025117
tattgaaatt

SEQ ID NO: 100050 - DNA, 10 bp, Unknown
  misc_feature (1)..( 10): Result.002 file - promoters60/1025117
tgttaatata

SEQ ID NO: 100051 - DNA, 7 bp, Unknown
  misc_feature (1)..( 7): Result.002 file - promoters60/1025117
gttgaat

SEQ ID NO: 100052 - DNA, 7 bp, Unknown
  misc_feature (1)..( 7): Result.002 file - promoters60/1025117
gttcaat

SEQ ID NO: 100053 - DNA, 9 bp, Unknown
  misc_feature (1)..( 9): Result.002 file - promoters60/1025117
cttaattac

SEQ ID NO: 100054 - DNA, 9 bp, Unknown
  misc_feature (1)..( 9): Result.002 file - promoters60/1025117
cttaattac

SEQ ID NO: 100055 - DNA, 17 bp, Unknown
  misc_feature (1)..( 17): Result.002 file - promoters60/1025117
tagtagttccaaacgca

SEQ ID NO: 100056 - DNA, 17 bp, Unknown
  misc_feature (1)..( 17): Result.002 file - promoters60/1025117
tagttgttcaatatttt

SEQ ID NO: 100057 - DNA, 17 bp, Unknown
  misc_feature (1)..( 17): Result.002 file - promoters60/1025117
cttttgtttaatgtttt

SEQ ID NO: 100058 - DNA, 7 bp, Unknown
  misc_feature (1)..( 7): Result.002 file - promoters60/1025117
tttggtg

SEQ ID NO: 100059 - DNA, 7 bp, Unknown
  misc_feature (1)..( 7): Result.002 file - promoters60/1025117
ttttgtg

SEQ ID NO: 100060 - DNA, 6 bp, Unknown
  misc_feature (1)..( 6): Result.002 file - promoters60/1025117
tcttta

SEQ ID NO: 100061 - DNA, 6 bp, Unknown
  misc_feature (1)..( 6): Result.002 file - promoters60/1025117
tcttta

SEQ ID NO: 100062 - DNA, 6 bp, Unknown
  misc_feature (1)..( 6): Result.002 file - promoters60/1025117
atcaag

SEQ ID NO: 100063 - DNA, 6 bp, Unknown
  misc_feature (1)..( 6): Result.002 file - promoters60/1025117
atcaag

SEQ ID NO: 100064 - DNA, 6 bp, Unknown
  misc_feature (1)..( 6): Result.002 file - promoters60/1025117
atattt

SEQ ID NO: 100065 - DNA, 6 bp, Unknown
  misc_feature (1)..( 6): Result.002 file - promoters60/1025117
atattt

SEQ ID NO: 100066 - DNA, 6 bp, Unknown
  misc_feature (1)..( 6): Result.002 file - promoters60/1025117
ttctaa

SEQ ID NO: 100067 - DNA, 6 bp, Unknown
  misc_feature (1)..( 6): Result.002 file - promoters60/1025117
ttctaa

SEQ ID NO: 100068 - DNA, 7 bp, Unknown
  misc_feature (1)..( 7): Result.002 file - promoters60/1025117
cagtaag

SEQ ID NO: 100069 - DNA, 7 bp, Unknown
  misc_feature (1)..( 7): Result.002 file - promoters60/1025117
cagcaag

SEQ ID NO: 100070 - DNA, 6 bp, Unknown
  misc_feature (1)..( 6): Result.002 file - promoters60/1025202
atagat

SEQ ID NO: 100071 - DNA, 6 bp, Unknown
  misc_feature (1)..( 6): Result.002 file - promoters60/1025202
atagat

SEQ ID NO: 100072 - DNA, 6 bp, Unknown
  misc_feature (1)..( 6): Result.002 file - promoters60/1025202
taaaga

SEQ ID NO: 100073 - DNA, 6 bp, Unknown
  misc_feature (1)..( 6): Result.002 file - promoters60/1025202
taaaga

SEQ ID NO: 100074 - DNA, 7 bp, Unknown
  misc_feature (1)..( 7): Result.002 file - promoters60/1025202
ataattt

SEQ ID NO: 100075 - DNA, 7 bp, Unknown
  misc_feature (1)..( 7): Result.002 file - promoters60/1025202
atatttt

SEQ ID NO: 100076 - DNA, 7 bp, Unknown
  misc_feature (1)..( 7): Result.002 file - promoters60/1025202
tttgctt

SEQ ID NO: 100077 - DNA, 7 bp, Unknown
  misc_feature (1)..( 7): Result.002 file - promoters60/1025202
ttttctt

SEQ ID NO: 100078 - DNA, 8 bp, Unknown
  misc_feature (1)..( 8): Result.002 file - promoters60/1025202
atttctgt

SEQ ID NO: 100079 - DNA, 8 bp, Unknown
  misc_feature (1)..( 8): Result.002 file - promoters60/1025202
atttatgt

SEQ ID NO: 100080 - DNA, 8 bp, Unknown
  misc_feature (1)..( 8): Result.002 file - promoters60/1025202
tgttctgt

SEQ ID NO: 100081 - DNA, 8 bp, Unknown
  misc_feature (1)..( 8): Result.002 file - promoters60/1025202
tttgtctc

SEQ ID NO: 100082 - DNA, 8 bp, Unknown
  misc_feature (1)..( 8): Result.002 file - promoters60/1025202
tttctctc

SEQ ID NO: 100083 - DNA, 6 bp, Unknown
  misc_feature (1)..( 6): Result.002 file - promoters60/1025202
agaact

SEQ ID NO: 100084 - DNA, 6 bp, Unknown
  misc_feature (1)..( 6): Result.002 file - promoters60/1025202
agaact

SEQ ID NO: 100085 - DNA, 6 bp, Unknown
  misc_feature (1)..( 6): Result.002 file - promoters60/1025202
gctggt

SEQ ID NO: 100086 - DNA, 6 bp, Unknown
  misc_feature (1)..( 6): Result.002 file - promoters60/1025202
gctggt

SEQ ID NO: 100087 - DNA, 6 bp, Unknown
  misc_feature (1)..( 6): Result.002 file - promoters60/1025202
tctctg

SEQ ID NO: 100088 - DNA, 6 bp, Unknown
  misc_feature (1)..( 6): Result.002 file - promoters60/1025202
tctctg

SEQ ID NO: 100089 - DNA, 6 bp, Unknown
  misc_feature (1)..( 6): Result.002 file - promoters60/1025202
atatgg

SEQ ID NO: 100090 - DNA, 6 bp, Unknown
  misc_feature (1)..( 6): Result.002 file - promoters60/1025202
atatgg

SEQ ID NO: 100091 - DNA, 6 bp, Unknown
  misc_feature (1)..( 6): Result.002 file - promoters60/1025202
ttgttg

SEQ ID NO: 100092 - DNA, 6 bp, Unknown
  misc_feature (1)..( 6): Result.002 file - promoters60/1025202
ttgttg

SEQ ID NO: 100093 - DNA, 7 bp, Unknown
  misc_feature (1)..( 7): Result.002 file - promoters60/1025202
ttaatgt

SEQ ID NO: 100094 - DNA, 7 bp, Unknown
  misc_feature (1)..( 7): Result.002 file - promoters60/1025202
ttattgt

SEQ ID NO: 100095 - DNA, 6 bp, Unknown
  misc_feature (1)..( 6): Result.002 file - promoters60/1025202
agtaaa

SEQ ID NO: 100096 - DNA, 6 bp, Unknown
  misc_feature (1)..( 6): Result.002 file - promoters60/1025202
agtaaa

SEQ ID NO: 100097 - DNA, 7 bp, Unknown
  misc_feature (1)..( 7): Result.002 file - promoters60/1025202
aatcggg

SEQ ID NO: 100098 - DNA, 7 bp, Unknown
  misc_feature (1)..( 7): Result.002 file - promoters60/1025202
aattggg

SEQ ID NO: 100099 - DNA, 8 bp, Unknown
  misc_feature (1)..( 8): Result.002 file - promoters60/1025202
gaaagaaa

SEQ ID NO: 100100 - DNA, 8 bp, Unknown
  misc_feature (1)..( 8): Result.002 file - promoters60/1025202
gaaacaaa

SEQ ID NO: 100101 - DNA, 10 bp, Unknown
  misc_feature (1)..( 10): Result.002 file - promoters60/1025202
ggaaaagaaa

SEQ ID NO: 100102 - DNA, 10 bp, Unknown
  misc_feature (1)..( 10): Result.002 file - promoters60/1025202
ggaaatgaaa

SEQ ID NO: 100103 - DNA, 7 bp, Unknown
  misc_feature (1)..( 7): Result.002 file - promoters60/1025202
cccacta

SEQ ID NO: 100104 - DNA, 7 bp, Unknown
  misc_feature (1)..( 7): Result.002 file - promoters60/1025202
cccacta

SEQ ID NO: 100105 - DNA, 9 bp, Unknown
  misc_feature (1)..( 9): Result.002 file - promoters60/1025202
aaagaaaag

SEQ ID NO: 100106 - DNA, 9 bp, Unknown
  misc_feature (1)..( 9): Result.002 file - promoters60/1025202
aaagtaaag

SEQ ID NO: 100107 - DNA, 7 bp, Unknown
  misc_feature (1)..( 7): Result.002 file - promoters60/1025202
gtatata

SEQ ID NO: 100108 - DNA, 7 bp, Unknown
  misc_feature (1)..( 7): Result.002 file - promoters60/1025202
gtatata

SEQ ID NO: 100109 - DNA, 9 bp, Unknown
  misc_feature (1)..( 9): Result.002 file - promoters60/1025211
gaaaatatt

SEQ ID NO: 100110 - DNA, 9 bp, Unknown
  misc_feature (1)..( 9): Result.002 file - promoters60/1025211
aaaaataag

SEQ ID NO: 100111 - DNA, 9 bp, Unknown
  misc_feature (1)..( 9): Result.002 file - promoters60/1025211
aaaaattaa

SEQ ID NO: 100112 - DNA, 9 bp, Unknown
  misc_feature (1)..( 9): Result.002 file - promoters60/1025211
aaacatatt

SEQ ID NO: 100113 - DNA, 9 bp, Unknown
  misc_feature (1)..( 9): Result.002 file - promoters60/1025211
taaaatttc

SEQ ID NO: 100114 - DNA, 9 bp, Unknown
  misc_feature (1)..( 9): Result.002 file - promoters60/1025211
caaaattca

SEQ ID NO: 100115 - DNA, 11 bp, Unknown
  misc_feature (1)..( 11): Result.002 file - promoters60/1025211
aaaataaataa

SEQ ID NO: 100116 - DNA, 11 bp, Unknown
  misc_feature (1)..( 11): Result.002 file - promoters60/1025211
ttaataaagct

SEQ ID NO: 100117 - DNA, 11 bp, Unknown
  misc_feature (1)..( 11): Result.002 file - promoters60/1025211
aaaattaatat

SEQ ID NO: 100118 - DNA, 11 bp, Unknown
  misc_feature (1)..( 11): Result.002 file - promoters60/1025211
gagataatatt

SEQ ID NO: 100119 - DNA, 11 bp, Unknown
  misc_feature (1)..( 11): Result.002 file - promoters60/1025211
attataaaata

SEQ ID NO: 100120 - DNA, 12 bp, Unknown
  misc_feature (1)..( 12): Result.002 file - promoters60/1025211
aatttacaaact

SEQ ID NO: 100121 - DNA, 8 bp, Unknown
  misc_feature (1)..( 8): Result.002 file - promoters60/1025211
aaaacaaa

SEQ ID NO: 100122 - DNA, 8 bp, Unknown
  misc_feature (1)..( 8): Result.002 file - promoters60/1025211
aaaaaaaa

SEQ ID NO: 100123 - DNA, 8 bp, Unknown
  misc_feature (1)..( 8): Result.002 file - promoters60/1025211
ggaacaaa

SEQ ID NO: 100124 - DNA, 8 bp, Unknown
  misc_feature (1)..( 8): Result.002 file - promoters60/1025211
taaataaa

SEQ ID NO: 100125 - DNA, 8 bp, Unknown
  misc_feature (1)..( 8): Result.002 file - promoters60/1025211
caaacaaa

SEQ ID NO: 100126 - DNA, 8 bp, Unknown
  misc_feature (1)..( 8): Result.002 file - promoters60/1025211
taaaaaaa

SEQ ID NO: 100127 - DNA, 8 bp, Unknown
  misc_feature (1)..( 8): Result.002 file - promoters60/1025211
aaaacaat

SEQ ID NO: 100128 - DNA, 8 bp, Unknown
  misc_feature (1)..( 8): Result.002 file - promoters60/1025211
cgaacaat

SEQ ID NO: 100129 - DNA, 15 bp, Unknown
  misc_feature (1)..( 15): Result.002 file - promoters60/1025211
aaaattgggactaaa

SEQ ID NO: 100130 - DNA, 15 bp, Unknown
  misc_feature (1)..( 15): Result.002 file - promoters60/1025211
cttatttggataaaa

SEQ ID NO: 100131 - DNA, 15 bp, Unknown
  misc_feature (1)..( 15): Result.002 file - promoters60/1025211
ttcctttgaataaaa

SEQ ID NO: 100132 - DNA, 15 bp, Unknown
  misc_feature (1)..( 15): Result.002 file - promoters60/1025211
tttttttaaatgttt

SEQ ID NO: 100133 - DNA, 15 bp, Unknown
  misc_feature (1)..( 15): Result.002 file - promoters60/1025211
tccgttgacacgtaa

SEQ ID NO: 100134 - DNA, 15 bp, Unknown
  misc_feature (1)..( 15): Result.002 file - promoters60/1025211
tccaattaaaaagga

SEQ ID NO: 100135 - DNA, 13 bp, Unknown
  misc_feature (1)..( 13): Result.002 file - promoters60/1025211
aataaataaaagc

SEQ ID NO: 100136 - DNA, 13 bp, Unknown
  misc_feature (1)..( 13): Result.002 file - promoters60/1025211
aaacaataaaatt

SEQ ID NO: 100137 - DNA, 13 bp, Unknown
  misc_feature (1)..( 13): Result.002 file - promoters60/1025211
acattataaaata

SEQ ID NO: 100138 - DNA, 13 bp, Unknown
  misc_feature (1)..( 13): Result.002 file - promoters60/1025211
aaacagtaaaacc

SEQ ID NO: 100139 - DNA, 13 bp, Unknown
  misc_feature (1)..( 13): Result.002 file - promoters60/1025211
aggagataatatt

SEQ ID NO: 100140 - DNA, 14 bp, Unknown
  misc_feature (1)..( 14): Result.002 file - promoters60/1025211
aaaatttacaaact

SEQ ID NO: 100141 - DNA, 8 bp, Unknown
  misc_feature (1)..( 8): Result.002 file - promoters60/1025211
gaaaaaca

SEQ ID NO: 100142 - DNA, 8 bp, Unknown
  misc_feature (1)..( 8): Result.002 file - promoters60/1025211
gaaaaaat

SEQ ID NO: 100143 - DNA, 8 bp, Unknown
  misc_feature (1)..( 8): Result.002 file - promoters60/1025211
gaaaaaaa

SEQ ID NO: 100144 - DNA, 9 bp, Unknown
  misc_feature (1)..( 9): Result.002 file - promoters60/1025211
gaacaaaac

SEQ ID NO: 100145 - DNA, 9 bp, Unknown
  misc_feature (1)..( 9): Result.002 file - promoters60/1025211
taaaaaata

SEQ ID NO: 100146 - DNA, 9 bp, Unknown
  misc_feature (1)..( 9): Result.002 file - promoters60/1025211
aaaacaatt

SEQ ID NO: 100147 - DNA, 9 bp, Unknown
  misc_feature (1)..( 9): Result.002 file - promoters60/1025211
atttctata

SEQ ID NO: 100148 - DNA, 9 bp, Unknown
  misc_feature (1)..( 9): Result.002 file - promoters60/1025211
atttttata

SEQ ID NO: 100149 - DNA, 9 bp, Unknown
  misc_feature (1)..( 9): Result.002 file - promoters60/1025211
ttttctaaa

SEQ ID NO: 100150 - DNA, 9 bp, Unknown
  misc_feature (1)..( 9): Result.002 file - promoters60/1025211
gtttatatg

SEQ ID NO: 100151 - DNA, 9 bp, Unknown
  misc_feature (1)..( 9): Result.002 file - promoters60/1025211
aattaaatg

SEQ ID NO: 100152 - DNA, 10 bp, Unknown
  misc_feature (1)..( 10): Result.002 file - promoters60/1025211
atttcataac

SEQ ID NO: 100153 - DNA, 10 bp, Unknown
  misc_feature (1)..( 10): Result.002 file - promoters60/1025211
atttcatcgt

SEQ ID NO: 100154 - DNA, 10 bp, Unknown
  misc_feature (1)..( 10): Result.002 file - promoters60/1025340
atgagaatcc

SEQ ID NO: 100155 - DNA, 10 bp, Unknown
  misc_feature (1)..( 10): Result.002 file - promoters60/1025340
atgagaactc

SEQ ID NO: 100156 - DNA, 7 bp, Unknown
  misc_feature (1)..( 7): Result.002 file - promoters60/1025340
agaagag

SEQ ID NO: 100157 - DNA, 8 bp, Unknown
  misc_feature (1)..( 8): Result.002 file - promoters60/1025340
agaagatg

SEQ ID NO: 100158 - DNA, 8 bp, Unknown
  misc_feature (1)..( 8): Result.002 file - promoters60/1025340
cgaatatg

SEQ ID NO: 100159 - DNA, 8 bp, Unknown
  misc_feature (1)..( 8): Result.002 file - promoters60/1025340
agaagagt

SEQ ID NO: 100160 - DNA, 9 bp, Unknown
  misc_feature (1)..( 9): Result.002 file - promoters60/1025340
acattgttt

SEQ ID NO: 100161 - DNA, 9 bp, Unknown
  misc_feature (1)..( 9): Result.002 file - promoters60/1025340
cgatttttt

SEQ ID NO: 100162 - DNA, 9 bp, Unknown
  misc_feature (1)..( 9): Result.002 file - promoters60/1025340
acattgtta

SEQ ID NO: 100163 - DNA, 7 bp, Unknown
  misc_feature (1)..( 7): Result.002 file - promoters60/1025340
aaactta

SEQ ID NO: 100164 - DNA, 7 bp, Unknown
  misc_feature (1)..( 7): Result.002 file - promoters60/1025340
aaactta

SEQ ID NO: 100165 - DNA, 7 bp, Unknown
  misc_feature (1)..( 7): Result.002 file - promoters60/1025340
aaattta

SEQ ID NO: 100166 - DNA, 11 bp, Unknown
  misc_feature (1)..( 11): Result.002 file - promoters60/1025468
ttttgtagatt

SEQ ID NO: 100167 - DNA, 11 bp, Unknown
  misc_feature (1)..( 11): Result.002 file - promoters60/1025468
cattgtaggtc

SEQ ID NO: 100168 - DNA, 11 bp, Unknown
  misc_feature (1)..( 11): Result.002 file - promoters60/1025468
ttttgtggatt

SEQ ID NO: 100169 - DNA, 8 bp, Unknown
  misc_feature (1)..( 8): Result.002 file - promoters60/1025468
ttatatat

SEQ ID NO: 100170 - DNA, 8 bp, Unknown
  misc_feature (1)..( 8): Result.002 file - promoters60/1025468
gtatataa

SEQ ID NO: 100171 - DNA, 8 bp, Unknown
  misc_feature (1)..( 8): Result.002 file - promoters60/1025468
ttatgtat

SEQ ID NO: 100172 - DNA, 10 bp, Unknown
  misc_feature (1)..( 10): Result.002 file - promoters60/1025468
gataatgtat

SEQ ID NO: 100173 - DNA, 10 bp, Unknown
  misc_feature (1)..( 10): Result.002 file - promoters60/1025468
gatgatgtac

SEQ ID NO: 100174 - DNA, 10 bp, Unknown
  misc_feature (1)..( 10): Result.002 file - promoters60/1025468
ctaaatatat

SEQ ID NO: 100175 - DNA, 10 bp, Unknown
  misc_feature (1)..( 10): Result.002 file - promoters60/1025468
ttaaaaatag

SEQ ID NO: 100176 - DNA, 11 bp, Unknown
  misc_feature (1)..( 11): Result.002 file - promoters60/1025468
ctatattgcaa

SEQ ID NO: 100177 - DNA, 11 bp, Unknown
  misc_feature (1)..( 11): Result.002 file - promoters60/1025468
agatatagcaa

SEQ ID NO: 100178 - DNA, 11 bp, Unknown
  misc_feature (1)..( 11): Result.002 file - promoters60/1025468
aaatatagtat

SEQ ID NO: 100179 - DNA, 11 bp, Unknown
  misc_feature (1)..( 11): Result.002 file - promoters60/1025468
aaaaatatcca

SEQ ID NO: 100180 - DNA, 10 bp, Unknown
  misc_feature (1)..( 10): Result.002 file - promoters60/1025468
atagagaagt

SEQ ID NO: 100181 - DNA, 10 bp, Unknown
  misc_feature (1)..( 10): Result.002 file - promoters60/1025468
ttagaaaagt

SEQ ID NO: 100182 - DNA, 10 bp, Unknown
  misc_feature (1)..( 10): Result.002 file - promoters60/1025468
ttagaaatac

SEQ ID NO: 100183 - DNA, 12 bp, Unknown
  misc_feature (1)..( 12): Result.002 file - promoters60/1025468
gtagattaagta

SEQ ID NO: 100184 - DNA, 12 bp, Unknown
  misc_feature (1)..( 12): Result.002 file - promoters60/1025468
ctaggttatgta

SEQ ID NO: 100185 - DNA, 12 bp, Unknown
  misc_feature (1)..( 12): Result.002 file - promoters60/1025468
ctatgtttacac

SEQ ID NO: 100186 - DNA, 8 bp, Unknown
  misc_feature (1)..( 8): Result.002 file - promoters60/1025468
gtaaatag

SEQ ID NO: 100187 - DNA, 8 bp, Unknown
  misc_feature (1)..( 8): Result.002 file - promoters60/1025468
ataaatag

SEQ ID NO: 100188 - DNA, 8 bp, Unknown
  misc_feature (1)..( 8): Result.002 file - promoters60/1025468
gtacatac

SEQ ID NO: 100189 - DNA, 10 bp, Unknown
  misc_feature (1)..( 10): Result.002 file - promoters60/1025468
ataaaaagaa

SEQ ID NO: 100190 - DNA, 10 bp, Unknown
  misc_feature (1)..( 10): Result.002 file - promoters60/1025468
ataaaaacaa

SEQ ID NO: 100191 - DNA, 10 bp, Unknown
  misc_feature (1)..( 10): Result.002 file - promoters60/1025468
caaaaatcaa

SEQ ID NO: 100192 - DNA, 7 bp, Unknown
  misc_feature (1)..( 7): Result.002 file - promoters60/1025468
gaaacaa

SEQ ID NO: 100193 - DNA, 7 bp, Unknown
  misc_feature (1)..( 7): Result.002 file - promoters60/1025468
aaaacaa

SEQ ID NO: 100194 - DNA, 8 bp, Unknown
  misc_feature (1)..( 8): Result.002 file - promoters60/1025468
aaaatcaa

SEQ ID NO: 100195 - DNA, 9 bp, Unknown
  misc_feature (1)..( 9): Result.002 file - promoters60/1025468
taaaagatg

SEQ ID NO: 100196 - DNA, 9 bp, Unknown
  misc_feature (1)..( 9): Result.002 file - promoters60/1025468
ataaagatt

SEQ ID NO: 100197 - DNA, 9 bp, Unknown
  misc_feature (1)..( 9): Result.002 file - promoters60/1025468
taaaatatg

SEQ ID NO: 100198 - DNA, 9 bp, Unknown
  misc_feature (1)..( 9): Result.002 file - promoters60/1025468
aaccaaagc

SEQ ID NO: 100199 - DNA, 9 bp, Unknown
  misc_feature (1)..( 9): Result.002 file - promoters60/1025468
acccacagc

SEQ ID NO: 100200 - DNA, 9 bp, Unknown
  misc_feature (1)..( 9): Result.002 file - promoters60/1025468
aaccaaaga

SEQ ID NO: 100201 - DNA, 9 bp, Unknown
  misc_feature (1)..( 9): Result.002 file - promoters60/1025471
ctcgtattt

SEQ ID NO: 100202 - DNA, 9 bp, Unknown
  misc_feature (1)..( 9): Result.002 file - promoters60/1025471
gtcgtatgt

SEQ ID NO: 100203 - DNA, 9 bp, Unknown
  misc_feature (1)..( 9): Result.002 file - promoters60/1025471
aacgtatgt

SEQ ID NO: 100204 - DNA, 9 bp, Unknown
  misc_feature (1)..( 9): Result.002 file - promoters60/1025471
aacttattt

SEQ ID NO: 100205 - DNA, 9 bp, Unknown
  misc_feature (1)..( 9): Result.002 file - promoters60/1025471
cactaattc

SEQ ID NO: 100206 - DNA, 9 bp, Unknown
  misc_feature (1)..( 9): Result.002 file - promoters60/1025471
aactaatgc

SEQ ID NO: 100207 - DNA, 9 bp, Unknown
  misc_feature (1)..( 9): Result.002 file - promoters60/1025471
agactaacc

SEQ ID NO: 100208 - DNA, 9 bp, Unknown
  misc_feature (1)..( 9): Result.002 file - promoters60/1025471
cgactaaga

SEQ ID NO: 100209 - DNA, 9 bp, Unknown
  misc_feature (1)..( 9): Result.002 file - promoters60/1025471
aaactgaga

SEQ ID NO: 100210 - DNA, 9 bp, Unknown
  misc_feature (1)..( 9): Result.002 file - promoters60/1025471
tgaccaaga

SEQ ID NO: 100211 - DNA, 9 bp, Unknown
  misc_feature (1)..( 9): Result.002 file - promoters60/1025471
tgaaaaaat

SEQ ID NO: 100212 - DNA, 9 bp, Unknown
  misc_feature (1)..( 9): Result.002 file - promoters60/1025471
tcaaaaaaa

SEQ ID NO: 100213 - DNA, 10 bp, Unknown
  misc_feature (1)..( 10): Result.002 file - promoters60/1025511
ttaataataa

SEQ ID NO: 100214 - DNA, 10 bp, Unknown
  misc_feature (1)..( 10): Result.002 file - promoters60/1025511
gaaataataa

SEQ ID NO: 100215 - DNA, 10 bp, Unknown
  misc_feature (1)..( 10): Result.002 file - promoters60/1025511
agaatcatgc

SEQ ID NO: 100216 - DNA, 10 bp, Unknown
  misc_feature (1)..( 10): Result.002 file - promoters60/1025511
aaaataatca

SEQ ID NO: 100217 - DNA, 10 bp, Unknown
  misc_feature (1)..( 10): Result.002 file - promoters60/1025511
ttagtaatag

SEQ ID NO: 100218 - DNA, 10 bp, Unknown
  misc_feature (1)..( 10): Result.002 file - promoters60/1025511
gaagtaaaga

SEQ ID NO: 100219 - DNA, 10 bp, Unknown
  misc_feature (1)..( 10): Result.002 file - promoters60/1025511
acaataaaaa

SEQ ID NO: 100220 - DNA, 10 bp, Unknown
  misc_feature (1)..( 10): Result.002 file - promoters60/1025582
gagacaattg

SEQ ID NO: 100221 - DNA, 10 bp, Unknown
  misc_feature (1)..( 10): Result.002 file - promoters60/1025582
tttacatttg

SEQ ID NO: 100222 - DNA, 10 bp, Unknown
  misc_feature (1)..( 10): Result.002 file - promoters60/1025582
gagataattt

SEQ ID NO: 100223 - DNA, 10 bp, Unknown
  misc_feature (1)..( 10): Result.002 file - promoters60/1025582
gagagattct

SEQ ID NO: 100224 - DNA, 7 bp, Unknown
  misc_feature (1)..( 7): Result.002 file - promoters60/1025582
cagagac

SEQ ID NO: 100225 - DNA, 7 bp, Unknown
  misc_feature (1)..( 7): Result.002 file - promoters60/1025582
cagagat

SEQ ID NO: 100226 - DNA, 7 bp, Unknown
  misc_feature (1)..( 7): Result.002 file - promoters60/1025582
gagagat

SEQ ID NO: 100227 - DNA, 17 bp, Unknown
  misc_feature (1)..( 17): Result.002 file - promoters60/1025642
atattcagaattaatat

SEQ ID NO: 100228 - DNA, 17 bp, Unknown
  misc_feature (1)..( 17): Result.002 file - promoters60/1025642
gaaatcataattaataa

SEQ ID NO: 100229 - DNA, 17 bp, Unknown
  misc_feature (1)..( 17): Result.002 file - promoters60/1025642
tactatataatgaatat

SEQ ID NO: 100230 - DNA, 17 bp, Unknown
  misc_feature (1)..( 17): Result.002 file - promoters60/1025642
acaccatttattaacat

SEQ ID NO: 100231 - DNA, 17 bp, Unknown
  misc_feature (1)..( 17): Result.002 file - promoters60/1025642
gaaaacatacttaatcg

SEQ ID NO: 100232 - DNA, 17 bp, Unknown
  misc_feature (1)..( 17): Result.002 file - promoters60/1025642
gtatacatgatttgaat

SEQ ID NO: 100233 - DNA, 17 bp, Unknown
  misc_feature (1)..( 17): Result.002 file - promoters60/1025642
aaatattttattcaaaa

SEQ ID NO: 100234 - DNA, 17 bp, Unknown
  misc_feature (1)..( 17): Result.002 file - promoters60/1025642
atgatgatgatgaatgt

SEQ ID NO: 100235 - DNA, 10 bp, Unknown
  misc_feature (1)..( 10): Result.002 file - promoters60/1025642
ccaaatttgg

SEQ ID NO: 100236 - DNA, 10 bp, Unknown
  misc_feature (1)..( 10): Result.002 file - promoters60/1025642
ccaattttaa

SEQ ID NO: 100237 - DNA, 10 bp, Unknown
  misc_feature (1)..( 10): Result.002 file - promoters60/1025642
ataattttgc

SEQ ID NO: 100238 - DNA, 12 bp, Unknown
  misc_feature (1)..( 12): Result.002 file - promoters60/1025642
ctaatgatttag

SEQ ID NO: 100239 - DNA, 12 bp, Unknown
  misc_feature (1)..( 12): Result.002 file - promoters60/1025642
ctaagtttggtt

SEQ ID NO: 100240 - DNA, 12 bp, Unknown
  misc_feature (1)..( 12): Result.002 file - promoters60/1025642
taggagatttag

SEQ ID NO: 100241 - DNA, 12 bp, Unknown
  misc_feature (1)..( 12): Result.002 file - promoters60/1025642
accaatattcag

SEQ ID NO: 100242 - DNA, 12 bp, Unknown
  misc_feature (1)..( 12): Result.002 file - promoters60/1025642
taaaatatttta

SEQ ID NO: 100243 - DNA, 12 bp, Unknown
  misc_feature (1)..( 12): Result.002 file - promoters60/1025642
accattatcgct

SEQ ID NO: 100244 - DNA, 12 bp, Unknown
  misc_feature (1)..( 12): Result.002 file - promoters60/1025642
taaaagattcga

SEQ ID NO: 100245 - DNA, 12 bp, Unknown
  misc_feature (1)..( 12): Result.002 file - promoters60/1025642
aaaactatatat

SEQ ID NO: 100246 - DNA, 12 bp, Unknown
  misc_feature (1)..( 12): Result.002 file - promoters60/1025642
gggtagattcga

SEQ ID NO: 100247 - DNA, 18 bp, Unknown
  misc_feature (1)..( 18): Result.002 file - promoters60/1025642
tagctaacaaataatttt

SEQ ID NO: 100248 - DNA, 18 bp, Unknown
  misc_feature (1)..( 18): Result.002 file - promoters60/1025642
attttaagaaagtatata

SEQ ID NO: 100249 - DNA, 18 bp, Unknown
  misc_feature (1)..( 18): Result.002 file - promoters60/1025642
tttttaaaaaactatata

SEQ ID NO: 100250 - DNA, 18 bp, Unknown
  misc_feature (1)..( 18): Result.002 file - promoters60/1025642
ttcgataaaagctaatgt

SEQ ID NO: 100251 - DNA, 18 bp, Unknown
  misc_feature (1)..( 18): Result.002 file - promoters60/1025642
cctttaaaagattcgact

SEQ ID NO: 100252 - DNA, 18 bp, Unknown
  misc_feature (1)..( 18): Result.002 file - promoters60/1025642
tttttatctgagaaattt

SEQ ID NO: 100253 - DNA, 10 bp, Unknown
  misc_feature (1)..( 10): Result.002 file - promoters60/1025683
cctttataaa

SEQ ID NO: 100254 - DNA, 10 bp, Unknown
  misc_feature (1)..( 10): Result.002 file - promoters60/1025683
cctatatata

SEQ ID NO: 100255 - DNA, 10 bp, Unknown
  misc_feature (1)..( 10): Result.002 file - promoters60/1025683
gtcttataaa

SEQ ID NO: 100256 - DNA, 10 bp, Unknown
  misc_feature (1)..( 10): Result.002 file - promoters60/1025683
ccactataaa

SEQ ID NO: 100257 - DNA, 10 bp, Unknown
  misc_feature (1)..( 10): Result.002 file - promoters60/1025683
gttatataaa

SEQ ID NO: 100258 - DNA, 10 bp, Unknown
  misc_feature (1)..( 10): Result.002 file - promoters60/1025683
cttatttatg

SEQ ID NO: 100259 - DNA, 10 bp, Unknown
  misc_feature (1)..( 10): Result.002 file - promoters60/1025683
cccttatatt

SEQ ID NO: 100260 - DNA, 12 bp, Unknown
  misc_feature (1)..( 12): Result.002 file - promoters60/1025683
ctatttacaatg

SEQ ID NO: 100261 - DNA, 12 bp, Unknown
  misc_feature (1)..( 12): Result.002 file - promoters60/1025683
gtatttactttg

SEQ ID NO: 100262 - DNA, 12 bp, Unknown
  misc_feature (1)..( 12): Result.002 file - promoters60/1025683
aagtttaaaatg

SEQ ID NO: 100263 - DNA, 12 bp, Unknown
  misc_feature (1)..( 12): Result.002 file - promoters60/1025683
ctttttaaagtt

SEQ ID NO: 100264 - DNA, 12 bp, Unknown
  misc_feature (1)..( 12): Result.002 file - promoters60/1025683
cttattaaagct

SEQ ID NO: 100265 - DNA, 12 bp, Unknown
  misc_feature (1)..( 12): Result.002 file - promoters60/1025683
tatttcaaatga

SEQ ID NO: 100266 - DNA, 14 bp, Unknown
  misc_feature (1)..( 14): Result.002 file - promoters60/1025683
tctaatgaaatttt

SEQ ID NO: 100267 - DNA, 14 bp, Unknown
  misc_feature (1)..( 14): Result.002 file - promoters60/1025683
aaaaatgtaatttt

SEQ ID NO: 100268 - DNA, 14 bp, Unknown
  misc_feature (1)..( 14): Result.002 file - promoters60/1025683
tataatgaatttgt

SEQ ID NO: 100269 - DNA, 14 bp, Unknown
  misc_feature (1)..( 14): Result.002 file - promoters60/1025683
tggatggtagtttt

SEQ ID NO: 100270 - DNA, 14 bp, Unknown
  misc_feature (1)..( 14): Result.002 file - promoters60/1025683
tatactgatttccg

SEQ ID NO: 100271 - DNA, 14 bp, Unknown
  misc_feature (1)..( 14): Result.002 file - promoters60/1025683
gatacttattctaa

SEQ ID NO: 100272 - DNA, 14 bp, Unknown
  misc_feature (1)..( 14): Result.002 file - promoters60/1025683
agtaacttaaattt

SEQ ID NO: 100273 - DNA, 14 bp, Unknown
  misc_feature (1)..( 14): Result.002 file - promoters60/1025683
agggatttagatta

SEQ ID NO: 100274 - DNA, 14 bp, Unknown
  misc_feature (1)..( 14): Result.002 file - promoters60/1025683
gataaaataaattg

SEQ ID NO: 100275 - DNA, 14 bp, Unknown
  misc_feature (1)..( 14): Result.002 file - promoters60/1025683
agggatatagaaca

SEQ ID NO: 100276 - DNA, 14 bp, Unknown
  misc_feature (1)..( 14): Result.002 file - promoters60/1025683
aaacattgagattt

SEQ ID NO: 100277 - DNA, 14 bp, Unknown
  misc_feature (1)..( 14): Result.002 file - promoters60/1025683
gaagaaaaaaattg

SEQ ID NO: 100278 - DNA, 11 bp, Unknown
  misc_feature (1)..( 11): Result.002 file - promoters60/1025707
aatgatacaaa

SEQ ID NO: 100279 - DNA, 11 bp, Unknown
  misc_feature (1)..( 11): Result.002 file - promoters60/1025707
aatcatacaac

SEQ ID NO: 100280 - DNA, 11 bp, Unknown
  misc_feature (1)..( 11): Result.002 file - promoters60/1025707
atacatagaaa

SEQ ID NO: 100281 - DNA, 6 bp, Unknown
  misc_feature (1)..( 6): Result.002 file - promoters60/1025707
tcttga

SEQ ID NO: 100282 - DNA, 6 bp, Unknown
  misc_feature (1)..( 6): Result.002 file - promoters60/1025707
tcttga

SEQ ID NO: 100283 - DNA, 7 bp, Unknown
  misc_feature (1)..( 7): Result.002 file - promoters60/1025707
tagtata

SEQ ID NO: 100284 - DNA, 7 bp, Unknown
  misc_feature (1)..( 7): Result.002 file - promoters60/1025707
tagaata

SEQ ID NO: 100285 - DNA, 11 bp, Unknown
  misc_feature (1)..( 11): Result.002 file - promoters60/1025707
acacgttaagt

SEQ ID NO: 100286 - DNA, 11 bp, Unknown
  misc_feature (1)..( 11): Result.002 file - promoters60/1025707
acacattaagt

SEQ ID NO: 100287 - DNA, 11 bp, Unknown
  misc_feature (1)..( 11): Result.002 file - promoters60/1025707
gataattaaga

SEQ ID NO: 100288 - DNA, 7 bp, Unknown
  misc_feature (1)..( 7): Result.002 file - promoters60/1025707
caaataa

SEQ ID NO: 100289 - DNA, 7 bp, Unknown
  misc_feature (1)..( 7): Result.002 file - promoters60/1025707
caagtaa

SEQ ID NO: 100290 - DNA, 7 bp, Unknown
  misc_feature (1)..( 7): Result.002 file - promoters60/1025707
ctatata

SEQ ID NO: 100291 - DNA, 7 bp, Unknown
  misc_feature (1)..( 7): Result.002 file - promoters60/1025707
ctaaata

SEQ ID NO: 100292 - DNA, 6 bp, Unknown
  misc_feature (1)..( 6): Result.002 file - promoters60/1025707
tataaa

SEQ ID NO: 100293 - DNA, 6 bp, Unknown
  misc_feature (1)..( 6): Result.002 file - promoters60/1025707
tataaa

SEQ ID NO: 100294 - DNA, 7 bp, Unknown
  misc_feature (1)..( 7): Result.002 file - promoters60/1025707
cacacaa

SEQ ID NO: 100295 - DNA, 7 bp, Unknown
  misc_feature (1)..( 7): Result.002 file - promoters60/1025707
cacccaa

SEQ ID NO: 100296 - DNA, 7 bp, Unknown
  misc_feature (1)..( 7): Result.002 file - promoters60/1025707
aatatca

SEQ ID NO: 100297 - DNA, 7 bp, Unknown
  misc_feature (1)..( 7): Result.002 file - promoters60/1025707
aatctca

SEQ ID NO: 100298 - DNA, 8 bp, Unknown
  misc_feature (1)..( 8): Result.002 file - promoters60/1025707
atacaaat

SEQ ID NO: 100299 - DNA, 8 bp, Unknown
  misc_feature (1)..( 8): Result.002 file - promoters60/1025707
atagaaat

SEQ ID NO: 100300 - DNA, 7 bp, Unknown
  misc_feature (1)..( 7): Result.002 file - promoters60/1025707
atacata

SEQ ID NO: 100301 - DNA, 7 bp, Unknown
  misc_feature (1)..( 7): Result.002 file - promoters60/1025707
ataaata

SEQ ID NO: 100302 - DNA, 8 bp, Unknown
  misc_feature (1)..( 8): Result.002 file - promoters60/1025707
aatattaa

SEQ ID NO: 100303 - DNA, 8 bp, Unknown
  misc_feature (1)..( 8): Result.002 file - promoters60/1025707
aataataa

SEQ ID NO: 100304 - DNA, 8 bp, Unknown
  misc_feature (1)..( 8): Result.002 file - promoters60/1025707
acaagaag

SEQ ID NO: 100305 - DNA, 8 bp, Unknown
  misc_feature (1)..( 8): Result.002 file - promoters60/1025707
acaaaaag

SEQ ID NO: 100306 - DNA, 6 bp, Unknown
  misc_feature (1)..( 6): Result.002 file - promoters60/1025707
ataaac

SEQ ID NO: 100307 - DNA, 6 bp, Unknown
  misc_feature (1)..( 6): Result.002 file - promoters60/1025707
ataaac

SEQ ID NO: 100308 - DNA, 7 bp, Unknown
  misc_feature (1)..( 7): Result.002 file - promoters60/1025707
tgaacaa

SEQ ID NO: 100309 - DNA, 7 bp, Unknown
  misc_feature (1)..( 7): Result.002 file - promoters60/1025707
tgatcaa

SEQ ID NO: 100310 - DNA, 6 bp, Unknown
  misc_feature (1)..( 6): Result.002 file - promoters60/1025707
cgatta

SEQ ID NO: 100311 - DNA, 6 bp, Unknown
  misc_feature (1)..( 6): Result.002 file - promoters60/1025707
cgatta

SEQ ID NO: 100312 - DNA, 6 bp, Unknown
  misc_feature (1)..( 6): Result.002 file - promoters60/1025707
ttttga

SEQ ID NO: 100313 - DNA, 6 bp, Unknown
  misc_feature (1)..( 6): Result.002 file - promoters60/1025707
ttttga

SEQ ID NO: 100314 - DNA, 6 bp, Unknown
  misc_feature (1)..( 6): Result.002 file - promoters60/1025707
acagta

SEQ ID NO: 100315 - DNA, 6 bp, Unknown
  misc_feature (1)..( 6): Result.002 file - promoters60/1025707
acagta

SEQ ID NO: 100316 - DNA, 7 bp, Unknown
  misc_feature (1)..( 7): Result.002 file - promoters60/1025707
taaaata

SEQ ID NO: 100317 - DNA, 7 bp, Unknown
  misc_feature (1)..( 7): Result.002 file - promoters60/1025707
taatata

SEQ ID NO: 100318 - DNA, 6 bp, Unknown
  misc_feature (1)..( 6): Result.002 file - promoters60/1025707
ttgaca

SEQ ID NO: 100319 - DNA, 6 bp, Unknown
  misc_feature (1)..( 6): Result.002 file - promoters60/1025707
ttgaca

SEQ ID NO: 100320 - DNA, 7 bp, Unknown
  misc_feature (1)..( 7): Result.002 file - promoters60/1025707
aaccaag

SEQ ID NO: 100321 - DNA, 7 bp, Unknown
  misc_feature (1)..( 7): Result.002 file - promoters60/1025707
aacgaag

SEQ ID NO: 100322 - DNA, 8 bp, Unknown
  misc_feature (1)..( 8): Result.002 file - promoters60/1025707
acgatgac

SEQ ID NO: 100323 - DNA, 8 bp, Unknown
  misc_feature (1)..( 8): Result.002 file - promoters60/1025707
acgatgac

SEQ ID NO: 100324 - DNA, 12 bp, Unknown
  misc_feature (1)..( 12): Result.002 file - promoters60/1025791
ttaaccttagcg

SEQ ID NO: 100325 - DNA, 12 bp, Unknown
  misc_feature (1)..( 12): Result.002 file - promoters60/1025791
ttaatcttaatc

SEQ ID NO: 100326 - DNA, 12 bp, Unknown
  misc_feature (1)..( 12): Result.002 file - promoters60/1025791
ataagcttagag

SEQ ID NO: 100327 - DNA, 12 bp, Unknown
  misc_feature (1)..( 12): Result.002 file - promoters60/1025791
aaaattttattg

SEQ ID NO: 100328 - DNA, 12 bp, Unknown
  misc_feature (1)..( 12): Result.002 file - promoters60/1025791
cgtgacttggag

SEQ ID NO: 100329 - DNA, 12 bp, Unknown
  misc_feature (1)..( 12): Result.002 file - promoters60/1025791
tagagcctagag

SEQ ID NO: 100330 - DNA, 13 bp, Unknown
  misc_feature (1)..( 13): Result.002 file - promoters60/1025791
aattgggcccaat

SEQ ID NO: 100331 - DNA, 13 bp, Unknown
  misc_feature (1)..( 13): Result.002 file - promoters60/1025791
cattaggctttaa

SEQ ID NO: 100332 - DNA, 13 bp, Unknown
  misc_feature (1)..( 13): Result.002 file - promoters60/1025791
aaatgggcctaat

SEQ ID NO: 100333 - DNA, 13 bp, Unknown
  misc_feature (1)..( 13): Result.002 file - promoters60/1025791
aattggaaatagg

SEQ ID NO: 100334 - DNA, 13 bp, Unknown
  misc_feature (1)..( 13): Result.002 file - promoters60/1025791
tgttgggctttta

SEQ ID NO: 100335 - DNA, 13 bp, Unknown
  misc_feature (1)..( 13): Result.002 file - promoters60/1025791
cattagtggataa

SEQ ID NO: 100336 - DNA, 13 bp, Unknown
  misc_feature (1)..( 13): Result.002 file - promoters60/1025791
caatgggctgggc

SEQ ID NO: 100337 - DNA, 8 bp, Unknown
  misc_feature (1)..( 8): Result.002 file - promoters60/1026014
aatattta

SEQ ID NO: 100338 - DNA, 8 bp, Unknown
  misc_feature (1)..( 8): Result.002 file - promoters60/1026014
aatttttt

SEQ ID NO: 100339 - DNA, 8 bp, Unknown
  misc_feature (1)..( 8): Result.002 file - promoters60/1026014
gatatttt

SEQ ID NO: 100340 - DNA, 8 bp, Unknown
  misc_feature (1)..( 8): Result.002 file - promoters60/1026014
aatattat

SEQ ID NO: 100341 - DNA, 8 bp, Unknown
  misc_feature (1)..( 8): Result.002 file - promoters60/1026014
tatttttt

SEQ ID NO: 100342 - DNA, 11 bp, Unknown
  misc_feature (1)..( 11): Result.002 file - promoters60/1026014
tttataaccat

SEQ ID NO: 100343 - DNA, 11 bp, Unknown
  misc_feature (1)..( 11): Result.002 file - promoters60/1026014
tttataacaaa

SEQ ID NO: 100344 - DNA, 11 bp, Unknown
  misc_feature (1)..( 11): Result.002 file - promoters60/1026014
attagaactaa

SEQ ID NO: 100345 - DNA, 11 bp, Unknown
  misc_feature (1)..( 11): Result.002 file - promoters60/1026014
tcaataataaa

SEQ ID NO: 100346 - DNA, 9 bp, Unknown
  misc_feature (1)..( 9): Result.002 file - promoters60/1026014
taaaaaaaa

SEQ ID NO: 100347 - DNA, 9 bp, Unknown
  misc_feature (1)..( 9): Result.002 file - promoters60/1026014
caaaataaa

SEQ ID NO: 100348 - DNA, 9 bp, Unknown
  misc_feature (1)..( 9): Result.002 file - promoters60/1026014
taaaaaaac

SEQ ID NO: 100349 - DNA, 9 bp, Unknown
  misc_feature (1)..( 9): Result.002 file - promoters60/1026014
aaaaagaac

SEQ ID NO: 100350 - DNA, 13 bp, Unknown
  misc_feature (1)..( 13): Result.002 file - promoters60/1026014
actttcataaatc

SEQ ID NO: 100351 - DNA, 13 bp, Unknown
  misc_feature (1)..( 13): Result.002 file - promoters60/1026014
gattttataatat

SEQ ID NO: 100352 - DNA, 13 bp, Unknown
  misc_feature (1)..( 13): Result.002 file - promoters60/1026014
tattttataggtc

SEQ ID NO: 100353 - DNA, 13 bp, Unknown
  misc_feature (1)..( 13): Result.002 file - promoters60/1026014
gatattacagttt

SEQ ID NO: 100354 - DNA, 13 bp, Unknown
  misc_feature (1)..( 13): Result.002 file - promoters60/1026014
ggatttctaataa

SEQ ID NO: 100355 - DNA, 13 bp, Unknown
  misc_feature (1)..( 13): Result.002 file - promoters60/1026014
attcgtaaaaatt

SEQ ID NO: 100356 - DNA, 10 bp, Unknown
  misc_feature (1)..( 10): Result.002 file - promoters60/1026014
ttttatgtta

SEQ ID NO: 100357 - DNA, 10 bp, Unknown
  misc_feature (1)..( 10): Result.002 file - promoters60/1026014
atttatatta

SEQ ID NO: 100358 - DNA, 10 bp, Unknown
  misc_feature (1)..( 10): Result.002 file - promoters60/1026014
ttttatttgc

SEQ ID NO: 100359 - DNA, 10 bp, Unknown
  misc_feature (1)..( 10): Result.002 file - promoters60/1026014
atttgtttga

SEQ ID NO: 100360 - DNA, 14 bp, Unknown
  misc_feature (1)..( 14): Result.002 file - promoters60/1026014
ttttactttgataa

SEQ ID NO: 100361 - DNA, 14 bp, Unknown
  misc_feature (1)..( 14): Result.002 file - promoters60/1026014
acttattttatgaa

SEQ ID NO: 100362 - DNA, 14 bp, Unknown
  misc_feature (1)..( 14): Result.002 file - promoters60/1026014
aattattttaattt

SEQ ID NO: 100363 - DNA, 14 bp, Unknown
  misc_feature (1)..( 14): Result.002 file - promoters60/1026014
aatcattatctttc

SEQ ID NO: 100364 - DNA, 14 bp, Unknown
  misc_feature (1)..( 14): Result.002 file - promoters60/1026014
aactaatttagcgt

SEQ ID NO: 100365 - DNA, 9 bp, Unknown
  misc_feature (1)..( 9): Result.002 file - promoters60/1026014
acaatattt

SEQ ID NO: 100366 - DNA, 9 bp, Unknown
  misc_feature (1)..( 9): Result.002 file - promoters60/1026014
acaaaattg

SEQ ID NO: 100367 - DNA, 9 bp, Unknown
  misc_feature (1)..( 9): Result.002 file - promoters60/1026014
acaaaatta

SEQ ID NO: 100368 - DNA, 9 bp, Unknown
  misc_feature (1)..( 9): Result.002 file - promoters60/1026014
agcaaattg

SEQ ID NO: 100369 - DNA, 12 bp, Unknown
  misc_feature (1)..( 12): Result.002 file - promoters60/1026014
acagaaaaaaga

SEQ ID NO: 100370 - DNA, 12 bp, Unknown
  misc_feature (1)..( 12): Result.002 file - promoters60/1026014
gaagaaaaaaaa

SEQ ID NO: 100371 - DNA, 12 bp, Unknown
  misc_feature (1)..( 12): Result.002 file - promoters60/1026014
aaataaaaattg

SEQ ID NO: 100372 - DNA, 12 bp, Unknown
  misc_feature (1)..( 12): Result.002 file - promoters60/1026014
cattaataatcc

SEQ ID NO: 100373 - DNA, 12 bp, Unknown
  misc_feature (1)..( 12): Result.002 file - promoters60/1026014
actgattttgga

SEQ ID NO: 100374 - DNA, 12 bp, Unknown
  misc_feature (1)..( 12): Result.002 file - promoters60/1026014
aaagattttata

SEQ ID NO: 100375 - DNA, 12 bp, Unknown
  misc_feature (1)..( 12): Result.002 file - promoters60/1026014
aataattatata

SEQ ID NO: 100376 - DNA, 12 bp, Unknown
  misc_feature (1)..( 12): Result.002 file - promoters60/1026014
ctttattttata

SEQ ID NO: 100377 - DNA, 12 bp, Unknown
  misc_feature (1)..( 12): Result.002 file - promoters60/1026014
aaaaatttacac

SEQ ID NO: 100378 - DNA, 11 bp, Unknown
  misc_feature (1)..( 11): Result.002 file - promoters60/1026014
caaaatcattt

SEQ ID NO: 100379 - DNA, 11 bp, Unknown
  misc_feature (1)..( 11): Result.002 file - promoters60/1026014
aaaaaacattg

SEQ ID NO: 100380 - DNA, 12 bp, Unknown
  misc_feature (1)..( 12): Result.002 file - promoters60/1026014
aaataaaaattg

SEQ ID NO: 100381 - DNA, 12 bp, Unknown
  misc_feature (1)..( 12): Result.002 file - promoters60/1026014
cattaataatcc

SEQ ID NO: 100382 - DNA, 7 bp, Unknown
  misc_feature (1)..( 7): Result.002 file - promoters60/1026039
taacgtt

SEQ ID NO: 100383 - DNA, 7 bp, Unknown
  misc_feature (1)..( 7): Result.002 file - promoters60/1026039
taaggtt

SEQ ID NO: 100384 - DNA, 15 bp, Unknown
  misc_feature (1)..( 15): Result.002 file - promoters60/1026039
aaaagcatacaaata

SEQ ID NO: 100385 - DNA, 15 bp, Unknown
  misc_feature (1)..( 15): Result.002 file - promoters60/1026039
aaaagaatagcttct

SEQ ID NO: 100386 - DNA, 15 bp, Unknown
  misc_feature (1)..( 15): Result.002 file - promoters60/1026039
gaaggcatacagata

SEQ ID NO: 100387 - DNA, 6 bp, Unknown
  misc_feature (1)..( 6): Result.002 file - promoters60/1026039
tcaact

SEQ ID NO: 100388 - DNA, 6 bp, Unknown
  misc_feature (1)..( 6): Result.002 file - promoters60/1026039
tcaact

SEQ ID NO: 100389 - DNA, 7 bp, Unknown
  misc_feature (1)..( 7): Result.002 file - promoters60/1026039
aacttcg

SEQ ID NO: 100390 - DNA, 7 bp, Unknown
  misc_feature (1)..( 7): Result.002 file - promoters60/1026039
aacgtcg

SEQ ID NO: 100391 - DNA, 7 bp, Unknown
  misc_feature (1)..( 7): Result.002 file - promoters60/1026039
ctattat

SEQ ID NO: 100392 - DNA, 7 bp, Unknown
  misc_feature (1)..( 7): Result.002 file - promoters60/1026039
ctagtat

SEQ ID NO: 100393 - DNA, 7 bp, Unknown
  misc_feature (1)..( 7): Result.002 file - promoters60/1026039
ctattac

SEQ ID NO: 100394 - DNA, 8 bp, Unknown
  misc_feature (1)..( 8): Result.002 file - promoters60/1026039
attgtatt

SEQ ID NO: 100395 - DNA, 8 bp, Unknown
  misc_feature (1)..( 8): Result.002 file - promoters60/1026039
attatatt

SEQ ID NO: 100396 - DNA, 9 bp, Unknown
  misc_feature (1)..( 9): Result.002 file - promoters60/1026039
aaatatcaa

SEQ ID NO: 100397 - DNA, 9 bp, Unknown
  misc_feature (1)..( 9): Result.002 file - promoters60/1026039
aaataacaa

SEQ ID NO: 100398 - DNA, 7 bp, Unknown
  misc_feature (1)..( 7): Result.002 file - promoters60/1026039
ttaatca

SEQ ID NO: 100399 - DNA, 7 bp, Unknown
  misc_feature (1)..( 7): Result.002 file - promoters60/1026039
ttattca

SEQ ID NO: 100400 - DNA, 6 bp, Unknown
  misc_feature (1)..( 6): Result.002 file - promoters60/1026039
tttctt

SEQ ID NO: 100401 - DNA, 6 bp, Unknown
  misc_feature (1)..( 6): Result.002 file - promoters60/1026039
tttctt

SEQ ID NO: 100402 - DNA, 6 bp, Unknown
  misc_feature (1)..( 6): Result.002 file - promoters60/1026039
caagaa

SEQ ID NO: 100403 - DNA, 6 bp, Unknown
  misc_feature (1)..( 6): Result.002 file - promoters60/1026039
caagaa

SEQ ID NO: 100404 - DNA, 8 bp, Unknown
  misc_feature (1)..( 8): Result.002 file - promoters60/1026039
acgttatt

SEQ ID NO: 100405 - DNA, 8 bp, Unknown
  misc_feature (1)..( 8): Result.002 file - promoters60/1026039
tggttatt

SEQ ID NO: 100406 - DNA, 8 bp, Unknown
  misc_feature (1)..( 8): Result.002 file - promoters60/1026039
tgggtata

SEQ ID NO: 100407 - DNA, 6 bp, Unknown
  misc_feature (1)..( 6): Result.002 file - promoters60/1026039
ctttgt

SEQ ID NO: 100408 - DNA, 6 bp, Unknown
  misc_feature (1)..( 6): Result.002 file - promoters60/1026039
ctttgt

SEQ ID NO: 100409 - DNA, 7 bp, Unknown
  misc_feature (1)..( 7): Result.002 file - promoters60/1026039
tttcaac

SEQ ID NO: 100410 - DNA, 7 bp, Unknown
  misc_feature (1)..( 7): Result.002 file - promoters60/1026039
ttttaac

SEQ ID NO: 100411 - DNA, 6 bp, Unknown
  misc_feature (1)..( 6): Result.002 file - promoters60/1026039
attaaa

SEQ ID NO: 100412 - DNA, 6 bp, Unknown
  misc_feature (1)..( 6): Result.002 file - promoters60/1026039
attaaa

SEQ ID NO: 100413 - DNA, 7 bp, Unknown
  misc_feature (1)..( 7): Result.002 file - promoters60/1026039
tacgtaa

SEQ ID NO: 100414 - DNA, 7 bp, Unknown
  misc_feature (1)..( 7): Result.002 file - promoters60/1026039
tacataa

SEQ ID NO: 100415 - DNA, 6 bp, Unknown
  misc_feature (1)..( 6): Result.002 file - promoters60/1026039
gtaaaa

SEQ ID NO: 100416 - DNA, 6 bp, Unknown
  misc_feature (1)..( 6): Result.002 file - promoters60/1026039
gtaaaa

SEQ ID NO: 100417 - DNA, 9 bp, Unknown
  misc_feature (1)..( 9): Result.002 file - promoters60/1026039
aaatagtta

SEQ ID NO: 100418 - DNA, 9 bp, Unknown
  misc_feature (1)..( 9): Result.002 file - promoters60/1026039
aaatattta

SEQ ID NO: 100419 - DNA, 8 bp, Unknown
  misc_feature (1)..( 8): Result.002 file - promoters60/1026039
caatactt

SEQ ID NO: 100420 - DNA, 8 bp, Unknown
  misc_feature (1)..( 8): Result.002 file - promoters60/1026039
caaaactt

SEQ ID NO: 100421 - DNA, 6 bp, Unknown
  misc_feature (1)..( 6): Result.002 file - promoters60/1026039
gttcta

SEQ ID NO: 100422 - DNA, 6 bp, Unknown
  misc_feature (1)..( 6): Result.002 file - promoters60/1026039
gttcta

SEQ ID NO: 100423 - DNA, 7 bp, Unknown
  misc_feature (1)..( 7): Result.002 file - promoters60/1026039
atatttt

SEQ ID NO: 100424 - DNA, 7 bp, Unknown
  misc_feature (1)..( 7): Result.002 file - promoters60/1026039
atacttt

SEQ ID NO: 100425 - DNA, 16 bp, Unknown
  misc_feature (1)..( 16): Result.002 file - promoters60/1026160
gatactgcccaaactt

SEQ ID NO: 100426 - DNA, 16 bp, Unknown
  misc_feature (1)..( 16): Result.002 file - promoters60/1026160
aaataggcccaacaaa

SEQ ID NO: 100427 - DNA, 16 bp, Unknown
  misc_feature (1)..( 16): Result.002 file - promoters60/1026160
ctaaaggcccaataac

SEQ ID NO: 100428 - DNA, 16 bp, Unknown
  misc_feature (1)..( 16): Result.002 file - promoters60/1026160
aaaaaggcccattata

SEQ ID NO: 100429 - DNA, 16 bp, Unknown
  misc_feature (1)..( 16): Result.002 file - promoters60/1026160
aataaagcccattata

SEQ ID NO: 100430 - DNA, 16 bp, Unknown
  misc_feature (1)..( 16): Result.002 file - promoters60/1026160
ttttttatttaaaaaa

SEQ ID NO: 100431 - DNA, 9 bp, Unknown
  misc_feature (1)..( 9): Result.002 file - promoters60/1026160
catataaag

SEQ ID NO: 100432 - DNA, 9 bp, Unknown
  misc_feature (1)..( 9): Result.002 file - promoters60/1026160
aataaaaag

SEQ ID NO: 100433 - DNA, 9 bp, Unknown
  misc_feature (1)..( 9): Result.002 file - promoters60/1026160
tttataaaa

SEQ ID NO: 100434 - DNA, 9 bp, Unknown
  misc_feature (1)..( 9): Result.002 file - promoters60/1026160
tatataaaa

SEQ ID NO: 100435 - DNA, 10 bp, Unknown
  misc_feature (1)..( 10): Result.002 file - promoters60/1026160
actattaaag

SEQ ID NO: 100436 - DNA, 10 bp, Unknown
  misc_feature (1)..( 10): Result.002 file - promoters60/1026160
cactataaaa

SEQ ID NO: 100437 - DNA, 10 bp, Unknown
  misc_feature (1)..( 10): Result.002 file - promoters60/1026160
cactatataa

SEQ ID NO: 100438 - DNA, 6 bp, Unknown
  misc_feature (1)..( 6): Result.002 file - promoters60/1026353
ttttag

SEQ ID NO: 100439 - DNA, 6 bp, Unknown
  misc_feature (1)..( 6): Result.002 file - promoters60/1026353
ttttag

SEQ ID NO: 100440 - DNA, 6 bp, Unknown
  misc_feature (1)..( 6): Result.002 file - promoters60/1026353
agtttt

SEQ ID NO: 100441 - DNA, 6 bp, Unknown
  misc_feature (1)..( 6): Result.002 file - promoters60/1026353
agtttt

SEQ ID NO: 100442 - DNA, 10 bp, Unknown
  misc_feature (1)..( 10): Result.002 file - promoters60/1026353
ttataattta

SEQ ID NO: 100443 - DNA, 10 bp, Unknown
  misc_feature (1)..( 10): Result.002 file - promoters60/1026353
ttatatttta

SEQ ID NO: 100444 - DNA, 10 bp, Unknown
  misc_feature (1)..( 10): Result.002 file - promoters60/1026353
atgctttata

SEQ ID NO: 100445 - DNA, 10 bp, Unknown
  misc_feature (1)..( 10): Result.002 file - promoters60/1026353
atgcattata

SEQ ID NO: 100446 - DNA, 7 bp, Unknown
  misc_feature (1)..( 7): Result.002 file - promoters60/1026353
tagtatt

SEQ ID NO: 100447 - DNA, 7 bp, Unknown
  misc_feature (1)..( 7): Result.002 file - promoters60/1026353
taggatt

SEQ ID NO: 100448 - DNA, 7 bp, Unknown
  misc_feature (1)..( 7): Result.002 file - promoters60/1026353
caaatca

SEQ ID NO: 100449 - DNA, 7 bp, Unknown
  misc_feature (1)..( 7): Result.002 file - promoters60/1026353
caagtca

SEQ ID NO: 100450 - DNA, 12 bp, Unknown
  misc_feature (1)..( 12): Result.002 file - promoters60/1026353
ttccactatgtt

SEQ ID NO: 100451 - DNA, 12 bp, Unknown
  misc_feature (1)..( 12): Result.002 file - promoters60/1026353
ttccactgtgtt

SEQ ID NO: 100452 - DNA, 6 bp, Unknown
  misc_feature (1)..( 6): Result.002 file - promoters60/1026353
gataat

SEQ ID NO: 100453 - DNA, 6 bp, Unknown
  misc_feature (1)..( 6): Result.002 file - promoters60/1026353
gataat

SEQ ID NO: 100454 - DNA, 8 bp, Unknown
  misc_feature (1)..( 8): Result.002 file - promoters60/1026353
aagtgaaa

SEQ ID NO: 100455 - DNA, 8 bp, Unknown
  misc_feature (1)..( 8): Result.002 file - promoters60/1026353
aagagaaa

SEQ ID NO: 100456 - DNA, 8 bp, Unknown
  misc_feature (1)..( 8): Result.002 file - promoters60/1026353
ttttttgt

SEQ ID NO: 100457 - DNA, 8 bp, Unknown
  misc_feature (1)..( 8): Result.002 file - promoters60/1026353
tttgttgt

SEQ ID NO: 100458 - DNA, 7 bp, Unknown
  misc_feature (1)..( 7): Result.002 file - promoters60/1026353
tagtagc

SEQ ID NO: 100459 - DNA, 7 bp, Unknown
  misc_feature (1)..( 7): Result.002 file - promoters60/1026353
tagaagc

SEQ ID NO: 100460 - DNA, 8 bp, Unknown
  misc_feature (1)..( 8): Result.002 file - promoters60/1026353
gactaaat

SEQ ID NO: 100461 - DNA, 8 bp, Unknown
  misc_feature (1)..( 8): Result.002 file - promoters60/1026353
gacttaat

SEQ ID NO: 100462 - DNA, 7 bp, Unknown
  misc_feature (1)..( 7): Result.002 file - promoters60/1026353
ttttggt

SEQ ID NO: 100463 - DNA, 7 bp, Unknown
  misc_feature (1)..( 7): Result.002 file - promoters60/1026353
tttaggt

SEQ ID NO: 100464 - DNA, 8 bp, Unknown
  misc_feature (1)..( 8): Result.002 file - promoters60/1026353
cctcgttt

SEQ ID NO: 100465 - DNA, 8 bp, Unknown
  misc_feature (1)..( 8): Result.002 file - promoters60/1026353
cctctttt

SEQ ID NO: 100466 - DNA, 8 bp, Unknown
  misc_feature (1)..( 8): Result.002 file - promoters60/1026353
attcggaa

SEQ ID NO: 100467 - DNA, 8 bp, Unknown
  misc_feature (1)..( 8): Result.002 file - promoters60/1026353
attccgaa

SEQ ID NO: 100468 - DNA, 10 bp, Unknown
  misc_feature (1)..( 10): Result.002 file - promoters60/1026412
tttctttatg

SEQ ID NO: 100469 - DNA, 10 bp, Unknown
  misc_feature (1)..( 10): Result.002 file - promoters60/1026412
tttttttata

SEQ ID NO: 100470 - DNA, 10 bp, Unknown
  misc_feature (1)..( 10): Result.002 file - promoters60/1026412
atttgttata

SEQ ID NO: 100471 - DNA, 10 bp, Unknown
  misc_feature (1)..( 10): Result.002 file - promoters60/1026412
ttttgttgtg

SEQ ID NO: 100472 - DNA, 12 bp, Unknown
  misc_feature (1)..( 12): Result.002 file - promoters60/1026412
aaaattgtgcag

SEQ ID NO: 100473 - DNA, 12 bp, Unknown
  misc_feature (1)..( 12): Result.002 file - promoters60/1026412
aaatttgttata

SEQ ID NO: 100474 - DNA, 12 bp, Unknown
  misc_feature (1)..( 12): Result.002 file - promoters60/1026412
agtttttttata

SEQ ID NO: 100475 - DNA, 12 bp, Unknown
  misc_feature (1)..( 12): Result.002 file - promoters60/1026412
tattttgttgtg

SEQ ID NO: 100476 - DNA, 7 bp, Unknown
  misc_feature (1)..( 7): Result.002 file - promoters60/1026419
aatgttt

SEQ ID NO: 100477 - DNA, 7 bp, Unknown
  misc_feature (1)..( 7): Result.002 file - promoters60/1026419
aatcttt

SEQ ID NO: 100478 - DNA, 10 bp, Unknown
  misc_feature (1)..( 10): Result.002 file - promoters60/1026419
gaaacaagta

SEQ ID NO: 100479 - DNA, 10 bp, Unknown
  misc_feature (1)..( 10): Result.002 file - promoters60/1026419
aaaataagta

SEQ ID NO: 100480 - DNA, 10 bp, Unknown
  misc_feature (1)..( 10): Result.002 file - promoters60/1026419
gaaagaagta

SEQ ID NO: 100481 - DNA, 6 bp, Unknown
  misc_feature (1)..( 6): Result.002 file - promoters60/1026419
tttatc

SEQ ID NO: 100482 - DNA, 6 bp, Unknown
  misc_feature (1)..( 6): Result.002 file - promoters60/1026419
tttatc

SEQ ID NO: 100483 - DNA, 7 bp, Unknown
  misc_feature (1)..( 7): Result.002 file - promoters60/1026419
atcgttt

SEQ ID NO: 100484 - DNA, 7 bp, Unknown
  misc_feature (1)..( 7): Result.002 file - promoters60/1026419
atcattt

SEQ ID NO: 100485 - DNA, 6 bp, Unknown
  misc_feature (1)..( 6): Result.002 file - promoters60/1026419
gcatgg

SEQ ID NO: 100486 - DNA, 6 bp, Unknown
  misc_feature (1)..( 6): Result.002 file - promoters60/1026419
gcatgg

SEQ ID NO: 100487 - DNA, 6 bp, Unknown
  misc_feature (1)..( 6): Result.002 file - promoters60/1026419
aacaaa

SEQ ID NO: 100488 - DNA, 6 bp, Unknown
  misc_feature (1)..( 6): Result.002 file - promoters60/1026419
aacaaa

SEQ ID NO: 100489 - DNA, 8 bp, Unknown
  misc_feature (1)..( 8): Result.002 file - promoters60/1026419
gaagtgag

SEQ ID NO: 100490 - DNA, 8 bp, Unknown
  misc_feature (1)..( 8): Result.002 file - promoters60/1026419
gaagagag

SEQ ID NO: 100491 - DNA, 7 bp, Unknown
  misc_feature (1)..( 7): Result.002 file - promoters60/1026419
ggttaat

SEQ ID NO: 100492 - DNA, 7 bp, Unknown
  misc_feature (1)..( 7): Result.002 file - promoters60/1026419
ggtgaat

SEQ ID NO: 100493 - DNA, 6 bp, Unknown
  misc_feature (1)..( 6): Result.002 file - promoters60/1026419
ttgggt

SEQ ID NO: 100494 - DNA, 6 bp, Unknown
  misc_feature (1)..( 6): Result.002 file - promoters60/1026419
ttgggt

SEQ ID NO: 100495 - DNA, 6 bp, Unknown
  misc_feature (1)..( 6): Result.002 file - promoters60/1026419
ataaaa

SEQ ID NO: 100496 - DNA, 6 bp, Unknown
  misc_feature (1)..( 6): Result.002 file - promoters60/1026419
ataaaa

SEQ ID NO: 100497 - DNA, 6 bp, Unknown
  misc_feature (1)..( 6): Result.002 file - promoters60/1026419
aagaaa

SEQ ID NO: 100498 - DNA, 6 bp, Unknown
  misc_feature (1)..( 6): Result.002 file - promoters60/1026419
aagaaa

SEQ ID NO: 100499 - DNA, 6 bp, Unknown
  misc_feature (1)..( 6): Result.002 file - promoters60/1026419
cacatg

SEQ ID NO: 100500 - DNA, 6 bp, Unknown
  misc_feature (1)..( 6): Result.002 file - promoters60/1026419
cacatg

SEQ ID NO: 100501 - DNA, 9 bp, Unknown
  misc_feature (1)..( 9): Result.002 file - promoters60/1026514
ggttttgct

SEQ ID NO: 100502 - DNA, 9 bp, Unknown
  misc_feature (1)..( 9): Result.002 file - promoters60/1026514
tcttttgct

SEQ ID NO: 100503 - DNA, 9 bp, Unknown
  misc_feature (1)..( 9): Result.002 file - promoters60/1026514
ggttttgta

SEQ ID NO: 100504 - DNA, 7 bp, Unknown
  misc_feature (1)..( 7): Result.002 file - promoters60/1026514
aagaagt

SEQ ID NO: 100505 - DNA, 7 bp, Unknown
  misc_feature (1)..( 7): Result.002 file - promoters60/1026514
aagaagt

SEQ ID NO: 100506 - DNA, 7 bp, Unknown
  misc_feature (1)..( 7): Result.002 file - promoters60/1026514
aactttt

SEQ ID NO: 100507 - DNA, 7 bp, Unknown
  misc_feature (1)..( 7): Result.002 file - promoters60/1026514
aactttt

SEQ ID NO: 100508 - DNA, 10 bp, Unknown
  misc_feature (1)..( 10): Result.002 file - promoters60/1026514
gttcaattgt

SEQ ID NO: 100509 - DNA, 10 bp, Unknown
  misc_feature (1)..( 10): Result.002 file - promoters60/1026514
gttgaataat

SEQ ID NO: 100510 - DNA, 10 bp, Unknown
  misc_feature (1)..( 10): Result.002 file - promoters60/1026514
actaaattga

SEQ ID NO: 100511 - DNA, 6 bp, Unknown
  misc_feature (1)..( 6): Result.002 file - promoters60/1026514
taaaat

SEQ ID NO: 100512 - DNA, 6 bp, Unknown
  misc_feature (1)..( 6): Result.002 file - promoters60/1026514
taaaat

SEQ ID NO: 100513 - DNA, 10 bp, Unknown
  misc_feature (1)..( 10): Result.002 file - promoters60/1026514
ttaaaaaaaa

SEQ ID NO: 100514 - DNA, 10 bp, Unknown
  misc_feature (1)..( 10): Result.002 file - promoters60/1026514
ataaaaaaaa

SEQ ID NO: 100515 - DNA, 10 bp, Unknown
  misc_feature (1)..( 10): Result.002 file - promoters60/1026514
ttaaacaaag

SEQ ID NO: 100516 - DNA, 6 bp, Unknown
  misc_feature (1)..( 6): Result.002 file - promoters60/1026514
gaaaaa

SEQ ID NO: 100517 - DNA, 6 bp, Unknown
  misc_feature (1)..( 6): Result.002 file - promoters60/1026514
gaaaaa

SEQ ID NO: 100518 - DNA, 6 bp, Unknown
  misc_feature (1)..( 6): Result.002 file - promoters60/1026514
aataat

SEQ ID NO: 100519 - DNA, 6 bp, Unknown
  misc_feature (1)..( 6): Result.002 file - promoters60/1026514
aataat

SEQ ID NO: 100520 - DNA, 8 bp, Unknown
  misc_feature (1)..( 8): Result.002 file - promoters60/1026514
gccactac

SEQ ID NO: 100521 - DNA, 8 bp, Unknown
  misc_feature (1)..( 8): Result.002 file - promoters60/1026514
gcctctac

SEQ ID NO: 100522 - DNA, 7 bp, Unknown
  misc_feature (1)..( 7): Result.002 file - promoters60/1026514
acttttc

SEQ ID NO: 100523 - DNA, 7 bp, Unknown
  misc_feature (1)..( 7): Result.002 file - promoters60/1026514
actgttc

SEQ ID NO: 100524 - DNA, 6 bp, Unknown
  misc_feature (1)..( 6): Result.002 file - promoters60/1026514
actcaa

SEQ ID NO: 100525 - DNA, 6 bp, Unknown
  misc_feature (1)..( 6): Result.002 file - promoters60/1026514
actcaa

SEQ ID NO: 100526 - DNA, 7 bp, Unknown
  misc_feature (1)..( 7): Result.002 file - promoters60/1026514
aaagtaa

SEQ ID NO: 100527 - DNA, 7 bp, Unknown
  misc_feature (1)..( 7): Result.002 file - promoters60/1026514
aaattaa

SEQ ID NO: 100528 - DNA, 8 bp, Unknown
  misc_feature (1)..( 8): Result.002 file - promoters60/1026514
ctcattta

SEQ ID NO: 100529 - DNA, 8 bp, Unknown
  misc_feature (1)..( 8): Result.002 file - promoters60/1026514
ctcaatta

SEQ ID NO: 100530 - DNA, 7 bp, Unknown
  misc_feature (1)..( 7): Result.002 file - promoters60/1026514
tatttgt

SEQ ID NO: 100531 - DNA, 7 bp, Unknown
  misc_feature (1)..( 7): Result.002 file - promoters60/1026514
tatttgt

SEQ ID NO: 100532 - DNA, 9 bp, Unknown
  misc_feature (1)..( 9): Result.002 file - promoters60/1026514
taatgtatt

SEQ ID NO: 100533 - DNA, 9 bp, Unknown
  misc_feature (1)..( 9): Result.002 file - promoters60/1026514
taatctatt

SEQ ID NO: 100534 - DNA, 6 bp, Unknown
  misc_feature (1)..( 6): Result.002 file - promoters60/1026514
atgacc

SEQ ID NO: 100535 - DNA, 6 bp, Unknown
  misc_feature (1)..( 6): Result.002 file - promoters60/1026514
atgacc

SEQ ID NO: 100536 - DNA, 7 bp, Unknown
  misc_feature (1)..( 7): Result.002 file - promoters60/1026514
cataaaa

SEQ ID NO: 100537 - DNA, 7 bp, Unknown
  misc_feature (1)..( 7): Result.002 file - promoters60/1026514
catcaaa

SEQ ID NO: 100538 - DNA, 11 bp, Unknown
  misc_feature (1)..( 11): Result.002 file - promoters60/1026514
tttgaggcctt

SEQ ID NO: 100539 - DNA, 11 bp, Unknown
  misc_feature (1)..( 11): Result.002 file - promoters60/1026514
tttgcggcctt

SEQ ID NO: 100540 - DNA, 7 bp, Unknown
  misc_feature (1)..( 7): Result.002 file - promoters60/1026514
tttgctt

SEQ ID NO: 100541 - DNA, 7 bp, Unknown
  misc_feature (1)..( 7): Result.002 file - promoters60/1026514
ttttctt

SEQ ID NO: 100542 - DNA, 10 bp, Unknown
  misc_feature (1)..( 10): Result.002 file - promoters60/1026551
taaatcaata

SEQ ID NO: 100543 - DNA, 10 bp, Unknown
  misc_feature (1)..( 10): Result.002 file - promoters60/1026551
taaattaata

SEQ ID NO: 100544 - DNA, 10 bp, Unknown
  misc_feature (1)..( 10): Result.002 file - promoters60/1026551
taagttaaga

SEQ ID NO: 100545 - DNA, 10 bp, Unknown
  misc_feature (1)..( 10): Result.002 file - promoters60/1026551
tcaatatata

SEQ ID NO: 100546 - DNA, 10 bp, Unknown
  misc_feature (1)..( 10): Result.002 file - promoters60/1026551
ttaatttata

SEQ ID NO: 100547 - DNA, 10 bp, Unknown
  misc_feature (1)..( 10): Result.002 file - promoters60/1026551
cccatatatg

SEQ ID NO: 100548 - DNA, 10 bp, Unknown
  misc_feature (1)..( 10): Result.002 file - promoters60/1026551
ttaagttaag

SEQ ID NO: 100549 - DNA, 11 bp, Unknown
  misc_feature (1)..( 11): Result.002 file - promoters60/1026551
gcatatacctt

SEQ ID NO: 100550 - DNA, 11 bp, Unknown
  misc_feature (1)..( 11): Result.002 file - promoters60/1026551
aagtataactt

SEQ ID NO: 100551 - DNA, 11 bp, Unknown
  misc_feature (1)..( 11): Result.002 file - promoters60/1026551
aagtttaaaat

SEQ ID NO: 100552 - DNA, 11 bp, Unknown
  misc_feature (1)..( 11): Result.002 file - promoters60/1026551
tggtttaaaaa

SEQ ID NO: 100553 - DNA, 8 bp, Unknown
  misc_feature (1)..( 8): Result.002 file - promoters60/1026551
ttaccaat

SEQ ID NO: 100554 - DNA, 8 bp, Unknown
  misc_feature (1)..( 8): Result.002 file - promoters60/1026551
ttatcaat

SEQ ID NO: 100555 - DNA, 8 bp, Unknown
  misc_feature (1)..( 8): Result.002 file - promoters60/1026551
atatcaat

SEQ ID NO: 100556 - DNA, 7 bp, Unknown
  misc_feature (1)..( 7): Result.002 file - promoters60/1026551
aaatatt

SEQ ID NO: 100557 - DNA, 7 bp, Unknown
  misc_feature (1)..( 7): Result.002 file - promoters60/1026551
aaatatg

SEQ ID NO: 100558 - DNA, 7 bp, Unknown
  misc_feature (1)..( 7): Result.002 file - promoters60/1026551
aaaaatg

SEQ ID NO: 100559 - DNA, 15 bp, Unknown
  misc_feature (1)..( 15): Result.002 file - promoters60/1026551
aaggatgatggacca

SEQ ID NO: 100560 - DNA, 15 bp, Unknown
  misc_feature (1)..( 15): Result.002 file - promoters60/1026551
aaggatgatggacca

SEQ ID NO: 100561 - DNA, 15 bp, Unknown
  misc_feature (1)..( 15): Result.002 file - promoters60/1026551
aaggatgctgtgcca

SEQ ID NO: 100562 - DNA, 21 bp, Unknown
  misc_feature (1)..( 21): Result.002 file - promoters60/1026551
tacacattaataacgtggtcc

SEQ ID NO: 100563 - DNA, 21 bp, Unknown
  misc_feature (1)..( 21): Result.002 file - promoters60/1026551
tacacattaataacgtggtcg

SEQ ID NO: 100564 - DNA, 21 bp, Unknown
  misc_feature (1)..( 21): Result.002 file - promoters60/1026551
cccacgtaaataacgtggtcc

SEQ ID NO: 100565 - DNA, 41 bp, Unknown
  misc_feature (1)..( 41): Result.002 file - promoters60/1026551
attttatcaaataaagaaaataaatttctatgacccaataa

SEQ ID NO: 100566 - DNA, 41 bp, Unknown
  misc_feature (1)..( 41): Result.002 file - promoters60/1026551
cgtttaccaaatcaagaaaatacatttctatgatccactaa

SEQ ID NO: 100567 - DNA, 41 bp, Unknown
  misc_feature (1)..( 41): Result.002 file - promoters60/1026551
attttgtcaaacctatccttatcttaataacaaacaaaata

SEQ ID NO: 100568 - DNA, 41 bp, Unknown
  misc_feature (1)..( 41): Result.002 file - promoters60/1026551
acgtggtccaacattaaatataacaatttaattgaaagctc

SEQ ID NO: 100569 - DNA, 7 bp, Unknown
  misc_feature (1)..( 7): Result.002 file - promoters60/1026551
ttacttt

SEQ ID NO: 100570 - DNA, 7 bp, Unknown
  misc_feature (1)..( 7): Result.002 file - promoters60/1026551
ttagttt

SEQ ID NO: 100571 - DNA, 7 bp, Unknown
  misc_feature (1)..( 7): Result.002 file - promoters60/1026551
ttaattt

SEQ ID NO: 100572 - DNA, 11 bp, Unknown
  misc_feature (1)..( 11): Result.002 file - promoters60/1026551
taaattttacg

SEQ ID NO: 100573 - DNA, 11 bp, Unknown
  misc_feature (1)..( 11): Result.002 file - promoters60/1026551
attattttata

SEQ ID NO: 100574 - DNA, 11 bp, Unknown
  misc_feature (1)..( 11): Result.002 file - promoters60/1026551
acgattatata

SEQ ID NO: 100575 - DNA, 11 bp, Unknown
  misc_feature (1)..( 11): Result.002 file - promoters60/1026551
attgttttaaa

SEQ ID NO: 100576 - DNA, 7 bp, Unknown
  misc_feature (1)..( 7): Result.002 file - promoters60/1026551
tttcatg

SEQ ID NO: 100577 - DNA, 7 bp, Unknown
  misc_feature (1)..( 7): Result.002 file - promoters60/1026551
tttgatg

SEQ ID NO: 100578 - DNA, 7 bp, Unknown
  misc_feature (1)..( 7): Result.002 file - promoters60/1026551
tttcatt

SEQ ID NO: 100579 - DNA, 9 bp, Unknown
  misc_feature (1)..( 9): Result.002 file - promoters60/1026551
tatattaat

SEQ ID NO: 100580 - DNA, 9 bp, Unknown
  misc_feature (1)..( 9): Result.002 file - promoters60/1026551
aatatcaat

SEQ ID NO: 100581 - DNA, 9 bp, Unknown
  misc_feature (1)..( 9): Result.002 file - promoters60/1026551
tattttata

SEQ ID NO: 100582 - DNA, 7 bp, Unknown
  misc_feature (1)..( 7): Result.002 file - promoters60/1026551
aatatgt

SEQ ID NO: 100583 - DNA, 7 bp, Unknown
  misc_feature (1)..( 7): Result.002 file - promoters60/1026551
tatatgt

SEQ ID NO: 100584 - DNA, 7 bp, Unknown
  misc_feature (1)..( 7): Result.002 file - promoters60/1026551
tatatgt

SEQ ID NO: 100585 - DNA, 7 bp, Unknown
  misc_feature (1)..( 7): Result.002 file - promoters60/1026562
aattata

SEQ ID NO: 100586 - DNA, 7 bp, Unknown
  misc_feature (1)..( 7): Result.002 file - promoters60/1026562
aataata

SEQ ID NO: 100587 - DNA, 8 bp, Unknown
  misc_feature (1)..( 8): Result.002 file - promoters60/1026562
ttgaagat

SEQ ID NO: 100588 - DNA, 8 bp, Unknown
  misc_feature (1)..( 8): Result.002 file - promoters60/1026562
ttgaggat

SEQ ID NO: 100589 - DNA, 6 bp, Unknown
  misc_feature (1)..( 6): Result.002 file - promoters60/1026562
agatta

SEQ ID NO: 100590 - DNA, 6 bp, Unknown
  misc_feature (1)..( 6): Result.002 file - promoters60/1026562
agatta

SEQ ID NO: 100591 - DNA, 13 bp, Unknown
  misc_feature (1)..( 13): Result.002 file - promoters60/1026562
aacgattttgtcc

SEQ ID NO: 100592 - DNA, 13 bp, Unknown
  misc_feature (1)..( 13): Result.002 file - promoters60/1026562
aacgagtttatcc

SEQ ID NO: 100593 - DNA, 8 bp, Unknown
  misc_feature (1)..( 8): Result.002 file - promoters60/1026562
ttttgtat

SEQ ID NO: 100594 - DNA, 8 bp, Unknown
  misc_feature (1)..( 8): Result.002 file - promoters60/1026562
tttcgtat

SEQ ID NO: 100595 - DNA, 7 bp, Unknown
  misc_feature (1)..( 7): Result.002 file - promoters60/1026562
caaatgg

SEQ ID NO: 100596 - DNA, 7 bp, Unknown
  misc_feature (1)..( 7): Result.002 file - promoters60/1026562
caaatgg

SEQ ID NO: 100597 - DNA, 6 bp, Unknown
  misc_feature (1)..( 6): Result.002 file - promoters60/1026562
ataatt

SEQ ID NO: 100598 - DNA, 6 bp, Unknown
  misc_feature (1)..( 6): Result.002 file - promoters60/1026562
ataatt

SEQ ID NO: 100599 - DNA, 6 bp, Unknown
  misc_feature (1)..( 6): Result.002 file - promoters60/1026562
caatct

SEQ ID NO: 100600 - DNA, 6 bp, Unknown
  misc_feature (1)..( 6): Result.002 file - promoters60/1026562
caatct

SEQ ID NO: 100601 - DNA, 7 bp, Unknown
  misc_feature (1)..( 7): Result.002 file - promoters60/1026562
aaaatct

SEQ ID NO: 100602 - DNA, 7 bp, Unknown
  misc_feature (1)..( 7): Result.002 file - promoters60/1026562
aaagtct

SEQ ID NO: 100603 - DNA, 6 bp, Unknown
  misc_feature (1)..( 6): Result.002 file - promoters60/1026562
caactg

SEQ ID NO: 100604 - DNA, 6 bp, Unknown
  misc_feature (1)..( 6): Result.002 file - promoters60/1026562
caactg

SEQ ID NO: 100605 - DNA, 7 bp, Unknown
  misc_feature (1)..( 7): Result.002 file - promoters60/1026562
aattaat

SEQ ID NO: 100606 - DNA, 7 bp, Unknown
  misc_feature (1)..( 7): Result.002 file - promoters60/1026562
aatcaat

SEQ ID NO: 100607 - DNA, 8 bp, Unknown
  misc_feature (1)..( 8): Result.002 file - promoters60/1026562
gagaaagt

SEQ ID NO: 100608 - DNA, 8 bp, Unknown
  misc_feature (1)..( 8): Result.002 file - promoters60/1026562
gagaaagt

SEQ ID NO: 100609 - DNA, 7 bp, Unknown
  misc_feature (1)..( 7): Result.002 file - promoters60/1026562
ttatcta

SEQ ID NO: 100610 - DNA, 7 bp, Unknown
  misc_feature (1)..( 7): Result.002 file - promoters60/1026562
ttatcta

SEQ ID NO: 100611 - DNA, 6 bp, Unknown
  misc_feature (1)..( 6): Result.002 file - promoters60/1026562
tgtttc

SEQ ID NO: 100612 - DNA, 6 bp, Unknown
  misc_feature (1)..( 6): Result.002 file - promoters60/1026562
tgtttc

SEQ ID NO: 100613 - DNA, 7 bp, Unknown
  misc_feature (1)..( 7): Result.002 file - promoters60/1026565
gttgaga

SEQ ID NO: 100614 - DNA, 7 bp, Unknown
  misc_feature (1)..( 7): Result.002 file - promoters60/1026565
gttcaga

SEQ ID NO: 100615 - DNA, 8 bp, Unknown
  misc_feature (1)..( 8): Result.002 file - promoters60/1026565
tttttttg

SEQ ID NO: 100616 - DNA, 8 bp, Unknown
  misc_feature (1)..( 8): Result.002 file - promoters60/1026565
ttttattg

SEQ ID NO: 100617 - DNA, 6 bp, Unknown
  misc_feature (1)..( 6): Result.002 file - promoters60/1026565
ttactt

SEQ ID NO: 100618 - DNA, 6 bp, Unknown
  misc_feature (1)..( 6): Result.002 file - promoters60/1026565
ttactt

SEQ ID NO: 100619 - DNA, 11 bp, Unknown
  misc_feature (1)..( 11): Result.002 file - promoters60/1026565
aagacagaaca

SEQ ID NO: 100620 - DNA, 11 bp, Unknown
  misc_feature (1)..( 11): Result.002 file - promoters60/1026565
aagacagaaca

SEQ ID NO: 100621 - DNA, 7 bp, Unknown
  misc_feature (1)..( 7): Result.002 file - promoters60/1026565
acaaaaa

SEQ ID NO: 100622 - DNA, 7 bp, Unknown
  misc_feature (1)..( 7): Result.002 file - promoters60/1026565
acataaa

SEQ ID NO: 100623 - DNA, 9 bp, Unknown
  misc_feature (1)..( 9): Result.002 file - promoters60/1026565
aagacgaca

SEQ ID NO: 100624 - DNA, 9 bp, Unknown
  misc_feature (1)..( 9): Result.002 file - promoters60/1026565
aagaagaca

SEQ ID NO: 100625 - DNA, 7 bp, Unknown
  misc_feature (1)..( 7): Result.002 file - promoters60/1026565
atttata

SEQ ID NO: 100626 - DNA, 7 bp, Unknown
  misc_feature (1)..( 7): Result.002 file - promoters60/1026565
atttata

SEQ ID NO: 100627 - DNA, 10 bp, Unknown
  misc_feature (1)..( 10): Result.002 file - promoters60/1026565
aagctctgaa

SEQ ID NO: 100628 - DNA, 10 bp, Unknown
  misc_feature (1)..( 10): Result.002 file - promoters60/1026565
aagctgtgaa

SEQ ID NO: 100629 - DNA, 7 bp, Unknown
  misc_feature (1)..( 7): Result.002 file - promoters60/1026565
ttttgat

SEQ ID NO: 100630 - DNA, 7 bp, Unknown
  misc_feature (1)..( 7): Result.002 file - promoters60/1026565
tttggat

SEQ ID NO: 100631 - DNA, 9 bp, Unknown
  misc_feature (1)..( 9): Result.002 file - promoters60/1026565
agacagaac

SEQ ID NO: 100632 - DNA, 9 bp, Unknown
  misc_feature (1)..( 9): Result.002 file - promoters60/1026565
agacaaaac

SEQ ID NO: 100633 - DNA, 6 bp, Unknown
  misc_feature (1)..( 6): Result.002 file - promoters60/1026565
aaaaag

SEQ ID NO: 100634 - DNA, 6 bp, Unknown
  misc_feature (1)..( 6): Result.002 file - promoters60/1026565
aaaaag

SEQ ID NO: 100635 - DNA, 7 bp, Unknown
  misc_feature (1)..( 7): Result.002 file - promoters60/1026565
tgatgaa

SEQ ID NO: 100636 - DNA, 7 bp, Unknown
  misc_feature (1)..( 7): Result.002 file - promoters60/1026565
tgaagaa

SEQ ID NO: 100637 - DNA, 7 bp, Unknown
  misc_feature (1)..( 7): Result.002 file - promoters60/1026565
aactatc

SEQ ID NO: 100638 - DNA, 7 bp, Unknown
  misc_feature (1)..( 7): Result.002 file - promoters60/1026565
aactatc

SEQ ID NO: 100639 - DNA, 8 bp, Unknown
  misc_feature (1)..( 8): Result.002 file - promoters60/1026565
agagatga

SEQ ID NO: 100640 - DNA, 8 bp, Unknown
  misc_feature (1)..( 8): Result.002 file - promoters60/1026565
agacatga

SEQ ID NO: 100641 - DNA, 6 bp, Unknown
  misc_feature (1)..( 6): Result.002 file - promoters60/1026565
actttt

SEQ ID NO: 100642 - DNA, 6 bp, Unknown
  misc_feature (1)..( 6): Result.002 file - promoters60/1026565
actttt

SEQ ID NO: 100643 - DNA, 7 bp, Unknown
  misc_feature (1)..( 7): Result.002 file - promoters60/1026565
tttgatt

SEQ ID NO: 100644 - DNA, 7 bp, Unknown
  misc_feature (1)..( 7): Result.002 file - promoters60/1026565
ttttatt

SEQ ID NO: 100645 - DNA, 6 bp, Unknown
  misc_feature (1)..( 6): Result.002 file - promoters60/1026565
acaaaa

SEQ ID NO: 100646 - DNA, 6 bp, Unknown
  misc_feature (1)..( 6): Result.002 file - promoters60/1026565
acaaaa

SEQ ID NO: 100647 - DNA, 9 bp, Unknown
  misc_feature (1)..( 9): Result.002 file - promoters60/1026578
gttgtttaa

SEQ ID NO: 100648 - DNA, 9 bp, Unknown
  misc_feature (1)..( 9): Result.002 file - promoters60/1026578
attgttttc

SEQ ID NO: 100649 - DNA, 9 bp, Unknown
  misc_feature (1)..( 9): Result.002 file - promoters60/1026578
atttttttc

SEQ ID NO: 100650 - DNA, 8 bp, Unknown
  misc_feature (1)..( 8): Result.002 file - promoters60/1026578
taaaagta

SEQ ID NO: 100651 - DNA, 8 bp, Unknown
  misc_feature (1)..( 8): Result.002 file - promoters60/1026578
taaaagat

SEQ ID NO: 100652 - DNA, 8 bp, Unknown
  misc_feature (1)..( 8): Result.002 file - promoters60/1026578
taagagag

SEQ ID NO: 100653 - DNA, 8 bp, Unknown
  misc_feature (1)..( 8): Result.002 file - promoters60/1026578
aaaaagat

SEQ ID NO: 100654 - DNA, 7 bp, Unknown
  misc_feature (1)..( 7): Result.002 file - promoters60/1026578
aaaattt

SEQ ID NO: 100655 - DNA, 7 bp, Unknown
  misc_feature (1)..( 7): Result.002 file - promoters60/1026578
taaattt

SEQ ID NO: 100656 - DNA, 7 bp, Unknown
  misc_feature (1)..( 7): Result.002 file - promoters60/1026578
taaattc

SEQ ID NO: 100657 - DNA, 10 bp, Unknown
  misc_feature (1)..( 10): Result.002 file - promoters60/1026618
taataagtat

SEQ ID NO: 100658 - DNA, 10 bp, Unknown
  misc_feature (1)..( 10): Result.002 file - promoters60/1026618
aaataattat

SEQ ID NO: 100659 - DNA, 10 bp, Unknown
  misc_feature (1)..( 10): Result.002 file - promoters60/1026618
gaattagtat

SEQ ID NO: 100660 - DNA, 10 bp, Unknown
  misc_feature (1)..( 10): Result.002 file - promoters60/1026618
aaaaaaatgg

SEQ ID NO: 100661 - DNA, 10 bp, Unknown
  misc_feature (1)..( 10): Result.002 file - promoters60/1026618
aaaaaaatca

SEQ ID NO: 100662 - DNA, 10 bp, Unknown
  misc_feature (1)..( 10): Result.002 file - promoters60/1026618
tcattatttg

SEQ ID NO: 100663 - DNA, 13 bp, Unknown
  misc_feature (1)..( 13): Result.002 file - promoters60/1026618
acgattataaaca

SEQ ID NO: 100664 - DNA, 13 bp, Unknown
  misc_feature (1)..( 13): Result.002 file - promoters60/1026618
aaatttaaaaagc

SEQ ID NO: 100665 - DNA, 13 bp, Unknown
  misc_feature (1)..( 13): Result.002 file - promoters60/1026618
ctacatataaatg

SEQ ID NO: 100666 - DNA, 13 bp, Unknown
  misc_feature (1)..( 13): Result.002 file - promoters60/1026618
gatcctaaacagc

SEQ ID NO: 100667 - DNA, 13 bp, Unknown
  misc_feature (1)..( 13): Result.002 file - promoters60/1026618
atttagataaatt

SEQ ID NO: 100668 - DNA, 13 bp, Unknown
  misc_feature (1)..( 13): Result.002 file - promoters60/1026618
aaacttaaaagta

SEQ ID NO: 100669 - DNA, 13 bp, Unknown
  misc_feature (1)..( 13): Result.002 file - promoters60/1026618
aattttatatatg

SEQ ID NO: 100670 - DNA, 9 bp, Unknown
  misc_feature (1)..( 9): Result.002 file - promoters60/1026622
aatccaaag

SEQ ID NO: 100671 - DNA, 9 bp, Unknown
  misc_feature (1)..( 9): Result.002 file - promoters60/1026622
aatcgaaat

SEQ ID NO: 100672 - DNA, 9 bp, Unknown
  misc_feature (1)..( 9): Result.002 file - promoters60/1026622
tatccgaag

SEQ ID NO: 100673 - DNA, 9 bp, Unknown
  misc_feature (1)..( 9): Result.002 file - promoters60/1026622
aatcgatag

SEQ ID NO: 100674 - DNA, 9 bp, Unknown
  misc_feature (1)..( 9): Result.002 file - promoters60/1026622
aatagatat

SEQ ID NO: 100675 - DNA, 9 bp, Unknown
  misc_feature (1)..( 9): Result.002 file - promoters60/1026622
ggtccaaag

SEQ ID NO: 100676 - DNA, 11 bp, Unknown
  misc_feature (1)..( 11): Result.002 file - promoters60/1026622
tgatataataa

SEQ ID NO: 100677 - DNA, 11 bp, Unknown
  misc_feature (1)..( 11): Result.002 file - promoters60/1026622
acatataaaat

SEQ ID NO: 100678 - DNA, 11 bp, Unknown
  misc_feature (1)..( 11): Result.002 file - promoters60/1026622
tgatttaataa

SEQ ID NO: 100679 - DNA, 11 bp, Unknown
  misc_feature (1)..( 11): Result.002 file - promoters60/1026622
ctttataaaaa

SEQ ID NO: 100680 - DNA, 11 bp, Unknown
  misc_feature (1)..( 11): Result.002 file - promoters60/1026622
tgattaaattg

SEQ ID NO: 100681 - DNA, 11 bp, Unknown
  misc_feature (1)..( 11): Result.002 file - promoters60/1026622
atatacaaaaa

SEQ ID NO: 100682 - DNA, 15 bp, Unknown
  misc_feature (1)..( 15): Result.002 file - promoters60/1026705
gtgacataccaagaa

SEQ ID NO: 100683 - DNA, 15 bp, Unknown
  misc_feature (1)..( 15): Result.002 file - promoters60/1026705
tgtacataacaaacg

SEQ ID NO: 100684 - DNA, 15 bp, Unknown
  misc_feature (1)..( 15): Result.002 file - promoters60/1026705
gtgaaatagtaaatt

SEQ ID NO: 100685 - DNA, 15 bp, Unknown
  misc_feature (1)..( 15): Result.002 file - promoters60/1026705
tgtgtataaccaacc

SEQ ID NO: 100686 - DNA, 15 bp, Unknown
  misc_feature (1)..( 15): Result.002 file - promoters60/1026705
tcgaaatataaaggc

SEQ ID NO: 100687 - DNA, 15 bp, Unknown
  misc_feature (1)..( 15): Result.002 file - promoters60/1026705
ttcatcaaaccgacc

SEQ ID NO: 100688 - DNA, 9 bp, Unknown
  misc_feature (1)..( 9): Result.002 file - promoters60/1026742
ctcttgctg

SEQ ID NO: 100689 - DNA, 9 bp, Unknown
  misc_feature (1)..( 9): Result.002 file - promoters60/1026742
cccttactg

SEQ ID NO: 100690 - DNA, 9 bp, Unknown
  misc_feature (1)..( 9): Result.002 file - promoters60/1026742
ctctttctg

SEQ ID NO: 100691 - DNA, 8 bp, Unknown
  misc_feature (1)..( 8): Result.002 file - promoters60/1026742
ccgtcaat

SEQ ID NO: 100692 - DNA, 8 bp, Unknown
  misc_feature (1)..( 8): Result.002 file - promoters60/1026742
ttgtcaat

SEQ ID NO: 100693 - DNA, 8 bp, Unknown
  misc_feature (1)..( 8): Result.002 file - promoters60/1026742
ccggcaaa

SEQ ID NO: 100694 - DNA, 6 bp, Unknown
  misc_feature (1)..( 6): Result.002 file - promoters60/1026754
ttgtta

SEQ ID NO: 100695 - DNA, 6 bp, Unknown
  misc_feature (1)..( 6): Result.002 file - promoters60/1026754
ttgtta

SEQ ID NO: 100696 - DNA, 6 bp, Unknown
  misc_feature (1)..( 6): Result.002 file - promoters60/1026754
tggaaa

SEQ ID NO: 100697 - DNA, 6 bp, Unknown
  misc_feature (1)..( 6): Result.002 file - promoters60/1026754
tggaaa

SEQ ID NO: 100698 - DNA, 8 bp, Unknown
  misc_feature (1)..( 8): Result.002 file - promoters60/1026754
ttcattct

SEQ ID NO: 100699 - DNA, 8 bp, Unknown
  misc_feature (1)..( 8): Result.002 file - promoters60/1026754
ttccttct

SEQ ID NO: 100700 - DNA, 9 bp, Unknown
  misc_feature (1)..( 9): Result.002 file - promoters60/1026754
gtttcttac

SEQ ID NO: 100701 - DNA, 9 bp, Unknown
  misc_feature (1)..( 9): Result.002 file - promoters60/1026754
gttttttac

SEQ ID NO: 100702 - DNA, 7 bp, Unknown
  misc_feature (1)..( 7): Result.002 file - promoters60/1026754
ctttctc

SEQ ID NO: 100703 - DNA, 7 bp, Unknown
  misc_feature (1)..( 7): Result.002 file - promoters60/1026754
ctttctc

SEQ ID NO: 100704 - DNA, 6 bp, Unknown
  misc_feature (1)..( 6): Result.002 file - promoters60/1026754
tacaag

SEQ ID NO: 100705 - DNA, 6 bp, Unknown
  misc_feature (1)..( 6): Result.002 file - promoters60/1026754
tacaag

SEQ ID NO: 100706 - DNA, 7 bp, Unknown
  misc_feature (1)..( 7): Result.002 file - promoters60/1026754
tttggtt

SEQ ID NO: 100707 - DNA, 7 bp, Unknown
  misc_feature (1)..( 7): Result.002 file - promoters60/1026754
tttagtt

SEQ ID NO: 100708 - DNA, 7 bp, Unknown
  misc_feature (1)..( 7): Result.002 file - promoters60/1026754
tcagatt

SEQ ID NO: 100709 - DNA, 7 bp, Unknown
  misc_feature (1)..( 7): Result.002 file - promoters60/1026754
tcacatt

SEQ ID NO: 100710 - DNA, 6 bp, Unknown
  misc_feature (1)..( 6): Result.002 file - promoters60/1026754
aagaaa

SEQ ID NO: 100711 - DNA, 6 bp, Unknown
  misc_feature (1)..( 6): Result.002 file - promoters60/1026754
aagaaa

SEQ ID NO: 100712 - DNA, 7 bp, Unknown
  misc_feature (1)..( 7): Result.002 file - promoters60/1026754
agaaagt

SEQ ID NO: 100713 - DNA, 7 bp, Unknown
  misc_feature (1)..( 7): Result.002 file - promoters60/1026754
agatagt

SEQ ID NO: 100714 - DNA, 6 bp, Unknown
  misc_feature (1)..( 6): Result.002 file - promoters60/1026754
aaatgc

SEQ ID NO: 100715 - DNA, 6 bp, Unknown
  misc_feature (1)..( 6): Result.002 file - promoters60/1026754
aaatgc

SEQ ID NO: 100716 - DNA, 7 bp, Unknown
  misc_feature (1)..( 7): Result.002 file - promoters60/1026754
ttataat

SEQ ID NO: 100717 - DNA, 7 bp, Unknown
  misc_feature (1)..( 7): Result.002 file - promoters60/1026754
ttaaaat

SEQ ID NO: 100718 - DNA, 9 bp, Unknown
  misc_feature (1)..( 9): Result.002 file - promoters60/1026754
tactccatt

SEQ ID NO: 100719 - DNA, 9 bp, Unknown
  misc_feature (1)..( 9): Result.002 file - promoters60/1026754
tactcaatt

SEQ ID NO: 100720 - DNA, 8 bp, Unknown
  misc_feature (1)..( 8): Result.002 file - promoters60/1026822
aaatatat

SEQ ID NO: 100721 - DNA, 8 bp, Unknown
  misc_feature (1)..( 8): Result.002 file - promoters60/1026822
aaacatat

SEQ ID NO: 100722 - DNA, 8 bp, Unknown
  misc_feature (1)..( 8): Result.002 file - promoters60/1026822
aaacactt

SEQ ID NO: 100723 - DNA, 8 bp, Unknown
  misc_feature (1)..( 8): Result.002 file - promoters60/1026822
aaaaactt

SEQ ID NO: 100724 - DNA, 7 bp, Unknown
  misc_feature (1)..( 7): Result.002 file - promoters60/1026822
attttaa

SEQ ID NO: 100725 - DNA, 7 bp, Unknown
  misc_feature (1)..( 7): Result.002 file - promoters60/1026822
attttaa

SEQ ID NO: 100726 - DNA, 10 bp, Unknown
  misc_feature (1)..( 10): Result.002 file - promoters60/1026822
acaaaatagg

SEQ ID NO: 100727 - DNA, 10 bp, Unknown
  misc_feature (1)..( 10): Result.002 file - promoters60/1026822
acacaatctt

SEQ ID NO: 100728 - DNA, 10 bp, Unknown
  misc_feature (1)..( 10): Result.002 file - promoters60/1026822
tataaattag

SEQ ID NO: 100729 - DNA, 6 bp, Unknown
  misc_feature (1)..( 6): Result.002 file - promoters60/1026822
ttaatt

SEQ ID NO: 100730 - DNA, 6 bp, Unknown
  misc_feature (1)..( 6): Result.002 file - promoters60/1026822
ttaatt

SEQ ID NO: 100731 - DNA, 7 bp, Unknown
  misc_feature (1)..( 7): Result.002 file - promoters60/1026822
ttatata

SEQ ID NO: 100732 - DNA, 7 bp, Unknown
  misc_feature (1)..( 7): Result.002 file - promoters60/1026822
ttacata

SEQ ID NO: 100733 - DNA, 6 bp, Unknown
  misc_feature (1)..( 6): Result.002 file - promoters60/1026822
tgatat

SEQ ID NO: 100734 - DNA, 6 bp, Unknown
  misc_feature (1)..( 6): Result.002 file - promoters60/1026822
tgatat

SEQ ID NO: 100735 - DNA, 6 bp, Unknown
  misc_feature (1)..( 6): Result.002 file - promoters60/1026822
aagatg

SEQ ID NO: 100736 - DNA, 6 bp, Unknown
  misc_feature (1)..( 6): Result.002 file - promoters60/1026822
aagatg

SEQ ID NO: 100737 - DNA, 6 bp, Unknown
  misc_feature (1)..( 6): Result.002 file - promoters60/1026822
ttaaac

SEQ ID NO: 100738 - DNA, 6 bp, Unknown
  misc_feature (1)..( 6): Result.002 file - promoters60/1026822
ttaaac

SEQ ID NO: 100739 - DNA, 8 bp, Unknown
  misc_feature (1)..( 8): Result.002 file - promoters60/1026822
aaattcat

SEQ ID NO: 100740 - DNA, 8 bp, Unknown
  misc_feature (1)..( 8): Result.002 file - promoters60/1026822
taatacat

SEQ ID NO: 100741 - DNA, 8 bp, Unknown
  misc_feature (1)..( 8): Result.002 file - promoters60/1026822
taaaacag

SEQ ID NO: 100742 - DNA, 6 bp, Unknown
  misc_feature (1)..( 6): Result.002 file - promoters60/1026822
atcaag

SEQ ID NO: 100743 - DNA, 6 bp, Unknown
  misc_feature (1)..( 6): Result.002 file - promoters60/1026822
atcaag

SEQ ID NO: 100744 - DNA, 6 bp, Unknown
  misc_feature (1)..( 6): Result.002 file - promoters60/1026822
aaagtt

SEQ ID NO: 100745 - DNA, 6 bp, Unknown
  misc_feature (1)..( 6): Result.002 file - promoters60/1026822
aaagtt

SEQ ID NO: 100746 - DNA, 7 bp, Unknown
  misc_feature (1)..( 7): Result.002 file - promoters60/1026822
tcattat

SEQ ID NO: 100747 - DNA, 7 bp, Unknown
  misc_feature (1)..( 7): Result.002 file - promoters60/1026822
tcattat

SEQ ID NO: 100748 - DNA, 7 bp, Unknown
  misc_feature (1)..( 7): Result.002 file - promoters60/1026822
ttttata

SEQ ID NO: 100749 - DNA, 7 bp, Unknown
  misc_feature (1)..( 7): Result.002 file - promoters60/1026822
tttaata

SEQ ID NO: 100750 - DNA, 8 bp, Unknown
  misc_feature (1)..( 8): Result.002 file - promoters60/1026822
acagaaca

SEQ ID NO: 100751 - DNA, 8 bp, Unknown
  misc_feature (1)..( 8): Result.002 file - promoters60/1026822
acagtaca

SEQ ID NO: 100752 - DNA, 8 bp, Unknown
  misc_feature (1)..( 8): Result.002 file - promoters60/1026822
aagagcat

SEQ ID NO: 100753 - DNA, 8 bp, Unknown
  misc_feature (1)..( 8): Result.002 file - promoters60/1026822
aagaccat

SEQ ID NO: 100754 - DNA, 13 bp, Unknown
  misc_feature (1)..( 13): Result.002 file - promoters60/1026861
acattcacgaaat

SEQ ID NO: 100755 - DNA, 13 bp, Unknown
  misc_feature (1)..( 13): Result.002 file - promoters60/1026861
atattctcgaatt

SEQ ID NO: 100756 - DNA, 13 bp, Unknown
  misc_feature (1)..( 13): Result.002 file - promoters60/1026861
acaatcagtatcc

SEQ ID NO: 100757 - DNA, 13 bp, Unknown
  misc_feature (1)..( 13): Result.002 file - promoters60/1026861
cgaatcagctaaa

SEQ ID NO: 100758 - DNA, 13 bp, Unknown
  misc_feature (1)..( 13): Result.002 file - promoters60/1026861
aaggcttcgaatt

SEQ ID NO: 100759 - DNA, 13 bp, Unknown
  misc_feature (1)..( 13): Result.002 file - promoters60/1026861
tatggatcgaatt

SEQ ID NO: 100760 - DNA, 9 bp, Unknown
  misc_feature (1)..( 9): Result.002 file - promoters60/1026861
ttataaaac

SEQ ID NO: 100761 - DNA, 9 bp, Unknown
  misc_feature (1)..( 9): Result.002 file - promoters60/1026861
ttataaaaa

SEQ ID NO: 100762 - DNA, 9 bp, Unknown
  misc_feature (1)..( 9): Result.002 file - promoters60/1026861
tcataaaat

SEQ ID NO: 100763 - DNA, 9 bp, Unknown
  misc_feature (1)..( 9): Result.002 file - promoters60/1026861
atataaaac

SEQ ID NO: 100764 - DNA, 10 bp, Unknown
  misc_feature (1)..( 10): Result.002 file - promoters60/1026861
atatataaag

SEQ ID NO: 100765 - DNA, 10 bp, Unknown
  misc_feature (1)..( 10): Result.002 file - promoters60/1026861
gaatagaaag

SEQ ID NO: 100766 - DNA, 9 bp, Unknown
  misc_feature (1)..( 9): Result.002 file - promoters60/1026883
tcaaataat

SEQ ID NO: 100767 - DNA, 9 bp, Unknown
  misc_feature (1)..( 9): Result.002 file - promoters60/1026883
gaaaacaat

SEQ ID NO: 100768 - DNA, 9 bp, Unknown
  misc_feature (1)..( 9): Result.002 file - promoters60/1026883
acaaattta

SEQ ID NO: 100769 - DNA, 9 bp, Unknown
  misc_feature (1)..( 9): Result.002 file - promoters60/1026883
taaaattta

SEQ ID NO: 100770 - DNA, 10 bp, Unknown
  misc_feature (1)..( 10): Result.002 file - promoters60/1026883
aatttgtctt

SEQ ID NO: 100771 - DNA, 10 bp, Unknown
  misc_feature (1)..( 10): Result.002 file - promoters60/1026883
tatttatcta

SEQ ID NO: 100772 - DNA, 10 bp, Unknown
  misc_feature (1)..( 10): Result.002 file - promoters60/1026883
aatctgttta

SEQ ID NO: 100773 - DNA, 10 bp, Unknown
  misc_feature (1)..( 10): Result.002 file - promoters60/1026883
attttgttta

SEQ ID NO: 100774 - DNA, 7 bp, Unknown
  misc_feature (1)..( 7): Result.002 file - promoters60/1026976
aatttag

SEQ ID NO: 100775 - DNA, 7 bp, Unknown
  misc_feature (1)..( 7): Result.002 file - promoters60/1026976
aatgtag

SEQ ID NO: 100776 - DNA, 13 bp, Unknown
  misc_feature (1)..( 13): Result.002 file - promoters60/1026976
ttgaatgtaatct

SEQ ID NO: 100777 - DNA, 13 bp, Unknown
  misc_feature (1)..( 13): Result.002 file - promoters60/1026976
ttgaatcaatatt

SEQ ID NO: 100778 - DNA, 13 bp, Unknown
  misc_feature (1)..( 13): Result.002 file - promoters60/1026976
ttgattcaaaatt

SEQ ID NO: 100779 - DNA, 6 bp, Unknown
  misc_feature (1)..( 6): Result.002 file - promoters60/1026976
aagaga

SEQ ID NO: 100780 - DNA, 6 bp, Unknown
  misc_feature (1)..( 6): Result.002 file - promoters60/1026976
aagaga

SEQ ID NO: 100781 - DNA, 6 bp, Unknown
  misc_feature (1)..( 6): Result.002 file - promoters60/1026976
tttgca

SEQ ID NO: 100782 - DNA, 6 bp, Unknown
  misc_feature (1)..( 6): Result.002 file - promoters60/1026976
tttgca

SEQ ID NO: 100783 - DNA, 6 bp, Unknown
  misc_feature (1)..( 6): Result.002 file - promoters60/1026976
tgaatc

SEQ ID NO: 100784 - DNA, 6 bp, Unknown
  misc_feature (1)..( 6): Result.002 file - promoters60/1026976
tgaatc

SEQ ID NO: 100785 - DNA, 7 bp, Unknown
  misc_feature (1)..( 7): Result.002 file - promoters60/1026976
atacata

SEQ ID NO: 100786 - DNA, 7 bp, Unknown
  misc_feature (1)..( 7): Result.002 file - promoters60/1026976
ataaata

SEQ ID NO: 100787 - DNA, 8 bp, Unknown
  misc_feature (1)..( 8): Result.002 file - promoters60/1026976
attcctgc

SEQ ID NO: 100788 - DNA, 8 bp, Unknown
  misc_feature (1)..( 8): Result.002 file - promoters60/1026976
atttctgc

SEQ ID NO: 100789 - DNA, 8 bp, Unknown
  misc_feature (1)..( 8): Result.002 file - promoters60/1026976
atttctct

SEQ ID NO: 100790 - DNA, 8 bp, Unknown
  misc_feature (1)..( 8): Result.002 file - promoters60/1026976
agaacaag

SEQ ID NO: 100791 - DNA, 8 bp, Unknown
  misc_feature (1)..( 8): Result.002 file - promoters60/1026976
agaacaag

SEQ ID NO: 100792 - DNA, 6 bp, Unknown
  misc_feature (1)..( 6): Result.002 file - promoters60/1026976
caagaa

SEQ ID NO: 100793 - DNA, 6 bp, Unknown
  misc_feature (1)..( 6): Result.002 file - promoters60/1026976
caagaa

SEQ ID NO: 100794 - DNA, 8 bp, Unknown
  misc_feature (1)..( 8): Result.002 file - promoters60/1026976
agaaagag

SEQ ID NO: 100795 - DNA, 8 bp, Unknown
  misc_feature (1)..( 8): Result.002 file - promoters60/1026976
agagagag

SEQ ID NO: 100796 - DNA, 9 bp, Unknown
  misc_feature (1)..( 9): Result.002 file - promoters60/1026976
ttgaggaag

SEQ ID NO: 100797 - DNA, 9 bp, Unknown
  misc_feature (1)..( 9): Result.002 file - promoters60/1026976
ttgagaaag

SEQ ID NO: 100798 - DNA, 6 bp, Unknown
  misc_feature (1)..( 6): Result.002 file - promoters60/1026976
gaatgc

SEQ ID NO: 100799 - DNA, 6 bp, Unknown
  misc_feature (1)..( 6): Result.002 file - promoters60/1026976
gaatgc

SEQ ID NO: 100800 - DNA, 9 bp, Unknown
  misc_feature (1)..( 9): Result.002 file - promoters60/1026976
atacttaat

SEQ ID NO: 100801 - DNA, 9 bp, Unknown
  misc_feature (1)..( 9): Result.002 file - promoters60/1026976
atatttaat

SEQ ID NO: 100802 - DNA, 7 bp, Unknown
  misc_feature (1)..( 7): Result.002 file - promoters60/1026976
tggattt

SEQ ID NO: 100803 - DNA, 7 bp, Unknown
  misc_feature (1)..( 7): Result.002 file - promoters60/1026976
tggattt

SEQ ID NO: 100804 - DNA, 6 bp, Unknown
  misc_feature (1)..( 6): Result.002 file - promoters60/1026976
aagatt

SEQ ID NO: 100805 - DNA, 6 bp, Unknown
  misc_feature (1)..( 6): Result.002 file - promoters60/1026976
aagatt

SEQ ID NO: 100806 - DNA, 6 bp, Unknown
  misc_feature (1)..( 6): Result.002 file - promoters60/1026976
ttggtt

SEQ ID NO: 100807 - DNA, 6 bp, Unknown
  misc_feature (1)..( 6): Result.002 file - promoters60/1026976
ttggtt

SEQ ID NO: 100808 - DNA, 6 bp, Unknown
  misc_feature (1)..( 6): Result.002 file - promoters60/1026976
ttaacc

SEQ ID NO: 100809 - DNA, 6 bp, Unknown
  misc_feature (1)..( 6): Result.002 file - promoters60/1026976
ttaacc

SEQ ID NO: 100810 - DNA, 7 bp, Unknown
  misc_feature (1)..( 7): Result.002 file - promoters60/1026976
ctcactc

SEQ ID NO: 100811 - DNA, 7 bp, Unknown
  misc_feature (1)..( 7): Result.002 file - promoters60/1026976
ctcgctc

SEQ ID NO: 100812 - DNA, 12 bp, Unknown
  misc_feature (1)..( 12): Result.002 file - promoters60/1026983
gtgacataccaa

SEQ ID NO: 100813 - DNA, 12 bp, Unknown
  misc_feature (1)..( 12): Result.002 file - promoters60/1026983
tgtacataacaa

SEQ ID NO: 100814 - DNA, 12 bp, Unknown
  misc_feature (1)..( 12): Result.002 file - promoters60/1026983
gtgaaatagtaa

SEQ ID NO: 100815 - DNA, 12 bp, Unknown
  misc_feature (1)..( 12): Result.002 file - promoters60/1026983
tttacatatcaa

SEQ ID NO: 100816 - DNA, 12 bp, Unknown
  misc_feature (1)..( 12): Result.002 file - promoters60/1026983
gtgaaaatggcg

SEQ ID NO: 100817 - DNA, 12 bp, Unknown
  misc_feature (1)..( 12): Result.002 file - promoters60/1026983
tcgaaatataaa

SEQ ID NO: 100818 - DNA, 11 bp, Unknown
  misc_feature (1)..( 11): Result.002 file - promoters60/1026987
tctattccttt

SEQ ID NO: 100819 - DNA, 11 bp, Unknown
  misc_feature (1)..( 11): Result.002 file - promoters60/1026987
ctacttccttg

SEQ ID NO: 100820 - DNA, 11 bp, Unknown
  misc_feature (1)..( 11): Result.002 file - promoters60/1026987
cgttttcgttg

SEQ ID NO: 100821 - DNA, 11 bp, Unknown
  misc_feature (1)..( 11): Result.002 file - promoters60/1026987
taacttcctcg

SEQ ID NO: 100822 - DNA, 11 bp, Unknown
  misc_feature (1)..( 11): Result.002 file - promoters60/1026987
taatttcaaaa

SEQ ID NO: 100823 - DNA, 11 bp, Unknown
  misc_feature (1)..( 11): Result.002 file - promoters60/1026987
aaacctccaat

SEQ ID NO: 100824 - DNA, 9 bp, Unknown
  misc_feature (1)..( 9): Result.002 file - promoters60/1026987
tctataaaa

SEQ ID NO: 100825 - DNA, 9 bp, Unknown
  misc_feature (1)..( 9): Result.002 file - promoters60/1026987
tatataaat

SEQ ID NO: 100826 - DNA, 9 bp, Unknown
  misc_feature (1)..( 9): Result.002 file - promoters60/1026987
cttataaat

SEQ ID NO: 100827 - DNA, 9 bp, Unknown
  misc_feature (1)..( 9): Result.002 file - promoters60/1026987
tatttaaac

SEQ ID NO: 100828 - DNA, 9 bp, Unknown
  misc_feature (1)..( 9): Result.002 file - promoters60/1026987
tatataaac

SEQ ID NO: 100829 - DNA, 9 bp, Unknown
  misc_feature (1)..( 9): Result.002 file - promoters60/1026987
cctataaac

SEQ ID NO: 100830 - DNA, 12 bp, Unknown
  misc_feature (1)..( 12): Result.002 file - promoters60/1026987
tatgtaaacgta

SEQ ID NO: 100831 - DNA, 12 bp, Unknown
  misc_feature (1)..( 12): Result.002 file - promoters60/1026987
tatttaaaaaga

SEQ ID NO: 100832 - DNA, 12 bp, Unknown
  misc_feature (1)..( 12): Result.002 file - promoters60/1026987
ctagtaaacata

SEQ ID NO: 100833 - DNA, 12 bp, Unknown
  misc_feature (1)..( 12): Result.002 file - promoters60/1026987
tatctaagacct

SEQ ID NO: 100834 - DNA, 12 bp, Unknown
  misc_feature (1)..( 12): Result.002 file - promoters60/1026987
taattaaacaga

SEQ ID NO: 100835 - DNA, 12 bp, Unknown
  misc_feature (1)..( 12): Result.002 file - promoters60/1026987
gcattaaaatat

SEQ ID NO: 100836 - DNA, 12 bp, Unknown
  misc_feature (1)..( 12): Result.002 file - promoters60/1026987
attttagaaaga

SEQ ID NO: 100837 - DNA, 12 bp, Unknown
  misc_feature (1)..( 12): Result.002 file - promoters60/1026987
gtcacaaatata

SEQ ID NO: 100838 - DNA, 12 bp, Unknown
  misc_feature (1)..( 12): Result.002 file - promoters60/1026987
ctagtaaacata

SEQ ID NO: 100839 - DNA, 12 bp, Unknown
  misc_feature (1)..( 12): Result.002 file - promoters60/1026987
gtaacaaataat

SEQ ID NO: 100840 - DNA, 12 bp, Unknown
  misc_feature (1)..( 12): Result.002 file - promoters60/1026987
ctaaaaaatcgt

SEQ ID NO: 100841 - DNA, 12 bp, Unknown
  misc_feature (1)..( 12): Result.002 file - promoters60/1026987
tttagaaagatc

SEQ ID NO: 100842 - DNA, 12 bp, Unknown
  misc_feature (1)..( 12): Result.002 file - promoters60/1026987
tttaaaaagaag

SEQ ID NO: 100843 - DNA, 10 bp, Unknown
  misc_feature (1)..( 10): Result.002 file - promoters60/1026987
acaaaagaga

SEQ ID NO: 100844 - DNA, 10 bp, Unknown
  misc_feature (1)..( 10): Result.002 file - promoters60/1026987
ccagaagaga

SEQ ID NO: 100845 - DNA, 10 bp, Unknown
  misc_feature (1)..( 10): Result.002 file - promoters60/1026987
attaaacaga

SEQ ID NO: 100846 - DNA, 10 bp, Unknown
  misc_feature (1)..( 10): Result.002 file - promoters60/1026987
tttaaaaaga

SEQ ID NO: 100847 - DNA, 10 bp, Unknown
  misc_feature (1)..( 10): Result.002 file - promoters60/1026987
attaaaatat

SEQ ID NO: 100848 - DNA, 10 bp, Unknown
  misc_feature (1)..( 10): Result.002 file - promoters60/1026987
tttagaaaga

SEQ ID NO: 100849 - DNA, 8 bp, Unknown
  misc_feature (1)..( 8): Result.002 file - promoters60/1027002
tttgagag

SEQ ID NO: 100850 - DNA, 8 bp, Unknown
  misc_feature (1)..( 8): Result.002 file - promoters60/1027002
tttgagta

SEQ ID NO: 100851 - DNA, 8 bp, Unknown
  misc_feature (1)..( 8): Result.002 file - promoters60/1027002
cttgggag

SEQ ID NO: 100852 - DNA, 8 bp, Unknown
  misc_feature (1)..( 8): Result.002 file - promoters60/1027002
aaaaaagc

SEQ ID NO: 100853 - DNA, 8 bp, Unknown
  misc_feature (1)..( 8): Result.002 file - promoters60/1027002
aaaaaaaa

SEQ ID NO: 100854 - DNA, 9 bp, Unknown
  misc_feature (1)..( 9): Result.002 file - promoters60/1027002
aaaataaaa

SEQ ID NO: 100855 - DNA, 8 bp, Unknown
  misc_feature (1)..( 8): Result.002 file - promoters60/1027002
agttttta

SEQ ID NO: 100856 - DNA, 8 bp, Unknown
  misc_feature (1)..( 8): Result.002 file - promoters60/1027002
tgttgtta

SEQ ID NO: 100857 - DNA, 8 bp, Unknown
  misc_feature (1)..( 8): Result.002 file - promoters60/1027002
agttttag

SEQ ID NO: 100858 - DNA, 8 bp, Unknown
  misc_feature (1)..( 8): Result.002 file - promoters60/1027002
aaataatt

SEQ ID NO: 100859 - DNA, 8 bp, Unknown
  misc_feature (1)..( 8): Result.002 file - promoters60/1027002
aaaaaatg

SEQ ID NO: 100860 - DNA, 8 bp, Unknown
  misc_feature (1)..( 8): Result.002 file - promoters60/1027002
gaaaaatg

SEQ ID NO: 100861 - DNA, 7 bp, Unknown
  misc_feature (1)..( 7): Result.002 file - promoters60/1027002
tgaaaag

SEQ ID NO: 100862 - DNA, 7 bp, Unknown
  misc_feature (1)..( 7): Result.002 file - promoters60/1027002
tgaaaaa

SEQ ID NO: 100863 - DNA, 7 bp, Unknown
  misc_feature (1)..( 7): Result.002 file - promoters60/1027002
cgaaaaa

SEQ ID NO: 100864 - DNA, 12 bp, Unknown
  misc_feature (1)..( 12): Result.002 file - promoters60/1027032
ttttaattatat

SEQ ID NO: 100865 - DNA, 12 bp, Unknown
  misc_feature (1)..( 12): Result.002 file - promoters60/1027032
atttaattagat

SEQ ID NO: 100866 - DNA, 12 bp, Unknown
  misc_feature (1)..( 12): Result.002 file - promoters60/1027032
gtaaaattatat

SEQ ID NO: 100867 - DNA, 12 bp, Unknown
  misc_feature (1)..( 12): Result.002 file - promoters60/1027032
tgtgaatgataa

SEQ ID NO: 100868 - DNA, 12 bp, Unknown
  misc_feature (1)..( 12): Result.002 file - promoters60/1027032
ccgtaattagta

SEQ ID NO: 100869 - DNA, 12 bp, Unknown
  misc_feature (1)..( 12): Result.002 file - promoters60/1027032
atttaagaactc

SEQ ID NO: 100870 - DNA, 7 bp, Unknown
  misc_feature (1)..( 7): Result.002 file - promoters60/1027125
ttatttt

SEQ ID NO: 100871 - DNA, 7 bp, Unknown
  misc_feature (1)..( 7): Result.002 file - promoters60/1027125
ttatttg

SEQ ID NO: 100872 - DNA, 8 bp, Unknown
  misc_feature (1)..( 8): Result.002 file - promoters60/1027125
ctatgtta

SEQ ID NO: 100873 - DNA, 10 bp, Unknown
  misc_feature (1)..( 10): Result.002 file - promoters60/1027125
aagtttacta

SEQ ID NO: 100874 - DNA, 10 bp, Unknown
  misc_feature (1)..( 10): Result.002 file - promoters60/1027125
aagtttttga

SEQ ID NO: 100875 - DNA, 10 bp, Unknown
  misc_feature (1)..( 10): Result.002 file - promoters60/1027125
tagtttttga

SEQ ID NO: 100876 - DNA, 7 bp, Unknown
  misc_feature (1)..( 7): Result.002 file - promoters60/1027125
gtttgtt

SEQ ID NO: 100877 - DNA, 7 bp, Unknown
  misc_feature (1)..( 7): Result.002 file - promoters60/1027125
ttttgtt

SEQ ID NO: 100878 - DNA, 7 bp, Unknown
  misc_feature (1)..( 7): Result.002 file - promoters60/1027125
ttttgta

SEQ ID NO: 100879 - DNA, 7 bp, Unknown
  misc_feature (1)..( 7): Result.002 file - promoters60/1027125
ctttgta

SEQ ID NO: 100880 - DNA, 7 bp, Unknown
  misc_feature (1)..( 7): Result.002 file - promoters60/1027125
tgtaaaa

SEQ ID NO: 100881 - DNA, 7 bp, Unknown
  misc_feature (1)..( 7): Result.002 file - promoters60/1027125
tgtaaat

SEQ ID NO: 100882 - DNA, 7 bp, Unknown
  misc_feature (1)..( 7): Result.002 file - promoters60/1027125
agtaaaa

SEQ ID NO: 100883 - DNA, 9 bp, Unknown
  misc_feature (1)..( 9): Result.002 file - promoters60/1027125
gcaaaaaga

SEQ ID NO: 100884 - DNA, 9 bp, Unknown
  misc_feature (1)..( 9): Result.002 file - promoters60/1027125
acaaaaaga

SEQ ID NO: 100885 - DNA, 9 bp, Unknown
  misc_feature (1)..( 9): Result.002 file - promoters60/1027125
aaaaaaagg

SEQ ID NO: 100886 - DNA, 9 bp, Unknown
  misc_feature (1)..( 9): Result.002 file - promoters60/1027125
acaaaaata

SEQ ID NO: 100887 - DNA, 9 bp, Unknown
  misc_feature (1)..( 9): Result.002 file - promoters60/1027125
ccagctaat

SEQ ID NO: 100888 - DNA, 9 bp, Unknown
  misc_feature (1)..( 9): Result.002 file - promoters60/1027125
ttagctaaa

SEQ ID NO: 100889 - DNA, 9 bp, Unknown
  misc_feature (1)..( 9): Result.002 file - promoters60/1027125
ttagcgaaa

SEQ ID NO: 100890 - DNA, 12 bp, Unknown
  misc_feature (1)..( 12): Result.002 file - promoters60/1027125
agctgtaaaatt

SEQ ID NO: 100891 - DNA, 12 bp, Unknown
  misc_feature (1)..( 12): Result.002 file - promoters60/1027125
aaaaataaaatt

SEQ ID NO: 100892 - DNA, 12 bp, Unknown
  misc_feature (1)..( 12): Result.002 file - promoters60/1027125
aaaaaaaaaata

SEQ ID NO: 100893 - DNA, 12 bp, Unknown
  misc_feature (1)..( 12): Result.002 file - promoters60/1027125
aatatgatcatc

SEQ ID NO: 100894 - DNA, 12 bp, Unknown
  misc_feature (1)..( 12): Result.002 file - promoters60/1027125
tgtatcatcatc

SEQ ID NO: 100895 - DNA, 12 bp, Unknown
  misc_feature (1)..( 12): Result.002 file - promoters60/1027125
tgtctcatgtgc

SEQ ID NO: 100896 - DNA, 8 bp, Unknown
  misc_feature (1)..( 8): Result.002 file - promoters60/1027156
atacaaaa

SEQ ID NO: 100897 - DNA, 8 bp, Unknown
  misc_feature (1)..( 8): Result.002 file - promoters60/1027156
atacaata

SEQ ID NO: 100898 - DNA, 8 bp, Unknown
  misc_feature (1)..( 8): Result.002 file - promoters60/1027156
ctacaata

SEQ ID NO: 100899 - DNA, 9 bp, Unknown
  misc_feature (1)..( 9): Result.002 file - promoters60/1027156
ttagtcaac

SEQ ID NO: 100900 - DNA, 9 bp, Unknown
  misc_feature (1)..( 9): Result.002 file - promoters60/1027156
aaagtaaac

SEQ ID NO: 100901 - DNA, 9 bp, Unknown
  misc_feature (1)..( 9): Result.002 file - promoters60/1027156
aaagaaaaa

SEQ ID NO: 100902 - DNA, 10 bp, Unknown
  misc_feature (1)..( 10): Result.002 file - promoters60/1027156
catataggtt

SEQ ID NO: 100903 - DNA, 10 bp, Unknown
  misc_feature (1)..( 10): Result.002 file - promoters60/1027156
aaaataagtt

SEQ ID NO: 100904 - DNA, 10 bp, Unknown
  misc_feature (1)..( 10): Result.002 file - promoters60/1027156
aaactaagaa

SEQ ID NO: 100905 - DNA, 9 bp, Unknown
  misc_feature (1)..( 9): Result.002 file - promoters60/1027156
caacaactt

SEQ ID NO: 100906 - DNA, 9 bp, Unknown
  misc_feature (1)..( 9): Result.002 file - promoters60/1027156
caaaaacta

SEQ ID NO: 100907 - DNA, 9 bp, Unknown
  misc_feature (1)..( 9): Result.002 file - promoters60/1027156
taaaataag

SEQ ID NO: 100908 - DNA, 8 bp, Unknown
  misc_feature (1)..( 8): Result.002 file - promoters60/1027171
ttttctta

SEQ ID NO: 100909 - DNA, 8 bp, Unknown
  misc_feature (1)..( 8): Result.002 file - promoters60/1027171
ttttgtta

SEQ ID NO: 100910 - DNA, 8 bp, Unknown
  misc_feature (1)..( 8): Result.002 file - promoters60/1027171
aaaatcaa

SEQ ID NO: 100911 - DNA, 8 bp, Unknown
  misc_feature (1)..( 8): Result.002 file - promoters60/1027171
aaaaacaa

SEQ ID NO: 100912 - DNA, 7 bp, Unknown
  misc_feature (1)..( 7): Result.002 file - promoters60/1027171
attcaaa

SEQ ID NO: 100913 - DNA, 7 bp, Unknown
  misc_feature (1)..( 7): Result.002 file - promoters60/1027171
atttaaa

SEQ ID NO: 100914 - DNA, 7 bp, Unknown
  misc_feature (1)..( 7): Result.002 file - promoters60/1027171
attcaac

SEQ ID NO: 100915 - DNA, 6 bp, Unknown
  misc_feature (1)..( 6): Result.002 file - promoters60/1027171
aaagat

SEQ ID NO: 100916 - DNA, 6 bp, Unknown
  misc_feature (1)..( 6): Result.002 file - promoters60/1027171
aaagat

SEQ ID NO: 100917 - DNA, 7 bp, Unknown
  misc_feature (1)..( 7): Result.002 file - promoters60/1027171
ttaatca

SEQ ID NO: 100918 - DNA, 7 bp, Unknown
  misc_feature (1)..( 7): Result.002 file - promoters60/1027171
ttaatca

SEQ ID NO: 100919 - DNA, 7 bp, Unknown
  misc_feature (1)..( 7): Result.002 file - promoters60/1027171
ccaaagc

SEQ ID NO: 100920 - DNA, 7 bp, Unknown
  misc_feature (1)..( 7): Result.002 file - promoters60/1027171
ccacagc

SEQ ID NO: 100921 - DNA, 6 bp, Unknown
  misc_feature (1)..( 6): Result.002 file - promoters60/1027171
aaaaca

SEQ ID NO: 100922 - DNA, 6 bp, Unknown
  misc_feature (1)..( 6): Result.002 file - promoters60/1027171
aaaaca

SEQ ID NO: 100923 - DNA, 7 bp, Unknown
  misc_feature (1)..( 7): Result.002 file - promoters60/1027171
agtagga

SEQ ID NO: 100924 - DNA, 7 bp, Unknown
  misc_feature (1)..( 7): Result.002 file - promoters60/1027171
agtagga

SEQ ID NO: 100925 - DNA, 10 bp, Unknown
  misc_feature (1)..( 10): Result.002 file - promoters60/1027171
tataattcaa

SEQ ID NO: 100926 - DNA, 10 bp, Unknown
  misc_feature (1)..( 10): Result.002 file - promoters60/1027171
tattattcaa

SEQ ID NO: 100927 - DNA, 6 bp, Unknown
  misc_feature (1)..( 6): Result.002 file - promoters60/1027171
aaactc

SEQ ID NO: 100928 - DNA, 6 bp, Unknown
  misc_feature (1)..( 6): Result.002 file - promoters60/1027171
aaactc

SEQ ID NO: 100929 - DNA, 7 bp, Unknown
  misc_feature (1)..( 7): Result.002 file - promoters60/1027171
ttcaaca

SEQ ID NO: 100930 - DNA, 7 bp, Unknown
  misc_feature (1)..( 7): Result.002 file - promoters60/1027171
ttctaca

SEQ ID NO: 100931 - DNA, 7 bp, Unknown
  misc_feature (1)..( 7): Result.002 file - promoters60/1027171
accgtca

SEQ ID NO: 100932 - DNA, 7 bp, Unknown
  misc_feature (1)..( 7): Result.002 file - promoters60/1027171
accatca

SEQ ID NO: 100933 - DNA, 6 bp, Unknown
  misc_feature (1)..( 6): Result.002 file - promoters60/1027171
ataaag

SEQ ID NO: 100934 - DNA, 6 bp, Unknown
  misc_feature (1)..( 6): Result.002 file - promoters60/1027171
ataaag

SEQ ID NO: 100935 - DNA, 10 bp, Unknown
  misc_feature (1)..( 10): Result.002 file - promoters60/1027171
caaaaaataa

SEQ ID NO: 100936 - DNA, 10 bp, Unknown
  misc_feature (1)..( 10): Result.002 file - promoters60/1027171
caaaacataa

SEQ ID NO: 100937 - DNA, 7 bp, Unknown
  misc_feature (1)..( 7): Result.002 file - promoters60/1027171
aatctag

SEQ ID NO: 100938 - DNA, 7 bp, Unknown
  misc_feature (1)..( 7): Result.002 file - promoters60/1027171
aatctag

SEQ ID NO: 100939 - DNA, 7 bp, Unknown
  misc_feature (1)..( 7): Result.002 file - promoters60/1027171
agataaa

SEQ ID NO: 100940 - DNA, 7 bp, Unknown
  misc_feature (1)..( 7): Result.002 file - promoters60/1027171
agataaa

SEQ ID NO: 100941 - DNA, 7 bp, Unknown
  misc_feature (1)..( 7): Result.002 file - promoters60/1027171
aaactta

SEQ ID NO: 100942 - DNA, 7 bp, Unknown
  misc_feature (1)..( 7): Result.002 file - promoters60/1027171
aaactta

SEQ ID NO: 100943 - DNA, 10 bp, Unknown
  misc_feature (1)..( 10): Result.002 file - promoters60/1027171
acaaacatta

SEQ ID NO: 100944 - DNA, 10 bp, Unknown
  misc_feature (1)..( 10): Result.002 file - promoters60/1027171
acaaacgtta

SEQ ID NO: 100945 - DNA, 8 bp, Unknown
  misc_feature (1)..( 8): Result.002 file - promoters60/1027171
aaaaaaac

SEQ ID NO: 100946 - DNA, 8 bp, Unknown
  misc_feature (1)..( 8): Result.002 file - promoters60/1027171
aaaagaac

SEQ ID NO: 100947 - DNA, 6 bp, Unknown
  misc_feature (1)..( 6): Result.002 file - promoters60/1027171
aaacat

SEQ ID NO: 100948 - DNA, 6 bp, Unknown
  misc_feature (1)..( 6): Result.002 file - promoters60/1027171
aaacat

SEQ ID NO: 100949 - DNA, 6 bp, Unknown
  misc_feature (1)..( 6): Result.002 file - promoters60/1027171
taatat

SEQ ID NO: 100950 - DNA, 6 bp, Unknown
  misc_feature (1)..( 6): Result.002 file - promoters60/1027171
taatat

SEQ ID NO: 100951 - DNA, 10 bp, Unknown
  misc_feature (1)..( 10): Result.002 file - promoters60/1027189
cctaaaaaat

SEQ ID NO: 100952 - DNA, 10 bp, Unknown
  misc_feature (1)..( 10): Result.002 file - promoters60/1027189
acaaaataat

SEQ ID NO: 100953 - DNA, 10 bp, Unknown
  misc_feature (1)..( 10): Result.002 file - promoters60/1027189
ttagaaaaat

SEQ ID NO: 100954 - DNA, 10 bp, Unknown
  misc_feature (1)..( 10): Result.002 file - promoters60/1027189
cggaaaaaac

SEQ ID NO: 100955 - DNA, 10 bp, Unknown
  misc_feature (1)..( 10): Result.002 file - promoters60/1027189
tagagaaaca

SEQ ID NO: 100956 - DNA, 10 bp, Unknown
  misc_feature (1)..( 10): Result.002 file - promoters60/1027189
ggtttggttt

SEQ ID NO: 100957 - DNA, 10 bp, Unknown
  misc_feature (1)..( 10): Result.002 file - promoters60/1027189
ggtttgtttt

SEQ ID NO: 100958 - DNA, 10 bp, Unknown
  misc_feature (1)..( 10): Result.002 file - promoters60/1027189
tcattggtta

SEQ ID NO: 100959 - DNA, 10 bp, Unknown
  misc_feature (1)..( 10): Result.002 file - promoters60/1027189
aatttatttg

SEQ ID NO: 100960 - DNA, 10 bp, Unknown
  misc_feature (1)..( 10): Result.002 file - promoters60/1027189
tatttattta

SEQ ID NO: 100961 - DNA, 10 bp, Unknown
  misc_feature (1)..( 10): Result.002 file - promoters60/1027189
cctttattct

SEQ ID NO: 100962 - DNA, 9 bp, Unknown
  misc_feature (1)..( 9): Result.002 file - promoters60/1027189
tatatgatg

SEQ ID NO: 100963 - DNA, 9 bp, Unknown
  misc_feature (1)..( 9): Result.002 file - promoters60/1027189
ggtatcatg

SEQ ID NO: 100964 - DNA, 9 bp, Unknown
  misc_feature (1)..( 9): Result.002 file - promoters60/1027189
aatatgaga

SEQ ID NO: 100965 - DNA, 9 bp, Unknown
  misc_feature (1)..( 9): Result.002 file - promoters60/1027189
tatatgaca

SEQ ID NO: 100966 - DNA, 9 bp, Unknown
  misc_feature (1)..( 9): Result.002 file - promoters60/1027189
aatattatg

SEQ ID NO: 100967 - DNA, 11 bp, Unknown
  misc_feature (1)..( 11): Result.002 file - promoters60/1027189
tacataacaaa

SEQ ID NO: 100968 - DNA, 11 bp, Unknown
  misc_feature (1)..( 11): Result.002 file - promoters60/1027189
tgtaaaacaaa

SEQ ID NO: 100969 - DNA, 11 bp, Unknown
  misc_feature (1)..( 11): Result.002 file - promoters60/1027189
aaaataaaaaa

SEQ ID NO: 100970 - DNA, 11 bp, Unknown
  misc_feature (1)..( 11): Result.002 file - promoters60/1027189
tacatatcaaa

SEQ ID NO: 100971 - DNA, 11 bp, Unknown
  misc_feature (1)..( 11): Result.002 file - promoters60/1027189
tttataccaac

SEQ ID NO: 100972 - DNA, 11 bp, Unknown
  misc_feature (1)..( 11): Result.002 file - promoters60/1027189
gttacaccaat

SEQ ID NO: 100973 - DNA, 7 bp, Unknown
  misc_feature (1)..( 7): Result.002 file - promoters60/1027189
caagaaa

SEQ ID NO: 100974 - DNA, 7 bp, Unknown
  misc_feature (1)..( 7): Result.002 file - promoters60/1027189
caacaaa

SEQ ID NO: 100975 - DNA, 7 bp, Unknown
  misc_feature (1)..( 7): Result.002 file - promoters60/1027189
aaacaaa

SEQ ID NO: 100976 - DNA, 7 bp, Unknown
  misc_feature (1)..( 7): Result.002 file - promoters60/1027189
aaacaat

SEQ ID NO: 100977 - DNA, 7 bp, Unknown
  misc_feature (1)..( 7): Result.002 file - promoters60/1027189
aaacaaa

SEQ ID NO: 100978 - DNA, 15 bp, Unknown
  misc_feature (1)..( 15): Result.002 file - promoters60/1027189
ataataattttgact

SEQ ID NO: 100979 - DNA, 15 bp, Unknown
  misc_feature (1)..( 15): Result.002 file - promoters60/1027189
ataattattttaact

SEQ ID NO: 100980 - DNA, 15 bp, Unknown
  misc_feature (1)..( 15): Result.002 file - promoters60/1027189
cttagaatttggttc

SEQ ID NO: 100981 - DNA, 15 bp, Unknown
  misc_feature (1)..( 15): Result.002 file - promoters60/1027189
atatttatttattta

SEQ ID NO: 100982 - DNA, 15 bp, Unknown
  misc_feature (1)..( 15): Result.002 file - promoters60/1027189
tttattcttttatgc

SEQ ID NO: 100983 - DNA, 15 bp, Unknown
  misc_feature (1)..( 15): Result.002 file - promoters60/1027201
aaatcatctcaatgc

SEQ ID NO: 100984 - DNA, 15 bp, Unknown
  misc_feature (1)..( 15): Result.002 file - promoters60/1027201
aaatcatctcaatgc

SEQ ID NO: 100985 - DNA, 7 bp, Unknown
  misc_feature (1)..( 7): Result.002 file - promoters60/1027201
catcata

SEQ ID NO: 100986 - DNA, 7 bp, Unknown
  misc_feature (1)..( 7): Result.002 file - promoters60/1027201
cataata

SEQ ID NO: 100987 - DNA, 8 bp, Unknown
  misc_feature (1)..( 8): Result.002 file - promoters60/1027201
caagaaca

SEQ ID NO: 100988 - DNA, 8 bp, Unknown
  misc_feature (1)..( 8): Result.002 file - promoters60/1027201
caataaca

SEQ ID NO: 100989 - DNA, 6 bp, Unknown
  misc_feature (1)..( 6): Result.002 file - promoters60/1027201
aattaa

SEQ ID NO: 100990 - DNA, 6 bp, Unknown
  misc_feature (1)..( 6): Result.002 file - promoters60/1027201
aattaa

SEQ ID NO: 100991 - DNA, 9 bp, Unknown
  misc_feature (1)..( 9): Result.002 file - promoters60/1027201
gatgaagaa

SEQ ID NO: 100992 - DNA, 9 bp, Unknown
  misc_feature (1)..( 9): Result.002 file - promoters60/1027201
attgatgaa

SEQ ID NO: 100993 - DNA, 9 bp, Unknown
  misc_feature (1)..( 9): Result.002 file - promoters60/1027201
gatgcagat

SEQ ID NO: 100994 - DNA, 6 bp, Unknown
  misc_feature (1)..( 6): Result.002 file - promoters60/1027201
ctctct

SEQ ID NO: 100995 - DNA, 6 bp, Unknown
  misc_feature (1)..( 6): Result.002 file - promoters60/1027201
ctctct

SEQ ID NO: 100996 - DNA, 7 bp, Unknown
  misc_feature (1)..( 7): Result.002 file - promoters60/1027201
tcgaatt

SEQ ID NO: 100997 - DNA, 7 bp, Unknown
  misc_feature (1)..( 7): Result.002 file - promoters60/1027201
tcgtatt

SEQ ID NO: 100998 - DNA, 9 bp, Unknown
  misc_feature (1)..( 9): Result.002 file - promoters60/1027201
aagctcgat

SEQ ID NO: 100999 - DNA, 9 bp, Unknown
  misc_feature (1)..( 9): Result.002 file - promoters60/1027201
aaggtcgat

SEQ ID NO: 101000 - DNA, 9 bp, Unknown
  misc_feature (1)..( 9): Result.002 file - promoters60/1027201
aagctcgat

SEQ ID NO: 101001 - DNA, 6 bp, Unknown
  misc_feature (1)..( 6): Result.002 file - promoters60/1027201
gaaaaa

SEQ ID NO: 101002 - DNA, 6 bp, Unknown
  misc_feature (1)..( 6): Result.002 file - promoters60/1027201
gaaaaa

SEQ ID NO: 101003 - DNA, 7 bp, Unknown
  misc_feature (1)..( 7): Result.002 file - promoters60/1027201
aaaaaat

SEQ ID NO: 101004 - DNA, 7 bp, Unknown
  misc_feature (1)..( 7): Result.002 file - promoters60/1027201
aaaaaat

SEQ ID NO: 101005 - DNA, 7 bp, Unknown
  misc_feature (1)..( 7): Result.002 file - promoters60/1027201
aaaaaaa

SEQ ID NO: 101006 - DNA, 7 bp, Unknown
  misc_feature (1)..( 7): Result.002 file - promoters60/1027201
atttgtt

SEQ ID NO: 101007 - DNA, 7 bp, Unknown
  misc_feature (1)..( 7): Result.002 file - promoters60/1027201
attggtt

SEQ ID NO: 101008 - DNA, 6 bp, Unknown
  misc_feature (1)..( 6): Result.002 file - promoters60/1027201
aaactt

SEQ ID NO: 101009 - DNA, 6 bp, Unknown
  misc_feature (1)..( 6): Result.002 file - promoters60/1027201
aaactt

SEQ ID NO: 101010 - DNA, 8 bp, Unknown
  misc_feature (1)..( 8): Result.002 file - promoters60/1027201
aaaattaa

SEQ ID NO: 101011 - DNA, 8 bp, Unknown
  misc_feature (1)..( 8): Result.002 file - promoters60/1027201
aaaattaa

SEQ ID NO: 101012 - DNA, 7 bp, Unknown
  misc_feature (1)..( 7): Result.002 file - promoters60/1027201
tactata

SEQ ID NO: 101013 - DNA, 7 bp, Unknown
  misc_feature (1)..( 7): Result.002 file - promoters60/1027201
tactata

SEQ ID NO: 101014 - DNA, 7 bp, Unknown
  misc_feature (1)..( 7): Result.002 file - promoters60/1027240
cgatttt

SEQ ID NO: 101015 - DNA, 7 bp, Unknown
  misc_feature (1)..( 7): Result.002 file - promoters60/1027240
agatttt

SEQ ID NO: 101016 - DNA, 7 bp, Unknown
  misc_feature (1)..( 7): Result.002 file - promoters60/1027240
agagttt

SEQ ID NO: 101017 - DNA, 10 bp, Unknown
  misc_feature (1)..( 10): Result.002 file - promoters60/1027240
caaaatattt

SEQ ID NO: 101018 - DNA, 10 bp, Unknown
  misc_feature (1)..( 10): Result.002 file - promoters60/1027240
caaaatcttt

SEQ ID NO: 101019 - DNA, 10 bp, Unknown
  misc_feature (1)..( 10): Result.002 file - promoters60/1027240
taaattatat

SEQ ID NO: 101020 - DNA, 10 bp, Unknown
  misc_feature (1)..( 10): Result.002 file - promoters60/1027240
taaaaccggt

SEQ ID NO: 101021 - DNA, 10 bp, Unknown
  misc_feature (1)..( 10): Result.002 file - promoters60/1027240
taaaacgaaa

SEQ ID NO: 101022 - DNA, 11 bp, Unknown
  misc_feature (1)..( 11): Result.002 file - promoters60/1027240
tataaaccgaa

SEQ ID NO: 101023 - DNA, 8 bp, Unknown
  misc_feature (1)..( 8): Result.002 file - promoters60/1027240
aatcaaaa

SEQ ID NO: 101024 - DNA, 8 bp, Unknown
  misc_feature (1)..( 8): Result.002 file - promoters60/1027240
tatcaaaa

SEQ ID NO: 101025 - DNA, 8 bp, Unknown
  misc_feature (1)..( 8): Result.002 file - promoters60/1027240
aatgaaaa

SEQ ID NO: 101026 - DNA, 9 bp, Unknown
  misc_feature (1)..( 9): Result.002 file - promoters60/1027240
taaccctag

SEQ ID NO: 101027 - DNA, 9 bp, Unknown
  misc_feature (1)..( 9): Result.002 file - promoters60/1027240
taaacctaa

SEQ ID NO: 101028 - DNA, 9 bp, Unknown
  misc_feature (1)..( 9): Result.002 file - promoters60/1027240
ctacccaaa

SEQ ID NO: 101029 - DNA, 9 bp, Unknown
  misc_feature (1)..( 9): Result.002 file - promoters60/1027240
tttggccca

SEQ ID NO: 101030 - DNA, 9 bp, Unknown
  misc_feature (1)..( 9): Result.002 file - promoters60/1027240
catggtcca

SEQ ID NO: 101031 - DNA, 9 bp, Unknown
  misc_feature (1)..( 9): Result.002 file - promoters60/1027240
catagtcgc

SEQ ID NO: 101032 - DNA, 12 bp, Unknown
  misc_feature (1)..( 12): Result.002 file - promoters60/1027240
atataattaaaa

SEQ ID NO: 101033 - DNA, 12 bp, Unknown
  misc_feature (1)..( 12): Result.002 file - promoters60/1027240
atataaaccgaa

SEQ ID NO: 101034 - DNA, 12 bp, Unknown
  misc_feature (1)..( 12): Result.002 file - promoters60/1027240
ttataaaacgaa

SEQ ID NO: 101035 - DNA, 6 bp, Unknown
  misc_feature (1)..( 6): Result.002 file - promoters60/1027240
aaaaac

SEQ ID NO: 101036 - DNA, 6 bp, Unknown
  misc_feature (1)..( 6): Result.002 file - promoters60/1027240
aaaaac

SEQ ID NO: 101037 - DNA, 6 bp, Unknown
  misc_feature (1)..( 6): Result.002 file - promoters60/1027240
aaaaaa

SEQ ID NO: 101038 - DNA, 12 bp, Unknown
  misc_feature (1)..( 12): Result.002 file - promoters60/1027240
cgagttaaccac

SEQ ID NO: 101039 - DNA, 12 bp, Unknown
  misc_feature (1)..( 12): Result.002 file - promoters60/1027240
taaaataaacac

SEQ ID NO: 101040 - DNA, 12 bp, Unknown
  misc_feature (1)..( 12): Result.002 file - promoters60/1027240
taagatatacac

SEQ ID NO: 101041 - DNA, 7 bp, Unknown
  misc_feature (1)..( 7): Result.002 file - promoters60/1027243
tatatat

SEQ ID NO: 101042 - DNA, 7 bp, Unknown
  misc_feature (1)..( 7): Result.002 file - promoters60/1027243
tatttat

SEQ ID NO: 101043 - DNA, 6 bp, Unknown
  misc_feature (1)..( 6): Result.002 file - promoters60/1027243
ttttat

SEQ ID NO: 101044 - DNA, 6 bp, Unknown
  misc_feature (1)..( 6): Result.002 file - promoters60/1027243
ttttat

SEQ ID NO: 101045 - DNA, 7 bp, Unknown
  misc_feature (1)..( 7): Result.002 file - promoters60/1027243
taatctt

SEQ ID NO: 101046 - DNA, 7 bp, Unknown
  misc_feature (1)..( 7): Result.002 file - promoters60/1027243
taaactt

SEQ ID NO: 101047 - DNA, 7 bp, Unknown
  misc_feature (1)..( 7): Result.002 file - promoters60/1027243
gcacaat

SEQ ID NO: 101048 - DNA, 7 bp, Unknown
  misc_feature (1)..( 7): Result.002 file - promoters60/1027243
gcaaaat

SEQ ID NO: 101049 - DNA, 7 bp, Unknown
  misc_feature (1)..( 7): Result.002 file - promoters60/1027243
agtgttg

SEQ ID NO: 101050 - DNA, 7 bp, Unknown
  misc_feature (1)..( 7): Result.002 file - promoters60/1027243
agttttg

SEQ ID NO: 101051 - DNA, 8 bp, Unknown
  misc_feature (1)..( 8): Result.002 file - promoters60/1027243
tagcagtt

SEQ ID NO: 101052 - DNA, 8 bp, Unknown
  misc_feature (1)..( 8): Result.002 file - promoters60/1027243
tagaagtt

SEQ ID NO: 101053 - DNA, 7 bp, Unknown
  misc_feature (1)..( 7): Result.002 file - promoters60/1027243
agtgaat

SEQ ID NO: 101054 - DNA, 7 bp, Unknown
  misc_feature (1)..( 7): Result.002 file - promoters60/1027243
agttaat

SEQ ID NO: 101055 - DNA, 6 bp, Unknown
  misc_feature (1)..( 6): Result.002 file - promoters60/1027243
caaaac

SEQ ID NO: 101056 - DNA, 6 bp, Unknown
  misc_feature (1)..( 6): Result.002 file - promoters60/1027243
caaaac

SEQ ID NO: 101057 - DNA, 7 bp, Unknown
  misc_feature (1)..( 7): Result.002 file - promoters60/1027243
taactct

SEQ ID NO: 101058 - DNA, 7 bp, Unknown
  misc_feature (1)..( 7): Result.002 file - promoters60/1027243
taactct

SEQ ID NO: 101059 - DNA, 7 bp, Unknown
  misc_feature (1)..( 7): Result.002 file - promoters60/1027243
atttata

SEQ ID NO: 101060 - DNA, 7 bp, Unknown
  misc_feature (1)..( 7): Result.002 file - promoters60/1027243
attcata

SEQ ID NO: 101061 - DNA, 6 bp, Unknown
  misc_feature (1)..( 6): Result.002 file - promoters60/1027243
tattaa

SEQ ID NO: 101062 - DNA, 6 bp, Unknown
  misc_feature (1)..( 6): Result.002 file - promoters60/1027243
tattaa

SEQ ID NO: 101063 - DNA, 9 bp, Unknown
  misc_feature (1)..( 9): Result.002 file - promoters60/1027243
ataataaca

SEQ ID NO: 101064 - DNA, 9 bp, Unknown
  misc_feature (1)..( 9): Result.002 file - promoters60/1027243
ataatcaca

SEQ ID NO: 101065 - DNA, 7 bp, Unknown
  misc_feature (1)..( 7): Result.002 file - promoters60/1027243
atattat

SEQ ID NO: 101066 - DNA, 7 bp, Unknown
  misc_feature (1)..( 7): Result.002 file - promoters60/1027243
atagtat

SEQ ID NO: 101067 - DNA, 6 bp, Unknown
  misc_feature (1)..( 6): Result.002 file - promoters60/1027243
aatctt

SEQ ID NO: 101068 - DNA, 6 bp, Unknown
  misc_feature (1)..( 6): Result.002 file - promoters60/1027243
aatctt

SEQ ID NO: 101069 - DNA, 6 bp, Unknown
  misc_feature (1)..( 6): Result.002 file - promoters60/1027243
tttttt

SEQ ID NO: 101070 - DNA, 6 bp, Unknown
  misc_feature (1)..( 6): Result.002 file - promoters60/1027243
tttttt

SEQ ID NO: 101071 - DNA, 11 bp, Unknown
  misc_feature (1)..( 11): Result.002 file - promoters60/1027243
cattgatactt

SEQ ID NO: 101072 - DNA, 11 bp, Unknown
  misc_feature (1)..( 11): Result.002 file - promoters60/1027243
cattggtactt

SEQ ID NO: 101073 - DNA, 8 bp, Unknown
  misc_feature (1)..( 8): Result.002 file - promoters60/1027243
aaataaaa

SEQ ID NO: 101074 - DNA, 8 bp, Unknown
  misc_feature (1)..( 8): Result.002 file - promoters60/1027243
aaagaaaa

SEQ ID NO: 101075 - DNA, 6 bp, Unknown
  misc_feature (1)..( 6): Result.002 file - promoters60/1027243
taataa

SEQ ID NO: 101076 - DNA, 6 bp, Unknown
  misc_feature (1)..( 6): Result.002 file - promoters60/1027243
taataa

SEQ ID NO: 101077 - DNA, 6 bp, Unknown
  misc_feature (1)..( 6): Result.002 file - promoters60/1027243
cacaca

SEQ ID NO: 101078 - DNA, 6 bp, Unknown
  misc_feature (1)..( 6): Result.002 file - promoters60/1027243
cacaca

SEQ ID NO: 101079 - DNA, 8 bp, Unknown
  misc_feature (1)..( 8): Result.002 file - promoters60/1027243
atttactt

SEQ ID NO: 101080 - DNA, 8 bp, Unknown
  misc_feature (1)..( 8): Result.002 file - promoters60/1027243
atttactt

SEQ ID NO: 101081 - DNA, 8 bp, Unknown
  misc_feature (1)..( 8): Result.002 file - promoters60/1027243
atcaaaac

SEQ ID NO: 101082 - DNA, 8 bp, Unknown
  misc_feature (1)..( 8): Result.002 file - promoters60/1027243
atccaaac

SEQ ID NO: 101083 - DNA, 8 bp, Unknown
  misc_feature (1)..( 8): Result.002 file - promoters60/1027243
cttcttca

SEQ ID NO: 101084 - DNA, 8 bp, Unknown
  misc_feature (1)..( 8): Result.002 file - promoters60/1027243
cttcttca

SEQ ID NO: 101085 - DNA, 8 bp, Unknown
  misc_feature (1)..( 8): Result.002 file - promoters60/1027276
acatattt

SEQ ID NO: 101086 - DNA, 8 bp, Unknown
  misc_feature (1)..( 8): Result.002 file - promoters60/1027276
acatatta

SEQ ID NO: 101087 - DNA, 8 bp, Unknown
  misc_feature (1)..( 8): Result.002 file - promoters60/1027276
acatgttt

SEQ ID NO: 101088 - DNA, 8 bp, Unknown
  misc_feature (1)..( 8): Result.002 file - promoters60/1027276
tcatctta

SEQ ID NO: 101089 - DNA, 8 bp, Unknown
  misc_feature (1)..( 8): Result.002 file - promoters60/1027276
ttatgttt

SEQ ID NO: 101090 - DNA, 8 bp, Unknown
  misc_feature (1)..( 8): Result.002 file - promoters60/1027276
tcatctaa

SEQ ID NO: 101091 - DNA, 12 bp, Unknown
  misc_feature (1)..( 12): Result.002 file - promoters60/1027276
attttaatctct

SEQ ID NO: 101092 - DNA, 12 bp, Unknown
  misc_feature (1)..( 12): Result.002 file - promoters60/1027276
tttttattctat

SEQ ID NO: 101093 - DNA, 12 bp, Unknown
  misc_feature (1)..( 12): Result.002 file - promoters60/1027276
gttgtattctaa

SEQ ID NO: 101094 - DNA, 12 bp, Unknown
  misc_feature (1)..( 12): Result.002 file - promoters60/1027276
caattaatctca

SEQ ID NO: 101095 - DNA, 12 bp, Unknown
  misc_feature (1)..( 12): Result.002 file - promoters60/1027276
tttttacggcgt

SEQ ID NO: 101096 - DNA, 12 bp, Unknown
  misc_feature (1)..( 12): Result.002 file - promoters60/1027276
tgctgaatcaat

SEQ ID NO: 101097 - DNA, 14 bp, Unknown
  misc_feature (1)..( 14): Result.002 file - promoters60/1027327
atttggaaaagacc

SEQ ID NO: 101098 - DNA, 14 bp, Unknown
  misc_feature (1)..( 14): Result.002 file - promoters60/1027327
tgttgtaaatgttg

SEQ ID NO: 101099 - DNA, 14 bp, Unknown
  misc_feature (1)..( 14): Result.002 file - promoters60/1027327
acttgtaaatgttt

SEQ ID NO: 101100 - DNA, 14 bp, Unknown
  misc_feature (1)..( 14): Result.002 file - promoters60/1027327
tcaagtaaatttaa

SEQ ID NO: 101101 - DNA, 14 bp, Unknown
  misc_feature (1)..( 14): Result.002 file - promoters60/1027327
acttataagtctct

SEQ ID NO: 101102 - DNA, 14 bp, Unknown
  misc_feature (1)..( 14): Result.002 file - promoters60/1027327
aataataaattaaa

SEQ ID NO: 101103 - DNA, 14 bp, Unknown
  misc_feature (1)..( 14): Result.002 file - promoters60/1027327
agaaacgaatcaat

SEQ ID NO: 101104 - DNA, 21 bp, Unknown
  misc_feature (1)..( 21): Result.002 file - promoters60/1027327
tatttaaaaaattatataatt

SEQ ID NO: 101105 - DNA, 21 bp, Unknown
  misc_feature (1)..( 21): Result.002 file - promoters60/1027327
gctagagaaaattcatttaag

SEQ ID NO: 101106 - DNA, 21 bp, Unknown
  misc_feature (1)..( 21): Result.002 file - promoters60/1027327
ggaagaataaattttatcatt

SEQ ID NO: 101107 - DNA, 21 bp, Unknown
  misc_feature (1)..( 21): Result.002 file - promoters60/1027327
aaaggataaaattagtgaact

SEQ ID NO: 101108 - DNA, 21 bp, Unknown
  misc_feature (1)..( 21): Result.002 file - promoters60/1027327
gagaacacaaagtcacaagac

SEQ ID NO: 101109 - DNA, 21 bp, Unknown
  misc_feature (1)..( 21): Result.002 file - promoters60/1027327
gcacataaaactttgaaccca

SEQ ID NO: 101110 - DNA, 21 bp, Unknown
  misc_feature (1)..( 21): Result.002 file - promoters60/1027327
tttttcactaattcataaaat

SEQ ID NO: 101111 - DNA, 12 bp, Unknown
  misc_feature (1)..( 12): Result.002 file - promoters60/1027327
aaaaattatata

SEQ ID NO: 101112 - DNA, 12 bp, Unknown
  misc_feature (1)..( 12): Result.002 file - promoters60/1027327
tcaatttatatc

SEQ ID NO: 101113 - DNA, 13 bp, Unknown
  misc_feature (1)..( 13): Result.002 file - promoters60/1027327
aaattttatcatt

SEQ ID NO: 101114 - DNA, 14 bp, Unknown
  misc_feature (1)..( 14): Result.002 file - promoters60/1027327
ttcactaattcata

SEQ ID NO: 101115 - DNA, 14 bp, Unknown
  misc_feature (1)..( 14): Result.002 file - promoters60/1027327
acttttaatcgatc

SEQ ID NO: 101116 - DNA, 14 bp, Unknown
  misc_feature (1)..( 14): Result.002 file - promoters60/1027327
aaactttgaaccca

SEQ ID NO: 101117 - DNA, 17 bp, Unknown
  misc_feature (1)..( 17): Result.002 file - promoters60/1027327
tatataatttaaatatt

SEQ ID NO: 101118 - DNA, 17 bp, Unknown
  misc_feature (1)..( 17): Result.002 file - promoters60/1027327
cataaaatacaacttct

SEQ ID NO: 101119 - DNA, 17 bp, Unknown
  misc_feature (1)..( 17): Result.002 file - promoters60/1027327
gaataaattttatcatt

SEQ ID NO: 101120 - DNA, 17 bp, Unknown
  misc_feature (1)..( 17): Result.002 file - promoters60/1027327
aatcaatttatatcttt

SEQ ID NO: 101121 - DNA, 17 bp, Unknown
  misc_feature (1)..( 17): Result.002 file - promoters60/1027327
gaaaaaatagtttacct

SEQ ID NO: 101122 - DNA, 17 bp, Unknown
  misc_feature (1)..( 17): Result.002 file - promoters60/1027327
ataaaactttgaaccca

SEQ ID NO: 101123 - DNA, 10 bp, Unknown
  misc_feature (1)..( 10): Result.002 file - promoters60/1027327
gtacattact

SEQ ID NO: 101124 - DNA, 10 bp, Unknown
  misc_feature (1)..( 10): Result.002 file - promoters60/1027327
gtaaatttaa

SEQ ID NO: 101125 - DNA, 10 bp, Unknown
  misc_feature (1)..( 10): Result.002 file - promoters60/1027327
gtaaatgttg

SEQ ID NO: 101126 - DNA, 11 bp, Unknown
  misc_feature (1)..( 11): Result.002 file - promoters60/1027327
tcaaacttata

SEQ ID NO: 101127 - DNA, 11 bp, Unknown
  misc_feature (1)..( 11): Result.002 file - promoters60/1027327
ataaattaaac

SEQ ID NO: 101128 - DNA, 11 bp, Unknown
  misc_feature (1)..( 11): Result.002 file - promoters60/1027327
aacgaatcaat

SEQ ID NO: 101129 - DNA, 12 bp, Unknown
  misc_feature (1)..( 12): Result.002 file - promoters60/1027399
tgataaaaatat

SEQ ID NO: 101130 - DNA, 12 bp, Unknown
  misc_feature (1)..( 12): Result.002 file - promoters60/1027399
tgatcaaatcaa

SEQ ID NO: 101131 - DNA, 12 bp, Unknown
  misc_feature (1)..( 12): Result.002 file - promoters60/1027399
tgctaaaaatcc

SEQ ID NO: 101132 - DNA, 12 bp, Unknown
  misc_feature (1)..( 12): Result.002 file - promoters60/1027399
tgaccaaaaggc

SEQ ID NO: 101133 - DNA, 12 bp, Unknown
  misc_feature (1)..( 12): Result.002 file - promoters60/1027399
aactaaaagaat

SEQ ID NO: 101134 - DNA, 12 bp, Unknown
  misc_feature (1)..( 12): Result.002 file - promoters60/1027399
tggtaaaacatc

SEQ ID NO: 101135 - DNA, 10 bp, Unknown
  misc_feature (1)..( 10): Result.002 file - promoters60/1027399
gaaattaaag

SEQ ID NO: 101136 - DNA, 10 bp, Unknown
  misc_feature (1)..( 10): Result.002 file - promoters60/1027399
caaactaatg

SEQ ID NO: 101137 - DNA, 10 bp, Unknown
  misc_feature (1)..( 10): Result.002 file - promoters60/1027399
ataagtaatt

SEQ ID NO: 101138 - DNA, 10 bp, Unknown
  misc_feature (1)..( 10): Result.002 file - promoters60/1027399
ccaagacatt

SEQ ID NO: 101139 - DNA, 10 bp, Unknown
  misc_feature (1)..( 10): Result.002 file - promoters60/1027399
taaataaacc

SEQ ID NO: 101140 - DNA, 10 bp, Unknown
  misc_feature (1)..( 10): Result.002 file - promoters60/1027399
taaagccata

SEQ ID NO: 101141 - DNA, 13 bp, Unknown
  misc_feature (1)..( 13): Result.002 file - promoters60/1027406
acaaactgtgaaa

SEQ ID NO: 101142 - DNA, 13 bp, Unknown
  misc_feature (1)..( 13): Result.002 file - promoters60/1027406
aaaaaatgtgaaa

SEQ ID NO: 101143 - DNA, 13 bp, Unknown
  misc_feature (1)..( 13): Result.002 file - promoters60/1027406
aaaaaataacttc

SEQ ID NO: 101144 - DNA, 13 bp, Unknown
  misc_feature (1)..( 13): Result.002 file - promoters60/1027406
aaataatttttag

SEQ ID NO: 101145 - DNA, 13 bp, Unknown
  misc_feature (1)..( 13): Result.002 file - promoters60/1027406
tgatagtttagaa

SEQ ID NO: 101146 - DNA, 13 bp, Unknown
  misc_feature (1)..( 13): Result.002 file - promoters60/1027406
taaacatatttga

SEQ ID NO: 101147 - DNA, 11 bp, Unknown
  misc_feature (1)..( 11): Result.002 file - promoters60/1027406
ccaaatttggt

SEQ ID NO: 101148 - DNA, 11 bp, Unknown
  misc_feature (1)..( 11): Result.002 file - promoters60/1027406
ccaattttaag

SEQ ID NO: 101149 - DNA, 11 bp, Unknown
  misc_feature (1)..( 11): Result.002 file - promoters60/1027406
attattctaag

SEQ ID NO: 101150 - DNA, 11 bp, Unknown
  misc_feature (1)..( 11): Result.002 file - promoters60/1027406
aagatttttct

SEQ ID NO: 101151 - DNA, 11 bp, Unknown
  misc_feature (1)..( 11): Result.002 file - promoters60/1027406
gacattttttt

SEQ ID NO: 101152 - DNA, 9 bp, Unknown
  misc_feature (1)..( 9): Result.002 file - promoters60/1027406
aattcttat

SEQ ID NO: 101153 - DNA, 9 bp, Unknown
  misc_feature (1)..( 9): Result.002 file - promoters60/1027406
aatttttac

SEQ ID NO: 101154 - DNA, 9 bp, Unknown
  misc_feature (1)..( 9): Result.002 file - promoters60/1027406
gtattttac

SEQ ID NO: 101155 - DNA, 9 bp, Unknown
  misc_feature (1)..( 9): Result.002 file - promoters60/1027406
ggattttaa

SEQ ID NO: 101156 - DNA, 9 bp, Unknown
  misc_feature (1)..( 9): Result.002 file - promoters60/1027406
atgttttaa

SEQ ID NO: 101157 - DNA, 10 bp, Unknown
  misc_feature (1)..( 10): Result.002 file - promoters60/1027406
aatgttgtaa

SEQ ID NO: 101158 - DNA, 9 bp, Unknown
  misc_feature (1)..( 9): Result.002 file - promoters60/1027406
aattaatat

SEQ ID NO: 101159 - DNA, 9 bp, Unknown
  misc_feature (1)..( 9): Result.002 file - promoters60/1027406
aatgaatat

SEQ ID NO: 101160 - DNA, 9 bp, Unknown
  misc_feature (1)..( 9): Result.002 file - promoters60/1027406
aatttttgg

SEQ ID NO: 101161 - DNA, 9 bp, Unknown
  misc_feature (1)..( 9): Result.002 file - promoters60/1027406
gatgaatgt

SEQ ID NO: 101162 - DNA, 9 bp, Unknown
  misc_feature (1)..( 9): Result.002 file - promoters60/1027406
tttgaataa

SEQ ID NO: 101163 - DNA, 11 bp, Unknown
  misc_feature (1)..( 11): Result.002 file - promoters60/1027406
taatttttgag

SEQ ID NO: 101164 - DNA, 11 bp, Unknown
  misc_feature (1)..( 11): Result.002 file - promoters60/1027406
taactttttct

SEQ ID NO: 101165 - DNA, 11 bp, Unknown
  misc_feature (1)..( 11): Result.002 file - promoters60/1027406
gcggtttgtga

SEQ ID NO: 101166 - DNA, 11 bp, Unknown
  misc_feature (1)..( 11): Result.002 file - promoters60/1027406
tttttttttgc

SEQ ID NO: 101167 - DNA, 11 bp, Unknown
  misc_feature (1)..( 11): Result.002 file - promoters60/1027406
gaactttaaaa

SEQ ID NO: 101168 - DNA, 13 bp, Unknown
  misc_feature (1)..( 13): Result.002 file - promoters60/1027406
ttaaggattttcc

SEQ ID NO: 101169 - DNA, 13 bp, Unknown
  misc_feature (1)..( 13): Result.002 file - promoters60/1027406
ttaaagatttttc

SEQ ID NO: 101170 - DNA, 13 bp, Unknown
  misc_feature (1)..( 13): Result.002 file - promoters60/1027406
taggagatttagg

SEQ ID NO: 101171 - DNA, 14 bp, Unknown
  misc_feature (1)..( 14): Result.002 file - promoters60/1027406
catattattattct

SEQ ID NO: 101172 - DNA, 14 bp, Unknown
  misc_feature (1)..( 14): Result.002 file - promoters60/1027406
cacgacattttttt

SEQ ID NO: 101173 - DNA, 18 bp, Unknown
  misc_feature (1)..( 18): Result.002 file - promoters60/1027406
attttaagaaagtatata

SEQ ID NO: 101174 - DNA, 18 bp, Unknown
  misc_feature (1)..( 18): Result.002 file - promoters60/1027406
gttttaaggataaattac

SEQ ID NO: 101175 - DNA, 18 bp, Unknown
  misc_feature (1)..( 18): Result.002 file - promoters60/1027406
attctaagtttggttttt

SEQ ID NO: 101176 - DNA, 18 bp, Unknown
  misc_feature (1)..( 18): Result.002 file - promoters60/1027406
tttttaaaaaactatata

SEQ ID NO: 101177 - DNA, 18 bp, Unknown
  misc_feature (1)..( 18): Result.002 file - promoters60/1027406
tcgataaaagctaatgtt

SEQ ID NO: 101178 - DNA, 18 bp, Unknown
  misc_feature (1)..( 18): Result.002 file - promoters60/1027406
attttaagaaagtatata

SEQ ID NO: 101179 - DNA, 18 bp, Unknown
  misc_feature (1)..( 18): Result.002 file - promoters60/1027406
tgaggttttaaggataaa

SEQ ID NO: 101180 - DNA, 18 bp, Unknown
  misc_feature (1)..( 18): Result.002 file - promoters60/1027406
tttttaaaaaactatata

SEQ ID NO: 101181 - DNA, 19 bp, Unknown
  misc_feature (1)..( 19): Result.002 file - promoters60/1027406
attcgataaaagctaatgt

SEQ ID NO: 101182 - DNA, 19 bp, Unknown
  misc_feature (1)..( 19): Result.002 file - promoters60/1027406
tttttatctgagaaatttc

SEQ ID NO: 101183 - DNA, 8 bp, Unknown
  misc_feature (1)..( 8): Result.002 file - promoters60/1027406
atgaaatg

SEQ ID NO: 101184 - DNA, 8 bp, Unknown
  misc_feature (1)..( 8): Result.002 file - promoters60/1027406
ctgaaatt

SEQ ID NO: 101185 - DNA, 8 bp, Unknown
  misc_feature (1)..( 8): Result.002 file - promoters60/1027406
ttgatatg

SEQ ID NO: 101186 - DNA, 8 bp, Unknown
  misc_feature (1)..( 8): Result.002 file - promoters60/1027406
atgaaatc

SEQ ID NO: 101187 - DNA, 8 bp, Unknown
  misc_feature (1)..( 8): Result.002 file - promoters60/1027406
ctgcaatt

SEQ ID NO: 101188 - DNA, 10 bp, Unknown
  misc_feature (1)..( 10): Result.002 file - promoters60/1027434
attattgttt

SEQ ID NO: 101189 - DNA, 10 bp, Unknown
  misc_feature (1)..( 10): Result.002 file - promoters60/1027434
gaaatttttt

SEQ ID NO: 101190 - DNA, 10 bp, Unknown
  misc_feature (1)..( 10): Result.002 file - promoters60/1027434
aaaatttcgc

SEQ ID NO: 101191 - DNA, 10 bp, Unknown
  misc_feature (1)..( 10): Result.002 file - promoters60/1027434
attatttttc

SEQ ID NO: 101192 - DNA, 11 bp, Unknown
  misc_feature (1)..( 11): Result.002 file - promoters60/1027452
taatttaaccc

SEQ ID NO: 101193 - DNA, 11 bp, Unknown
  misc_feature (1)..( 11): Result.002 file - promoters60/1027452
taatttcttaa

SEQ ID NO: 101194 - DNA, 11 bp, Unknown
  misc_feature (1)..( 11): Result.002 file - promoters60/1027452
aaatttcgtaa

SEQ ID NO: 101195 - DNA, 11 bp, Unknown
  misc_feature (1)..( 11): Result.002 file - promoters60/1027452
tgattgcgtct

SEQ ID NO: 101196 - DNA, 11 bp, Unknown
  misc_feature (1)..( 11): Result.002 file - promoters60/1027456
ccttttttttg

SEQ ID NO: 101197 - DNA, 11 bp, Unknown
  misc_feature (1)..( 11): Result.002 file - promoters60/1027456
actttattttg

SEQ ID NO: 101198 - DNA, 11 bp, Unknown
  misc_feature (1)..( 11): Result.002 file - promoters60/1027456
tttctattttt

SEQ ID NO: 101199 - DNA, 11 bp, Unknown
  misc_feature (1)..( 11): Result.002 file - promoters60/1027456
actatatatat

SEQ ID NO: 101200 - DNA, 7 bp, Unknown
  misc_feature (1)..( 7): Result.002 file - promoters60/1027456
ttttctt

SEQ ID NO: 101201 - DNA, 7 bp, Unknown
  misc_feature (1)..( 7): Result.002 file - promoters60/1027456
gtttctt

SEQ ID NO: 101202 - DNA, 8 bp, Unknown
  misc_feature (1)..( 8): Result.002 file - promoters60/1027456
tttatctg

SEQ ID NO: 101203 - DNA, 8 bp, Unknown
  misc_feature (1)..( 8): Result.002 file - promoters60/1027456
tgtatctg

SEQ ID NO: 101204 - DNA, 7 bp, Unknown
  misc_feature (1)..( 7): Result.002 file - promoters60/1027456
attatcc

SEQ ID NO: 101205 - DNA, 7 bp, Unknown
  misc_feature (1)..( 7): Result.002 file - promoters60/1027456
attgtcc

SEQ ID NO: 101206 - DNA, 7 bp, Unknown
  misc_feature (1)..( 7): Result.002 file - promoters60/1027456
attatca

SEQ ID NO: 101207 - DNA, 7 bp, Unknown
  misc_feature (1)..( 7): Result.002 file - promoters60/1027456
gttatcc

SEQ ID NO: 101208 - DNA, 8 bp, Unknown
  misc_feature (1)..( 8): Result.002 file - promoters60/1027456
tctttttt

SEQ ID NO: 101209 - DNA, 8 bp, Unknown
  misc_feature (1)..( 8): Result.002 file - promoters60/1027456
tatttttt

SEQ ID NO: 101210 - DNA, 8 bp, Unknown
  misc_feature (1)..( 8): Result.002 file - promoters60/1027456
tcttttta

SEQ ID NO: 101211 - DNA, 9 bp, Unknown
  misc_feature (1)..( 9): Result.002 file - promoters60/1027456
tatttattt

SEQ ID NO: 101212 - DNA, 9 bp, Unknown
  misc_feature (1)..( 9): Result.002 file - promoters60/1027456
aatttatgg

SEQ ID NO: 101213 - DNA, 9 bp, Unknown
  misc_feature (1)..( 9): Result.002 file - promoters60/1027456
tatcagtca

SEQ ID NO: 101214 - DNA, 9 bp, Unknown
  misc_feature (1)..( 9): Result.002 file - promoters60/1027456
tatgagtca

SEQ ID NO: 101215 - DNA, 9 bp, Unknown
  misc_feature (1)..( 9): Result.002 file - promoters60/1027456
gatgattca

SEQ ID NO: 101216 - DNA, 9 bp, Unknown
  misc_feature (1)..( 9): Result.002 file - promoters60/1027456
aatgtgtca

SEQ ID NO: 101217 - DNA, 9 bp, Unknown
  misc_feature (1)..( 9): Result.002 file - promoters60/1027456
tatgatttc

SEQ ID NO: 101218 - DNA, 9 bp, Unknown
  misc_feature (1)..( 9): Result.002 file - promoters60/1027456
ttaatttct

SEQ ID NO: 101219 - DNA, 9 bp, Unknown
  misc_feature (1)..( 9): Result.002 file - promoters60/1027456
ataaattca

SEQ ID NO: 101220 - DNA, 9 bp, Unknown
  misc_feature (1)..( 9): Result.002 file - promoters60/1027456
ttattttct

SEQ ID NO: 101221 - DNA, 9 bp, Unknown
  misc_feature (1)..( 9): Result.002 file - promoters60/1027456
gaaaaatca

SEQ ID NO: 101222 - DNA, 9 bp, Unknown
  misc_feature (1)..( 9): Result.002 file - promoters60/1027456
aaaaattca

SEQ ID NO: 101223 - DNA, 16 bp, Unknown
  misc_feature (1)..( 16): Result.002 file - promoters60/1027456
tcatctgaaaaatcaa

SEQ ID NO: 101224 - DNA, 16 bp, Unknown
  misc_feature (1)..( 16): Result.002 file - promoters60/1027456
cgattttaaaaattca

SEQ ID NO: 101225 - DNA, 16 bp, Unknown
  misc_feature (1)..( 16): Result.002 file - promoters60/1027456
tatatatataaattca

SEQ ID NO: 101226 - DNA, 16 bp, Unknown
  misc_feature (1)..( 16): Result.002 file - promoters60/1027456
tatatatatatattta

SEQ ID NO: 101227 - DNA, 11 bp, Unknown
  misc_feature (1)..( 11): Result.002 file - promoters60/1027456
agaattgttga

SEQ ID NO: 101228 - DNA, 11 bp, Unknown
  misc_feature (1)..( 11): Result.002 file - promoters60/1027456
agaattgaaat

SEQ ID NO: 101229 - DNA, 11 bp, Unknown
  misc_feature (1)..( 11): Result.002 file - promoters60/1027456
ttaattgtatt

SEQ ID NO: 101230 - DNA, 11 bp, Unknown
  misc_feature (1)..( 11): Result.002 file - promoters60/1027456
ttcattgcatt

SEQ ID NO: 101231 - DNA, 13 bp, Unknown
  misc_feature (1)..( 13): Result.002 file - promoters60/1027456
gaagagaacctga

SEQ ID NO: 101232 - DNA, 13 bp, Unknown
  misc_feature (1)..( 13): Result.002 file - promoters60/1027456
gaaaagatatata

SEQ ID NO: 101233 - DNA, 13 bp, Unknown
  misc_feature (1)..( 13): Result.002 file - promoters60/1027456
agaaatatatata

SEQ ID NO: 101234 - DNA, 13 bp, Unknown
  misc_feature (1)..( 13): Result.002 file - promoters60/1027456
ccaaatttatggt

SEQ ID NO: 101235 - DNA, 10 bp, Unknown
  misc_feature (1)..( 10): Result.002 file - promoters60/1027456
attcgtttag

SEQ ID NO: 101236 - DNA, 10 bp, Unknown
  misc_feature (1)..( 10): Result.002 file - promoters60/1027456
tttcatttta

SEQ ID NO: 101237 - DNA, 10 bp, Unknown
  misc_feature (1)..( 10): Result.002 file - promoters60/1027456
ttttatttct

SEQ ID NO: 101238 - DNA, 10 bp, Unknown
  misc_feature (1)..( 10): Result.002 file - promoters60/1027456
actaatttta

SEQ ID NO: 101239 - DNA, 11 bp, Unknown
  misc_feature (1)..( 11): Result.002 file - promoters60/1027456
acatcttaaat

SEQ ID NO: 101240 - DNA, 11 bp, Unknown
  misc_feature (1)..( 11): Result.002 file - promoters60/1027456
caagctttaat

SEQ ID NO: 101241 - DNA, 11 bp, Unknown
  misc_feature (1)..( 11): Result.002 file - promoters60/1027456
attacttactc

SEQ ID NO: 101242 - DNA, 11 bp, Unknown
  misc_feature (1)..( 11): Result.002 file - promoters60/1027456
tttatttaata

SEQ ID NO: 101243 - DNA, 14 bp, Unknown
  misc_feature (1)..( 14): Result.002 file - promoters60/1027456
tttttacttacaaa

SEQ ID NO: 101244 - DNA, 14 bp, Unknown
  misc_feature (1)..( 14): Result.002 file - promoters60/1027456
taattaattaaaaa

SEQ ID NO: 101245 - DNA, 14 bp, Unknown
  misc_feature (1)..( 14): Result.002 file - promoters60/1027456
ccattacttactct

SEQ ID NO: 101246 - DNA, 14 bp, Unknown
  misc_feature (1)..( 14): Result.002 file - promoters60/1027456
tttttactgtatta

SEQ ID NO: 101247 - DNA, 12 bp, Unknown
  misc_feature (1)..( 12): Result.002 file - promoters60/1027456
tacaatatattt

SEQ ID NO: 101248 - DNA, 12 bp, Unknown
  misc_feature (1)..( 12): Result.002 file - promoters60/1027456
tacaaaataaat

SEQ ID NO: 101249 - DNA, 12 bp, Unknown
  misc_feature (1)..( 12): Result.002 file - promoters60/1027456
aataatttattt

SEQ ID NO: 101250 - DNA, 12 bp, Unknown
  misc_feature (1)..( 12): Result.002 file - promoters60/1027456
tttaattaatta

SEQ ID NO: 101251 - DNA, 15 bp, Unknown
  misc_feature (1)..( 15): Result.002 file - promoters60/1027456
ttagtaaatcatctc

SEQ ID NO: 101252 - DNA, 15 bp, Unknown
  misc_feature (1)..( 15): Result.002 file - promoters60/1027456
tctctgtatcttctt

SEQ ID NO: 101253 - DNA, 15 bp, Unknown
  misc_feature (1)..( 15): Result.002 file - promoters60/1027456
ttagtaattcattgt

SEQ ID NO: 101254 - DNA, 15 bp, Unknown
  misc_feature (1)..( 15): Result.002 file - promoters60/1027456
gtacattttcgttgt

SEQ ID NO: 101255 - DNA, 14 bp, Unknown
  misc_feature (1)..( 14): Result.002 file - promoters60/1027460
ctttgtcaaaaata

SEQ ID NO: 101256 - DNA, 14 bp, Unknown
  misc_feature (1)..( 14): Result.002 file - promoters60/1027460
gactttgaaacata

SEQ ID NO: 101257 - DNA, 14 bp, Unknown
  misc_feature (1)..( 14): Result.002 file - promoters60/1027460
gacattgacacaga

SEQ ID NO: 101258 - DNA, 9 bp, Unknown
  misc_feature (1)..( 9): Result.002 file - promoters60/1027460
aaacataat

SEQ ID NO: 101259 - DNA, 9 bp, Unknown
  misc_feature (1)..( 9): Result.002 file - promoters60/1027460
aaaaatagt

SEQ ID NO: 101260 - DNA, 9 bp, Unknown
  misc_feature (1)..( 9): Result.002 file - promoters60/1027460
taaaatata

SEQ ID NO: 101261 - DNA, 9 bp, Unknown
  misc_feature (1)..( 9): Result.002 file - promoters60/1027460
gaaaacata

SEQ ID NO: 101262 - DNA, 9 bp, Unknown
  misc_feature (1)..( 9): Result.002 file - promoters60/1027460
gaaaaccgg

SEQ ID NO: 101263 - DNA, 9 bp, Unknown
  misc_feature (1)..( 9): Result.002 file - promoters60/1027460
taaaatata

SEQ ID NO: 101264 - DNA, 8 bp, Unknown
  misc_feature (1)..( 8): Result.002 file - promoters60/1027460
atgagaac

SEQ ID NO: 101265 - DNA, 8 bp, Unknown
  misc_feature (1)..( 8): Result.002 file - promoters60/1027460
aagagaac

SEQ ID NO: 101266 - DNA, 8 bp, Unknown
  misc_feature (1)..( 8): Result.002 file - promoters60/1027460
aagaaaac

SEQ ID NO: 101267 - DNA, 7 bp, Unknown
  misc_feature (1)..( 7): Result.002 file - promoters60/1027460
gagtaat

SEQ ID NO: 101268 - DNA, 7 bp, Unknown
  misc_feature (1)..( 7): Result.002 file - promoters60/1027460
gagtaaa

SEQ ID NO: 101269 - DNA, 7 bp, Unknown
  misc_feature (1)..( 7): Result.002 file - promoters60/1027460
gaggaaa

SEQ ID NO: 101270 - DNA, 13 bp, Unknown
  misc_feature (1)..( 13): Result.002 file - promoters60/1027460
agactttgaaaca

SEQ ID NO: 101271 - DNA, 13 bp, Unknown
  misc_feature (1)..( 13): Result.002 file - promoters60/1027460
agactttcgttcc

SEQ ID NO: 101272 - DNA, 13 bp, Unknown
  misc_feature (1)..( 13): Result.002 file - promoters60/1027460
tgacattgacaca

SEQ ID NO: 101273 - DNA, 11 bp, Unknown
  misc_feature (1)..( 11): Result.002 file - promoters60/1027492
acctaagttta

SEQ ID NO: 101274 - DNA, 11 bp, Unknown
  misc_feature (1)..( 11): Result.002 file - promoters60/1027492
agtaaagatta

SEQ ID NO: 101275 - DNA, 11 bp, Unknown
  misc_feature (1)..( 11): Result.002 file - promoters60/1027492
tctgaagtttc

SEQ ID NO: 101276 - DNA, 11 bp, Unknown
  misc_feature (1)..( 11): Result.002 file - promoters60/1027492
tcagaattttt

SEQ ID NO: 101277 - DNA, 11 bp, Unknown
  misc_feature (1)..( 11): Result.002 file - promoters60/1027492
atcagagtttt

SEQ ID NO: 101278 - DNA, 11 bp, Unknown
  misc_feature (1)..( 11): Result.002 file - promoters60/1027492
atcagaaccca

SEQ ID NO: 101279 - DNA, 16 bp, Unknown
  misc_feature (1)..( 16): Result.002 file - promoters60/1027492
tgtacatattgagagg

SEQ ID NO: 101280 - DNA, 16 bp, Unknown
  misc_feature (1)..( 16): Result.002 file - promoters60/1027492
aaagattattgatata

SEQ ID NO: 101281 - DNA, 16 bp, Unknown
  misc_feature (1)..( 16): Result.002 file - promoters60/1027492
gtggttgattgatagg

SEQ ID NO: 101282 - DNA, 16 bp, Unknown
  misc_feature (1)..( 16): Result.002 file - promoters60/1027492
cagaatttttgcgagc

SEQ ID NO: 101283 - DNA, 16 bp, Unknown
  misc_feature (1)..( 16): Result.002 file - promoters60/1027492
tcagagttttaaaaag

SEQ ID NO: 101284 - DNA, 16 bp, Unknown
  misc_feature (1)..( 16): Result.002 file - promoters60/1027492
gagaggaatcagaacc

SEQ ID NO: 101285 - DNA, 13 bp, Unknown
  misc_feature (1)..( 13): Result.002 file - promoters60/1027492
acaatgggctggg

SEQ ID NO: 101286 - DNA, 13 bp, Unknown
  misc_feature (1)..( 13): Result.002 file - promoters60/1027492
gaaataggcccaa

SEQ ID NO: 101287 - DNA, 13 bp, Unknown
  misc_feature (1)..( 13): Result.002 file - promoters60/1027492
ctgttgggctttt

SEQ ID NO: 101288 - DNA, 13 bp, Unknown
  misc_feature (1)..( 13): Result.002 file - promoters60/1027492
taattgggctttt

SEQ ID NO: 101289 - DNA, 13 bp, Unknown
  misc_feature (1)..( 13): Result.002 file - promoters60/1027492
taaaaaggcccat

SEQ ID NO: 101290 - DNA, 13 bp, Unknown
  misc_feature (1)..( 13): Result.002 file - promoters60/1027492
taaaaaatatctg

SEQ ID NO: 101291 - DNA, 15 bp, Unknown
  misc_feature (1)..( 15): Result.002 file - promoters60/1027590
tagtaagattctaga

SEQ ID NO: 101292 - DNA, 15 bp, Unknown
  misc_feature (1)..( 15): Result.002 file - promoters60/1027590
aactaggattcttac

SEQ ID NO: 101293 - DNA, 15 bp, Unknown
  misc_feature (1)..( 15): Result.002 file - promoters60/1027590
aagagagattctttg

SEQ ID NO: 101294 - DNA, 15 bp, Unknown
  misc_feature (1)..( 15): Result.002 file - promoters60/1027590
tttatatatttttaa

SEQ ID NO: 101295 - DNA, 15 bp, Unknown
  misc_feature (1)..( 15): Result.002 file - promoters60/1027590
tttatatattttgtc

SEQ ID NO: 101296 - DNA, 15 bp, Unknown
  misc_feature (1)..( 15): Result.002 file - promoters60/1027590
accatggatgctttt

SEQ ID NO: 101297 - DNA, 15 bp, Unknown
  misc_feature (1)..( 15): Result.002 file - promoters60/1027590
aaagatcattcgtac

SEQ ID NO: 101298 - DNA, 10 bp, Unknown
  misc_feature (1)..( 10): Result.002 file - promoters60/1027590
tatttttaaa

SEQ ID NO: 101299 - DNA, 10 bp, Unknown
  misc_feature (1)..( 10): Result.002 file - promoters60/1027590
gctttttaac

SEQ ID NO: 101300 - DNA, 10 bp, Unknown
  misc_feature (1)..( 10): Result.002 file - promoters60/1027590
gattcttact

SEQ ID NO: 101301 - DNA, 10 bp, Unknown
  misc_feature (1)..( 10): Result.002 file - promoters60/1027590
gattttttta

SEQ ID NO: 101302 - DNA, 10 bp, Unknown
  misc_feature (1)..( 10): Result.002 file - promoters60/1027590
cttgtttaac

SEQ ID NO: 101303 - DNA, 10 bp, Unknown
  misc_feature (1)..( 10): Result.002 file - promoters60/1027590
cattcgtacc

SEQ ID NO: 101304 - DNA, 10 bp, Unknown
  misc_feature (1)..( 10): Result.002 file - promoters60/1027590
gattctttgg

SEQ ID NO: 101305 - DNA, 11 bp, Unknown
  misc_feature (1)..( 11): Result.002 file - promoters60/1027590
ttattttcctc

SEQ ID NO: 101306 - DNA, 11 bp, Unknown
  misc_feature (1)..( 11): Result.002 file - promoters60/1027590
gtattttttgt

SEQ ID NO: 101307 - DNA, 11 bp, Unknown
  misc_feature (1)..( 11): Result.002 file - promoters60/1027590
agattttttgt

SEQ ID NO: 101308 - DNA, 11 bp, Unknown
  misc_feature (1)..( 11): Result.002 file - promoters60/1027590
gggttttttcc

SEQ ID NO: 101309 - DNA, 11 bp, Unknown
  misc_feature (1)..( 11): Result.002 file - promoters60/1027590
gtatttaaaca

SEQ ID NO: 101310 - DNA, 11 bp, Unknown
  misc_feature (1)..( 11): Result.002 file - promoters60/1027590
ctatttaaaac

SEQ ID NO: 101311 - DNA, 12 bp, Unknown
  misc_feature (1)..( 12): Result.002 file - promoters60/1027596
tactttctggca

SEQ ID NO: 101312 - DNA, 12 bp, Unknown
  misc_feature (1)..( 12): Result.002 file - promoters60/1027596
tacttttaaccc

SEQ ID NO: 101313 - DNA, 12 bp, Unknown
  misc_feature (1)..( 12): Result.002 file - promoters60/1027596
aactttcatata

SEQ ID NO: 101314 - DNA, 12 bp, Unknown
  misc_feature (1)..( 12): Result.002 file - promoters60/1027596
aactttctggga

SEQ ID NO: 101315 - DNA, 12 bp, Unknown
  misc_feature (1)..( 12): Result.002 file - promoters60/1027596
ttcttcctggga

SEQ ID NO: 101316 - DNA, 8 bp, Unknown
  misc_feature (1)..( 8): Result.002 file - promoters60/1027596
aaaaagtt

SEQ ID NO: 101317 - DNA, 8 bp, Unknown
  misc_feature (1)..( 8): Result.002 file - promoters60/1027596
aaaaagtc

SEQ ID NO: 101318 - DNA, 8 bp, Unknown
  misc_feature (1)..( 8): Result.002 file - promoters60/1027596
ggaaagtt

SEQ ID NO: 101319 - DNA, 8 bp, Unknown
  misc_feature (1)..( 8): Result.002 file - promoters60/1027596
aaaaagaa

SEQ ID NO: 101320 - DNA, 8 bp, Unknown
  misc_feature (1)..( 8): Result.002 file - promoters60/1027596
aaaaattt

SEQ ID NO: 101321 - DNA, 11 bp, Unknown
  misc_feature (1)..( 11): Result.002 file - promoters60/1027596
cttattattgt

SEQ ID NO: 101322 - DNA, 11 bp, Unknown
  misc_feature (1)..( 11): Result.002 file - promoters60/1027596
attattattca

SEQ ID NO: 101323 - DNA, 12 bp, Unknown
  misc_feature (1)..( 12): Result.002 file - promoters60/1027596
tttctttatttc

SEQ ID NO: 101324 - DNA, 12 bp, Unknown
  misc_feature (1)..( 12): Result.002 file - promoters60/1027596
cttcttaattaa

SEQ ID NO: 101325 - DNA, 12 bp, Unknown
  misc_feature (1)..( 12): Result.002 file - promoters60/1027596
catttttagact

SEQ ID NO: 101326 - DNA, 12 bp, Unknown
  misc_feature (1)..( 12): Result.002 file - promoters60/1027596
agatttaattct

SEQ ID NO: 101327 - DNA, 11 bp, Unknown
  misc_feature (1)..( 11): Result.002 file - promoters60/1027596
agagaaagaaa

SEQ ID NO: 101328 - DNA, 11 bp, Unknown
  misc_feature (1)..( 11): Result.002 file - promoters60/1027596
gacgaaagacg

SEQ ID NO: 101329 - DNA, 11 bp, Unknown
  misc_feature (1)..( 11): Result.002 file - promoters60/1027596
agaggaagtga

SEQ ID NO: 101330 - DNA, 11 bp, Unknown
  misc_feature (1)..( 11): Result.002 file - promoters60/1027596
gagtaaataaa

SEQ ID NO: 101331 - DNA, 11 bp, Unknown
  misc_feature (1)..( 11): Result.002 file - promoters60/1027596
cgctaattaaa

SEQ ID NO: 101332 - DNA, 11 bp, Unknown
  misc_feature (1)..( 11): Result.002 file - promoters60/1027596
ttatttacttt

SEQ ID NO: 101333 - DNA, 11 bp, Unknown
  misc_feature (1)..( 11): Result.002 file - promoters60/1027596
ttattttcttt

SEQ ID NO: 101334 - DNA, 11 bp, Unknown
  misc_feature (1)..( 11): Result.002 file - promoters60/1027596
aaactttctgg

SEQ ID NO: 101335 - DNA, 11 bp, Unknown
  misc_feature (1)..( 11): Result.002 file - promoters60/1027596
cgattctctta

SEQ ID NO: 101336 - DNA, 11 bp, Unknown
  misc_feature (1)..( 11): Result.002 file - promoters60/1027596
gtatttttgtt

SEQ ID NO: 101337 - DNA, 10 bp, Unknown
  misc_feature (1)..( 10): Result.002 file - promoters60/1027596
cttattattc

SEQ ID NO: 101338 - DNA, 10 bp, Unknown
  misc_feature (1)..( 10): Result.002 file - promoters60/1027596
tatatcattt

SEQ ID NO: 101339 - DNA, 10 bp, Unknown
  misc_feature (1)..( 10): Result.002 file - promoters60/1027596
gtcatcattt

SEQ ID NO: 101340 - DNA, 10 bp, Unknown
  misc_feature (1)..( 10): Result.002 file - promoters60/1027596
gtcataattc

SEQ ID NO: 101341 - DNA, 10 bp, Unknown
  misc_feature (1)..( 10): Result.002 file - promoters60/1027596
aataccatgc

SEQ ID NO: 101342 - DNA, 12 bp, Unknown
  misc_feature (1)..( 12): Result.002 file - promoters60/1027652
ttgcatatataa

SEQ ID NO: 101343 - DNA, 12 bp, Unknown
  misc_feature (1)..( 12): Result.002 file - promoters60/1027652
attagtatttaa

SEQ ID NO: 101344 - DNA, 10 bp, Unknown
  misc_feature (1)..( 10): Result.002 file - promoters60/1027652
gcatctatat

SEQ ID NO: 101345 - DNA, 12 bp, Unknown
  misc_feature (1)..( 12): Result.002 file - promoters60/1027652
tagcatttacta

SEQ ID NO: 101346 - DNA, 9 bp, Unknown
  misc_feature (1)..( 9): Result.002 file - promoters60/1027652
tttttgttt

SEQ ID NO: 101347 - DNA, 9 bp, Unknown
  misc_feature (1)..( 9): Result.002 file - promoters60/1027652
tttatgttt

SEQ ID NO: 101348 - DNA, 9 bp, Unknown
  misc_feature (1)..( 9): Result.002 file - promoters60/1027652
ccgttgttt

SEQ ID NO: 101349 - DNA, 9 bp, Unknown
  misc_feature (1)..( 9): Result.002 file - promoters60/1027652
attacgtta

SEQ ID NO: 101350 - DNA, 10 bp, Unknown
  misc_feature (1)..( 10): Result.002 file - promoters60/1027652
atactcaaat

SEQ ID NO: 101351 - DNA, 10 bp, Unknown
  misc_feature (1)..( 10): Result.002 file - promoters60/1027652
aaactaaaat

SEQ ID NO: 101352 - DNA, 10 bp, Unknown
  misc_feature (1)..( 10): Result.002 file - promoters60/1027652
ttgctcaaac

SEQ ID NO: 101353 - DNA, 10 bp, Unknown
  misc_feature (1)..( 10): Result.002 file - promoters60/1027652
atattcaaac

SEQ ID NO: 101354 - DNA, 9 bp, Unknown
  misc_feature (1)..( 9): Result.002 file - promoters60/1027652
caaaggaaa

SEQ ID NO: 101355 - DNA, 9 bp, Unknown
  misc_feature (1)..( 9): Result.002 file - promoters60/1027652
ttaagaaaa

SEQ ID NO: 101356 - DNA, 9 bp, Unknown
  misc_feature (1)..( 9): Result.002 file - promoters60/1027652
ataaaaaaa

SEQ ID NO: 101357 - DNA, 9 bp, Unknown
  misc_feature (1)..( 9): Result.002 file - promoters60/1027652
ttaagaagc

SEQ ID NO: 101358 - DNA, 9 bp, Unknown
  misc_feature (1)..( 9): Result.002 file - promoters60/1027652
tcaaaaaag

SEQ ID NO: 101359 - DNA, 8 bp, Unknown
  misc_feature (1)..( 8): Result.002 file - promoters60/1027652
ttttgtca

SEQ ID NO: 101360 - DNA, 8 bp, Unknown
  misc_feature (1)..( 8): Result.002 file - promoters60/1027652
gtttttca

SEQ ID NO: 101361 - DNA, 8 bp, Unknown
  misc_feature (1)..( 8): Result.002 file - promoters60/1027652
ttttgtta

SEQ ID NO: 101362 - DNA, 8 bp, Unknown
  misc_feature (1)..( 8): Result.002 file - promoters60/1027652
atttaaaa

SEQ ID NO: 101363 - DNA, 19 bp, Unknown
  misc_feature (1)..( 19): Result.002 file - promoters60/1027652
gaaaaacatgtttttgttt

SEQ ID NO: 101364 - DNA, 19 bp, Unknown
  misc_feature (1)..( 19): Result.002 file - promoters60/1027652
gaaaaattattaaagtata

SEQ ID NO: 101365 - DNA, 19 bp, Unknown
  misc_feature (1)..( 19): Result.002 file - promoters60/1027652
taaagattattaaattata

SEQ ID NO: 101366 - DNA, 19 bp, Unknown
  misc_feature (1)..( 19): Result.002 file - promoters60/1027652
acaagattcacaactaatg

SEQ ID NO: 101367 - DNA, 10 bp, Unknown
  misc_feature (1)..( 10): Result.002 file - promoters60/1027652
ggaaaataag

SEQ ID NO: 101368 - DNA, 10 bp, Unknown
  misc_feature (1)..( 10): Result.002 file - promoters60/1027652
gtcaaaaaag

SEQ ID NO: 101369 - DNA, 10 bp, Unknown
  misc_feature (1)..( 10): Result.002 file - promoters60/1027652
aaaaaaaaag

SEQ ID NO: 101370 - DNA, 10 bp, Unknown
  misc_feature (1)..( 10): Result.002 file - promoters60/1027652
ttaagaaaat

SEQ ID NO: 101371 - DNA, 10 bp, Unknown
  misc_feature (1)..( 10): Result.002 file - promoters60/1027652
ttaagaagct

SEQ ID NO: 101372 - DNA, 9 bp, Unknown
  misc_feature (1)..( 9): Result.002 file - promoters60/1027652
tatttaaac

SEQ ID NO: 101373 - DNA, 9 bp, Unknown
  misc_feature (1)..( 9): Result.002 file - promoters60/1027652
tatttatat

SEQ ID NO: 101374 - DNA, 9 bp, Unknown
  misc_feature (1)..( 9): Result.002 file - promoters60/1027652
tatataagt

SEQ ID NO: 101375 - DNA, 9 bp, Unknown
  misc_feature (1)..( 9): Result.002 file - promoters60/1027652
tatatatat

SEQ ID NO: 101376 - DNA, 8 bp, Unknown
  misc_feature (1)..( 8): Result.002 file - promoters60/1027652
aaagtcca

SEQ ID NO: 101377 - DNA, 8 bp, Unknown
  misc_feature (1)..( 8): Result.002 file - promoters60/1027652
aaattcct

SEQ ID NO: 101378 - DNA, 8 bp, Unknown
  misc_feature (1)..( 8): Result.002 file - promoters60/1027652
aaattcaa

SEQ ID NO: 101379 - DNA, 8 bp, Unknown
  misc_feature (1)..( 8): Result.002 file - promoters60/1027652
tatttcta

SEQ ID NO: 101380 - DNA, 8 bp, Unknown
  misc_feature (1)..( 8): Result.002 file - promoters60/1027652
aaattcga

SEQ ID NO: 101381 - DNA, 12 bp, Unknown
  misc_feature (1)..( 12): Result.002 file - promoters60/1027652
tagatctagatc

SEQ ID NO: 101382 - DNA, 12 bp, Unknown
  misc_feature (1)..( 12): Result.002 file - promoters60/1027652
actctctcgatc

SEQ ID NO: 101383 - DNA, 12 bp, Unknown
  misc_feature (1)..( 12): Result.002 file - promoters60/1027652
aaaatcaagagt

SEQ ID NO: 101384 - DNA, 12 bp, Unknown
  misc_feature (1)..( 12): Result.002 file - promoters60/1027652
aaaattaaggat

SEQ ID NO: 101385 - DNA, 12 bp, Unknown
  misc_feature (1)..( 12): Result.002 file - promoters60/1027652
acaaattcaaat

SEQ ID NO: 101386 - DNA, 12 bp, Unknown
  misc_feature (1)..( 12): Result.002 file - promoters60/1027652
acatatttctaa

SEQ ID NO: 101387 - DNA, 12 bp, Unknown
  misc_feature (1)..( 12): Result.002 file - promoters60/1027652
tcaaattcgaat

SEQ ID NO: 101388 - DNA, 12 bp, Unknown
  misc_feature (1)..( 12): Result.002 file - promoters60/1027652
ctaaattcctat

SEQ ID NO: 101389 - DNA, 12 bp, Unknown
  misc_feature (1)..( 12): Result.002 file - promoters60/1027652
ccaaaatatctc

SEQ ID NO: 101390 - DNA, 9 bp, Unknown
  misc_feature (1)..( 9): Result.002 file - promoters60/1027652
aataatatt

SEQ ID NO: 101391 - DNA, 9 bp, Unknown
  misc_feature (1)..( 9): Result.002 file - promoters60/1027652
gctaatatt

SEQ ID NO: 101392 - DNA, 9 bp, Unknown
  misc_feature (1)..( 9): Result.002 file - promoters60/1027652
aataatatg

SEQ ID NO: 101393 - DNA, 9 bp, Unknown
  misc_feature (1)..( 9): Result.002 file - promoters60/1027652
catattata

SEQ ID NO: 101394 - DNA, 10 bp, Unknown
  misc_feature (1)..( 10): Result.002 file - promoters60/1027652
aaaaattatt

SEQ ID NO: 101395 - DNA, 10 bp, Unknown
  misc_feature (1)..( 10): Result.002 file - promoters60/1027652
aaaaattaag

SEQ ID NO: 101396 - DNA, 10 bp, Unknown
  misc_feature (1)..( 10): Result.002 file - promoters60/1027652
gtaaattatt

SEQ ID NO: 101397 - DNA, 10 bp, Unknown
  misc_feature (1)..( 10): Result.002 file - promoters60/1027652
caaaatcaag

SEQ ID NO: 101398 - DNA, 6 bp, Unknown
  misc_feature (1)..( 6): Result.002 file - promoters60/1027673
atcaca

SEQ ID NO: 101399 - DNA, 6 bp, Unknown
  misc_feature (1)..( 6): Result.002 file - promoters60/1027673
atcaca

SEQ ID NO: 101400 - DNA, 7 bp, Unknown
  misc_feature (1)..( 7): Result.002 file - promoters60/1027673
ttttgta

SEQ ID NO: 101401 - DNA, 7 bp, Unknown
  misc_feature (1)..( 7): Result.002 file - promoters60/1027673
tttcgta

SEQ ID NO: 101402 - DNA, 6 bp, Unknown
  misc_feature (1)..( 6): Result.002 file - promoters60/1027673
agaaga

SEQ ID NO: 101403 - DNA, 6 bp, Unknown
  misc_feature (1)..( 6): Result.002 file - promoters60/1027673
agaaga

SEQ ID NO: 101404 - DNA, 7 bp, Unknown
  misc_feature (1)..( 7): Result.002 file - promoters60/1027673
ttgtaga

SEQ ID NO: 101405 - DNA, 7 bp, Unknown
  misc_feature (1)..( 7): Result.002 file - promoters60/1027673
ttggaga

SEQ ID NO: 101406 - DNA, 9 bp, Unknown
  misc_feature (1)..( 9): Result.002 file - promoters60/1027673
gagagagag

SEQ ID NO: 101407 - DNA, 9 bp, Unknown
  misc_feature (1)..( 9): Result.002 file - promoters60/1027673
gagtgagag

SEQ ID NO: 101408 - DNA, 7 bp, Unknown
  misc_feature (1)..( 7): Result.002 file - promoters60/1027673
caaatta

SEQ ID NO: 101409 - DNA, 7 bp, Unknown
  misc_feature (1)..( 7): Result.002 file - promoters60/1027673
caattta

SEQ ID NO: 101410 - DNA, 8 bp, Unknown
  misc_feature (1)..( 8): Result.002 file - promoters60/1027673
aaatacga

SEQ ID NO: 101411 - DNA, 8 bp, Unknown
  misc_feature (1)..( 8): Result.002 file - promoters60/1027673
aaatccga

SEQ ID NO: 101412 - DNA, 8 bp, Unknown
  misc_feature (1)..( 8): Result.002 file - promoters60/1027673
agacgaag

SEQ ID NO: 101413 - DNA, 8 bp, Unknown
  misc_feature (1)..( 8): Result.002 file - promoters60/1027673
agaagaag

SEQ ID NO: 101414 - DNA, 6 bp, Unknown
  misc_feature (1)..( 6): Result.002 file - promoters60/1027673
tgtttc

SEQ ID NO: 101415 - DNA, 6 bp, Unknown
  misc_feature (1)..( 6): Result.002 file - promoters60/1027673
tgtttc

SEQ ID NO: 101416 - DNA, 11 bp, Unknown
  misc_feature (1)..( 11): Result.002 file - promoters60/1027725
tttaacagttg

SEQ ID NO: 101417 - DNA, 11 bp, Unknown
  misc_feature (1)..( 11): Result.002 file - promoters60/1027725
aataaaagttt

SEQ ID NO: 101418 - DNA, 11 bp, Unknown
  misc_feature (1)..( 11): Result.002 file - promoters60/1027725
cataacagttg

SEQ ID NO: 101419 - DNA, 11 bp, Unknown
  misc_feature (1)..( 11): Result.002 file - promoters60/1027725
acataaatttt

SEQ ID NO: 101420 - DNA, 11 bp, Unknown
  misc_feature (1)..( 11): Result.002 file - promoters60/1027725
aatagaagaaa

SEQ ID NO: 101421 - DNA, 11 bp, Unknown
  misc_feature (1)..( 11): Result.002 file - promoters60/1027725
catagtagaat

SEQ ID NO: 101422 - DNA, 11 bp, Unknown
  misc_feature (1)..( 11): Result.002 file - promoters60/1027725
gacctaagttt

SEQ ID NO: 101423 - DNA, 11 bp, Unknown
  misc_feature (1)..( 11): Result.002 file - promoters60/1027725
tagataaattt

SEQ ID NO: 101424 - DNA, 10 bp, Unknown
  misc_feature (1)..( 10): Result.002 file - promoters60/1027725
ttgtatttgg

SEQ ID NO: 101425 - DNA, 10 bp, Unknown
  misc_feature (1)..( 10): Result.002 file - promoters60/1027725
ttggattaat

SEQ ID NO: 101426 - DNA, 10 bp, Unknown
  misc_feature (1)..( 10): Result.002 file - promoters60/1027725
atgtttttgc

SEQ ID NO: 101427 - DNA, 10 bp, Unknown
  misc_feature (1)..( 10): Result.002 file - promoters60/1027725
ttgttttatt

SEQ ID NO: 101428 - DNA, 10 bp, Unknown
  misc_feature (1)..( 10): Result.002 file - promoters60/1027725
ttggatagct

SEQ ID NO: 101429 - DNA, 10 bp, Unknown
  misc_feature (1)..( 10): Result.002 file - promoters60/1027725
atgtttatgc

SEQ ID NO: 101430 - DNA, 13 bp, Unknown
  misc_feature (1)..( 13): Result.002 file - promoters60/1027725
ctaatttcattga

SEQ ID NO: 101431 - DNA, 13 bp, Unknown
  misc_feature (1)..( 13): Result.002 file - promoters60/1027725
ttacttttattat

SEQ ID NO: 101432 - DNA, 13 bp, Unknown
  misc_feature (1)..( 13): Result.002 file - promoters60/1027725
caactctcagtga

SEQ ID NO: 101433 - DNA, 13 bp, Unknown
  misc_feature (1)..( 13): Result.002 file - promoters60/1027725
gtctgttcattga

SEQ ID NO: 101434 - DNA, 13 bp, Unknown
  misc_feature (1)..( 13): Result.002 file - promoters60/1027725
ttacttttaacaa

SEQ ID NO: 101435 - DNA, 13 bp, Unknown
  misc_feature (1)..( 13): Result.002 file - promoters60/1027725
attctttttacag

SEQ ID NO: 101436 - DNA, 14 bp, Unknown
  misc_feature (1)..( 14): Result.002 file - promoters60/1027725
aaaacattatgcgt

SEQ ID NO: 101437 - DNA, 14 bp, Unknown
  misc_feature (1)..( 14): Result.002 file - promoters60/1027725
taaaaatttttctg

SEQ ID NO: 101438 - DNA, 14 bp, Unknown
  misc_feature (1)..( 14): Result.002 file - promoters60/1027725
aaaagattatggtt

SEQ ID NO: 101439 - DNA, 14 bp, Unknown
  misc_feature (1)..( 14): Result.002 file - promoters60/1027725
tctagtttattgtt

SEQ ID NO: 101440 - DNA, 14 bp, Unknown
  misc_feature (1)..( 14): Result.002 file - promoters60/1027725
gtcatattcttaag

SEQ ID NO: 101441 - DNA, 14 bp, Unknown
  misc_feature (1)..( 14): Result.002 file - promoters60/1027725
atgtctttgttagt

SEQ ID NO: 101442 - DNA, 8 bp, Unknown
  misc_feature (1)..( 8): Result.002 file - promoters60/1027765
gaaacaaa

SEQ ID NO: 101443 - DNA, 8 bp, Unknown
  misc_feature (1)..( 8): Result.002 file - promoters60/1027765
taaaaaaa

SEQ ID NO: 101444 - DNA, 8 bp, Unknown
  misc_feature (1)..( 8): Result.002 file - promoters60/1027765
taaaaatt

SEQ ID NO: 101445 - DNA, 12 bp, Unknown
  misc_feature (1)..( 12): Result.002 file - promoters60/1027765
taaattttttaa

SEQ ID NO: 101446 - DNA, 12 bp, Unknown
  misc_feature (1)..( 12): Result.002 file - promoters60/1027765
aagattttataa

SEQ ID NO: 101447 - DNA, 12 bp, Unknown
  misc_feature (1)..( 12): Result.002 file - promoters60/1027765
aaaatttacact

SEQ ID NO: 101448 - DNA, 7 bp, Unknown
  misc_feature (1)..( 7): Result.002 file - promoters60/1027765
ttacaaa

SEQ ID NO: 101449 - DNA, 7 bp, Unknown
  misc_feature (1)..( 7): Result.002 file - promoters60/1027765
ttagaaa

SEQ ID NO: 101450 - DNA, 7 bp, Unknown
  misc_feature (1)..( 7): Result.002 file - promoters60/1027765
ttataaa

SEQ ID NO: 101451 - DNA, 12 bp, Unknown
  misc_feature (1)..( 12): Result.002 file - promoters60/1027765
ggattgttttgt

SEQ ID NO: 101452 - DNA, 12 bp, Unknown
  misc_feature (1)..( 12): Result.002 file - promoters60/1027765
atatttttttgt

SEQ ID NO: 101453 - DNA, 12 bp, Unknown
  misc_feature (1)..( 12): Result.002 file - promoters60/1027765
atattttttact

SEQ ID NO: 101454 - DNA, 7 bp, Unknown
  misc_feature (1)..( 7): Result.002 file - promoters60/1027765
ttaaaat

SEQ ID NO: 101455 - DNA, 7 bp, Unknown
  misc_feature (1)..( 7): Result.002 file - promoters60/1027765
ttacaat

SEQ ID NO: 101456 - DNA, 7 bp, Unknown
  misc_feature (1)..( 7): Result.002 file - promoters60/1027765
ttaaaat

SEQ ID NO: 101457 - DNA, 8 bp, Unknown
  misc_feature (1)..( 8): Result.002 file - promoters60/1027765
aaaagaag

SEQ ID NO: 101458 - DNA, 8 bp, Unknown
  misc_feature (1)..( 8): Result.002 file - promoters60/1027765
aaaagaac

SEQ ID NO: 101459 - DNA, 8 bp, Unknown
  misc_feature (1)..( 8): Result.002 file - promoters60/1027765
aaaaaaac

SEQ ID NO: 101460 - DNA, 11 bp, Unknown
  misc_feature (1)..( 11): Result.002 file - promoters60/1027765
tataatttaca

SEQ ID NO: 101461 - DNA, 11 bp, Unknown
  misc_feature (1)..( 11): Result.002 file - promoters60/1027765
tatgatttgtt

SEQ ID NO: 101462 - DNA, 11 bp, Unknown
  misc_feature (1)..( 11): Result.002 file - promoters60/1027765
gataaattaca

SEQ ID NO: 101463 - DNA, 9 bp, Unknown
  misc_feature (1)..( 9): Result.002 file - promoters60/1027765
taaaaattg

SEQ ID NO: 101464 - DNA, 9 bp, Unknown
  misc_feature (1)..( 9): Result.002 file - promoters60/1027765
taaaaattg

SEQ ID NO: 101465 - DNA, 9 bp, Unknown
  misc_feature (1)..( 9): Result.002 file - promoters60/1027765
taataatcc

SEQ ID NO: 101466 - DNA, 9 bp, Unknown
  misc_feature (1)..( 9): Result.002 file - promoters60/1027869
atcgtttac

SEQ ID NO: 101467 - DNA, 9 bp, Unknown
  misc_feature (1)..( 9): Result.002 file - promoters60/1027869
ctcgtctac

SEQ ID NO: 101468 - DNA, 9 bp, Unknown
  misc_feature (1)..( 9): Result.002 file - promoters60/1027869
atcttttta

SEQ ID NO: 101469 - DNA, 6 bp, Unknown
  misc_feature (1)..( 6): Result.002 file - promoters60/1027869
gatttg

SEQ ID NO: 101470 - DNA, 6 bp, Unknown
  misc_feature (1)..( 6): Result.002 file - promoters60/1027869
gatttg

SEQ ID NO: 101471 - DNA, 10 bp, Unknown
  misc_feature (1)..( 10): Result.002 file - promoters60/1027869
aaagattgaa

SEQ ID NO: 101472 - DNA, 10 bp, Unknown
  misc_feature (1)..( 10): Result.002 file - promoters60/1027869
aaagatcgaa

SEQ ID NO: 101473 - DNA, 10 bp, Unknown
  misc_feature (1)..( 10): Result.002 file - promoters60/1027869
aaatatcaca

SEQ ID NO: 101474 - DNA, 7 bp, Unknown
  misc_feature (1)..( 7): Result.002 file - promoters60/1027869
aacaaat

SEQ ID NO: 101475 - DNA, 7 bp, Unknown
  misc_feature (1)..( 7): Result.002 file - promoters60/1027869
aacaaat

SEQ ID NO: 101476 - DNA, 6 bp, Unknown
  misc_feature (1)..( 6): Result.002 file - promoters60/1027869
aattta

SEQ ID NO: 101477 - DNA, 6 bp, Unknown
  misc_feature (1)..( 6): Result.002 file - promoters60/1027869
aattta

SEQ ID NO: 101478 - DNA, 7 bp, Unknown
  misc_feature (1)..( 7): Result.002 file - promoters60/1027869
ttacaat

SEQ ID NO: 101479 - DNA, 7 bp, Unknown
  misc_feature (1)..( 7): Result.002 file - promoters60/1027869
ttataat

SEQ ID NO: 101480 - DNA, 7 bp, Unknown
  misc_feature (1)..( 7): Result.002 file - promoters60/1027869
tttacaa

SEQ ID NO: 101481 - DNA, 7 bp, Unknown
  misc_feature (1)..( 7): Result.002 file - promoters60/1027869
ttttcaa

SEQ ID NO: 101482 - DNA, 7 bp, Unknown
  misc_feature (1)..( 7): Result.002 file - promoters60/1027869
agataca

SEQ ID NO: 101483 - DNA, 7 bp, Unknown
  misc_feature (1)..( 7): Result.002 file - promoters60/1027869
agaaaca

SEQ ID NO: 101484 - DNA, 11 bp, Unknown
  misc_feature (1)..( 11): Result.002 file - promoters60/1027869
tatcaacatct

SEQ ID NO: 101485 - DNA, 11 bp, Unknown
  misc_feature (1)..( 11): Result.002 file - promoters60/1027869
tataaacatct

SEQ ID NO: 101486 - DNA, 7 bp, Unknown
  misc_feature (1)..( 7): Result.002 file - promoters60/1027869
atgaaga

SEQ ID NO: 101487 - DNA, 7 bp, Unknown
  misc_feature (1)..( 7): Result.002 file - promoters60/1027869
atgtaga

SEQ ID NO: 101488 - DNA, 7 bp, Unknown
  misc_feature (1)..( 7): Result.002 file - promoters60/1027873
tttattt

SEQ ID NO: 101489 - DNA, 7 bp, Unknown
  misc_feature (1)..( 7): Result.002 file - promoters60/1027873
tttattt

SEQ ID NO: 101490 - DNA, 10 bp, Unknown
  misc_feature (1)..( 10): Result.002 file - promoters60/1027873
tttttaacaa

SEQ ID NO: 101491 - DNA, 10 bp, Unknown
  misc_feature (1)..( 10): Result.002 file - promoters60/1027873
tttctaactc

SEQ ID NO: 101492 - DNA, 10 bp, Unknown
  misc_feature (1)..( 10): Result.002 file - promoters60/1027873
gatttagcaa

SEQ ID NO: 101493 - DNA, 6 bp, Unknown
  misc_feature (1)..( 6): Result.002 file - promoters60/1027873
agttaa

SEQ ID NO: 101494 - DNA, 6 bp, Unknown
  misc_feature (1)..( 6): Result.002 file - promoters60/1027873
agttaa

SEQ ID NO: 101495 - DNA, 6 bp, Unknown
  misc_feature (1)..( 6): Result.002 file - promoters60/1027873
ttttgg

SEQ ID NO: 101496 - DNA, 6 bp, Unknown
  misc_feature (1)..( 6): Result.002 file - promoters60/1027873
ttttgg

SEQ ID NO: 101497 - DNA, 6 bp, Unknown
  misc_feature (1)..( 6): Result.002 file - promoters60/1027873
ttttgg

SEQ ID NO: 101498 - DNA, 6 bp, Unknown
  misc_feature (1)..( 6): Result.002 file - promoters60/1027873
aataat

SEQ ID NO: 101499 - DNA, 6 bp, Unknown
  misc_feature (1)..( 6): Result.002 file - promoters60/1027873
aataat

SEQ ID NO: 101500 - DNA, 7 bp, Unknown
  misc_feature (1)..( 7): Result.002 file - promoters60/1027873
taaatta

SEQ ID NO: 101501 - DNA, 7 bp, Unknown
  misc_feature (1)..( 7): Result.002 file - promoters60/1027873
taactta

SEQ ID NO: 101502 - DNA, 13 bp, Unknown
  misc_feature (1)..( 13): Result.002 file - promoters60/1027873
cgcaaaaacatat

SEQ ID NO: 101503 - DNA, 13 bp, Unknown
  misc_feature (1)..( 13): Result.002 file - promoters60/1027873
accaaaatcatat

SEQ ID NO: 101504 - DNA, 13 bp, Unknown
  misc_feature (1)..( 13): Result.002 file - promoters60/1027873
accagaatcgctt

SEQ ID NO: 101505 - DNA, 8 bp, Unknown
  misc_feature (1)..( 8): Result.002 file - promoters60/1027873
ttttggta

SEQ ID NO: 101506 - DNA, 8 bp, Unknown
  misc_feature (1)..( 8): Result.002 file - promoters60/1027873
tttgggta

SEQ ID NO: 101507 - DNA, 6 bp, Unknown
  misc_feature (1)..( 6): Result.002 file - promoters60/1027873
atggtt

SEQ ID NO: 101508 - DNA, 6 bp, Unknown
  misc_feature (1)..( 6): Result.002 file - promoters60/1027873
atggtt

SEQ ID NO: 101509 - DNA, 8 bp, Unknown
  misc_feature (1)..( 8): Result.002 file - promoters60/1027873
gttaacaa

SEQ ID NO: 101510 - DNA, 8 bp, Unknown
  misc_feature (1)..( 8): Result.002 file - promoters60/1027873
tttagcaa

SEQ ID NO: 101511 - DNA, 9 bp, Unknown
  misc_feature (1)..( 9): Result.002 file - promoters60/1027873
attcagctg

SEQ ID NO: 101512 - DNA, 6 bp, Unknown
  misc_feature (1)..( 6): Result.002 file - promoters60/1027873
cgattt

SEQ ID NO: 101513 - DNA, 6 bp, Unknown
  misc_feature (1)..( 6): Result.002 file - promoters60/1027873
cgattt

SEQ ID NO: 101514 - DNA, 7 bp, Unknown
  misc_feature (1)..( 7): Result.002 file - promoters60/1027873
atgtcta

SEQ ID NO: 101515 - DNA, 7 bp, Unknown
  misc_feature (1)..( 7): Result.002 file - promoters60/1027873
atgacta

SEQ ID NO: 101516 - DNA, 6 bp, Unknown
  misc_feature (1)..( 6): Result.002 file - promoters60/1027873
attttt

SEQ ID NO: 101517 - DNA, 6 bp, Unknown
  misc_feature (1)..( 6): Result.002 file - promoters60/1027873
attttt

SEQ ID NO: 101518 - DNA, 8 bp, Unknown
  misc_feature (1)..( 8): Result.002 file - promoters60/1027873
catttttg

SEQ ID NO: 101519 - DNA, 8 bp, Unknown
  misc_feature (1)..( 8): Result.002 file - promoters60/1027873
catttttg

SEQ ID NO: 101520 - DNA, 8 bp, Unknown
  misc_feature (1)..( 8): Result.002 file - promoters60/1027873
tggggttg

SEQ ID NO: 101521 - DNA, 8 bp, Unknown
  misc_feature (1)..( 8): Result.002 file - promoters60/1027873
tgggtttg

SEQ ID NO: 101522 - DNA, 10 bp, Unknown
  misc_feature (1)..( 10): Result.002 file - promoters60/1027873
aaagggctta

SEQ ID NO: 101523 - DNA, 10 bp, Unknown
  misc_feature (1)..( 10): Result.002 file - promoters60/1027873
aaagagctta

SEQ ID NO: 101524 - DNA, 10 bp, Unknown
  misc_feature (1)..( 10): Result.002 file - promoters60/1027873
gaccaaacca

SEQ ID NO: 101525 - DNA, 10 bp, Unknown
  misc_feature (1)..( 10): Result.002 file - promoters60/1027873
gaccgaacca

SEQ ID NO: 101526 - DNA, 7 bp, Unknown
  misc_feature (1)..( 7): Result.002 file - promoters60/1027873
taataag

SEQ ID NO: 101527 - DNA, 7 bp, Unknown
  misc_feature (1)..( 7): Result.002 file - promoters60/1027873
taaaaag

SEQ ID NO: 101528 - DNA, 8 bp, Unknown
  misc_feature (1)..( 8): Result.002 file - promoters60/1027877
atcaagaa

SEQ ID NO: 101529 - DNA, 8 bp, Unknown
  misc_feature (1)..( 8): Result.002 file - promoters60/1027877
atcaggaa

SEQ ID NO: 101530 - DNA, 8 bp, Unknown
  misc_feature (1)..( 8): Result.002 file - promoters60/1027877
atcaagag

SEQ ID NO: 101531 - DNA, 8 bp, Unknown
  misc_feature (1)..( 8): Result.002 file - promoters60/1027877
aattgaaa

SEQ ID NO: 101532 - DNA, 8 bp, Unknown
  misc_feature (1)..( 8): Result.002 file - promoters60/1027877
aatcgaaa

SEQ ID NO: 101533 - DNA, 8 bp, Unknown
  misc_feature (1)..( 8): Result.002 file - promoters60/1027877
taagaatc

SEQ ID NO: 101534 - DNA, 8 bp, Unknown
  misc_feature (1)..( 8): Result.002 file - promoters60/1027877
taagaatc

SEQ ID NO: 101535 - DNA, 7 bp, Unknown
  misc_feature (1)..( 7): Result.002 file - promoters60/1027877
tttcttt

SEQ ID NO: 101536 - DNA, 7 bp, Unknown
  misc_feature (1)..( 7): Result.002 file - promoters60/1027877
tttgttt

SEQ ID NO: 101537 - DNA, 8 bp, Unknown
  misc_feature (1)..( 8): Result.002 file - promoters60/1027877
ttgtagaa

SEQ ID NO: 101538 - DNA, 8 bp, Unknown
  misc_feature (1)..( 8): Result.002 file - promoters60/1027877
gagtagaa

SEQ ID NO: 101539 - DNA, 8 bp, Unknown
  misc_feature (1)..( 8): Result.002 file - promoters60/1027877
ttgtagac

SEQ ID NO: 101540 - DNA, 7 bp, Unknown
  misc_feature (1)..( 7): Result.002 file - promoters60/1027877
acaagta

SEQ ID NO: 101541 - DNA, 7 bp, Unknown
  misc_feature (1)..( 7): Result.002 file - promoters60/1027877
acaggta

SEQ ID NO: 101542 - DNA, 6 bp, Unknown
  misc_feature (1)..( 6): Result.002 file - promoters60/1027877
caagaa

SEQ ID NO: 101543 - DNA, 6 bp, Unknown
  misc_feature (1)..( 6): Result.002 file - promoters60/1027877
caagaa

SEQ ID NO: 101544 - DNA, 6 bp, Unknown
  misc_feature (1)..( 6): Result.002 file - promoters60/1027877
atgaca

SEQ ID NO: 101545 - DNA, 6 bp, Unknown
  misc_feature (1)..( 6): Result.002 file - promoters60/1027877
atgaca

SEQ ID NO: 101546 - DNA, 6 bp, Unknown
  misc_feature (1)..( 6): Result.002 file - promoters60/1027877
actggt

SEQ ID NO: 101547 - DNA, 6 bp, Unknown
  misc_feature (1)..( 6): Result.002 file - promoters60/1027877
actggt

SEQ ID NO: 101548 - DNA, 10 bp, Unknown
  misc_feature (1)..( 10): Result.002 file - promoters60/1027877
atcacttgat

SEQ ID NO: 101549 - DNA, 10 bp, Unknown
  misc_feature (1)..( 10): Result.002 file - promoters60/1027877
atcccttgat

SEQ ID NO: 101550 - DNA, 9 bp, Unknown
  misc_feature (1)..( 9): Result.002 file - promoters60/1027877
atttaaata

SEQ ID NO: 101551 - DNA, 9 bp, Unknown
  misc_feature (1)..( 9): Result.002 file - promoters60/1027877
attgaaata

SEQ ID NO: 101552 - DNA, 8 bp, Unknown
  misc_feature (1)..( 8): Result.002 file - promoters60/1027914
tcttttct

SEQ ID NO: 101553 - DNA, 8 bp, Unknown
  misc_feature (1)..( 8): Result.002 file - promoters60/1027914
tctcttct

SEQ ID NO: 101554 - DNA, 8 bp, Unknown
  misc_feature (1)..( 8): Result.002 file - promoters60/1027914
tctattct

SEQ ID NO: 101555 - DNA, 7 bp, Unknown
  misc_feature (1)..( 7): Result.002 file - promoters60/1027914
gtgatta

SEQ ID NO: 101556 - DNA, 7 bp, Unknown
  misc_feature (1)..( 7): Result.002 file - promoters60/1027914
ttgatta

SEQ ID NO: 101557 - DNA, 7 bp, Unknown
  misc_feature (1)..( 7): Result.002 file - promoters60/1027914
ttgttta

SEQ ID NO: 101558 - DNA, 11 bp, Unknown
  misc_feature (1)..( 11): Result.002 file - promoters60/1027914
attataaaaac

SEQ ID NO: 101559 - DNA, 11 bp, Unknown
  misc_feature (1)..( 11): Result.002 file - promoters60/1027914
tatataataac

SEQ ID NO: 101560 - DNA, 11 bp, Unknown
  misc_feature (1)..( 11): Result.002 file - promoters60/1027914
tatataatcca

SEQ ID NO: 101561 - DNA, 11 bp, Unknown
  misc_feature (1)..( 11): Result.002 file - promoters60/1027928
tgttttctacc

SEQ ID NO: 101562 - DNA, 11 bp, Unknown
  misc_feature (1)..( 11): Result.002 file - promoters60/1027928
atttttctact

SEQ ID NO: 101563 - DNA, 12 bp, Unknown
  misc_feature (1)..( 12): Result.002 file - promoters60/1027928
aacacttcaacc

SEQ ID NO: 101564 - DNA, 12 bp, Unknown
  misc_feature (1)..( 12): Result.002 file - promoters60/1027928
aatttatctaac

SEQ ID NO: 101565 - DNA, 12 bp, Unknown
  misc_feature (1)..( 12): Result.002 file - promoters60/1027928
cctttttcatca

SEQ ID NO: 101566 - DNA, 12 bp, Unknown
  misc_feature (1)..( 12): Result.002 file - promoters60/1027928
ttttttgcatca

SEQ ID NO: 101567 - DNA, 12 bp, Unknown
  misc_feature (1)..( 12): Result.002 file - promoters60/1027928
aatttatgaaaa

SEQ ID NO: 101568 - DNA, 13 bp, Unknown
  misc_feature (1)..( 13): Result.002 file - promoters60/1027928
actcttttgagaa

SEQ ID NO: 101569 - DNA, 13 bp, Unknown
  misc_feature (1)..( 13): Result.002 file - promoters60/1027928
actatttatacat

SEQ ID NO: 101570 - DNA, 13 bp, Unknown
  misc_feature (1)..( 13): Result.002 file - promoters60/1027928
tttcttttcacat

SEQ ID NO: 101571 - DNA, 13 bp, Unknown
  misc_feature (1)..( 13): Result.002 file - promoters60/1027928
cctattaataaaa

SEQ ID NO: 101572 - DNA, 13 bp, Unknown
  misc_feature (1)..( 13): Result.002 file - promoters60/1027928
ttgattagtaaaa

SEQ ID NO: 101573 - DNA, 13 bp, Unknown
  misc_feature (1)..( 13): Result.002 file - promoters60/1027928
tttataaatattt

SEQ ID NO: 101574 - DNA, 13 bp, Unknown
  misc_feature (1)..( 13): Result.002 file - promoters60/1027928
tgtttaaacatta

SEQ ID NO: 101575 - DNA, 10 bp, Unknown
  misc_feature (1)..( 10): Result.002 file - promoters60/1027928
atgttaaacc

SEQ ID NO: 101576 - DNA, 10 bp, Unknown
  misc_feature (1)..( 10): Result.002 file - promoters60/1027928
ttgtcaaatg

SEQ ID NO: 101577 - DNA, 10 bp, Unknown
  misc_feature (1)..( 10): Result.002 file - promoters60/1027928
gtgttaaaag

SEQ ID NO: 101578 - DNA, 11 bp, Unknown
  misc_feature (1)..( 11): Result.002 file - promoters60/1027928
gtgtttaaaca

SEQ ID NO: 101579 - DNA, 11 bp, Unknown
  misc_feature (1)..( 11): Result.002 file - promoters60/1027928
tattttcaact

SEQ ID NO: 101580 - DNA, 11 bp, Unknown
  misc_feature (1)..( 11): Result.002 file - promoters60/1027928
agaatcaccta

SEQ ID NO: 101581 - DNA, 15 bp, Unknown
  misc_feature (1)..( 15): Result.002 file - promoters60/1027928
tgtaatttttttcta

SEQ ID NO: 101582 - DNA, 15 bp, Unknown
  misc_feature (1)..( 15): Result.002 file - promoters60/1027928
aataatgtttttcta

SEQ ID NO: 101583 - DNA, 15 bp, Unknown
  misc_feature (1)..( 15): Result.002 file - promoters60/1027928
tttaatttcttttca

SEQ ID NO: 101584 - DNA, 15 bp, Unknown
  misc_feature (1)..( 15): Result.002 file - promoters60/1027928
ataaatattttcaac

SEQ ID NO: 101585 - DNA, 15 bp, Unknown
  misc_feature (1)..( 15): Result.002 file - promoters60/1027928
taaaatttcacaatg

SEQ ID NO: 101586 - DNA, 15 bp, Unknown
  misc_feature (1)..( 15): Result.002 file - promoters60/1027928
tttgattagtaaaag

SEQ ID NO: 101587 - DNA, 15 bp, Unknown
  misc_feature (1)..( 15): Result.002 file - promoters60/1027928
tttaaacattaaaga

SEQ ID NO: 101588 - DNA, 6 bp, Unknown
  misc_feature (1)..( 6): Result.002 file - promoters60/1027970
ttttgt

SEQ ID NO: 101589 - DNA, 6 bp, Unknown
  misc_feature (1)..( 6): Result.002 file - promoters60/1027970
ttttgt

SEQ ID NO: 101590 - DNA, 6 bp, Unknown
  misc_feature (1)..( 6): Result.002 file - promoters60/1027970
tatatt

SEQ ID NO: 101591 - DNA, 6 bp, Unknown
  misc_feature (1)..( 6): Result.002 file - promoters60/1027970
tatatt

SEQ ID NO: 101592 - DNA, 6 bp, Unknown
  misc_feature (1)..( 6): Result.002 file - promoters60/1027970
tattat

SEQ ID NO: 101593 - DNA, 6 bp, Unknown
  misc_feature (1)..( 6): Result.002 file - promoters60/1027970
tattat

SEQ ID NO: 101594 - DNA, 7 bp, Unknown
  misc_feature (1)..( 7): Result.002 file - promoters60/1027970
attattc

SEQ ID NO: 101595 - DNA, 7 bp, Unknown
  misc_feature (1)..( 7): Result.002 file - promoters60/1027970
atttttc

SEQ ID NO: 101596 - DNA, 6 bp, Unknown
  misc_feature (1)..( 6): Result.002 file - promoters60/1027970
taaaga

SEQ ID NO: 101597 - DNA, 6 bp, Unknown
  misc_feature (1)..( 6): Result.002 file - promoters60/1027970
taaaga

SEQ ID NO: 101598 - DNA, 6 bp, Unknown
  misc_feature (1)..( 6): Result.002 file - promoters60/1027970
agtttt

SEQ ID NO: 101599 - DNA, 6 bp, Unknown
  misc_feature (1)..( 6): Result.002 file - promoters60/1027970
agtttt

SEQ ID NO: 101600 - DNA, 7 bp, Unknown
  misc_feature (1)..( 7): Result.002 file - promoters60/1027970
tcgttta

SEQ ID NO: 101601 - DNA, 7 bp, Unknown
  misc_feature (1)..( 7): Result.002 file - promoters60/1027970
tcggtta

SEQ ID NO: 101602 - DNA, 8 bp, Unknown
  misc_feature (1)..( 8): Result.002 file - promoters60/1027970
taagattc

SEQ ID NO: 101603 - DNA, 8 bp, Unknown
  misc_feature (1)..( 8): Result.002 file - promoters60/1027970
taaaattg

SEQ ID NO: 101604 - DNA, 8 bp, Unknown
  misc_feature (1)..( 8): Result.002 file - promoters60/1027970
taagcttc

SEQ ID NO: 101605 - DNA, 6 bp, Unknown
  misc_feature (1)..( 6): Result.002 file - promoters60/1027970
aagtga

SEQ ID NO: 101606 - DNA, 6 bp, Unknown
  misc_feature (1)..( 6): Result.002 file - promoters60/1027970
aagtga

SEQ ID NO: 101607 - DNA, 10 bp, Unknown
  misc_feature (1)..( 10): Result.002 file - promoters60/1027970
ttactttctt

SEQ ID NO: 101608 - DNA, 10 bp, Unknown
  misc_feature (1)..( 10): Result.002 file - promoters60/1027970
ttaatttctt

SEQ ID NO: 101609 - DNA, 12 bp, Unknown
  misc_feature (1)..( 12): Result.002 file - promoters60/1027970
ttggaaaacatg

SEQ ID NO: 101610 - DNA, 12 bp, Unknown
  misc_feature (1)..( 12): Result.002 file - promoters60/1027970
ttggaaagcatg

SEQ ID NO: 101611 - DNA, 7 bp, Unknown
  misc_feature (1)..( 7): Result.002 file - promoters60/1027970
cttccgt

SEQ ID NO: 101612 - DNA, 7 bp, Unknown
  misc_feature (1)..( 7): Result.002 file - promoters60/1027970
cttccgt

SEQ ID NO: 101613 - DNA, 6 bp, Unknown
  misc_feature (1)..( 6): Result.002 file - promoters60/1027970
attatt

SEQ ID NO: 101614 - DNA, 6 bp, Unknown
  misc_feature (1)..( 6): Result.002 file - promoters60/1027970
attatt

SEQ ID NO: 101615 - DNA, 7 bp, Unknown
  misc_feature (1)..( 7): Result.002 file - promoters60/1027970
gagctaa

SEQ ID NO: 101616 - DNA, 7 bp, Unknown
  misc_feature (1)..( 7): Result.002 file - promoters60/1027970
gaggtaa

SEQ ID NO: 101617 - DNA, 6 bp, Unknown
  misc_feature (1)..( 6): Result.002 file - promoters60/1027970
aataaa

SEQ ID NO: 101618 - DNA, 6 bp, Unknown
  misc_feature (1)..( 6): Result.002 file - promoters60/1027970
aataaa

SEQ ID NO: 101619 - DNA, 6 bp, Unknown
  misc_feature (1)..( 6): Result.002 file - promoters60/1027970
aaaatt

SEQ ID NO: 101620 - DNA, 6 bp, Unknown
  misc_feature (1)..( 6): Result.002 file - promoters60/1027970
aaaatt

SEQ ID NO: 101621 - DNA, 7 bp, Unknown
  misc_feature (1)..( 7): Result.002 file - promoters60/1027990
aaaaccc

SEQ ID NO: 101622 - DNA, 7 bp, Unknown
  misc_feature (1)..( 7): Result.002 file - promoters60/1027990
aaaaccc

SEQ ID NO: 101623 - DNA, 6 bp, Unknown
  misc_feature (1)..( 6): Result.002 file - promoters60/1027990
tagaaa

SEQ ID NO: 101624 - DNA, 6 bp, Unknown
  misc_feature (1)..( 6): Result.002 file - promoters60/1027990
tagaaa

SEQ ID NO: 101625 - DNA, 7 bp, Unknown
  misc_feature (1)..( 7): Result.002 file - promoters60/1027990
tgtggtt

SEQ ID NO: 101626 - DNA, 7 bp, Unknown
  misc_feature (1)..( 7): Result.002 file - promoters60/1027990
tgtcgtt

SEQ ID NO: 101627 - DNA, 6 bp, Unknown
  misc_feature (1)..( 6): Result.002 file - promoters60/1027990
caggaa

SEQ ID NO: 101628 - DNA, 6 bp, Unknown
  misc_feature (1)..( 6): Result.002 file - promoters60/1027990
caggaa

SEQ ID NO: 101629 - DNA, 7 bp, Unknown
  misc_feature (1)..( 7): Result.002 file - promoters60/1027990
tttctca

SEQ ID NO: 101630 - DNA, 7 bp, Unknown
  misc_feature (1)..( 7): Result.002 file - promoters60/1027990
tttctca

SEQ ID NO: 101631 - DNA, 7 bp, Unknown
  misc_feature (1)..( 7): Result.002 file - promoters60/1028013
atcaagc

SEQ ID NO: 101632 - DNA, 7 bp, Unknown
  misc_feature (1)..( 7): Result.002 file - promoters60/1028013
atctagc

SEQ ID NO: 101633 - DNA, 6 bp, Unknown
  misc_feature (1)..( 6): Result.002 file - promoters60/1028013
ttttct

SEQ ID NO: 101634 - DNA, 6 bp, Unknown
  misc_feature (1)..( 6): Result.002 file - promoters60/1028013
ttttct

SEQ ID NO: 101635 - DNA, 8 bp, Unknown
  misc_feature (1)..( 8): Result.002 file - promoters60/1028013
agagaaga

SEQ ID NO: 101636 - DNA, 8 bp, Unknown
  misc_feature (1)..( 8): Result.002 file - promoters60/1028013
taagaaga

SEQ ID NO: 101637 - DNA, 8 bp, Unknown
  misc_feature (1)..( 8): Result.002 file - promoters60/1028013
agataagt

SEQ ID NO: 101638 - DNA, 8 bp, Unknown
  misc_feature (1)..( 8): Result.002 file - promoters60/1028013
tgggctta

SEQ ID NO: 101639 - DNA, 8 bp, Unknown
  misc_feature (1)..( 8): Result.002 file - promoters60/1028013
tgggatta

SEQ ID NO: 101640 - DNA, 6 bp, Unknown
  misc_feature (1)..( 6): Result.002 file - promoters60/1028013
tttaaa

SEQ ID NO: 101641 - DNA, 6 bp, Unknown
  misc_feature (1)..( 6): Result.002 file - promoters60/1028013
tttaaa

SEQ ID NO: 101642 - DNA, 7 bp, Unknown
  misc_feature (1)..( 7): Result.002 file - promoters60/1028013
aaagcat

SEQ ID NO: 101643 - DNA, 7 bp, Unknown
  misc_feature (1)..( 7): Result.002 file - promoters60/1028013
aaatcat

SEQ ID NO: 101644 - DNA, 8 bp, Unknown
  misc_feature (1)..( 8): Result.002 file - promoters60/1028013
tctcttct

SEQ ID NO: 101645 - DNA, 8 bp, Unknown
  misc_feature (1)..( 8): Result.002 file - promoters60/1028013
tctcgtct

SEQ ID NO: 101646 - DNA, 7 bp, Unknown
  misc_feature (1)..( 7): Result.002 file - promoters60/1028013
agaaaag

SEQ ID NO: 101647 - DNA, 7 bp, Unknown
  misc_feature (1)..( 7): Result.002 file - promoters60/1028013
agataag

SEQ ID NO: 101648 - DNA, 6 bp, Unknown
  misc_feature (1)..( 6): Result.002 file - promoters60/1028013
acgtgg

SEQ ID NO: 101649 - DNA, 6 bp, Unknown
  misc_feature (1)..( 6): Result.002 file - promoters60/1028013
acgtgg

SEQ ID NO: 101650 - DNA, 6 bp, Unknown
  misc_feature (1)..( 6): Result.002 file - promoters60/1028013
agatag

SEQ ID NO: 101651 - DNA, 6 bp, Unknown
  misc_feature (1)..( 6): Result.002 file - promoters60/1028013
agatag

SEQ ID NO: 101652 - DNA, 8 bp, Unknown
  misc_feature (1)..( 8): Result.002 file - promoters60/1028013
tttatttt

SEQ ID NO: 101653 - DNA, 8 bp, Unknown
  misc_feature (1)..( 8): Result.002 file - promoters60/1028013
tttctttt

SEQ ID NO: 101654 - DNA, 6 bp, Unknown
  misc_feature (1)..( 6): Result.002 file - promoters60/1028013
tgactc

SEQ ID NO: 101655 - DNA, 6 bp, Unknown
  misc_feature (1)..( 6): Result.002 file - promoters60/1028013
tgactc

SEQ ID NO: 101656 - DNA, 7 bp, Unknown
  misc_feature (1)..( 7): Result.002 file - promoters60/1028013
ttgtgtc

SEQ ID NO: 101657 - DNA, 7 bp, Unknown
  misc_feature (1)..( 7): Result.002 file - promoters60/1028013
ttgagtc

SEQ ID NO: 101658 - DNA, 7 bp, Unknown
  misc_feature (1)..( 7): Result.002 file - promoters60/1028013
ctttttt

SEQ ID NO: 101659 - DNA, 7 bp, Unknown
  misc_feature (1)..( 7): Result.002 file - promoters60/1028013
cttgttt

SEQ ID NO: 101660 - DNA, 7 bp, Unknown
  misc_feature (1)..( 7): Result.002 file - promoters60/1028013
taaaatt

SEQ ID NO: 101661 - DNA, 7 bp, Unknown
  misc_feature (1)..( 7): Result.002 file - promoters60/1028013
taagatt

SEQ ID NO: 101662 - DNA, 6 bp, Unknown
  misc_feature (1)..( 6): Result.002 file - promoters60/1028013
ttcaaa

SEQ ID NO: 101663 - DNA, 6 bp, Unknown
  misc_feature (1)..( 6): Result.002 file - promoters60/1028013
ttcaaa

SEQ ID NO: 101664 - DNA, 9 bp, Unknown
  misc_feature (1)..( 9): Result.002 file - promoters60/1028013
aaaaaaaac

SEQ ID NO: 101665 - DNA, 9 bp, Unknown
  misc_feature (1)..( 9): Result.002 file - promoters60/1028013
aaacaaaac

SEQ ID NO: 101666 - DNA, 7 bp, Unknown
  misc_feature (1)..( 7): Result.002 file - promoters60/1028013
ttattca

SEQ ID NO: 101667 - DNA, 7 bp, Unknown
  misc_feature (1)..( 7): Result.002 file - promoters60/1028013
ttagtca

SEQ ID NO: 101668 - DNA, 7 bp, Unknown
  misc_feature (1)..( 7): Result.002 file - promoters60/1028013
aattaat

SEQ ID NO: 101669 - DNA, 7 bp, Unknown
  misc_feature (1)..( 7): Result.002 file - promoters60/1028013
aataaat

SEQ ID NO: 101670 - DNA, 6 bp, Unknown
  misc_feature (1)..( 6): Result.002 file - promoters60/1028013
aataat

SEQ ID NO: 101671 - DNA, 6 bp, Unknown
  misc_feature (1)..( 6): Result.002 file - promoters60/1028013
aataat

SEQ ID NO: 101672 - DNA, 6 bp, Unknown
  misc_feature (1)..( 6): Result.002 file - promoters60/1028042
ttaaaa

SEQ ID NO: 101673 - DNA, 6 bp, Unknown
  misc_feature (1)..( 6): Result.002 file - promoters60/1028042
ttaaaa

SEQ ID NO: 101674 - DNA, 6 bp, Unknown
  misc_feature (1)..( 6): Result.002 file - promoters60/1028042
taaaac

SEQ ID NO: 101675 - DNA, 6 bp, Unknown
  misc_feature (1)..( 6): Result.002 file - promoters60/1028042
taaaac

SEQ ID NO: 101676 - DNA, 6 bp, Unknown
  misc_feature (1)..( 6): Result.002 file - promoters60/1028042
aaactt

SEQ ID NO: 101677 - DNA, 6 bp, Unknown
  misc_feature (1)..( 6): Result.002 file - promoters60/1028042
aaactt

SEQ ID NO: 101678 - DNA, 7 bp, Unknown
  misc_feature (1)..( 7): Result.002 file - promoters60/1028042
cacgatc

SEQ ID NO: 101679 - DNA, 7 bp, Unknown
  misc_feature (1)..( 7): Result.002 file - promoters60/1028042
cacaatc

SEQ ID NO: 101680 - DNA, 7 bp, Unknown
  misc_feature (1)..( 7): Result.002 file - promoters60/1028042
aaagcaa

SEQ ID NO: 101681 - DNA, 7 bp, Unknown
  misc_feature (1)..( 7): Result.002 file - promoters60/1028042
aaaccaa

SEQ ID NO: 101682 - DNA, 6 bp, Unknown
  misc_feature (1)..( 6): Result.002 file - promoters60/1028042
agttaa

SEQ ID NO: 101683 - DNA, 6 bp, Unknown
  misc_feature (1)..( 6): Result.002 file - promoters60/1028042
agttaa

SEQ ID NO: 101684 - DNA, 7 bp, Unknown
  misc_feature (1)..( 7): Result.002 file - promoters60/1028042
aagcaat

SEQ ID NO: 101685 - DNA, 7 bp, Unknown
  misc_feature (1)..( 7): Result.002 file - promoters60/1028042
aagcaat

SEQ ID NO: 101686 - DNA, 7 bp, Unknown
  misc_feature (1)..( 7): Result.002 file - promoters60/1028042
acatgta

SEQ ID NO: 101687 - DNA, 7 bp, Unknown
  misc_feature (1)..( 7): Result.002 file - promoters60/1028042
acatgtt

SEQ ID NO: 101688 - DNA, 7 bp, Unknown
  misc_feature (1)..( 7): Result.002 file - promoters60/1028042
ccatgtt

SEQ ID NO: 101689 - DNA, 7 bp, Unknown
  misc_feature (1)..( 7): Result.002 file - promoters60/1028042
aatctaa

SEQ ID NO: 101690 - DNA, 7 bp, Unknown
  misc_feature (1)..( 7): Result.002 file - promoters60/1028042
aatgtaa

SEQ ID NO: 101691 - DNA, 7 bp, Unknown
  misc_feature (1)..( 7): Result.002 file - promoters60/1028042
gatgtaa

SEQ ID NO: 101692 - DNA, 13 bp, Unknown
  misc_feature (1)..( 13): Result.002 file - promoters60/1028042
cagaaaagaagac

SEQ ID NO: 101693 - DNA, 13 bp, Unknown
  misc_feature (1)..( 13): Result.002 file - promoters60/1028042
cagaaaagaaaaa

SEQ ID NO: 101694 - DNA, 13 bp, Unknown
  misc_feature (1)..( 13): Result.002 file - promoters60/1028042
accaaaagacaaa

SEQ ID NO: 101695 - DNA, 8 bp, Unknown
  misc_feature (1)..( 8): Result.002 file - promoters60/1028042
aaatcaaa

SEQ ID NO: 101696 - DNA, 8 bp, Unknown
  misc_feature (1)..( 8): Result.002 file - promoters60/1028042
aaaacaaa

SEQ ID NO: 101697 - DNA, 7 bp, Unknown
  misc_feature (1)..( 7): Result.002 file - promoters60/1028042
acaaaag

SEQ ID NO: 101698 - DNA, 7 bp, Unknown
  misc_feature (1)..( 7): Result.002 file - promoters60/1028042
acaaaag

SEQ ID NO: 101699 - DNA, 8 bp, Unknown
  misc_feature (1)..( 8): Result.002 file - promoters60/1028042
agaggaag

SEQ ID NO: 101700 - DNA, 8 bp, Unknown
  misc_feature (1)..( 8): Result.002 file - promoters60/1028042
agacgaaa

SEQ ID NO: 101701 - DNA, 8 bp, Unknown
  misc_feature (1)..( 8): Result.002 file - promoters60/1028042
aaacgaaa

SEQ ID NO: 101702 - DNA, 13 bp, Unknown
  misc_feature (1)..( 13): Result.002 file - promoters60/1028042
actctaatcaacc

SEQ ID NO: 101703 - DNA, 13 bp, Unknown
  misc_feature (1)..( 13): Result.002 file - promoters60/1028042
agaacaattaacc

SEQ ID NO: 101704 - DNA, 13 bp, Unknown
  misc_feature (1)..( 13): Result.002 file - promoters60/1028042
agatcaattagtg

SEQ ID NO: 101705 - DNA, 6 bp, Unknown
  misc_feature (1)..( 6): Result.002 file - promoters60/1028042
cctttc

SEQ ID NO: 101706 - DNA, 6 bp, Unknown
  misc_feature (1)..( 6): Result.002 file - promoters60/1028042
cctttc

SEQ ID NO: 101707 - DNA, 6 bp, Unknown
  misc_feature (1)..( 6): Result.002 file - promoters60/1028042
ctttaa

SEQ ID NO: 101708 - DNA, 6 bp, Unknown
  misc_feature (1)..( 6): Result.002 file - promoters60/1028042
ctttaa

SEQ ID NO: 101709 - DNA, 9 bp, Unknown
  misc_feature (1)..( 9): Result.002 file - promoters60/1028042
aatttcagt

SEQ ID NO: 101710 - DNA, 9 bp, Unknown
  misc_feature (1)..( 9): Result.002 file - promoters60/1028042
aatttaagt

SEQ ID NO: 101711 - DNA, 8 bp, Unknown
  misc_feature (1)..( 8): Result.002 file - promoters60/1028042
atatttca

SEQ ID NO: 101712 - DNA, 8 bp, Unknown
  misc_feature (1)..( 8): Result.002 file - promoters60/1028042
atagttca

SEQ ID NO: 101713 - DNA, 7 bp, Unknown
  misc_feature (1)..( 7): Result.002 file - promoters60/1028042
ttttttt

SEQ ID NO: 101714 - DNA, 7 bp, Unknown
  misc_feature (1)..( 7): Result.002 file - promoters60/1028042
ttttttt

SEQ ID NO: 101715 - DNA, 7 bp, Unknown
  misc_feature (1)..( 7): Result.002 file - promoters60/1028042
tttgttt

SEQ ID NO: 101716 - DNA, 7 bp, Unknown
  misc_feature (1)..( 7): Result.002 file - promoters60/1028042
tttattt

SEQ ID NO: 101717 - DNA, 7 bp, Unknown
  misc_feature (1)..( 7): Result.002 file - promoters60/1028042
aaacttt

SEQ ID NO: 101718 - DNA, 7 bp, Unknown
  misc_feature (1)..( 7): Result.002 file - promoters60/1028042
aaagttt

SEQ ID NO: 101719 - DNA, 7 bp, Unknown
  misc_feature (1)..( 7): Result.002 file - promoters60/1028042
cattata

SEQ ID NO: 101720 - DNA, 7 bp, Unknown
  misc_feature (1)..( 7): Result.002 file - promoters60/1028042
cataata

SEQ ID NO: 101721 - DNA, 7 bp, Unknown
  misc_feature (1)..( 7): Result.002 file - promoters60/1028042
aaacgcg

SEQ ID NO: 101722 - DNA, 7 bp, Unknown
  misc_feature (1)..( 7): Result.002 file - promoters60/1028042
aaaagcg

SEQ ID NO: 101723 - DNA, 12 bp, Unknown
  misc_feature (1)..( 12): Result.002 file - promoters60/1028084
gaaattttagga

SEQ ID NO: 101724 - DNA, 12 bp, Unknown
  misc_feature (1)..( 12): Result.002 file - promoters60/1028084
gaaattttattt

SEQ ID NO: 101725 - DNA, 12 bp, Unknown
  misc_feature (1)..( 12): Result.002 file - promoters60/1028084
tatcttttattt

SEQ ID NO: 101726 - DNA, 8 bp, Unknown
  misc_feature (1)..( 8): Result.002 file - promoters60/1028084
catccaca

SEQ ID NO: 101727 - DNA, 8 bp, Unknown
  misc_feature (1)..( 8): Result.002 file - promoters60/1028084
catccaca

SEQ ID NO: 101728 - DNA, 6 bp, Unknown
  misc_feature (1)..( 6): Result.002 file - promoters60/1028084
cacaaa

SEQ ID NO: 101729 - DNA, 6 bp, Unknown
  misc_feature (1)..( 6): Result.002 file - promoters60/1028084
cacaaa

SEQ ID NO: 101730 - DNA, 10 bp, Unknown
  misc_feature (1)..( 10): Result.002 file - promoters60/1028084
atatcaattt

SEQ ID NO: 101731 - DNA, 10 bp, Unknown
  misc_feature (1)..( 10): Result.002 file - promoters60/1028084
ataccaattt

SEQ ID NO: 101732 - DNA, 10 bp, Unknown
  misc_feature (1)..( 10): Result.002 file - promoters60/1028084
gtaacaattt

SEQ ID NO: 101733 - DNA, 7 bp, Unknown
  misc_feature (1)..( 7): Result.002 file - promoters60/1028084
aaacaaa

SEQ ID NO: 101734 - DNA, 7 bp, Unknown
  misc_feature (1)..( 7): Result.002 file - promoters60/1028084
aaaaaaa

SEQ ID NO: 101735 - DNA, 8 bp, Unknown
  misc_feature (1)..( 8): Result.002 file - promoters60/1028084
aaacagac

SEQ ID NO: 101736 - DNA, 8 bp, Unknown
  misc_feature (1)..( 8): Result.002 file - promoters60/1028084
aaaaagac

SEQ ID NO: 101737 - DNA, 6 bp, Unknown
  misc_feature (1)..( 6): Result.002 file - promoters60/1028084
tatata

SEQ ID NO: 101738 - DNA, 6 bp, Unknown
  misc_feature (1)..( 6): Result.002 file - promoters60/1028084
tatata

SEQ ID NO: 101739 - DNA, 6 bp, Unknown
  misc_feature (1)..( 6): Result.002 file - promoters60/1028084
tgtatg

SEQ ID NO: 101740 - DNA, 6 bp, Unknown
  misc_feature (1)..( 6): Result.002 file - promoters60/1028084
tgtatg

SEQ ID NO: 101741 - DNA, 6 bp, Unknown
  misc_feature (1)..( 6): Result.002 file - promoters60/1028084
ataata

SEQ ID NO: 101742 - DNA, 6 bp, Unknown
  misc_feature (1)..( 6): Result.002 file - promoters60/1028084
ataata

SEQ ID NO: 101743 - DNA, 6 bp, Unknown
  misc_feature (1)..( 6): Result.002 file - promoters60/1028084
attatt

SEQ ID NO: 101744 - DNA, 6 bp, Unknown
  misc_feature (1)..( 6): Result.002 file - promoters60/1028084
attatt

SEQ ID NO: 101745 - DNA, 7 bp, Unknown
  misc_feature (1)..( 7): Result.002 file - promoters60/1028084
gttaagt

SEQ ID NO: 101746 - DNA, 7 bp, Unknown
  misc_feature (1)..( 7): Result.002 file - promoters60/1028084
gtttagt

SEQ ID NO: 101747 - DNA, 6 bp, Unknown
  misc_feature (1)..( 6): Result.002 file - promoters60/1028084
tagtgt

SEQ ID NO: 101748 - DNA, 6 bp, Unknown
  misc_feature (1)..( 6): Result.002 file - promoters60/1028084
tagtgt

SEQ ID NO: 101749 - DNA, 7 bp, Unknown
  misc_feature (1)..( 7): Result.002 file - promoters60/1028084
ttttcac

SEQ ID NO: 101750 - DNA, 7 bp, Unknown
  misc_feature (1)..( 7): Result.002 file - promoters60/1028084
tttgcac

SEQ ID NO: 101751 - DNA, 6 bp, Unknown
  misc_feature (1)..( 6): Result.002 file - promoters60/1028084
aagaaa

SEQ ID NO: 101752 - DNA, 6 bp, Unknown
  misc_feature (1)..( 6): Result.002 file - promoters60/1028084
aagaaa

SEQ ID NO: 101753 - DNA, 6 bp, Unknown
  misc_feature (1)..( 6): Result.002 file - promoters60/1028084
aaatca

SEQ ID NO: 101754 - DNA, 6 bp, Unknown
  misc_feature (1)..( 6): Result.002 file - promoters60/1028084
aaatca

SEQ ID NO: 101755 - DNA, 7 bp, Unknown
  misc_feature (1)..( 7): Result.002 file - promoters60/1028084
aataact

SEQ ID NO: 101756 - DNA, 7 bp, Unknown
  misc_feature (1)..( 7): Result.002 file - promoters60/1028084
aataact

SEQ ID NO: 101757 - DNA, 6 bp, Unknown
  misc_feature (1)..( 6): Result.002 file - promoters60/1028095
gattaa

SEQ ID NO: 101758 - DNA, 6 bp, Unknown
  misc_feature (1)..( 6): Result.002 file - promoters60/1028095
gattaa

SEQ ID NO: 101759 - DNA, 8 bp, Unknown
  misc_feature (1)..( 8): Result.002 file - promoters60/1028095
atatgttt

SEQ ID NO: 101760 - DNA, 8 bp, Unknown
  misc_feature (1)..( 8): Result.002 file - promoters60/1028095
atatcttt

SEQ ID NO: 101761 - DNA, 9 bp, Unknown
  misc_feature (1)..( 9): Result.002 file - promoters60/1028095
aaccacatc

SEQ ID NO: 101762 - DNA, 9 bp, Unknown
  misc_feature (1)..( 9): Result.002 file - promoters60/1028095
aacaacatc

SEQ ID NO: 101763 - DNA, 8 bp, Unknown
  misc_feature (1)..( 8): Result.002 file - promoters60/1028095
tagttata

SEQ ID NO: 101764 - DNA, 8 bp, Unknown
  misc_feature (1)..( 8): Result.002 file - promoters60/1028095
tagctata

SEQ ID NO: 101765 - DNA, 6 bp, Unknown
  misc_feature (1)..( 6): Result.002 file - promoters60/1028095
tttttt

SEQ ID NO: 101766 - DNA, 6 bp, Unknown
  misc_feature (1)..( 6): Result.002 file - promoters60/1028095
tttttt

SEQ ID NO: 101767 - DNA, 9 bp, Unknown
  misc_feature (1)..( 9): Result.002 file - promoters60/1028095
tttttttta

SEQ ID NO: 101768 - DNA, 9 bp, Unknown
  misc_feature (1)..( 9): Result.002 file - promoters60/1028095
tttatttta

SEQ ID NO: 101769 - DNA, 7 bp, Unknown
  misc_feature (1)..( 7): Result.002 file - promoters60/1028095
tataaaa

SEQ ID NO: 101770 - DNA, 7 bp, Unknown
  misc_feature (1)..( 7): Result.002 file - promoters60/1028095
tataaaa

SEQ ID NO: 101771 - DNA, 7 bp, Unknown
  misc_feature (1)..( 7): Result.002 file - promoters60/1028095
tgaaatt

SEQ ID NO: 101772 - DNA, 7 bp, Unknown
  misc_feature (1)..( 7): Result.002 file - promoters60/1028095
tgatatt

SEQ ID NO: 101773 - DNA, 7 bp, Unknown
  misc_feature (1)..( 7): Result.002 file - promoters60/1028095
cgttttt

SEQ ID NO: 101774 - DNA, 7 bp, Unknown
  misc_feature (1)..( 7): Result.002 file - promoters60/1028095
cgttttt

SEQ ID NO: 101775 - DNA, 8 bp, Unknown
  misc_feature (1)..( 8): Result.002 file - promoters60/1028095
caaataaa

SEQ ID NO: 101776 - DNA, 8 bp, Unknown
  misc_feature (1)..( 8): Result.002 file - promoters60/1028095
caaagaaa

SEQ ID NO: 101777 - DNA, 7 bp, Unknown
  misc_feature (1)..( 7): Result.002 file - promoters60/1028095
ttattat

SEQ ID NO: 101778 - DNA, 7 bp, Unknown
  misc_feature (1)..( 7): Result.002 file - promoters60/1028095
ttattat

SEQ ID NO: 101779 - DNA, 10 bp, Unknown
  misc_feature (1)..( 10): Result.002 file - promoters60/1028095
aaataaagtt

SEQ ID NO: 101780 - DNA, 10 bp, Unknown
  misc_feature (1)..( 10): Result.002 file - promoters60/1028095
aaataaggtt

SEQ ID NO: 101781 - DNA, 6 bp, Unknown
  misc_feature (1)..( 6): Result.002 file - promoters60/1028095
aaaacg

SEQ ID NO: 101782 - DNA, 6 bp, Unknown
  misc_feature (1)..( 6): Result.002 file - promoters60/1028095
aaaacg

SEQ ID NO: 101783 - DNA, 8 bp, Unknown
  misc_feature (1)..( 8): Result.002 file - promoters60/1028131
catatata

SEQ ID NO: 101784 - DNA, 8 bp, Unknown
  misc_feature (1)..( 8): Result.002 file - promoters60/1028131
agtatata

SEQ ID NO: 101785 - DNA, 8 bp, Unknown
  misc_feature (1)..( 8): Result.002 file - promoters60/1028131
agtctatt

SEQ ID NO: 101786 - DNA, 8 bp, Unknown
  misc_feature (1)..( 8): Result.002 file - promoters60/1028131
atcatttc

SEQ ID NO: 101787 - DNA, 8 bp, Unknown
  misc_feature (1)..( 8): Result.002 file - promoters60/1028131
ttcatttt

SEQ ID NO: 101788 - DNA, 9 bp, Unknown
  misc_feature (1)..( 9): Result.002 file - promoters60/1028131
ttcatattt

SEQ ID NO: 101789 - DNA, 14 bp, Unknown
  misc_feature (1)..( 14): Result.002 file - promoters60/1028131
cccaaatttattta

SEQ ID NO: 101790 - DNA, 14 bp, Unknown
  misc_feature (1)..( 14): Result.002 file - promoters60/1028131
tcttcattttttta

SEQ ID NO: 101791 - DNA, 14 bp, Unknown
  misc_feature (1)..( 14): Result.002 file - promoters60/1028131
ttcatatttgaaga

SEQ ID NO: 101792 - DNA, 10 bp, Unknown
  misc_feature (1)..( 10): Result.002 file - promoters60/1028131
gaaaccctag

SEQ ID NO: 101793 - DNA, 10 bp, Unknown
  misc_feature (1)..( 10): Result.002 file - promoters60/1028131
gaagcccaat

SEQ ID NO: 101794 - DNA, 10 bp, Unknown
  misc_feature (1)..( 10): Result.002 file - promoters60/1028131
atagcccaat

SEQ ID NO: 101795 - DNA, 6 bp, Unknown
  misc_feature (1)..( 6): Result.002 file - promoters60/1028151
aagatg

SEQ ID NO: 101796 - DNA, 6 bp, Unknown
  misc_feature (1)..( 6): Result.002 file - promoters60/1028151
aagatg

SEQ ID NO: 101797 - DNA, 9 bp, Unknown
  misc_feature (1)..( 9): Result.002 file - promoters60/1028151
gttttattt

SEQ ID NO: 101798 - DNA, 9 bp, Unknown
  misc_feature (1)..( 9): Result.002 file - promoters60/1028151
tgattattt

SEQ ID NO: 101799 - DNA, 9 bp, Unknown
  misc_feature (1)..( 9): Result.002 file - promoters60/1028151
tgagtattc

SEQ ID NO: 101800 - DNA, 8 bp, Unknown
  misc_feature (1)..( 8): Result.002 file - promoters60/1028151
acagcttt

SEQ ID NO: 101801 - DNA, 8 bp, Unknown
  misc_feature (1)..( 8): Result.002 file - promoters60/1028151
acatcttt

SEQ ID NO: 101802 - DNA, 6 bp, Unknown
  misc_feature (1)..( 6): Result.002 file - promoters60/1028151
tatttt

SEQ ID NO: 101803 - DNA, 6 bp, Unknown
  misc_feature (1)..( 6): Result.002 file - promoters60/1028151
tatttt

SEQ ID NO: 101804 - DNA, 7 bp, Unknown
  misc_feature (1)..( 7): Result.002 file - promoters60/1028151
agatttt

SEQ ID NO: 101805 - DNA, 7 bp, Unknown
  misc_feature (1)..( 7): Result.002 file - promoters60/1028151
agatttt

SEQ ID NO: 101806 - DNA, 7 bp, Unknown
  misc_feature (1)..( 7): Result.002 file - promoters60/1028151
aaagact

SEQ ID NO: 101807 - DNA, 7 bp, Unknown
  misc_feature (1)..( 7): Result.002 file - promoters60/1028151
aaacact

SEQ ID NO: 101808 - DNA, 6 bp, Unknown
  misc_feature (1)..( 6): Result.002 file - promoters60/1028151
tctctc

SEQ ID NO: 101809 - DNA, 6 bp, Unknown
  misc_feature (1)..( 6): Result.002 file - promoters60/1028151
tctctc

SEQ ID NO: 101810 - DNA, 7 bp, Unknown
  misc_feature (1)..( 7): Result.002 file - promoters60/1028151
atgttga

SEQ ID NO: 101811 - DNA, 7 bp, Unknown
  misc_feature (1)..( 7): Result.002 file - promoters60/1028151
atgatga

SEQ ID NO: 101812 - DNA, 8 bp, Unknown
  misc_feature (1)..( 8): Result.002 file - promoters60/1028151
attgtttt

SEQ ID NO: 101813 - DNA, 8 bp, Unknown
  misc_feature (1)..( 8): Result.002 file - promoters60/1028151
attttttt

SEQ ID NO: 101814 - DNA, 8 bp, Unknown
  misc_feature (1)..( 8): Result.002 file - promoters60/1028151
aagatgat

SEQ ID NO: 101815 - DNA, 8 bp, Unknown
  misc_feature (1)..( 8): Result.002 file - promoters60/1028151
aagaggat

SEQ ID NO: 101816 - DNA, 10 bp, Unknown
  misc_feature (1)..( 10): Result.002 file - promoters60/1028151
tttatttata

SEQ ID NO: 101817 - DNA, 10 bp, Unknown
  misc_feature (1)..( 10): Result.002 file - promoters60/1028151
tttttttata

SEQ ID NO: 101818 - DNA, 7 bp, Unknown
  misc_feature (1)..( 7): Result.002 file - promoters60/1028151
tcttaaa

SEQ ID NO: 101819 - DNA, 7 bp, Unknown
  misc_feature (1)..( 7): Result.002 file - promoters60/1028151
tctaaaa

SEQ ID NO: 101820 - DNA, 7 bp, Unknown
  misc_feature (1)..( 7): Result.002 file - promoters60/1028177
tatttta

SEQ ID NO: 101821 - DNA, 7 bp, Unknown
  misc_feature (1)..( 7): Result.002 file - promoters60/1028177
gatttta

SEQ ID NO: 101822 - DNA, 7 bp, Unknown
  misc_feature (1)..( 7): Result.002 file - promoters60/1028177
gattttt

SEQ ID NO: 101823 - DNA, 8 bp, Unknown
  misc_feature (1)..( 8): Result.002 file - promoters60/1028177
ttggccaa

SEQ ID NO: 101824 - DNA, 8 bp, Unknown
  misc_feature (1)..( 8): Result.002 file - promoters60/1028177
ttggacaa

SEQ ID NO: 101825 - DNA, 11 bp, Unknown
  misc_feature (1)..( 11): Result.002 file - promoters60/1028177
ctatcaatttt

SEQ ID NO: 101826 - DNA, 11 bp, Unknown
  misc_feature (1)..( 11): Result.002 file - promoters60/1028177
ctatcaatttt

SEQ ID NO: 101827 - DNA, 9 bp, Unknown
  misc_feature (1)..( 9): Result.002 file - promoters60/1028177
tgatttctt

SEQ ID NO: 101828 - DNA, 9 bp, Unknown
  misc_feature (1)..( 9): Result.002 file - promoters60/1028177
tgatttctt

SEQ ID NO: 101829 - DNA, 7 bp, Unknown
  misc_feature (1)..( 7): Result.002 file - promoters60/1028177
gatatgt

SEQ ID NO: 101830 - DNA, 7 bp, Unknown
  misc_feature (1)..( 7): Result.002 file - promoters60/1028177
gatttgt

SEQ ID NO: 101831 - DNA, 9 bp, Unknown
  misc_feature (1)..( 9): Result.002 file - promoters60/1028177
gttctatgg

SEQ ID NO: 101832 - DNA, 9 bp, Unknown
  misc_feature (1)..( 9): Result.002 file - promoters60/1028177
gttctaact

SEQ ID NO: 101833 - DNA, 9 bp, Unknown
  misc_feature (1)..( 9): Result.002 file - promoters60/1028177
cttcttact

SEQ ID NO: 101834 - DNA, 7 bp, Unknown
  misc_feature (1)..( 7): Result.002 file - promoters60/1028177
ctaagta

SEQ ID NO: 101835 - DNA, 7 bp, Unknown
  misc_feature (1)..( 7): Result.002 file - promoters60/1028177
ctatgta

SEQ ID NO: 101836 - DNA, 6 bp, Unknown
  misc_feature (1)..( 6): Result.002 file - promoters60/1028177
aactct

SEQ ID NO: 101837 - DNA, 6 bp, Unknown
  misc_feature (1)..( 6): Result.002 file - promoters60/1028177
aactct

SEQ ID NO: 101838 - DNA, 8 bp, Unknown
  misc_feature (1)..( 8): Result.002 file - promoters60/1028177
gttgtact

SEQ ID NO: 101839 - DNA, 8 bp, Unknown
  misc_feature (1)..( 8): Result.002 file - promoters60/1028177
gttctact

SEQ ID NO: 101840 - DNA, 8 bp, Unknown
  misc_feature (1)..( 8): Result.002 file - promoters60/1028177
aggatttg

SEQ ID NO: 101841 - DNA, 8 bp, Unknown
  misc_feature (1)..( 8): Result.002 file - promoters60/1028177
tggatttg

SEQ ID NO: 101842 - DNA, 8 bp, Unknown
  misc_feature (1)..( 8): Result.002 file - promoters60/1028177
tggtttta

SEQ ID NO: 101843 - DNA, 6 bp, Unknown
  misc_feature (1)..( 6): Result.002 file - promoters60/1028177
tttttt

SEQ ID NO: 101844 - DNA, 6 bp, Unknown
  misc_feature (1)..( 6): Result.002 file - promoters60/1028177
tttttt

SEQ ID NO: 101845 - DNA, 7 bp, Unknown
  misc_feature (1)..( 7): Result.002 file - promoters60/1028177
ttatttt

SEQ ID NO: 101846 - DNA, 7 bp, Unknown
  misc_feature (1)..( 7): Result.002 file - promoters60/1028177
ttagttt

SEQ ID NO: 101847 - DNA, 7 bp, Unknown
  misc_feature (1)..( 7): Result.002 file - promoters60/1028177
tctaaaa

SEQ ID NO: 101848 - DNA, 7 bp, Unknown
  misc_feature (1)..( 7): Result.002 file - promoters60/1028177
tcttaaa

SEQ ID NO: 101849 - DNA, 6 bp, Unknown
  misc_feature (1)..( 6): Result.002 file - promoters60/1028177
tagaaa

SEQ ID NO: 101850 - DNA, 6 bp, Unknown
  misc_feature (1)..( 6): Result.002 file - promoters60/1028177
tagaaa

SEQ ID NO: 101851 - DNA, 8 bp, Unknown
  misc_feature (1)..( 8): Result.002 file - promoters60/1028177
cctagaat

SEQ ID NO: 101852 - DNA, 8 bp, Unknown
  misc_feature (1)..( 8): Result.002 file - promoters60/1028177
cctggaat

SEQ ID NO: 101853 - DNA, 6 bp, Unknown
  misc_feature (1)..( 6): Result.002 file - promoters60/1028224
taagtt

SEQ ID NO: 101854 - DNA, 6 bp, Unknown
  misc_feature (1)..( 6): Result.002 file - promoters60/1028224
taagtt

SEQ ID NO: 101855 - DNA, 7 bp, Unknown
  misc_feature (1)..( 7): Result.002 file - promoters60/1028224
tcgtcaa

SEQ ID NO: 101856 - DNA, 7 bp, Unknown
  misc_feature (1)..( 7): Result.002 file - promoters60/1028224
tcgtcaa

SEQ ID NO: 101857 - DNA, 6 bp, Unknown
  misc_feature (1)..( 6): Result.002 file - promoters60/1028224
caatta

SEQ ID NO: 101858 - DNA, 6 bp, Unknown
  misc_feature (1)..( 6): Result.002 file - promoters60/1028224
caatta

SEQ ID NO: 101859 - DNA, 8 bp, Unknown
  misc_feature (1)..( 8): Result.002 file - promoters60/1028224
taatcagt

SEQ ID NO: 101860 - DNA, 8 bp, Unknown
  misc_feature (1)..( 8): Result.002 file - promoters60/1028224
taatcacg

SEQ ID NO: 101861 - DNA, 8 bp, Unknown
  misc_feature (1)..( 8): Result.002 file - promoters60/1028224
aaattagt

SEQ ID NO: 101862 - DNA, 6 bp, Unknown
  misc_feature (1)..( 6): Result.002 file - promoters60/1028224
acgact

SEQ ID NO: 101863 - DNA, 6 bp, Unknown
  misc_feature (1)..( 6): Result.002 file - promoters60/1028224
acgact

SEQ ID NO: 101864 - DNA, 8 bp, Unknown
  misc_feature (1)..( 8): Result.002 file - promoters60/1028224
atgtttat

SEQ ID NO: 101865 - DNA, 8 bp, Unknown
  misc_feature (1)..( 8): Result.002 file - promoters60/1028224
atgttttg

SEQ ID NO: 101866 - DNA, 8 bp, Unknown
  misc_feature (1)..( 8): Result.002 file - promoters60/1028224
ctgtttat

SEQ ID NO: 101867 - DNA, 6 bp, Unknown
  misc_feature (1)..( 6): Result.002 file - promoters60/1028224
ttaaaa

SEQ ID NO: 101868 - DNA, 6 bp, Unknown
  misc_feature (1)..( 6): Result.002 file - promoters60/1028224
ttaaaa

SEQ ID NO: 101869 - DNA, 8 bp, Unknown
  misc_feature (1)..( 8): Result.002 file - promoters60/1028224
ttatgttt

SEQ ID NO: 101870 - DNA, 8 bp, Unknown
  misc_feature (1)..( 8): Result.002 file - promoters60/1028224
ttatgtat

SEQ ID NO: 101871 - DNA, 8 bp, Unknown
  misc_feature (1)..( 8): Result.002 file - promoters60/1028224
atattttt

SEQ ID NO: 101872 - DNA, 6 bp, Unknown
  misc_feature (1)..( 6): Result.002 file - promoters60/1028224
tataaa

SEQ ID NO: 101873 - DNA, 6 bp, Unknown
  misc_feature (1)..( 6): Result.002 file - promoters60/1028224
tataaa

SEQ ID NO: 101874 - DNA, 7 bp, Unknown
  misc_feature (1)..( 7): Result.002 file - promoters60/1028224
acaattt

SEQ ID NO: 101875 - DNA, 7 bp, Unknown
  misc_feature (1)..( 7): Result.002 file - promoters60/1028224
acatttt

SEQ ID NO: 101876 - DNA, 7 bp, Unknown
  misc_feature (1)..( 7): Result.002 file - promoters60/1028224
taatata

SEQ ID NO: 101877 - DNA, 7 bp, Unknown
  misc_feature (1)..( 7): Result.002 file - promoters60/1028224
taaaata

SEQ ID NO: 101878 - DNA, 6 bp, Unknown
  misc_feature (1)..( 6): Result.002 file - promoters60/1028224
tttcat

SEQ ID NO: 101879 - DNA, 6 bp, Unknown
  misc_feature (1)..( 6): Result.002 file - promoters60/1028224
tttcat

SEQ ID NO: 101880 - DNA, 6 bp, Unknown
  misc_feature (1)..( 6): Result.002 file - promoters60/1028224
tgaaat

SEQ ID NO: 101881 - DNA, 6 bp, Unknown
  misc_feature (1)..( 6): Result.002 file - promoters60/1028224
tgaaat

SEQ ID NO: 101882 - DNA, 7 bp, Unknown
  misc_feature (1)..( 7): Result.002 file - promoters60/1028224
gtttaaa

SEQ ID NO: 101883 - DNA, 7 bp, Unknown
  misc_feature (1)..( 7): Result.002 file - promoters60/1028224
gttgaaa

SEQ ID NO: 101884 - DNA, 7 bp, Unknown
  misc_feature (1)..( 7): Result.002 file - promoters60/1028224
gtttttt

SEQ ID NO: 101885 - DNA, 7 bp, Unknown
  misc_feature (1)..( 7): Result.002 file - promoters60/1028224
gtttttt

SEQ ID NO: 101886 - DNA, 7 bp, Unknown
  misc_feature (1)..( 7): Result.002 file - promoters60/1028224
ggtcaac

SEQ ID NO: 101887 - DNA, 7 bp, Unknown
  misc_feature (1)..( 7): Result.002 file - promoters60/1028224
ggtaaac

SEQ ID NO: 101888 - DNA, 6 bp, Unknown
  misc_feature (1)..( 6): Result.002 file - promoters60/1028224
atttga

SEQ ID NO: 101889 - DNA, 6 bp, Unknown
  misc_feature (1)..( 6): Result.002 file - promoters60/1028224
atttga

SEQ ID NO: 101890 - DNA, 6 bp, Unknown
  misc_feature (1)..( 6): Result.002 file - promoters60/1028224
taaatt

SEQ ID NO: 101891 - DNA, 6 bp, Unknown
  misc_feature (1)..( 6): Result.002 file - promoters60/1028224
taaatt

SEQ ID NO: 101892 - DNA, 6 bp, Unknown
  misc_feature (1)..( 6): Result.002 file - promoters60/1028224
taatct

SEQ ID NO: 101893 - DNA, 6 bp, Unknown
  misc_feature (1)..( 6): Result.002 file - promoters60/1028224
taatct

SEQ ID NO: 101894 - DNA, 9 bp, Unknown
  misc_feature (1)..( 9): Result.002 file - promoters60/1028224
taaccattt

SEQ ID NO: 101895 - DNA, 9 bp, Unknown
  misc_feature (1)..( 9): Result.002 file - promoters60/1028224
taaccattt

SEQ ID NO: 101896 - DNA, 7 bp, Unknown
  misc_feature (1)..( 7): Result.002 file - promoters60/1028224
tattgtt

SEQ ID NO: 101897 - DNA, 7 bp, Unknown
  misc_feature (1)..( 7): Result.002 file - promoters60/1028224
tatagtt

SEQ ID NO: 101898 - DNA, 11 bp, Unknown
  misc_feature (1)..( 11): Result.002 file - promoters60/1028224
aaacttcatct

SEQ ID NO: 101899 - DNA, 11 bp, Unknown
  misc_feature (1)..( 11): Result.002 file - promoters60/1028224
aaagttcatct

SEQ ID NO: 101900 - DNA, 7 bp, Unknown
  misc_feature (1)..( 7): Result.002 file - promoters60/1028224
tatatgt

SEQ ID NO: 101901 - DNA, 7 bp, Unknown
  misc_feature (1)..( 7): Result.002 file - promoters60/1028224
tatgtgt

SEQ ID NO: 101902 - DNA, 7 bp, Unknown
  misc_feature (1)..( 7): Result.002 file - promoters60/1028224
taagatt

SEQ ID NO: 101903 - DNA, 7 bp, Unknown
  misc_feature (1)..( 7): Result.002 file - promoters60/1028224
taagatt

SEQ ID NO: 101904 - DNA, 7 bp, Unknown
  misc_feature (1)..( 7): Result.002 file - promoters60/1028224
tggttat

SEQ ID NO: 101905 - DNA, 7 bp, Unknown
  misc_feature (1)..( 7): Result.002 file - promoters60/1028224
tggatat

SEQ ID NO: 101906 - DNA, 10 bp, Unknown
  misc_feature (1)..( 10): Result.002 file - promoters60/1028243
actataaaac

SEQ ID NO: 101907 - DNA, 10 bp, Unknown
  misc_feature (1)..( 10): Result.002 file - promoters60/1028243
tatataaaga

SEQ ID NO: 101908 - DNA, 10 bp, Unknown
  misc_feature (1)..( 10): Result.002 file - promoters60/1028243
tatataaaag

SEQ ID NO: 101909 - DNA, 10 bp, Unknown
  misc_feature (1)..( 10): Result.002 file - promoters60/1028243
catacaaaga

SEQ ID NO: 101910 - DNA, 10 bp, Unknown
  misc_feature (1)..( 10): Result.002 file - promoters60/1028243
tatataaatg

SEQ ID NO: 101911 - DNA, 10 bp, Unknown
  misc_feature (1)..( 10): Result.002 file - promoters60/1028243
tatttaaggc

SEQ ID NO: 101912 - DNA, 11 bp, Unknown
  misc_feature (1)..( 11): Result.002 file - promoters60/1028243
acacgtttgta

SEQ ID NO: 101913 - DNA, 11 bp, Unknown
  misc_feature (1)..( 11): Result.002 file - promoters60/1028243
acaagttaatt

SEQ ID NO: 101914 - DNA, 11 bp, Unknown
  misc_feature (1)..( 11): Result.002 file - promoters60/1028243
acatgttattc

SEQ ID NO: 101915 - DNA, 11 bp, Unknown
  misc_feature (1)..( 11): Result.002 file - promoters60/1028243
tcaatttaaaa

SEQ ID NO: 101916 - DNA, 11 bp, Unknown
  misc_feature (1)..( 11): Result.002 file - promoters60/1028243
aaaatataaaa

SEQ ID NO: 101917 - DNA, 11 bp, Unknown
  misc_feature (1)..( 11): Result.002 file - promoters60/1028243
tgaatttaaat

SEQ ID NO: 101918 - DNA, 6 bp, Unknown
  misc_feature (1)..( 6): Result.002 file - promoters60/1028273
gccaat

SEQ ID NO: 101919 - DNA, 6 bp, Unknown
  misc_feature (1)..( 6): Result.002 file - promoters60/1028273
gccaat

SEQ ID NO: 101920 - DNA, 6 bp, Unknown
  misc_feature (1)..( 6): Result.002 file - promoters60/1028273
gcagag

SEQ ID NO: 101921 - DNA, 6 bp, Unknown
  misc_feature (1)..( 6): Result.002 file - promoters60/1028273
gcagag

SEQ ID NO: 101922 - DNA, 6 bp, Unknown
  misc_feature (1)..( 6): Result.002 file - promoters60/1028273
ttaaag

SEQ ID NO: 101923 - DNA, 6 bp, Unknown
  misc_feature (1)..( 6): Result.002 file - promoters60/1028273
ttaaag

SEQ ID NO: 101924 - DNA, 8 bp, Unknown
  misc_feature (1)..( 8): Result.002 file - promoters60/1028273
aattctaa

SEQ ID NO: 101925 - DNA, 8 bp, Unknown
  misc_feature (1)..( 8): Result.002 file - promoters60/1028273
aattttaa

SEQ ID NO: 101926 - DNA, 7 bp, Unknown
  misc_feature (1)..( 7): Result.002 file - promoters60/1028273
aatcgga

SEQ ID NO: 101927 - DNA, 7 bp, Unknown
  misc_feature (1)..( 7): Result.002 file - promoters60/1028273
aatcgga

SEQ ID NO: 101928 - DNA, 11 bp, Unknown
  misc_feature (1)..( 11): Result.002 file - promoters60/1028273
agagagtgaag

SEQ ID NO: 101929 - DNA, 11 bp, Unknown
  misc_feature (1)..( 11): Result.002 file - promoters60/1028273
agacagtgaag

SEQ ID NO: 101930 - DNA, 6 bp, Unknown
  misc_feature (1)..( 6): Result.002 file - promoters60/1028273
aagtgt

SEQ ID NO: 101931 - DNA, 6 bp, Unknown
  misc_feature (1)..( 6): Result.002 file - promoters60/1028273
aagtgt

SEQ ID NO: 101932 - DNA, 6 bp, Unknown
  misc_feature (1)..( 6): Result.002 file - promoters60/1028273
atatat

SEQ ID NO: 101933 - DNA, 6 bp, Unknown
  misc_feature (1)..( 6): Result.002 file - promoters60/1028273
atatat

SEQ ID NO: 101934 - DNA, 7 bp, Unknown
  misc_feature (1)..( 7): Result.002 file - promoters60/1028273
acaatac

SEQ ID NO: 101935 - DNA, 7 bp, Unknown
  misc_feature (1)..( 7): Result.002 file - promoters60/1028273
acaatac

SEQ ID NO: 101936 - DNA, 9 bp, Unknown
  misc_feature (1)..( 9): Result.002 file - promoters60/1028273
atacaaata

SEQ ID NO: 101937 - DNA, 9 bp, Unknown
  misc_feature (1)..( 9): Result.002 file - promoters60/1028273
atacacata

SEQ ID NO: 101938 - DNA, 6 bp, Unknown
  misc_feature (1)..( 6): Result.002 file - promoters60/1028273
tcaaat

SEQ ID NO: 101939 - DNA, 6 bp, Unknown
  misc_feature (1)..( 6): Result.002 file - promoters60/1028273
tcaaat

SEQ ID NO: 101940 - DNA, 6 bp, Unknown
  misc_feature (1)..( 6): Result.002 file - promoters60/1028273
gagcag

SEQ ID NO: 101941 - DNA, 6 bp, Unknown
  misc_feature (1)..( 6): Result.002 file - promoters60/1028273
gagcag

SEQ ID NO: 101942 - DNA, 7 bp, Unknown
  misc_feature (1)..( 7): Result.002 file - promoters60/1028273
gaattaa

SEQ ID NO: 101943 - DNA, 7 bp, Unknown
  misc_feature (1)..( 7): Result.002 file - promoters60/1028273
gaaataa

SEQ ID NO: 101944 - DNA, 10 bp, Unknown
  misc_feature (1)..( 10): Result.002 file - promoters60/1028318
ttcttcaaga

SEQ ID NO: 101945 - DNA, 10 bp, Unknown
  misc_feature (1)..( 10): Result.002 file - promoters60/1028318
ttcttaaaga

SEQ ID NO: 101946 - DNA, 10 bp, Unknown
  misc_feature (1)..( 10): Result.002 file - promoters60/1028318
ctcttaataa

SEQ ID NO: 101947 - DNA, 8 bp, Unknown
  misc_feature (1)..( 8): Result.002 file - promoters60/1028318
tattatag

SEQ ID NO: 101948 - DNA, 8 bp, Unknown
  misc_feature (1)..( 8): Result.002 file - promoters60/1028318
tattattt

SEQ ID NO: 101949 - DNA, 8 bp, Unknown
  misc_feature (1)..( 8): Result.002 file - promoters60/1028318
gattcttt

SEQ ID NO: 101950 - DNA, 8 bp, Unknown
  misc_feature (1)..( 8): Result.002 file - promoters60/1028318
acaaataa

SEQ ID NO: 101951 - DNA, 8 bp, Unknown
  misc_feature (1)..( 8): Result.002 file - promoters60/1028318
ataaataa

SEQ ID NO: 101952 - DNA, 8 bp, Unknown
  misc_feature (1)..( 8): Result.002 file - promoters60/1028318
ataaatac

SEQ ID NO: 101953 - DNA, 8 bp, Unknown
  misc_feature (1)..( 8): Result.002 file - promoters60/1028318
aatctttt

SEQ ID NO: 101954 - DNA, 8 bp, Unknown
  misc_feature (1)..( 8): Result.002 file - promoters60/1028318
catcgttt

SEQ ID NO: 101955 - DNA, 8 bp, Unknown
  misc_feature (1)..( 8): Result.002 file - promoters60/1028318
catcgtcg

SEQ ID NO: 101956 - DNA, 14 bp, Unknown
  misc_feature (1)..( 14): Result.002 file - promoters60/1028368
ggagcaaataaatt

SEQ ID NO: 101957 - DNA, 14 bp, Unknown
  misc_feature (1)..( 14): Result.002 file - promoters60/1028368
agtgacaatacatt

SEQ ID NO: 101958 - DNA, 14 bp, Unknown
  misc_feature (1)..( 14): Result.002 file - promoters60/1028368
gagattaaaaaaag

SEQ ID NO: 101959 - DNA, 14 bp, Unknown
  misc_feature (1)..( 14): Result.002 file - promoters60/1028368
cagctaaacaaaaa

SEQ ID NO: 101960 - DNA, 14 bp, Unknown
  misc_feature (1)..( 14): Result.002 file - promoters60/1028368
tcaaagaatacaca

SEQ ID NO: 101961 - DNA, 14 bp, Unknown
  misc_feature (1)..( 14): Result.002 file - promoters60/1028368
agactaaaaactct

SEQ ID NO: 101962 - DNA, 14 bp, Unknown
  misc_feature (1)..( 14): Result.002 file - promoters60/1028368
aacccaactacaaa

SEQ ID NO: 101963 - DNA, 10 bp, Unknown
  misc_feature (1)..( 10): Result.002 file - promoters60/1028368
taattaaact

SEQ ID NO: 101964 - DNA, 10 bp, Unknown
  misc_feature (1)..( 10): Result.002 file - promoters60/1028368
agattaaaaa

SEQ ID NO: 101965 - DNA, 10 bp, Unknown
  misc_feature (1)..( 10): Result.002 file - promoters60/1028368
gacttaaaat

SEQ ID NO: 101966 - DNA, 10 bp, Unknown
  misc_feature (1)..( 10): Result.002 file - promoters60/1028368
agactaaaaa

SEQ ID NO: 101967 - DNA, 10 bp, Unknown
  misc_feature (1)..( 10): Result.002 file - promoters60/1028368
atactaaaaa

SEQ ID NO: 101968 - DNA, 10 bp, Unknown
  misc_feature (1)..( 10): Result.002 file - promoters60/1028368
caactacaaa

SEQ ID NO: 101969 - DNA, 14 bp, Unknown
  misc_feature (1)..( 14): Result.002 file - promoters60/1028413
accaaatctaaatt

SEQ ID NO: 101970 - DNA, 14 bp, Unknown
  misc_feature (1)..( 14): Result.002 file - promoters60/1028413
cttcaatttaactg

SEQ ID NO: 101971 - DNA, 14 bp, Unknown
  misc_feature (1)..( 14): Result.002 file - promoters60/1028413
atttcatttttaaa

SEQ ID NO: 101972 - DNA, 14 bp, Unknown
  misc_feature (1)..( 14): Result.002 file - promoters60/1028413
aatatattttgaaa

SEQ ID NO: 101973 - DNA, 14 bp, Unknown
  misc_feature (1)..( 14): Result.002 file - promoters60/1028413
taattatttttggc

SEQ ID NO: 101974 - DNA, 14 bp, Unknown
  misc_feature (1)..( 14): Result.002 file - promoters60/1028413
taatgatttggggt

SEQ ID NO: 101975 - DNA, 13 bp, Unknown
  misc_feature (1)..( 13): Result.002 file - promoters60/1028413
ctaaattcttata

SEQ ID NO: 101976 - DNA, 13 bp, Unknown
  misc_feature (1)..( 13): Result.002 file - promoters60/1028413
tttcatttttaaa

SEQ ID NO: 101977 - DNA, 13 bp, Unknown
  misc_feature (1)..( 13): Result.002 file - promoters60/1028413
ctaaagtctataa

SEQ ID NO: 101978 - DNA, 13 bp, Unknown
  misc_feature (1)..( 13): Result.002 file - promoters60/1028413
tgacattcttcag

SEQ ID NO: 101979 - DNA, 13 bp, Unknown
  misc_feature (1)..( 13): Result.002 file - promoters60/1028413
ttatcttcaattt

SEQ ID NO: 101980 - DNA, 13 bp, Unknown
  misc_feature (1)..( 13): Result.002 file - promoters60/1028413
atatattttgaaa

SEQ ID NO: 101981 - DNA, 12 bp, Unknown
  misc_feature (1)..( 12): Result.002 file - promoters60/1028470
aataaaattaat

SEQ ID NO: 101982 - DNA, 12 bp, Unknown
  misc_feature (1)..( 12): Result.002 file - promoters60/1028470
gataatatttca

SEQ ID NO: 101983 - DNA, 12 bp, Unknown
  misc_feature (1)..( 12): Result.002 file - promoters60/1028470
tataaaatacag

SEQ ID NO: 101984 - DNA, 12 bp, Unknown
  misc_feature (1)..( 12): Result.002 file - promoters60/1028470
aataaatcttgt

SEQ ID NO: 101985 - DNA, 12 bp, Unknown
  misc_feature (1)..( 12): Result.002 file - promoters60/1028470
taaaaaatcaaa

SEQ ID NO: 101986 - DNA, 12 bp, Unknown
  misc_feature (1)..( 12): Result.002 file - promoters60/1028470
aatattattaac

SEQ ID NO: 101987 - DNA, 12 bp, Unknown
  misc_feature (1)..( 12): Result.002 file - promoters60/1028470
atgaatattttc

SEQ ID NO: 101988 - DNA, 9 bp, Unknown
  misc_feature (1)..( 9): Result.002 file - promoters60/1028470
atttcttta

SEQ ID NO: 101989 - DNA, 9 bp, Unknown
  misc_feature (1)..( 9): Result.002 file - promoters60/1028470
ttttgtttc

SEQ ID NO: 101990 - DNA, 9 bp, Unknown
  misc_feature (1)..( 9): Result.002 file - promoters60/1028470
ctttttttg

SEQ ID NO: 101991 - DNA, 9 bp, Unknown
  misc_feature (1)..( 9): Result.002 file - promoters60/1028470
gtttttttc

SEQ ID NO: 101992 - DNA, 9 bp, Unknown
  misc_feature (1)..( 9): Result.002 file - promoters60/1028470
taatcttta

SEQ ID NO: 101993 - DNA, 9 bp, Unknown
  misc_feature (1)..( 9): Result.002 file - promoters60/1028470
ttttgttaa

SEQ ID NO: 101994 - DNA, 11 bp, Unknown
  misc_feature (1)..( 11): Result.002 file - promoters60/1028470
ttcaaatacaa

SEQ ID NO: 101995 - DNA, 11 bp, Unknown
  misc_feature (1)..( 11): Result.002 file - promoters60/1028470
atcaaataggt

SEQ ID NO: 101996 - DNA, 11 bp, Unknown
  misc_feature (1)..( 11): Result.002 file - promoters60/1028470
ctcaaattcaa

SEQ ID NO: 101997 - DNA, 12 bp, Unknown
  misc_feature (1)..( 12): Result.002 file - promoters60/1028470
atctaaaaaagt

SEQ ID NO: 101998 - DNA, 12 bp, Unknown
  misc_feature (1)..( 12): Result.002 file - promoters60/1028470
tttcaataaccg

SEQ ID NO: 101999 - DNA, 12 bp, Unknown
  misc_feature (1)..( 12): Result.002 file - promoters60/1028470
tttcaactttgg

SEQ ID NO: 102000 - DNA, 11 bp, Unknown
  misc_feature (1)..( 11): Result.002 file - promoters60/1028470
ccgttaaaaat

SEQ ID NO: 102001 - DNA, 11 bp, Unknown
  misc_feature (1)..( 11): Result.002 file - promoters60/1028470
ataataaaaaa

SEQ ID NO: 102002 - DNA, 11 bp, Unknown
  misc_feature (1)..( 11): Result.002 file - promoters60/1028470
gatctaaaaaa

SEQ ID NO: 102003 - DNA, 11 bp, Unknown
  misc_feature (1)..( 11): Result.002 file - promoters60/1028470
cgtttaaataa

SEQ ID NO: 102004 - DNA, 11 bp, Unknown
  misc_feature (1)..( 11): Result.002 file - promoters60/1028470
cccagaaaaaa

SEQ ID NO: 102005 - DNA, 11 bp, Unknown
  misc_feature (1)..( 11): Result.002 file - promoters60/1028470
tgtctcaaatt

SEQ ID NO: 102006 - DNA, 7 bp, Unknown
  misc_feature (1)..( 7): Result.002 file - promoters60/1028508
tcttctt

SEQ ID NO: 102007 - DNA, 7 bp, Unknown
  misc_feature (1)..( 7): Result.002 file - promoters60/1028508
tcttctt

SEQ ID NO: 102008 - DNA, 7 bp, Unknown
  misc_feature (1)..( 7): Result.002 file - promoters60/1028508
caaacaa

SEQ ID NO: 102009 - DNA, 7 bp, Unknown
  misc_feature (1)..( 7): Result.002 file - promoters60/1028508
caaccaa

SEQ ID NO: 102010 - DNA, 7 bp, Unknown
  misc_feature (1)..( 7): Result.002 file - promoters60/1028508
aaaaatc

SEQ ID NO: 102011 - DNA, 7 bp, Unknown
  misc_feature (1)..( 7): Result.002 file - promoters60/1028508
aaatatc

SEQ ID NO: 102012 - DNA, 11 bp, Unknown
  misc_feature (1)..( 11): Result.002 file - promoters60/1028508
tctatataaac

SEQ ID NO: 102013 - DNA, 11 bp, Unknown
  misc_feature (1)..( 11): Result.002 file - promoters60/1028508
tctatataaac

SEQ ID NO: 102014 - DNA, 7 bp, Unknown
  misc_feature (1)..( 7): Result.002 file - promoters60/1028508
gtccagt

SEQ ID NO: 102015 - DNA, 7 bp, Unknown
  misc_feature (1)..( 7): Result.002 file - promoters60/1028508
gtcaagt

SEQ ID NO: 102016 - DNA, 6 bp, Unknown
  misc_feature (1)..( 6): Result.002 file - promoters60/1028508
ttggaa

SEQ ID NO: 102017 - DNA, 6 bp, Unknown
  misc_feature (1)..( 6): Result.002 file - promoters60/1028508
ttggaa

SEQ ID NO: 102018 - DNA, 8 bp, Unknown
  misc_feature (1)..( 8): Result.002 file - promoters60/1028508
tcataaaa

SEQ ID NO: 102019 - DNA, 8 bp, Unknown
  misc_feature (1)..( 8): Result.002 file - promoters60/1028508
tcagaaaa

SEQ ID NO: 102020 - DNA, 7 bp, Unknown
  misc_feature (1)..( 7): Result.002 file - promoters60/1028508
aaaacaa

SEQ ID NO: 102021 - DNA, 7 bp, Unknown
  misc_feature (1)..( 7): Result.002 file - promoters60/1028508
aaagcaa

SEQ ID NO: 102022 - DNA, 12 bp, Unknown
  misc_feature (1)..( 12): Result.002 file - promoters60/1028508
taatggatctac

SEQ ID NO: 102023 - DNA, 12 bp, Unknown
  misc_feature (1)..( 12): Result.002 file - promoters60/1028508
taatagatttac

SEQ ID NO: 102024 - DNA, 6 bp, Unknown
  misc_feature (1)..( 6): Result.002 file - promoters60/1028508
aaaaaa

SEQ ID NO: 102025 - DNA, 6 bp, Unknown
  misc_feature (1)..( 6): Result.002 file - promoters60/1028508
aaaaaa

SEQ ID NO: 102026 - DNA, 6 bp, Unknown
  misc_feature (1)..( 6): Result.002 file - promoters60/1028508
tttggc

SEQ ID NO: 102027 - DNA, 6 bp, Unknown
  misc_feature (1)..( 6): Result.002 file - promoters60/1028508
tttggc

SEQ ID NO: 102028 - DNA, 6 bp, Unknown
  misc_feature (1)..( 6): Result.002 file - promoters60/1028508
tatgga

SEQ ID NO: 102029 - DNA, 6 bp, Unknown
  misc_feature (1)..( 6): Result.002 file - promoters60/1028508
tatgga

SEQ ID NO: 102030 - DNA, 7 bp, Unknown
  misc_feature (1)..( 7): Result.002 file - promoters60/1028508
tggacgt

SEQ ID NO: 102031 - DNA, 7 bp, Unknown
  misc_feature (1)..( 7): Result.002 file - promoters60/1028508
tggccgt

SEQ ID NO: 102032 - DNA, 6 bp, Unknown
  misc_feature (1)..( 6): Result.002 file - promoters60/1028508
tggaat

SEQ ID NO: 102033 - DNA, 6 bp, Unknown
  misc_feature (1)..( 6): Result.002 file - promoters60/1028508
tggaat

SEQ ID NO: 102034 - DNA, 7 bp, Unknown
  misc_feature (1)..( 7): Result.002 file - promoters60/1028508
ttctact

SEQ ID NO: 102035 - DNA, 7 bp, Unknown
  misc_feature (1)..( 7): Result.002 file - promoters60/1028508
ttcaact

SEQ ID NO: 102036 - DNA, 7 bp, Unknown
  misc_feature (1)..( 7): Result.002 file - promoters60/1028508
cttttaa

SEQ ID NO: 102037 - DNA, 7 bp, Unknown
  misc_feature (1)..( 7): Result.002 file - promoters60/1028508
cttgtaa

SEQ ID NO: 102038 - DNA, 9 bp, Unknown
  misc_feature (1)..( 9): Result.002 file - promoters60/1028508
ttctcaaaa

SEQ ID NO: 102039 - DNA, 9 bp, Unknown
  misc_feature (1)..( 9): Result.002 file - promoters60/1028508
ttcttaaaa

SEQ ID NO: 102040 - DNA, 6 bp, Unknown
  misc_feature (1)..( 6): Result.002 file - promoters60/1028508
aaattg

SEQ ID NO: 102041 - DNA, 6 bp, Unknown
  misc_feature (1)..( 6): Result.002 file - promoters60/1028508
aaattg

SEQ ID NO: 102042 - DNA, 8 bp, Unknown
  misc_feature (1)..( 8): Result.002 file - promoters60/1028508
accagcga

SEQ ID NO: 102043 - DNA, 8 bp, Unknown
  misc_feature (1)..( 8): Result.002 file - promoters60/1028508
accagcga

SEQ ID NO: 102044 - DNA, 8 bp, Unknown
  misc_feature (1)..( 8): Result.002 file - promoters60/1028508
aaagaaaa

SEQ ID NO: 102045 - DNA, 8 bp, Unknown
  misc_feature (1)..( 8): Result.002 file - promoters60/1028508
aaaaaaaa

SEQ ID NO: 102046 - DNA, 11 bp, Unknown
  misc_feature (1)..( 11): Result.002 file - promoters60/1028545
ttatattaaaa

SEQ ID NO: 102047 - DNA, 11 bp, Unknown
  misc_feature (1)..( 11): Result.002 file - promoters60/1028545
ttattttaatt

SEQ ID NO: 102048 - DNA, 11 bp, Unknown
  misc_feature (1)..( 11): Result.002 file - promoters60/1028545
agttttgaatt

SEQ ID NO: 102049 - DNA, 11 bp, Unknown
  misc_feature (1)..( 11): Result.002 file - promoters60/1028545
ttatgtattca

SEQ ID NO: 102050 - DNA, 11 bp, Unknown
  misc_feature (1)..( 11): Result.002 file - promoters60/1028545
ttaagtagatt

SEQ ID NO: 102051 - DNA, 11 bp, Unknown
  misc_feature (1)..( 11): Result.002 file - promoters60/1028545
cgaagaagatt

SEQ ID NO: 102052 - DNA, 8 bp, Unknown
  misc_feature (1)..( 8): Result.002 file - promoters60/1028545
aaatttta

SEQ ID NO: 102053 - DNA, 8 bp, Unknown
  misc_feature (1)..( 8): Result.002 file - promoters60/1028545
aaatatta

SEQ ID NO: 102054 - DNA, 8 bp, Unknown
  misc_feature (1)..( 8): Result.002 file - promoters60/1028545
aaatttgt

SEQ ID NO: 102055 - DNA, 8 bp, Unknown
  misc_feature (1)..( 8): Result.002 file - promoters60/1028545
gtccttta

SEQ ID NO: 102056 - DNA, 8 bp, Unknown
  misc_feature (1)..( 8): Result.002 file - promoters60/1028545
gtcttttt

SEQ ID NO: 102057 - DNA, 8 bp, Unknown
  misc_feature (1)..( 8): Result.002 file - promoters60/1028545
cacttttt

SEQ ID NO: 102058 - DNA, 8 bp, Unknown
  misc_feature (1)..( 8): Result.002 file - promoters60/1028545
ctaatttc

SEQ ID NO: 102059 - DNA, 8 bp, Unknown
  misc_feature (1)..( 8): Result.002 file - promoters60/1028545
aaaatttc

SEQ ID NO: 102060 - DNA, 8 bp, Unknown
  misc_feature (1)..( 8): Result.002 file - promoters60/1028545
ctaatttg

SEQ ID NO: 102061 - DNA, 11 bp, Unknown
  misc_feature (1)..( 11): Result.002 file - promoters60/1028545
gcaagtatata

SEQ ID NO: 102062 - DNA, 11 bp, Unknown
  misc_feature (1)..( 11): Result.002 file - promoters60/1028545
acaagaatata

SEQ ID NO: 102063 - DNA, 11 bp, Unknown
  misc_feature (1)..( 11): Result.002 file - promoters60/1028545
acaagatcaag

SEQ ID NO: 102064 - DNA, 7 bp, Unknown
  misc_feature (1)..( 7): Result.002 file - promoters60/1028549
tctgtat

SEQ ID NO: 102065 - DNA, 7 bp, Unknown
  misc_feature (1)..( 7): Result.002 file - promoters60/1028549
tctatat

SEQ ID NO: 102066 - DNA, 7 bp, Unknown
  misc_feature (1)..( 7): Result.002 file - promoters60/1028549
aaatcga

SEQ ID NO: 102067 - DNA, 7 bp, Unknown
  misc_feature (1)..( 7): Result.002 file - promoters60/1028549
aaatcga

SEQ ID NO: 102068 - DNA, 7 bp, Unknown
  misc_feature (1)..( 7): Result.002 file - promoters60/1028549
acttttg

SEQ ID NO: 102069 - DNA, 7 bp, Unknown
  misc_feature (1)..( 7): Result.002 file - promoters60/1028549
actgttg

SEQ ID NO: 102070 - DNA, 6 bp, Unknown
  misc_feature (1)..( 6): Result.002 file - promoters60/1028549
tttaaa

SEQ ID NO: 102071 - DNA, 6 bp, Unknown
  misc_feature (1)..( 6): Result.002 file - promoters60/1028549
tttaaa

SEQ ID NO: 102072 - DNA, 6 bp, Unknown
  misc_feature (1)..( 6): Result.002 file - promoters60/1028549
gtgaaa

SEQ ID NO: 102073 - DNA, 6 bp, Unknown
  misc_feature (1)..( 6): Result.002 file - promoters60/1028549
gtgaaa

SEQ ID NO: 102074 - DNA, 7 bp, Unknown
  misc_feature (1)..( 7): Result.002 file - promoters60/1028549
aaaagaa

SEQ ID NO: 102075 - DNA, 7 bp, Unknown
  misc_feature (1)..( 7): Result.002 file - promoters60/1028549
aaaggaa

SEQ ID NO: 102076 - DNA, 7 bp, Unknown
  misc_feature (1)..( 7): Result.002 file - promoters60/1028549
aaaccca

SEQ ID NO: 102077 - DNA, 7 bp, Unknown
  misc_feature (1)..( 7): Result.002 file - promoters60/1028549
aaatcca

SEQ ID NO: 102078 - DNA, 7 bp, Unknown
  misc_feature (1)..( 7): Result.002 file - promoters60/1028549
aactgaa

SEQ ID NO: 102079 - DNA, 7 bp, Unknown
  misc_feature (1)..( 7): Result.002 file - promoters60/1028549
aactgaa

SEQ ID NO: 102080 - DNA, 7 bp, Unknown
  misc_feature (1)..( 7): Result.002 file - promoters60/1028549
tttggtg

SEQ ID NO: 102081 - DNA, 7 bp, Unknown
  misc_feature (1)..( 7): Result.002 file - promoters60/1028549
ttttgtg

SEQ ID NO: 102082 - DNA, 7 bp, Unknown
  misc_feature (1)..( 7): Result.002 file - promoters60/1028549
gtttatc

SEQ ID NO: 102083 - DNA, 7 bp, Unknown
  misc_feature (1)..( 7): Result.002 file - promoters60/1028549
gtttatc

SEQ ID NO: 102084 - DNA, 7 bp, Unknown
  misc_feature (1)..( 7): Result.002 file - promoters60/1028549
atcgtac

SEQ ID NO: 102085 - DNA, 7 bp, Unknown
  misc_feature (1)..( 7): Result.002 file - promoters60/1028549
atcttac

SEQ ID NO: 102086 - DNA, 6 bp, Unknown
  misc_feature (1)..( 6): Result.002 file - promoters60/1028549
ataaat

SEQ ID NO: 102087 - DNA, 6 bp, Unknown
  misc_feature (1)..( 6): Result.002 file - promoters60/1028549
ataaat

SEQ ID NO: 102088 - DNA, 7 bp, Unknown
  misc_feature (1)..( 7): Result.002 file - promoters60/1028549
ggtacaa

SEQ ID NO: 102089 - DNA, 7 bp, Unknown
  misc_feature (1)..( 7): Result.002 file - promoters60/1028549
ggttcaa

SEQ ID NO: 102090 - DNA, 8 bp, Unknown
  misc_feature (1)..( 8): Result.002 file - promoters60/1028549
cagtggat

SEQ ID NO: 102091 - DNA, 8 bp, Unknown
  misc_feature (1)..( 8): Result.002 file - promoters60/1028549
cagttgat

SEQ ID NO: 102092 - DNA, 9 bp, Unknown
  misc_feature (1)..( 9): Result.002 file - promoters60/1028590
atgattatc

SEQ ID NO: 102093 - DNA, 9 bp, Unknown
  misc_feature (1)..( 9): Result.002 file - promoters60/1028590
atgattatc

SEQ ID NO: 102094 - DNA, 8 bp, Unknown
  misc_feature (1)..( 8): Result.002 file - promoters60/1028590
aaaatact

SEQ ID NO: 102095 - DNA, 8 bp, Unknown
  misc_feature (1)..( 8): Result.002 file - promoters60/1028590
aaaaaact

SEQ ID NO: 102096 - DNA, 7 bp, Unknown
  misc_feature (1)..( 7): Result.002 file - promoters60/1028590
cttctta

SEQ ID NO: 102097 - DNA, 7 bp, Unknown
  misc_feature (1)..( 7): Result.002 file - promoters60/1028590
tttctta

SEQ ID NO: 102098 - DNA, 8 bp, Unknown
  misc_feature (1)..( 8): Result.002 file - promoters60/1028590
tttacttt

SEQ ID NO: 102099 - DNA, 8 bp, Unknown
  misc_feature (1)..( 8): Result.002 file - promoters60/1028590
caaccttg

SEQ ID NO: 102100 - DNA, 8 bp, Unknown
  misc_feature (1)..( 8): Result.002 file - promoters60/1028590
caactttg

SEQ ID NO: 102101 - DNA, 6 bp, Unknown
  misc_feature (1)..( 6): Result.002 file - promoters60/1028590
atcaag

SEQ ID NO: 102102 - DNA, 6 bp, Unknown
  misc_feature (1)..( 6): Result.002 file - promoters60/1028590
atcaag

SEQ ID NO: 102103 - DNA, 9 bp, Unknown
  misc_feature (1)..( 9): Result.002 file - promoters60/1028590
aactaaata

SEQ ID NO: 102104 - DNA, 9 bp, Unknown
  misc_feature (1)..( 9): Result.002 file - promoters60/1028590
aactatata

SEQ ID NO: 102105 - DNA, 7 bp, Unknown
  misc_feature (1)..( 7): Result.002 file - promoters60/1028590
aactacg

SEQ ID NO: 102106 - DNA, 7 bp, Unknown
  misc_feature (1)..( 7): Result.002 file - promoters60/1028590
aacaacg

SEQ ID NO: 102107 - DNA, 13 bp, Unknown
  misc_feature (1)..( 13): Result.002 file - promoters60/1028590
aaaacaaaaatga

SEQ ID NO: 102108 - DNA, 13 bp, Unknown
  misc_feature (1)..( 13): Result.002 file - promoters60/1028590
aaaacaaaaatga

SEQ ID NO: 102109 - DNA, 13 bp, Unknown
  misc_feature (1)..( 13): Result.002 file - promoters60/1028590
aaaacaaagaacc

SEQ ID NO: 102110 - DNA, 7 bp, Unknown
  misc_feature (1)..( 7): Result.002 file - promoters60/1028590
tactata

SEQ ID NO: 102111 - DNA, 7 bp, Unknown
  misc_feature (1)..( 7): Result.002 file - promoters60/1028590
tacaata

SEQ ID NO: 102112 - DNA, 6 bp, Unknown
  misc_feature (1)..( 6): Result.002 file - promoters60/1028590
ccaaac

SEQ ID NO: 102113 - DNA, 6 bp, Unknown
  misc_feature (1)..( 6): Result.002 file - promoters60/1028590
ccaaac

SEQ ID NO: 102114 - DNA, 8 bp, Unknown
  misc_feature (1)..( 8): Result.002 file - promoters60/1028590
aaaggttg

SEQ ID NO: 102115 - DNA, 8 bp, Unknown
  misc_feature (1)..( 8): Result.002 file - promoters60/1028590
aaaagttg

SEQ ID NO: 102116 - DNA, 10 bp, Unknown
  misc_feature (1)..( 10): Result.002 file - promoters60/1028590
ggtagtatac

SEQ ID NO: 102117 - DNA, 10 bp, Unknown
  misc_feature (1)..( 10): Result.002 file - promoters60/1028590
ggtagaatac

SEQ ID NO: 102118 - DNA, 7 bp, Unknown
  misc_feature (1)..( 7): Result.002 file - promoters60/1028590
tataaat

SEQ ID NO: 102119 - DNA, 7 bp, Unknown
  misc_feature (1)..( 7): Result.002 file - promoters60/1028590
tataaat

SEQ ID NO: 102120 - DNA, 6 bp, Unknown
  misc_feature (1)..( 6): Result.002 file - promoters60/1028590
ttgatg

SEQ ID NO: 102121 - DNA, 6 bp, Unknown
  misc_feature (1)..( 6): Result.002 file - promoters60/1028590
ttgatg

SEQ ID NO: 102122 - DNA, 7 bp, Unknown
  misc_feature (1)..( 7): Result.002 file - promoters60/1028590
tcattca

SEQ ID NO: 102123 - DNA, 7 bp, Unknown
  misc_feature (1)..( 7): Result.002 file - promoters60/1028590
tcaatca

SEQ ID NO: 102124 - DNA, 8 bp, Unknown
  misc_feature (1)..( 8): Result.002 file - promoters60/1028590
ttcatctt

SEQ ID NO: 102125 - DNA, 8 bp, Unknown
  misc_feature (1)..( 8): Result.002 file - promoters60/1028590
ttcatctt

SEQ ID NO: 102126 - DNA, 8 bp, Unknown
  misc_feature (1)..( 8): Result.002 file - promoters60/1028590
tcttctcc

SEQ ID NO: 102127 - DNA, 8 bp, Unknown
  misc_feature (1)..( 8): Result.002 file - promoters60/1028590
tcttctcc

SEQ ID NO: 102128 - DNA, 7 bp, Unknown
  misc_feature (1)..( 7): Result.002 file - promoters60/1028590
attttat

SEQ ID NO: 102129 - DNA, 7 bp, Unknown
  misc_feature (1)..( 7): Result.002 file - promoters60/1028590
attatat

SEQ ID NO: 102130 - DNA, 6 bp, Unknown
  misc_feature (1)..( 6): Result.002 file - promoters60/1028590
ttctta

SEQ ID NO: 102131 - DNA, 6 bp, Unknown
  misc_feature (1)..( 6): Result.002 file - promoters60/1028590
ttctta

SEQ ID NO: 102132 - DNA, 6 bp, Unknown
  misc_feature (1)..( 6): Result.002 file - promoters60/1028590
taatta

SEQ ID NO: 102133 - DNA, 6 bp, Unknown
  misc_feature (1)..( 6): Result.002 file - promoters60/1028590
taatta

SEQ ID NO: 102134 - DNA, 7 bp, Unknown
  misc_feature (1)..( 7): Result.002 file - promoters60/1028674
ttaaaat

SEQ ID NO: 102135 - DNA, 7 bp, Unknown
  misc_feature (1)..( 7): Result.002 file - promoters60/1028674
ttataat

SEQ ID NO: 102136 - DNA, 7 bp, Unknown
  misc_feature (1)..( 7): Result.002 file - promoters60/1028674
ttataag

SEQ ID NO: 102137 - DNA, 11 bp, Unknown
  misc_feature (1)..( 11): Result.002 file - promoters60/1028674
aaatatcaaat

SEQ ID NO: 102138 - DNA, 11 bp, Unknown
  misc_feature (1)..( 11): Result.002 file - promoters60/1028674
ttataacaaat

SEQ ID NO: 102139 - DNA, 11 bp, Unknown
  misc_feature (1)..( 11): Result.002 file - promoters60/1028674
ttagaactaaa

SEQ ID NO: 102140 - DNA, 9 bp, Unknown
  misc_feature (1)..( 9): Result.002 file - promoters60/1028674
aaaatttaa

SEQ ID NO: 102141 - DNA, 9 bp, Unknown
  misc_feature (1)..( 9): Result.002 file - promoters60/1028674
tatatttaa

SEQ ID NO: 102142 - DNA, 9 bp, Unknown
  misc_feature (1)..( 9): Result.002 file - promoters60/1028674
aaaatttac

SEQ ID NO: 102143 - DNA, 9 bp, Unknown
  misc_feature (1)..( 9): Result.002 file - promoters60/1028674
aataattat

SEQ ID NO: 102144 - DNA, 9 bp, Unknown
  misc_feature (1)..( 9): Result.002 file - promoters60/1028674
tttaaagat

SEQ ID NO: 102145 - DNA, 9 bp, Unknown
  misc_feature (1)..( 9): Result.002 file - promoters60/1028674
attagagat

SEQ ID NO: 102146 - DNA, 9 bp, Unknown
  misc_feature (1)..( 9): Result.002 file - promoters60/1028674
tttaaaatc

SEQ ID NO: 102147 - DNA, 9 bp, Unknown
  misc_feature (1)..( 9): Result.002 file - promoters60/1028674
cattaatta

SEQ ID NO: 102148 - DNA, 9 bp, Unknown
  misc_feature (1)..( 9): Result.002 file - promoters60/1028674
atttaatta

SEQ ID NO: 102149 - DNA, 9 bp, Unknown
  misc_feature (1)..( 9): Result.002 file - promoters60/1028674
cattaataa

SEQ ID NO: 102150 - DNA, 8 bp, Unknown
  misc_feature (1)..( 8): Result.002 file - promoters60/1028674
ttgaaaat

SEQ ID NO: 102151 - DNA, 8 bp, Unknown
  misc_feature (1)..( 8): Result.002 file - promoters60/1028674
atgaaaat

SEQ ID NO: 102152 - DNA, 8 bp, Unknown
  misc_feature (1)..( 8): Result.002 file - promoters60/1028674
atgaaatc

SEQ ID NO: 102153 - DNA, 8 bp, Unknown
  misc_feature (1)..( 8): Result.002 file - promoters60/1028674
attaaaaa

SEQ ID NO: 102154 - DNA, 8 bp, Unknown
  misc_feature (1)..( 8): Result.002 file - promoters60/1028674
tttaaaaa

SEQ ID NO: 102155 - DNA, 8 bp, Unknown
  misc_feature (1)..( 8): Result.002 file - promoters60/1028674
tttaaaca

SEQ ID NO: 102156 - DNA, 10 bp, Unknown
  misc_feature (1)..( 10): Result.002 file - promoters60/1028682
ttttcaatta

SEQ ID NO: 102157 - DNA, 10 bp, Unknown
  misc_feature (1)..( 10): Result.002 file - promoters60/1028682
ttttcaaacc

SEQ ID NO: 102158 - DNA, 10 bp, Unknown
  misc_feature (1)..( 10): Result.002 file - promoters60/1028682
gtttcaattc

SEQ ID NO: 102159 - DNA, 10 bp, Unknown
  misc_feature (1)..( 10): Result.002 file - promoters60/1028682
tgatcacttc

SEQ ID NO: 102160 - DNA, 9 bp, Unknown
  misc_feature (1)..( 9): Result.002 file - promoters60/1028682
acatatata

SEQ ID NO: 102161 - DNA, 9 bp, Unknown
  misc_feature (1)..( 9): Result.002 file - promoters60/1028682
ctatatatt

SEQ ID NO: 102162 - DNA, 9 bp, Unknown
  misc_feature (1)..( 9): Result.002 file - promoters60/1028682
atatatata

SEQ ID NO: 102163 - DNA, 9 bp, Unknown
  misc_feature (1)..( 9): Result.002 file - promoters60/1028682
ccatataaa

SEQ ID NO: 102164 - DNA, 9 bp, Unknown
  misc_feature (1)..( 9): Result.002 file - promoters60/1028682
ctataaatt

SEQ ID NO: 102165 - DNA, 9 bp, Unknown
  misc_feature (1)..( 9): Result.002 file - promoters60/1028682
aaaaattca

SEQ ID NO: 102166 - DNA, 9 bp, Unknown
  misc_feature (1)..( 9): Result.002 file - promoters60/1028682
caaatttca

SEQ ID NO: 102167 - DNA, 9 bp, Unknown
  misc_feature (1)..( 9): Result.002 file - promoters60/1028682
aaaaatcga

SEQ ID NO: 102168 - DNA, 9 bp, Unknown
  misc_feature (1)..( 9): Result.002 file - promoters60/1028682
aaaaactca

SEQ ID NO: 102169 - DNA, 6 bp, Unknown
  misc_feature (1)..( 6): Result.002 file - promoters60/1028735
atatga

SEQ ID NO: 102170 - DNA, 6 bp, Unknown
  misc_feature (1)..( 6): Result.002 file - promoters60/1028735
atatga

SEQ ID NO: 102171 - DNA, 7 bp, Unknown
  misc_feature (1)..( 7): Result.002 file - promoters60/1028735
aacacac

SEQ ID NO: 102172 - DNA, 7 bp, Unknown
  misc_feature (1)..( 7): Result.002 file - promoters60/1028735
aacacac

SEQ ID NO: 102173 - DNA, 7 bp, Unknown
  misc_feature (1)..( 7): Result.002 file - promoters60/1028735
agggtcc

SEQ ID NO: 102174 - DNA, 7 bp, Unknown
  misc_feature (1)..( 7): Result.002 file - promoters60/1028735
aggatcc

SEQ ID NO: 102175 - DNA, 6 bp, Unknown
  misc_feature (1)..( 6): Result.002 file - promoters60/1028735
ttcttc

SEQ ID NO: 102176 - DNA, 6 bp, Unknown
  misc_feature (1)..( 6): Result.002 file - promoters60/1028735
ttcttc

SEQ ID NO: 102177 - DNA, 11 bp, Unknown
  misc_feature (1)..( 11): Result.002 file - promoters60/1028735
gaaccactcac

SEQ ID NO: 102178 - DNA, 11 bp, Unknown
  misc_feature (1)..( 11): Result.002 file - promoters60/1028735
gaaacacgcac

SEQ ID NO: 102179 - DNA, 6 bp, Unknown
  misc_feature (1)..( 6): Result.002 file - promoters60/1028735
ggaaaa

SEQ ID NO: 102180 - DNA, 6 bp, Unknown
  misc_feature (1)..( 6): Result.002 file - promoters60/1028735
ggaaaa

SEQ ID NO: 102181 - DNA, 7 bp, Unknown
  misc_feature (1)..( 7): Result.002 file - promoters60/1028735
aacaact

SEQ ID NO: 102182 - DNA, 7 bp, Unknown
  misc_feature (1)..( 7): Result.002 file - promoters60/1028735
aactact

SEQ ID NO: 102183 - DNA, 6 bp, Unknown
  misc_feature (1)..( 6): Result.002 file - promoters60/1028735
aggtat

SEQ ID NO: 102184 - DNA, 6 bp, Unknown
  misc_feature (1)..( 6): Result.002 file - promoters60/1028735
aggtat

SEQ ID NO: 102185 - DNA, 9 bp, Unknown
  misc_feature (1)..( 9): Result.002 file - promoters60/1028735
cacttttac

SEQ ID NO: 102186 - DNA, 9 bp, Unknown
  misc_feature (1)..( 9): Result.002 file - promoters60/1028735
cacttttac

SEQ ID NO: 102187 - DNA, 11 bp, Unknown
  misc_feature (1)..( 11): Result.002 file - promoters60/1028735
acaattggagg

SEQ ID NO: 102188 - DNA, 11 bp, Unknown
  misc_feature (1)..( 11): Result.002 file - promoters60/1028735
acacttggagg

SEQ ID NO: 102189 - DNA, 7 bp, Unknown
  misc_feature (1)..( 7): Result.002 file - promoters60/1028735
tacccac

SEQ ID NO: 102190 - DNA, 7 bp, Unknown
  misc_feature (1)..( 7): Result.002 file - promoters60/1028735
tactcac

SEQ ID NO: 102191 - DNA, 6 bp, Unknown
  misc_feature (1)..( 6): Result.002 file - promoters60/1028751
cagaaa

SEQ ID NO: 102192 - DNA, 6 bp, Unknown
  misc_feature (1)..( 6): Result.002 file - promoters60/1028751
cagaaa

SEQ ID NO: 102193 - DNA, 10 bp, Unknown
  misc_feature (1)..( 10): Result.002 file - promoters60/1028751
tgcaataaga

SEQ ID NO: 102194 - DNA, 10 bp, Unknown
  misc_feature (1)..( 10): Result.002 file - promoters60/1028751
tgcaacaaga

SEQ ID NO: 102195 - DNA, 6 bp, Unknown
  misc_feature (1)..( 6): Result.002 file - promoters60/1028751
aaaaaa

SEQ ID NO: 102196 - DNA, 6 bp, Unknown
  misc_feature (1)..( 6): Result.002 file - promoters60/1028751
aaaaaa

SEQ ID NO: 102197 - DNA, 6 bp, Unknown
  misc_feature (1)..( 6): Result.002 file - promoters60/1028751
cttttc

SEQ ID NO: 102198 - DNA, 6 bp, Unknown
  misc_feature (1)..( 6): Result.002 file - promoters60/1028751
cttttc

SEQ ID NO: 102199 - DNA, 7 bp, Unknown
  misc_feature (1)..( 7): Result.002 file - promoters60/1028751
ttccttt

SEQ ID NO: 102200 - DNA, 7 bp, Unknown
  misc_feature (1)..( 7): Result.002 file - promoters60/1028751
ttcattt

SEQ ID NO: 102201 - DNA, 9 bp, Unknown
  misc_feature (1)..( 9): Result.002 file - promoters60/1028751
tttatttta

SEQ ID NO: 102202 - DNA, 9 bp, Unknown
  misc_feature (1)..( 9): Result.002 file - promoters60/1028751
tttagttta

SEQ ID NO: 102203 - DNA, 6 bp, Unknown
  misc_feature (1)..( 6): Result.002 file - promoters60/1028751
taatgt

SEQ ID NO: 102204 - DNA, 6 bp, Unknown
  misc_feature (1)..( 6): Result.002 file - promoters60/1028751
taatgt

SEQ ID NO: 102205 - DNA, 10 bp, Unknown
  misc_feature (1)..( 10): Result.002 file - promoters60/1028751
gataattgat

SEQ ID NO: 102206 - DNA, 10 bp, Unknown
  misc_feature (1)..( 10): Result.002 file - promoters60/1028751
gataattgat

SEQ ID NO: 102207 - DNA, 6 bp, Unknown
  misc_feature (1)..( 6): Result.002 file - promoters60/1028751
tcaaaa

SEQ ID NO: 102208 - DNA, 6 bp, Unknown
  misc_feature (1)..( 6): Result.002 file - promoters60/1028751
tcaaaa

SEQ ID NO: 102209 - DNA, 6 bp, Unknown
  misc_feature (1)..( 6): Result.002 file - promoters60/1028751
tggatt

SEQ ID NO: 102210 - DNA, 6 bp, Unknown
  misc_feature (1)..( 6): Result.002 file - promoters60/1028751
tggatt

SEQ ID NO: 102211 - DNA, 6 bp, Unknown
  misc_feature (1)..( 6): Result.002 file - promoters60/1028751
ttttgc

SEQ ID NO: 102212 - DNA, 6 bp, Unknown
  misc_feature (1)..( 6): Result.002 file - promoters60/1028751
ttttgc

SEQ ID NO: 102213 - DNA, 9 bp, Unknown
  misc_feature (1)..( 9): Result.002 file - promoters60/1028751
gatataata

SEQ ID NO: 102214 - DNA, 9 bp, Unknown
  misc_feature (1)..( 9): Result.002 file - promoters60/1028751
gatattata

SEQ ID NO: 102215 - DNA, 7 bp, Unknown
  misc_feature (1)..( 7): Result.002 file - promoters60/1028751
attagag

SEQ ID NO: 102216 - DNA, 7 bp, Unknown
  misc_feature (1)..( 7): Result.002 file - promoters60/1028751
atttgag

SEQ ID NO: 102217 - DNA, 6 bp, Unknown
  misc_feature (1)..( 6): Result.002 file - promoters60/1028751
catgaa

SEQ ID NO: 102218 - DNA, 6 bp, Unknown
  misc_feature (1)..( 6): Result.002 file - promoters60/1028751
catgaa

SEQ ID NO: 102219 - DNA, 7 bp, Unknown
  misc_feature (1)..( 7): Result.002 file - promoters60/1028751
aattctt

SEQ ID NO: 102220 - DNA, 7 bp, Unknown
  misc_feature (1)..( 7): Result.002 file - promoters60/1028751
aatgctt

SEQ ID NO: 102221 - DNA, 7 bp, Unknown
  misc_feature (1)..( 7): Result.002 file - promoters60/1028751
gatccag

SEQ ID NO: 102222 - DNA, 7 bp, Unknown
  misc_feature (1)..( 7): Result.002 file - promoters60/1028751
gatacag

SEQ ID NO: 102223 - DNA, 6 bp, Unknown
  misc_feature (1)..( 6): Result.002 file - promoters60/1028751
attcca

SEQ ID NO: 102224 - DNA, 6 bp, Unknown
  misc_feature (1)..( 6): Result.002 file - promoters60/1028751
attcca

SEQ ID NO: 102225 - DNA, 7 bp, Unknown
  misc_feature (1)..( 7): Result.002 file - promoters60/1028751
aaacctg

SEQ ID NO: 102226 - DNA, 7 bp, Unknown
  misc_feature (1)..( 7): Result.002 file - promoters60/1028751
aaagctg

SEQ ID NO: 102227 - DNA, 6 bp, Unknown
  misc_feature (1)..( 6): Result.002 file - promoters60/1028751
tttgac

SEQ ID NO: 102228 - DNA, 6 bp, Unknown
  misc_feature (1)..( 6): Result.002 file - promoters60/1028751
tttgac

SEQ ID NO: 102229 - DNA, 6 bp, Unknown
  misc_feature (1)..( 6): Result.002 file - promoters60/1028751
acggta

SEQ ID NO: 102230 - DNA, 6 bp, Unknown
  misc_feature (1)..( 6): Result.002 file - promoters60/1028751
acggta

SEQ ID NO: 102231 - DNA, 7 bp, Unknown
  misc_feature (1)..( 7): Result.002 file - promoters60/1028751
tcacgtt

SEQ ID NO: 102232 - DNA, 7 bp, Unknown
  misc_feature (1)..( 7): Result.002 file - promoters60/1028751
tcaagtt

SEQ ID NO: 102233 - DNA, 9 bp, Unknown
  misc_feature (1)..( 9): Result.002 file - promoters60/1028751
atttgattt

SEQ ID NO: 102234 - DNA, 9 bp, Unknown
  misc_feature (1)..( 9): Result.002 file - promoters60/1028751
atttaattt

SEQ ID NO: 102235 - DNA, 13 bp, Unknown
  misc_feature (1)..( 13): Result.002 file - promoters60/1028826
aaacgtttaggag

SEQ ID NO: 102236 - DNA, 13 bp, Unknown
  misc_feature (1)..( 13): Result.002 file - promoters60/1028826
atacgtttttttt

SEQ ID NO: 102237 - DNA, 13 bp, Unknown
  misc_feature (1)..( 13): Result.002 file - promoters60/1028826
aaaagtttgttat

SEQ ID NO: 102238 - DNA, 13 bp, Unknown
  misc_feature (1)..( 13): Result.002 file - promoters60/1028826
ttacatttgtctg

SEQ ID NO: 102239 - DNA, 13 bp, Unknown
  misc_feature (1)..( 13): Result.002 file - promoters60/1028826
gtccatttttctg

SEQ ID NO: 102240 - DNA, 13 bp, Unknown
  misc_feature (1)..( 13): Result.002 file - promoters60/1028826
cgtcgttttgcgt

SEQ ID NO: 102241 - DNA, 12 bp, Unknown
  misc_feature (1)..( 12): Result.002 file - promoters60/1028826
gtcatgtgttgt

SEQ ID NO: 102242 - DNA, 12 bp, Unknown
  misc_feature (1)..( 12): Result.002 file - promoters60/1028826
tacatttgtctg

SEQ ID NO: 102243 - DNA, 12 bp, Unknown
  misc_feature (1)..( 12): Result.002 file - promoters60/1028826
agtatgtgttga

SEQ ID NO: 102244 - DNA, 12 bp, Unknown
  misc_feature (1)..( 12): Result.002 file - promoters60/1028826
tacgtttttttt

SEQ ID NO: 102245 - DNA, 12 bp, Unknown
  misc_feature (1)..( 12): Result.002 file - promoters60/1028826
tccatttttctg

SEQ ID NO: 102246 - DNA, 12 bp, Unknown
  misc_feature (1)..( 12): Result.002 file - promoters60/1028826
gtcgttttgcgt

SEQ ID NO: 102247 - DNA, 10 bp, Unknown
  misc_feature (1)..( 10): Result.002 file - promoters60/1028859
aaagatatat

SEQ ID NO: 102248 - DNA, 10 bp, Unknown
  misc_feature (1)..( 10): Result.002 file - promoters60/1028859
aaatatatat

SEQ ID NO: 102249 - DNA, 6 bp, Unknown
  misc_feature (1)..( 6): Result.002 file - promoters60/1028859
aaaaaa

SEQ ID NO: 102250 - DNA, 6 bp, Unknown
  misc_feature (1)..( 6): Result.002 file - promoters60/1028859
aaaaaa

SEQ ID NO: 102251 - DNA, 7 bp, Unknown
  misc_feature (1)..( 7): Result.002 file - promoters60/1028859
atgcttg

SEQ ID NO: 102252 - DNA, 7 bp, Unknown
  misc_feature (1)..( 7): Result.002 file - promoters60/1028859
atgattg

SEQ ID NO: 102253 - DNA, 14 bp, Unknown
  misc_feature (1)..( 14): Result.002 file - promoters60/1028859
attatagtttaatt

SEQ ID NO: 102254 - DNA, 14 bp, Unknown
  misc_feature (1)..( 14): Result.002 file - promoters60/1028859
attaaagttcaatt

SEQ ID NO: 102255 - DNA, 7 bp, Unknown
  misc_feature (1)..( 7): Result.002 file - promoters60/1028859
aaggaat

SEQ ID NO: 102256 - DNA, 7 bp, Unknown
  misc_feature (1)..( 7): Result.002 file - promoters60/1028859
aagaaat

SEQ ID NO: 102257 - DNA, 8 bp, Unknown
  misc_feature (1)..( 8): Result.002 file - promoters60/1028859
aataaaat

SEQ ID NO: 102258 - DNA, 8 bp, Unknown
  misc_feature (1)..( 8): Result.002 file - promoters60/1028859
aatcaaat

SEQ ID NO: 102259 - DNA, 6 bp, Unknown
  misc_feature (1)..( 6): Result.002 file - promoters60/1028859
ctcaag

SEQ ID NO: 102260 - DNA, 6 bp, Unknown
  misc_feature (1)..( 6): Result.002 file - promoters60/1028859
ctcaag

SEQ ID NO: 102261 - DNA, 7 bp, Unknown
  misc_feature (1)..( 7): Result.002 file - promoters60/1028859
tcttctt

SEQ ID NO: 102262 - DNA, 7 bp, Unknown
  misc_feature (1)..( 7): Result.002 file - promoters60/1028859
tcttctt

SEQ ID NO: 102263 - DNA, 9 bp, Unknown
  misc_feature (1)..( 9): Result.002 file - promoters60/1028859
tctcttttt

SEQ ID NO: 102264 - DNA, 9 bp, Unknown
  misc_feature (1)..( 9): Result.002 file - promoters60/1028859
tctcttttt

SEQ ID NO: 102265 - DNA, 6 bp, Unknown
  misc_feature (1)..( 6): Result.002 file - promoters60/1028859
tgtgtt

SEQ ID NO: 102266 - DNA, 6 bp, Unknown
  misc_feature (1)..( 6): Result.002 file - promoters60/1028859
tgtgtt

SEQ ID NO: 102267 - DNA, 6 bp, Unknown
  misc_feature (1)..( 6): Result.002 file - promoters60/1028859
tttttt

SEQ ID NO: 102268 - DNA, 6 bp, Unknown
  misc_feature (1)..( 6): Result.002 file - promoters60/1028859
tttttt

SEQ ID NO: 102269 - DNA, 6 bp, Unknown
  misc_feature (1)..( 6): Result.002 file - promoters60/1028859
ttttta

SEQ ID NO: 102270 - DNA, 6 bp, Unknown
  misc_feature (1)..( 6): Result.002 file - promoters60/1028859
ttttta

SEQ ID NO: 102271 - DNA, 6 bp, Unknown
  misc_feature (1)..( 6): Result.002 file - promoters60/1028859
ttgttt

SEQ ID NO: 102272 - DNA, 6 bp, Unknown
  misc_feature (1)..( 6): Result.002 file - promoters60/1028859
ttgttt

SEQ ID NO: 102273 - DNA, 9 bp, Unknown
  misc_feature (1)..( 9): Result.002 file - promoters60/1028863
tttcattaa

SEQ ID NO: 102274 - DNA, 9 bp, Unknown
  misc_feature (1)..( 9): Result.002 file - promoters60/1028863
attcattta

SEQ ID NO: 102275 - DNA, 9 bp, Unknown
  misc_feature (1)..( 9): Result.002 file - promoters60/1028863
tttgatttt

SEQ ID NO: 102276 - DNA, 9 bp, Unknown
  misc_feature (1)..( 9): Result.002 file - promoters60/1028863
tttcactaa

SEQ ID NO: 102277 - DNA, 9 bp, Unknown
  misc_feature (1)..( 9): Result.002 file - promoters60/1028863
attaattaa

SEQ ID NO: 102278 - DNA, 9 bp, Unknown
  misc_feature (1)..( 9): Result.002 file - promoters60/1028863
tttcactct

SEQ ID NO: 102279 - DNA, 6 bp, Unknown
  misc_feature (1)..( 6): Result.002 file - promoters60/1028878
attcga

SEQ ID NO: 102280 - DNA, 6 bp, Unknown
  misc_feature (1)..( 6): Result.002 file - promoters60/1028878
attcga

SEQ ID NO: 102281 - DNA, 9 bp, Unknown
  misc_feature (1)..( 9): Result.002 file - promoters60/1028878
cttgaagaa

SEQ ID NO: 102282 - DNA, 9 bp, Unknown
  misc_feature (1)..( 9): Result.002 file - promoters60/1028878
cttcaagaa

SEQ ID NO: 102283 - DNA, 6 bp, Unknown
  misc_feature (1)..( 6): Result.002 file - promoters60/1028878
tcttct

SEQ ID NO: 102284 - DNA, 6 bp, Unknown
  misc_feature (1)..( 6): Result.002 file - promoters60/1028878
tcttct

SEQ ID NO: 102285 - DNA, 6 bp, Unknown
  misc_feature (1)..( 6): Result.002 file - promoters60/1028878
tctgta

SEQ ID NO: 102286 - DNA, 6 bp, Unknown
  misc_feature (1)..( 6): Result.002 file - promoters60/1028878
tctgta

SEQ ID NO: 102287 - DNA, 6 bp, Unknown
  misc_feature (1)..( 6): Result.002 file - promoters60/1028878
gataaa

SEQ ID NO: 102288 - DNA, 6 bp, Unknown
  misc_feature (1)..( 6): Result.002 file - promoters60/1028878
gataaa

SEQ ID NO: 102289 - DNA, 6 bp, Unknown
  misc_feature (1)..( 6): Result.002 file - promoters60/1028878
cttctt

SEQ ID NO: 102290 - DNA, 6 bp, Unknown
  misc_feature (1)..( 6): Result.002 file - promoters60/1028878
cttctt

SEQ ID NO: 102291 - DNA, 6 bp, Unknown
  misc_feature (1)..( 6): Result.002 file - promoters60/1028878
catctc

SEQ ID NO: 102292 - DNA, 6 bp, Unknown
  misc_feature (1)..( 6): Result.002 file - promoters60/1028878
catctc

SEQ ID NO: 102293 - DNA, 6 bp, Unknown
  misc_feature (1)..( 6): Result.002 file - promoters60/1028878
agtttt

SEQ ID NO: 102294 - DNA, 6 bp, Unknown
  misc_feature (1)..( 6): Result.002 file - promoters60/1028878
agtttt

SEQ ID NO: 102295 - DNA, 7 bp, Unknown
  misc_feature (1)..( 7): Result.002 file - promoters60/1028878
acataaa

SEQ ID NO: 102296 - DNA, 7 bp, Unknown
  misc_feature (1)..( 7): Result.002 file - promoters60/1028878
acaaaaa

SEQ ID NO: 102297 - DNA, 11 bp, Unknown
  misc_feature (1)..( 11): Result.002 file - promoters60/1028908
acaaataaagt

SEQ ID NO: 102298 - DNA, 11 bp, Unknown
  misc_feature (1)..( 11): Result.002 file - promoters60/1028908
acaaatacgaa

SEQ ID NO: 102299 - DNA, 11 bp, Unknown
  misc_feature (1)..( 11): Result.002 file - promoters60/1028908
tcaagtacgaa

SEQ ID NO: 102300 - DNA, 13 bp, Unknown
  misc_feature (1)..( 13): Result.002 file - promoters60/1028908
gttggtttatcat

SEQ ID NO: 102301 - DNA, 13 bp, Unknown
  misc_feature (1)..( 13): Result.002 file - promoters60/1028908
aatggttaatcat

SEQ ID NO: 102302 - DNA, 13 bp, Unknown
  misc_feature (1)..( 13): Result.002 file - promoters60/1028908
aatgcttacattg

SEQ ID NO: 102303 - DNA, 8 bp, Unknown
  misc_feature (1)..( 8): Result.002 file - promoters60/1028908
actttttc

SEQ ID NO: 102304 - DNA, 8 bp, Unknown
  misc_feature (1)..( 8): Result.002 file - promoters60/1028908
actttttc

SEQ ID NO: 102305 - DNA, 8 bp, Unknown
  misc_feature (1)..( 8): Result.002 file - promoters60/1028908
gaaaaaac

SEQ ID NO: 102306 - DNA, 8 bp, Unknown
  misc_feature (1)..( 8): Result.002 file - promoters60/1028908
gaacaaac

SEQ ID NO: 102307 - DNA, 6 bp, Unknown
  misc_feature (1)..( 6): Result.002 file - promoters60/1028908
atctat

SEQ ID NO: 102308 - DNA, 6 bp, Unknown
  misc_feature (1)..( 6): Result.002 file - promoters60/1028908
atctat

SEQ ID NO: 102309 - DNA, 6 bp, Unknown
  misc_feature (1)..( 6): Result.002 file - promoters60/1028908
atctct

SEQ ID NO: 102310 - DNA, 6 bp, Unknown
  misc_feature (1)..( 6): Result.002 file - promoters60/1028908
atctct

SEQ ID NO: 102311 - DNA, 7 bp, Unknown
  misc_feature (1)..( 7): Result.002 file - promoters60/1028908
ttcaatc

SEQ ID NO: 102312 - DNA, 7 bp, Unknown
  misc_feature (1)..( 7): Result.002 file - promoters60/1028908
ttctatc

SEQ ID NO: 102313 - DNA, 8 bp, Unknown
  misc_feature (1)..( 8): Result.002 file - promoters60/1028908
gcgtggtc

SEQ ID NO: 102314 - DNA, 8 bp, Unknown
  misc_feature (1)..( 8): Result.002 file - promoters60/1028908
gcgtcgtc

SEQ ID NO: 102315 - DNA, 6 bp, Unknown
  misc_feature (1)..( 6): Result.002 file - promoters60/1028908
tcagat

SEQ ID NO: 102316 - DNA, 6 bp, Unknown
  misc_feature (1)..( 6): Result.002 file - promoters60/1028908
tcagat

SEQ ID NO: 102317 - DNA, 7 bp, Unknown
  misc_feature (1)..( 7): Result.002 file - promoters60/1028908
acacgca

SEQ ID NO: 102318 - DNA, 7 bp, Unknown
  misc_feature (1)..( 7): Result.002 file - promoters60/1028908
acacgca

SEQ ID NO: 102319 - DNA, 6 bp, Unknown
  misc_feature (1)..( 6): Result.002 file - promoters60/1028908
ttcctt

SEQ ID NO: 102320 - DNA, 6 bp, Unknown
  misc_feature (1)..( 6): Result.002 file - promoters60/1028908
ttcctt

SEQ ID NO: 102321 - DNA, 12 bp, Unknown
  misc_feature (1)..( 12): Result.002 file - promoters60/1028937
acaataataaac

SEQ ID NO: 102322 - DNA, 12 bp, Unknown
  misc_feature (1)..( 12): Result.002 file - promoters60/1028937
tttataatataa

SEQ ID NO: 102323 - DNA, 12 bp, Unknown
  misc_feature (1)..( 12): Result.002 file - promoters60/1028937
acaattatatag

SEQ ID NO: 102324 - DNA, 12 bp, Unknown
  misc_feature (1)..( 12): Result.002 file - promoters60/1028937
taaatagtaaaa

SEQ ID NO: 102325 - DNA, 12 bp, Unknown
  misc_feature (1)..( 12): Result.002 file - promoters60/1028937
atccttatctag

SEQ ID NO: 102326 - DNA, 13 bp, Unknown
  misc_feature (1)..( 13): Result.002 file - promoters60/1028937
atcatataaaaaa

SEQ ID NO: 102327 - DNA, 13 bp, Unknown
  misc_feature (1)..( 13): Result.002 file - promoters60/1028937
tttacataaaaat

SEQ ID NO: 102328 - DNA, 13 bp, Unknown
  misc_feature (1)..( 13): Result.002 file - promoters60/1028937
aaacaataattat

SEQ ID NO: 102329 - DNA, 13 bp, Unknown
  misc_feature (1)..( 13): Result.002 file - promoters60/1028937
ccttatcaaaaaa

SEQ ID NO: 102330 - DNA, 13 bp, Unknown
  misc_feature (1)..( 13): Result.002 file - promoters60/1028937
taaacaaacaaat

SEQ ID NO: 102331 - DNA, 13 bp, Unknown
  misc_feature (1)..( 13): Result.002 file - promoters60/1028937
aaaacaatttata

SEQ ID NO: 102332 - DNA, 13 bp, Unknown
  misc_feature (1)..( 13): Result.002 file - promoters60/1028937
caaacaaaaacaa

SEQ ID NO: 102333 - DNA, 13 bp, Unknown
  misc_feature (1)..( 13): Result.002 file - promoters60/1028937
aaaagaatttata

SEQ ID NO: 102334 - DNA, 13 bp, Unknown
  misc_feature (1)..( 13): Result.002 file - promoters60/1028937
tgaagaatctgat

SEQ ID NO: 102335 - DNA, 9 bp, Unknown
  misc_feature (1)..( 9): Result.002 file - promoters60/1028937
taatgaaac

SEQ ID NO: 102336 - DNA, 9 bp, Unknown
  misc_feature (1)..( 9): Result.002 file - promoters60/1028937
ttatgaaac

SEQ ID NO: 102337 - DNA, 9 bp, Unknown
  misc_feature (1)..( 9): Result.002 file - promoters60/1028937
aaatgaaac

SEQ ID NO: 102338 - DNA, 9 bp, Unknown
  misc_feature (1)..( 9): Result.002 file - promoters60/1028937
aaaagaaaa

SEQ ID NO: 102339 - DNA, 8 bp, Unknown
  misc_feature (1)..( 8): Result.002 file - promoters60/1028937
ctattttg

SEQ ID NO: 102340 - DNA, 8 bp, Unknown
  misc_feature (1)..( 8): Result.002 file - promoters60/1028937
ttatttta

SEQ ID NO: 102341 - DNA, 8 bp, Unknown
  misc_feature (1)..( 8): Result.002 file - promoters60/1028937
taattttg

SEQ ID NO: 102342 - DNA, 8 bp, Unknown
  misc_feature (1)..( 8): Result.002 file - promoters60/1028937
ctaatttc

SEQ ID NO: 102343 - DNA, 11 bp, Unknown
  misc_feature (1)..( 11): Result.002 file - promoters60/1028937
atatatataat

SEQ ID NO: 102344 - DNA, 11 bp, Unknown
  misc_feature (1)..( 11): Result.002 file - promoters60/1028937
atatatttaat

SEQ ID NO: 102345 - DNA, 11 bp, Unknown
  misc_feature (1)..( 11): Result.002 file - promoters60/1028937
ttctttttaat

SEQ ID NO: 102346 - DNA, 11 bp, Unknown
  misc_feature (1)..( 11): Result.002 file - promoters60/1028937
atttttataaa

SEQ ID NO: 102347 - DNA, 11 bp, Unknown
  misc_feature (1)..( 11): Result.002 file - promoters60/1028937
ggattatctat

SEQ ID NO: 102348 - DNA, 11 bp, Unknown
  misc_feature (1)..( 11): Result.002 file - promoters60/1028937
agattatcaaa

SEQ ID NO: 102349 - DNA, 11 bp, Unknown
  misc_feature (1)..( 11): Result.002 file - promoters60/1028937
attttatgaaa

SEQ ID NO: 102350 - DNA, 11 bp, Unknown
  misc_feature (1)..( 11): Result.002 file - promoters60/1028937
agattataaga

SEQ ID NO: 102351 - DNA, 9 bp, Unknown
  misc_feature (1)..( 9): Result.002 file - promoters60/1028937
attttataa

SEQ ID NO: 102352 - DNA, 9 bp, Unknown
  misc_feature (1)..( 9): Result.002 file - promoters60/1028937
attttatag

SEQ ID NO: 102353 - DNA, 9 bp, Unknown
  misc_feature (1)..( 9): Result.002 file - promoters60/1028937
tttttaatt

SEQ ID NO: 102354 - DNA, 9 bp, Unknown
  misc_feature (1)..( 9): Result.002 file - promoters60/1028937
tttttataa

SEQ ID NO: 102355 - DNA, 9 bp, Unknown
  misc_feature (1)..( 9): Result.002 file - promoters60/1028937
tatttaatc

SEQ ID NO: 102356 - DNA, 16 bp, Unknown
  misc_feature (1)..( 16): Result.002 file - promoters60/1028937
gaaaacaatttatatt

SEQ ID NO: 102357 - DNA, 16 bp, Unknown
  misc_feature (1)..( 16): Result.002 file - promoters60/1028937
agcacttttttttatt

SEQ ID NO: 102358 - DNA, 16 bp, Unknown
  misc_feature (1)..( 16): Result.002 file - promoters60/1028937
aaaaagaatttataaa

SEQ ID NO: 102359 - DNA, 16 bp, Unknown
  misc_feature (1)..( 16): Result.002 file - promoters60/1028937
aaaaacaataattatg

SEQ ID NO: 102360 - DNA, 16 bp, Unknown
  misc_feature (1)..( 16): Result.002 file - promoters60/1028937
atgaagaatctgatgt

SEQ ID NO: 102361 - DNA, 12 bp, Unknown
  misc_feature (1)..( 12): Result.002 file - promoters60/1028937
aaataaaaattg

SEQ ID NO: 102362 - DNA, 12 bp, Unknown
  misc_feature (1)..( 12): Result.002 file - promoters60/1028937
aaaaaaacattg

SEQ ID NO: 102363 - DNA, 12 bp, Unknown
  misc_feature (1)..( 12): Result.002 file - promoters60/1028937
tgttaaaaacta

SEQ ID NO: 102364 - DNA, 12 bp, Unknown
  misc_feature (1)..( 12): Result.002 file - promoters60/1028937
aagtaaaaaaca

SEQ ID NO: 102365 - DNA, 12 bp, Unknown
  misc_feature (1)..( 12): Result.002 file - promoters60/1028937
acaaaattgaat

SEQ ID NO: 102366 - DNA, 12 bp, Unknown
  misc_feature (1)..( 12): Result.002 file - promoters60/1028937
acaaaattaact

SEQ ID NO: 102367 - DNA, 12 bp, Unknown
  misc_feature (1)..( 12): Result.002 file - promoters60/1028937
acaaaaatgaat

SEQ ID NO: 102368 - DNA, 12 bp, Unknown
  misc_feature (1)..( 12): Result.002 file - promoters60/1028937
ataaaaattaga

SEQ ID NO: 102369 - DNA, 8 bp, Unknown
  misc_feature (1)..( 8): Result.002 file - promoters60/1028937
aagaaata

SEQ ID NO: 102370 - DNA, 8 bp, Unknown
  misc_feature (1)..( 8): Result.002 file - promoters60/1028937
tagaaatg

SEQ ID NO: 102371 - DNA, 8 bp, Unknown
  misc_feature (1)..( 8): Result.002 file - promoters60/1028937
aagaaaga

SEQ ID NO: 102372 - DNA, 8 bp, Unknown
  misc_feature (1)..( 8): Result.002 file - promoters60/1028937
aagtaata

SEQ ID NO: 102373 - DNA, 11 bp, Unknown
  misc_feature (1)..( 11): Result.002 file - promoters60/1028937
taataaaacaa

SEQ ID NO: 102374 - DNA, 11 bp, Unknown
  misc_feature (1)..( 11): Result.002 file - promoters60/1028937
gaataaaacaa

SEQ ID NO: 102375 - DNA, 11 bp, Unknown
  misc_feature (1)..( 11): Result.002 file - promoters60/1028937
taataaaatat

SEQ ID NO: 102376 - DNA, 11 bp, Unknown
  misc_feature (1)..( 11): Result.002 file - promoters60/1028937
ttataaaaatt

SEQ ID NO: 102377 - DNA, 10 bp, Unknown
  misc_feature (1)..( 10): Result.002 file - promoters60/1028937
gaatacttta

SEQ ID NO: 102378 - DNA, 10 bp, Unknown
  misc_feature (1)..( 10): Result.002 file - promoters60/1028937
acatattttt

SEQ ID NO: 102379 - DNA, 10 bp, Unknown
  misc_feature (1)..( 10): Result.002 file - promoters60/1028937
atgtattttt

SEQ ID NO: 102380 - DNA, 10 bp, Unknown
  misc_feature (1)..( 10): Result.002 file - promoters60/1028937
atatatttaa

SEQ ID NO: 102381 - DNA, 12 bp, Unknown
  misc_feature (1)..( 12): Result.002 file - promoters60/1028955
acaaatatatgt

SEQ ID NO: 102382 - DNA, 12 bp, Unknown
  misc_feature (1)..( 12): Result.002 file - promoters60/1028955
ttagatagatgt

SEQ ID NO: 102383 - DNA, 12 bp, Unknown
  misc_feature (1)..( 12): Result.002 file - promoters60/1028955
aaaaataccact

SEQ ID NO: 102384 - DNA, 12 bp, Unknown
  misc_feature (1)..( 12): Result.002 file - promoters60/1028955
aaacataaattt

SEQ ID NO: 102385 - DNA, 12 bp, Unknown
  misc_feature (1)..( 12): Result.002 file - promoters60/1028955
caaaagagagag

SEQ ID NO: 102386 - DNA, 12 bp, Unknown
  misc_feature (1)..( 12): Result.002 file - promoters60/1028955
gatgattgattg

SEQ ID NO: 102387 - DNA, 8 bp, Unknown
  misc_feature (1)..( 8): Result.002 file - promoters60/1028963
tgttttgc

SEQ ID NO: 102388 - DNA, 8 bp, Unknown
  misc_feature (1)..( 8): Result.002 file - promoters60/1028963
tgttttgc

SEQ ID NO: 102389 - DNA, 6 bp, Unknown
  misc_feature (1)..( 6): Result.002 file - promoters60/1028963
tttcaa

SEQ ID NO: 102390 - DNA, 6 bp, Unknown
  misc_feature (1)..( 6): Result.002 file - promoters60/1028963
tttcaa

SEQ ID NO: 102391 - DNA, 9 bp, Unknown
  misc_feature (1)..( 9): Result.002 file - promoters60/1028963
gattgaaca

SEQ ID NO: 102392 - DNA, 9 bp, Unknown
  misc_feature (1)..( 9): Result.002 file - promoters60/1028963
gattaaaca

SEQ ID NO: 102393 - DNA, 10 bp, Unknown
  misc_feature (1)..( 10): Result.002 file - promoters60/1028963
taatacaatt

SEQ ID NO: 102394 - DNA, 10 bp, Unknown
  misc_feature (1)..( 10): Result.002 file - promoters60/1028963
aaataaaata

SEQ ID NO: 102395 - DNA, 10 bp, Unknown
  misc_feature (1)..( 10): Result.002 file - promoters60/1028963
aaatgaaata

SEQ ID NO: 102396 - DNA, 8 bp, Unknown
  misc_feature (1)..( 8): Result.002 file - promoters60/1028963
tatcttct

SEQ ID NO: 102397 - DNA, 8 bp, Unknown
  misc_feature (1)..( 8): Result.002 file - promoters60/1028963
tattttct

SEQ ID NO: 102398 - DNA, 8 bp, Unknown
  misc_feature (1)..( 8): Result.002 file - promoters60/1028963
tatcttaa

SEQ ID NO: 102399 - DNA, 6 bp, Unknown
  misc_feature (1)..( 6): Result.002 file - promoters60/1028963
aaatcg

SEQ ID NO: 102400 - DNA, 6 bp, Unknown
  misc_feature (1)..( 6): Result.002 file - promoters60/1028963
aaatcg

SEQ ID NO: 102401 - DNA, 6 bp, Unknown
  misc_feature (1)..( 6): Result.002 file - promoters60/1028963
atctga

SEQ ID NO: 102402 - DNA, 6 bp, Unknown
  misc_feature (1)..( 6): Result.002 file - promoters60/1028963
atctga

SEQ ID NO: 102403 - DNA, 7 bp, Unknown
  misc_feature (1)..( 7): Result.002 file - promoters60/1028963
tatatat

SEQ ID NO: 102404 - DNA, 7 bp, Unknown
  misc_feature (1)..( 7): Result.002 file - promoters60/1028963
tatctat

SEQ ID NO: 102405 - DNA, 7 bp, Unknown
  misc_feature (1)..( 7): Result.002 file - promoters60/1028963
gaacaaa

SEQ ID NO: 102406 - DNA, 7 bp, Unknown
  misc_feature (1)..( 7): Result.002 file - promoters60/1028963
gaaaaaa

SEQ ID NO: 102407 - DNA, 6 bp, Unknown
  misc_feature (1)..( 6): Result.002 file - promoters60/1028963
agtaaa

SEQ ID NO: 102408 - DNA, 6 bp, Unknown
  misc_feature (1)..( 6): Result.002 file - promoters60/1028963
agtaaa

SEQ ID NO: 102409 - DNA, 7 bp, Unknown
  misc_feature (1)..( 7): Result.002 file - promoters60/1028963
aatcggg

SEQ ID NO: 102410 - DNA, 7 bp, Unknown
  misc_feature (1)..( 7): Result.002 file - promoters60/1028963
aattggg

SEQ ID NO: 102411 - DNA, 8 bp, Unknown
  misc_feature (1)..( 8): Result.002 file - promoters60/1028963
gaaagaaa

SEQ ID NO: 102412 - DNA, 8 bp, Unknown
  misc_feature (1)..( 8): Result.002 file - promoters60/1028963
gaaacaaa

SEQ ID NO: 102413 - DNA, 10 bp, Unknown
  misc_feature (1)..( 10): Result.002 file - promoters60/1028963
ggaaaagaaa

SEQ ID NO: 102414 - DNA, 10 bp, Unknown
  misc_feature (1)..( 10): Result.002 file - promoters60/1028963
ggaaatgaaa

SEQ ID NO: 102415 - DNA, 7 bp, Unknown
  misc_feature (1)..( 7): Result.002 file - promoters60/1028963
cccacta

SEQ ID NO: 102416 - DNA, 7 bp, Unknown
  misc_feature (1)..( 7): Result.002 file - promoters60/1028963
cccacta

SEQ ID NO: 102417 - DNA, 9 bp, Unknown
  misc_feature (1)..( 9): Result.002 file - promoters60/1028963
aaagaaaag

SEQ ID NO: 102418 - DNA, 9 bp, Unknown
  misc_feature (1)..( 9): Result.002 file - promoters60/1028963
aaagtaaag

SEQ ID NO: 102419 - DNA, 7 bp, Unknown
  misc_feature (1)..( 7): Result.002 file - promoters60/1028963
gtatata

SEQ ID NO: 102420 - DNA, 7 bp, Unknown
  misc_feature (1)..( 7): Result.002 file - promoters60/1028963
gtatata

SEQ ID NO: 102421 - DNA, 7 bp, Unknown
  misc_feature (1)..( 7): Result.002 file - promoters60/1028984
aaaaacc

SEQ ID NO: 102422 - DNA, 7 bp, Unknown
  misc_feature (1)..( 7): Result.002 file - promoters60/1028984
aaacacc

SEQ ID NO: 102423 - DNA, 7 bp, Unknown
  misc_feature (1)..( 7): Result.002 file - promoters60/1028984
taaaatg

SEQ ID NO: 102424 - DNA, 7 bp, Unknown
  misc_feature (1)..( 7): Result.002 file - promoters60/1028984
taaaata

SEQ ID NO: 102425 - DNA, 7 bp, Unknown
  misc_feature (1)..( 7): Result.002 file - promoters60/1028984
gaaaatg

SEQ ID NO: 102426 - DNA, 7 bp, Unknown
  misc_feature (1)..( 7): Result.002 file - promoters60/1028984
aaaatca

SEQ ID NO: 102427 - DNA, 7 bp, Unknown
  misc_feature (1)..( 7): Result.002 file - promoters60/1028984
aaaatca

SEQ ID NO: 102428 - DNA, 6 bp, Unknown
  misc_feature (1)..( 6): Result.002 file - promoters60/1028984
ggttta

SEQ ID NO: 102429 - DNA, 6 bp, Unknown
  misc_feature (1)..( 6): Result.002 file - promoters60/1028984
ggttta

SEQ ID NO: 102430 - DNA, 7 bp, Unknown
  misc_feature (1)..( 7): Result.002 file - promoters60/1028984
gattata

SEQ ID NO: 102431 - DNA, 7 bp, Unknown
  misc_feature (1)..( 7): Result.002 file - promoters60/1028984
gattata

SEQ ID NO: 102432 - DNA, 9 bp, Unknown
  misc_feature (1)..( 9): Result.002 file - promoters60/1028984
cagtaacaa

SEQ ID NO: 102433 - DNA, 9 bp, Unknown
  misc_feature (1)..( 9): Result.002 file - promoters60/1028984
cagtagcaa

SEQ ID NO: 102434 - DNA, 6 bp, Unknown
  misc_feature (1)..( 6): Result.002 file - promoters60/1028984
tcaaca

SEQ ID NO: 102435 - DNA, 6 bp, Unknown
  misc_feature (1)..( 6): Result.002 file - promoters60/1028984
tcaaca

SEQ ID NO: 102436 - DNA, 7 bp, Unknown
  misc_feature (1)..( 7): Result.002 file - promoters60/1028984
attacag

SEQ ID NO: 102437 - DNA, 7 bp, Unknown
  misc_feature (1)..( 7): Result.002 file - promoters60/1028984
atttcag

SEQ ID NO: 102438 - DNA, 8 bp, Unknown
  misc_feature (1)..( 8): Result.002 file - promoters60/1028984
agtggttt

SEQ ID NO: 102439 - DNA, 8 bp, Unknown
  misc_feature (1)..( 8): Result.002 file - promoters60/1028984
agtagttt

SEQ ID NO: 102440 - DNA, 7 bp, Unknown
  misc_feature (1)..( 7): Result.002 file - promoters60/1028984
ttaatcg

SEQ ID NO: 102441 - DNA, 7 bp, Unknown
  misc_feature (1)..( 7): Result.002 file - promoters60/1028984
ttattcg

SEQ ID NO: 102442 - DNA, 6 bp, Unknown
  misc_feature (1)..( 6): Result.002 file - promoters60/1028984
tacgaa

SEQ ID NO: 102443 - DNA, 6 bp, Unknown
  misc_feature (1)..( 6): Result.002 file - promoters60/1028984
tacgaa

SEQ ID NO: 102444 - DNA, 7 bp, Unknown
  misc_feature (1)..( 7): Result.002 file - promoters60/1028984
aaaaatc

SEQ ID NO: 102445 - DNA, 7 bp, Unknown
  misc_feature (1)..( 7): Result.002 file - promoters60/1028984
aaacatc

SEQ ID NO: 102446 - DNA, 7 bp, Unknown
  misc_feature (1)..( 7): Result.002 file - promoters60/1028984
gataaac

SEQ ID NO: 102447 - DNA, 7 bp, Unknown
  misc_feature (1)..( 7): Result.002 file - promoters60/1028984
gattaac

SEQ ID NO: 102448 - DNA, 6 bp, Unknown
  misc_feature (1)..( 6): Result.002 file - promoters60/1028984
atcgtc

SEQ ID NO: 102449 - DNA, 6 bp, Unknown
  misc_feature (1)..( 6): Result.002 file - promoters60/1028984
atcgtc

SEQ ID NO: 102450 - DNA, 6 bp, Unknown
  misc_feature (1)..( 6): Result.002 file - promoters60/1028984
tttcac

SEQ ID NO: 102451 - DNA, 6 bp, Unknown
  misc_feature (1)..( 6): Result.002 file - promoters60/1028984
tttcac

SEQ ID NO: 102452 - DNA, 8 bp, Unknown
  misc_feature (1)..( 8): Result.002 file - promoters60/1028984
taacgcgt

SEQ ID NO: 102453 - DNA, 8 bp, Unknown
  misc_feature (1)..( 8): Result.002 file - promoters60/1028984
taacacgt

SEQ ID NO: 102454 - DNA, 10 bp, Unknown
  misc_feature (1)..( 10): Result.002 file - promoters60/1029005
gctattacat

SEQ ID NO: 102455 - DNA, 10 bp, Unknown
  misc_feature (1)..( 10): Result.002 file - promoters60/1029005
attataacaa

SEQ ID NO: 102456 - DNA, 10 bp, Unknown
  misc_feature (1)..( 10): Result.002 file - promoters60/1029005
attatatcca

SEQ ID NO: 102457 - DNA, 10 bp, Unknown
  misc_feature (1)..( 10): Result.002 file - promoters60/1029005
tacataacaa

SEQ ID NO: 102458 - DNA, 12 bp, Unknown
  misc_feature (1)..( 12): Result.002 file - promoters60/1029005
ttaatagacaaa

SEQ ID NO: 102459 - DNA, 12 bp, Unknown
  misc_feature (1)..( 12): Result.002 file - promoters60/1029005
gtaaaagaaaga

SEQ ID NO: 102460 - DNA, 12 bp, Unknown
  misc_feature (1)..( 12): Result.002 file - promoters60/1029005
ttaagagacaaa

SEQ ID NO: 102461 - DNA, 12 bp, Unknown
  misc_feature (1)..( 12): Result.002 file - promoters60/1029005
ctaacagaataa

SEQ ID NO: 102462 - DNA, 9 bp, Unknown
  misc_feature (1)..( 9): Result.002 file - promoters60/1029005
gaatgatat

SEQ ID NO: 102463 - DNA, 9 bp, Unknown
  misc_feature (1)..( 9): Result.002 file - promoters60/1029005
aaattatat

SEQ ID NO: 102464 - DNA, 9 bp, Unknown
  misc_feature (1)..( 9): Result.002 file - promoters60/1029005
taattataa

SEQ ID NO: 102465 - DNA, 9 bp, Unknown
  misc_feature (1)..( 9): Result.002 file - promoters60/1029005
aaagtatct

SEQ ID NO: 102466 - DNA, 10 bp, Unknown
  misc_feature (1)..( 10): Result.002 file - promoters60/1029005
cttttcttta

SEQ ID NO: 102467 - DNA, 10 bp, Unknown
  misc_feature (1)..( 10): Result.002 file - promoters60/1029005
tttttgtttc

SEQ ID NO: 102468 - DNA, 10 bp, Unknown
  misc_feature (1)..( 10): Result.002 file - promoters60/1029005
tttttctttc

SEQ ID NO: 102469 - DNA, 10 bp, Unknown
  misc_feature (1)..( 10): Result.002 file - promoters60/1029005
gtttttttcc

SEQ ID NO: 102470 - DNA, 10 bp, Unknown
  misc_feature (1)..( 10): Result.002 file - promoters60/1029005
aatttattta

SEQ ID NO: 102471 - DNA, 10 bp, Unknown
  misc_feature (1)..( 10): Result.002 file - promoters60/1029005
tttttctttc

SEQ ID NO: 102472 - DNA, 10 bp, Unknown
  misc_feature (1)..( 10): Result.002 file - promoters60/1029005
cgtttttttc

SEQ ID NO: 102473 - DNA, 10 bp, Unknown
  misc_feature (1)..( 10): Result.002 file - promoters60/1029005
tttttgtttc

SEQ ID NO: 102474 - DNA, 13 bp, Unknown
  misc_feature (1)..( 13): Result.002 file - promoters60/1029005
caaaccaatgtta

SEQ ID NO: 102475 - DNA, 13 bp, Unknown
  misc_feature (1)..( 13): Result.002 file - promoters60/1029005
aaaatcaaatttt

SEQ ID NO: 102476 - DNA, 13 bp, Unknown
  misc_feature (1)..( 13): Result.002 file - promoters60/1029005
aaaaacaaagttt

SEQ ID NO: 102477 - DNA, 14 bp, Unknown
  misc_feature (1)..( 14): Result.002 file - promoters60/1029005
aaagaataaaaatt

SEQ ID NO: 102478 - DNA, 9 bp, Unknown
  misc_feature (1)..( 9): Result.002 file - promoters60/1029085
gtttaattt

SEQ ID NO: 102479 - DNA, 9 bp, Unknown
  misc_feature (1)..( 9): Result.002 file - promoters60/1029085
gttaaattt

SEQ ID NO: 102480 - DNA, 9 bp, Unknown
  misc_feature (1)..( 9): Result.002 file - promoters60/1029085
gattaattt

SEQ ID NO: 102481 - DNA, 7 bp, Unknown
  misc_feature (1)..( 7): Result.002 file - promoters60/1029085
caaaaac

SEQ ID NO: 102482 - DNA, 7 bp, Unknown
  misc_feature (1)..( 7): Result.002 file - promoters60/1029085
caaaaag

SEQ ID NO: 102483 - DNA, 7 bp, Unknown
  misc_feature (1)..( 7): Result.002 file - promoters60/1029085
taaaaag

SEQ ID NO: 102484 - DNA, 8 bp, Unknown
  misc_feature (1)..( 8): Result.002 file - promoters60/1029085
taaaaaat

SEQ ID NO: 102485 - DNA, 8 bp, Unknown
  misc_feature (1)..( 8): Result.002 file - promoters60/1029085
gaaaaaat

SEQ ID NO: 102486 - DNA, 8 bp, Unknown
  misc_feature (1)..( 8): Result.002 file - promoters60/1029085
taaaaagg

SEQ ID NO: 102487 - DNA, 8 bp, Unknown
  misc_feature (1)..( 8): Result.002 file - promoters60/1029085
gattgata

SEQ ID NO: 102488 - DNA, 8 bp, Unknown
  misc_feature (1)..( 8): Result.002 file - promoters60/1029085
gattcata

SEQ ID NO: 102489 - DNA, 8 bp, Unknown
  misc_feature (1)..( 8): Result.002 file - promoters60/1029085
gattcaaa

SEQ ID NO: 102490 - DNA, 8 bp, Unknown
  misc_feature (1)..( 8): Result.002 file - promoters60/1029242
attccaaa

SEQ ID NO: 102491 - DNA, 8 bp, Unknown
  misc_feature (1)..( 8): Result.002 file - promoters60/1029242
attccaaa

SEQ ID NO: 102492 - DNA, 7 bp, Unknown
  misc_feature (1)..( 7): Result.002 file - promoters60/1029242
ttttgaa

SEQ ID NO: 102493 - DNA, 7 bp, Unknown
  misc_feature (1)..( 7): Result.002 file - promoters60/1029242
ttttgaa

SEQ ID NO: 102494 - DNA, 12 bp, Unknown
  misc_feature (1)..( 12): Result.002 file - promoters60/1029242
ataagtaatttt

SEQ ID NO: 102495 - DNA, 12 bp, Unknown
  misc_feature (1)..( 12): Result.002 file - promoters60/1029242
gagtataattta

SEQ ID NO: 102496 - DNA, 12 bp, Unknown
  misc_feature (1)..( 12): Result.002 file - promoters60/1029242
gagtagaattta

SEQ ID NO: 102497 - DNA, 8 bp, Unknown
  misc_feature (1)..( 8): Result.002 file - promoters60/1029242
aattctta

SEQ ID NO: 102498 - DNA, 8 bp, Unknown
  misc_feature (1)..( 8): Result.002 file - promoters60/1029242
aattttta

SEQ ID NO: 102499 - DNA, 7 bp, Unknown
  misc_feature (1)..( 7): Result.002 file - promoters60/1029242
atataac

SEQ ID NO: 102500 - DNA, 7 bp, Unknown
  misc_feature (1)..( 7): Result.002 file - promoters60/1029242
ataaaac

SEQ ID NO: 102501 - DNA, 6 bp, Unknown
  misc_feature (1)..( 6): Result.002 file - promoters60/1029242
tactta

SEQ ID NO: 102502 - DNA, 6 bp, Unknown
  misc_feature (1)..( 6): Result.002 file - promoters60/1029242
tactta

SEQ ID NO: 102503 - DNA, 7 bp, Unknown
  misc_feature (1)..( 7): Result.002 file - promoters60/1029242
aattaaa

SEQ ID NO: 102504 - DNA, 7 bp, Unknown
  misc_feature (1)..( 7): Result.002 file - promoters60/1029242
aattaaa

SEQ ID NO: 102505 - DNA, 6 bp, Unknown
  misc_feature (1)..( 6): Result.002 file - promoters60/1029242
aaaaga

SEQ ID NO: 102506 - DNA, 6 bp, Unknown
  misc_feature (1)..( 6): Result.002 file - promoters60/1029242
aaaaga

SEQ ID NO: 102507 - DNA, 8 bp, Unknown
  misc_feature (1)..( 8): Result.002 file - promoters60/1029242
aaaccaaa

SEQ ID NO: 102508 - DNA, 8 bp, Unknown
  misc_feature (1)..( 8): Result.002 file - promoters60/1029242
aaatcaaa

SEQ ID NO: 102509 - DNA, 6 bp, Unknown
  misc_feature (1)..( 6): Result.002 file - promoters60/1029242
agagta

SEQ ID NO: 102510 - DNA, 6 bp, Unknown
  misc_feature (1)..( 6): Result.002 file - promoters60/1029242
agagta

SEQ ID NO: 102511 - DNA, 10 bp, Unknown
  misc_feature (1)..( 10): Result.002 file - promoters60/1029242
caaatttctt

SEQ ID NO: 102512 - DNA, 10 bp, Unknown
  misc_feature (1)..( 10): Result.002 file - promoters60/1029242
caaatatctt

SEQ ID NO: 102513 - DNA, 7 bp, Unknown
  misc_feature (1)..( 7): Result.002 file - promoters60/1029242
ttttctt

SEQ ID NO: 102514 - DNA, 7 bp, Unknown
  misc_feature (1)..( 7): Result.002 file - promoters60/1029242
tttactt

SEQ ID NO: 102515 - DNA, 6 bp, Unknown
  misc_feature (1)..( 6): Result.002 file - promoters60/1029242
aaaaat

SEQ ID NO: 102516 - DNA, 6 bp, Unknown
  misc_feature (1)..( 6): Result.002 file - promoters60/1029242
aaaaat

SEQ ID NO: 102517 - DNA, 8 bp, Unknown
  misc_feature (1)..( 8): Result.002 file - promoters60/1029242
tatttaca

SEQ ID NO: 102518 - DNA, 8 bp, Unknown
  misc_feature (1)..( 8): Result.002 file - promoters60/1029242
tatataca

SEQ ID NO: 102519 - DNA, 9 bp, Unknown
  misc_feature (1)..( 9): Result.002 file - promoters60/1029315
ttttgattt

SEQ ID NO: 102520 - DNA, 9 bp, Unknown
  misc_feature (1)..( 9): Result.002 file - promoters60/1029315
ttttggttt

SEQ ID NO: 102521 - DNA, 9 bp, Unknown
  misc_feature (1)..( 9): Result.002 file - promoters60/1029315
ggtggattc

SEQ ID NO: 102522 - DNA, 8 bp, Unknown
  misc_feature (1)..( 8): Result.002 file - promoters60/1029315
caacattc

SEQ ID NO: 102523 - DNA, 8 bp, Unknown
  misc_feature (1)..( 8): Result.002 file - promoters60/1029315
caaaattg

SEQ ID NO: 102524 - DNA, 8 bp, Unknown
  misc_feature (1)..( 8): Result.002 file - promoters60/1029315
aaaacttg

SEQ ID NO: 102525 - DNA, 9 bp, Unknown
  misc_feature (1)..( 9): Result.002 file - promoters60/1029315
aacaaacac

SEQ ID NO: 102526 - DNA, 9 bp, Unknown
  misc_feature (1)..( 9): Result.002 file - promoters60/1029315
aacaatcac

SEQ ID NO: 102527 - DNA, 9 bp, Unknown
  misc_feature (1)..( 9): Result.002 file - promoters60/1029315
aacaatcaa

SEQ ID NO: 102528 - DNA, 7 bp, Unknown
  misc_feature (1)..( 7): Result.002 file - promoters60/1029315
atataat

SEQ ID NO: 102529 - DNA, 7 bp, Unknown
  misc_feature (1)..( 7): Result.002 file - promoters60/1029315
atataat

SEQ ID NO: 102530 - DNA, 7 bp, Unknown
  misc_feature (1)..( 7): Result.002 file - promoters60/1029315
atataaa

SEQ ID NO: 102531 - DNA, 9 bp, Unknown
  misc_feature (1)..( 9): Result.002 file - promoters60/1029315
ctttgatta

SEQ ID NO: 102532 - DNA, 9 bp, Unknown
  misc_feature (1)..( 9): Result.002 file - promoters60/1029315
ttttcatta

SEQ ID NO: 102533 - DNA, 9 bp, Unknown
  misc_feature (1)..( 9): Result.002 file - promoters60/1029315
ttttcaata

SEQ ID NO: 102534 - DNA, 9 bp, Unknown
  misc_feature (1)..( 9): Result.002 file - promoters60/1029315
aaactaaac

SEQ ID NO: 102535 - DNA, 9 bp, Unknown
  misc_feature (1)..( 9): Result.002 file - promoters60/1029315
aaactaatt

SEQ ID NO: 102536 - DNA, 9 bp, Unknown
  misc_feature (1)..( 9): Result.002 file - promoters60/1029315
aaagtaatt

SEQ ID NO: 102537 - DNA, 9 bp, Unknown
  misc_feature (1)..( 9): Result.002 file - promoters60/1029395
aattgatga

SEQ ID NO: 102538 - DNA, 9 bp, Unknown
  misc_feature (1)..( 9): Result.002 file - promoters60/1029395
atttggtga

SEQ ID NO: 102539 - DNA, 9 bp, Unknown
  misc_feature (1)..( 9): Result.002 file - promoters60/1029395
aatcgatct

SEQ ID NO: 102540 - DNA, 7 bp, Unknown
  misc_feature (1)..( 7): Result.002 file - promoters60/1029395
ataaatc

SEQ ID NO: 102541 - DNA, 7 bp, Unknown
  misc_feature (1)..( 7): Result.002 file - promoters60/1029395
atatatc

SEQ ID NO: 102542 - DNA, 8 bp, Unknown
  misc_feature (1)..( 8): Result.002 file - promoters60/1029395
atgaataa

SEQ ID NO: 102543 - DNA, 8 bp, Unknown
  misc_feature (1)..( 8): Result.002 file - promoters60/1029395
atgcataa

SEQ ID NO: 102544 - DNA, 7 bp, Unknown
  misc_feature (1)..( 7): Result.002 file - promoters60/1029395
ctaattg

SEQ ID NO: 102545 - DNA, 7 bp, Unknown
  misc_feature (1)..( 7): Result.002 file - promoters60/1029395
ctatttg

SEQ ID NO: 102546 - DNA, 6 bp, Unknown
  misc_feature (1)..( 6): Result.002 file - promoters60/1029395
tagcta

SEQ ID NO: 102547 - DNA, 6 bp, Unknown
  misc_feature (1)..( 6): Result.002 file - promoters60/1029395
tagcta

SEQ ID NO: 102548 - DNA, 7 bp, Unknown
  misc_feature (1)..( 7): Result.002 file - promoters60/1029395
tcaattt

SEQ ID NO: 102549 - DNA, 7 bp, Unknown
  misc_feature (1)..( 7): Result.002 file - promoters60/1029395
tcagttt

SEQ ID NO: 102550 - DNA, 6 bp, Unknown
  misc_feature (1)..( 6): Result.002 file - promoters60/1029395
atctcg

SEQ ID NO: 102551 - DNA, 6 bp, Unknown
  misc_feature (1)..( 6): Result.002 file - promoters60/1029395
atctcg

SEQ ID NO: 102552 - DNA, 6 bp, Unknown
  misc_feature (1)..( 6): Result.002 file - promoters60/1029395
ctaaat

SEQ ID NO: 102553 - DNA, 6 bp, Unknown
  misc_feature (1)..( 6): Result.002 file - promoters60/1029395
ctaaat

SEQ ID NO: 102554 - DNA, 9 bp, Unknown
  misc_feature (1)..( 9): Result.002 file - promoters60/1029395
aattaaaaa

SEQ ID NO: 102555 - DNA, 9 bp, Unknown
  misc_feature (1)..( 9): Result.002 file - promoters60/1029395
aattgaaaa

SEQ ID NO: 102556 - DNA, 9 bp, Unknown
  misc_feature (1)..( 9): Result.002 file - promoters60/1029395
cttttgtat

SEQ ID NO: 102557 - DNA, 9 bp, Unknown
  misc_feature (1)..( 9): Result.002 file - promoters60/1029395
cttttttat

SEQ ID NO: 102558 - DNA, 6 bp, Unknown
  misc_feature (1)..( 6): Result.002 file - promoters60/1029395
aaaaga

SEQ ID NO: 102559 - DNA, 6 bp, Unknown
  misc_feature (1)..( 6): Result.002 file - promoters60/1029395
aaaaga

SEQ ID NO: 102560 - DNA, 6 bp, Unknown
  misc_feature (1)..( 6): Result.002 file - promoters60/1029395
aataat

SEQ ID NO: 102561 - DNA, 6 bp, Unknown
  misc_feature (1)..( 6): Result.002 file - promoters60/1029395
aataat

SEQ ID NO: 102562 - DNA, 8 bp, Unknown
  misc_feature (1)..( 8): Result.002 file - promoters60/1029395
aaacatgt

SEQ ID NO: 102563 - DNA, 8 bp, Unknown
  misc_feature (1)..( 8): Result.002 file - promoters60/1029395
aaacatgt

SEQ ID NO: 102564 - DNA, 9 bp, Unknown
  misc_feature (1)..( 9): Result.002 file - promoters60/1029395
tttatttga

SEQ ID NO: 102565 - DNA, 9 bp, Unknown
  misc_feature (1)..( 9): Result.002 file - promoters60/1029395
tttgtttca

SEQ ID NO: 102566 - DNA, 9 bp, Unknown
  misc_feature (1)..( 9): Result.002 file - promoters60/1029395
tctatttgt

SEQ ID NO: 102567 - DNA, 6 bp, Unknown
  misc_feature (1)..( 6): Result.002 file - promoters60/1029395
actatt

SEQ ID NO: 102568 - DNA, 6 bp, Unknown
  misc_feature (1)..( 6): Result.002 file - promoters60/1029395
actatt

SEQ ID NO: 102569 - DNA, 8 bp, Unknown
  misc_feature (1)..( 8): Result.002 file - promoters60/1029395
tcttttat

SEQ ID NO: 102570 - DNA, 8 bp, Unknown
  misc_feature (1)..( 8): Result.002 file - promoters60/1029395
tctcttat

SEQ ID NO: 102571 - DNA, 6 bp, Unknown
  misc_feature (1)..( 6): Result.002 file - promoters60/1029395
tttgta

SEQ ID NO: 102572 - DNA, 6 bp, Unknown
  misc_feature (1)..( 6): Result.002 file - promoters60/1029395
tttgta

SEQ ID NO: 102573 - DNA, 6 bp, Unknown
  misc_feature (1)..( 6): Result.002 file - promoters60/1029395
tcactc

SEQ ID NO: 102574 - DNA, 6 bp, Unknown
  misc_feature (1)..( 6): Result.002 file - promoters60/1029395
tcactc

SEQ ID NO: 102575 - DNA, 6 bp, Unknown
  misc_feature (1)..( 6): Result.002 file - promoters60/1029636
atcatt

SEQ ID NO: 102576 - DNA, 6 bp, Unknown
  misc_feature (1)..( 6): Result.002 file - promoters60/1029636
atcatt

SEQ ID NO: 102577 - DNA, 8 bp, Unknown
  misc_feature (1)..( 8): Result.002 file - promoters60/1029636
aatgattt

SEQ ID NO: 102578 - DNA, 8 bp, Unknown
  misc_feature (1)..( 8): Result.002 file - promoters60/1029636
aatcattt

SEQ ID NO: 102579 - DNA, 15 bp, Unknown
  misc_feature (1)..( 15): Result.002 file - promoters60/1029636
attattaaaaataaa

SEQ ID NO: 102580 - DNA, 15 bp, Unknown
  misc_feature (1)..( 15): Result.002 file - promoters60/1029636
attgttataaaaaaa

SEQ ID NO: 102581 - DNA, 6 bp, Unknown
  misc_feature (1)..( 6): Result.002 file - promoters60/1029636
agagaa

SEQ ID NO: 102582 - DNA, 6 bp, Unknown
  misc_feature (1)..( 6): Result.002 file - promoters60/1029636
agagaa

SEQ ID NO: 102583 - DNA, 7 bp, Unknown
  misc_feature (1)..( 7): Result.002 file - promoters60/1029636
gatagga

SEQ ID NO: 102584 - DNA, 7 bp, Unknown
  misc_feature (1)..( 7): Result.002 file - promoters60/1029636
gattgga

SEQ ID NO: 102585 - DNA, 8 bp, Unknown
  misc_feature (1)..( 8): Result.002 file - promoters60/1029636
agtgacat

SEQ ID NO: 102586 - DNA, 8 bp, Unknown
  misc_feature (1)..( 8): Result.002 file - promoters60/1029636
agtgacat

SEQ ID NO: 102587 - DNA, 12 bp, Unknown
  misc_feature (1)..( 12): Result.002 file - promoters60/1029636
gttaggttggat

SEQ ID NO: 102588 - DNA, 12 bp, Unknown
  misc_feature (1)..( 12): Result.002 file - promoters60/1029636
gttcggttcgat

SEQ ID NO: 102589 - DNA, 7 bp, Unknown
  misc_feature (1)..( 7): Result.002 file - promoters60/1029636
aaaaccg

SEQ ID NO: 102590 - DNA, 7 bp, Unknown
  misc_feature (1)..( 7): Result.002 file - promoters60/1029636
aaatccg

SEQ ID NO: 102591 - DNA, 6 bp, Unknown
  misc_feature (1)..( 6): Result.002 file - promoters60/1029636
tgtttc

SEQ ID NO: 102592 - DNA, 6 bp, Unknown
  misc_feature (1)..( 6): Result.002 file - promoters60/1029636
tgtttc

SEQ ID NO: 102593 - DNA, 6 bp, Unknown
  misc_feature (1)..( 6): Result.002 file - promoters60/1029837
ataaat

SEQ ID NO: 102594 - DNA, 6 bp, Unknown
  misc_feature (1)..( 6): Result.002 file - promoters60/1029837
ataaat

SEQ ID NO: 102595 - DNA, 6 bp, Unknown
  misc_feature (1)..( 6): Result.002 file - promoters60/1029837
caaaat

SEQ ID NO: 102596 - DNA, 6 bp, Unknown
  misc_feature (1)..( 6): Result.002 file - promoters60/1029837
caaaat

SEQ ID NO: 102597 - DNA, 6 bp, Unknown
  misc_feature (1)..( 6): Result.002 file - promoters60/1029837
ataata

SEQ ID NO: 102598 - DNA, 6 bp, Unknown
  misc_feature (1)..( 6): Result.002 file - promoters60/1029837
ataata

SEQ ID NO: 102599 - DNA, 6 bp, Unknown
  misc_feature (1)..( 6): Result.002 file - promoters60/1029837
aatttt

SEQ ID NO: 102600 - DNA, 6 bp, Unknown
  misc_feature (1)..( 6): Result.002 file - promoters60/1029837
aatttt

SEQ ID NO: 102601 - DNA, 8 bp, Unknown
  misc_feature (1)..( 8): Result.002 file - promoters60/1029837
ataaagaa

SEQ ID NO: 102602 - DNA, 8 bp, Unknown
  misc_feature (1)..( 8): Result.002 file - promoters60/1029837
atagagaa

SEQ ID NO: 102603 - DNA, 6 bp, Unknown
  misc_feature (1)..( 6): Result.002 file - promoters60/1029837
agtcgc

SEQ ID NO: 102604 - DNA, 6 bp, Unknown
  misc_feature (1)..( 6): Result.002 file - promoters60/1029837
agtcgc

SEQ ID NO: 102605 - DNA, 7 bp, Unknown
  misc_feature (1)..( 7): Result.002 file - promoters60/1029837
gccgagt

SEQ ID NO: 102606 - DNA, 7 bp, Unknown
  misc_feature (1)..( 7): Result.002 file - promoters60/1029837
gccgagt

SEQ ID NO: 102607 - DNA, 7 bp, Unknown
  misc_feature (1)..( 7): Result.002 file - promoters60/1029837
acggttc

SEQ ID NO: 102608 - DNA, 7 bp, Unknown
  misc_feature (1)..( 7): Result.002 file - promoters60/1029837
acgtttc

SEQ ID NO: 102609 - DNA, 8 bp, Unknown
  misc_feature (1)..( 8): Result.002 file - promoters60/1029837
tctaactc

SEQ ID NO: 102610 - DNA, 8 bp, Unknown
  misc_feature (1)..( 8): Result.002 file - promoters60/1029837
tctcactc

SEQ ID NO: 102611 - DNA, 6 bp, Unknown
  misc_feature (1)..( 6): Result.002 file - promoters60/1029837
agatta

SEQ ID NO: 102612 - DNA, 6 bp, Unknown
  misc_feature (1)..( 6): Result.002 file - promoters60/1029837
agatta

SEQ ID NO: 102613 - DNA, 18 bp, Unknown
  misc_feature (1)..( 18): Result.002 file - promoters60/1029837
aaatcttactaatcaaat

SEQ ID NO: 102614 - DNA, 18 bp, Unknown
  misc_feature (1)..( 18): Result.002 file - promoters60/1029837
aaatattaataattaaat

SEQ ID NO: 102615 - DNA, 18 bp, Unknown
  misc_feature (1)..( 18): Result.002 file - promoters60/1029837
ataaagtaataataacaa

SEQ ID NO: 102616 - DNA, 7 bp, Unknown
  misc_feature (1)..( 7): Result.002 file - promoters60/1029837
tttttga

SEQ ID NO: 102617 - DNA, 7 bp, Unknown
  misc_feature (1)..( 7): Result.002 file - promoters60/1029837
tttttga

SEQ ID NO: 102618 - DNA, 7 bp, Unknown
  misc_feature (1)..( 7): Result.002 file - promoters60/1029837
tttaaat

SEQ ID NO: 102619 - DNA, 7 bp, Unknown
  misc_feature (1)..( 7): Result.002 file - promoters60/1029837
tttaaat

SEQ ID NO: 102620 - DNA, 8 bp, Unknown
  misc_feature (1)..( 8): Result.002 file - promoters60/1029837
aattaatt

SEQ ID NO: 102621 - DNA, 8 bp, Unknown
  misc_feature (1)..( 8): Result.002 file - promoters60/1029837
aataaatt

SEQ ID NO: 102622 - DNA, 7 bp, Unknown
  misc_feature (1)..( 7): Result.002 file - promoters60/1029837
tcattaa

SEQ ID NO: 102623 - DNA, 7 bp, Unknown
  misc_feature (1)..( 7): Result.002 file - promoters60/1029837
tcattaa

SEQ ID NO: 102624 - DNA, 7 bp, Unknown
  misc_feature (1)..( 7): Result.002 file - promoters60/1029837
tctctga

SEQ ID NO: 102625 - DNA, 7 bp, Unknown
  misc_feature (1)..( 7): Result.002 file - promoters60/1029837
tctttga

SEQ ID NO: 102626 - DNA, 6 bp, Unknown
  misc_feature (1)..( 6): Result.002 file - promoters60/1029837
cctata

SEQ ID NO: 102627 - DNA, 6 bp, Unknown
  misc_feature (1)..( 6): Result.002 file - promoters60/1029837
cctata

SEQ ID NO: 102628 - DNA, 8 bp, Unknown
  misc_feature (1)..( 8): Result.002 file - promoters60/1029837
taaatttt

SEQ ID NO: 102629 - DNA, 8 bp, Unknown
  misc_feature (1)..( 8): Result.002 file - promoters60/1029837
aaaattta

SEQ ID NO: 102630 - DNA, 6 bp, Unknown
  misc_feature (1)..( 6): Result.002 file - promoters60/1029837
aacttt

SEQ ID NO: 102631 - DNA, 6 bp, Unknown
  misc_feature (1)..( 6): Result.002 file - promoters60/1029837
aacttt

SEQ ID NO: 102632 - DNA, 7 bp, Unknown
  misc_feature (1)..( 7): Result.002 file - promoters60/1029837
agatcca

SEQ ID NO: 102633 - DNA, 7 bp, Unknown
  misc_feature (1)..( 7): Result.002 file - promoters60/1029837
agatcca

SEQ ID NO: 102634 - DNA, 6 bp, Unknown
  misc_feature (1)..( 6): Result.002 file - promoters60/1029837
ttaatg

SEQ ID NO: 102635 - DNA, 6 bp, Unknown
  misc_feature (1)..( 6): Result.002 file - promoters60/1029837
ttaatg

SEQ ID NO: 102636 - DNA, 6 bp, Unknown
  misc_feature (1)..( 6): Result.002 file - promoters60/1029837
gaaaaa

SEQ ID NO: 102637 - DNA, 6 bp, Unknown
  misc_feature (1)..( 6): Result.002 file - promoters60/1029837
gaaaaa

SEQ ID NO: 102638 - DNA, 8 bp, Unknown
  misc_feature (1)..( 8): Result.002 file - promoters60/1029841
aaaacatt

SEQ ID NO: 102639 - DNA, 8 bp, Unknown
  misc_feature (1)..( 8): Result.002 file - promoters60/1029841
aaaacaaa

SEQ ID NO: 102640 - DNA, 8 bp, Unknown
  misc_feature (1)..( 8): Result.002 file - promoters60/1029841
aaatcaaa

SEQ ID NO: 102641 - DNA, 8 bp, Unknown
  misc_feature (1)..( 8): Result.002 file - promoters60/1029841
cataagag

SEQ ID NO: 102642 - DNA, 8 bp, Unknown
  misc_feature (1)..( 8): Result.002 file - promoters60/1029841
cataagtc

SEQ ID NO: 102643 - DNA, 8 bp, Unknown
  misc_feature (1)..( 8): Result.002 file - promoters60/1029841
tataagat

SEQ ID NO: 102644 - DNA, 8 bp, Unknown
  misc_feature (1)..( 8): Result.002 file - promoters60/1029841
tttaagat

SEQ ID NO: 102645 - DNA, 11 bp, Unknown
  misc_feature (1)..( 11): Result.002 file - promoters60/1029841
gaataaagtat

SEQ ID NO: 102646 - DNA, 11 bp, Unknown
  misc_feature (1)..( 11): Result.002 file - promoters60/1029841
agatacagtat

SEQ ID NO: 102647 - DNA, 11 bp, Unknown
  misc_feature (1)..( 11): Result.002 file - promoters60/1029841
gaagaaaaaag

SEQ ID NO: 102648 - DNA, 11 bp, Unknown
  misc_feature (1)..( 11): Result.002 file - promoters60/1029841
aaagaaaaaca

SEQ ID NO: 102649 - DNA, 9 bp, Unknown
  misc_feature (1)..( 9): Result.002 file - promoters60/1029841
gaataatcc

SEQ ID NO: 102650 - DNA, 9 bp, Unknown
  misc_feature (1)..( 9): Result.002 file - promoters60/1029841
taataatta

SEQ ID NO: 102651 - DNA, 9 bp, Unknown
  misc_feature (1)..( 9): Result.002 file - promoters60/1029841
aaatattta

SEQ ID NO: 102652 - DNA, 9 bp, Unknown
  misc_feature (1)..( 9): Result.002 file - promoters60/1029841
taaaaatca

SEQ ID NO: 102653 - DNA, 7 bp, Unknown
  misc_feature (1)..( 7): Result.002 file - promoters60/1029841
taaattg

SEQ ID NO: 102654 - DNA, 7 bp, Unknown
  misc_feature (1)..( 7): Result.002 file - promoters60/1029841
taagttg

SEQ ID NO: 102655 - DNA, 7 bp, Unknown
  misc_feature (1)..( 7): Result.002 file - promoters60/1029841
taaattg

SEQ ID NO: 102656 - DNA, 13 bp, Unknown
  misc_feature (1)..( 13): Result.002 file - promoters60/1029841
aaaccaaaatcac

SEQ ID NO: 102657 - DNA, 13 bp, Unknown
  misc_feature (1)..( 13): Result.002 file - promoters60/1029841
aaaacaaaacatt

SEQ ID NO: 102658 - DNA, 13 bp, Unknown
  misc_feature (1)..( 13): Result.002 file - promoters60/1029841
taaacacaataca

SEQ ID NO: 102659 - DNA, 10 bp, Unknown
  misc_feature (1)..( 10): Result.002 file - promoters60/1029841
ataatgtgag

SEQ ID NO: 102660 - DNA, 10 bp, Unknown
  misc_feature (1)..( 10): Result.002 file - promoters60/1029841
gtaatgtaca

SEQ ID NO: 102661 - DNA, 10 bp, Unknown
  misc_feature (1)..( 10): Result.002 file - promoters60/1029841
gtaatgaaca

SEQ ID NO: 102662 - DNA, 8 bp, Unknown
  misc_feature (1)..( 8): Result.002 file - promoters60/1029841
aaaatgaa

SEQ ID NO: 102663 - DNA, 8 bp, Unknown
  misc_feature (1)..( 8): Result.002 file - promoters60/1029841
aaaaagaa

SEQ ID NO: 102664 - DNA, 9 bp, Unknown
  misc_feature (1)..( 9): Result.002 file - promoters60/1029841
aagaaagat

SEQ ID NO: 102665 - DNA, 16 bp, Unknown
  misc_feature (1)..( 16): Result.002 file - promoters60/1029908
tgagaagatttatttg

SEQ ID NO: 102666 - DNA, 16 bp, Unknown
  misc_feature (1)..( 16): Result.002 file - promoters60/1029908
aagaaagattctgaat

SEQ ID NO: 102667 - DNA, 16 bp, Unknown
  misc_feature (1)..( 16): Result.002 file - promoters60/1029908
gttatagatttaattg

SEQ ID NO: 102668 - DNA, 16 bp, Unknown
  misc_feature (1)..( 16): Result.002 file - promoters60/1029908
aagaaaaattacgaga

SEQ ID NO: 102669 - DNA, 16 bp, Unknown
  misc_feature (1)..( 16): Result.002 file - promoters60/1029908
cgtatagattagatca

SEQ ID NO: 102670 - DNA, 16 bp, Unknown
  misc_feature (1)..( 16): Result.002 file - promoters60/1029908
tgggacgaagcccgta

SEQ ID NO: 102671 - DNA, 12 bp, Unknown
  misc_feature (1)..( 12): Result.002 file - promoters60/1029931
gcaaggtttcgt

SEQ ID NO: 102672 - DNA, 12 bp, Unknown
  misc_feature (1)..( 12): Result.002 file - promoters60/1029931
caaagctttaaa

SEQ ID NO: 102673 - DNA, 12 bp, Unknown
  misc_feature (1)..( 12): Result.002 file - promoters60/1029931
gcaaggttggat

SEQ ID NO: 102674 - DNA, 12 bp, Unknown
  misc_feature (1)..( 12): Result.002 file - promoters60/1029931
aaaatctttaaa

SEQ ID NO: 102675 - DNA, 6 bp, Unknown
  misc_feature (1)..( 6): Result.002 file - promoters60/1030139
ttcaca

SEQ ID NO: 102676 - DNA, 6 bp, Unknown
  misc_feature (1)..( 6): Result.002 file - promoters60/1030139
ttcaca

SEQ ID NO: 102677 - DNA, 6 bp, Unknown
  misc_feature (1)..( 6): Result.002 file - promoters60/1030139
agcttt

SEQ ID NO: 102678 - DNA, 6 bp, Unknown
  misc_feature (1)..( 6): Result.002 file - promoters60/1030139
agcttt

SEQ ID NO: 102679 - DNA, 6 bp, Unknown
  misc_feature (1)..( 6): Result.002 file - promoters60/1030139
ttttca

SEQ ID NO: 102680 - DNA, 6 bp, Unknown
  misc_feature (1)..( 6): Result.002 file - promoters60/1030139
ttttca

SEQ ID NO: 102681 - DNA, 7 bp, Unknown
  misc_feature (1)..( 7): Result.002 file - promoters60/1030139
atataag

SEQ ID NO: 102682 - DNA, 7 bp, Unknown
  misc_feature (1)..( 7): Result.002 file - promoters60/1030139
atataag

SEQ ID NO: 102683 - DNA, 6 bp, Unknown
  misc_feature (1)..( 6): Result.002 file - promoters60/1030139
tcacta

SEQ ID NO: 102684 - DNA, 6 bp, Unknown
  misc_feature (1)..( 6): Result.002 file - promoters60/1030139
tcacta

SEQ ID NO: 102685 - DNA, 6 bp, Unknown
  misc_feature (1)..( 6): Result.002 file - promoters60/1030139
tcaatc

SEQ ID NO: 102686 - DNA, 6 bp, Unknown
  misc_feature (1)..( 6): Result.002 file - promoters60/1030139
tcaatc

SEQ ID NO: 102687 - DNA, 6 bp, Unknown
  misc_feature (1)..( 6): Result.002 file - promoters60/1030139
agtaag

SEQ ID NO: 102688 - DNA, 6 bp, Unknown
  misc_feature (1)..( 6): Result.002 file - promoters60/1030139
agtaag

SEQ ID NO: 102689 - DNA, 7 bp, Unknown
  misc_feature (1)..( 7): Result.002 file - promoters60/1030139
accaaac

SEQ ID NO: 102690 - DNA, 7 bp, Unknown
  misc_feature (1)..( 7): Result.002 file - promoters60/1030139
accaaac

SEQ ID NO: 102691 - DNA, 7 bp, Unknown
  misc_feature (1)..( 7): Result.002 file - promoters60/1030139
ttgctgt

SEQ ID NO: 102692 - DNA, 7 bp, Unknown
  misc_feature (1)..( 7): Result.002 file - promoters60/1030139
ttgatgt

SEQ ID NO: 102693 - DNA, 7 bp, Unknown
  misc_feature (1)..( 7): Result.002 file - promoters60/1030157
aacattt

SEQ ID NO: 102694 - DNA, 7 bp, Unknown
  misc_feature (1)..( 7): Result.002 file - promoters60/1030157
aacattt

SEQ ID NO: 102695 - DNA, 7 bp, Unknown
  misc_feature (1)..( 7): Result.002 file - promoters60/1030157
aacattc

SEQ ID NO: 102696 - DNA, 7 bp, Unknown
  misc_feature (1)..( 7): Result.002 file - promoters60/1030157
taaccta

SEQ ID NO: 102697 - DNA, 7 bp, Unknown
  misc_feature (1)..( 7): Result.002 file - promoters60/1030157
taaacta

SEQ ID NO: 102698 - DNA, 6 bp, Unknown
  misc_feature (1)..( 6): Result.002 file - promoters60/1030157
gaaatt

SEQ ID NO: 102699 - DNA, 6 bp, Unknown
  misc_feature (1)..( 6): Result.002 file - promoters60/1030157
gaaatt

SEQ ID NO: 102700 - DNA, 7 bp, Unknown
  misc_feature (1)..( 7): Result.002 file - promoters60/1030157
taatata

SEQ ID NO: 102701 - DNA, 7 bp, Unknown
  misc_feature (1)..( 7): Result.002 file - promoters60/1030157
taaaata

SEQ ID NO: 102702 - DNA, 6 bp, Unknown
  misc_feature (1)..( 6): Result.002 file - promoters60/1030157
taatta

SEQ ID NO: 102703 - DNA, 6 bp, Unknown
  misc_feature (1)..( 6): Result.002 file - promoters60/1030157
taatta

SEQ ID NO: 102704 - DNA, 6 bp, Unknown
  misc_feature (1)..( 6): Result.002 file - promoters60/1030157
aaaata

SEQ ID NO: 102705 - DNA, 6 bp, Unknown
  misc_feature (1)..( 6): Result.002 file - promoters60/1030157
aaaata

SEQ ID NO: 102706 - DNA, 7 bp, Unknown
  misc_feature (1)..( 7): Result.002 file - promoters60/1030157
aataaca

SEQ ID NO: 102707 - DNA, 7 bp, Unknown
  misc_feature (1)..( 7): Result.002 file - promoters60/1030157
aataaca

SEQ ID NO: 102708 - DNA, 7 bp, Unknown
  misc_feature (1)..( 7): Result.002 file - promoters60/1030157
tttgttt

SEQ ID NO: 102709 - DNA, 7 bp, Unknown
  misc_feature (1)..( 7): Result.002 file - promoters60/1030157
tttcttt

SEQ ID NO: 102710 - DNA, 8 bp, Unknown
  misc_feature (1)..( 8): Result.002 file - promoters60/1030157
tgaaatat

SEQ ID NO: 102711 - DNA, 8 bp, Unknown
  misc_feature (1)..( 8): Result.002 file - promoters60/1030157
tgagatat

SEQ ID NO: 102712 - DNA, 6 bp, Unknown
  misc_feature (1)..( 6): Result.002 file - promoters60/1030157
tcaaat

SEQ ID NO: 102713 - DNA, 6 bp, Unknown
  misc_feature (1)..( 6): Result.002 file - promoters60/1030157
tcaaat

SEQ ID NO: 102714 - DNA, 7 bp, Unknown
  misc_feature (1)..( 7): Result.002 file - promoters60/1030157
caattcg

SEQ ID NO: 102715 - DNA, 7 bp, Unknown
  misc_feature (1)..( 7): Result.002 file - promoters60/1030157
caaatcg

SEQ ID NO: 102716 - DNA, 6 bp, Unknown
  misc_feature (1)..( 6): Result.002 file - promoters60/1030157
aaaata

SEQ ID NO: 102717 - DNA, 6 bp, Unknown
  misc_feature (1)..( 6): Result.002 file - promoters60/1030157
aaaata

SEQ ID NO: 102718 - DNA, 6 bp, Unknown
  misc_feature (1)..( 6): Result.002 file - promoters60/1030157
tataac

SEQ ID NO: 102719 - DNA, 6 bp, Unknown
  misc_feature (1)..( 6): Result.002 file - promoters60/1030157
tataac

SEQ ID NO: 102720 - DNA, 8 bp, Unknown
  misc_feature (1)..( 8): Result.002 file - promoters60/1030157
agtgaaga

SEQ ID NO: 102721 - DNA, 8 bp, Unknown
  misc_feature (1)..( 8): Result.002 file - promoters60/1030157
agtgaaga

SEQ ID NO: 102722 - DNA, 6 bp, Unknown
  misc_feature (1)..( 6): Result.002 file - promoters60/1030157
agacga

SEQ ID NO: 102723 - DNA, 6 bp, Unknown
  misc_feature (1)..( 6): Result.002 file - promoters60/1030157
agacga

SEQ ID NO: 102724 - DNA, 6 bp, Unknown
  misc_feature (1)..( 6): Result.002 file - promoters60/1030209
tattct

SEQ ID NO: 102725 - DNA, 6 bp, Unknown
  misc_feature (1)..( 6): Result.002 file - promoters60/1030209
tattct

SEQ ID NO: 102726 - DNA, 9 bp, Unknown
  misc_feature (1)..( 9): Result.002 file - promoters60/1030209
atgatatct

SEQ ID NO: 102727 - DNA, 9 bp, Unknown
  misc_feature (1)..( 9): Result.002 file - promoters60/1030209
atgttatct

SEQ ID NO: 102728 - DNA, 11 bp, Unknown
  misc_feature (1)..( 11): Result.002 file - promoters60/1030209
tcttctcaaca

SEQ ID NO: 102729 - DNA, 11 bp, Unknown
  misc_feature (1)..( 11): Result.002 file - promoters60/1030209
tctactccaca

SEQ ID NO: 102730 - DNA, 11 bp, Unknown
  misc_feature (1)..( 11): Result.002 file - promoters60/1030209
gttaaatctaa

SEQ ID NO: 102731 - DNA, 11 bp, Unknown
  misc_feature (1)..( 11): Result.002 file - promoters60/1030209
gttacatcaag

SEQ ID NO: 102732 - DNA, 11 bp, Unknown
  misc_feature (1)..( 11): Result.002 file - promoters60/1030209
aacacaccaag

SEQ ID NO: 102733 - DNA, 7 bp, Unknown
  misc_feature (1)..( 7): Result.002 file - promoters60/1030209
aagcaaa

SEQ ID NO: 102734 - DNA, 7 bp, Unknown
  misc_feature (1)..( 7): Result.002 file - promoters60/1030209
aagaaaa

SEQ ID NO: 102735 - DNA, 7 bp, Unknown
  misc_feature (1)..( 7): Result.002 file - promoters60/1030209
aaatccc

SEQ ID NO: 102736 - DNA, 7 bp, Unknown
  misc_feature (1)..( 7): Result.002 file - promoters60/1030209
aaagccc

SEQ ID NO: 102737 - DNA, 6 bp, Unknown
  misc_feature (1)..( 6): Result.002 file - promoters60/1030209
tatttt

SEQ ID NO: 102738 - DNA, 6 bp, Unknown
  misc_feature (1)..( 6): Result.002 file - promoters60/1030209
tatttt

SEQ ID NO: 102739 - DNA, 9 bp, Unknown
  misc_feature (1)..( 9): Result.002 file - promoters60/1030209
ttttaaaaa

SEQ ID NO: 102740 - DNA, 9 bp, Unknown
  misc_feature (1)..( 9): Result.002 file - promoters60/1030209
ttttgaaaa

SEQ ID NO: 102741 - DNA, 9 bp, Unknown
  misc_feature (1)..( 9): Result.002 file - promoters60/1030209
atctaaaaa

SEQ ID NO: 102742 - DNA, 6 bp, Unknown
  misc_feature (1)..( 6): Result.002 file - promoters60/1030209
aaacag

SEQ ID NO: 102743 - DNA, 6 bp, Unknown
  misc_feature (1)..( 6): Result.002 file - promoters60/1030209
aaacag

SEQ ID NO: 102744 - DNA, 8 bp, Unknown
  misc_feature (1)..( 8): Result.002 file - promoters60/1030209
aaaaagtt

SEQ ID NO: 102745 - DNA, 8 bp, Unknown
  misc_feature (1)..( 8): Result.002 file - promoters60/1030209
aaagagtt

SEQ ID NO: 102746 - DNA, 11 bp, Unknown
  misc_feature (1)..( 11): Result.002 file - promoters60/1030209
gatgagagaaa

SEQ ID NO: 102747 - DNA, 11 bp, Unknown
  misc_feature (1)..( 11): Result.002 file - promoters60/1030209
gatcagagaaa

SEQ ID NO: 102748 - DNA, 7 bp, Unknown
  misc_feature (1)..( 7): Result.002 file - promoters60/1030209
gaatatt

SEQ ID NO: 102749 - DNA, 7 bp, Unknown
  misc_feature (1)..( 7): Result.002 file - promoters60/1030209
gaaaatt

SEQ ID NO: 102750 - DNA, 6 bp, Unknown
  misc_feature (1)..( 6): Result.002 file - promoters60/1030209
tttctc

SEQ ID NO: 102751 - DNA, 6 bp, Unknown
  misc_feature (1)..( 6): Result.002 file - promoters60/1030209
tttctc

SEQ ID NO: 102752 - DNA, 6 bp, Unknown
  misc_feature (1)..( 6): Result.002 file - promoters60/1030209
aaaaat

SEQ ID NO: 102753 - DNA, 6 bp, Unknown
  misc_feature (1)..( 6): Result.002 file - promoters60/1030209
aaaaat

SEQ ID NO: 102754 - DNA, 7 bp, Unknown
  misc_feature (1)..( 7): Result.002 file - promoters60/1030209
aaagtaa

SEQ ID NO: 102755 - DNA, 7 bp, Unknown
  misc_feature (1)..( 7): Result.002 file - promoters60/1030209
aaaataa

SEQ ID NO: 102756 - DNA, 6 bp, Unknown
  misc_feature (1)..( 6): Result.002 file - promoters60/1030209
aaaaac

SEQ ID NO: 102757 - DNA, 6 bp, Unknown
  misc_feature (1)..( 6): Result.002 file - promoters60/1030209
aaaaac

SEQ ID NO: 102758 - DNA, 12 bp, Unknown
  misc_feature (1)..( 12): Result.002 file - promoters60/1030259
ttttatttctat

SEQ ID NO: 102759 - DNA, 12 bp, Unknown
  misc_feature (1)..( 12): Result.002 file - promoters60/1030259
atttatttggat

SEQ ID NO: 102760 - DNA, 12 bp, Unknown
  misc_feature (1)..( 12): Result.002 file - promoters60/1030259
atttatttatat

SEQ ID NO: 102761 - DNA, 13 bp, Unknown
  misc_feature (1)..( 13): Result.002 file - promoters60/1030259
tttctattgcaac

SEQ ID NO: 102762 - DNA, 7 bp, Unknown
  misc_feature (1)..( 7): Result.002 file - promoters60/1030336
cgccgcc

SEQ ID NO: 102763 - DNA, 7 bp, Unknown
  misc_feature (1)..( 7): Result.002 file - promoters60/1030336
cgccgcc

SEQ ID NO: 102764 - DNA, 10 bp, Unknown
  misc_feature (1)..( 10): Result.002 file - promoters60/1030336
aatcattcaa

SEQ ID NO: 102765 - DNA, 10 bp, Unknown
  misc_feature (1)..( 10): Result.002 file - promoters60/1030336
aatccttcaa

SEQ ID NO: 102766 - DNA, 7 bp, Unknown
  misc_feature (1)..( 7): Result.002 file - promoters60/1030336
caatttc

SEQ ID NO: 102767 - DNA, 7 bp, Unknown
  misc_feature (1)..( 7): Result.002 file - promoters60/1030336
caaattc

SEQ ID NO: 102768 - DNA, 12 bp, Unknown
  misc_feature (1)..( 12): Result.002 file - promoters60/1030336
cgtcaaaaagaa

SEQ ID NO: 102769 - DNA, 12 bp, Unknown
  misc_feature (1)..( 12): Result.002 file - promoters60/1030336
ggtaaaacagaa

SEQ ID NO: 102770 - DNA, 13 bp, Unknown
  misc_feature (1)..( 13): Result.002 file - promoters60/1030336
aggtaaaccagat

SEQ ID NO: 102771 - DNA, 8 bp, Unknown
  misc_feature (1)..( 8): Result.002 file - promoters60/1030336
tttaagaa

SEQ ID NO: 102772 - DNA, 8 bp, Unknown
  misc_feature (1)..( 8): Result.002 file - promoters60/1030336
tttatgaa

SEQ ID NO: 102773 - DNA, 6 bp, Unknown
  misc_feature (1)..( 6): Result.002 file - promoters60/1030336
gtttcg

SEQ ID NO: 102774 - DNA, 6 bp, Unknown
  misc_feature (1)..( 6): Result.002 file - promoters60/1030336
gtttcg

SEQ ID NO: 102775 - DNA, 7 bp, Unknown
  misc_feature (1)..( 7): Result.002 file - promoters60/1030336
cgccttt

SEQ ID NO: 102776 - DNA, 7 bp, Unknown
  misc_feature (1)..( 7): Result.002 file - promoters60/1030336
cgccttt

SEQ ID NO: 102777 - DNA, 6 bp, Unknown
  misc_feature (1)..( 6): Result.002 file - promoters60/1030336
aatttc

SEQ ID NO: 102778 - DNA, 6 bp, Unknown
  misc_feature (1)..( 6): Result.002 file - promoters60/1030336
aatttc

SEQ ID NO: 102779 - DNA, 8 bp, Unknown
  misc_feature (1)..( 8): Result.002 file - promoters60/1030336
ccagaaga

SEQ ID NO: 102780 - DNA, 8 bp, Unknown
  misc_feature (1)..( 8): Result.002 file - promoters60/1030336
ccaaaaga

SEQ ID NO: 102781 - DNA, 6 bp, Unknown
  misc_feature (1)..( 6): Result.002 file - promoters60/1030336
aagaga

SEQ ID NO: 102782 - DNA, 6 bp, Unknown
  misc_feature (1)..( 6): Result.002 file - promoters60/1030336
aagaga

SEQ ID NO: 102783 - DNA, 7 bp, Unknown
  misc_feature (1)..( 7): Result.002 file - promoters60/1030336
atcatcg

SEQ ID NO: 102784 - DNA, 7 bp, Unknown
  misc_feature (1)..( 7): Result.002 file - promoters60/1030336
atcatcg

SEQ ID NO: 102785 - DNA, 6 bp, Unknown
  misc_feature (1)..( 6): Result.002 file - promoters60/1030336
cggtta

SEQ ID NO: 102786 - DNA, 6 bp, Unknown
  misc_feature (1)..( 6): Result.002 file - promoters60/1030336
cggtta

SEQ ID NO: 102787 - DNA, 8 bp, Unknown
  misc_feature (1)..( 8): Result.002 file - promoters60/1030428
tgttttta

SEQ ID NO: 102788 - DNA, 8 bp, Unknown
  misc_feature (1)..( 8): Result.002 file - promoters60/1030428
tattttta

SEQ ID NO: 102789 - DNA, 8 bp, Unknown
  misc_feature (1)..( 8): Result.002 file - promoters60/1030428
tatatttc

SEQ ID NO: 102790 - DNA, 8 bp, Unknown
  misc_feature (1)..( 8): Result.002 file - promoters60/1030428
atatgtga

SEQ ID NO: 102791 - DNA, 8 bp, Unknown
  misc_feature (1)..( 8): Result.002 file - promoters60/1030428
atatgtta

SEQ ID NO: 102792 - DNA, 8 bp, Unknown
  misc_feature (1)..( 8): Result.002 file - promoters60/1030428
ttatttta

SEQ ID NO: 102793 - DNA, 7 bp, Unknown
  misc_feature (1)..( 7): Result.002 file - promoters60/1030428
tataaag

SEQ ID NO: 102794 - DNA, 7 bp, Unknown
  misc_feature (1)..( 7): Result.002 file - promoters60/1030428
aataaag

SEQ ID NO: 102795 - DNA, 7 bp, Unknown
  misc_feature (1)..( 7): Result.002 file - promoters60/1030428
tataaac

SEQ ID NO: 102796 - DNA, 9 bp, Unknown
  misc_feature (1)..( 9): Result.002 file - promoters60/1030428
tgttatata

SEQ ID NO: 102797 - DNA, 9 bp, Unknown
  misc_feature (1)..( 9): Result.002 file - promoters60/1030428
gattacata

SEQ ID NO: 102798 - DNA, 9 bp, Unknown
  misc_feature (1)..( 9): Result.002 file - promoters60/1030428
gattacagc

SEQ ID NO: 102799 - DNA, 7 bp, Unknown
  misc_feature (1)..( 7): Result.002 file - promoters60/1030428
taaagaa

SEQ ID NO: 102800 - DNA, 7 bp, Unknown
  misc_feature (1)..( 7): Result.002 file - promoters60/1030428
aaaagaa

SEQ ID NO: 102801 - DNA, 7 bp, Unknown
  misc_feature (1)..( 7): Result.002 file - promoters60/1030428
aaaagag

SEQ ID NO: 102802 - DNA, 8 bp, Unknown
  misc_feature (1)..( 8): Result.002 file - promoters60/1030428
tgtgtttt

SEQ ID NO: 102803 - DNA, 8 bp, Unknown
  misc_feature (1)..( 8): Result.002 file - promoters60/1030428
cttgtttt

SEQ ID NO: 102804 - DNA, 8 bp, Unknown
  misc_feature (1)..( 8): Result.002 file - promoters60/1030428
cttatttc

SEQ ID NO: 102805 - DNA, 7 bp, Unknown
  misc_feature (1)..( 7): Result.002 file - promoters60/1030528
ttaaaaa

SEQ ID NO: 102806 - DNA, 7 bp, Unknown
  misc_feature (1)..( 7): Result.002 file - promoters60/1030528
ttaaaac

SEQ ID NO: 102807 - DNA, 7 bp, Unknown
  misc_feature (1)..( 7): Result.002 file - promoters60/1030528
ctaaaaa

SEQ ID NO: 102808 - DNA, 7 bp, Unknown
  misc_feature (1)..( 7): Result.002 file - promoters60/1030528
ttaaaat

SEQ ID NO: 102809 - DNA, 9 bp, Unknown
  misc_feature (1)..( 9): Result.002 file - promoters60/1030528
atactaatt

SEQ ID NO: 102810 - DNA, 9 bp, Unknown
  misc_feature (1)..( 9): Result.002 file - promoters60/1030528
ataataatt

SEQ ID NO: 102811 - DNA, 9 bp, Unknown
  misc_feature (1)..( 9): Result.002 file - promoters60/1030528
agaataatg

SEQ ID NO: 102812 - DNA, 13 bp, Unknown
  misc_feature (1)..( 13): Result.002 file - promoters60/1030528
ttatttttttaaa

SEQ ID NO: 102813 - DNA, 13 bp, Unknown
  misc_feature (1)..( 13): Result.002 file - promoters60/1030528
ttatatttttaat

SEQ ID NO: 102814 - DNA, 13 bp, Unknown
  misc_feature (1)..( 13): Result.002 file - promoters60/1030528
caatgcatttaaa

SEQ ID NO: 102815 - DNA, 13 bp, Unknown
  misc_feature (1)..( 13): Result.002 file - promoters60/1030528
tctaattcttatc

SEQ ID NO: 102816 - DNA, 7 bp, Unknown
  misc_feature (1)..( 7): Result.002 file - promoters60/1030528
aaacgtt

SEQ ID NO: 102817 - DNA, 7 bp, Unknown
  misc_feature (1)..( 7): Result.002 file - promoters60/1030528
aaaagtt

SEQ ID NO: 102818 - DNA, 7 bp, Unknown
  misc_feature (1)..( 7): Result.002 file - promoters60/1030528
aaaagtc

SEQ ID NO: 102819 - DNA, 9 bp, Unknown
  misc_feature (1)..( 9): Result.002 file - promoters60/1030528
tataaaacc

SEQ ID NO: 102820 - DNA, 9 bp, Unknown
  misc_feature (1)..( 9): Result.002 file - promoters60/1030528
tataaacac

SEQ ID NO: 102821 - DNA, 9 bp, Unknown
  misc_feature (1)..( 9): Result.002 file - promoters60/1030528
tataaaacc

SEQ ID NO: 102822 - DNA, 17 bp, Unknown
  misc_feature (1)..( 17): Result.002 file - promoters60/1030530
ttttaattttttaaata

SEQ ID NO: 102823 - DNA, 17 bp, Unknown
  misc_feature (1)..( 17): Result.002 file - promoters60/1030530
ttttcattattttaata

SEQ ID NO: 102824 - DNA, 17 bp, Unknown
  misc_feature (1)..( 17): Result.002 file - promoters60/1030530
ttttaaacatgtatgaa

SEQ ID NO: 102825 - DNA, 17 bp, Unknown
  misc_feature (1)..( 17): Result.002 file - promoters60/1030530
tgttaattgtctccggc

SEQ ID NO: 102826 - DNA, 13 bp, Unknown
  misc_feature (1)..( 13): Result.002 file - promoters60/1030530
gacttgtaaattt

SEQ ID NO: 102827 - DNA, 13 bp, Unknown
  misc_feature (1)..( 13): Result.002 file - promoters60/1030530
aacttgtctgagt

SEQ ID NO: 102828 - DNA, 13 bp, Unknown
  misc_feature (1)..( 13): Result.002 file - promoters60/1030530
aacatgtatgaat

SEQ ID NO: 102829 - DNA, 13 bp, Unknown
  misc_feature (1)..( 13): Result.002 file - promoters60/1030530
ggcgactatgaat

SEQ ID NO: 102830 - DNA, 13 bp, Unknown
  misc_feature (1)..( 13): Result.002 file - promoters60/1030530
aaaacgtatgaac

SEQ ID NO: 102831 - DNA, 13 bp, Unknown
  misc_feature (1)..( 13): Result.002 file - promoters60/1030530
aacatgtatgaat

SEQ ID NO: 102832 - DNA, 13 bp, Unknown
  misc_feature (1)..( 13): Result.002 file - promoters60/1030530
aaaacgtatgaac

SEQ ID NO: 102833 - DNA, 13 bp, Unknown
  misc_feature (1)..( 13): Result.002 file - promoters60/1030530
aacttgtctgagt

SEQ ID NO: 102834 - DNA, 13 bp, Unknown
  misc_feature (1)..( 13): Result.002 file - promoters60/1030530
ggcgactatgaat

SEQ ID NO: 102835 - DNA, 14 bp, Unknown
  misc_feature (1)..( 14): Result.002 file - promoters60/1030547
tgcattagttcttc

SEQ ID NO: 102836 - DNA, 14 bp, Unknown
  misc_feature (1)..( 14): Result.002 file - promoters60/1030547
taaatttgttatgt

SEQ ID NO: 102837 - DNA, 14 bp, Unknown
  misc_feature (1)..( 14): Result.002 file - promoters60/1030547
gttattagttaacc

SEQ ID NO: 102838 - DNA, 14 bp, Unknown
  misc_feature (1)..( 14): Result.002 file - promoters60/1030547
attattatttctcg

SEQ ID NO: 102839 - DNA, 14 bp, Unknown
  misc_feature (1)..( 14): Result.002 file - promoters60/1030547
taaattttttaaaa

SEQ ID NO: 102840 - DNA, 14 bp, Unknown
  misc_feature (1)..( 14): Result.002 file - promoters60/1030547
tatacgttttaaaa

SEQ ID NO: 102841 - DNA, 14 bp, Unknown
  misc_feature (1)..( 14): Result.002 file - promoters60/1030547
gaaatttcctcgct

SEQ ID NO: 102842 - DNA, 15 bp, Unknown
  misc_feature (1)..( 15): Result.002 file - promoters60/1030547
aattcgaatttttca

SEQ ID NO: 102843 - DNA, 15 bp, Unknown
  misc_feature (1)..( 15): Result.002 file - promoters60/1030547
ggccggaattttagt

SEQ ID NO: 102844 - DNA, 15 bp, Unknown
  misc_feature (1)..( 15): Result.002 file - promoters60/1030547
atttgaaattttcat

SEQ ID NO: 102845 - DNA, 15 bp, Unknown
  misc_feature (1)..( 15): Result.002 file - promoters60/1030547
gaatgaaatctgtcc

SEQ ID NO: 102846 - DNA, 15 bp, Unknown
  misc_feature (1)..( 15): Result.002 file - promoters60/1030547
cgcctaaataaaaaa

SEQ ID NO: 102847 - DNA, 15 bp, Unknown
  misc_feature (1)..( 15): Result.002 file - promoters60/1030547
aggaaaaatcaaaaa

SEQ ID NO: 102848 - DNA, 20 bp, Unknown
  misc_feature (1)..( 20): Result.002 file - promoters60/1030547
attcgaatttttcaatattt

SEQ ID NO: 102849 - DNA, 20 bp, Unknown
  misc_feature (1)..( 20): Result.002 file - promoters60/1030547
tttagtctattttaattcgt

SEQ ID NO: 102850 - DNA, 20 bp, Unknown
  misc_feature (1)..( 20): Result.002 file - promoters60/1030547
atttgaaattttcataaact

SEQ ID NO: 102851 - DNA, 20 bp, Unknown
  misc_feature (1)..( 20): Result.002 file - promoters60/1030547
caatcccaattctaacaatg

SEQ ID NO: 102852 - DNA, 20 bp, Unknown
  misc_feature (1)..( 20): Result.002 file - promoters60/1030547
tagaaaagaatgaaatctgt

SEQ ID NO: 102853 - DNA, 20 bp, Unknown
  misc_feature (1)..( 20): Result.002 file - promoters60/1030547
aaagacgcgcctaaataaaa

SEQ ID NO: 102854 - DNA, 20 bp, Unknown
  misc_feature (1)..( 20): Result.002 file - promoters60/1030547
aaaggaaaaatcaaaaatcc

SEQ ID NO: 102855 - DNA, 11 bp, Unknown
  misc_feature (1)..( 11): Result.002 file - promoters60/1030547
ttttgaagaat

SEQ ID NO: 102856 - DNA, 11 bp, Unknown
  misc_feature (1)..( 11): Result.002 file - promoters60/1030547
ttttgatgaat

SEQ ID NO: 102857 - DNA, 11 bp, Unknown
  misc_feature (1)..( 11): Result.002 file - promoters60/1030547
gtttgaatcgt

SEQ ID NO: 102858 - DNA, 11 bp, Unknown
  misc_feature (1)..( 11): Result.002 file - promoters60/1030547
atttgctgaat

SEQ ID NO: 102859 - DNA, 11 bp, Unknown
  misc_feature (1)..( 11): Result.002 file - promoters60/1030547
aaaagatgaag

SEQ ID NO: 102860 - DNA, 11 bp, Unknown
  misc_feature (1)..( 11): Result.002 file - promoters60/1030547
tttcgatgtat

SEQ ID NO: 102861 - DNA, 19 bp, Unknown
  misc_feature (1)..( 19): Result.002 file - promoters60/1030547
ataaaaatgttagatagga

SEQ ID NO: 102862 - DNA, 19 bp, Unknown
  misc_feature (1)..( 19): Result.002 file - promoters60/1030547
tcataaattttaaaattat

SEQ ID NO: 102863 - DNA, 19 bp, Unknown
  misc_feature (1)..( 19): Result.002 file - promoters60/1030547
tgttaaatatgaatattac

SEQ ID NO: 102864 - DNA, 20 bp, Unknown
  misc_feature (1)..( 20): Result.002 file - promoters60/1030547
atgtaaattttgaaataatt

SEQ ID NO: 102865 - DNA, 20 bp, Unknown
  misc_feature (1)..( 20): Result.002 file - promoters60/1030547
tgagaaatagatttgaaaaa

SEQ ID NO: 102866 - DNA, 20 bp, Unknown
  misc_feature (1)..( 20): Result.002 file - promoters60/1030547
ttttaaattttttaaaatat

SEQ ID NO: 102867 - DNA, 11 bp, Unknown
  misc_feature (1)..( 11): Result.002 file - promoters60/1030547
cttatataaac

SEQ ID NO: 102868 - DNA, 11 bp, Unknown
  misc_feature (1)..( 11): Result.002 file - promoters60/1030547
tatatataata

SEQ ID NO: 102869 - DNA, 11 bp, Unknown
  misc_feature (1)..( 11): Result.002 file - promoters60/1030547
agtatataaac

SEQ ID NO: 102870 - DNA, 11 bp, Unknown
  misc_feature (1)..( 11): Result.002 file - promoters60/1030547
tataaataaaa

SEQ ID NO: 102871 - DNA, 11 bp, Unknown
  misc_feature (1)..( 11): Result.002 file - promoters60/1030547
tgtatataaat

SEQ ID NO: 102872 - DNA, 11 bp, Unknown
  misc_feature (1)..( 11): Result.002 file - promoters60/1030547
gctataaaaac

SEQ ID NO: 102873 - DNA, 11 bp, Unknown
  misc_feature (1)..( 11): Result.002 file - promoters60/1030547
cccataaaagc

SEQ ID NO: 102874 - DNA, 11 bp, Unknown
  misc_feature (1)..( 11): Result.002 file - promoters60/1030547
gataaatatcc

SEQ ID NO: 102875 - DNA, 12 bp, Unknown
  misc_feature (1)..( 12): Result.002 file - promoters60/1030547
tatataaacaaa

SEQ ID NO: 102876 - DNA, 12 bp, Unknown
  misc_feature (1)..( 12): Result.002 file - promoters60/1030547
ataataaccaaa

SEQ ID NO: 102877 - DNA, 12 bp, Unknown
  misc_feature (1)..( 12): Result.002 file - promoters60/1030547
tatataaactct

SEQ ID NO: 102878 - DNA, 12 bp, Unknown
  misc_feature (1)..( 12): Result.002 file - promoters60/1030547
tttataaataaa

SEQ ID NO: 102879 - DNA, 12 bp, Unknown
  misc_feature (1)..( 12): Result.002 file - promoters60/1030547
tatataaatgac

SEQ ID NO: 102880 - DNA, 12 bp, Unknown
  misc_feature (1)..( 12): Result.002 file - promoters60/1030547
gctataaaaacc

SEQ ID NO: 102881 - DNA, 12 bp, Unknown
  misc_feature (1)..( 12): Result.002 file - promoters60/1030547
cccataaaagca

SEQ ID NO: 102882 - DNA, 11 bp, Unknown
  misc_feature (1)..( 11): Result.002 file - promoters60/1030547
caaaatttgta

SEQ ID NO: 102883 - DNA, 11 bp, Unknown
  misc_feature (1)..( 11): Result.002 file - promoters60/1030547
caatattttaa

SEQ ID NO: 102884 - DNA, 11 bp, Unknown
  misc_feature (1)..( 11): Result.002 file - promoters60/1030547
gaatatgtttt

SEQ ID NO: 102885 - DNA, 11 bp, Unknown
  misc_feature (1)..( 11): Result.002 file - promoters60/1030547
aattattttac

SEQ ID NO: 102886 - DNA, 12 bp, Unknown
  misc_feature (1)..( 12): Result.002 file - promoters60/1030547
atttagtttgaa

SEQ ID NO: 102887 - DNA, 12 bp, Unknown
  misc_feature (1)..( 12): Result.002 file - promoters60/1030547
ggctgattttac

SEQ ID NO: 102888 - DNA, 12 bp, Unknown
  misc_feature (1)..( 12): Result.002 file - promoters60/1030547
agatagtatata

SEQ ID NO: 102889 - DNA, 19 bp, Unknown
  misc_feature (1)..( 19): Result.002 file - promoters60/1030547
gataggaaaaagttgttac

SEQ ID NO: 102890 - DNA, 19 bp, Unknown
  misc_feature (1)..( 19): Result.002 file - promoters60/1030547
gcccagaaaaagctgattg

SEQ ID NO: 102891 - DNA, 19 bp, Unknown
  misc_feature (1)..( 19): Result.002 file - promoters60/1030547
gatttgaaaaacagacaac

SEQ ID NO: 102892 - DNA, 19 bp, Unknown
  misc_feature (1)..( 19): Result.002 file - promoters60/1030547
gatagtaaaaaaagagatc

SEQ ID NO: 102893 - DNA, 19 bp, Unknown
  misc_feature (1)..( 19): Result.002 file - promoters60/1030547
attttcataaattttaaaa

SEQ ID NO: 102894 - DNA, 19 bp, Unknown
  misc_feature (1)..( 19): Result.002 file - promoters60/1030547
gaaactaagattataattt

SEQ ID NO: 102895 - DNA, 10 bp, Unknown
  misc_feature (1)..( 10): Result.002 file - promoters60/1030547
gttatttttg

SEQ ID NO: 102896 - DNA, 10 bp, Unknown
  misc_feature (1)..( 10): Result.002 file - promoters60/1030547
tttagtttga

SEQ ID NO: 102897 - DNA, 10 bp, Unknown
  misc_feature (1)..( 10): Result.002 file - promoters60/1030547
gttttttttt

SEQ ID NO: 102898 - DNA, 10 bp, Unknown
  misc_feature (1)..( 10): Result.002 file - promoters60/1030547
attattttac

SEQ ID NO: 102899 - DNA, 10 bp, Unknown
  misc_feature (1)..( 10): Result.002 file - promoters60/1030547
ctgattttac

SEQ ID NO: 102900 - DNA, 10 bp, Unknown
  misc_feature (1)..( 10): Result.002 file - promoters60/1030547
aatattttaa

SEQ ID NO: 102901 - DNA, 8 bp, Unknown
  misc_feature (1)..( 8): Result.002 file - promoters60/1030547
aaatcctc

SEQ ID NO: 102902 - DNA, 8 bp, Unknown
  misc_feature (1)..( 8): Result.002 file - promoters60/1030547
aaaacctt

SEQ ID NO: 102903 - DNA, 8 bp, Unknown
  misc_feature (1)..( 8): Result.002 file - promoters60/1030547
aaaccctt

SEQ ID NO: 102904 - DNA, 8 bp, Unknown
  misc_feature (1)..( 8): Result.002 file - promoters60/1030547
aaagcctg

SEQ ID NO: 102905 - DNA, 8 bp, Unknown
  misc_feature (1)..( 8): Result.002 file - promoters60/1030547
taaacctg

SEQ ID NO: 102906 - DNA, 8 bp, Unknown
  misc_feature (1)..( 8): Result.002 file - promoters60/1030547
ttaacctt

SEQ ID NO: 102907 - DNA, 9 bp, Unknown
  misc_feature (1)..( 9): Result.002 file - promoters60/1030581
aatgtgaaa

SEQ ID NO: 102908 - DNA, 9 bp, Unknown
  misc_feature (1)..( 9): Result.002 file - promoters60/1030581
aatttgaaa

SEQ ID NO: 102909 - DNA, 9 bp, Unknown
  misc_feature (1)..( 9): Result.002 file - promoters60/1030581
gttttgaag

SEQ ID NO: 102910 - DNA, 10 bp, Unknown
  misc_feature (1)..( 10): Result.002 file - promoters60/1030581
agtttagaac

SEQ ID NO: 102911 - DNA, 14 bp, Unknown
  misc_feature (1)..( 14): Result.002 file - promoters60/1030605
ggagactataagct

SEQ ID NO: 102912 - DNA, 14 bp, Unknown
  misc_feature (1)..( 14): Result.002 file - promoters60/1030605
ttaaactatagttg

SEQ ID NO: 102913 - DNA, 14 bp, Unknown
  misc_feature (1)..( 14): Result.002 file - promoters60/1030605
tagtactatcgttt

SEQ ID NO: 102914 - DNA, 14 bp, Unknown
  misc_feature (1)..( 14): Result.002 file - promoters60/1030605
ttaaaatatattta

SEQ ID NO: 102915 - DNA, 14 bp, Unknown
  misc_feature (1)..( 14): Result.002 file - promoters60/1030605
ttgacatattttta

SEQ ID NO: 102916 - DNA, 14 bp, Unknown
  misc_feature (1)..( 14): Result.002 file - promoters60/1030605
ataagctagtatcg

SEQ ID NO: 102917 - DNA, 14 bp, Unknown
  misc_feature (1)..( 14): Result.002 file - promoters60/1030605
ttaaactatagttg

SEQ ID NO: 102918 - DNA, 14 bp, Unknown
  misc_feature (1)..( 14): Result.002 file - promoters60/1030605
aaaaactaaatgat

SEQ ID NO: 102919 - DNA, 14 bp, Unknown
  misc_feature (1)..( 14): Result.002 file - promoters60/1030605
ttaaaatatattta

SEQ ID NO: 102920 - DNA, 14 bp, Unknown
  misc_feature (1)..( 14): Result.002 file - promoters60/1030605
ttgacatattttta

SEQ ID NO: 102921 - DNA, 12 bp, Unknown
  misc_feature (1)..( 12): Result.002 file - promoters60/1030605
caaataaaacag

SEQ ID NO: 102922 - DNA, 12 bp, Unknown
  misc_feature (1)..( 12): Result.002 file - promoters60/1030605
aaaataataatc

SEQ ID NO: 102923 - DNA, 12 bp, Unknown
  misc_feature (1)..( 12): Result.002 file - promoters60/1030605
aaaaaaaaatac

SEQ ID NO: 102924 - DNA, 12 bp, Unknown
  misc_feature (1)..( 12): Result.002 file - promoters60/1030605
caactaatttgt

SEQ ID NO: 102925 - DNA, 12 bp, Unknown
  misc_feature (1)..( 12): Result.002 file - promoters60/1030605
gaaaaattcaac

SEQ ID NO: 102926 - DNA, 12 bp, Unknown
  misc_feature (1)..( 12): Result.002 file - promoters60/1030605
caaaaaaagaat

SEQ ID NO: 102927 - DNA, 15 bp, Unknown
  misc_feature (1)..( 15): Result.002 file - promoters60/1030605
aaattttgaaatcat

SEQ ID NO: 102928 - DNA, 15 bp, Unknown
  misc_feature (1)..( 15): Result.002 file - promoters60/1030605
tcattttgacatcat

SEQ ID NO: 102929 - DNA, 15 bp, Unknown
  misc_feature (1)..( 15): Result.002 file - promoters60/1030605
aaattttattgcttg

SEQ ID NO: 102930 - DNA, 15 bp, Unknown
  misc_feature (1)..( 15): Result.002 file - promoters60/1030605
tgtttttgaacttat

SEQ ID NO: 102931 - DNA, 15 bp, Unknown
  misc_feature (1)..( 15): Result.002 file - promoters60/1030605
ttgttttgatcgctt

SEQ ID NO: 102932 - DNA, 15 bp, Unknown
  misc_feature (1)..( 15): Result.002 file - promoters60/1030605
tatatttaatcagaa

SEQ ID NO: 102933 - DNA, 15 bp, Unknown
  misc_feature (1)..( 15): Result.002 file - promoters60/1030605
cacgattgacatatt

SEQ ID NO: 102934 - DNA, 8 bp, Unknown
  misc_feature (1)..( 8): Result.002 file - promoters60/1030605
aacaaata

SEQ ID NO: 102935 - DNA, 8 bp, Unknown
  misc_feature (1)..( 8): Result.002 file - promoters60/1030605
gacaaatg

SEQ ID NO: 102936 - DNA, 8 bp, Unknown
  misc_feature (1)..( 8): Result.002 file - promoters60/1030605
aactaatt

SEQ ID NO: 102937 - DNA, 8 bp, Unknown
  misc_feature (1)..( 8): Result.002 file - promoters60/1030605
tcctaatt

SEQ ID NO: 102938 - DNA, 8 bp, Unknown
  misc_feature (1)..( 8): Result.002 file - promoters60/1030605
gacaaagt

SEQ ID NO: 102939 - DNA, 11 bp, Unknown
  misc_feature (1)..( 11): Result.002 file - promoters60/1030605
tttgaaaagga

SEQ ID NO: 102940 - DNA, 11 bp, Unknown
  misc_feature (1)..( 11): Result.002 file - promoters60/1030605
tttgcaaattt

SEQ ID NO: 102941 - DNA, 11 bp, Unknown
  misc_feature (1)..( 11): Result.002 file - promoters60/1030605
tctgaaaaact

SEQ ID NO: 102942 - DNA, 11 bp, Unknown
  misc_feature (1)..( 11): Result.002 file - promoters60/1030605
gatgaaaaatt

SEQ ID NO: 102943 - DNA, 12 bp, Unknown
  misc_feature (1)..( 12): Result.002 file - promoters60/1030605
gttgaagaaaaa

SEQ ID NO: 102944 - DNA, 7 bp, Unknown
  misc_feature (1)..( 7): Result.002 file - promoters60/1030605
aaataaa

SEQ ID NO: 102945 - DNA, 7 bp, Unknown
  misc_feature (1)..( 7): Result.002 file - promoters60/1030605
aaataat

SEQ ID NO: 102946 - DNA, 7 bp, Unknown
  misc_feature (1)..( 7): Result.002 file - promoters60/1030605
agatata

SEQ ID NO: 102947 - DNA, 7 bp, Unknown
  misc_feature (1)..( 7): Result.002 file - promoters60/1030605
atatata

SEQ ID NO: 102948 - DNA, 7 bp, Unknown
  misc_feature (1)..( 7): Result.002 file - promoters60/1030605
atatata

SEQ ID NO: 102949 - DNA, 8 bp, Unknown
  misc_feature (1)..( 8): Result.002 file - promoters60/1030605
aaagtaaa

SEQ ID NO: 102950 - DNA, 11 bp, Unknown
  misc_feature (1)..( 11): Result.002 file - promoters60/1030605
aaatattttga

SEQ ID NO: 102951 - DNA, 11 bp, Unknown
  misc_feature (1)..( 11): Result.002 file - promoters60/1030605
atatatttata

SEQ ID NO: 102952 - DNA, 11 bp, Unknown
  misc_feature (1)..( 11): Result.002 file - promoters60/1030605
ataaattagaa

SEQ ID NO: 102953 - DNA, 11 bp, Unknown
  misc_feature (1)..( 11): Result.002 file - promoters60/1030605
atatatattac

SEQ ID NO: 102954 - DNA, 11 bp, Unknown
  misc_feature (1)..( 11): Result.002 file - promoters60/1030605
ttttattcata

SEQ ID NO: 102955 - DNA, 11 bp, Unknown
  misc_feature (1)..( 11): Result.002 file - promoters60/1030605
tcataattatc

SEQ ID NO: 102956 - DNA, 11 bp, Unknown
  misc_feature (1)..( 11): Result.002 file - promoters60/1030605
taaattagaat

SEQ ID NO: 102957 - DNA, 11 bp, Unknown
  misc_feature (1)..( 11): Result.002 file - promoters60/1030605
ataaatagaat

SEQ ID NO: 102958 - DNA, 11 bp, Unknown
  misc_feature (1)..( 11): Result.002 file - promoters60/1030605
gttaattgaaa

SEQ ID NO: 102959 - DNA, 11 bp, Unknown
  misc_feature (1)..( 11): Result.002 file - promoters60/1030605
ttacttggaaa

SEQ ID NO: 102960 - DNA, 11 bp, Unknown
  misc_feature (1)..( 11): Result.002 file - promoters60/1030605
cgacttggtcc

SEQ ID NO: 102961 - DNA, 16 bp, Unknown
  misc_feature (1)..( 16): Result.002 file - promoters60/1030605
ccttctataaaaagga

SEQ ID NO: 102962 - DNA, 16 bp, Unknown
  misc_feature (1)..( 16): Result.002 file - promoters60/1030605
cctactatataaactc

SEQ ID NO: 102963 - DNA, 16 bp, Unknown
  misc_feature (1)..( 16): Result.002 file - promoters60/1030605
ctctctatatataaag

SEQ ID NO: 102964 - DNA, 16 bp, Unknown
  misc_feature (1)..( 16): Result.002 file - promoters60/1030605
ttagctataaaaggag

SEQ ID NO: 102965 - DNA, 16 bp, Unknown
  misc_feature (1)..( 16): Result.002 file - promoters60/1030605
ataagtatatatactc

SEQ ID NO: 102966 - DNA, 10 bp, Unknown
  misc_feature (1)..( 10): Result.002 file - promoters60/1030605
tatttagaaa

SEQ ID NO: 102967 - DNA, 10 bp, Unknown
  misc_feature (1)..( 10): Result.002 file - promoters60/1030605
tattgagata

SEQ ID NO: 102968 - DNA, 10 bp, Unknown
  misc_feature (1)..( 10): Result.002 file - promoters60/1030605
tatttaatca

SEQ ID NO: 102969 - DNA, 10 bp, Unknown
  misc_feature (1)..( 10): Result.002 file - promoters60/1030605
tttttataaa

SEQ ID NO: 102970 - DNA, 10 bp, Unknown
  misc_feature (1)..( 10): Result.002 file - promoters60/1030605
tattttttgg

SEQ ID NO: 102971 - DNA, 8 bp, Unknown
  misc_feature (1)..( 8): Result.002 file - promoters60/1030616
ttctattc

SEQ ID NO: 102972 - DNA, 8 bp, Unknown
  misc_feature (1)..( 8): Result.002 file - promoters60/1030616
ttctataa

SEQ ID NO: 102973 - DNA, 8 bp, Unknown
  misc_feature (1)..( 8): Result.002 file - promoters60/1030616
gtctataa

SEQ ID NO: 102974 - DNA, 6 bp, Unknown
  misc_feature (1)..( 6): Result.002 file - promoters60/1030616
tttgct

SEQ ID NO: 102975 - DNA, 6 bp, Unknown
  misc_feature (1)..( 6): Result.002 file - promoters60/1030616
tttgct

SEQ ID NO: 102976 - DNA, 7 bp, Unknown
  misc_feature (1)..( 7): Result.002 file - promoters60/1030616
gaaattt

SEQ ID NO: 102977 - DNA, 7 bp, Unknown
  misc_feature (1)..( 7): Result.002 file - promoters60/1030616
gaaatta

SEQ ID NO: 102978 - DNA, 7 bp, Unknown
  misc_feature (1)..( 7): Result.002 file - promoters60/1030616
aaaatat

SEQ ID NO: 102979 - DNA, 6 bp, Unknown
  misc_feature (1)..( 6): Result.002 file - promoters60/1030616
atttgt

SEQ ID NO: 102980 - DNA, 6 bp, Unknown
  misc_feature (1)..( 6): Result.002 file - promoters60/1030616
atttgt

SEQ ID NO: 102981 - DNA, 7 bp, Unknown
  misc_feature (1)..( 7): Result.002 file - promoters60/1030616
tgtaaat

SEQ ID NO: 102982 - DNA, 7 bp, Unknown
  misc_feature (1)..( 7): Result.002 file - promoters60/1030616
tgtaaaa

SEQ ID NO: 102983 - DNA, 7 bp, Unknown
  misc_feature (1)..( 7): Result.002 file - promoters60/1030616
tgttaat

SEQ ID NO: 102984 - DNA, 10 bp, Unknown
  misc_feature (1)..( 10): Result.002 file - promoters60/1030616
ctacgattga

SEQ ID NO: 102985 - DNA, 10 bp, Unknown
  misc_feature (1)..( 10): Result.002 file - promoters60/1030616
ctacaattag

SEQ ID NO: 102986 - DNA, 10 bp, Unknown
  misc_feature (1)..( 10): Result.002 file - promoters60/1030616
ttccaattag

SEQ ID NO: 102987 - DNA, 6 bp, Unknown
  misc_feature (1)..( 6): Result.002 file - promoters60/1030616
gattta

SEQ ID NO: 102988 - DNA, 6 bp, Unknown
  misc_feature (1)..( 6): Result.002 file - promoters60/1030616
gattta

SEQ ID NO: 102989 - DNA, 6 bp, Unknown
  misc_feature (1)..( 6): Result.002 file - promoters60/1030616
aaatga

SEQ ID NO: 102990 - DNA, 6 bp, Unknown
  misc_feature (1)..( 6): Result.002 file - promoters60/1030616
aaatga

SEQ ID NO: 102991 - DNA, 10 bp, Unknown
  misc_feature (1)..( 10): Result.002 file - promoters60/1030616
ccggaatttt

SEQ ID NO: 102992 - DNA, 10 bp, Unknown
  misc_feature (1)..( 10): Result.002 file - promoters60/1030616
ccgaaatttt

SEQ ID NO: 102993 - DNA, 6 bp, Unknown
  misc_feature (1)..( 6): Result.002 file - promoters60/1030616
caaaaa

SEQ ID NO: 102994 - DNA, 6 bp, Unknown
  misc_feature (1)..( 6): Result.002 file - promoters60/1030616
caaaaa

SEQ ID NO: 102995 - DNA, 7 bp, Unknown
  misc_feature (1)..( 7): Result.002 file - promoters60/1030616
gccaaat

SEQ ID NO: 102996 - DNA, 7 bp, Unknown
  misc_feature (1)..( 7): Result.002 file - promoters60/1030616
gcccaat

SEQ ID NO: 102997 - DNA, 8 bp, Unknown
  misc_feature (1)..( 8): Result.002 file - promoters60/1030616
aaatcctc

SEQ ID NO: 102998 - DNA, 8 bp, Unknown
  misc_feature (1)..( 8): Result.002 file - promoters60/1030616
aaattctc

SEQ ID NO: 102999 - DNA, 8 bp, Unknown
  misc_feature (1)..( 8): Result.002 file - promoters60/1030616
taatttct

SEQ ID NO: 103000 - DNA, 8 bp, Unknown
  misc_feature (1)..( 8): Result.002 file - promoters60/1030616
aaatatct

SEQ ID NO: 103001 - DNA, 8 bp, Unknown
  misc_feature (1)..( 8): Result.002 file - promoters60/1030616
aaattata

SEQ ID NO: 103002 - DNA, 7 bp, Unknown
  misc_feature (1)..( 7): Result.002 file - promoters60/1030616
tttgtaa

SEQ ID NO: 103003 - DNA, 7 bp, Unknown
  misc_feature (1)..( 7): Result.002 file - promoters60/1030616
tttataa

SEQ ID NO: 103004 - DNA, 7 bp, Unknown
  misc_feature (1)..( 7): Result.002 file - promoters60/1030616
attataa

SEQ ID NO: 103005 - DNA, 6 bp, Unknown
  misc_feature (1)..( 6): Result.002 file - promoters60/1030616
ttgtta

SEQ ID NO: 103006 - DNA, 6 bp, Unknown
  misc_feature (1)..( 6): Result.002 file - promoters60/1030616
ttgtta

SEQ ID NO: 103007 - DNA, 7 bp, Unknown
  misc_feature (1)..( 7): Result.002 file - promoters60/1030616
ttttgaa

SEQ ID NO: 103008 - DNA, 7 bp, Unknown
  misc_feature (1)..( 7): Result.002 file - promoters60/1030616
ttttgat

SEQ ID NO: 103009 - DNA, 7 bp, Unknown
  misc_feature (1)..( 7): Result.002 file - promoters60/1030616
ttttatt

SEQ ID NO: 103010 - DNA, 8 bp, Unknown
  misc_feature (1)..( 8): Result.002 file - promoters60/1030616
agaccctt

SEQ ID NO: 103011 - DNA, 8 bp, Unknown
  misc_feature (1)..( 8): Result.002 file - promoters60/1030616
agactctt

SEQ ID NO: 103012 - DNA, 6 bp, Unknown
  misc_feature (1)..( 6): Result.002 file - promoters60/1030616
ttgaga

SEQ ID NO: 103013 - DNA, 6 bp, Unknown
  misc_feature (1)..( 6): Result.002 file - promoters60/1030616
ttgaga

SEQ ID NO: 103014 - DNA, 7 bp, Unknown
  misc_feature (1)..( 7): Result.002 file - promoters60/1030616
taaattg

SEQ ID NO: 103015 - DNA, 7 bp, Unknown
  misc_feature (1)..( 7): Result.002 file - promoters60/1030616
taagttg

SEQ ID NO: 103016 - DNA, 10 bp, Unknown
  misc_feature (1)..( 10): Result.002 file - promoters60/1030616
tctattttaa

SEQ ID NO: 103017 - DNA, 10 bp, Unknown
  misc_feature (1)..( 10): Result.002 file - promoters60/1030616
aaacttttaa

SEQ ID NO: 103018 - DNA, 10 bp, Unknown
  misc_feature (1)..( 10): Result.002 file - promoters60/1030616
aaactcttac

SEQ ID NO: 103019 - DNA, 6 bp, Unknown
  misc_feature (1)..( 6): Result.002 file - promoters60/1030616
atacct

SEQ ID NO: 103020 - DNA, 6 bp, Unknown
  misc_feature (1)..( 6): Result.002 file - promoters60/1030616
atacct

SEQ ID NO: 103021 - DNA, 7 bp, Unknown
  misc_feature (1)..( 7): Result.002 file - promoters60/1030616
aaagata

SEQ ID NO: 103022 - DNA, 7 bp, Unknown
  misc_feature (1)..( 7): Result.002 file - promoters60/1030616
aaacata

SEQ ID NO: 103023 - DNA, 9 bp, Unknown
  misc_feature (1)..( 9): Result.002 file - promoters60/1030616
taaaacatt

SEQ ID NO: 103024 - DNA, 9 bp, Unknown
  misc_feature (1)..( 9): Result.002 file - promoters60/1030616
taaaatatt

SEQ ID NO: 103025 - DNA, 8 bp, Unknown
  misc_feature (1)..( 8): Result.002 file - promoters60/1030616
ctttgcat

SEQ ID NO: 103026 - DNA, 8 bp, Unknown
  misc_feature (1)..( 8): Result.002 file - promoters60/1030616
ctttacat

SEQ ID NO: 103027 - DNA, 7 bp, Unknown
  misc_feature (1)..( 7): Result.002 file - promoters60/1030616
aaagaaa

SEQ ID NO: 103028 - DNA, 7 bp, Unknown
  misc_feature (1)..( 7): Result.002 file - promoters60/1030616
aaataaa

SEQ ID NO: 103029 - DNA, 6 bp, Unknown
  misc_feature (1)..( 6): Result.002 file - promoters60/1030616
ttacct

SEQ ID NO: 103030 - DNA, 6 bp, Unknown
  misc_feature (1)..( 6): Result.002 file - promoters60/1030616
ttacct

SEQ ID NO: 103031 - DNA, 9 bp, Unknown
  misc_feature (1)..( 9): Result.002 file - promoters60/1030699
ttaccatat

SEQ ID NO: 103032 - DNA, 9 bp, Unknown
  misc_feature (1)..( 9): Result.002 file - promoters60/1030699
ttaacatgg

SEQ ID NO: 103033 - DNA, 9 bp, Unknown
  misc_feature (1)..( 9): Result.002 file - promoters60/1030699
ttaacaaaa

SEQ ID NO: 103034 - DNA, 9 bp, Unknown
  misc_feature (1)..( 9): Result.002 file - promoters60/1030699
ttaagaaaa

SEQ ID NO: 103035 - DNA, 9 bp, Unknown
  misc_feature (1)..( 9): Result.002 file - promoters60/1030699
acaactttt

SEQ ID NO: 103036 - DNA, 9 bp, Unknown
  misc_feature (1)..( 9): Result.002 file - promoters60/1030699
gttactttt

SEQ ID NO: 103037 - DNA, 9 bp, Unknown
  misc_feature (1)..( 9): Result.002 file - promoters60/1030699
acaaatttt

SEQ ID NO: 103038 - DNA, 9 bp, Unknown
  misc_feature (1)..( 9): Result.002 file - promoters60/1030699
acaaaaaat

SEQ ID NO: 103039 - DNA, 15 bp, Unknown
  misc_feature (1)..( 15): Result.002 file - promoters60/1030699
tttattttttgaaat

SEQ ID NO: 103040 - DNA, 15 bp, Unknown
  misc_feature (1)..( 15): Result.002 file - promoters60/1030699
tttattatttcaaat

SEQ ID NO: 103041 - DNA, 15 bp, Unknown
  misc_feature (1)..( 15): Result.002 file - promoters60/1030699
tttacttttaacaaa

SEQ ID NO: 103042 - DNA, 15 bp, Unknown
  misc_feature (1)..( 15): Result.002 file - promoters60/1030699
tttatttcttggttc

SEQ ID NO: 103043 - DNA, 11 bp, Unknown
  misc_feature (1)..( 11): Result.002 file - promoters60/1030699
aacaaaaacaa

SEQ ID NO: 103044 - DNA, 11 bp, Unknown
  misc_feature (1)..( 11): Result.002 file - promoters60/1030699
gacataaattt

SEQ ID NO: 103045 - DNA, 11 bp, Unknown
  misc_feature (1)..( 11): Result.002 file - promoters60/1030699
aacaaaacaat

SEQ ID NO: 103046 - DNA, 11 bp, Unknown
  misc_feature (1)..( 11): Result.002 file - promoters60/1030699
aacgaaaccaa

SEQ ID NO: 103047 - DNA, 15 bp, Unknown
  misc_feature (1)..( 15): Result.002 file - promoters60/1030699
caaacttttattttt

SEQ ID NO: 103048 - DNA, 15 bp, Unknown
  misc_feature (1)..( 15): Result.002 file - promoters60/1030699
caaatttttactttt

SEQ ID NO: 103049 - DNA, 15 bp, Unknown
  misc_feature (1)..( 15): Result.002 file - promoters60/1030699
atgcttttgatttca

SEQ ID NO: 103050 - DNA, 15 bp, Unknown
  misc_feature (1)..( 15): Result.002 file - promoters60/1030699
catattcttaagcaa

SEQ ID NO: 103051 - DNA, 7 bp, Unknown
  misc_feature (1)..( 7): Result.002 file - promoters60/1030699
ttgtttt

SEQ ID NO: 103052 - DNA, 7 bp, Unknown
  misc_feature (1)..( 7): Result.002 file - promoters60/1030699
atgtttt

SEQ ID NO: 103053 - DNA, 7 bp, Unknown
  misc_feature (1)..( 7): Result.002 file - promoters60/1030699
atgtttg

SEQ ID NO: 103054 - DNA, 7 bp, Unknown
  misc_feature (1)..( 7): Result.002 file - promoters60/1030699
atgattg

SEQ ID NO: 103055 - DNA, 9 bp, Unknown
  misc_feature (1)..( 9): Result.002 file - promoters60/1030715
ttcataata

SEQ ID NO: 103056 - DNA, 9 bp, Unknown
  misc_feature (1)..( 9): Result.002 file - promoters60/1030715
agtataata

SEQ ID NO: 103057 - DNA, 9 bp, Unknown
  misc_feature (1)..( 9): Result.002 file - promoters60/1030715
ttcattata

SEQ ID NO: 103058 - DNA, 6 bp, Unknown
  misc_feature (1)..( 6): Result.002 file - promoters60/1030715
acaaag

SEQ ID NO: 103059 - DNA, 6 bp, Unknown
  misc_feature (1)..( 6): Result.002 file - promoters60/1030715
acaaag

SEQ ID NO: 103060 - DNA, 8 bp, Unknown
  misc_feature (1)..( 8): Result.002 file - promoters60/1030715
atgaattc

SEQ ID NO: 103061 - DNA, 8 bp, Unknown
  misc_feature (1)..( 8): Result.002 file - promoters60/1030715
atggattc

SEQ ID NO: 103062 - DNA, 7 bp, Unknown
  misc_feature (1)..( 7): Result.002 file - promoters60/1030715
aaattga

SEQ ID NO: 103063 - DNA, 7 bp, Unknown
  misc_feature (1)..( 7): Result.002 file - promoters60/1030715
aaattga

SEQ ID NO: 103064 - DNA, 7 bp, Unknown
  misc_feature (1)..( 7): Result.002 file - promoters60/1030715
atatttc

SEQ ID NO: 103065 - DNA, 7 bp, Unknown
  misc_feature (1)..( 7): Result.002 file - promoters60/1030715
ttatttc

SEQ ID NO: 103066 - DNA, 7 bp, Unknown
  misc_feature (1)..( 7): Result.002 file - promoters60/1030715
atatttt

SEQ ID NO: 103067 - DNA, 7 bp, Unknown
  misc_feature (1)..( 7): Result.002 file - promoters60/1030715
aagaatt

SEQ ID NO: 103068 - DNA, 7 bp, Unknown
  misc_feature (1)..( 7): Result.002 file - promoters60/1030715
aagaatg

SEQ ID NO: 103069 - DNA, 7 bp, Unknown
  misc_feature (1)..( 7): Result.002 file - promoters60/1030715
gagaatg

SEQ ID NO: 103070 - DNA, 7 bp, Unknown
  misc_feature (1)..( 7): Result.002 file - promoters60/1030715
gtttgtg

SEQ ID NO: 103071 - DNA, 7 bp, Unknown
  misc_feature (1)..( 7): Result.002 file - promoters60/1030715
gtttgtg

SEQ ID NO: 103072 - DNA, 6 bp, Unknown
  misc_feature (1)..( 6): Result.002 file - promoters60/1030715
tgctaa

SEQ ID NO: 103073 - DNA, 6 bp, Unknown
  misc_feature (1)..( 6): Result.002 file - promoters60/1030715
tgctaa

SEQ ID NO: 103074 - DNA, 8 bp, Unknown
  misc_feature (1)..( 8): Result.002 file - promoters60/1030715
taaaagtt

SEQ ID NO: 103075 - DNA, 8 bp, Unknown
  misc_feature (1)..( 8): Result.002 file - promoters60/1030715
taacagtt

SEQ ID NO: 103076 - DNA, 11 bp, Unknown
  misc_feature (1)..( 11): Result.002 file - promoters60/1030715
ttgttcttatt

SEQ ID NO: 103077 - DNA, 11 bp, Unknown
  misc_feature (1)..( 11): Result.002 file - promoters60/1030715
ttgtacttatt

SEQ ID NO: 103078 - DNA, 6 bp, Unknown
  misc_feature (1)..( 6): Result.002 file - promoters60/1030715
tttatt

SEQ ID NO: 103079 - DNA, 6 bp, Unknown
  misc_feature (1)..( 6): Result.002 file - promoters60/1030715
tttatt

SEQ ID NO: 103080 - DNA, 7 bp, Unknown
  misc_feature (1)..( 7): Result.002 file - promoters60/1030715
tttaaga

SEQ ID NO: 103081 - DNA, 7 bp, Unknown
  misc_feature (1)..( 7): Result.002 file - promoters60/1030715
tttcaga

SEQ ID NO: 103082 - DNA, 6 bp, Unknown
  misc_feature (1)..( 6): Result.002 file - promoters60/1030715
tttgtg

SEQ ID NO: 103083 - DNA, 6 bp, Unknown
  misc_feature (1)..( 6): Result.002 file - promoters60/1030715
tttgtg

SEQ ID NO: 103084 - DNA, 7 bp, Unknown
  misc_feature (1)..( 7): Result.002 file - promoters60/1030715
aaaatga

SEQ ID NO: 103085 - DNA, 7 bp, Unknown
  misc_feature (1)..( 7): Result.002 file - promoters60/1030715
aaaatga

SEQ ID NO: 103086 - DNA, 6 bp, Unknown
  misc_feature (1)..( 6): Result.002 file - promoters60/1030715
ttaaac

SEQ ID NO: 103087 - DNA, 6 bp, Unknown
  misc_feature (1)..( 6): Result.002 file - promoters60/1030715
ttaaac

SEQ ID NO: 103088 - DNA, 6 bp, Unknown
  misc_feature (1)..( 6): Result.002 file - promoters60/1030715
gaattt

SEQ ID NO: 103089 - DNA, 6 bp, Unknown
  misc_feature (1)..( 6): Result.002 file - promoters60/1030715
gaattt

SEQ ID NO: 103090 - DNA, 6 bp, Unknown
  misc_feature (1)..( 6): Result.002 file - promoters60/1030715
ttatta

SEQ ID NO: 103091 - DNA, 6 bp, Unknown
  misc_feature (1)..( 6): Result.002 file - promoters60/1030715
ttatta

SEQ ID NO: 103092 - DNA, 8 bp, Unknown
  misc_feature (1)..( 8): Result.002 file - promoters60/1030715
ttacaaat

SEQ ID NO: 103093 - DNA, 8 bp, Unknown
  misc_feature (1)..( 8): Result.002 file - promoters60/1030715
ttacgaat

SEQ ID NO: 103094 - DNA, 6 bp, Unknown
  misc_feature (1)..( 6): Result.002 file - promoters60/1030715
taataa

SEQ ID NO: 103095 - DNA, 6 bp, Unknown
  misc_feature (1)..( 6): Result.002 file - promoters60/1030715
taataa

SEQ ID NO: 103096 - DNA, 8 bp, Unknown
  misc_feature (1)..( 8): Result.002 file - promoters60/1030715
taaagatt

SEQ ID NO: 103097 - DNA, 8 bp, Unknown
  misc_feature (1)..( 8): Result.002 file - promoters60/1030715
taaatatt

SEQ ID NO: 103098 - DNA, 7 bp, Unknown
  misc_feature (1)..( 7): Result.002 file - promoters60/1030715
tttcttt

SEQ ID NO: 103099 - DNA, 7 bp, Unknown
  misc_feature (1)..( 7): Result.002 file - promoters60/1030715
tttgttt

SEQ ID NO: 103100 - DNA, 7 bp, Unknown
  misc_feature (1)..( 7): Result.002 file - promoters60/1030715
ttggatg

SEQ ID NO: 103101 - DNA, 7 bp, Unknown
  misc_feature (1)..( 7): Result.002 file - promoters60/1030715
ttggatg

SEQ ID NO: 103102 - DNA, 7 bp, Unknown
  misc_feature (1)..( 7): Result.002 file - promoters60/1030715
tgagtat

SEQ ID NO: 103103 - DNA, 7 bp, Unknown
  misc_feature (1)..( 7): Result.002 file - promoters60/1030715
tgactat

SEQ ID NO: 103104 - DNA, 6 bp, Unknown
  misc_feature (1)..( 6): Result.002 file - promoters60/1030715
atctaa

SEQ ID NO: 103105 - DNA, 6 bp, Unknown
  misc_feature (1)..( 6): Result.002 file - promoters60/1030715
atctaa

SEQ ID NO: 103106 - DNA, 6 bp, Unknown
  misc_feature (1)..( 6): Result.002 file - promoters60/1030715
taggtg

SEQ ID NO: 103107 - DNA, 6 bp, Unknown
  misc_feature (1)..( 6): Result.002 file - promoters60/1030715
taggtg

SEQ ID NO: 103108 - DNA, 11 bp, Unknown
  misc_feature (1)..( 11): Result.002 file - promoters60/1030757
caaatacattg

SEQ ID NO: 103109 - DNA, 11 bp, Unknown
  misc_feature (1)..( 11): Result.002 file - promoters60/1030757
caaaaacaact

SEQ ID NO: 103110 - DNA, 11 bp, Unknown
  misc_feature (1)..( 11): Result.002 file - promoters60/1030757
taaatacattt

SEQ ID NO: 103111 - DNA, 11 bp, Unknown
  misc_feature (1)..( 11): Result.002 file - promoters60/1030757
ctgataaattt

SEQ ID NO: 103112 - DNA, 11 bp, Unknown
  misc_feature (1)..( 11): Result.002 file - promoters60/1030757
aagatacgttg

SEQ ID NO: 103113 - DNA, 8 bp, Unknown
  misc_feature (1)..( 8): Result.002 file - promoters60/1030757
caaataat

SEQ ID NO: 103114 - DNA, 8 bp, Unknown
  misc_feature (1)..( 8): Result.002 file - promoters60/1030757
caaataag

SEQ ID NO: 103115 - DNA, 8 bp, Unknown
  misc_feature (1)..( 8): Result.002 file - promoters60/1030757
caaatatt

SEQ ID NO: 103116 - DNA, 8 bp, Unknown
  misc_feature (1)..( 8): Result.002 file - promoters60/1030757
aaaacaat

SEQ ID NO: 103117 - DNA, 10 bp, Unknown
  misc_feature (1)..( 10): Result.002 file - promoters60/1030757
tttttttttt

SEQ ID NO: 103118 - DNA, 10 bp, Unknown
  misc_feature (1)..( 10): Result.002 file - promoters60/1030757
tttttttctg

SEQ ID NO: 103119 - DNA, 11 bp, Unknown
  misc_feature (1)..( 11): Result.002 file - promoters60/1030757
ttttgtttctc

SEQ ID NO: 103120 - DNA, 11 bp, Unknown
  misc_feature (1)..( 11): Result.002 file - promoters60/1030757
aaatgtttctc

SEQ ID NO: 103121 - DNA, 8 bp, Unknown
  misc_feature (1)..( 8): Result.002 file - promoters60/1030757
cttctgaa

SEQ ID NO: 103122 - DNA, 8 bp, Unknown
  misc_feature (1)..( 8): Result.002 file - promoters60/1030757
cttttgaa

SEQ ID NO: 103123 - DNA, 8 bp, Unknown
  misc_feature (1)..( 8): Result.002 file - promoters60/1030757
attttgag

SEQ ID NO: 103124 - DNA, 8 bp, Unknown
  misc_feature (1)..( 8): Result.002 file - promoters60/1030757
ctttagag

SEQ ID NO: 103125 - DNA, 10 bp, Unknown
  misc_feature (1)..( 10): Result.002 file - promoters60/1030757
gttttttgtt

SEQ ID NO: 103126 - DNA, 10 bp, Unknown
  misc_feature (1)..( 10): Result.002 file - promoters60/1030757
attttttttt

SEQ ID NO: 103127 - DNA, 10 bp, Unknown
  misc_feature (1)..( 10): Result.002 file - promoters60/1030757
gttttttgag

SEQ ID NO: 103128 - DNA, 10 bp, Unknown
  misc_feature (1)..( 10): Result.002 file - promoters60/1030757
tgattttgag

SEQ ID NO: 103129 - DNA, 10 bp, Unknown
  misc_feature (1)..( 10): Result.002 file - promoters60/1030757
aatatattac

SEQ ID NO: 103130 - DNA, 10 bp, Unknown
  misc_feature (1)..( 10): Result.002 file - promoters60/1030757
aatttattag

SEQ ID NO: 103131 - DNA, 10 bp, Unknown
  misc_feature (1)..( 10): Result.002 file - promoters60/1030757
gatagatttc

SEQ ID NO: 103132 - DNA, 10 bp, Unknown
  misc_feature (1)..( 10): Result.002 file - promoters60/1030757
catataactt

SEQ ID NO: 103133 - DNA, 10 bp, Unknown
  misc_feature (1)..( 10): Result.002 file - promoters60/1030757
tattcatttt

SEQ ID NO: 103134 - DNA, 11 bp, Unknown
  misc_feature (1)..( 11): Result.002 file - promoters60/1030757
acttttatata

SEQ ID NO: 103135 - DNA, 11 bp, Unknown
  misc_feature (1)..( 11): Result.002 file - promoters60/1030757
acttttatgtt

SEQ ID NO: 103136 - DNA, 11 bp, Unknown
  misc_feature (1)..( 11): Result.002 file - promoters60/1030757
gatttcataca

SEQ ID NO: 103137 - DNA, 11 bp, Unknown
  misc_feature (1)..( 11): Result.002 file - promoters60/1030757
gaatttaaata

SEQ ID NO: 103138 - DNA, 9 bp, Unknown
  misc_feature (1)..( 9): Result.002 file - promoters60/1030757
tttattata

SEQ ID NO: 103139 - DNA, 9 bp, Unknown
  misc_feature (1)..( 9): Result.002 file - promoters60/1030757
tttgttacc

SEQ ID NO: 103140 - DNA, 9 bp, Unknown
  misc_feature (1)..( 9): Result.002 file - promoters60/1030757
cttaatata

SEQ ID NO: 103141 - DNA, 10 bp, Unknown
  misc_feature (1)..( 10): Result.002 file - promoters60/1030757
tttgattaat

SEQ ID NO: 103142 - DNA, 8 bp, Unknown
  misc_feature (1)..( 8): Result.002 file - promoters60/1030757
aattttta

SEQ ID NO: 103143 - DNA, 8 bp, Unknown
  misc_feature (1)..( 8): Result.002 file - promoters60/1030757
aatttttt

SEQ ID NO: 103144 - DNA, 8 bp, Unknown
  misc_feature (1)..( 8): Result.002 file - promoters60/1030757
atttttta

SEQ ID NO: 103145 - DNA, 8 bp, Unknown
  misc_feature (1)..( 8): Result.002 file - promoters60/1030757
ctttttta

SEQ ID NO: 103146 - DNA, 9 bp, Unknown
  misc_feature (1)..( 9): Result.002 file - promoters60/1030757
caccagtca

SEQ ID NO: 103147 - DNA, 9 bp, Unknown
  misc_feature (1)..( 9): Result.002 file - promoters60/1030757
cacgagtcg

SEQ ID NO: 103148 - DNA, 9 bp, Unknown
  misc_feature (1)..( 9): Result.002 file - promoters60/1030757
aacctgtct

SEQ ID NO: 103149 - DNA, 9 bp, Unknown
  misc_feature (1)..( 9): Result.002 file - promoters60/1030757
cccctctct

SEQ ID NO: 103150 - DNA, 9 bp, Unknown
  misc_feature (1)..( 9): Result.002 file - promoters60/1030757
tttcttttt

SEQ ID NO: 103151 - DNA, 9 bp, Unknown
  misc_feature (1)..( 9): Result.002 file - promoters60/1030757
attcatttt

SEQ ID NO: 103152 - DNA, 9 bp, Unknown
  misc_feature (1)..( 9): Result.002 file - promoters60/1030757
tttcttatc

SEQ ID NO: 103153 - DNA, 9 bp, Unknown
  misc_feature (1)..( 9): Result.002 file - promoters60/1030757
tatcaattt

SEQ ID NO: 103154 - DNA, 9 bp, Unknown
  misc_feature (1)..( 9): Result.002 file - promoters60/1030757
gaccaattt

SEQ ID NO: 103155 - DNA, 11 bp, Unknown
  misc_feature (1)..( 11): Result.002 file - promoters60/1030757
aatataaacat

SEQ ID NO: 103156 - DNA, 11 bp, Unknown
  misc_feature (1)..( 11): Result.002 file - promoters60/1030757
tctataaaact

SEQ ID NO: 103157 - DNA, 11 bp, Unknown
  misc_feature (1)..( 11): Result.002 file - promoters60/1030757
tatataaagag

SEQ ID NO: 103158 - DNA, 11 bp, Unknown
  misc_feature (1)..( 11): Result.002 file - promoters60/1030757
tatttaacggt

SEQ ID NO: 103159 - DNA, 11 bp, Unknown
  misc_feature (1)..( 11): Result.002 file - promoters60/1030757
tgcataaaact

SEQ ID NO: 103160 - DNA, 11 bp, Unknown
  misc_feature (1)..( 11): Result.002 file - promoters60/1030757
aaacgtgaaag

SEQ ID NO: 103161 - DNA, 11 bp, Unknown
  misc_feature (1)..( 11): Result.002 file - promoters60/1030757
tggattgaaag

SEQ ID NO: 103162 - DNA, 11 bp, Unknown
  misc_feature (1)..( 11): Result.002 file - promoters60/1030757
aaacgtaaaac

SEQ ID NO: 103163 - DNA, 11 bp, Unknown
  misc_feature (1)..( 11): Result.002 file - promoters60/1030757
aacattcaaaa

SEQ ID NO: 103164 - DNA, 8 bp, Unknown
  misc_feature (1)..( 8): Result.002 file - promoters60/1030757
agatatac

SEQ ID NO: 103165 - DNA, 8 bp, Unknown
  misc_feature (1)..( 8): Result.002 file - promoters60/1030757
ggatttac

SEQ ID NO: 103166 - DNA, 8 bp, Unknown
  misc_feature (1)..( 8): Result.002 file - promoters60/1030757
agaaatag

SEQ ID NO: 103167 - DNA, 8 bp, Unknown
  misc_feature (1)..( 8): Result.002 file - promoters60/1030757
cggttttg

SEQ ID NO: 103168 - DNA, 8 bp, Unknown
  misc_feature (1)..( 8): Result.002 file - promoters60/1030757
ggatttga

SEQ ID NO: 103169 - DNA, 8 bp, Unknown
  misc_feature (1)..( 8): Result.002 file - promoters60/1030771
tgtatctc

SEQ ID NO: 103170 - DNA, 8 bp, Unknown
  misc_feature (1)..( 8): Result.002 file - promoters60/1030771
tgtctctc

SEQ ID NO: 103171 - DNA, 7 bp, Unknown
  misc_feature (1)..( 7): Result.002 file - promoters60/1030771
agattct

SEQ ID NO: 103172 - DNA, 7 bp, Unknown
  misc_feature (1)..( 7): Result.002 file - promoters60/1030771
agagtct

SEQ ID NO: 103173 - DNA, 7 bp, Unknown
  misc_feature (1)..( 7): Result.002 file - promoters60/1030771
cttactc

SEQ ID NO: 103174 - DNA, 7 bp, Unknown
  misc_feature (1)..( 7): Result.002 file - promoters60/1030771
cttcctc

SEQ ID NO: 103175 - DNA, 6 bp, Unknown
  misc_feature (1)..( 6): Result.002 file - promoters60/1030771
ctttta

SEQ ID NO: 103176 - DNA, 6 bp, Unknown
  misc_feature (1)..( 6): Result.002 file - promoters60/1030771
ctttta

SEQ ID NO: 103177 - DNA, 6 bp, Unknown
  misc_feature (1)..( 6): Result.002 file - promoters60/1030771
ccaatc

SEQ ID NO: 103178 - DNA, 6 bp, Unknown
  misc_feature (1)..( 6): Result.002 file - promoters60/1030771
ccaatc

SEQ ID NO: 103179 - DNA, 9 bp, Unknown
  misc_feature (1)..( 9): Result.002 file - promoters60/1030771
tgaaaaagt

SEQ ID NO: 103180 - DNA, 9 bp, Unknown
  misc_feature (1)..( 9): Result.002 file - promoters60/1030771
tgaaaaaaa

SEQ ID NO: 103181 - DNA, 9 bp, Unknown
  misc_feature (1)..( 9): Result.002 file - promoters60/1030771
taaaagagt

SEQ ID NO: 103182 - DNA, 6 bp, Unknown
  misc_feature (1)..( 6): Result.002 file - promoters60/1030771
aaaaac

SEQ ID NO: 103183 - DNA, 6 bp, Unknown
  misc_feature (1)..( 6): Result.002 file - promoters60/1030771
aaaaac

SEQ ID NO: 103184 - DNA, 6 bp, Unknown
  misc_feature (1)..( 6): Result.002 file - promoters60/1030771
taaaaa

SEQ ID NO: 103185 - DNA, 6 bp, Unknown
  misc_feature (1)..( 6): Result.002 file - promoters60/1030771
taaaaa

SEQ ID NO: 103186 - DNA, 7 bp, Unknown
  misc_feature (1)..( 7): Result.002 file - promoters60/1030771
aagccca

SEQ ID NO: 103187 - DNA, 7 bp, Unknown
  misc_feature (1)..( 7): Result.002 file - promoters60/1030771
aagtcca

SEQ ID NO: 103188 - DNA, 6 bp, Unknown
  misc_feature (1)..( 6): Result.002 file - promoters60/1030771
atccaa

SEQ ID NO: 103189 - DNA, 6 bp, Unknown
  misc_feature (1)..( 6): Result.002 file - promoters60/1030771
atccaa

SEQ ID NO: 103190 - DNA, 7 bp, Unknown
  misc_feature (1)..( 7): Result.002 file - promoters60/1030771
catattt

SEQ ID NO: 103191 - DNA, 7 bp, Unknown
  misc_feature (1)..( 7): Result.002 file - promoters60/1030771
cattttt

SEQ ID NO: 103192 - DNA, 6 bp, Unknown
  misc_feature (1)..( 6): Result.002 file - promoters60/1030771
tttcat

SEQ ID NO: 103193 - DNA, 6 bp, Unknown
  misc_feature (1)..( 6): Result.002 file - promoters60/1030771
tttcat

SEQ ID NO: 103194 - DNA, 6 bp, Unknown
  misc_feature (1)..( 6): Result.002 file - promoters60/1030771
ttatta

SEQ ID NO: 103195 - DNA, 6 bp, Unknown
  misc_feature (1)..( 6): Result.002 file - promoters60/1030771
ttatta

SEQ ID NO: 103196 - DNA, 7 bp, Unknown
  misc_feature (1)..( 7): Result.002 file - promoters60/1030771
gcccatt

SEQ ID NO: 103197 - DNA, 7 bp, Unknown
  misc_feature (1)..( 7): Result.002 file - promoters60/1030771
gcccatt

SEQ ID NO: 103198 - DNA, 7 bp, Unknown
  misc_feature (1)..( 7): Result.002 file - promoters60/1030771
tcttcct

SEQ ID NO: 103199 - DNA, 7 bp, Unknown
  misc_feature (1)..( 7): Result.002 file - promoters60/1030771
tctgcct

SEQ ID NO: 103200 - DNA, 6 bp, Unknown
  misc_feature (1)..( 6): Result.002 file - promoters60/1030771
gtaata

SEQ ID NO: 103201 - DNA, 6 bp, Unknown
  misc_feature (1)..( 6): Result.002 file - promoters60/1030771
gtaata

SEQ ID NO: 103202 - DNA, 6 bp, Unknown
  misc_feature (1)..( 6): Result.002 file - promoters60/1030778
agagca

SEQ ID NO: 103203 - DNA, 6 bp, Unknown
  misc_feature (1)..( 6): Result.002 file - promoters60/1030778
agagca

SEQ ID NO: 103204 - DNA, 6 bp, Unknown
  misc_feature (1)..( 6): Result.002 file - promoters60/1030778
atagag

SEQ ID NO: 103205 - DNA, 6 bp, Unknown
  misc_feature (1)..( 6): Result.002 file - promoters60/1030778
atagag

SEQ ID NO: 103206 - DNA, 7 bp, Unknown
  misc_feature (1)..( 7): Result.002 file - promoters60/1030778
tatcttg

SEQ ID NO: 103207 - DNA, 7 bp, Unknown
  misc_feature (1)..( 7): Result.002 file - promoters60/1030778
tatattg

SEQ ID NO: 103208 - DNA, 6 bp, Unknown
  misc_feature (1)..( 6): Result.002 file - promoters60/1030778
aaagac

SEQ ID NO: 103209 - DNA, 6 bp, Unknown
  misc_feature (1)..( 6): Result.002 file - promoters60/1030778
aaagac

SEQ ID NO: 103210 - DNA, 7 bp, Unknown
  misc_feature (1)..( 7): Result.002 file - promoters60/1030778
taataaa

SEQ ID NO: 103211 - DNA, 7 bp, Unknown
  misc_feature (1)..( 7): Result.002 file - promoters60/1030778
taaaaaa

SEQ ID NO: 103212 - DNA, 6 bp, Unknown
  misc_feature (1)..( 6): Result.002 file - promoters60/1030778
taaaaa

SEQ ID NO: 103213 - DNA, 6 bp, Unknown
  misc_feature (1)..( 6): Result.002 file - promoters60/1030778
taaaaa

SEQ ID NO: 103214 - DNA, 6 bp, Unknown
  misc_feature (1)..( 6): Result.002 file - promoters60/1030778
cttcta

SEQ ID NO: 103215 - DNA, 6 bp, Unknown
  misc_feature (1)..( 6): Result.002 file - promoters60/1030778
cttcta

SEQ ID NO: 103216 - DNA, 7 bp, Unknown
  misc_feature (1)..( 7): Result.002 file - promoters60/1030778
tttctat

SEQ ID NO: 103217 - DNA, 7 bp, Unknown
  misc_feature (1)..( 7): Result.002 file - promoters60/1030778
tttgtat

SEQ ID NO: 103218 - DNA, 7 bp, Unknown
  misc_feature (1)..( 7): Result.002 file - promoters60/1030778
tatattg

SEQ ID NO: 103219 - DNA, 7 bp, Unknown
  misc_feature (1)..( 7): Result.002 file - promoters60/1030778
tatgttg

SEQ ID NO: 103220 - DNA, 8 bp, Unknown
  misc_feature (1)..( 8): Result.002 file - promoters60/1030778
tgttaaaa

SEQ ID NO: 103221 - DNA, 8 bp, Unknown
  misc_feature (1)..( 8): Result.002 file - promoters60/1030778
tgttgaaa

SEQ ID NO: 103222 - DNA, 8 bp, Unknown
  misc_feature (1)..( 8): Result.002 file - promoters60/1030778
cattaaac

SEQ ID NO: 103223 - DNA, 8 bp, Unknown
  misc_feature (1)..( 8): Result.002 file - promoters60/1030778
catttaac

SEQ ID NO: 103224 - DNA, 6 bp, Unknown
  misc_feature (1)..( 6): Result.002 file - promoters60/1030778
tctcca

SEQ ID NO: 103225 - DNA, 6 bp, Unknown
  misc_feature (1)..( 6): Result.002 file - promoters60/1030778
tctcca

SEQ ID NO: 103226 - DNA, 7 bp, Unknown
  misc_feature (1)..( 7): Result.002 file - promoters60/1030778
ccatttt

SEQ ID NO: 103227 - DNA, 7 bp, Unknown
  misc_feature (1)..( 7): Result.002 file - promoters60/1030778
ccatttt

SEQ ID NO: 103228 - DNA, 6 bp, Unknown
  misc_feature (1)..( 6): Result.002 file - promoters60/1030778
ttttca

SEQ ID NO: 103229 - DNA, 6 bp, Unknown
  misc_feature (1)..( 6): Result.002 file - promoters60/1030778
ttttca

SEQ ID NO: 103230 - DNA, 6 bp, Unknown
  misc_feature (1)..( 6): Result.002 file - promoters60/1030778
tgtctt

SEQ ID NO: 103231 - DNA, 6 bp, Unknown
  misc_feature (1)..( 6): Result.002 file - promoters60/1030778
tgtctt

SEQ ID NO: 103232 - DNA, 6 bp, Unknown
  misc_feature (1)..( 6): Result.002 file - promoters60/1030778
caagct

SEQ ID NO: 103233 - DNA, 6 bp, Unknown
  misc_feature (1)..( 6): Result.002 file - promoters60/1030778
caagct

SEQ ID NO: 103234 - DNA, 7 bp, Unknown
  misc_feature (1)..( 7): Result.002 file - promoters60/1030778
ataaata

SEQ ID NO: 103235 - DNA, 7 bp, Unknown
  misc_feature (1)..( 7): Result.002 file - promoters60/1030778
atacata

SEQ ID NO: 103236 - DNA, 7 bp, Unknown
  misc_feature (1)..( 7): Result.002 file - promoters60/1030782
atgcctg

SEQ ID NO: 103237 - DNA, 7 bp, Unknown
  misc_feature (1)..( 7): Result.002 file - promoters60/1030782
atgtctg

SEQ ID NO: 103238 - DNA, 8 bp, Unknown
  misc_feature (1)..( 8): Result.002 file - promoters60/1030782
tcataatg

SEQ ID NO: 103239 - DNA, 8 bp, Unknown
  misc_feature (1)..( 8): Result.002 file - promoters60/1030782
tcataatg

SEQ ID NO: 103240 - DNA, 8 bp, Unknown
  misc_feature (1)..( 8): Result.002 file - promoters60/1030782
attttgat

SEQ ID NO: 103241 - DNA, 8 bp, Unknown
  misc_feature (1)..( 8): Result.002 file - promoters60/1030782
atttggat

SEQ ID NO: 103242 - DNA, 8 bp, Unknown
  misc_feature (1)..( 8): Result.002 file - promoters60/1030782
cgttcaaa

SEQ ID NO: 103243 - DNA, 8 bp, Unknown
  misc_feature (1)..( 8): Result.002 file - promoters60/1030782
cgttgaaa

SEQ ID NO: 103244 - DNA, 7 bp, Unknown
  misc_feature (1)..( 7): Result.002 file - promoters60/1030782
gaaataa

SEQ ID NO: 103245 - DNA, 7 bp, Unknown
  misc_feature (1)..( 7): Result.002 file - promoters60/1030782
gaaataa

SEQ ID NO: 103246 - DNA, 6 bp, Unknown
  misc_feature (1)..( 6): Result.002 file - promoters60/1030782
aataaa

SEQ ID NO: 103247 - DNA, 6 bp, Unknown
  misc_feature (1)..( 6): Result.002 file - promoters60/1030782
aataaa

SEQ ID NO: 103248 - DNA, 7 bp, Unknown
  misc_feature (1)..( 7): Result.002 file - promoters60/1030782
atagttt

SEQ ID NO: 103249 - DNA, 7 bp, Unknown
  misc_feature (1)..( 7): Result.002 file - promoters60/1030782
atatttt

SEQ ID NO: 103250 - DNA, 6 bp, Unknown
  misc_feature (1)..( 6): Result.002 file - promoters60/1030782
agatca

SEQ ID NO: 103251 - DNA, 6 bp, Unknown
  misc_feature (1)..( 6): Result.002 file - promoters60/1030782
agatca

SEQ ID NO: 103252 - DNA, 7 bp, Unknown
  misc_feature (1)..( 7): Result.002 file - promoters60/1030782
aaagaaa

SEQ ID NO: 103253 - DNA, 7 bp, Unknown
  misc_feature (1)..( 7): Result.002 file - promoters60/1030782
aaagaaa

SEQ ID NO: 103254 - DNA, 6 bp, Unknown
  misc_feature (1)..( 6): Result.002 file - promoters60/1030782
atgaca

SEQ ID NO: 103255 - DNA, 6 bp, Unknown
  misc_feature (1)..( 6): Result.002 file - promoters60/1030782
atgaca

SEQ ID NO: 103256 - DNA, 7 bp, Unknown
  misc_feature (1)..( 7): Result.002 file - promoters60/1030782
aaaggta

SEQ ID NO: 103257 - DNA, 7 bp, Unknown
  misc_feature (1)..( 7): Result.002 file - promoters60/1030782
aaatgta

SEQ ID NO: 103258 - DNA, 9 bp, Unknown
  misc_feature (1)..( 9): Result.002 file - promoters60/1030782
attaatacc

SEQ ID NO: 103259 - DNA, 9 bp, Unknown
  misc_feature (1)..( 9): Result.002 file - promoters60/1030782
attaacacc

SEQ ID NO: 103260 - DNA, 6 bp, Unknown
  misc_feature (1)..( 6): Result.002 file - promoters60/1030782
caatca

SEQ ID NO: 103261 - DNA, 6 bp, Unknown
  misc_feature (1)..( 6): Result.002 file - promoters60/1030782
caatca

SEQ ID NO: 103262 - DNA, 8 bp, Unknown
  misc_feature (1)..( 8): Result.002 file - promoters60/1030782
aaagagaa

SEQ ID NO: 103263 - DNA, 8 bp, Unknown
  misc_feature (1)..( 8): Result.002 file - promoters60/1030782
aaagagaa

SEQ ID NO: 103264 - DNA, 6 bp, Unknown
  misc_feature (1)..( 6): Result.002 file - promoters60/1030782
atgaga

SEQ ID NO: 103265 - DNA, 6 bp, Unknown
  misc_feature (1)..( 6): Result.002 file - promoters60/1030782
atgaga

SEQ ID NO: 103266 - DNA, 9 bp, Unknown
  misc_feature (1)..( 9): Result.002 file - promoters60/1030803
tcggtgaag

SEQ ID NO: 103267 - DNA, 9 bp, Unknown
  misc_feature (1)..( 9): Result.002 file - promoters60/1030803
tcggagaat

SEQ ID NO: 103268 - DNA, 9 bp, Unknown
  misc_feature (1)..( 9): Result.002 file - promoters60/1030803
aatgtgaag

SEQ ID NO: 103269 - DNA, 8 bp, Unknown
  misc_feature (1)..( 8): Result.002 file - promoters60/1030803
tcggggaa

SEQ ID NO: 103270 - DNA, 8 bp, Unknown
  misc_feature (1)..( 8): Result.002 file - promoters60/1030803
tcggagaa

SEQ ID NO: 103271 - DNA, 8 bp, Unknown
  misc_feature (1)..( 8): Result.002 file - promoters60/1030803
aattttac

SEQ ID NO: 103272 - DNA, 8 bp, Unknown
  misc_feature (1)..( 8): Result.002 file - promoters60/1030803
aatattac

SEQ ID NO: 103273 - DNA, 7 bp, Unknown
  misc_feature (1)..( 7): Result.002 file - promoters60/1030803
agggaaa

SEQ ID NO: 103274 - DNA, 7 bp, Unknown
  misc_feature (1)..( 7): Result.002 file - promoters60/1030803
aggcaaa

SEQ ID NO: 103275 - DNA, 7 bp, Unknown
  misc_feature (1)..( 7): Result.002 file - promoters60/1030803
gtgtgtt

SEQ ID NO: 103276 - DNA, 7 bp, Unknown
  misc_feature (1)..( 7): Result.002 file - promoters60/1030803
gtgggtt

SEQ ID NO: 103277 - DNA, 7 bp, Unknown
  misc_feature (1)..( 7): Result.002 file - promoters60/1030803
caatcac

SEQ ID NO: 103278 - DNA, 7 bp, Unknown
  misc_feature (1)..( 7): Result.002 file - promoters60/1030803
caaccac

SEQ ID NO: 103279 - DNA, 6 bp, Unknown
  misc_feature (1)..( 6): Result.002 file - promoters60/1030803
ggctga

SEQ ID NO: 103280 - DNA, 6 bp, Unknown
  misc_feature (1)..( 6): Result.002 file - promoters60/1030803
ggctga

SEQ ID NO: 103281 - DNA, 11 bp, Unknown
  misc_feature (1)..( 11): Result.002 file - promoters60/1030803
aggttctcaga

SEQ ID NO: 103282 - DNA, 11 bp, Unknown
  misc_feature (1)..( 11): Result.002 file - promoters60/1030803
agggtctgaga

SEQ ID NO: 103283 - DNA, 6 bp, Unknown
  misc_feature (1)..( 6): Result.002 file - promoters60/1030803
agattt

SEQ ID NO: 103284 - DNA, 6 bp, Unknown
  misc_feature (1)..( 6): Result.002 file - promoters60/1030803
agattt

SEQ ID NO: 103285 - DNA, 9 bp, Unknown
  misc_feature (1)..( 9): Result.002 file - promoters60/1030821
tttgcttac

SEQ ID NO: 103286 - DNA, 9 bp, Unknown
  misc_feature (1)..( 9): Result.002 file - promoters60/1030821
ttttctttt

SEQ ID NO: 103287 - DNA, 9 bp, Unknown
  misc_feature (1)..( 9): Result.002 file - promoters60/1030821
cttgtttaa

SEQ ID NO: 103288 - DNA, 9 bp, Unknown
  misc_feature (1)..( 9): Result.002 file - promoters60/1030821
cttctttag

SEQ ID NO: 103289 - DNA, 9 bp, Unknown
  misc_feature (1)..( 9): Result.002 file - promoters60/1030821
cttctttaa

SEQ ID NO: 103290 - DNA, 9 bp, Unknown
  misc_feature (1)..( 9): Result.002 file - promoters60/1030821
catgtttaa

SEQ ID NO: 103291 - DNA, 8 bp, Unknown
  misc_feature (1)..( 8): Result.002 file - promoters60/1030894
attgtttt

SEQ ID NO: 103292 - DNA, 8 bp, Unknown
  misc_feature (1)..( 8): Result.002 file - promoters60/1030894
tatgtttt

SEQ ID NO: 103293 - DNA, 8 bp, Unknown
  misc_feature (1)..( 8): Result.002 file - promoters60/1030894
attgtttt

SEQ ID NO: 103294 - DNA, 8 bp, Unknown
  misc_feature (1)..( 8): Result.002 file - promoters60/1030894
attgttcg

SEQ ID NO: 103295 - DNA, 13 bp, Unknown
  misc_feature (1)..( 13): Result.002 file - promoters60/1030894
caaaaacaaatgt

SEQ ID NO: 103296 - DNA, 13 bp, Unknown
  misc_feature (1)..( 13): Result.002 file - promoters60/1030894
aggatacaactgt

SEQ ID NO: 103297 - DNA, 13 bp, Unknown
  misc_feature (1)..( 13): Result.002 file - promoters60/1030894
caaaaacaaaaaa

SEQ ID NO: 103298 - DNA, 13 bp, Unknown
  misc_feature (1)..( 13): Result.002 file - promoters60/1030894
tccctacaaccat

SEQ ID NO: 103299 - DNA, 13 bp, Unknown
  misc_feature (1)..( 13): Result.002 file - promoters60/1030894
gccaaacaacatt

SEQ ID NO: 103300 - DNA, 8 bp, Unknown
  misc_feature (1)..( 8): Result.002 file - promoters60/1030894
aaaaacaa

SEQ ID NO: 103301 - DNA, 8 bp, Unknown
  misc_feature (1)..( 8): Result.002 file - promoters60/1030894
ccaaacaa

SEQ ID NO: 103302 - DNA, 8 bp, Unknown
  misc_feature (1)..( 8): Result.002 file - promoters60/1030894
ccatacac

SEQ ID NO: 103303 - DNA, 8 bp, Unknown
  misc_feature (1)..( 8): Result.002 file - promoters60/1030894
aaaaacaa

SEQ ID NO: 103304 - DNA, 13 bp, Unknown
  misc_feature (1)..( 13): Result.002 file - promoters60/1030902
gtcttataaataa

SEQ ID NO: 103305 - DNA, 13 bp, Unknown
  misc_feature (1)..( 13): Result.002 file - promoters60/1030902
catgtataaaaac

SEQ ID NO: 103306 - DNA, 13 bp, Unknown
  misc_feature (1)..( 13): Result.002 file - promoters60/1030902
gtcatataaatat

SEQ ID NO: 103307 - DNA, 13 bp, Unknown
  misc_feature (1)..( 13): Result.002 file - promoters60/1030902
ttcatataagtaa

SEQ ID NO: 103308 - DNA, 13 bp, Unknown
  misc_feature (1)..( 13): Result.002 file - promoters60/1030902
gcactataaacaa

SEQ ID NO: 103309 - DNA, 13 bp, Unknown
  misc_feature (1)..( 13): Result.002 file - promoters60/1030902
tctttataaactc

SEQ ID NO: 103310 - DNA, 11 bp, Unknown
  misc_feature (1)..( 11): Result.002 file - promoters60/1030916
gtaattgtagt

SEQ ID NO: 103311 - DNA, 11 bp, Unknown
  misc_feature (1)..( 11): Result.002 file - promoters60/1030916
ataactgtcat

SEQ ID NO: 103312 - DNA, 11 bp, Unknown
  misc_feature (1)..( 11): Result.002 file - promoters60/1030916
aatattgtaag

SEQ ID NO: 103313 - DNA, 11 bp, Unknown
  misc_feature (1)..( 11): Result.002 file - promoters60/1030916
ttaattgcagt

SEQ ID NO: 103314 - DNA, 11 bp, Unknown
  misc_feature (1)..( 11): Result.002 file - promoters60/1030916
ttacttgattc

SEQ ID NO: 103315 - DNA, 11 bp, Unknown
  misc_feature (1)..( 11): Result.002 file - promoters60/1030916
agcaaaaacgt

SEQ ID NO: 103316 - DNA, 11 bp, Unknown
  misc_feature (1)..( 11): Result.002 file - promoters60/1030916
ttcaaaaacgt

SEQ ID NO: 103317 - DNA, 11 bp, Unknown
  misc_feature (1)..( 11): Result.002 file - promoters60/1030916
agcaaaacatt

SEQ ID NO: 103318 - DNA, 11 bp, Unknown
  misc_feature (1)..( 11): Result.002 file - promoters60/1030916
gtcaaaatctg

SEQ ID NO: 103319 - DNA, 11 bp, Unknown
  misc_feature (1)..( 11): Result.002 file - promoters60/1030916
tacaaaataat

SEQ ID NO: 103320 - DNA, 12 bp, Unknown
  misc_feature (1)..( 12): Result.002 file - promoters60/1030916
ttttgcttttaa

SEQ ID NO: 103321 - DNA, 12 bp, Unknown
  misc_feature (1)..( 12): Result.002 file - promoters60/1030916
ttttccttttaa

SEQ ID NO: 103322 - DNA, 12 bp, Unknown
  misc_feature (1)..( 12): Result.002 file - promoters60/1030916
agttgtttttta

SEQ ID NO: 103323 - DNA, 12 bp, Unknown
  misc_feature (1)..( 12): Result.002 file - promoters60/1030916
aatcaattttaa

SEQ ID NO: 103324 - DNA, 10 bp, Unknown
  misc_feature (1)..( 10): Result.002 file - promoters60/1030916
gttttacaat

SEQ ID NO: 103325 - DNA, 10 bp, Unknown
  misc_feature (1)..( 10): Result.002 file - promoters60/1030916
actttataat

SEQ ID NO: 103326 - DNA, 10 bp, Unknown
  misc_feature (1)..( 10): Result.002 file - promoters60/1030916
acattaaaat

SEQ ID NO: 103327 - DNA, 10 bp, Unknown
  misc_feature (1)..( 10): Result.002 file - promoters60/1030916
acttcataga

SEQ ID NO: 103328 - DNA, 7 bp, Unknown
  misc_feature (1)..( 7): Result.002 file - promoters60/1030916
acacaat

SEQ ID NO: 103329 - DNA, 7 bp, Unknown
  misc_feature (1)..( 7): Result.002 file - promoters60/1030916
acaaaat

SEQ ID NO: 103330 - DNA, 7 bp, Unknown
  misc_feature (1)..( 7): Result.002 file - promoters60/1030916
tcacaat

SEQ ID NO: 103331 - DNA, 7 bp, Unknown
  misc_feature (1)..( 7): Result.002 file - promoters60/1030916
tcaaaat

SEQ ID NO: 103332 - DNA, 11 bp, Unknown
  misc_feature (1)..( 11): Result.002 file - promoters60/1030918
ctttatttgat

SEQ ID NO: 103333 - DNA, 11 bp, Unknown
  misc_feature (1)..( 11): Result.002 file - promoters60/1030918
gtttattgata

SEQ ID NO: 103334 - DNA, 11 bp, Unknown
  misc_feature (1)..( 11): Result.002 file - promoters60/1030918
ctttattcgat

SEQ ID NO: 103335 - DNA, 11 bp, Unknown
  misc_feature (1)..( 11): Result.002 file - promoters60/1030918
cttaatgaaac

SEQ ID NO: 103336 - DNA, 7 bp, Unknown
  misc_feature (1)..( 7): Result.002 file - promoters60/1030933
taaggtt

SEQ ID NO: 103337 - DNA, 7 bp, Unknown
  misc_feature (1)..( 7): Result.002 file - promoters60/1030933
taaagtt

SEQ ID NO: 103338 - DNA, 7 bp, Unknown
  misc_feature (1)..( 7): Result.002 file - promoters60/1030933
tgttaag

SEQ ID NO: 103339 - DNA, 7 bp, Unknown
  misc_feature (1)..( 7): Result.002 file - promoters60/1030933
tgttaag

SEQ ID NO: 103340 - DNA, 7 bp, Unknown
  misc_feature (1)..( 7): Result.002 file - promoters60/1030933
ttttaga

SEQ ID NO: 103341 - DNA, 7 bp, Unknown
  misc_feature (1)..( 7): Result.002 file - promoters60/1030933
ttttaga

SEQ ID NO: 103342 - DNA, 7 bp, Unknown
  misc_feature (1)..( 7): Result.002 file - promoters60/1030933
ttttagc

SEQ ID NO: 103343 - DNA, 9 bp, Unknown
  misc_feature (1)..( 9): Result.002 file - promoters60/1030933
tataaccat

SEQ ID NO: 103344 - DNA, 9 bp, Unknown
  misc_feature (1)..( 9): Result.002 file - promoters60/1030933
gataaccat

SEQ ID NO: 103345 - DNA, 9 bp, Unknown
  misc_feature (1)..( 9): Result.002 file - promoters60/1030933
tataacata

SEQ ID NO: 103346 - DNA, 11 bp, Unknown
  misc_feature (1)..( 11): Result.002 file - promoters60/1030933
tgaataaaaaa

SEQ ID NO: 103347 - DNA, 11 bp, Unknown
  misc_feature (1)..( 11): Result.002 file - promoters60/1030933
tgaaaaaaaaa

SEQ ID NO: 103348 - DNA, 11 bp, Unknown
  misc_feature (1)..( 11): Result.002 file - promoters60/1030933
aaaccaaaaaa

SEQ ID NO: 103349 - DNA, 6 bp, Unknown
  misc_feature (1)..( 6): Result.002 file - promoters60/1030933
aagata

SEQ ID NO: 103350 - DNA, 6 bp, Unknown
  misc_feature (1)..( 6): Result.002 file - promoters60/1030933
aagata

SEQ ID NO: 103351 - DNA, 7 bp, Unknown
  misc_feature (1)..( 7): Result.002 file - promoters60/1030933
taacaat

SEQ ID NO: 103352 - DNA, 7 bp, Unknown
  misc_feature (1)..( 7): Result.002 file - promoters60/1030933
taaaaat

SEQ ID NO: 103353 - DNA, 8 bp, Unknown
  misc_feature (1)..( 8): Result.002 file - promoters60/1030933
ttaaacca

SEQ ID NO: 103354 - DNA, 8 bp, Unknown
  misc_feature (1)..( 8): Result.002 file - promoters60/1030933
gtaaaccg

SEQ ID NO: 103355 - DNA, 8 bp, Unknown
  misc_feature (1)..( 8): Result.002 file - promoters60/1030933
ttaatcca

SEQ ID NO: 103356 - DNA, 6 bp, Unknown
  misc_feature (1)..( 6): Result.002 file - promoters60/1030933
acaaaa

SEQ ID NO: 103357 - DNA, 6 bp, Unknown
  misc_feature (1)..( 6): Result.002 file - promoters60/1030933
acaaaa

SEQ ID NO: 103358 - DNA, 6 bp, Unknown
  misc_feature (1)..( 6): Result.002 file - promoters60/1030933
tttata

SEQ ID NO: 103359 - DNA, 6 bp, Unknown
  misc_feature (1)..( 6): Result.002 file - promoters60/1030933
tttata

SEQ ID NO: 103360 - DNA, 7 bp, Unknown
  misc_feature (1)..( 7): Result.002 file - promoters60/1030933
ttttttt

SEQ ID NO: 103361 - DNA, 7 bp, Unknown
  misc_feature (1)..( 7): Result.002 file - promoters60/1030933
tttcttt

SEQ ID NO: 103362 - DNA, 6 bp, Unknown
  misc_feature (1)..( 6): Result.002 file - promoters60/1030933
tttttc

SEQ ID NO: 103363 - DNA, 6 bp, Unknown
  misc_feature (1)..( 6): Result.002 file - promoters60/1030933
tttttc

SEQ ID NO: 103364 - DNA, 6 bp, Unknown
  misc_feature (1)..( 6): Result.002 file - promoters60/1030933
agatat

SEQ ID NO: 103365 - DNA, 6 bp, Unknown
  misc_feature (1)..( 6): Result.002 file - promoters60/1030933
agatat

SEQ ID NO: 103366 - DNA, 11 bp, Unknown
  misc_feature (1)..( 11): Result.002 file - promoters60/1030933
taacaatattt

SEQ ID NO: 103367 - DNA, 11 bp, Unknown
  misc_feature (1)..( 11): Result.002 file - promoters60/1030933
agccaatgttt

SEQ ID NO: 103368 - DNA, 11 bp, Unknown
  misc_feature (1)..( 11): Result.002 file - promoters60/1030933
agcaaatggga

SEQ ID NO: 103369 - DNA, 6 bp, Unknown
  misc_feature (1)..( 6): Result.002 file - promoters60/1030933
gatatc

SEQ ID NO: 103370 - DNA, 6 bp, Unknown
  misc_feature (1)..( 6): Result.002 file - promoters60/1030933
gatatc

SEQ ID NO: 103371 - DNA, 7 bp, Unknown
  misc_feature (1)..( 7): Result.002 file - promoters60/1030933
aattaaa

SEQ ID NO: 103372 - DNA, 7 bp, Unknown
  misc_feature (1)..( 7): Result.002 file - promoters60/1030933
aatcaaa

SEQ ID NO: 103373 - DNA, 6 bp, Unknown
  misc_feature (1)..( 6): Result.002 file - promoters60/1030933
gaaaat

SEQ ID NO: 103374 - DNA, 6 bp, Unknown
  misc_feature (1)..( 6): Result.002 file - promoters60/1030933
gaaaat

SEQ ID NO: 103375 - DNA, 8 bp, Unknown
  misc_feature (1)..( 8): Result.002 file - promoters60/1030933
aaattgaa

SEQ ID NO: 103376 - DNA, 8 bp, Unknown
  misc_feature (1)..( 8): Result.002 file - promoters60/1030933
aaattgaa

SEQ ID NO: 103377 - DNA, 6 bp, Unknown
  misc_feature (1)..( 6): Result.002 file - promoters60/1030933
attttt

SEQ ID NO: 103378 - DNA, 6 bp, Unknown
  misc_feature (1)..( 6): Result.002 file - promoters60/1030933
attttt

SEQ ID NO: 103379 - DNA, 7 bp, Unknown
  misc_feature (1)..( 7): Result.002 file - promoters60/1030933
tagatga

SEQ ID NO: 103380 - DNA, 7 bp, Unknown
  misc_feature (1)..( 7): Result.002 file - promoters60/1030933
tagatga

SEQ ID NO: 103381 - DNA, 7 bp, Unknown
  misc_feature (1)..( 7): Result.002 file - promoters60/1030933
gagataa

SEQ ID NO: 103382 - DNA, 7 bp, Unknown
  misc_feature (1)..( 7): Result.002 file - promoters60/1030933
gagctaa

SEQ ID NO: 103383 - DNA, 7 bp, Unknown
  misc_feature (1)..( 7): Result.002 file - promoters60/1030933
caataag

SEQ ID NO: 103384 - DNA, 7 bp, Unknown
  misc_feature (1)..( 7): Result.002 file - promoters60/1030933
caacaag

SEQ ID NO: 103385 - DNA, 6 bp, Unknown
  misc_feature (1)..( 6): Result.002 file - promoters60/1030933
aaatct

SEQ ID NO: 103386 - DNA, 6 bp, Unknown
  misc_feature (1)..( 6): Result.002 file - promoters60/1030933
aaatct

SEQ ID NO: 103387 - DNA, 6 bp, Unknown
  misc_feature (1)..( 6): Result.002 file - promoters60/1030933
aattgt

SEQ ID NO: 103388 - DNA, 6 bp, Unknown
  misc_feature (1)..( 6): Result.002 file - promoters60/1030933
aattgt

SEQ ID NO: 103389 - DNA, 7 bp, Unknown
  misc_feature (1)..( 7): Result.002 file - promoters60/1030933
aattaat

SEQ ID NO: 103390 - DNA, 7 bp, Unknown
  misc_feature (1)..( 7): Result.002 file - promoters60/1030933
aataaat

SEQ ID NO: 103391 - DNA, 6 bp, Unknown
  misc_feature (1)..( 6): Result.002 file - promoters60/1030933
gaaaac

SEQ ID NO: 103392 - DNA, 6 bp, Unknown
  misc_feature (1)..( 6): Result.002 file - promoters60/1030933
gaaaac

SEQ ID NO: 103393 - DNA, 6 bp, Unknown
  misc_feature (1)..( 6): Result.002 file - promoters60/1030933
ccaatc

SEQ ID NO: 103394 - DNA, 6 bp, Unknown
  misc_feature (1)..( 6): Result.002 file - promoters60/1030933
ccaatc

SEQ ID NO: 103395 - DNA, 6 bp, Unknown
  misc_feature (1)..( 6): Result.002 file - promoters60/1030933
agaaat

SEQ ID NO: 103396 - DNA, 6 bp, Unknown
  misc_feature (1)..( 6): Result.002 file - promoters60/1030933
agaaat

SEQ ID NO: 103397 - DNA, 14 bp, Unknown
  misc_feature (1)..( 14): Result.002 file - promoters60/1030940
actacacatagtga

SEQ ID NO: 103398 - DNA, 14 bp, Unknown
  misc_feature (1)..( 14): Result.002 file - promoters60/1030940
gctaaacaaaaact

SEQ ID NO: 103399 - DNA, 14 bp, Unknown
  misc_feature (1)..( 14): Result.002 file - promoters60/1030940
aacaaaccaaatca

SEQ ID NO: 103400 - DNA, 14 bp, Unknown
  misc_feature (1)..( 14): Result.002 file - promoters60/1030940
gcttaacactctta

SEQ ID NO: 103401 - DNA, 14 bp, Unknown
  misc_feature (1)..( 14): Result.002 file - promoters60/1030940
tccaaattctgaac

SEQ ID NO: 103402 - DNA, 14 bp, Unknown
  misc_feature (1)..( 14): Result.002 file - promoters60/1030940
agataataaagcaa

SEQ ID NO: 103403 - DNA, 15 bp, Unknown
  misc_feature (1)..( 15): Result.002 file - promoters60/1030940
aagaaagaaacctcg

SEQ ID NO: 103404 - DNA, 15 bp, Unknown
  misc_feature (1)..( 15): Result.002 file - promoters60/1030940
cttaaagaataggtt

SEQ ID NO: 103405 - DNA, 15 bp, Unknown
  misc_feature (1)..( 15): Result.002 file - promoters60/1030940
caagaagaaaaaaat

SEQ ID NO: 103406 - DNA, 15 bp, Unknown
  misc_feature (1)..( 15): Result.002 file - promoters60/1030940
cctgaagaacaggtt

SEQ ID NO: 103407 - DNA, 15 bp, Unknown
  misc_feature (1)..( 15): Result.002 file - promoters60/1030940
ttgcgtttacatgtt

SEQ ID NO: 103408 - DNA, 15 bp, Unknown
  misc_feature (1)..( 15): Result.002 file - promoters60/1030940
cttagagacaaagta

SEQ ID NO: 103409 - DNA, 7 bp, Unknown
  misc_feature (1)..( 7): Result.002 file - promoters60/1031035
attgatt

SEQ ID NO: 103410 - DNA, 7 bp, Unknown
  misc_feature (1)..( 7): Result.002 file - promoters60/1031035
tttgatt

SEQ ID NO: 103411 - DNA, 8 bp, Unknown
  misc_feature (1)..( 8): Result.002 file - promoters60/1031035
tttggatc

SEQ ID NO: 103412 - DNA, 10 bp, Unknown
  misc_feature (1)..( 10): Result.002 file - promoters60/1031035
acttacaaaa

SEQ ID NO: 103413 - DNA, 10 bp, Unknown
  misc_feature (1)..( 10): Result.002 file - promoters60/1031035
acaaacaaaa

SEQ ID NO: 103414 - DNA, 10 bp, Unknown
  misc_feature (1)..( 10): Result.002 file - promoters60/1031035
acagacaaaa

SEQ ID NO: 103415 - DNA, 11 bp, Unknown
  misc_feature (1)..( 11): Result.002 file - promoters60/1031035
aaagacagaac

SEQ ID NO: 103416 - DNA, 11 bp, Unknown
  misc_feature (1)..( 11): Result.002 file - promoters60/1031035
acagacaaaac

SEQ ID NO: 103417 - DNA, 11 bp, Unknown
  misc_feature (1)..( 11): Result.002 file - promoters60/1031035
acaaacaaaaa

SEQ ID NO: 103418 - DNA, 7 bp, Unknown
  misc_feature (1)..( 7): Result.002 file - promoters60/1031035
acaaaaa

SEQ ID NO: 103419 - DNA, 7 bp, Unknown
  misc_feature (1)..( 7): Result.002 file - promoters60/1031035
tcaaaaa

SEQ ID NO: 103420 - DNA, 7 bp, Unknown
  misc_feature (1)..( 7): Result.002 file - promoters60/1031035
acaaaag

SEQ ID NO: 103421 - DNA, 8 bp, Unknown
  misc_feature (1)..( 8): Result.002 file - promoters60/1031048
tggtgtta

SEQ ID NO: 103422 - DNA, 8 bp, Unknown
  misc_feature (1)..( 8): Result.002 file - promoters60/1031048
tggtatta

SEQ ID NO: 103423 - DNA, 7 bp, Unknown
  misc_feature (1)..( 7): Result.002 file - promoters60/1031048
aacttca

SEQ ID NO: 103424 - DNA, 7 bp, Unknown
  misc_feature (1)..( 7): Result.002 file - promoters60/1031048
aacctca

SEQ ID NO: 103425 - DNA, 8 bp, Unknown
  misc_feature (1)..( 8): Result.002 file - promoters60/1031048
acgctgcc

SEQ ID NO: 103426 - DNA, 8 bp, Unknown
  misc_feature (1)..( 8): Result.002 file - promoters60/1031048
acgttgcc

SEQ ID NO: 103427 - DNA, 7 bp, Unknown
  misc_feature (1)..( 7): Result.002 file - promoters60/1031048
tggagtt

SEQ ID NO: 103428 - DNA, 7 bp, Unknown
  misc_feature (1)..( 7): Result.002 file - promoters60/1031048
tggggtt

SEQ ID NO: 103429 - DNA, 7 bp, Unknown
  misc_feature (1)..( 7): Result.002 file - promoters60/1031048
ttagtgg

SEQ ID NO: 103430 - DNA, 7 bp, Unknown
  misc_feature (1)..( 7): Result.002 file - promoters60/1031048
ttaatgg

SEQ ID NO: 103431 - DNA, 8 bp, Unknown
  misc_feature (1)..( 8): Result.002 file - promoters60/1031048
ttcatcta

SEQ ID NO: 103432 - DNA, 8 bp, Unknown
  misc_feature (1)..( 8): Result.002 file - promoters60/1031048
ttcaacta

SEQ ID NO: 103433 - DNA, 6 bp, Unknown
  misc_feature (1)..( 6): Result.002 file - promoters60/1031048
tacaaa

SEQ ID NO: 103434 - DNA, 6 bp, Unknown
  misc_feature (1)..( 6): Result.002 file - promoters60/1031048
tacaaa

SEQ ID NO: 103435 - DNA, 6 bp, Unknown
  misc_feature (1)..( 6): Result.002 file - promoters60/1031048
gttttt

SEQ ID NO: 103436 - DNA, 6 bp, Unknown
  misc_feature (1)..( 6): Result.002 file - promoters60/1031048
gttttt

SEQ ID NO: 103437 - DNA, 9 bp, Unknown
  misc_feature (1)..( 9): Result.002 file - promoters60/1031084
tagagaatg

SEQ ID NO: 103438 - DNA, 9 bp, Unknown
  misc_feature (1)..( 9): Result.002 file - promoters60/1031084
tagacaatg

SEQ ID NO: 103439 - DNA, 9 bp, Unknown
  misc_feature (1)..( 9): Result.002 file - promoters60/1031084
tagagaata

SEQ ID NO: 103440 - DNA, 8 bp, Unknown
  misc_feature (1)..( 8): Result.002 file - promoters60/1031084
taataagt

SEQ ID NO: 103441 - DNA, 8 bp, Unknown
  misc_feature (1)..( 8): Result.002 file - promoters60/1031084
caatgagt

SEQ ID NO: 103442 - DNA, 8 bp, Unknown
  misc_feature (1)..( 8): Result.002 file - promoters60/1031084
taataaaa

SEQ ID NO: 103443 - DNA, 6 bp, Unknown
  misc_feature (1)..( 6): Result.002 file - promoters60/1031084
attaaa

SEQ ID NO: 103444 - DNA, 6 bp, Unknown
  misc_feature (1)..( 6): Result.002 file - promoters60/1031084
attaaa

SEQ ID NO: 103445 - DNA, 7 bp, Unknown
  misc_feature (1)..( 7): Result.002 file - promoters60/1031084
attgaaa

SEQ ID NO: 103446 - DNA, 12 bp, Unknown
  misc_feature (1)..( 12): Result.002 file - promoters60/1031084
aaaatagaaaaa

SEQ ID NO: 103447 - DNA, 12 bp, Unknown
  misc_feature (1)..( 12): Result.002 file - promoters60/1031084
aaaatactttaa

SEQ ID NO: 103448 - DNA, 12 bp, Unknown
  misc_feature (1)..( 12): Result.002 file - promoters60/1031084
gaaacagagaaa

SEQ ID NO: 103449 - DNA, 11 bp, Unknown
  misc_feature (1)..( 11): Result.002 file - promoters60/1031084
aaatagaaaaa

SEQ ID NO: 103450 - DNA, 11 bp, Unknown
  misc_feature (1)..( 11): Result.002 file - promoters60/1031084
ttaaggaaaaa

SEQ ID NO: 103451 - DNA, 11 bp, Unknown
  misc_feature (1)..( 11): Result.002 file - promoters60/1031084
aaacagagaaa

SEQ ID NO: 103452 - DNA, 7 bp, Unknown
  misc_feature (1)..( 7): Result.002 file - promoters60/1031084
aaaacca

SEQ ID NO: 103453 - DNA, 7 bp, Unknown
  misc_feature (1)..( 7): Result.002 file - promoters60/1031084
taaacca

SEQ ID NO: 103454 - DNA, 7 bp, Unknown
  misc_feature (1)..( 7): Result.002 file - promoters60/1031084
taatcca

SEQ ID NO: 103455 - DNA, 7 bp, Unknown
  misc_feature (1)..( 7): Result.002 file - promoters60/1031084
atcaaaa

SEQ ID NO: 103456 - DNA, 7 bp, Unknown
  misc_feature (1)..( 7): Result.002 file - promoters60/1031084
ttcaaaa

SEQ ID NO: 103457 - DNA, 7 bp, Unknown
  misc_feature (1)..( 7): Result.002 file - promoters60/1031084
atcaaag

SEQ ID NO: 103458 - DNA, 8 bp, Unknown
  misc_feature (1)..( 8): Result.002 file - promoters60/1031084
tacaagca

SEQ ID NO: 103459 - DNA, 8 bp, Unknown
  misc_feature (1)..( 8): Result.002 file - promoters60/1031084
cacatgca

SEQ ID NO: 103460 - DNA, 8 bp, Unknown
  misc_feature (1)..( 8): Result.002 file - promoters60/1031084
aagaagta

SEQ ID NO: 103461 - DNA, 12 bp, Unknown
  misc_feature (1)..( 12): Result.002 file - promoters60/1031103
tgtgttatttca

SEQ ID NO: 103462 - DNA, 12 bp, Unknown
  misc_feature (1)..( 12): Result.002 file - promoters60/1031103
gtagttatttca

SEQ ID NO: 103463 - DNA, 12 bp, Unknown
  misc_feature (1)..( 12): Result.002 file - promoters60/1031103
tgtgatattgat

SEQ ID NO: 103464 - DNA, 6 bp, Unknown
  misc_feature (1)..( 6): Result.002 file - promoters60/1031103
aattat

SEQ ID NO: 103465 - DNA, 6 bp, Unknown
  misc_feature (1)..( 6): Result.002 file - promoters60/1031103
aattat

SEQ ID NO: 103466 - DNA, 7 bp, Unknown
  misc_feature (1)..( 7): Result.002 file - promoters60/1031103
aaagtgg

SEQ ID NO: 103467 - DNA, 7 bp, Unknown
  misc_feature (1)..( 7): Result.002 file - promoters60/1031103
aaattgg

SEQ ID NO: 103468 - DNA, 6 bp, Unknown
  misc_feature (1)..( 6): Result.002 file - promoters60/1031103
ttttga

SEQ ID NO: 103469 - DNA, 6 bp, Unknown
  misc_feature (1)..( 6): Result.002 file - promoters60/1031103
ttttga

SEQ ID NO: 103470 - DNA, 8 bp, Unknown
  misc_feature (1)..( 8): Result.002 file - promoters60/1031103
aatacaaa

SEQ ID NO: 103471 - DNA, 8 bp, Unknown
  misc_feature (1)..( 8): Result.002 file - promoters60/1031103
aattcaaa

SEQ ID NO: 103472 - DNA, 7 bp, Unknown
  misc_feature (1)..( 7): Result.002 file - promoters60/1031103
aaaaccc

SEQ ID NO: 103473 - DNA, 7 bp, Unknown
  misc_feature (1)..( 7): Result.002 file - promoters60/1031103
aaaaccc

SEQ ID NO: 103474 - DNA, 8 bp, Unknown
  misc_feature (1)..( 8): Result.002 file - promoters60/1031103
agattgat

SEQ ID NO: 103475 - DNA, 8 bp, Unknown
  misc_feature (1)..( 8): Result.002 file - promoters60/1031103
agattgat

SEQ ID NO: 103476 - DNA, 7 bp, Unknown
  misc_feature (1)..( 7): Result.002 file - promoters60/1031103
ttatgga

SEQ ID NO: 103477 - DNA, 7 bp, Unknown
  misc_feature (1)..( 7): Result.002 file - promoters60/1031103
ttatgga

SEQ ID NO: 103478 - DNA, 6 bp, Unknown
  misc_feature (1)..( 6): Result.002 file - promoters60/1031103
tatttt

SEQ ID NO: 103479 - DNA, 6 bp, Unknown
  misc_feature (1)..( 6): Result.002 file - promoters60/1031103
tatttt

SEQ ID NO: 103480 - DNA, 6 bp, Unknown
  misc_feature (1)..( 6): Result.002 file - promoters60/1031103
ttttct

SEQ ID NO: 103481 - DNA, 6 bp, Unknown
  misc_feature (1)..( 6): Result.002 file - promoters60/1031103
ttttct

SEQ ID NO: 103482 - DNA, 6 bp, Unknown
  misc_feature (1)..( 6): Result.002 file - promoters60/1031103
tttaga

SEQ ID NO: 103483 - DNA, 6 bp, Unknown
  misc_feature (1)..( 6): Result.002 file - promoters60/1031103
tttaga

SEQ ID NO: 103484 - DNA, 7 bp, Unknown
  misc_feature (1)..( 7): Result.002 file - promoters60/1031103
agaaaat

SEQ ID NO: 103485 - DNA, 7 bp, Unknown
  misc_feature (1)..( 7): Result.002 file - promoters60/1031103
agacaat

SEQ ID NO: 103486 - DNA, 6 bp, Unknown
  misc_feature (1)..( 6): Result.002 file - promoters60/1031103
atgtag

SEQ ID NO: 103487 - DNA, 6 bp, Unknown
  misc_feature (1)..( 6): Result.002 file - promoters60/1031103
atgtag

SEQ ID NO: 103488 - DNA, 7 bp, Unknown
  misc_feature (1)..( 7): Result.002 file - promoters60/1031103
gcactaa

SEQ ID NO: 103489 - DNA, 7 bp, Unknown
  misc_feature (1)..( 7): Result.002 file - promoters60/1031103
gcagtaa

SEQ ID NO: 103490 - DNA, 7 bp, Unknown
  misc_feature (1)..( 7): Result.002 file - promoters60/1031103
taaattt

SEQ ID NO: 103491 - DNA, 7 bp, Unknown
  misc_feature (1)..( 7): Result.002 file - promoters60/1031103
taacttt

SEQ ID NO: 103492 - DNA, 6 bp, Unknown
  misc_feature (1)..( 6): Result.002 file - promoters60/1031103
tttcta

SEQ ID NO: 103493 - DNA, 6 bp, Unknown
  misc_feature (1)..( 6): Result.002 file - promoters60/1031103
tttcta

SEQ ID NO: 103494 - DNA, 7 bp, Unknown
  misc_feature (1)..( 7): Result.002 file - promoters60/1031103
tatattc

SEQ ID NO: 103495 - DNA, 7 bp, Unknown
  misc_feature (1)..( 7): Result.002 file - promoters60/1031103
tatgttc

SEQ ID NO: 103496 - DNA, 7 bp, Unknown
  misc_feature (1)..( 7): Result.002 file - promoters60/1031103
ttacatt

SEQ ID NO: 103497 - DNA, 7 bp, Unknown
  misc_feature (1)..( 7): Result.002 file - promoters60/1031103
ttagatt

SEQ ID NO: 103498 - DNA, 6 bp, Unknown
  misc_feature (1)..( 6): Result.002 file - promoters60/1031208
tataat

SEQ ID NO: 103499 - DNA, 6 bp, Unknown
  misc_feature (1)..( 6): Result.002 file - promoters60/1031208
tataat

SEQ ID NO: 103500 - DNA, 11 bp, Unknown
  misc_feature (1)..( 11): Result.002 file - promoters60/1031208
aaaaagaaaaa

SEQ ID NO: 103501 - DNA, 11 bp, Unknown
  misc_feature (1)..( 11): Result.002 file - promoters60/1031208
aaaaataaaaa

SEQ ID NO: 103502 - DNA, 8 bp, Unknown
  misc_feature (1)..( 8): Result.002 file - promoters60/1031208
aatttttg

SEQ ID NO: 103503 - DNA, 8 bp, Unknown
  misc_feature (1)..( 8): Result.002 file - promoters60/1031208
aatttttt

SEQ ID NO: 103504 - DNA, 8 bp, Unknown
  misc_feature (1)..( 8): Result.002 file - promoters60/1031208
cgtttttt

SEQ ID NO: 103505 - DNA, 10 bp, Unknown
  misc_feature (1)..( 10): Result.002 file - promoters60/1031208
tcaattacac

SEQ ID NO: 103506 - DNA, 10 bp, Unknown
  misc_feature (1)..( 10): Result.002 file - promoters60/1031208
tcaattaaaa

SEQ ID NO: 103507 - DNA, 10 bp, Unknown
  misc_feature (1)..( 10): Result.002 file - promoters60/1031208
ccaattcaaa

SEQ ID NO: 103508 - DNA, 6 bp, Unknown
  misc_feature (1)..( 6): Result.002 file - promoters60/1031208
aaaaaa

SEQ ID NO: 103509 - DNA, 6 bp, Unknown
  misc_feature (1)..( 6): Result.002 file - promoters60/1031208
aaaaaa

SEQ ID NO: 103510 - DNA, 9 bp, Unknown
  misc_feature (1)..( 9): Result.002 file - promoters60/1031208
cttaatttg

SEQ ID NO: 103511 - DNA, 9 bp, Unknown
  misc_feature (1)..( 9): Result.002 file - promoters60/1031208
cttactttg

SEQ ID NO: 103512 - DNA, 8 bp, Unknown
  misc_feature (1)..( 8): Result.002 file - promoters60/1031208
attatctt

SEQ ID NO: 103513 - DNA, 8 bp, Unknown
  misc_feature (1)..( 8): Result.002 file - promoters60/1031208
attctctt

SEQ ID NO: 103514 - DNA, 14 bp, Unknown
  misc_feature (1)..( 14): Result.002 file - promoters60/1031208
aatatggtcttaaa

SEQ ID NO: 103515 - DNA, 14 bp, Unknown
  misc_feature (1)..( 14): Result.002 file - promoters60/1031208
aatttggtctaaaa

SEQ ID NO: 103516 - DNA, 7 bp, Unknown
  misc_feature (1)..( 7): Result.002 file - promoters60/1031208
atttgtt

SEQ ID NO: 103517 - DNA, 7 bp, Unknown
  misc_feature (1)..( 7): Result.002 file - promoters60/1031208
ttttgtt

SEQ ID NO: 103518 - DNA, 7 bp, Unknown
  misc_feature (1)..( 7): Result.002 file - promoters60/1031208
ttttgta

SEQ ID NO: 103519 - DNA, 7 bp, Unknown
  misc_feature (1)..( 7): Result.002 file - promoters60/1031208
atatttg

SEQ ID NO: 103520 - DNA, 7 bp, Unknown
  misc_feature (1)..( 7): Result.002 file - promoters60/1031208
ttatttg

SEQ ID NO: 103521 - DNA, 7 bp, Unknown
  misc_feature (1)..( 7): Result.002 file - promoters60/1031208
ttatttc

SEQ ID NO: 103522 - DNA, 10 bp, Unknown
  misc_feature (1)..( 10): Result.002 file - promoters60/1031208
ttattcttaa

SEQ ID NO: 103523 - DNA, 10 bp, Unknown
  misc_feature (1)..( 10): Result.002 file - promoters60/1031208
ttattctcta

SEQ ID NO: 103524 - DNA, 10 bp, Unknown
  misc_feature (1)..( 10): Result.002 file - promoters60/1031208
tcattctcta

SEQ ID NO: 103525 - DNA, 7 bp, Unknown
  misc_feature (1)..( 7): Result.002 file - promoters60/1031208
atactta

SEQ ID NO: 103526 - DNA, 7 bp, Unknown
  misc_feature (1)..( 7): Result.002 file - promoters60/1031208
ataatta

SEQ ID NO: 103527 - DNA, 7 bp, Unknown
  misc_feature (1)..( 7): Result.002 file - promoters60/1031208
attaatc

SEQ ID NO: 103528 - DNA, 7 bp, Unknown
  misc_feature (1)..( 7): Result.002 file - promoters60/1031208
attaatc

SEQ ID NO: 103529 - DNA, 10 bp, Unknown
  misc_feature (1)..( 10): Result.002 file - promoters60/1031208
tttttttatt

SEQ ID NO: 103530 - DNA, 10 bp, Unknown
  misc_feature (1)..( 10): Result.002 file - promoters60/1031208
ttttattatt

SEQ ID NO: 103531 - DNA, 6 bp, Unknown
  misc_feature (1)..( 6): Result.002 file - promoters60/1031208
gtatgt

SEQ ID NO: 103532 - DNA, 6 bp, Unknown
  misc_feature (1)..( 6): Result.002 file - promoters60/1031208
gtatgt

SEQ ID NO: 103533 - DNA, 8 bp, Unknown
  misc_feature (1)..( 8): Result.002 file - promoters60/1031208
tcaacaac

SEQ ID NO: 103534 - DNA, 8 bp, Unknown
  misc_feature (1)..( 8): Result.002 file - promoters60/1031208
tcaagaac

SEQ ID NO: 103535 - DNA, 6 bp, Unknown
  misc_feature (1)..( 6): Result.002 file - promoters60/1031208
tcggcc

SEQ ID NO: 103536 - DNA, 6 bp, Unknown
  misc_feature (1)..( 6): Result.002 file - promoters60/1031208
tcggcc

SEQ ID NO: 103537 - DNA, 10 bp, Unknown
  misc_feature (1)..( 10): Result.002 file - promoters60/1031229
agtcttaccc

SEQ ID NO: 103538 - DNA, 10 bp, Unknown
  misc_feature (1)..( 10): Result.002 file - promoters60/1031229
agttttactt

SEQ ID NO: 103539 - DNA, 10 bp, Unknown
  misc_feature (1)..( 10): Result.002 file - promoters60/1031229
ccttttcttg

SEQ ID NO: 103540 - DNA, 12 bp, Unknown
  misc_feature (1)..( 12): Result.002 file - promoters60/1031229
ttttcttgttgt

SEQ ID NO: 103541 - DNA, 12 bp, Unknown
  misc_feature (1)..( 12): Result.002 file - promoters60/1031229
ttttcttattgt

SEQ ID NO: 103542 - DNA, 12 bp, Unknown
  misc_feature (1)..( 12): Result.002 file - promoters60/1031229
tttacttgcagc

SEQ ID NO: 103543 - DNA, 11 bp, Unknown
  misc_feature (1)..( 11): Result.002 file - promoters60/1031229
gtactatttta

SEQ ID NO: 103544 - DNA, 11 bp, Unknown
  misc_feature (1)..( 11): Result.002 file - promoters60/1031229
ttactttttta

SEQ ID NO: 103545 - DNA, 11 bp, Unknown
  misc_feature (1)..( 11): Result.002 file - promoters60/1031229
ttacttctcgt

SEQ ID NO: 103546 - DNA, 11 bp, Unknown
  misc_feature (1)..( 11): Result.002 file - promoters60/1031267
gtgacttggag

SEQ ID NO: 103547 - DNA, 11 bp, Unknown
  misc_feature (1)..( 11): Result.002 file - promoters60/1031267
atgacgtggaa

SEQ ID NO: 103548 - DNA, 11 bp, Unknown
  misc_feature (1)..( 11): Result.002 file - promoters60/1031267
gtggcttgttt

SEQ ID NO: 103549 - DNA, 11 bp, Unknown
  misc_feature (1)..( 11): Result.002 file - promoters60/1031267
acggattggag

SEQ ID NO: 103550 - DNA, 11 bp, Unknown
  misc_feature (1)..( 11): Result.002 file - promoters60/1031267
aggagttggag

SEQ ID NO: 103551 - DNA, 11 bp, Unknown
  misc_feature (1)..( 11): Result.002 file - promoters60/1031267
tggtggtggaa

SEQ ID NO: 103552 - DNA, 15 bp, Unknown
  misc_feature (1)..( 15): Result.002 file - promoters60/1031291
tctctcaaagatttt

SEQ ID NO: 103553 - DNA, 15 bp, Unknown
  misc_feature (1)..( 15): Result.002 file - promoters60/1031291
agtttcaaagaaaga

SEQ ID NO: 103554 - DNA, 15 bp, Unknown
  misc_feature (1)..( 15): Result.002 file - promoters60/1031291
gccctcaaaaaagct

SEQ ID NO: 103555 - DNA, 15 bp, Unknown
  misc_feature (1)..( 15): Result.002 file - promoters60/1031291
tctttcaaaatttga

SEQ ID NO: 103556 - DNA, 15 bp, Unknown
  misc_feature (1)..( 15): Result.002 file - promoters60/1031291
acaaggaaagacttt

SEQ ID NO: 103557 - DNA, 15 bp, Unknown
  misc_feature (1)..( 15): Result.002 file - promoters60/1031291
agactcaaaagttat

SEQ ID NO: 103558 - DNA, 7 bp, Unknown
  misc_feature (1)..( 7): Result.002 file - promoters60/1031299
taaacat

SEQ ID NO: 103559 - DNA, 7 bp, Unknown
  misc_feature (1)..( 7): Result.002 file - promoters60/1031299
taaacat

SEQ ID NO: 103560 - DNA, 7 bp, Unknown
  misc_feature (1)..( 7): Result.002 file - promoters60/1031299
aaaacat

SEQ ID NO: 103561 - DNA, 16 bp, Unknown
  misc_feature (1)..( 16): Result.002 file - promoters60/1031299
ttaactttacgttctt

SEQ ID NO: 103562 - DNA, 16 bp, Unknown
  misc_feature (1)..( 16): Result.002 file - promoters60/1031299
ttaactgataaaatat

SEQ ID NO: 103563 - DNA, 17 bp, Unknown
  misc_feature (1)..( 17): Result.002 file - promoters60/1031299
ataatctaattgataaa

SEQ ID NO: 103564 - DNA, 17 bp, Unknown
  misc_feature (1)..( 17): Result.002 file - promoters60/1031299
ttaatataagactaatc

SEQ ID NO: 103565 - DNA, 8 bp, Unknown
  misc_feature (1)..( 8): Result.002 file - promoters60/1031299
agatttta

SEQ ID NO: 103566 - DNA, 8 bp, Unknown
  misc_feature (1)..( 8): Result.002 file - promoters60/1031299
agatttta

SEQ ID NO: 103567 - DNA, 8 bp, Unknown
  misc_feature (1)..( 8): Result.002 file - promoters60/1031299
aaatttta

SEQ ID NO: 103568 - DNA, 8 bp, Unknown
  misc_feature (1)..( 8): Result.002 file - promoters60/1031299
aaatatat

SEQ ID NO: 103569 - DNA, 8 bp, Unknown
  misc_feature (1)..( 8): Result.002 file - promoters60/1031299
taatatat

SEQ ID NO: 103570 - DNA, 8 bp, Unknown
  misc_feature (1)..( 8): Result.002 file - promoters60/1031299
aaatatgc

SEQ ID NO: 103571 - DNA, 10 bp, Unknown
  misc_feature (1)..( 10): Result.002 file - promoters60/1031299
acactttttc

SEQ ID NO: 103572 - DNA, 10 bp, Unknown
  misc_feature (1)..( 10): Result.002 file - promoters60/1031299
acaattttta

SEQ ID NO: 103573 - DNA, 10 bp, Unknown
  misc_feature (1)..( 10): Result.002 file - promoters60/1031299
ttggttttta

SEQ ID NO: 103574 - DNA, 8 bp, Unknown
  misc_feature (1)..( 8): Result.002 file - promoters60/1031299
tttaaaat

SEQ ID NO: 103575 - DNA, 8 bp, Unknown
  misc_feature (1)..( 8): Result.002 file - promoters60/1031299
tgtaaaat

SEQ ID NO: 103576 - DNA, 8 bp, Unknown
  misc_feature (1)..( 8): Result.002 file - promoters60/1031299
tttaaaac

SEQ ID NO: 103577 - DNA, 7 bp, Unknown
  misc_feature (1)..( 7): Result.002 file - promoters60/1031299
aatgtta

SEQ ID NO: 103578 - DNA, 7 bp, Unknown
  misc_feature (1)..( 7): Result.002 file - promoters60/1031299
aatgttt

SEQ ID NO: 103579 - DNA, 7 bp, Unknown
  misc_feature (1)..( 7): Result.002 file - promoters60/1031299
aatctta

SEQ ID NO: 103580 - DNA, 16 bp, Unknown
  misc_feature (1)..( 16): Result.002 file - promoters60/1031299
taatttaactgataaa

SEQ ID NO: 103581 - DNA, 16 bp, Unknown
  misc_feature (1)..( 16): Result.002 file - promoters60/1031299
aaatttaatataagac

SEQ ID NO: 103582 - DNA, 16 bp, Unknown
  misc_feature (1)..( 16): Result.002 file - promoters60/1031299
taatctaattgataaa

SEQ ID NO: 103583 - DNA, 8 bp, Unknown
  misc_feature (1)..( 8): Result.002 file - promoters60/1031299
tataaata

SEQ ID NO: 103584 - DNA, 8 bp, Unknown
  misc_feature (1)..( 8): Result.002 file - promoters60/1031299
gatatata

SEQ ID NO: 103585 - DNA, 8 bp, Unknown
  misc_feature (1)..( 8): Result.002 file - promoters60/1031299
tataaata

SEQ ID NO: 103586 - DNA, 8 bp, Unknown
  misc_feature (1)..( 8): Result.002 file - promoters60/1031336
tgttgact

SEQ ID NO: 103587 - DNA, 8 bp, Unknown
  misc_feature (1)..( 8): Result.002 file - promoters60/1031336
tgttgact

SEQ ID NO: 103588 - DNA, 6 bp, Unknown
  misc_feature (1)..( 6): Result.002 file - promoters60/1031336
ctttgt

SEQ ID NO: 103589 - DNA, 6 bp, Unknown
  misc_feature (1)..( 6): Result.002 file - promoters60/1031336
ctttgt

SEQ ID NO: 103590 - DNA, 6 bp, Unknown
  misc_feature (1)..( 6): Result.002 file - promoters60/1031336
gtagct

SEQ ID NO: 103591 - DNA, 6 bp, Unknown
  misc_feature (1)..( 6): Result.002 file - promoters60/1031336
gtagct

SEQ ID NO: 103592 - DNA, 10 bp, Unknown
  misc_feature (1)..( 10): Result.002 file - promoters60/1031336
ttcttgtttc

SEQ ID NO: 103593 - DNA, 10 bp, Unknown
  misc_feature (1)..( 10): Result.002 file - promoters60/1031336
ttcttcttta

SEQ ID NO: 103594 - DNA, 10 bp, Unknown
  misc_feature (1)..( 10): Result.002 file - promoters60/1031336
aagatcttta

SEQ ID NO: 103595 - DNA, 8 bp, Unknown
  misc_feature (1)..( 8): Result.002 file - promoters60/1031336
ccagattt

SEQ ID NO: 103596 - DNA, 8 bp, Unknown
  misc_feature (1)..( 8): Result.002 file - promoters60/1031336
ccatattt

SEQ ID NO: 103597 - DNA, 7 bp, Unknown
  misc_feature (1)..( 7): Result.002 file - promoters60/1031336
tttaact

SEQ ID NO: 103598 - DNA, 7 bp, Unknown
  misc_feature (1)..( 7): Result.002 file - promoters60/1031336
tttcact

SEQ ID NO: 103599 - DNA, 9 bp, Unknown
  misc_feature (1)..( 9): Result.002 file - promoters60/1031336
aaaacaaaa

SEQ ID NO: 103600 - DNA, 9 bp, Unknown
  misc_feature (1)..( 9): Result.002 file - promoters60/1031336
aaaacaaaa

SEQ ID NO: 103601 - DNA, 9 bp, Unknown
  misc_feature (1)..( 9): Result.002 file - promoters60/1031336
tcaacaaaa

SEQ ID NO: 103602 - DNA, 6 bp, Unknown
  misc_feature (1)..( 6): Result.002 file - promoters60/1031336
aaatat

SEQ ID NO: 103603 - DNA, 6 bp, Unknown
  misc_feature (1)..( 6): Result.002 file - promoters60/1031336
aaatat

SEQ ID NO: 103604 - DNA, 6 bp, Unknown
  misc_feature (1)..( 6): Result.002 file - promoters60/1031336
caaaaa

SEQ ID NO: 103605 - DNA, 6 bp, Unknown
  misc_feature (1)..( 6): Result.002 file - promoters60/1031336
caaaaa

SEQ ID NO: 103606 - DNA, 7 bp, Unknown
  misc_feature (1)..( 7): Result.002 file - promoters60/1031336
actgaat

SEQ ID NO: 103607 - DNA, 7 bp, Unknown
  misc_feature (1)..( 7): Result.002 file - promoters60/1031336
acttaat

SEQ ID NO: 103608 - DNA, 9 bp, Unknown
  misc_feature (1)..( 9): Result.002 file - promoters60/1031336
ctcaagttt

SEQ ID NO: 103609 - DNA, 9 bp, Unknown
  misc_feature (1)..( 9): Result.002 file - promoters60/1031336
ctcaaattt

SEQ ID NO: 103610 - DNA, 6 bp, Unknown
  misc_feature (1)..( 6): Result.002 file - promoters60/1031336
aaacaa

SEQ ID NO: 103611 - DNA, 6 bp, Unknown
  misc_feature (1)..( 6): Result.002 file - promoters60/1031336
aaacaa

SEQ ID NO: 103612 - DNA, 10 bp, Unknown
  misc_feature (1)..( 10): Result.002 file - promoters60/1031336
attaaagaaa

SEQ ID NO: 103613 - DNA, 10 bp, Unknown
  misc_feature (1)..( 10): Result.002 file - promoters60/1031336
attaaaggaa

SEQ ID NO: 103614 - DNA, 10 bp, Unknown
  misc_feature (1)..( 10): Result.002 file - promoters60/1031336
agtaagggaa

SEQ ID NO: 103615 - DNA, 9 bp, Unknown
  misc_feature (1)..( 9): Result.002 file - promoters60/1031336
aaaacaaaa

SEQ ID NO: 103616 - DNA, 9 bp, Unknown
  misc_feature (1)..( 9): Result.002 file - promoters60/1031336
aaaacaaaa

SEQ ID NO: 103617 - DNA, 7 bp, Unknown
  misc_feature (1)..( 7): Result.002 file - promoters60/1031336
aaacacg

SEQ ID NO: 103618 - DNA, 7 bp, Unknown
  misc_feature (1)..( 7): Result.002 file - promoters60/1031336
aaaaacg

SEQ ID NO: 103619 - DNA, 7 bp, Unknown
  misc_feature (1)..( 7): Result.002 file - promoters60/1031336
tgtgatt

SEQ ID NO: 103620 - DNA, 7 bp, Unknown
  misc_feature (1)..( 7): Result.002 file - promoters60/1031336
tgtaatt

SEQ ID NO: 103621 - DNA, 8 bp, Unknown
  misc_feature (1)..( 8): Result.002 file - promoters60/1031336
atttttat

SEQ ID NO: 103622 - DNA, 8 bp, Unknown
  misc_feature (1)..( 8): Result.002 file - promoters60/1031336
attattat

SEQ ID NO: 103623 - DNA, 10 bp, Unknown
  misc_feature (1)..( 10): Result.002 file - promoters60/1031336
ttgtgatgat

SEQ ID NO: 103624 - DNA, 10 bp, Unknown
  misc_feature (1)..( 10): Result.002 file - promoters60/1031336
ttgtaatgat

SEQ ID NO: 103625 - DNA, 6 bp, Unknown
  misc_feature (1)..( 6): Result.002 file - promoters60/1031336
tagaat

SEQ ID NO: 103626 - DNA, 6 bp, Unknown
  misc_feature (1)..( 6): Result.002 file - promoters60/1031336
tagaat

SEQ ID NO: 103627 - DNA, 9 bp, Unknown
  misc_feature (1)..( 9): Result.002 file - promoters60/1031336
taaagtttt

SEQ ID NO: 103628 - DNA, 9 bp, Unknown
  misc_feature (1)..( 9): Result.002 file - promoters60/1031336
taaagtttt

SEQ ID NO: 103629 - DNA, 8 bp, Unknown
  misc_feature (1)..( 8): Result.002 file - promoters60/1031336
ttttagtt

SEQ ID NO: 103630 - DNA, 8 bp, Unknown
  misc_feature (1)..( 8): Result.002 file - promoters60/1031336
ttttggtt

SEQ ID NO: 103631 - DNA, 12 bp, Unknown
  misc_feature (1)..( 12): Result.002 file - promoters60/1031368
ttcgtggacaca

SEQ ID NO: 103632 - DNA, 12 bp, Unknown
  misc_feature (1)..( 12): Result.002 file - promoters60/1031368
gatttggagaca

SEQ ID NO: 103633 - DNA, 12 bp, Unknown
  misc_feature (1)..( 12): Result.002 file - promoters60/1031368
ttcgttgactaa

SEQ ID NO: 103634 - DNA, 7 bp, Unknown
  misc_feature (1)..( 7): Result.002 file - promoters60/1031368
ggactat

SEQ ID NO: 103635 - DNA, 7 bp, Unknown
  misc_feature (1)..( 7): Result.002 file - promoters60/1031368
tgactat

SEQ ID NO: 103636 - DNA, 7 bp, Unknown
  misc_feature (1)..( 7): Result.002 file - promoters60/1031368
tgattat

SEQ ID NO: 103637 - DNA, 6 bp, Unknown
  misc_feature (1)..( 6): Result.002 file - promoters60/1031368
gtcaat

SEQ ID NO: 103638 - DNA, 6 bp, Unknown
  misc_feature (1)..( 6): Result.002 file - promoters60/1031368
gtcaat

SEQ ID NO: 103639 - DNA, 9 bp, Unknown
  misc_feature (1)..( 9): Result.002 file - promoters60/1031368
tttattgtt

SEQ ID NO: 103640 - DNA, 9 bp, Unknown
  misc_feature (1)..( 9): Result.002 file - promoters60/1031368
tttcttgtt

SEQ ID NO: 103641 - DNA, 6 bp, Unknown
  misc_feature (1)..( 6): Result.002 file - promoters60/1031368
attgta

SEQ ID NO: 103642 - DNA, 6 bp, Unknown
  misc_feature (1)..( 6): Result.002 file - promoters60/1031368
attgta

SEQ ID NO: 103643 - DNA, 8 bp, Unknown
  misc_feature (1)..( 8): Result.002 file - promoters60/1031368
caaataat

SEQ ID NO: 103644 - DNA, 8 bp, Unknown
  misc_feature (1)..( 8): Result.002 file - promoters60/1031368
caaataat

SEQ ID NO: 103645 - DNA, 6 bp, Unknown
  misc_feature (1)..( 6): Result.002 file - promoters60/1031368
tacaaa

SEQ ID NO: 103646 - DNA, 6 bp, Unknown
  misc_feature (1)..( 6): Result.002 file - promoters60/1031368
tacaaa

SEQ ID NO: 103647 - DNA, 9 bp, Unknown
  misc_feature (1)..( 9): Result.002 file - promoters60/1031368
cataaattc

SEQ ID NO: 103648 - DNA, 9 bp, Unknown
  misc_feature (1)..( 9): Result.002 file - promoters60/1031368
cataaattt

SEQ ID NO: 103649 - DNA, 9 bp, Unknown
  misc_feature (1)..( 9): Result.002 file - promoters60/1031368
tatatattt

SEQ ID NO: 103650 - DNA, 6 bp, Unknown
  misc_feature (1)..( 6): Result.002 file - promoters60/1031368
ttatat

SEQ ID NO: 103651 - DNA, 6 bp, Unknown
  misc_feature (1)..( 6): Result.002 file - promoters60/1031368
ttatat

SEQ ID NO: 103652 - DNA, 6 bp, Unknown
  misc_feature (1)..( 6): Result.002 file - promoters60/1031368
ggtttg

SEQ ID NO: 103653 - DNA, 6 bp, Unknown
  misc_feature (1)..( 6): Result.002 file - promoters60/1031368
ggtttg

SEQ ID NO: 103654 - DNA, 6 bp, Unknown
  misc_feature (1)..( 6): Result.002 file - promoters60/1031368
ggttga

SEQ ID NO: 103655 - DNA, 6 bp, Unknown
  misc_feature (1)..( 6): Result.002 file - promoters60/1031368
ggttga

SEQ ID NO: 103656 - DNA, 6 bp, Unknown
  misc_feature (1)..( 6): Result.002 file - promoters60/1031368
ttattg

SEQ ID NO: 103657 - DNA, 6 bp, Unknown
  misc_feature (1)..( 6): Result.002 file - promoters60/1031368
ttattg

SEQ ID NO: 103658 - DNA, 7 bp, Unknown
  misc_feature (1)..( 7): Result.002 file - promoters60/1031368
ttgtatg

SEQ ID NO: 103659 - DNA, 7 bp, Unknown
  misc_feature (1)..( 7): Result.002 file - promoters60/1031368
ttgtatg

SEQ ID NO: 103660 - DNA, 6 bp, Unknown
  misc_feature (1)..( 6): Result.002 file - promoters60/1031368
cgtgtc

SEQ ID NO: 103661 - DNA, 6 bp, Unknown
  misc_feature (1)..( 6): Result.002 file - promoters60/1031368
cgtgtc

SEQ ID NO: 103662 - DNA, 7 bp, Unknown
  misc_feature (1)..( 7): Result.002 file - promoters60/1031368
aatatat

SEQ ID NO: 103663 - DNA, 7 bp, Unknown
  misc_feature (1)..( 7): Result.002 file - promoters60/1031368
aatttat

SEQ ID NO: 103664 - DNA, 8 bp, Unknown
  misc_feature (1)..( 8): Result.002 file - promoters60/1031386
atttataa

SEQ ID NO: 103665 - DNA, 8 bp, Unknown
  misc_feature (1)..( 8): Result.002 file - promoters60/1031386
attaataa

SEQ ID NO: 103666 - DNA, 6 bp, Unknown
  misc_feature (1)..( 6): Result.002 file - promoters60/1031386
tcaaat

SEQ ID NO: 103667 - DNA, 6 bp, Unknown
  misc_feature (1)..( 6): Result.002 file - promoters60/1031386
tcaaat

SEQ ID NO: 103668 - DNA, 8 bp, Unknown
  misc_feature (1)..( 8): Result.002 file - promoters60/1031386
tgactaaa

SEQ ID NO: 103669 - DNA, 8 bp, Unknown
  misc_feature (1)..( 8): Result.002 file - promoters60/1031386
tgaataaa

SEQ ID NO: 103670 - DNA, 8 bp, Unknown
  misc_feature (1)..( 8): Result.002 file - promoters60/1031386
atttaaat

SEQ ID NO: 103671 - DNA, 8 bp, Unknown
  misc_feature (1)..( 8): Result.002 file - promoters60/1031386
attttaat

SEQ ID NO: 103672 - DNA, 8 bp, Unknown
  misc_feature (1)..( 8): Result.002 file - promoters60/1031386
ttatgagt

SEQ ID NO: 103673 - DNA, 8 bp, Unknown
  misc_feature (1)..( 8): Result.002 file - promoters60/1031386
ttattagt

SEQ ID NO: 103674 - DNA, 6 bp, Unknown
  misc_feature (1)..( 6): Result.002 file - promoters60/1031386
atatat

SEQ ID NO: 103675 - DNA, 6 bp, Unknown
  misc_feature (1)..( 6): Result.002 file - promoters60/1031386
atatat

SEQ ID NO: 103676 - DNA, 7 bp, Unknown
  misc_feature (1)..( 7): Result.002 file - promoters60/1031386
aaccaaa

SEQ ID NO: 103677 - DNA, 7 bp, Unknown
  misc_feature (1)..( 7): Result.002 file - promoters60/1031386
aactaaa

SEQ ID NO: 103678 - DNA, 6 bp, Unknown
  misc_feature (1)..( 6): Result.002 file - promoters60/1031386
gtcatg

SEQ ID NO: 103679 - DNA, 6 bp, Unknown
  misc_feature (1)..( 6): Result.002 file - promoters60/1031386
gtcatg

SEQ ID NO: 103680 - DNA, 6 bp, Unknown
  misc_feature (1)..( 6): Result.002 file - promoters60/1031386
ttttag

SEQ ID NO: 103681 - DNA, 6 bp, Unknown
  misc_feature (1)..( 6): Result.002 file - promoters60/1031386
ttttag

SEQ ID NO: 103682 - DNA, 8 bp, Unknown
  misc_feature (1)..( 8): Result.002 file - promoters60/1031386
aatccaat

SEQ ID NO: 103683 - DNA, 8 bp, Unknown
  misc_feature (1)..( 8): Result.002 file - promoters60/1031386
aatcgaat

SEQ ID NO: 103684 - DNA, 6 bp, Unknown
  misc_feature (1)..( 6): Result.002 file - promoters60/1031386
ttacat

SEQ ID NO: 103685 - DNA, 6 bp, Unknown
  misc_feature (1)..( 6): Result.002 file - promoters60/1031386
ttacat

SEQ ID NO: 103686 - DNA, 8 bp, Unknown
  misc_feature (1)..( 8): Result.002 file - promoters60/1031386
aaatatca

SEQ ID NO: 103687 - DNA, 8 bp, Unknown
  misc_feature (1)..( 8): Result.002 file - promoters60/1031386
aaatatcc

SEQ ID NO: 103688 - DNA, 9 bp, Unknown
  misc_feature (1)..( 9): Result.002 file - promoters60/1031386
aaattatcc

SEQ ID NO: 103689 - DNA, 7 bp, Unknown
  misc_feature (1)..( 7): Result.002 file - promoters60/1031386
cgacatc

SEQ ID NO: 103690 - DNA, 7 bp, Unknown
  misc_feature (1)..( 7): Result.002 file - promoters60/1031386
cgaaatc

SEQ ID NO: 103691 - DNA, 8 bp, Unknown
  misc_feature (1)..( 8): Result.002 file - promoters60/1031386
agaaaaca

SEQ ID NO: 103692 - DNA, 8 bp, Unknown
  misc_feature (1)..( 8): Result.002 file - promoters60/1031386
agaaaaca

SEQ ID NO: 103693 - DNA, 8 bp, Unknown
  misc_feature (1)..( 8): Result.002 file - promoters60/1031386
agacaacg

SEQ ID NO: 103694 - DNA, 6 bp, Unknown
  misc_feature (1)..( 6): Result.002 file - promoters60/1031386
aagaaa

SEQ ID NO: 103695 - DNA, 6 bp, Unknown
  misc_feature (1)..( 6): Result.002 file - promoters60/1031386
aagaaa

SEQ ID NO: 103696 - DNA, 10 bp, Unknown
  misc_feature (1)..( 10): Result.002 file - promoters60/1031386
atacatttag

SEQ ID NO: 103697 - DNA, 10 bp, Unknown
  misc_feature (1)..( 10): Result.002 file - promoters60/1031386
ataaatttag

SEQ ID NO: 103698 - DNA, 6 bp, Unknown
  misc_feature (1)..( 6): Result.002 file - promoters60/1031386
tttcat

SEQ ID NO: 103699 - DNA, 6 bp, Unknown
  misc_feature (1)..( 6): Result.002 file - promoters60/1031386
tttcat

SEQ ID NO: 103700 - DNA, 7 bp, Unknown
  misc_feature (1)..( 7): Result.002 file - promoters60/1031386
tgagttt

SEQ ID NO: 103701 - DNA, 7 bp, Unknown
  misc_feature (1)..( 7): Result.002 file - promoters60/1031386
tgatttt

SEQ ID NO: 103702 - DNA, 6 bp, Unknown
  misc_feature (1)..( 6): Result.002 file - promoters60/1031386
gaaaaa

SEQ ID NO: 103703 - DNA, 6 bp, Unknown
  misc_feature (1)..( 6): Result.002 file - promoters60/1031386
gaaaaa

SEQ ID NO: 103704 - DNA, 8 bp, Unknown
  misc_feature (1)..( 8): Result.002 file - promoters60/1031386
taaaggat

SEQ ID NO: 103705 - DNA, 8 bp, Unknown
  misc_feature (1)..( 8): Result.002 file - promoters60/1031386
taaacgat

SEQ ID NO: 103706 - DNA, 7 bp, Unknown
  misc_feature (1)..( 7): Result.002 file - promoters60/1031386
tattcta

SEQ ID NO: 103707 - DNA, 7 bp, Unknown
  misc_feature (1)..( 7): Result.002 file - promoters60/1031386
tatacta

SEQ ID NO: 103708 - DNA, 6 bp, Unknown
  misc_feature (1)..( 6): Result.002 file - promoters60/1031386
taaaat

SEQ ID NO: 103709 - DNA, 6 bp, Unknown
  misc_feature (1)..( 6): Result.002 file - promoters60/1031386
taaaat

SEQ ID NO: 103710 - DNA, 7 bp, Unknown
  misc_feature (1)..( 7): Result.002 file - promoters60/1031386
atatgaa

SEQ ID NO: 103711 - DNA, 7 bp, Unknown
  misc_feature (1)..( 7): Result.002 file - promoters60/1031386
ataggaa

SEQ ID NO: 103712 - DNA, 7 bp, Unknown
  misc_feature (1)..( 7): Result.002 file - promoters60/1031386
cgaacaa

SEQ ID NO: 103713 - DNA, 7 bp, Unknown
  misc_feature (1)..( 7): Result.002 file - promoters60/1031386
cgaacaa

SEQ ID NO: 103714 - DNA, 9 bp, Unknown
  misc_feature (1)..( 9): Result.002 file - promoters60/1031386
atgttaaat

SEQ ID NO: 103715 - DNA, 9 bp, Unknown
  misc_feature (1)..( 9): Result.002 file - promoters60/1031386
atgtaaaat

SEQ ID NO: 103716 - DNA, 9 bp, Unknown
  misc_feature (1)..( 9): Result.002 file - promoters60/1031386
gtttacttt

SEQ ID NO: 103717 - DNA, 9 bp, Unknown
  misc_feature (1)..( 9): Result.002 file - promoters60/1031386
gttcacttt

SEQ ID NO: 103718 - DNA, 8 bp, Unknown
  misc_feature (1)..( 8): Result.002 file - promoters60/1031386
gtttgttt

SEQ ID NO: 103719 - DNA, 8 bp, Unknown
  misc_feature (1)..( 8): Result.002 file - promoters60/1031386
gttttttt

SEQ ID NO: 103720 - DNA, 13 bp, Unknown
  misc_feature (1)..( 13): Result.002 file - promoters60/1031390
agtatttttaaaa

SEQ ID NO: 103721 - DNA, 13 bp, Unknown
  misc_feature (1)..( 13): Result.002 file - promoters60/1031390
tctgttttcaaaa

SEQ ID NO: 103722 - DNA, 13 bp, Unknown
  misc_feature (1)..( 13): Result.002 file - promoters60/1031390
agtgttttcaaac

SEQ ID NO: 103723 - DNA, 13 bp, Unknown
  misc_feature (1)..( 13): Result.002 file - promoters60/1031390
ctaattgtaaaaa

SEQ ID NO: 103724 - DNA, 8 bp, Unknown
  misc_feature (1)..( 8): Result.002 file - promoters60/1031390
taaaaagg

SEQ ID NO: 103725 - DNA, 8 bp, Unknown
  misc_feature (1)..( 8): Result.002 file - promoters60/1031390
taaatagg

SEQ ID NO: 103726 - DNA, 8 bp, Unknown
  misc_feature (1)..( 8): Result.002 file - promoters60/1031390
taaaaaca

SEQ ID NO: 103727 - DNA, 10 bp, Unknown
  misc_feature (1)..( 10): Result.002 file - promoters60/1031390
tgatattttc

SEQ ID NO: 103728 - DNA, 10 bp, Unknown
  misc_feature (1)..( 10): Result.002 file - promoters60/1031390
tgaaattttt

SEQ ID NO: 103729 - DNA, 11 bp, Unknown
  misc_feature (1)..( 11): Result.002 file - promoters60/1031390
gttgattatta

SEQ ID NO: 103730 - DNA, 11 bp, Unknown
  misc_feature (1)..( 11): Result.002 file - promoters60/1031390
tgatattattt

SEQ ID NO: 103731 - DNA, 9 bp, Unknown
  misc_feature (1)..( 9): Result.002 file - promoters60/1031390
cttttttgt

SEQ ID NO: 103732 - DNA, 9 bp, Unknown
  misc_feature (1)..( 9): Result.002 file - promoters60/1031390
tttttatgt

SEQ ID NO: 103733 - DNA, 10 bp, Unknown
  misc_feature (1)..( 10): Result.002 file - promoters60/1031390
attattaaaa

SEQ ID NO: 103734 - DNA, 10 bp, Unknown
  misc_feature (1)..( 10): Result.002 file - promoters60/1031390
attattttaa

SEQ ID NO: 103735 - DNA, 7 bp, Unknown
  misc_feature (1)..( 7): Result.002 file - promoters60/1031425
tcaaaca

SEQ ID NO: 103736 - DNA, 7 bp, Unknown
  misc_feature (1)..( 7): Result.002 file - promoters60/1031425
tcaaacc

SEQ ID NO: 103737 - DNA, 7 bp, Unknown
  misc_feature (1)..( 7): Result.002 file - promoters60/1031425
ccaaacc

SEQ ID NO: 103738 - DNA, 8 bp, Unknown
  misc_feature (1)..( 8): Result.002 file - promoters60/1031425
atatattt

SEQ ID NO: 103739 - DNA, 8 bp, Unknown
  misc_feature (1)..( 8): Result.002 file - promoters60/1031425
caatattt

SEQ ID NO: 103740 - DNA, 8 bp, Unknown
  misc_feature (1)..( 8): Result.002 file - promoters60/1031425
caaaatta

SEQ ID NO: 103741 - DNA, 15 bp, Unknown
  misc_feature (1)..( 15): Result.002 file - promoters60/1031563
acaatagtcttaaac

SEQ ID NO: 103742 - DNA, 15 bp, Unknown
  misc_feature (1)..( 15): Result.002 file - promoters60/1031563
ggaatgaacttaaac

SEQ ID NO: 103743 - DNA, 15 bp, Unknown
  misc_feature (1)..( 15): Result.002 file - promoters60/1031563
acattagtctaaaat

SEQ ID NO: 103744 - DNA, 7 bp, Unknown
  misc_feature (1)..( 7): Result.002 file - promoters60/1031563
gtgtagt

SEQ ID NO: 103745 - DNA, 7 bp, Unknown
  misc_feature (1)..( 7): Result.002 file - promoters60/1031563
gtgtagt

SEQ ID NO: 103746 - DNA, 7 bp, Unknown
  misc_feature (1)..( 7): Result.002 file - promoters60/1031563
acaaaat

SEQ ID NO: 103747 - DNA, 7 bp, Unknown
  misc_feature (1)..( 7): Result.002 file - promoters60/1031563
acaaaat

SEQ ID NO: 103748 - DNA, 7 bp, Unknown
  misc_feature (1)..( 7): Result.002 file - promoters60/1031563
cactcaa

SEQ ID NO: 103749 - DNA, 7 bp, Unknown
  misc_feature (1)..( 7): Result.002 file - promoters60/1031563
cacacaa

SEQ ID NO: 103750 - DNA, 6 bp, Unknown
  misc_feature (1)..( 6): Result.002 file - promoters60/1031563
gaaact

SEQ ID NO: 103751 - DNA, 6 bp, Unknown
  misc_feature (1)..( 6): Result.002 file - promoters60/1031563
gaaact

SEQ ID NO: 103752 - DNA, 7 bp, Unknown
  misc_feature (1)..( 7): Result.002 file - promoters60/1031563
gaaacgt

SEQ ID NO: 103753 - DNA, 7 bp, Unknown
  misc_feature (1)..( 7): Result.002 file - promoters60/1031563
gaatcgt

SEQ ID NO: 103754 - DNA, 8 bp, Unknown
  misc_feature (1)..( 8): Result.002 file - promoters60/1031563
ctatagat

SEQ ID NO: 103755 - DNA, 8 bp, Unknown
  misc_feature (1)..( 8): Result.002 file - promoters60/1031563
ctaaagag

SEQ ID NO: 103756 - DNA, 8 bp, Unknown
  misc_feature (1)..( 8): Result.002 file - promoters60/1031563
aaaaagag

SEQ ID NO: 103757 - DNA, 7 bp, Unknown
  misc_feature (1)..( 7): Result.002 file - promoters60/1031563
caatagt

SEQ ID NO: 103758 - DNA, 7 bp, Unknown
  misc_feature (1)..( 7): Result.002 file - promoters60/1031563
caaaagt

SEQ ID NO: 103759 - DNA, 7 bp, Unknown
  misc_feature (1)..( 7): Result.002 file - promoters60/1031563
caaaagc

SEQ ID NO: 103760 - DNA, 8 bp, Unknown
  misc_feature (1)..( 8): Result.002 file - promoters60/1031563
agcgattt

SEQ ID NO: 103761 - DNA, 8 bp, Unknown
  misc_feature (1)..( 8): Result.002 file - promoters60/1031563
agctattt

SEQ ID NO: 103762 - DNA, 7 bp, Unknown
  misc_feature (1)..( 7): Result.002 file - promoters60/1031563
tacaaac

SEQ ID NO: 103763 - DNA, 7 bp, Unknown
  misc_feature (1)..( 7): Result.002 file - promoters60/1031563
tacaaac

SEQ ID NO: 103764 - DNA, 8 bp, Unknown
  misc_feature (1)..( 8): Result.002 file - promoters60/1031563
ttattaca

SEQ ID NO: 103765 - DNA, 8 bp, Unknown
  misc_feature (1)..( 8): Result.002 file - promoters60/1031563
ttataaca

SEQ ID NO: 103766 - DNA, 6 bp, Unknown
  misc_feature (1)..( 6): Result.002 file - promoters60/1031563
agattc

SEQ ID NO: 103767 - DNA, 6 bp, Unknown
  misc_feature (1)..( 6): Result.002 file - promoters60/1031563
agattc

SEQ ID NO: 103768 - DNA, 7 bp, Unknown
  misc_feature (1)..( 7): Result.002 file - promoters60/1031563
ttttgta

SEQ ID NO: 103769 - DNA, 7 bp, Unknown
  misc_feature (1)..( 7): Result.002 file - promoters60/1031563
tttagta

SEQ ID NO: 103770 - DNA, 7 bp, Unknown
  misc_feature (1)..( 7): Result.002 file - promoters60/1031563
attacct

SEQ ID NO: 103771 - DNA, 7 bp, Unknown
  misc_feature (1)..( 7): Result.002 file - promoters60/1031563
attccct

SEQ ID NO: 103772 - DNA, 7 bp, Unknown
  misc_feature (1)..( 7): Result.002 file - promoters60/1031563
ccttttc

SEQ ID NO: 103773 - DNA, 7 bp, Unknown
  misc_feature (1)..( 7): Result.002 file - promoters60/1031563
cctattc

SEQ ID NO: 103774 - DNA, 7 bp, Unknown
  misc_feature (1)..( 7): Result.002 file - promoters60/1031563
ttgtgtt

SEQ ID NO: 103775 - DNA, 7 bp, Unknown
  misc_feature (1)..( 7): Result.002 file - promoters60/1031563
ttgtgtt

SEQ ID NO: 103776 - DNA, 8 bp, Unknown
  misc_feature (1)..( 8): Result.002 file - promoters60/1031563
tgttaata

SEQ ID NO: 103777 - DNA, 8 bp, Unknown
  misc_feature (1)..( 8): Result.002 file - promoters60/1031563
tgttcata

SEQ ID NO: 103778 - DNA, 7 bp, Unknown
  misc_feature (1)..( 7): Result.002 file - promoters60/1031563
aaaaaat

SEQ ID NO: 103779 - DNA, 7 bp, Unknown
  misc_feature (1)..( 7): Result.002 file - promoters60/1031563
aaataat

SEQ ID NO: 103780 - DNA, 7 bp, Unknown
  misc_feature (1)..( 7): Result.002 file - promoters60/1031563
aaatact

SEQ ID NO: 103781 - DNA, 7 bp, Unknown
  misc_feature (1)..( 7): Result.002 file - promoters60/1031563
aaatact

SEQ ID NO: 103782 - DNA, 9 bp, Unknown
  misc_feature (1)..( 9): Result.002 file - promoters60/1031563
tttaataga

SEQ ID NO: 103783 - DNA, 9 bp, Unknown
  misc_feature (1)..( 9): Result.002 file - promoters60/1031563
ttttataga

SEQ ID NO: 103784 - DNA, 6 bp, Unknown
  misc_feature (1)..( 6): Result.002 file - promoters60/1031563
aaaagc

SEQ ID NO: 103785 - DNA, 6 bp, Unknown
  misc_feature (1)..( 6): Result.002 file - promoters60/1031563
aaaagc

SEQ ID NO: 103786 - DNA, 6 bp, Unknown
  misc_feature (1)..( 6): Result.002 file - promoters60/1031563
aatttc

SEQ ID NO: 103787 - DNA, 6 bp, Unknown
  misc_feature (1)..( 6): Result.002 file - promoters60/1031563
aatttc

SEQ ID NO: 103788 - DNA, 6 bp, Unknown
  misc_feature (1)..( 6): Result.002 file - promoters60/1031563
ttgaaa

SEQ ID NO: 103789 - DNA, 6 bp, Unknown
  misc_feature (1)..( 6): Result.002 file - promoters60/1031563
ttgaaa

SEQ ID NO: 103790 - DNA, 6 bp, Unknown
  misc_feature (1)..( 6): Result.002 file - promoters60/1031563
aaaaaa

SEQ ID NO: 103791 - DNA, 6 bp, Unknown
  misc_feature (1)..( 6): Result.002 file - promoters60/1031563
aaaaaa

SEQ ID NO: 103792 - DNA, 7 bp, Unknown
  misc_feature (1)..( 7): Result.002 file - promoters60/1031638
tccaaaa

SEQ ID NO: 103793 - DNA, 7 bp, Unknown
  misc_feature (1)..( 7): Result.002 file - promoters60/1031638
tcctaaa

SEQ ID NO: 103794 - DNA, 7 bp, Unknown
  misc_feature (1)..( 7): Result.002 file - promoters60/1031638
tccaaac

SEQ ID NO: 103795 - DNA, 9 bp, Unknown
  misc_feature (1)..( 9): Result.002 file - promoters60/1031638
aaaagcaaa

SEQ ID NO: 103796 - DNA, 9 bp, Unknown
  misc_feature (1)..( 9): Result.002 file - promoters60/1031638
aaaaacaac

SEQ ID NO: 103797 - DNA, 9 bp, Unknown
  misc_feature (1)..( 9): Result.002 file - promoters60/1031638
caaaacaaa

SEQ ID NO: 103798 - DNA, 9 bp, Unknown
  misc_feature (1)..( 9): Result.002 file - promoters60/1031638
gaaaacact

SEQ ID NO: 103799 - DNA, 7 bp, Unknown
  misc_feature (1)..( 7): Result.002 file - promoters60/1031638
cccacga

SEQ ID NO: 103800 - DNA, 7 bp, Unknown
  misc_feature (1)..( 7): Result.002 file - promoters60/1031638
tccacga

SEQ ID NO: 103801 - DNA, 7 bp, Unknown
  misc_feature (1)..( 7): Result.002 file - promoters60/1031638
cccacgt

SEQ ID NO: 103802 - DNA, 8 bp, Unknown
  misc_feature (1)..( 8): Result.002 file - promoters60/1031638
aaattata

SEQ ID NO: 103803 - DNA, 8 bp, Unknown
  misc_feature (1)..( 8): Result.002 file - promoters60/1031638
aaaatatc

SEQ ID NO: 103804 - DNA, 8 bp, Unknown
  misc_feature (1)..( 8): Result.002 file - promoters60/1031638
taatcata

SEQ ID NO: 103805 - DNA, 9 bp, Unknown
  misc_feature (1)..( 9): Result.002 file - promoters60/1031638
aaaaataaa

SEQ ID NO: 103806 - DNA, 9 bp, Unknown
  misc_feature (1)..( 9): Result.002 file - promoters60/1031638
caaaacaaa

SEQ ID NO: 103807 - DNA, 9 bp, Unknown
  misc_feature (1)..( 9): Result.002 file - promoters60/1031638
aaaaattag

SEQ ID NO: 103808 - DNA, 9 bp, Unknown
  misc_feature (1)..( 9): Result.002 file - promoters60/1031638
gcaaactta

SEQ ID NO: 103809 - DNA, 10 bp, Unknown
  misc_feature (1)..( 10): Result.002 file - promoters60/1031638
aaatattgaa

SEQ ID NO: 103810 - DNA, 10 bp, Unknown
  misc_feature (1)..( 10): Result.002 file - promoters60/1031638
aaaaatttat

SEQ ID NO: 103811 - DNA, 10 bp, Unknown
  misc_feature (1)..( 10): Result.002 file - promoters60/1031638
atatataata

SEQ ID NO: 103812 - DNA, 9 bp, Unknown
  misc_feature (1)..( 9): Result.002 file - promoters60/1031638
ctaaacact

SEQ ID NO: 103813 - DNA, 9 bp, Unknown
  misc_feature (1)..( 9): Result.002 file - promoters60/1031638
ttaaacata

SEQ ID NO: 103814 - DNA, 9 bp, Unknown
  misc_feature (1)..( 9): Result.002 file - promoters60/1031638
ttaaaaata

SEQ ID NO: 103815 - DNA, 9 bp, Unknown
  misc_feature (1)..( 9): Result.002 file - promoters60/1031638
attttgtag

SEQ ID NO: 103816 - DNA, 9 bp, Unknown
  misc_feature (1)..( 9): Result.002 file - promoters60/1031638
attttgtaa

SEQ ID NO: 103817 - DNA, 9 bp, Unknown
  misc_feature (1)..( 9): Result.002 file - promoters60/1031638
cgtttataa

SEQ ID NO: 103818 - DNA, 7 bp, Unknown
  misc_feature (1)..( 7): Result.002 file - promoters60/1031638
aaaattg

SEQ ID NO: 103819 - DNA, 7 bp, Unknown
  misc_feature (1)..( 7): Result.002 file - promoters60/1031638
aaaatta

SEQ ID NO: 103820 - DNA, 7 bp, Unknown
  misc_feature (1)..( 7): Result.002 file - promoters60/1031638
aaactta

SEQ ID NO: 103821 - DNA, 7 bp, Unknown
  misc_feature (1)..( 7): Result.002 file - promoters60/1031638
ataaaat

SEQ ID NO: 103822 - DNA, 7 bp, Unknown
  misc_feature (1)..( 7): Result.002 file - promoters60/1031638
gtaaaat

SEQ ID NO: 103823 - DNA, 7 bp, Unknown
  misc_feature (1)..( 7): Result.002 file - promoters60/1031638
gtaaaaa

SEQ ID NO: 103824 - DNA, 9 bp, Unknown
  misc_feature (1)..( 9): Result.002 file - promoters60/1031638
ttaatattt

SEQ ID NO: 103825 - DNA, 9 bp, Unknown
  misc_feature (1)..( 9): Result.002 file - promoters60/1031638
ataagattt

SEQ ID NO: 103826 - DNA, 9 bp, Unknown
  misc_feature (1)..( 9): Result.002 file - promoters60/1031638
ataatattg

SEQ ID NO: 103827 - DNA, 6 bp, Unknown
  misc_feature (1)..( 6): Result.002 file - promoters60/1031638
ttcaaa

SEQ ID NO: 103828 - DNA, 6 bp, Unknown
  misc_feature (1)..( 6): Result.002 file - promoters60/1031638
ttcaaa

SEQ ID NO: 103829 - DNA, 6 bp, Unknown
  misc_feature (1)..( 6): Result.002 file - promoters60/1031638
ttcaaa

SEQ ID NO: 103830 - DNA, 9 bp, Unknown
  misc_feature (1)..( 9): Result.002 file - promoters60/1031638
ttttttttt

SEQ ID NO: 103831 - DNA, 9 bp, Unknown
  misc_feature (1)..( 9): Result.002 file - promoters60/1031638
ttttttttc

SEQ ID NO: 103832 - DNA, 9 bp, Unknown
  misc_feature (1)..( 9): Result.002 file - promoters60/1031638
tttcttaaa

SEQ ID NO: 103833 - DNA, 10 bp, Unknown
  misc_feature (1)..( 10): Result.002 file - promoters60/1031638
attgatgttc

SEQ ID NO: 103834 - DNA, 10 bp, Unknown
  misc_feature (1)..( 10): Result.002 file - promoters60/1031638
attaatgttc

SEQ ID NO: 103835 - DNA, 10 bp, Unknown
  misc_feature (1)..( 10): Result.002 file - promoters60/1031638
attaattcca

SEQ ID NO: 103836 - DNA, 9 bp, Unknown
  misc_feature (1)..( 9): Result.002 file - promoters60/1031638
ttaaaatag

SEQ ID NO: 103837 - DNA, 9 bp, Unknown
  misc_feature (1)..( 9): Result.002 file - promoters60/1031638
ttaaaaata

SEQ ID NO: 103838 - DNA, 9 bp, Unknown
  misc_feature (1)..( 9): Result.002 file - promoters60/1031638
ttaaacata

SEQ ID NO: 103839 - DNA, 8 bp, Unknown
  misc_feature (1)..( 8): Result.002 file - promoters60/1031638
ttaaaata

SEQ ID NO: 103840 - DNA, 8 bp, Unknown
  misc_feature (1)..( 8): Result.002 file - promoters60/1031638
taaaaata

SEQ ID NO: 103841 - DNA, 9 bp, Unknown
  misc_feature (1)..( 9): Result.002 file - promoters60/1031638
ttaaacata

SEQ ID NO: 103842 - DNA, 7 bp, Unknown
  misc_feature (1)..( 7): Result.002 file - promoters60/1031665
ttagtca

SEQ ID NO: 103843 - DNA, 7 bp, Unknown
  misc_feature (1)..( 7): Result.002 file - promoters60/1031665
ttattca

SEQ ID NO: 103844 - DNA, 7 bp, Unknown
  misc_feature (1)..( 7): Result.002 file - promoters60/1031665
atagatt

SEQ ID NO: 103845 - DNA, 7 bp, Unknown
  misc_feature (1)..( 7): Result.002 file - promoters60/1031665
atatatt

SEQ ID NO: 103846 - DNA, 9 bp, Unknown
  misc_feature (1)..( 9): Result.002 file - promoters60/1031665
tgatagatt

SEQ ID NO: 103847 - DNA, 9 bp, Unknown
  misc_feature (1)..( 9): Result.002 file - promoters60/1031665
gtataaatt

SEQ ID NO: 103848 - DNA, 9 bp, Unknown
  misc_feature (1)..( 9): Result.002 file - promoters60/1031665
gtaaaaata

SEQ ID NO: 103849 - DNA, 8 bp, Unknown
  misc_feature (1)..( 8): Result.002 file - promoters60/1031665
cttttttt

SEQ ID NO: 103850 - DNA, 8 bp, Unknown
  misc_feature (1)..( 8): Result.002 file - promoters60/1031665
ttttgttt

SEQ ID NO: 103851 - DNA, 8 bp, Unknown
  misc_feature (1)..( 8): Result.002 file - promoters60/1031665
ttttgttt

SEQ ID NO: 103852 - DNA, 9 bp, Unknown
  misc_feature (1)..( 9): Result.002 file - promoters60/1031665
aagttgttg

SEQ ID NO: 103853 - DNA, 9 bp, Unknown
  misc_feature (1)..( 9): Result.002 file - promoters60/1031665
ttgtttttg

SEQ ID NO: 103854 - DNA, 9 bp, Unknown
  misc_feature (1)..( 9): Result.002 file - promoters60/1031665
ttgttttaa

SEQ ID NO: 103855 - DNA, 9 bp, Unknown
  misc_feature (1)..( 9): Result.002 file - promoters60/1031665
aaatcaaat

SEQ ID NO: 103856 - DNA, 9 bp, Unknown
  misc_feature (1)..( 9): Result.002 file - promoters60/1031665
aaaccaaac

SEQ ID NO: 103857 - DNA, 9 bp, Unknown
  misc_feature (1)..( 9): Result.002 file - promoters60/1031665
aaatgaaat

SEQ ID NO: 103858 - DNA, 12 bp, Unknown
  misc_feature (1)..( 12): Result.002 file - promoters60/1031665
aaaaaaataaaa

SEQ ID NO: 103859 - DNA, 12 bp, Unknown
  misc_feature (1)..( 12): Result.002 file - promoters60/1031665
aaataaattaaa

SEQ ID NO: 103860 - DNA, 7 bp, Unknown
  misc_feature (1)..( 7): Result.002 file - promoters60/1031665
tttgttt

SEQ ID NO: 103861 - DNA, 7 bp, Unknown
  misc_feature (1)..( 7): Result.002 file - promoters60/1031665
tttattt

SEQ ID NO: 103862 - DNA, 7 bp, Unknown
  misc_feature (1)..( 7): Result.002 file - promoters60/1031665
tttattt

SEQ ID NO: 103863 - DNA, 8 bp, Unknown
  misc_feature (1)..( 8): Result.002 file - promoters60/1031665
gtctaaac

SEQ ID NO: 103864 - DNA, 8 bp, Unknown
  misc_feature (1)..( 8): Result.002 file - promoters60/1031665
gtccaaac

SEQ ID NO: 103865 - DNA, 8 bp, Unknown
  misc_feature (1)..( 8): Result.002 file - promoters60/1031665
ttgaactc

SEQ ID NO: 103866 - DNA, 8 bp, Unknown
  misc_feature (1)..( 8): Result.002 file - promoters60/1031665
ttgaactc

SEQ ID NO: 103867 - DNA, 7 bp, Unknown
  misc_feature (1)..( 7): Result.002 file - promoters60/1031665
ttttaat

SEQ ID NO: 103868 - DNA, 7 bp, Unknown
  misc_feature (1)..( 7): Result.002 file - promoters60/1031665
ttttaat

SEQ ID NO: 103869 - DNA, 7 bp, Unknown
  misc_feature (1)..( 7): Result.002 file - promoters60/1031665
aaatcaa

SEQ ID NO: 103870 - DNA, 7 bp, Unknown
  misc_feature (1)..( 7): Result.002 file - promoters60/1031665
aaaccaa

SEQ ID NO: 103871 - DNA, 6 bp, Unknown
  misc_feature (1)..( 6): Result.002 file - promoters60/1031665
aaccaa

SEQ ID NO: 103872 - DNA, 6 bp, Unknown
  misc_feature (1)..( 6): Result.002 file - promoters60/1031665
aaccaa

SEQ ID NO: 103873 - DNA, 6 bp, Unknown
  misc_feature (1)..( 6): Result.002 file - promoters60/1031665
aagaaa

SEQ ID NO: 103874 - DNA, 6 bp, Unknown
  misc_feature (1)..( 6): Result.002 file - promoters60/1031665
aagaaa

SEQ ID NO: 103875 - DNA, 7 bp, Unknown
  misc_feature (1)..( 7): Result.002 file - promoters60/1031665
aataatt

SEQ ID NO: 103876 - DNA, 7 bp, Unknown
  misc_feature (1)..( 7): Result.002 file - promoters60/1031665
aataatt

SEQ ID NO: 103877 - DNA, 9 bp, Unknown
  misc_feature (1)..( 9): Result.002 file - promoters60/1031665
caaaaagag

SEQ ID NO: 103878 - DNA, 9 bp, Unknown
  misc_feature (1)..( 9): Result.002 file - promoters60/1031665
caaagagag

SEQ ID NO: 103879 - DNA, 6 bp, Unknown
  misc_feature (1)..( 6): Result.002 file - promoters60/1031665
aaattg

SEQ ID NO: 103880 - DNA, 6 bp, Unknown
  misc_feature (1)..( 6): Result.002 file - promoters60/1031665
aaattg

SEQ ID NO: 103881 - DNA, 9 bp, Unknown
  misc_feature (1)..( 9): Result.002 file - promoters60/1031665
tgaagcaaa

SEQ ID NO: 103882 - DNA, 9 bp, Unknown
  misc_feature (1)..( 9): Result.002 file - promoters60/1031665
tgaaacaaa

SEQ ID NO: 103883 - DNA, 7 bp, Unknown
  misc_feature (1)..( 7): Result.002 file - promoters60/1031665
tattgtg

SEQ ID NO: 103884 - DNA, 7 bp, Unknown
  misc_feature (1)..( 7): Result.002 file - promoters60/1031665
tattgtg

SEQ ID NO: 103885 - DNA, 10 bp, Unknown
  misc_feature (1)..( 10): Result.002 file - promoters60/1031706
tcaaccaact

SEQ ID NO: 103886 - DNA, 10 bp, Unknown
  misc_feature (1)..( 10): Result.002 file - promoters60/1031706
ctaactaaca

SEQ ID NO: 103887 - DNA, 10 bp, Unknown
  misc_feature (1)..( 10): Result.002 file - promoters60/1031706
ccaaccaatg

SEQ ID NO: 103888 - DNA, 10 bp, Unknown
  misc_feature (1)..( 10): Result.002 file - promoters60/1031706
tcaatcaaat

SEQ ID NO: 103889 - DNA, 10 bp, Unknown
  misc_feature (1)..( 10): Result.002 file - promoters60/1031706
ttaatgaaat

SEQ ID NO: 103890 - DNA, 10 bp, Unknown
  misc_feature (1)..( 10): Result.002 file - promoters60/1031706
tcaattaatc

SEQ ID NO: 103891 - DNA, 9 bp, Unknown
  misc_feature (1)..( 9): Result.002 file - promoters60/1031706
aaaacaaac

SEQ ID NO: 103892 - DNA, 9 bp, Unknown
  misc_feature (1)..( 9): Result.002 file - promoters60/1031706
ggaacaaaa

SEQ ID NO: 103893 - DNA, 9 bp, Unknown
  misc_feature (1)..( 9): Result.002 file - promoters60/1031706
caaacaaat

SEQ ID NO: 103894 - DNA, 9 bp, Unknown
  misc_feature (1)..( 9): Result.002 file - promoters60/1031706
taaaaaaag

SEQ ID NO: 103895 - DNA, 9 bp, Unknown
  misc_feature (1)..( 9): Result.002 file - promoters60/1031706
aaaacaatt

SEQ ID NO: 103896 - DNA, 9 bp, Unknown
  misc_feature (1)..( 9): Result.002 file - promoters60/1031706
taaacaaac

SEQ ID NO: 103897 - DNA, 12 bp, Unknown
  misc_feature (1)..( 12): Result.002 file - promoters60/1031706
taacaaaaaaaa

SEQ ID NO: 103898 - DNA, 12 bp, Unknown
  misc_feature (1)..( 12): Result.002 file - promoters60/1031706
tctcaagaaacg

SEQ ID NO: 103899 - DNA, 13 bp, Unknown
  misc_feature (1)..( 13): Result.002 file - promoters60/1031706
taggaaaataata

SEQ ID NO: 103900 - DNA, 13 bp, Unknown
  misc_feature (1)..( 13): Result.002 file - promoters60/1031706
taataaaaaactc

SEQ ID NO: 103901 - DNA, 13 bp, Unknown
  misc_feature (1)..( 13): Result.002 file - promoters60/1031706
gaacaaacaaaca

SEQ ID NO: 103902 - DNA, 13 bp, Unknown
  misc_feature (1)..( 13): Result.002 file - promoters60/1031706
ctcataactaact

SEQ ID NO: 103903 - DNA, 9 bp, Unknown
  misc_feature (1)..( 9): Result.002 file - promoters60/1031706
aataagaat

SEQ ID NO: 103904 - DNA, 9 bp, Unknown
  misc_feature (1)..( 9): Result.002 file - promoters60/1031706
gataagacg

SEQ ID NO: 103905 - DNA, 9 bp, Unknown
  misc_feature (1)..( 9): Result.002 file - promoters60/1031706
tttaaaaat

SEQ ID NO: 103906 - DNA, 9 bp, Unknown
  misc_feature (1)..( 9): Result.002 file - promoters60/1031706
gataagaca

SEQ ID NO: 103907 - DNA, 9 bp, Unknown
  misc_feature (1)..( 9): Result.002 file - promoters60/1031706
gtgaaaata

SEQ ID NO: 103908 - DNA, 9 bp, Unknown
  misc_feature (1)..( 9): Result.002 file - promoters60/1031706
gacaaaaat

SEQ ID NO: 103909 - DNA, 13 bp, Unknown
  misc_feature (1)..( 13): Result.002 file - promoters60/1031706
tccattatatata

SEQ ID NO: 103910 - DNA, 13 bp, Unknown
  misc_feature (1)..( 13): Result.002 file - promoters60/1031706
acgcctatatata

SEQ ID NO: 103911 - DNA, 13 bp, Unknown
  misc_feature (1)..( 13): Result.002 file - promoters60/1031706
tcttgtatatata

SEQ ID NO: 103912 - DNA, 13 bp, Unknown
  misc_feature (1)..( 13): Result.002 file - promoters60/1031706
tttcttatatctt

SEQ ID NO: 103913 - DNA, 13 bp, Unknown
  misc_feature (1)..( 13): Result.002 file - promoters60/1031706
tcctttatattct

SEQ ID NO: 103914 - DNA, 13 bp, Unknown
  misc_feature (1)..( 13): Result.002 file - promoters60/1031706
tggtctatataaa

SEQ ID NO: 103915 - DNA, 11 bp, Unknown
  misc_feature (1)..( 11): Result.002 file - promoters60/1031706
acatattctga

SEQ ID NO: 103916 - DNA, 11 bp, Unknown
  misc_feature (1)..( 11): Result.002 file - promoters60/1031706
acatattgagc

SEQ ID NO: 103917 - DNA, 11 bp, Unknown
  misc_feature (1)..( 11): Result.002 file - promoters60/1031706
gaataatcttt

SEQ ID NO: 103918 - DNA, 11 bp, Unknown
  misc_feature (1)..( 11): Result.002 file - promoters60/1031706
cgttaattttt

SEQ ID NO: 103919 - DNA, 11 bp, Unknown
  misc_feature (1)..( 11): Result.002 file - promoters60/1031706
gagtaatttta

SEQ ID NO: 103920 - DNA, 11 bp, Unknown
  misc_feature (1)..( 11): Result.002 file - promoters60/1031706
tcattataaaa

SEQ ID NO: 103921 - DNA, 9 bp, Unknown
  misc_feature (1)..( 9): Result.002 file - promoters60/1031706
caaaactac

SEQ ID NO: 103922 - DNA, 9 bp, Unknown
  misc_feature (1)..( 9): Result.002 file - promoters60/1031706
aaaatctaa

SEQ ID NO: 103923 - DNA, 9 bp, Unknown
  misc_feature (1)..( 9): Result.002 file - promoters60/1031706
aaaaactgt

SEQ ID NO: 103924 - DNA, 9 bp, Unknown
  misc_feature (1)..( 9): Result.002 file - promoters60/1031706
aaaatcaag

SEQ ID NO: 103925 - DNA, 9 bp, Unknown
  misc_feature (1)..( 9): Result.002 file - promoters60/1031706
caaataaac

SEQ ID NO: 103926 - DNA, 10 bp, Unknown
  misc_feature (1)..( 10): Result.002 file - promoters60/1031706
aaagatctgt

SEQ ID NO: 103927 - DNA, 13 bp, Unknown
  misc_feature (1)..( 13): Result.002 file - promoters60/1031706
atatttcatcgtt

SEQ ID NO: 103928 - DNA, 13 bp, Unknown
  misc_feature (1)..( 13): Result.002 file - promoters60/1031706
aaatttcataacc

SEQ ID NO: 103929 - DNA, 13 bp, Unknown
  misc_feature (1)..( 13): Result.002 file - promoters60/1031706
ataattccagagt

SEQ ID NO: 103930 - DNA, 13 bp, Unknown
  misc_feature (1)..( 13): Result.002 file - promoters60/1031706
ccatttgaataat

SEQ ID NO: 103931 - DNA, 13 bp, Unknown
  misc_feature (1)..( 13): Result.002 file - promoters60/1031706
caaataccaaaat

SEQ ID NO: 103932 - DNA, 13 bp, Unknown
  misc_feature (1)..( 13): Result.002 file - promoters60/1031706
ttaaatcccaagt

SEQ ID NO: 103933 - DNA, 7 bp, Unknown
  misc_feature (1)..( 7): Result.002 file - promoters60/1032026
attgaaa

SEQ ID NO: 103934 - DNA, 7 bp, Unknown
  misc_feature (1)..( 7): Result.002 file - promoters60/1032026
attaaaa

SEQ ID NO: 103935 - DNA, 6 bp, Unknown
  misc_feature (1)..( 6): Result.002 file - promoters60/1032026
tattta

SEQ ID NO: 103936 - DNA, 6 bp, Unknown
  misc_feature (1)..( 6): Result.002 file - promoters60/1032026
tattta

SEQ ID NO: 103937 - DNA, 7 bp, Unknown
  misc_feature (1)..( 7): Result.002 file - promoters60/1032026
gatattc

SEQ ID NO: 103938 - DNA, 7 bp, Unknown
  misc_feature (1)..( 7): Result.002 file - promoters60/1032026
gatcttc

SEQ ID NO: 103939 - DNA, 6 bp, Unknown
  misc_feature (1)..( 6): Result.002 file - promoters60/1032026
aaaaca

SEQ ID NO: 103940 - DNA, 6 bp, Unknown
  misc_feature (1)..( 6): Result.002 file - promoters60/1032026
aaaaca

SEQ ID NO: 103941 - DNA, 10 bp, Unknown
  misc_feature (1)..( 10): Result.002 file - promoters60/1032026
agaaaacaaa

SEQ ID NO: 103942 - DNA, 10 bp, Unknown
  misc_feature (1)..( 10): Result.002 file - promoters60/1032026
agaaaaaaaa

SEQ ID NO: 103943 - DNA, 6 bp, Unknown
  misc_feature (1)..( 6): Result.002 file - promoters60/1032026
ataata

SEQ ID NO: 103944 - DNA, 6 bp, Unknown
  misc_feature (1)..( 6): Result.002 file - promoters60/1032026
ataata

SEQ ID NO: 103945 - DNA, 7 bp, Unknown
  misc_feature (1)..( 7): Result.002 file - promoters60/1032026
aaacaca

SEQ ID NO: 103946 - DNA, 7 bp, Unknown
  misc_feature (1)..( 7): Result.002 file - promoters60/1032026
aaataca

SEQ ID NO: 103947 - DNA, 7 bp, Unknown
  misc_feature (1)..( 7): Result.002 file - promoters60/1032026
actttag

SEQ ID NO: 103948 - DNA, 7 bp, Unknown
  misc_feature (1)..( 7): Result.002 file - promoters60/1032026
actatag

SEQ ID NO: 103949 - DNA, 6 bp, Unknown
  misc_feature (1)..( 6): Result.002 file - promoters60/1032026
actata

SEQ ID NO: 103950 - DNA, 6 bp, Unknown
  misc_feature (1)..( 6): Result.002 file - promoters60/1032026
actata

SEQ ID NO: 103951 - DNA, 7 bp, Unknown
  misc_feature (1)..( 7): Result.002 file - promoters60/1032026
acattta

SEQ ID NO: 103952 - DNA, 7 bp, Unknown
  misc_feature (1)..( 7): Result.002 file - promoters60/1032026
acagtta

SEQ ID NO: 103953 - DNA, 6 bp, Unknown
  misc_feature (1)..( 6): Result.002 file - promoters60/1032026
ttaatc

SEQ ID NO: 103954 - DNA, 6 bp, Unknown
  misc_feature (1)..( 6): Result.002 file - promoters60/1032026
ttaatc

SEQ ID NO: 103955 - DNA, 8 bp, Unknown
  misc_feature (1)..( 8): Result.002 file - promoters60/1032026
taccaaaa

SEQ ID NO: 103956 - DNA, 8 bp, Unknown
  misc_feature (1)..( 8): Result.002 file - promoters60/1032026
tacaaaaa

SEQ ID NO: 103957 - DNA, 6 bp, Unknown
  misc_feature (1)..( 6): Result.002 file - promoters60/1032026
aattat

SEQ ID NO: 103958 - DNA, 6 bp, Unknown
  misc_feature (1)..( 6): Result.002 file - promoters60/1032026
aattat

SEQ ID NO: 103959 - DNA, 7 bp, Unknown
  misc_feature (1)..( 7): Result.002 file - promoters60/1032026
taatcac

SEQ ID NO: 103960 - DNA, 7 bp, Unknown
  misc_feature (1)..( 7): Result.002 file - promoters60/1032026
taaacac

SEQ ID NO: 103961 - DNA, 6 bp, Unknown
  misc_feature (1)..( 6): Result.002 file - promoters60/1032026
caaaac

SEQ ID NO: 103962 - DNA, 6 bp, Unknown
  misc_feature (1)..( 6): Result.002 file - promoters60/1032026
caaaac

SEQ ID NO: 103963 - DNA, 8 bp, Unknown
  misc_feature (1)..( 8): Result.002 file - promoters60/1032026
tactattt

SEQ ID NO: 103964 - DNA, 8 bp, Unknown
  misc_feature (1)..( 8): Result.002 file - promoters60/1032026
tacaattt

SEQ ID NO: 103965 - DNA, 9 bp, Unknown
  misc_feature (1)..( 9): Result.002 file - promoters60/1032026
cagcttttt

SEQ ID NO: 103966 - DNA, 9 bp, Unknown
  misc_feature (1)..( 9): Result.002 file - promoters60/1032026
cagtttttt

SEQ ID NO: 103967 - DNA, 6 bp, Unknown
  misc_feature (1)..( 6): Result.002 file - promoters60/1032026
acaact

SEQ ID NO: 103968 - DNA, 6 bp, Unknown
  misc_feature (1)..( 6): Result.002 file - promoters60/1032026
acaact

SEQ ID NO: 103969 - DNA, 7 bp, Unknown
  misc_feature (1)..( 7): Result.002 file - promoters60/1032026
tttctaa

SEQ ID NO: 103970 - DNA, 7 bp, Unknown
  misc_feature (1)..( 7): Result.002 file - promoters60/1032026
tttctaa

SEQ ID NO: 103971 - DNA, 6 bp, Unknown
  misc_feature (1)..( 6): Result.002 file - promoters60/1032026
ctccaa

SEQ ID NO: 103972 - DNA, 6 bp, Unknown
  misc_feature (1)..( 6): Result.002 file - promoters60/1032026
ctccaa

SEQ ID NO: 103973 - DNA, 7 bp, Unknown
  misc_feature (1)..( 7): Result.002 file - promoters60/1032026
tactatt

SEQ ID NO: 103974 - DNA, 7 bp, Unknown
  misc_feature (1)..( 7): Result.002 file - promoters60/1032026
tacaatt

SEQ ID NO: 103975 - DNA, 7 bp, Unknown
  misc_feature (1)..( 7): Result.002 file - promoters60/1032026
acataaa

SEQ ID NO: 103976 - DNA, 7 bp, Unknown
  misc_feature (1)..( 7): Result.002 file - promoters60/1032026
acataaa

SEQ ID NO: 103977 - DNA, 7 bp, Unknown
  misc_feature (1)..( 7): Result.002 file - promoters60/1032026
aaatttt

SEQ ID NO: 103978 - DNA, 7 bp, Unknown
  misc_feature (1)..( 7): Result.002 file - promoters60/1032026
aaacttt

SEQ ID NO: 103979 - DNA, 6 bp, Unknown
  misc_feature (1)..( 6): Result.002 file - promoters60/1032026
taaata

SEQ ID NO: 103980 - DNA, 6 bp, Unknown
  misc_feature (1)..( 6): Result.002 file - promoters60/1032026
taaata

SEQ ID NO: 103981 - DNA, 7 bp, Unknown
  misc_feature (1)..( 7): Result.002 file - promoters60/1032047
caatatt

SEQ ID NO: 103982 - DNA, 7 bp, Unknown
  misc_feature (1)..( 7): Result.002 file - promoters60/1032047
caaaatt

SEQ ID NO: 103983 - DNA, 7 bp, Unknown
  misc_feature (1)..( 7): Result.002 file - promoters60/1032047
caatata

SEQ ID NO: 103984 - DNA, 7 bp, Unknown
  misc_feature (1)..( 7): Result.002 file - promoters60/1032047
tttttac

SEQ ID NO: 103985 - DNA, 7 bp, Unknown
  misc_feature (1)..( 7): Result.002 file - promoters60/1032047
gttttac

SEQ ID NO: 103986 - DNA, 7 bp, Unknown
  misc_feature (1)..( 7): Result.002 file - promoters60/1032047
tttttat

SEQ ID NO: 103987 - DNA, 12 bp, Unknown
  misc_feature (1)..( 12): Result.002 file - promoters60/1032047
aaaggaaagaat

SEQ ID NO: 103988 - DNA, 12 bp, Unknown
  misc_feature (1)..( 12): Result.002 file - promoters60/1032047
acaggaaaatgg

SEQ ID NO: 103989 - DNA, 12 bp, Unknown
  misc_feature (1)..( 12): Result.002 file - promoters60/1032047
aaagcaaacaat

SEQ ID NO: 103990 - DNA, 13 bp, Unknown
  misc_feature (1)..( 13): Result.002 file - promoters60/1032047
ctcctataaattg

SEQ ID NO: 103991 - DNA, 13 bp, Unknown
  misc_feature (1)..( 13): Result.002 file - promoters60/1032047
ggtgtataaattg

SEQ ID NO: 103992 - DNA, 13 bp, Unknown
  misc_feature (1)..( 13): Result.002 file - promoters60/1032047
ctcttatatattc

SEQ ID NO: 103993 - DNA, 15 bp, Unknown
  misc_feature (1)..( 15): Result.002 file - promoters60/1032047
tatataagatatatg

SEQ ID NO: 103994 - DNA, 15 bp, Unknown
  misc_feature (1)..( 15): Result.002 file - promoters60/1032047
caaaaaagaaatatg

SEQ ID NO: 103995 - DNA, 16 bp, Unknown
  misc_feature (1)..( 16): Result.002 file - promoters60/1032047
ccataaaggaaaaagc

SEQ ID NO: 103996 - DNA, 9 bp, Unknown
  misc_feature (1)..( 9): Result.002 file - promoters60/1032047
atatgaaat

SEQ ID NO: 103997 - DNA, 9 bp, Unknown
  misc_feature (1)..( 9): Result.002 file - promoters60/1032047
ataggaata

SEQ ID NO: 103998 - DNA, 9 bp, Unknown
  misc_feature (1)..( 9): Result.002 file - promoters60/1032047
atagtaata

SEQ ID NO: 103999 - DNA, 13 bp, Unknown
  misc_feature (1)..( 13): Result.002 file - promoters60/1032047
tgtttatggaaaa

SEQ ID NO: 104000 - DNA, 13 bp, Unknown
  misc_feature (1)..( 13): Result.002 file - promoters60/1032047
ccataaaggaaaa

SEQ ID NO: 104001 - DNA, 13 bp, Unknown
  misc_feature (1)..( 13): Result.002 file - promoters60/1032047
ccaaaaaagaaat

SEQ ID NO: 104002 - DNA, 8 bp, Unknown
  misc_feature (1)..( 8): Result.002 file - promoters60/1032149
ttagtgca

SEQ ID NO: 104003 - DNA, 8 bp, Unknown
  misc_feature (1)..( 8): Result.002 file - promoters60/1032149
ttattgca

SEQ ID NO: 104004 - DNA, 6 bp, Unknown
  misc_feature (1)..( 6): Result.002 file - promoters60/1032149
aaatta

SEQ ID NO: 104005 - DNA, 6 bp, Unknown
  misc_feature (1)..( 6): Result.002 file - promoters60/1032149
aaatta

SEQ ID NO: 104006 - DNA, 9 bp, Unknown
  misc_feature (1)..( 9): Result.002 file - promoters60/1032149
ataaaaata

SEQ ID NO: 104007 - DNA, 9 bp, Unknown
  misc_feature (1)..( 9): Result.002 file - promoters60/1032149
atagaaata

SEQ ID NO: 104008 - DNA, 9 bp, Unknown
  misc_feature (1)..( 9): Result.002 file - promoters60/1032149
tttgcataa

SEQ ID NO: 104009 - DNA, 9 bp, Unknown
  misc_feature (1)..( 9): Result.002 file - promoters60/1032149
tttgtataa

SEQ ID NO: 104010 - DNA, 12 bp, Unknown
  misc_feature (1)..( 12): Result.002 file - promoters60/1032149
tttgcataatca

SEQ ID NO: 104011 - DNA, 12 bp, Unknown
  misc_feature (1)..( 12): Result.002 file - promoters60/1032149
agttattaatca

SEQ ID NO: 104012 - DNA, 12 bp, Unknown
  misc_feature (1)..( 12): Result.002 file - promoters60/1032149
agtgattcatct

SEQ ID NO: 104013 - DNA, 11 bp, Unknown
  misc_feature (1)..( 11): Result.002 file - promoters60/1032149
tcatattaagc

SEQ ID NO: 104014 - DNA, 11 bp, Unknown
  misc_feature (1)..( 11): Result.002 file - promoters60/1032149
agttattaatc

SEQ ID NO: 104015 - DNA, 11 bp, Unknown
  misc_feature (1)..( 11): Result.002 file - promoters60/1032149
agtgattcatc

SEQ ID NO: 104016 - DNA, 6 bp, Unknown
  misc_feature (1)..( 6): Result.002 file - promoters60/1032149
ttttac

SEQ ID NO: 104017 - DNA, 6 bp, Unknown
  misc_feature (1)..( 6): Result.002 file - promoters60/1032149
ttttac

SEQ ID NO: 104018 - DNA, 11 bp, Unknown
  misc_feature (1)..( 11): Result.002 file - promoters60/1032149
ttttttacaca

SEQ ID NO: 104019 - DNA, 11 bp, Unknown
  misc_feature (1)..( 11): Result.002 file - promoters60/1032149
tttcttataca

SEQ ID NO: 104020 - DNA, 6 bp, Unknown
  misc_feature (1)..( 6): Result.002 file - promoters60/1032149
ctaaca

SEQ ID NO: 104021 - DNA, 6 bp, Unknown
  misc_feature (1)..( 6): Result.002 file - promoters60/1032149
ctaaca

SEQ ID NO: 104022 - DNA, 7 bp, Unknown
  misc_feature (1)..( 7): Result.002 file - promoters60/1032149
caattaa

SEQ ID NO: 104023 - DNA, 7 bp, Unknown
  misc_feature (1)..( 7): Result.002 file - promoters60/1032149
caactaa

SEQ ID NO: 104024 - DNA, 7 bp, Unknown
  misc_feature (1)..( 7): Result.002 file - promoters60/1032149
tactatt

SEQ ID NO: 104025 - DNA, 7 bp, Unknown
  misc_feature (1)..( 7): Result.002 file - promoters60/1032149
tacaatt

SEQ ID NO: 104026 - DNA, 6 bp, Unknown
  misc_feature (1)..( 6): Result.002 file - promoters60/1032149
taaaaa

SEQ ID NO: 104027 - DNA, 6 bp, Unknown
  misc_feature (1)..( 6): Result.002 file - promoters60/1032149
taaaaa

SEQ ID NO: 104028 - DNA, 6 bp, Unknown
  misc_feature (1)..( 6): Result.002 file - promoters60/1032149
atttat

SEQ ID NO: 104029 - DNA, 6 bp, Unknown
  misc_feature (1)..( 6): Result.002 file - promoters60/1032149
atttat

SEQ ID NO: 104030 - DNA, 6 bp, Unknown
  misc_feature (1)..( 6): Result.002 file - promoters60/1032149
ttcttt

SEQ ID NO: 104031 - DNA, 6 bp, Unknown
  misc_feature (1)..( 6): Result.002 file - promoters60/1032149
ttcttt

SEQ ID NO: 104032 - DNA, 9 bp, Unknown
  misc_feature (1)..( 9): Result.002 file - promoters60/1032149
aataaatta

SEQ ID NO: 104033 - DNA, 9 bp, Unknown
  misc_feature (1)..( 9): Result.002 file - promoters60/1032149
aataaatta

SEQ ID NO: 104034 - DNA, 8 bp, Unknown
  misc_feature (1)..( 8): Result.002 file - promoters60/1032149
gatcggta

SEQ ID NO: 104035 - DNA, 8 bp, Unknown
  misc_feature (1)..( 8): Result.002 file - promoters60/1032149
gattggta

SEQ ID NO: 104036 - DNA, 6 bp, Unknown
  misc_feature (1)..( 6): Result.002 file - promoters60/1032149
atagtt

SEQ ID NO: 104037 - DNA, 6 bp, Unknown
  misc_feature (1)..( 6): Result.002 file - promoters60/1032149
atagtt

SEQ ID NO: 104038 - DNA, 10 bp, Unknown
  misc_feature (1)..( 10): Result.002 file - promoters60/1032149
attttttatc

SEQ ID NO: 104039 - DNA, 10 bp, Unknown
  misc_feature (1)..( 10): Result.002 file - promoters60/1032149
atttttaatc

SEQ ID NO: 104040 - DNA, 8 bp, Unknown
  misc_feature (1)..( 8): Result.002 file - promoters60/1032149
catactgt

SEQ ID NO: 104041 - DNA, 8 bp, Unknown
  misc_feature (1)..( 8): Result.002 file - promoters60/1032149
catattgt

SEQ ID NO: 104042 - DNA, 9 bp, Unknown
  misc_feature (1)..( 9): Result.002 file - promoters60/1032149
tttattaaa

SEQ ID NO: 104043 - DNA, 9 bp, Unknown
  misc_feature (1)..( 9): Result.002 file - promoters60/1032149
ttttttaaa

SEQ ID NO: 104044 - DNA, 6 bp, Unknown
  misc_feature (1)..( 6): Result.002 file - promoters60/1032149
acaaaa

SEQ ID NO: 104045 - DNA, 6 bp, Unknown
  misc_feature (1)..( 6): Result.002 file - promoters60/1032149
acaaaa

SEQ ID NO: 104046 - DNA, 7 bp, Unknown
  misc_feature (1)..( 7): Result.002 file - promoters60/1032149
aaaagtt

SEQ ID NO: 104047 - DNA, 7 bp, Unknown
  misc_feature (1)..( 7): Result.002 file - promoters60/1032149
aaaagtt

SEQ ID NO: 104048 - DNA, 7 bp, Unknown
  misc_feature (1)..( 7): Result.002 file - promoters60/1032149
tttctta

SEQ ID NO: 104049 - DNA, 7 bp, Unknown
  misc_feature (1)..( 7): Result.002 file - promoters60/1032149
tttttta

SEQ ID NO: 104050 - DNA, 10 bp, Unknown
  misc_feature (1)..( 10): Result.002 file - promoters60/1032160
gcaagagaca

SEQ ID NO: 104051 - DNA, 10 bp, Unknown
  misc_feature (1)..( 10): Result.002 file - promoters60/1032160
cacagagact

SEQ ID NO: 104052 - DNA, 10 bp, Unknown
  misc_feature (1)..( 10): Result.002 file - promoters60/1032160
caaagaaaca

SEQ ID NO: 104053 - DNA, 10 bp, Unknown
  misc_feature (1)..( 10): Result.002 file - promoters60/1032160
ttgagagact

SEQ ID NO: 104054 - DNA, 10 bp, Unknown
  misc_feature (1)..( 10): Result.002 file - promoters60/1032160
cacacagaat

SEQ ID NO: 104055 - DNA, 10 bp, Unknown
  misc_feature (1)..( 10): Result.002 file - promoters60/1032160
cagacagaaa

SEQ ID NO: 104056 - DNA, 12 bp, Unknown
  misc_feature (1)..( 12): Result.002 file - promoters60/1032160
aattttaagata

SEQ ID NO: 104057 - DNA, 12 bp, Unknown
  misc_feature (1)..( 12): Result.002 file - promoters60/1032160
aatattacgttt

SEQ ID NO: 104058 - DNA, 12 bp, Unknown
  misc_feature (1)..( 12): Result.002 file - promoters60/1032160
aattttgctaaa

SEQ ID NO: 104059 - DNA, 12 bp, Unknown
  misc_feature (1)..( 12): Result.002 file - promoters60/1032160
aatttatttaat

SEQ ID NO: 104060 - DNA, 12 bp, Unknown
  misc_feature (1)..( 12): Result.002 file - promoters60/1032160
gattttgctgtg

SEQ ID NO: 104061 - DNA, 12 bp, Unknown
  misc_feature (1)..( 12): Result.002 file - promoters60/1032160
cttattatgttt

SEQ ID NO: 104062 - DNA, 8 bp, Unknown
  misc_feature (1)..( 8): Result.002 file - promoters60/1032258
tgttgcta

SEQ ID NO: 104063 - DNA, 8 bp, Unknown
  misc_feature (1)..( 8): Result.002 file - promoters60/1032258
tgttgcta

SEQ ID NO: 104064 - DNA, 8 bp, Unknown
  misc_feature (1)..( 8): Result.002 file - promoters60/1032258
tgtggctt

SEQ ID NO: 104065 - DNA, 7 bp, Unknown
  misc_feature (1)..( 7): Result.002 file - promoters60/1032258
gcatttt

SEQ ID NO: 104066 - DNA, 7 bp, Unknown
  misc_feature (1)..( 7): Result.002 file - promoters60/1032258
gcagttt

SEQ ID NO: 104067 - DNA, 6 bp, Unknown
  misc_feature (1)..( 6): Result.002 file - promoters60/1032258
atattg

SEQ ID NO: 104068 - DNA, 6 bp, Unknown
  misc_feature (1)..( 6): Result.002 file - promoters60/1032258
atattg

SEQ ID NO: 104069 - DNA, 7 bp, Unknown
  misc_feature (1)..( 7): Result.002 file - promoters60/1032258
ccatata

SEQ ID NO: 104070 - DNA, 7 bp, Unknown
  misc_feature (1)..( 7): Result.002 file - promoters60/1032258
ccacata

SEQ ID NO: 104071 - DNA, 6 bp, Unknown
  misc_feature (1)..( 6): Result.002 file - promoters60/1032258
attgaa

SEQ ID NO: 104072 - DNA, 6 bp, Unknown
  misc_feature (1)..( 6): Result.002 file - promoters60/1032258
attgaa

SEQ ID NO: 104073 - DNA, 7 bp, Unknown
  misc_feature (1)..( 7): Result.002 file - promoters60/1032258
attataa

SEQ ID NO: 104074 - DNA, 7 bp, Unknown
  misc_feature (1)..( 7): Result.002 file - promoters60/1032258
attctaa

SEQ ID NO: 104075 - DNA, 6 bp, Unknown
  misc_feature (1)..( 6): Result.002 file - promoters60/1032258
aaaaac

SEQ ID NO: 104076 - DNA, 6 bp, Unknown
  misc_feature (1)..( 6): Result.002 file - promoters60/1032258
aaaaac

SEQ ID NO: 104077 - DNA, 6 bp, Unknown
  misc_feature (1)..( 6): Result.002 file - promoters60/1032258
gaaaat

SEQ ID NO: 104078 - DNA, 6 bp, Unknown
  misc_feature (1)..( 6): Result.002 file - promoters60/1032258
gaaaat

SEQ ID NO: 104079 - DNA, 6 bp, Unknown
  misc_feature (1)..( 6): Result.002 file - promoters60/1032258
atgatg

SEQ ID NO: 104080 - DNA, 6 bp, Unknown
  misc_feature (1)..( 6): Result.002 file - promoters60/1032258
atgatg

SEQ ID NO: 104081 - DNA, 6 bp, Unknown
  misc_feature (1)..( 6): Result.002 file - promoters60/1032258
tattgt

SEQ ID NO: 104082 - DNA, 6 bp, Unknown
  misc_feature (1)..( 6): Result.002 file - promoters60/1032258
tattgt

SEQ ID NO: 104083 - DNA, 7 bp, Unknown
  misc_feature (1)..( 7): Result.002 file - promoters60/1032258
atattta

SEQ ID NO: 104084 - DNA, 7 bp, Unknown
  misc_feature (1)..( 7): Result.002 file - promoters60/1032258
atattta

SEQ ID NO: 104085 - DNA, 6 bp, Unknown
  misc_feature (1)..( 6): Result.002 file - promoters60/1032258
agtatt

SEQ ID NO: 104086 - DNA, 6 bp, Unknown
  misc_feature (1)..( 6): Result.002 file - promoters60/1032258
agtatt

SEQ ID NO: 104087 - DNA, 6 bp, Unknown
  misc_feature (1)..( 6): Result.002 file - promoters60/1032258
aataca

SEQ ID NO: 104088 - DNA, 6 bp, Unknown
  misc_feature (1)..( 6): Result.002 file - promoters60/1032258
aataca

SEQ ID NO: 104089 - DNA, 7 bp, Unknown
  misc_feature (1)..( 7): Result.002 file - promoters60/1032258
attctct

SEQ ID NO: 104090 - DNA, 7 bp, Unknown
  misc_feature (1)..( 7): Result.002 file - promoters60/1032258
attttct

SEQ ID NO: 104091 - DNA, 7 bp, Unknown
  misc_feature (1)..( 7): Result.002 file - promoters60/1032258
tttttaa

SEQ ID NO: 104092 - DNA, 7 bp, Unknown
  misc_feature (1)..( 7): Result.002 file - promoters60/1032258
tttataa

SEQ ID NO: 104093 - DNA, 6 bp, Unknown
  misc_feature (1)..( 6): Result.002 file - promoters60/1032258
tgtaaa

SEQ ID NO: 104094 - DNA, 6 bp, Unknown
  misc_feature (1)..( 6): Result.002 file - promoters60/1032258
tgtaaa

SEQ ID NO: 104095 - DNA, 7 bp, Unknown
  misc_feature (1)..( 7): Result.002 file - promoters60/1032266
agtcttt

SEQ ID NO: 104096 - DNA, 7 bp, Unknown
  misc_feature (1)..( 7): Result.002 file - promoters60/1032266
agtgttt

SEQ ID NO: 104097 - DNA, 6 bp, Unknown
  misc_feature (1)..( 6): Result.002 file - promoters60/1032266
attcta

SEQ ID NO: 104098 - DNA, 6 bp, Unknown
  misc_feature (1)..( 6): Result.002 file - promoters60/1032266
attcta

SEQ ID NO: 104099 - DNA, 6 bp, Unknown
  misc_feature (1)..( 6): Result.002 file - promoters60/1032266
gaacat

SEQ ID NO: 104100 - DNA, 6 bp, Unknown
  misc_feature (1)..( 6): Result.002 file - promoters60/1032266
gaacat

SEQ ID NO: 104101 - DNA, 6 bp, Unknown
  misc_feature (1)..( 6): Result.002 file - promoters60/1032266
tctaca

SEQ ID NO: 104102 - DNA, 6 bp, Unknown
  misc_feature (1)..( 6): Result.002 file - promoters60/1032266
tctaca

SEQ ID NO: 104103 - DNA, 6 bp, Unknown
  misc_feature (1)..( 6): Result.002 file - promoters60/1032266
cgtaga

SEQ ID NO: 104104 - DNA, 6 bp, Unknown
  misc_feature (1)..( 6): Result.002 file - promoters60/1032266
cgtaga

SEQ ID NO: 104105 - DNA, 11 bp, Unknown
  misc_feature (1)..( 11): Result.002 file - promoters60/1032266
atttattagtg

SEQ ID NO: 104106 - DNA, 11 bp, Unknown
  misc_feature (1)..( 11): Result.002 file - promoters60/1032266
atttatttgtg

SEQ ID NO: 104107 - DNA, 6 bp, Unknown
  misc_feature (1)..( 6): Result.002 file - promoters60/1032266
aaatat

SEQ ID NO: 104108 - DNA, 6 bp, Unknown
  misc_feature (1)..( 6): Result.002 file - promoters60/1032266
aaatat

SEQ ID NO: 104109 - DNA, 8 bp, Unknown
  misc_feature (1)..( 8): Result.002 file - promoters60/1032266
atattttc

SEQ ID NO: 104110 - DNA, 8 bp, Unknown
  misc_feature (1)..( 8): Result.002 file - promoters60/1032266
atatcttc

SEQ ID NO: 104111 - DNA, 8 bp, Unknown
  misc_feature (1)..( 8): Result.002 file - promoters60/1032266
aaaatttg

SEQ ID NO: 104112 - DNA, 8 bp, Unknown
  misc_feature (1)..( 8): Result.002 file - promoters60/1032266
aaaatttg

SEQ ID NO: 104113 - DNA, 7 bp, Unknown
  misc_feature (1)..( 7): Result.002 file - promoters60/1032266
atgaact

SEQ ID NO: 104114 - DNA, 7 bp, Unknown
  misc_feature (1)..( 7): Result.002 file - promoters60/1032266
atgtact

SEQ ID NO: 104115 - DNA, 6 bp, Unknown
  misc_feature (1)..( 6): Result.002 file - promoters60/1032266
aaaaag

SEQ ID NO: 104116 - DNA, 6 bp, Unknown
  misc_feature (1)..( 6): Result.002 file - promoters60/1032266
aaaaag

SEQ ID NO: 104117 - DNA, 7 bp, Unknown
  misc_feature (1)..( 7): Result.002 file - promoters60/1032266
agattta

SEQ ID NO: 104118 - DNA, 7 bp, Unknown
  misc_feature (1)..( 7): Result.002 file - promoters60/1032266
agattta

SEQ ID NO: 104119 - DNA, 6 bp, Unknown
  misc_feature (1)..( 6): Result.002 file - promoters60/1032266
attatt

SEQ ID NO: 104120 - DNA, 6 bp, Unknown
  misc_feature (1)..( 6): Result.002 file - promoters60/1032266
attatt

SEQ ID NO: 104121 - DNA, 10 bp, Unknown
  misc_feature (1)..( 10): Result.002 file - promoters60/1032266
tttgcaacgt

SEQ ID NO: 104122 - DNA, 10 bp, Unknown
  misc_feature (1)..( 10): Result.002 file - promoters60/1032266
tttgtaacgt

SEQ ID NO: 104123 - DNA, 6 bp, Unknown
  misc_feature (1)..( 6): Result.002 file - promoters60/1032266
tgatat

SEQ ID NO: 104124 - DNA, 6 bp, Unknown
  misc_feature (1)..( 6): Result.002 file - promoters60/1032266
tgatat

SEQ ID NO: 104125 - DNA, 6 bp, Unknown
  misc_feature (1)..( 6): Result.002 file - promoters60/1032266
ttaaaa

SEQ ID NO: 104126 - DNA, 6 bp, Unknown
  misc_feature (1)..( 6): Result.002 file - promoters60/1032266
ttaaaa

SEQ ID NO: 104127 - DNA, 8 bp, Unknown
  misc_feature (1)..( 8): Result.002 file - promoters60/1032266
ttcgttaa

SEQ ID NO: 104128 - DNA, 8 bp, Unknown
  misc_feature (1)..( 8): Result.002 file - promoters60/1032266
ttcattaa

SEQ ID NO: 104129 - DNA, 12 bp, Unknown
  misc_feature (1)..( 12): Result.002 file - promoters60/1032316
aagcaaaacaca

SEQ ID NO: 104130 - DNA, 12 bp, Unknown
  misc_feature (1)..( 12): Result.002 file - promoters60/1032316
ccacaaaacatc

SEQ ID NO: 104131 - DNA, 12 bp, Unknown
  misc_feature (1)..( 12): Result.002 file - promoters60/1032316
actaaaaacaga

SEQ ID NO: 104132 - DNA, 12 bp, Unknown
  misc_feature (1)..( 12): Result.002 file - promoters60/1032316
gaataaaaaatc

SEQ ID NO: 104133 - DNA, 12 bp, Unknown
  misc_feature (1)..( 12): Result.002 file - promoters60/1032316
actaaaaactct

SEQ ID NO: 104134 - DNA, 12 bp, Unknown
  misc_feature (1)..( 12): Result.002 file - promoters60/1032316
ttctaaatctcg

SEQ ID NO: 104135 - DNA, 9 bp, Unknown
  misc_feature (1)..( 9): Result.002 file - promoters60/1032400
gaagtggaa

SEQ ID NO: 104136 - DNA, 9 bp, Unknown
  misc_feature (1)..( 9): Result.002 file - promoters60/1032400
gaagaggaa

SEQ ID NO: 104137 - DNA, 8 bp, Unknown
  misc_feature (1)..( 8): Result.002 file - promoters60/1032400
aatgagct

SEQ ID NO: 104138 - DNA, 8 bp, Unknown
  misc_feature (1)..( 8): Result.002 file - promoters60/1032400
aatgtgct

SEQ ID NO: 104139 - DNA, 9 bp, Unknown
  misc_feature (1)..( 9): Result.002 file - promoters60/1032400
tgctaaatt

SEQ ID NO: 104140 - DNA, 9 bp, Unknown
  misc_feature (1)..( 9): Result.002 file - promoters60/1032400
tgcttaatt

SEQ ID NO: 104141 - DNA, 7 bp, Unknown
  misc_feature (1)..( 7): Result.002 file - promoters60/1032400
taatgaa

SEQ ID NO: 104142 - DNA, 7 bp, Unknown
  misc_feature (1)..( 7): Result.002 file - promoters60/1032400
taatgaa

SEQ ID NO: 104143 - DNA, 8 bp, Unknown
  misc_feature (1)..( 8): Result.002 file - promoters60/1032400
tggctgtt

SEQ ID NO: 104144 - DNA, 8 bp, Unknown
  misc_feature (1)..( 8): Result.002 file - promoters60/1032400
tggttgtt

SEQ ID NO: 104145 - DNA, 8 bp, Unknown
  misc_feature (1)..( 8): Result.002 file - promoters60/1032400
aattgatt

SEQ ID NO: 104146 - DNA, 8 bp, Unknown
  misc_feature (1)..( 8): Result.002 file - promoters60/1032400
aatttatt

SEQ ID NO: 104147 - DNA, 8 bp, Unknown
  misc_feature (1)..( 8): Result.002 file - promoters60/1032400
ctttgatt

SEQ ID NO: 104148 - DNA, 7 bp, Unknown
  misc_feature (1)..( 7): Result.002 file - promoters60/1032400
gtttaat

SEQ ID NO: 104149 - DNA, 7 bp, Unknown
  misc_feature (1)..( 7): Result.002 file - promoters60/1032400
gttaaat

SEQ ID NO: 104150 - DNA, 9 bp, Unknown
  misc_feature (1)..( 9): Result.002 file - promoters60/1032400
cccgggaaa

SEQ ID NO: 104151 - DNA, 9 bp, Unknown
  misc_feature (1)..( 9): Result.002 file - promoters60/1032400
cccgagaaa

SEQ ID NO: 104152 - DNA, 7 bp, Unknown
  misc_feature (1)..( 7): Result.002 file - promoters60/1032400
acagaag

SEQ ID NO: 104153 - DNA, 7 bp, Unknown
  misc_feature (1)..( 7): Result.002 file - promoters60/1032400
acacaag

SEQ ID NO: 104154 - DNA, 7 bp, Unknown
  misc_feature (1)..( 7): Result.002 file - promoters60/1032400
agaaaaa

SEQ ID NO: 104155 - DNA, 7 bp, Unknown
  misc_feature (1)..( 7): Result.002 file - promoters60/1032400
agagaaa

SEQ ID NO: 104156 - DNA, 7 bp, Unknown
  misc_feature (1)..( 7): Result.002 file - promoters60/1032400
ttcaatg

SEQ ID NO: 104157 - DNA, 7 bp, Unknown
  misc_feature (1)..( 7): Result.002 file - promoters60/1032400
ttcaatg

SEQ ID NO: 104158 - DNA, 8 bp, Unknown
  misc_feature (1)..( 8): Result.002 file - promoters60/1032400
tctttatt

SEQ ID NO: 104159 - DNA, 8 bp, Unknown
  misc_feature (1)..( 8): Result.002 file - promoters60/1032400
tcttaatt

SEQ ID NO: 104160 - DNA, 6 bp, Unknown
  misc_feature (1)..( 6): Result.002 file - promoters60/1032436
ttggtt

SEQ ID NO: 104161 - DNA, 6 bp, Unknown
  misc_feature (1)..( 6): Result.002 file - promoters60/1032436
ttggtt

SEQ ID NO: 104162 - DNA, 8 bp, Unknown
  misc_feature (1)..( 8): Result.002 file - promoters60/1032436
tactcaaa

SEQ ID NO: 104163 - DNA, 8 bp, Unknown
  misc_feature (1)..( 8): Result.002 file - promoters60/1032436
tactgaaa

SEQ ID NO: 104164 - DNA, 8 bp, Unknown
  misc_feature (1)..( 8): Result.002 file - promoters60/1032436
aactcaat

SEQ ID NO: 104165 - DNA, 6 bp, Unknown
  misc_feature (1)..( 6): Result.002 file - promoters60/1032436
ttctgt

SEQ ID NO: 104166 - DNA, 6 bp, Unknown
  misc_feature (1)..( 6): Result.002 file - promoters60/1032436
ttctgt

SEQ ID NO: 104167 - DNA, 7 bp, Unknown
  misc_feature (1)..( 7): Result.002 file - promoters60/1032436
gaaaata

SEQ ID NO: 104168 - DNA, 7 bp, Unknown
  misc_feature (1)..( 7): Result.002 file - promoters60/1032436
gaacata

SEQ ID NO: 104169 - DNA, 7 bp, Unknown
  misc_feature (1)..( 7): Result.002 file - promoters60/1032436
ggttttg

SEQ ID NO: 104170 - DNA, 7 bp, Unknown
  misc_feature (1)..( 7): Result.002 file - promoters60/1032436
ggttttg

SEQ ID NO: 104171 - DNA, 6 bp, Unknown
  misc_feature (1)..( 6): Result.002 file - promoters60/1032436
gaaaaa

SEQ ID NO: 104172 - DNA, 6 bp, Unknown
  misc_feature (1)..( 6): Result.002 file - promoters60/1032436
gaaaaa

SEQ ID NO: 104173 - DNA, 6 bp, Unknown
  misc_feature (1)..( 6): Result.002 file - promoters60/1032436
aataat

SEQ ID NO: 104174 - DNA, 6 bp, Unknown
  misc_feature (1)..( 6): Result.002 file - promoters60/1032436
aataat

SEQ ID NO: 104175 - DNA, 8 bp, Unknown
  misc_feature (1)..( 8): Result.002 file - promoters60/1032436
gccactac

SEQ ID NO: 104176 - DNA, 8 bp, Unknown
  misc_feature (1)..( 8): Result.002 file - promoters60/1032436
gcctctac

SEQ ID NO: 104177 - DNA, 7 bp, Unknown
  misc_feature (1)..( 7): Result.002 file - promoters60/1032436
acttttc

SEQ ID NO: 104178 - DNA, 7 bp, Unknown
  misc_feature (1)..( 7): Result.002 file - promoters60/1032436
actgttc

SEQ ID NO: 104179 - DNA, 7 bp, Unknown
  misc_feature (1)..( 7): Result.002 file - promoters60/1032436
aaagtaa

SEQ ID NO: 104180 - DNA, 7 bp, Unknown
  misc_feature (1)..( 7): Result.002 file - promoters60/1032436
aaattaa

SEQ ID NO: 104181 - DNA, 9 bp, Unknown
  misc_feature (1)..( 9): Result.002 file - promoters60/1032436
ttaaaaaaa

SEQ ID NO: 104182 - DNA, 9 bp, Unknown
  misc_feature (1)..( 9): Result.002 file - promoters60/1032436
ttaaacaaa

SEQ ID NO: 104183 - DNA, 8 bp, Unknown
  misc_feature (1)..( 8): Result.002 file - promoters60/1032436
ctcattta

SEQ ID NO: 104184 - DNA, 8 bp, Unknown
  misc_feature (1)..( 8): Result.002 file - promoters60/1032436
ctcaatta

SEQ ID NO: 104185 - DNA, 7 bp, Unknown
  misc_feature (1)..( 7): Result.002 file - promoters60/1032436
tatttgt

SEQ ID NO: 104186 - DNA, 7 bp, Unknown
  misc_feature (1)..( 7): Result.002 file - promoters60/1032436
tatttgt

SEQ ID NO: 104187 - DNA, 9 bp, Unknown
  misc_feature (1)..( 9): Result.002 file - promoters60/1032436
taatgtatt

SEQ ID NO: 104188 - DNA, 9 bp, Unknown
  misc_feature (1)..( 9): Result.002 file - promoters60/1032436
taatctatt

SEQ ID NO: 104189 - DNA, 9 bp, Unknown
  misc_feature (1)..( 9): Result.002 file - promoters60/1032436
gattcgttt

SEQ ID NO: 104190 - DNA, 9 bp, Unknown
  misc_feature (1)..( 9): Result.002 file - promoters60/1032436
gatttgttt

SEQ ID NO: 104191 - DNA, 7 bp, Unknown
  misc_feature (1)..( 7): Result.002 file - promoters60/1032436
gtttctt

SEQ ID NO: 104192 - DNA, 7 bp, Unknown
  misc_feature (1)..( 7): Result.002 file - promoters60/1032436
gttcctt

SEQ ID NO: 104193 - DNA, 13 bp, Unknown
  misc_feature (1)..( 13): Result.002 file - promoters60/1032436
aagaattagtgat

SEQ ID NO: 104194 - DNA, 13 bp, Unknown
  misc_feature (1)..( 13): Result.002 file - promoters60/1032436
aaggattaatgat

SEQ ID NO: 104195 - DNA, 12 bp, Unknown
  misc_feature (1)..( 12): Result.002 file - promoters60/1032668
taaaaatgaatt

SEQ ID NO: 104196 - DNA, 12 bp, Unknown
  misc_feature (1)..( 12): Result.002 file - promoters60/1032668
taaaaatgatac

SEQ ID NO: 104197 - DNA, 12 bp, Unknown
  misc_feature (1)..( 12): Result.002 file - promoters60/1032668
gtttaatggatt

SEQ ID NO: 104198 - DNA, 12 bp, Unknown
  misc_feature (1)..( 12): Result.002 file - promoters60/1032668
tgaaaaggatga

SEQ ID NO: 104199 - DNA, 9 bp, Unknown
  misc_feature (1)..( 9): Result.002 file - promoters60/1032668
aaacatgaa

SEQ ID NO: 104200 - DNA, 9 bp, Unknown
  misc_feature (1)..( 9): Result.002 file - promoters60/1032668
aaaaatgca

SEQ ID NO: 104201 - DNA, 9 bp, Unknown
  misc_feature (1)..( 9): Result.002 file - promoters60/1032668
ggacatgaa

SEQ ID NO: 104202 - DNA, 9 bp, Unknown
  misc_feature (1)..( 9): Result.002 file - promoters60/1032668
aaaaataaa

SEQ ID NO: 104203 - DNA, 6 bp, Unknown
  misc_feature (1)..( 6): Result.002 file - promoters60/1032698
caaatc

SEQ ID NO: 104204 - DNA, 6 bp, Unknown
  misc_feature (1)..( 6): Result.002 file - promoters60/1032698
caaatc

SEQ ID NO: 104205 - DNA, 7 bp, Unknown
  misc_feature (1)..( 7): Result.002 file - promoters60/1032698
ttctcta

SEQ ID NO: 104206 - DNA, 7 bp, Unknown
  misc_feature (1)..( 7): Result.002 file - promoters60/1032698
ttcacta

SEQ ID NO: 104207 - DNA, 7 bp, Unknown
  misc_feature (1)..( 7): Result.002 file - promoters60/1032698
agatgga

SEQ ID NO: 104208 - DNA, 7 bp, Unknown
  misc_feature (1)..( 7): Result.002 file - promoters60/1032698
agacgga

SEQ ID NO: 104209 - DNA, 7 bp, Unknown
  misc_feature (1)..( 7): Result.002 file - promoters60/1032698
cataatt

SEQ ID NO: 104210 - DNA, 7 bp, Unknown
  misc_feature (1)..( 7): Result.002 file - promoters60/1032698
cattatt

SEQ ID NO: 104211 - DNA, 7 bp, Unknown
  misc_feature (1)..( 7): Result.002 file - promoters60/1032698
tttcagc

SEQ ID NO: 104212 - DNA, 7 bp, Unknown
  misc_feature (1)..( 7): Result.002 file - promoters60/1032698
ttttagc

SEQ ID NO: 104213 - DNA, 6 bp, Unknown
  misc_feature (1)..( 6): Result.002 file - promoters60/1032698
actttt

SEQ ID NO: 104214 - DNA, 6 bp, Unknown
  misc_feature (1)..( 6): Result.002 file - promoters60/1032698
actttt

SEQ ID NO: 104215 - DNA, 7 bp, Unknown
  misc_feature (1)..( 7): Result.002 file - promoters60/1032698
tataaaa

SEQ ID NO: 104216 - DNA, 7 bp, Unknown
  misc_feature (1)..( 7): Result.002 file - promoters60/1032698
tataaaa

SEQ ID NO: 104217 - DNA, 6 bp, Unknown
  misc_feature (1)..( 6): Result.002 file - promoters60/1032698
gaatct

SEQ ID NO: 104218 - DNA, 6 bp, Unknown
  misc_feature (1)..( 6): Result.002 file - promoters60/1032698
gaatct

SEQ ID NO: 104219 - DNA, 7 bp, Unknown
  misc_feature (1)..( 7): Result.002 file - promoters60/1032698
tggaaag

SEQ ID NO: 104220 - DNA, 7 bp, Unknown
  misc_feature (1)..( 7): Result.002 file - promoters60/1032698
tggaaat

SEQ ID NO: 104221 - DNA, 7 bp, Unknown
  misc_feature (1)..( 7): Result.002 file - promoters60/1032698
aggaaat

SEQ ID NO: 104222 - DNA, 6 bp, Unknown
  misc_feature (1)..( 6): Result.002 file - promoters60/1032698
gagata

SEQ ID NO: 104223 - DNA, 6 bp, Unknown
  misc_feature (1)..( 6): Result.002 file - promoters60/1032698
gagata

SEQ ID NO: 104224 - DNA, 9 bp, Unknown
  misc_feature (1)..( 9): Result.002 file - promoters60/1032698
caatcaaaa

SEQ ID NO: 104225 - DNA, 9 bp, Unknown
  misc_feature (1)..( 9): Result.002 file - promoters60/1032698
caaacaaaa

SEQ ID NO: 104226 - DNA, 7 bp, Unknown
  misc_feature (1)..( 7): Result.002 file - promoters60/1032698
tattttt

SEQ ID NO: 104227 - DNA, 7 bp, Unknown
  misc_feature (1)..( 7): Result.002 file - promoters60/1032698
tatattt

SEQ ID NO: 104228 - DNA, 8 bp, Unknown
  misc_feature (1)..( 8): Result.002 file - promoters60/1032698
atctgaaa

SEQ ID NO: 104229 - DNA, 8 bp, Unknown
  misc_feature (1)..( 8): Result.002 file - promoters60/1032698
atcagaaa

SEQ ID NO: 104230 - DNA, 7 bp, Unknown
  misc_feature (1)..( 7): Result.002 file - promoters60/1032698
atgagaa

SEQ ID NO: 104231 - DNA, 7 bp, Unknown
  misc_feature (1)..( 7): Result.002 file - promoters60/1032698
atgagaa

SEQ ID NO: 104232 - DNA, 7 bp, Unknown
  misc_feature (1)..( 7): Result.002 file - promoters60/1032698
aggttca

SEQ ID NO: 104233 - DNA, 7 bp, Unknown
  misc_feature (1)..( 7): Result.002 file - promoters60/1032698
aggctca

SEQ ID NO: 104234 - DNA, 6 bp, Unknown
  misc_feature (1)..( 6): Result.002 file - promoters60/1032698
gaagat

SEQ ID NO: 104235 - DNA, 6 bp, Unknown
  misc_feature (1)..( 6): Result.002 file - promoters60/1032698
gaagat

SEQ ID NO: 104236 - DNA, 7 bp, Unknown
  misc_feature (1)..( 7): Result.002 file - promoters60/1032698
ttggtcc

SEQ ID NO: 104237 - DNA, 7 bp, Unknown
  misc_feature (1)..( 7): Result.002 file - promoters60/1032698
ttgatcc

SEQ ID NO: 104238 - DNA, 6 bp, Unknown
  misc_feature (1)..( 6): Result.002 file - promoters60/1032698
acttgg

SEQ ID NO: 104239 - DNA, 6 bp, Unknown
  misc_feature (1)..( 6): Result.002 file - promoters60/1032698
acttgg

SEQ ID NO: 104240 - DNA, 8 bp, Unknown
  misc_feature (1)..( 8): Result.002 file - promoters60/1032698
aaagaaaa

SEQ ID NO: 104241 - DNA, 8 bp, Unknown
  misc_feature (1)..( 8): Result.002 file - promoters60/1032698
aaagaaaa

SEQ ID NO: 104242 - DNA, 7 bp, Unknown
  misc_feature (1)..( 7): Result.002 file - promoters60/1032709
aatatgt

SEQ ID NO: 104243 - DNA, 7 bp, Unknown
  misc_feature (1)..( 7): Result.002 file - promoters60/1032709
aatgtgt

SEQ ID NO: 104244 - DNA, 8 bp, Unknown
  misc_feature (1)..( 8): Result.002 file - promoters60/1032709
tgatggat

SEQ ID NO: 104245 - DNA, 8 bp, Unknown
  misc_feature (1)..( 8): Result.002 file - promoters60/1032709
tgatggat

SEQ ID NO: 104246 - DNA, 6 bp, Unknown
  misc_feature (1)..( 6): Result.002 file - promoters60/1032709
cagtct

SEQ ID NO: 104247 - DNA, 6 bp, Unknown
  misc_feature (1)..( 6): Result.002 file - promoters60/1032709
cagtct

SEQ ID NO: 104248 - DNA, 8 bp, Unknown
  misc_feature (1)..( 8): Result.002 file - promoters60/1032709
tcctagaa

SEQ ID NO: 104249 - DNA, 8 bp, Unknown
  misc_feature (1)..( 8): Result.002 file - promoters60/1032709
tccttgaa

SEQ ID NO: 104250 - DNA, 7 bp, Unknown
  misc_feature (1)..( 7): Result.002 file - promoters60/1032709
ctggtct

SEQ ID NO: 104251 - DNA, 7 bp, Unknown
  misc_feature (1)..( 7): Result.002 file - promoters60/1032709
ctgttct

SEQ ID NO: 104252 - DNA, 7 bp, Unknown
  misc_feature (1)..( 7): Result.002 file - promoters60/1032709
ttgactc

SEQ ID NO: 104253 - DNA, 7 bp, Unknown
  misc_feature (1)..( 7): Result.002 file - promoters60/1032709
ttgactc

SEQ ID NO: 104254 - DNA, 7 bp, Unknown
  misc_feature (1)..( 7): Result.002 file - promoters60/1032709
agacgag

SEQ ID NO: 104255 - DNA, 7 bp, Unknown
  misc_feature (1)..( 7): Result.002 file - promoters60/1032709
agacgag

SEQ ID NO: 104256 - DNA, 9 bp, Unknown
  misc_feature (1)..( 9): Result.002 file - promoters60/1032709
agaaacaaa

SEQ ID NO: 104257 - DNA, 9 bp, Unknown
  misc_feature (1)..( 9): Result.002 file - promoters60/1032709
agaaaaaaa

SEQ ID NO: 104258 - DNA, 7 bp, Unknown
  misc_feature (1)..( 7): Result.002 file - promoters60/1032709
atattta

SEQ ID NO: 104259 - DNA, 7 bp, Unknown
  misc_feature (1)..( 7): Result.002 file - promoters60/1032709
atattta

SEQ ID NO: 104260 - DNA, 7 bp, Unknown
  misc_feature (1)..( 7): Result.002 file - promoters60/1032709
aacacag

SEQ ID NO: 104261 - DNA, 7 bp, Unknown
  misc_feature (1)..( 7): Result.002 file - promoters60/1032709
aactcag

SEQ ID NO: 104262 - DNA, 9 bp, Unknown
  misc_feature (1)..( 9): Result.002 file - promoters60/1032709
ttgttctta

SEQ ID NO: 104263 - DNA, 9 bp, Unknown
  misc_feature (1)..( 9): Result.002 file - promoters60/1032709
ttgttatta

SEQ ID NO: 104264 - DNA, 6 bp, Unknown
  misc_feature (1)..( 6): Result.002 file - promoters60/1032709
aatatc

SEQ ID NO: 104265 - DNA, 6 bp, Unknown
  misc_feature (1)..( 6): Result.002 file - promoters60/1032709
aatatc

SEQ ID NO: 104266 - DNA, 7 bp, Unknown
  misc_feature (1)..( 7): Result.002 file - promoters60/1032709
ctaaacc

SEQ ID NO: 104267 - DNA, 7 bp, Unknown
  misc_feature (1)..( 7): Result.002 file - promoters60/1032709
ctaaacc

SEQ ID NO: 104268 - DNA, 7 bp, Unknown
  misc_feature (1)..( 7): Result.002 file - promoters60/1032709
cgtattg

SEQ ID NO: 104269 - DNA, 7 bp, Unknown
  misc_feature (1)..( 7): Result.002 file - promoters60/1032709
cgtattg

SEQ ID NO: 104270 - DNA, 7 bp, Unknown
  misc_feature (1)..( 7): Result.002 file - promoters60/1032709
aaatcaa

SEQ ID NO: 104271 - DNA, 7 bp, Unknown
  misc_feature (1)..( 7): Result.002 file - promoters60/1032709
aaaccaa

SEQ ID NO: 104272 - DNA, 7 bp, Unknown
  misc_feature (1)..( 7): Result.002 file - promoters60/1032709
gaaaaaa

SEQ ID NO: 104273 - DNA, 7 bp, Unknown
  misc_feature (1)..( 7): Result.002 file - promoters60/1032709
gaaaaaa

SEQ ID NO: 104274 - DNA, 9 bp, Unknown
  misc_feature (1)..( 9): Result.002 file - promoters60/1032713
tttcaaaac

SEQ ID NO: 104275 - DNA, 9 bp, Unknown
  misc_feature (1)..( 9): Result.002 file - promoters60/1032713
tttgaaaca

SEQ ID NO: 104276 - DNA, 9 bp, Unknown
  misc_feature (1)..( 9): Result.002 file - promoters60/1032713
attgaaaca

SEQ ID NO: 104277 - DNA, 9 bp, Unknown
  misc_feature (1)..( 9): Result.002 file - promoters60/1032713
acacggcaa

SEQ ID NO: 104278 - DNA, 9 bp, Unknown
  misc_feature (1)..( 9): Result.002 file - promoters60/1032713
aaacgccaa

SEQ ID NO: 104279 - DNA, 9 bp, Unknown
  misc_feature (1)..( 9): Result.002 file - promoters60/1032713
aaaagccat

SEQ ID NO: 104280 - DNA, 7 bp, Unknown
  misc_feature (1)..( 7): Result.002 file - promoters60/1032713
caacata

SEQ ID NO: 104281 - DNA, 7 bp, Unknown
  misc_feature (1)..( 7): Result.002 file - promoters60/1032713
caaaata

SEQ ID NO: 104282 - DNA, 7 bp, Unknown
  misc_feature (1)..( 7): Result.002 file - promoters60/1032713
caaaata

SEQ ID NO: 104283 - DNA, 10 bp, Unknown
  misc_feature (1)..( 10): Result.002 file - promoters60/1032713
tgtactaact

SEQ ID NO: 104284 - DNA, 10 bp, Unknown
  misc_feature (1)..( 10): Result.002 file - promoters60/1032713
attacttact

SEQ ID NO: 104285 - DNA, 10 bp, Unknown
  misc_feature (1)..( 10): Result.002 file - promoters60/1032713
attgcttata

SEQ ID NO: 104286 - DNA, 8 bp, Unknown
  misc_feature (1)..( 8): Result.002 file - promoters60/1032713
aaatccat

SEQ ID NO: 104287 - DNA, 8 bp, Unknown
  misc_feature (1)..( 8): Result.002 file - promoters60/1032713
aaagccat

SEQ ID NO: 104288 - DNA, 9 bp, Unknown
  misc_feature (1)..( 9): Result.002 file - promoters60/1032713
aaacgccaa

SEQ ID NO: 104289 - DNA, 7 bp, Unknown
  misc_feature (1)..( 7): Result.002 file - promoters60/1032730
ctaaata

SEQ ID NO: 104290 - DNA, 7 bp, Unknown
  misc_feature (1)..( 7): Result.002 file - promoters60/1032730
ctagata

SEQ ID NO: 104291 - DNA, 9 bp, Unknown
  misc_feature (1)..( 9): Result.002 file - promoters60/1032730
gtagtatat

SEQ ID NO: 104292 - DNA, 9 bp, Unknown
  misc_feature (1)..( 9): Result.002 file - promoters60/1032730
gtagtatat

SEQ ID NO: 104293 - DNA, 8 bp, Unknown
  misc_feature (1)..( 8): Result.002 file - promoters60/1032730
tgtcgttt

SEQ ID NO: 104294 - DNA, 8 bp, Unknown
  misc_feature (1)..( 8): Result.002 file - promoters60/1032730
tgtggttt

SEQ ID NO: 104295 - DNA, 6 bp, Unknown
  misc_feature (1)..( 6): Result.002 file - promoters60/1032730
cccaaa

SEQ ID NO: 104296 - DNA, 6 bp, Unknown
  misc_feature (1)..( 6): Result.002 file - promoters60/1032730
cccaaa

SEQ ID NO: 104297 - DNA, 6 bp, Unknown
  misc_feature (1)..( 6): Result.002 file - promoters60/1032730
acaaat

SEQ ID NO: 104298 - DNA, 6 bp, Unknown
  misc_feature (1)..( 6): Result.002 file - promoters60/1032730
acaaat

SEQ ID NO: 104299 - DNA, 7 bp, Unknown
  misc_feature (1)..( 7): Result.002 file - promoters60/1032730
aaattca

SEQ ID NO: 104300 - DNA, 7 bp, Unknown
  misc_feature (1)..( 7): Result.002 file - promoters60/1032730
aaaatca

SEQ ID NO: 104301 - DNA, 8 bp, Unknown
  misc_feature (1)..( 8): Result.002 file - promoters60/1032730
ttttaaaa

SEQ ID NO: 104302 - DNA, 8 bp, Unknown
  misc_feature (1)..( 8): Result.002 file - promoters60/1032730
ttttcaaa

SEQ ID NO: 104303 - DNA, 7 bp, Unknown
  misc_feature (1)..( 7): Result.002 file - promoters60/1032730
aaaaaga

SEQ ID NO: 104304 - DNA, 7 bp, Unknown
  misc_feature (1)..( 7): Result.002 file - promoters60/1032730
aaagaga

SEQ ID NO: 104305 - DNA, 8 bp, Unknown
  misc_feature (1)..( 8): Result.002 file - promoters60/1032730
cgtttata

SEQ ID NO: 104306 - DNA, 8 bp, Unknown
  misc_feature (1)..( 8): Result.002 file - promoters60/1032730
cgttaata

SEQ ID NO: 104307 - DNA, 6 bp, Unknown
  misc_feature (1)..( 6): Result.002 file - promoters60/1032730
agaatc

SEQ ID NO: 104308 - DNA, 6 bp, Unknown
  misc_feature (1)..( 6): Result.002 file - promoters60/1032730
agaatc

SEQ ID NO: 104309 - DNA, 6 bp, Unknown
  misc_feature (1)..( 6): Result.002 file - promoters60/1032730
actcaa

SEQ ID NO: 104310 - DNA, 6 bp, Unknown
  misc_feature (1)..( 6): Result.002 file - promoters60/1032730
actcaa

SEQ ID NO: 104311 - DNA, 8 bp, Unknown
  misc_feature (1)..( 8): Result.002 file - promoters60/1032730
aatcaaaa

SEQ ID NO: 104312 - DNA, 8 bp, Unknown
  misc_feature (1)..( 8): Result.002 file - promoters60/1032730
aatcaaaa

SEQ ID NO: 104313 - DNA, 6 bp, Unknown
  misc_feature (1)..( 6): Result.002 file - promoters60/1032730
cagaaa

SEQ ID NO: 104314 - DNA, 6 bp, Unknown
  misc_feature (1)..( 6): Result.002 file - promoters60/1032730
cagaaa

SEQ ID NO: 104315 - DNA, 7 bp, Unknown
  misc_feature (1)..( 7): Result.002 file - promoters60/1032730
attaaaa

SEQ ID NO: 104316 - DNA, 7 bp, Unknown
  misc_feature (1)..( 7): Result.002 file - promoters60/1032730
attgaaa

SEQ ID NO: 104317 - DNA, 6 bp, Unknown
  misc_feature (1)..( 6): Result.002 file - promoters60/1032730
acgaaa

SEQ ID NO: 104318 - DNA, 6 bp, Unknown
  misc_feature (1)..( 6): Result.002 file - promoters60/1032730
acgaaa

SEQ ID NO: 104319 - DNA, 6 bp, Unknown
  misc_feature (1)..( 6): Result.002 file - promoters60/1032730
gacttt

SEQ ID NO: 104320 - DNA, 6 bp, Unknown
  misc_feature (1)..( 6): Result.002 file - promoters60/1032730
gacttt

SEQ ID NO: 104321 - DNA, 9 bp, Unknown
  misc_feature (1)..( 9): Result.002 file - promoters60/1032752
agaacaata

SEQ ID NO: 104322 - DNA, 9 bp, Unknown
  misc_feature (1)..( 9): Result.002 file - promoters60/1032752
aaaacaata

SEQ ID NO: 104323 - DNA, 9 bp, Unknown
  misc_feature (1)..( 9): Result.002 file - promoters60/1032752
agaataatg

SEQ ID NO: 104324 - DNA, 9 bp, Unknown
  misc_feature (1)..( 9): Result.002 file - promoters60/1032752
gaaaaaatt

SEQ ID NO: 104325 - DNA, 9 bp, Unknown
  misc_feature (1)..( 9): Result.002 file - promoters60/1032752
ctaaaaatg

SEQ ID NO: 104326 - DNA, 12 bp, Unknown
  misc_feature (1)..( 12): Result.002 file - promoters60/1032752
cttttctatttg

SEQ ID NO: 104327 - DNA, 12 bp, Unknown
  misc_feature (1)..( 12): Result.002 file - promoters60/1032752
aaacactaattg

SEQ ID NO: 104328 - DNA, 12 bp, Unknown
  misc_feature (1)..( 12): Result.002 file - promoters60/1032752
cttttgtatttt

SEQ ID NO: 104329 - DNA, 12 bp, Unknown
  misc_feature (1)..( 12): Result.002 file - promoters60/1032752
tttttgtcaacg

SEQ ID NO: 104330 - DNA, 9 bp, Unknown
  misc_feature (1)..( 9): Result.002 file - promoters60/1032752
aatttattc

SEQ ID NO: 104331 - DNA, 9 bp, Unknown
  misc_feature (1)..( 9): Result.002 file - promoters60/1032752
aatatatta

SEQ ID NO: 104332 - DNA, 9 bp, Unknown
  misc_feature (1)..( 9): Result.002 file - promoters60/1032752
gatttatac

SEQ ID NO: 104333 - DNA, 9 bp, Unknown
  misc_feature (1)..( 9): Result.002 file - promoters60/1032752
catttatca

SEQ ID NO: 104334 - DNA, 9 bp, Unknown
  misc_feature (1)..( 9): Result.002 file - promoters60/1032752
tatgtatat

SEQ ID NO: 104335 - DNA, 9 bp, Unknown
  misc_feature (1)..( 9): Result.002 file - promoters60/1032752
cattaatca

SEQ ID NO: 104336 - DNA, 18 bp, Unknown
  misc_feature (1)..( 18): Result.002 file - promoters60/1032752
ggtacactcattaatcat

SEQ ID NO: 104337 - DNA, 18 bp, Unknown
  misc_feature (1)..( 18): Result.002 file - promoters60/1032752
ttccacaaaaataatcat

SEQ ID NO: 104338 - DNA, 18 bp, Unknown
  misc_feature (1)..( 18): Result.002 file - promoters60/1032752
aaaaaagaaagtaatcga

SEQ ID NO: 104339 - DNA, 18 bp, Unknown
  misc_feature (1)..( 18): Result.002 file - promoters60/1032752
atcatcacaaagaatcca

SEQ ID NO: 104340 - DNA, 18 bp, Unknown
  misc_feature (1)..( 18): Result.002 file - promoters60/1032752
aaaaaaaaaattaatact

SEQ ID NO: 104341 - DNA, 11 bp, Unknown
  misc_feature (1)..( 11): Result.002 file - promoters60/1032752
attgtcttttc

SEQ ID NO: 104342 - DNA, 11 bp, Unknown
  misc_feature (1)..( 11): Result.002 file - promoters60/1032752
tttgtattttt

SEQ ID NO: 104343 - DNA, 11 bp, Unknown
  misc_feature (1)..( 11): Result.002 file - promoters60/1032752
attgtcttatt

SEQ ID NO: 104344 - DNA, 11 bp, Unknown
  misc_feature (1)..( 11): Result.002 file - promoters60/1032752
gtcaaattttt

SEQ ID NO: 104345 - DNA, 9 bp, Unknown
  misc_feature (1)..( 9): Result.002 file - promoters60/1032752
catgaatat

SEQ ID NO: 104346 - DNA, 9 bp, Unknown
  misc_feature (1)..( 9): Result.002 file - promoters60/1032752
aatgaatta

SEQ ID NO: 104347 - DNA, 9 bp, Unknown
  misc_feature (1)..( 9): Result.002 file - promoters60/1032752
tatgtatat

SEQ ID NO: 104348 - DNA, 9 bp, Unknown
  misc_feature (1)..( 9): Result.002 file - promoters60/1032752
cattaatca

SEQ ID NO: 104349 - DNA, 9 bp, Unknown
  misc_feature (1)..( 9): Result.002 file - promoters60/1032752
catttatca

SEQ ID NO: 104350 - DNA, 9 bp, Unknown
  misc_feature (1)..( 9): Result.002 file - promoters60/1032752
aaagaaagt

SEQ ID NO: 104351 - DNA, 9 bp, Unknown
  misc_feature (1)..( 9): Result.002 file - promoters60/1032752
aaaaaaaaa

SEQ ID NO: 104352 - DNA, 9 bp, Unknown
  misc_feature (1)..( 9): Result.002 file - promoters60/1032752
aaagaaagt

SEQ ID NO: 104353 - DNA, 9 bp, Unknown
  misc_feature (1)..( 9): Result.002 file - promoters60/1032752
aaagaatcc

SEQ ID NO: 104354 - DNA, 10 bp, Unknown
  misc_feature (1)..( 10): Result.002 file - promoters60/1032752
aaaaataatc

SEQ ID NO: 104355 - DNA, 10 bp, Unknown
  misc_feature (1)..( 10): Result.002 file - promoters60/1032752
aaaaattaat

SEQ ID NO: 104356 - DNA, 10 bp, Unknown
  misc_feature (1)..( 10): Result.002 file - promoters60/1032752
gaaagtaatc

SEQ ID NO: 104357 - DNA, 10 bp, Unknown
  misc_feature (1)..( 10): Result.002 file - promoters60/1032752
aaaaatcagt

SEQ ID NO: 104358 - DNA, 11 bp, Unknown
  misc_feature (1)..( 11): Result.002 file - promoters60/1032752
aaatttaatga

SEQ ID NO: 104359 - DNA, 11 bp, Unknown
  misc_feature (1)..( 11): Result.002 file - promoters60/1032752
caatttaaatt

SEQ ID NO: 104360 - DNA, 11 bp, Unknown
  misc_feature (1)..( 11): Result.002 file - promoters60/1032752
gcatttaaatt

SEQ ID NO: 104361 - DNA, 11 bp, Unknown
  misc_feature (1)..( 11): Result.002 file - promoters60/1032752
aaagttagttt

SEQ ID NO: 104362 - DNA, 11 bp, Unknown
  misc_feature (1)..( 11): Result.002 file - promoters60/1032752
ggtcaaatttt

SEQ ID NO: 104363 - DNA, 11 bp, Unknown
  misc_feature (1)..( 11): Result.002 file - promoters60/1032752
atttaaattta

SEQ ID NO: 104364 - DNA, 11 bp, Unknown
  misc_feature (1)..( 11): Result.002 file - promoters60/1032752
atttaaattga

SEQ ID NO: 104365 - DNA, 11 bp, Unknown
  misc_feature (1)..( 11): Result.002 file - promoters60/1032752
aaaaaaagtta

SEQ ID NO: 104366 - DNA, 12 bp, Unknown
  misc_feature (1)..( 12): Result.002 file - promoters60/1032788
ttgagtttaggc

SEQ ID NO: 104367 - DNA, 12 bp, Unknown
  misc_feature (1)..( 12): Result.002 file - promoters60/1032788
ttaagtctagta

SEQ ID NO: 104368 - DNA, 12 bp, Unknown
  misc_feature (1)..( 12): Result.002 file - promoters60/1032788
gatagtttaaaa

SEQ ID NO: 104369 - DNA, 12 bp, Unknown
  misc_feature (1)..( 12): Result.002 file - promoters60/1032788
ataagtttcaaa

SEQ ID NO: 104370 - DNA, 12 bp, Unknown
  misc_feature (1)..( 12): Result.002 file - promoters60/1032788
acaattctaatt

SEQ ID NO: 104371 - DNA, 12 bp, Unknown
  misc_feature (1)..( 12): Result.002 file - promoters60/1032788
atatgtttatat

SEQ ID NO: 104372 - DNA, 12 bp, Unknown
  misc_feature (1)..( 12): Result.002 file - promoters60/1032788
tgaagtatcatc

SEQ ID NO: 104373 - DNA, 9 bp, Unknown
  misc_feature (1)..( 9): Result.002 file - promoters60/1032788
aaaaataaa

SEQ ID NO: 104374 - DNA, 9 bp, Unknown
  misc_feature (1)..( 9): Result.002 file - promoters60/1032788
aaacatata

SEQ ID NO: 104375 - DNA, 9 bp, Unknown
  misc_feature (1)..( 9): Result.002 file - promoters60/1032788
aaaattaat

SEQ ID NO: 104376 - DNA, 9 bp, Unknown
  misc_feature (1)..( 9): Result.002 file - promoters60/1032788
taaaataca

SEQ ID NO: 104377 - DNA, 9 bp, Unknown
  misc_feature (1)..( 9): Result.002 file - promoters60/1032788
aaaaattta

SEQ ID NO: 104378 - DNA, 9 bp, Unknown
  misc_feature (1)..( 9): Result.002 file - promoters60/1032788
aaaaatcaa

SEQ ID NO: 104379 - DNA, 9 bp, Unknown
  misc_feature (1)..( 9): Result.002 file - promoters60/1032788
taacatagg

SEQ ID NO: 104380 - DNA, 9 bp, Unknown
  misc_feature (1)..( 9): Result.002 file - promoters60/1032788
gataatatt

SEQ ID NO: 104381 - DNA, 11 bp, Unknown
  misc_feature (1)..( 11): Result.002 file - promoters60/1032788
aataaataaaa

SEQ ID NO: 104382 - DNA, 11 bp, Unknown
  misc_feature (1)..( 11): Result.002 file - promoters60/1032788
tttaattaaac

SEQ ID NO: 104383 - DNA, 11 bp, Unknown
  misc_feature (1)..( 11): Result.002 file - promoters60/1032788
aaacaataaaa

SEQ ID NO: 104384 - DNA, 11 bp, Unknown
  misc_feature (1)..( 11): Result.002 file - promoters60/1032788
acattataaaa

SEQ ID NO: 104385 - DNA, 11 bp, Unknown
  misc_feature (1)..( 11): Result.002 file - promoters60/1032788
tttcatttcca

SEQ ID NO: 104386 - DNA, 11 bp, Unknown
  misc_feature (1)..( 11): Result.002 file - promoters60/1032788
aaaaaatcaaa

SEQ ID NO: 104387 - DNA, 12 bp, Unknown
  misc_feature (1)..( 12): Result.002 file - promoters60/1032788
aaaatttacaaa

SEQ ID NO: 104388 - DNA, 10 bp, Unknown
  misc_feature (1)..( 10): Result.002 file - promoters60/1032788
atattattag

SEQ ID NO: 104389 - DNA, 10 bp, Unknown
  misc_feature (1)..( 10): Result.002 file - promoters60/1032788
atattaataa

SEQ ID NO: 104390 - DNA, 10 bp, Unknown
  misc_feature (1)..( 10): Result.002 file - promoters60/1032788
atattattag

SEQ ID NO: 104391 - DNA, 10 bp, Unknown
  misc_feature (1)..( 10): Result.002 file - promoters60/1032788
atataattat

SEQ ID NO: 104392 - DNA, 10 bp, Unknown
  misc_feature (1)..( 10): Result.002 file - promoters60/1032788
ttattatatt

SEQ ID NO: 104393 - DNA, 10 bp, Unknown
  misc_feature (1)..( 10): Result.002 file - promoters60/1032788
atattaacac

SEQ ID NO: 104394 - DNA, 10 bp, Unknown
  misc_feature (1)..( 10): Result.002 file - promoters60/1032788
atataactaa

SEQ ID NO: 104395 - DNA, 11 bp, Unknown
  misc_feature (1)..( 11): Result.002 file - promoters60/1032788
gtttgtttaac

SEQ ID NO: 104396 - DNA, 11 bp, Unknown
  misc_feature (1)..( 11): Result.002 file - promoters60/1032788
atttatttact

SEQ ID NO: 104397 - DNA, 11 bp, Unknown
  misc_feature (1)..( 11): Result.002 file - promoters60/1032788
ttttatttctt

SEQ ID NO: 104398 - DNA, 11 bp, Unknown
  misc_feature (1)..( 11): Result.002 file - promoters60/1032788
ttttgtttctg

SEQ ID NO: 104399 - DNA, 11 bp, Unknown
  misc_feature (1)..( 11): Result.002 file - promoters60/1032788
atttttttcac

SEQ ID NO: 104400 - DNA, 11 bp, Unknown
  misc_feature (1)..( 11): Result.002 file - promoters60/1032788
ttttctttcaa

SEQ ID NO: 104401 - DNA, 11 bp, Unknown
  misc_feature (1)..( 11): Result.002 file - promoters60/1032788
gaagcttccaa

SEQ ID NO: 104402 - DNA, 11 bp, Unknown
  misc_feature (1)..( 11): Result.002 file - promoters60/1032788
ttttattttta

SEQ ID NO: 104403 - DNA, 12 bp, Unknown
  misc_feature (1)..( 12): Result.002 file - promoters60/1032788
aaattaaaatca

SEQ ID NO: 104404 - DNA, 12 bp, Unknown
  misc_feature (1)..( 12): Result.002 file - promoters60/1032788
gaatgaaaaaaa

SEQ ID NO: 104405 - DNA, 12 bp, Unknown
  misc_feature (1)..( 12): Result.002 file - promoters60/1032788
ccgttaaaaatc

SEQ ID NO: 104406 - DNA, 12 bp, Unknown
  misc_feature (1)..( 12): Result.002 file - promoters60/1032788
ctcagaaaaaca

SEQ ID NO: 104407 - DNA, 12 bp, Unknown
  misc_feature (1)..( 12): Result.002 file - promoters60/1032788
aaatcaaatagt

SEQ ID NO: 104408 - DNA, 12 bp, Unknown
  misc_feature (1)..( 12): Result.002 file - promoters60/1032788
ttaataaaccaa

SEQ ID NO: 104409 - DNA, 12 bp, Unknown
  misc_feature (1)..( 12): Result.002 file - promoters60/1032788
cgtttaaataag

SEQ ID NO: 104410 - DNA, 10 bp, Unknown
  misc_feature (1)..( 10): Result.002 file - promoters60/1032788
aaaatattaa

SEQ ID NO: 104411 - DNA, 10 bp, Unknown
  misc_feature (1)..( 10): Result.002 file - promoters60/1032788
taaaaattaa

SEQ ID NO: 104412 - DNA, 10 bp, Unknown
  misc_feature (1)..( 10): Result.002 file - promoters60/1032788
caaatattgc

SEQ ID NO: 104413 - DNA, 10 bp, Unknown
  misc_feature (1)..( 10): Result.002 file - promoters60/1032788
taacaattct

SEQ ID NO: 104414 - DNA, 10 bp, Unknown
  misc_feature (1)..( 10): Result.002 file - promoters60/1032788
ccaaaattca

SEQ ID NO: 104415 - DNA, 10 bp, Unknown
  misc_feature (1)..( 10): Result.002 file - promoters60/1032788
gtaaaatttc

SEQ ID NO: 104416 - DNA, 8 bp, Unknown
  misc_feature (1)..( 8): Result.002 file - promoters60/1032788
aaaacaaa

SEQ ID NO: 104417 - DNA, 8 bp, Unknown
  misc_feature (1)..( 8): Result.002 file - promoters60/1032788
taaataaa

SEQ ID NO: 104418 - DNA, 8 bp, Unknown
  misc_feature (1)..( 8): Result.002 file - promoters60/1032788
taaaaaaa

SEQ ID NO: 104419 - DNA, 8 bp, Unknown
  misc_feature (1)..( 8): Result.002 file - promoters60/1032788
aaaacaat

SEQ ID NO: 104420 - DNA, 8 bp, Unknown
  misc_feature (1)..( 8): Result.002 file - promoters60/1032788
caaacaaa

SEQ ID NO: 104421 - DNA, 8 bp, Unknown
  misc_feature (1)..( 8): Result.002 file - promoters60/1032788
tatatatt

SEQ ID NO: 104422 - DNA, 8 bp, Unknown
  misc_feature (1)..( 8): Result.002 file - promoters60/1032788
aatattaa

SEQ ID NO: 104423 - DNA, 10 bp, Unknown
  misc_feature (1)..( 10): Result.002 file - promoters60/1032788
tgaaaaacaa

SEQ ID NO: 104424 - DNA, 10 bp, Unknown
  misc_feature (1)..( 10): Result.002 file - promoters60/1032788
agaaaaaata

SEQ ID NO: 104425 - DNA, 10 bp, Unknown
  misc_feature (1)..( 10): Result.002 file - promoters60/1032788
tgaaaatctc

SEQ ID NO: 104426 - DNA, 10 bp, Unknown
  misc_feature (1)..( 10): Result.002 file - promoters60/1032788
ttaaaaaata

SEQ ID NO: 104427 - DNA, 10 bp, Unknown
  misc_feature (1)..( 10): Result.002 file - promoters60/1032788
ccaaaatata

SEQ ID NO: 104428 - DNA, 10 bp, Unknown
  misc_feature (1)..( 10): Result.002 file - promoters60/1032788
caaaacaatt

SEQ ID NO: 104429 - DNA, 9 bp, Unknown
  misc_feature (1)..( 9): Result.002 file - promoters60/1032788
atatagtat

SEQ ID NO: 104430 - DNA, 9 bp, Unknown
  misc_feature (1)..( 9): Result.002 file - promoters60/1032788
atatcgtaa

SEQ ID NO: 104431 - DNA, 9 bp, Unknown
  misc_feature (1)..( 9): Result.002 file - promoters60/1032788
atacagtag

SEQ ID NO: 104432 - DNA, 9 bp, Unknown
  misc_feature (1)..( 9): Result.002 file - promoters60/1032788
agataatat

SEQ ID NO: 104433 - DNA, 9 bp, Unknown
  misc_feature (1)..( 9): Result.002 file - promoters60/1032788
aaaaaatca

SEQ ID NO: 104434 - DNA, 9 bp, Unknown
  misc_feature (1)..( 9): Result.002 file - promoters60/1032788
aaaaaaccc

SEQ ID NO: 104435 - DNA, 10 bp, Unknown
  misc_feature (1)..( 10): Result.002 file - promoters60/1032815
gaagattcta

SEQ ID NO: 104436 - DNA, 10 bp, Unknown
  misc_feature (1)..( 10): Result.002 file - promoters60/1032815
gaagtttcta

SEQ ID NO: 104437 - DNA, 10 bp, Unknown
  misc_feature (1)..( 10): Result.002 file - promoters60/1032815
tcagtttcat

SEQ ID NO: 104438 - DNA, 6 bp, Unknown
  misc_feature (1)..( 6): Result.002 file - promoters60/1032844
aatcgt

SEQ ID NO: 104439 - DNA, 6 bp, Unknown
  misc_feature (1)..( 6): Result.002 file - promoters60/1032844
aatcgt

SEQ ID NO: 104440 - DNA, 6 bp, Unknown
  misc_feature (1)..( 6): Result.002 file - promoters60/1032844
aatcgt

SEQ ID NO: 104441 - DNA, 9 bp, Unknown
  misc_feature (1)..( 9): Result.002 file - promoters60/1032844
taagattgg

SEQ ID NO: 104442 - DNA, 9 bp, Unknown
  misc_feature (1)..( 9): Result.002 file - promoters60/1032844
taatattgg

SEQ ID NO: 104443 - DNA, 7 bp, Unknown
  misc_feature (1)..( 7): Result.002 file - promoters60/1032844
ataaaaa

SEQ ID NO: 104444 - DNA, 7 bp, Unknown
  misc_feature (1)..( 7): Result.002 file - promoters60/1032844
ataaaaa

SEQ ID NO: 104445 - DNA, 7 bp, Unknown
  misc_feature (1)..( 7): Result.002 file - promoters60/1032844
agaagct

SEQ ID NO: 104446 - DNA, 7 bp, Unknown
  misc_feature (1)..( 7): Result.002 file - promoters60/1032844
agaagct

SEQ ID NO: 104447 - DNA, 15 bp, Unknown
  misc_feature (1)..( 15): Result.002 file - promoters60/1032844
ttaatatatattact

SEQ ID NO: 104448 - DNA, 15 bp, Unknown
  misc_feature (1)..( 15): Result.002 file - promoters60/1032844
ttaatatatattact

SEQ ID NO: 104449 - DNA, 6 bp, Unknown
  misc_feature (1)..( 6): Result.002 file - promoters60/1032844
ttttaa

SEQ ID NO: 104450 - DNA, 6 bp, Unknown
  misc_feature (1)..( 6): Result.002 file - promoters60/1032844
ttttaa

SEQ ID NO: 104451 - DNA, 7 bp, Unknown
  misc_feature (1)..( 7): Result.002 file - promoters60/1032844
actcaaa

SEQ ID NO: 104452 - DNA, 7 bp, Unknown
  misc_feature (1)..( 7): Result.002 file - promoters60/1032844
actcaaa

SEQ ID NO: 104453 - DNA, 7 bp, Unknown
  misc_feature (1)..( 7): Result.002 file - promoters60/1032844
tttggtt

SEQ ID NO: 104454 - DNA, 7 bp, Unknown
  misc_feature (1)..( 7): Result.002 file - promoters60/1032844
tttagtt

SEQ ID NO: 104455 - DNA, 9 bp, Unknown
  misc_feature (1)..( 9): Result.002 file - promoters60/1032844
agcccaata

SEQ ID NO: 104456 - DNA, 9 bp, Unknown
  misc_feature (1)..( 9): Result.002 file - promoters60/1032844
agcccaata

SEQ ID NO: 104457 - DNA, 6 bp, Unknown
  misc_feature (1)..( 6): Result.002 file - promoters60/1032844
agccca

SEQ ID NO: 104458 - DNA, 6 bp, Unknown
  misc_feature (1)..( 6): Result.002 file - promoters60/1032844
agccca

SEQ ID NO: 104459 - DNA, 8 bp, Unknown
  misc_feature (1)..( 8): Result.002 file - promoters60/1032844
tcatcatc

SEQ ID NO: 104460 - DNA, 8 bp, Unknown
  misc_feature (1)..( 8): Result.002 file - promoters60/1032844
tcatcatc

SEQ ID NO: 104461 - DNA, 8 bp, Unknown
  misc_feature (1)..( 8): Result.002 file - promoters60/1032844
aagtggta

SEQ ID NO: 104462 - DNA, 8 bp, Unknown
  misc_feature (1)..( 8): Result.002 file - promoters60/1032844
aagttgta

SEQ ID NO: 104463 - DNA, 7 bp, Unknown
  misc_feature (1)..( 7): Result.002 file - promoters60/1032844
gctcatt

SEQ ID NO: 104464 - DNA, 7 bp, Unknown
  misc_feature (1)..( 7): Result.002 file - promoters60/1032844
gctgatt

SEQ ID NO: 104465 - DNA, 14 bp, Unknown
  misc_feature (1)..( 14): Result.002 file - promoters60/1032897
agacttaaaatcta

SEQ ID NO: 104466 - DNA, 14 bp, Unknown
  misc_feature (1)..( 14): Result.002 file - promoters60/1032897
agaattaaaatcaa

SEQ ID NO: 104467 - DNA, 14 bp, Unknown
  misc_feature (1)..( 14): Result.002 file - promoters60/1032897
cttgttacaatgtt

SEQ ID NO: 104468 - DNA, 14 bp, Unknown
  misc_feature (1)..( 14): Result.002 file - promoters60/1032897
tgctctaaaatcta

SEQ ID NO: 104469 - DNA, 14 bp, Unknown
  misc_feature (1)..( 14): Result.002 file - promoters60/1032897
agaattattttgct

SEQ ID NO: 104470 - DNA, 14 bp, Unknown
  misc_feature (1)..( 14): Result.002 file - promoters60/1032897
tcgattaaatgtgg

SEQ ID NO: 104471 - DNA, 14 bp, Unknown
  misc_feature (1)..( 14): Result.002 file - promoters60/1032897
gatactataataaa

SEQ ID NO: 104472 - DNA, 13 bp, Unknown
  misc_feature (1)..( 13): Result.002 file - promoters60/1032897
tttataaaaccct

SEQ ID NO: 104473 - DNA, 13 bp, Unknown
  misc_feature (1)..( 13): Result.002 file - promoters60/1032897
tatataaatggcc

SEQ ID NO: 104474 - DNA, 13 bp, Unknown
  misc_feature (1)..( 13): Result.002 file - promoters60/1032897
tatataaatccct

SEQ ID NO: 104475 - DNA, 13 bp, Unknown
  misc_feature (1)..( 13): Result.002 file - promoters60/1032897
atcatctcttcaa

SEQ ID NO: 104476 - DNA, 13 bp, Unknown
  misc_feature (1)..( 13): Result.002 file - promoters60/1032897
attatttaaggcc

SEQ ID NO: 104477 - DNA, 13 bp, Unknown
  misc_feature (1)..( 13): Result.002 file - promoters60/1032897
tatataaagttcc

SEQ ID NO: 104478 - DNA, 12 bp, Unknown
  misc_feature (1)..( 12): Result.002 file - promoters60/1032897
aggaggaagaag

SEQ ID NO: 104479 - DNA, 12 bp, Unknown
  misc_feature (1)..( 12): Result.002 file - promoters60/1032897
ggatagaaaaag

SEQ ID NO: 104480 - DNA, 12 bp, Unknown
  misc_feature (1)..( 12): Result.002 file - promoters60/1032897
ttatataaaata

SEQ ID NO: 104481 - DNA, 12 bp, Unknown
  misc_feature (1)..( 12): Result.002 file - promoters60/1032897
ttatatagtcaa

SEQ ID NO: 104482 - DNA, 12 bp, Unknown
  misc_feature (1)..( 12): Result.002 file - promoters60/1032897
ctatatacgcat

SEQ ID NO: 104483 - DNA, 12 bp, Unknown
  misc_feature (1)..( 12): Result.002 file - promoters60/1032897
ctatgtagatgt

SEQ ID NO: 104484 - DNA, 7 bp, Unknown
  misc_feature (1)..( 7): Result.002 file - promoters60/1032940
taaccgc

SEQ ID NO: 104485 - DNA, 7 bp, Unknown
  misc_feature (1)..( 7): Result.002 file - promoters60/1032940
taaacgc

SEQ ID NO: 104486 - DNA, 7 bp, Unknown
  misc_feature (1)..( 7): Result.002 file - promoters60/1032940
agatcca

SEQ ID NO: 104487 - DNA, 7 bp, Unknown
  misc_feature (1)..( 7): Result.002 file - promoters60/1032940
agaccca

SEQ ID NO: 104488 - DNA, 7 bp, Unknown
  misc_feature (1)..( 7): Result.002 file - promoters60/1032940
aaagtaa

SEQ ID NO: 104489 - DNA, 7 bp, Unknown
  misc_feature (1)..( 7): Result.002 file - promoters60/1032940
aaattaa

SEQ ID NO: 104490 - DNA, 6 bp, Unknown
  misc_feature (1)..( 6): Result.002 file - promoters60/1032940
aataaa

SEQ ID NO: 104491 - DNA, 6 bp, Unknown
  misc_feature (1)..( 6): Result.002 file - promoters60/1032940
aataaa

SEQ ID NO: 104492 - DNA, 7 bp, Unknown
  misc_feature (1)..( 7): Result.002 file - promoters60/1032940
tttaaaa

SEQ ID NO: 104493 - DNA, 7 bp, Unknown
  misc_feature (1)..( 7): Result.002 file - promoters60/1032940
tttaaaa

SEQ ID NO: 104494 - DNA, 8 bp, Unknown
  misc_feature (1)..( 8): Result.002 file - promoters60/1032940
ttcgtaaa

SEQ ID NO: 104495 - DNA, 8 bp, Unknown
  misc_feature (1)..( 8): Result.002 file - promoters60/1032940
ttcggaaa

SEQ ID NO: 104496 - DNA, 6 bp, Unknown
  misc_feature (1)..( 6): Result.002 file - promoters60/1032940
agttgt

SEQ ID NO: 104497 - DNA, 6 bp, Unknown
  misc_feature (1)..( 6): Result.002 file - promoters60/1032940
agttgt

SEQ ID NO: 104498 - DNA, 7 bp, Unknown
  misc_feature (1)..( 7): Result.002 file - promoters60/1032940
tttagga

SEQ ID NO: 104499 - DNA, 7 bp, Unknown
  misc_feature (1)..( 7): Result.002 file - promoters60/1032940
ttttgga

SEQ ID NO: 104500 - DNA, 8 bp, Unknown
  misc_feature (1)..( 8): Result.002 file - promoters60/1032940
taacgttt

SEQ ID NO: 104501 - DNA, 8 bp, Unknown
  misc_feature (1)..( 8): Result.002 file - promoters60/1032940
taaagttt

SEQ ID NO: 104502 - DNA, 8 bp, Unknown
  misc_feature (1)..( 8): Result.002 file - promoters60/1032940
gaaacttt

SEQ ID NO: 104503 - DNA, 8 bp, Unknown
  misc_feature (1)..( 8): Result.002 file - promoters60/1032940
atataata

SEQ ID NO: 104504 - DNA, 8 bp, Unknown
  misc_feature (1)..( 8): Result.002 file - promoters60/1032940
atataata

SEQ ID NO: 104505 - DNA, 6 bp, Unknown
  misc_feature (1)..( 6): Result.002 file - promoters60/1032940
tttttt

SEQ ID NO: 104506 - DNA, 6 bp, Unknown
  misc_feature (1)..( 6): Result.002 file - promoters60/1032940
tttttt

SEQ ID NO: 104507 - DNA, 6 bp, Unknown
  misc_feature (1)..( 6): Result.002 file - promoters60/1032940
tatata

SEQ ID NO: 104508 - DNA, 6 bp, Unknown
  misc_feature (1)..( 6): Result.002 file - promoters60/1032940
tatata

SEQ ID NO: 104509 - DNA, 6 bp, Unknown
  misc_feature (1)..( 6): Result.002 file - promoters60/1032940
ttagaa

SEQ ID NO: 104510 - DNA, 6 bp, Unknown
  misc_feature (1)..( 6): Result.002 file - promoters60/1032940
ttagaa

SEQ ID NO: 104511 - DNA, 8 bp, Unknown
  misc_feature (1)..( 8): Result.002 file - promoters60/1032940
ttttgtat

SEQ ID NO: 104512 - DNA, 8 bp, Unknown
  misc_feature (1)..( 8): Result.002 file - promoters60/1032940
ttttgtat

SEQ ID NO: 104513 - DNA, 10 bp, Unknown
  misc_feature (1)..( 10): Result.002 file - promoters60/1032940
ttttaaatta

SEQ ID NO: 104514 - DNA, 10 bp, Unknown
  misc_feature (1)..( 10): Result.002 file - promoters60/1032940
ttttaaatta

SEQ ID NO: 104515 - DNA, 9 bp, Unknown
  misc_feature (1)..( 9): Result.002 file - promoters60/1032940
aatctttga

SEQ ID NO: 104516 - DNA, 9 bp, Unknown
  misc_feature (1)..( 9): Result.002 file - promoters60/1032940
aatgtttga

SEQ ID NO: 104517 - DNA, 8 bp, Unknown
  misc_feature (1)..( 8): Result.002 file - promoters60/1032940
ttaaatta

SEQ ID NO: 104518 - DNA, 8 bp, Unknown
  misc_feature (1)..( 8): Result.002 file - promoters60/1032940
ttaaatta

SEQ ID NO: 104519 - DNA, 7 bp, Unknown
  misc_feature (1)..( 7): Result.002 file - promoters60/1032940
tttgtta

SEQ ID NO: 104520 - DNA, 7 bp, Unknown
  misc_feature (1)..( 7): Result.002 file - promoters60/1032940
tttttta

SEQ ID NO: 104521 - DNA, 9 bp, Unknown
  misc_feature (1)..( 9): Result.002 file - promoters60/1032940
aattaaaat

SEQ ID NO: 104522 - DNA, 9 bp, Unknown
  misc_feature (1)..( 9): Result.002 file - promoters60/1032940
aatttaaat

SEQ ID NO: 104523 - DNA, 6 bp, Unknown
  misc_feature (1)..( 6): Result.002 file - promoters60/1032940
tcaatt

SEQ ID NO: 104524 - DNA, 6 bp, Unknown
  misc_feature (1)..( 6): Result.002 file - promoters60/1032940
tcaatt

SEQ ID NO: 104525 - DNA, 7 bp, Unknown
  misc_feature (1)..( 7): Result.002 file - promoters60/1032940
aaataca

SEQ ID NO: 104526 - DNA, 7 bp, Unknown
  misc_feature (1)..( 7): Result.002 file - promoters60/1032940
aaataca

SEQ ID NO: 104527 - DNA, 8 bp, Unknown
  misc_feature (1)..( 8): Result.002 file - promoters60/1032940
taaataca

SEQ ID NO: 104528 - DNA, 8 bp, Unknown
  misc_feature (1)..( 8): Result.002 file - promoters60/1032940
taaataca

SEQ ID NO: 104529 - DNA, 9 bp, Unknown
  misc_feature (1)..( 9): Result.002 file - promoters60/1032940
caatttaaa

SEQ ID NO: 104530 - DNA, 9 bp, Unknown
  misc_feature (1)..( 9): Result.002 file - promoters60/1032940
caatttaaa

SEQ ID NO: 104531 - DNA, 10 bp, Unknown
  misc_feature (1)..( 10): Result.002 file - promoters60/1032940
atataatata

SEQ ID NO: 104532 - DNA, 10 bp, Unknown
  misc_feature (1)..( 10): Result.002 file - promoters60/1032940
atataaaata

SEQ ID NO: 104533 - DNA, 11 bp, Unknown
  misc_feature (1)..( 11): Result.002 file - promoters60/1033164
ctttatttgat

SEQ ID NO: 104534 - DNA, 11 bp, Unknown
  misc_feature (1)..( 11): Result.002 file - promoters60/1033164
ctttattcgat

SEQ ID NO: 104535 - DNA, 11 bp, Unknown
  misc_feature (1)..( 11): Result.002 file - promoters60/1033164
gttgatttacc

SEQ ID NO: 104536 - DNA, 7 bp, Unknown
  misc_feature (1)..( 7): Result.002 file - promoters60/1033164
cgaaaga

SEQ ID NO: 104537 - DNA, 7 bp, Unknown
  misc_feature (1)..( 7): Result.002 file - promoters60/1033164
cgagaga

SEQ ID NO: 104538 - DNA, 7 bp, Unknown
  misc_feature (1)..( 7): Result.002 file - promoters60/1033164
ggagaga

SEQ ID NO: 104539 - DNA, 10 bp, Unknown
  misc_feature (1)..( 10): Result.002 file - promoters60/1033184
acttaatctt

SEQ ID NO: 104540 - DNA, 10 bp, Unknown
  misc_feature (1)..( 10): Result.002 file - promoters60/1033184
acttaattct

SEQ ID NO: 104541 - DNA, 10 bp, Unknown
  misc_feature (1)..( 10): Result.002 file - promoters60/1033184
acttaacaaa

SEQ ID NO: 104542 - DNA, 10 bp, Unknown
  misc_feature (1)..( 10): Result.002 file - promoters60/1033184
acttgattca

SEQ ID NO: 104543 - DNA, 10 bp, Unknown
  misc_feature (1)..( 10): Result.002 file - promoters60/1033184
tcttggttca

SEQ ID NO: 104544 - DNA, 10 bp, Unknown
  misc_feature (1)..( 10): Result.002 file - promoters60/1033184
actaaacgga

SEQ ID NO: 104545 - DNA, 15 bp, Unknown
  misc_feature (1)..( 15): Result.002 file - promoters60/1033184
gggtttaagtcttaa

SEQ ID NO: 104546 - DNA, 15 bp, Unknown
  misc_feature (1)..( 15): Result.002 file - promoters60/1033184
ttatttaaggcccaa

SEQ ID NO: 104547 - DNA, 15 bp, Unknown
  misc_feature (1)..( 15): Result.002 file - promoters60/1033184
ctattaaagccgcat

SEQ ID NO: 104548 - DNA, 15 bp, Unknown
  misc_feature (1)..( 15): Result.002 file - promoters60/1033184
ttatataaatccttc

SEQ ID NO: 104549 - DNA, 15 bp, Unknown
  misc_feature (1)..( 15): Result.002 file - promoters60/1033184
ttatattcttcgttc

SEQ ID NO: 104550 - DNA, 15 bp, Unknown
  misc_feature (1)..( 15): Result.002 file - promoters60/1033184
tactataaattcttc

SEQ ID NO: 104551 - DNA, 16 bp, Unknown
  misc_feature (1)..( 16): Result.002 file - promoters60/1033184
ttttttttttttttac

SEQ ID NO: 104552 - DNA, 16 bp, Unknown
  misc_feature (1)..( 16): Result.002 file - promoters60/1033184
aatagatttttgttaa

SEQ ID NO: 104553 - DNA, 16 bp, Unknown
  misc_feature (1)..( 16): Result.002 file - promoters60/1033184
tcgattatgtttttac

SEQ ID NO: 104554 - DNA, 16 bp, Unknown
  misc_feature (1)..( 16): Result.002 file - promoters60/1033184
tcgattgtgttcttag

SEQ ID NO: 104555 - DNA, 16 bp, Unknown
  misc_feature (1)..( 16): Result.002 file - promoters60/1033184
attccaaagttcaatt

SEQ ID NO: 104556 - DNA, 16 bp, Unknown
  misc_feature (1)..( 16): Result.002 file - promoters60/1033184
atgatctacttcttat

SEQ ID NO: 104557 - DNA, 9 bp, Unknown
  misc_feature (1)..( 9): Result.002 file - promoters60/1033208
aaacgtttg

SEQ ID NO: 104558 - DNA, 9 bp, Unknown
  misc_feature (1)..( 9): Result.002 file - promoters60/1033208
taacttttg

SEQ ID NO: 104559 - DNA, 9 bp, Unknown
  misc_feature (1)..( 9): Result.002 file - promoters60/1033208
taaatttta

SEQ ID NO: 104560 - DNA, 7 bp, Unknown
  misc_feature (1)..( 7): Result.002 file - promoters60/1033208
ttaacaa

SEQ ID NO: 104561 - DNA, 7 bp, Unknown
  misc_feature (1)..( 7): Result.002 file - promoters60/1033208
ctaacaa

SEQ ID NO: 104562 - DNA, 7 bp, Unknown
  misc_feature (1)..( 7): Result.002 file - promoters60/1033208
ttagcaa

SEQ ID NO: 104563 - DNA, 11 bp, Unknown
  misc_feature (1)..( 11): Result.002 file - promoters60/1033208
ttgggaaatgt

SEQ ID NO: 104564 - DNA, 11 bp, Unknown
  misc_feature (1)..( 11): Result.002 file - promoters60/1033208
atggaaaatgt

SEQ ID NO: 104565 - DNA, 11 bp, Unknown
  misc_feature (1)..( 11): Result.002 file - promoters60/1033208
ttggaaaatat

SEQ ID NO: 104566 - DNA, 11 bp, Unknown
  misc_feature (1)..( 11): Result.002 file - promoters60/1033208
cccatttgcta

SEQ ID NO: 104567 - DNA, 11 bp, Unknown
  misc_feature (1)..( 11): Result.002 file - promoters60/1033208
ccctttttttt

SEQ ID NO: 104568 - DNA, 11 bp, Unknown
  misc_feature (1)..( 11): Result.002 file - promoters60/1033208
aactttttaaa

SEQ ID NO: 104569 - DNA, 11 bp, Unknown
  misc_feature (1)..( 11): Result.002 file - promoters60/1033208
taatttttaaa

SEQ ID NO: 104570 - DNA, 10 bp, Unknown
  misc_feature (1)..( 10): Result.002 file - promoters60/1033208
aagaaaatct

SEQ ID NO: 104571 - DNA, 10 bp, Unknown
  misc_feature (1)..( 10): Result.002 file - promoters60/1033208
aagtaaatga

SEQ ID NO: 104572 - DNA, 10 bp, Unknown
  misc_feature (1)..( 10): Result.002 file - promoters60/1033208
tcttaaatga

SEQ ID NO: 104573 - DNA, 7 bp, Unknown
  misc_feature (1)..( 7): Result.002 file - promoters60/1033217
aagatga

SEQ ID NO: 104574 - DNA, 7 bp, Unknown
  misc_feature (1)..( 7): Result.002 file - promoters60/1033217
aagatga

SEQ ID NO: 104575 - DNA, 6 bp, Unknown
  misc_feature (1)..( 6): Result.002 file - promoters60/1033217
tgaaga

SEQ ID NO: 104576 - DNA, 6 bp, Unknown
  misc_feature (1)..( 6): Result.002 file - promoters60/1033217
tgaaga

SEQ ID NO: 104577 - DNA, 7 bp, Unknown
  misc_feature (1)..( 7): Result.002 file - promoters60/1033217
tatcaac

SEQ ID NO: 104578 - DNA, 7 bp, Unknown
  misc_feature (1)..( 7): Result.002 file - promoters60/1033217
tatgaac

SEQ ID NO: 104579 - DNA, 6 bp, Unknown
  misc_feature (1)..( 6): Result.002 file - promoters60/1033217
ggggaa

SEQ ID NO: 104580 - DNA, 6 bp, Unknown
  misc_feature (1)..( 6): Result.002 file - promoters60/1033217
ggggaa

SEQ ID NO: 104581 - DNA, 6 bp, Unknown
  misc_feature (1)..( 6): Result.002 file - promoters60/1033217
ttgaag

SEQ ID NO: 104582 - DNA, 6 bp, Unknown
  misc_feature (1)..( 6): Result.002 file - promoters60/1033217
ttgaag

SEQ ID NO: 104583 - DNA, 7 bp, Unknown
  misc_feature (1)..( 7): Result.002 file - promoters60/1033217
tatttta

SEQ ID NO: 104584 - DNA, 7 bp, Unknown
  misc_feature (1)..( 7): Result.002 file - promoters60/1033217
tatttta

SEQ ID NO: 104585 - DNA, 7 bp, Unknown
  misc_feature (1)..( 7): Result.002 file - promoters60/1033217
aaaaaaa

SEQ ID NO: 104586 - DNA, 7 bp, Unknown
  misc_feature (1)..( 7): Result.002 file - promoters60/1033217
aaaaaaa

SEQ ID NO: 104587 - DNA, 6 bp, Unknown
  misc_feature (1)..( 6): Result.002 file - promoters60/1033217
taaaaa

SEQ ID NO: 104588 - DNA, 6 bp, Unknown
  misc_feature (1)..( 6): Result.002 file - promoters60/1033217
taaaaa

SEQ ID NO: 104589 - DNA, 6 bp, Unknown
  misc_feature (1)..( 6): Result.002 file - promoters60/1033217
aaaaca

SEQ ID NO: 104590 - DNA, 6 bp, Unknown
  misc_feature (1)..( 6): Result.002 file - promoters60/1033217
aaaaca

SEQ ID NO: 104591 - DNA, 6 bp, Unknown
  misc_feature (1)..( 6): Result.002 file - promoters60/1033217
acaaac

SEQ ID NO: 104592 - DNA, 6 bp, Unknown
  misc_feature (1)..( 6): Result.002 file - promoters60/1033217
acaaac

SEQ ID NO: 104593 - DNA, 7 bp, Unknown
  misc_feature (1)..( 7): Result.002 file - promoters60/1033217
atgttga

SEQ ID NO: 104594 - DNA, 7 bp, Unknown
  misc_feature (1)..( 7): Result.002 file - promoters60/1033217
atgatga

SEQ ID NO: 104595 - DNA, 8 bp, Unknown
  misc_feature (1)..( 8): Result.002 file - promoters60/1033217
attgtttt

SEQ ID NO: 104596 - DNA, 8 bp, Unknown
  misc_feature (1)..( 8): Result.002 file - promoters60/1033217
attttttt

SEQ ID NO: 104597 - DNA, 8 bp, Unknown
  misc_feature (1)..( 8): Result.002 file - promoters60/1033217
tgattatt

SEQ ID NO: 104598 - DNA, 8 bp, Unknown
  misc_feature (1)..( 8): Result.002 file - promoters60/1033217
tgagtatt

SEQ ID NO: 104599 - DNA, 8 bp, Unknown
  misc_feature (1)..( 8): Result.002 file - promoters60/1033217
aagatgat

SEQ ID NO: 104600 - DNA, 8 bp, Unknown
  misc_feature (1)..( 8): Result.002 file - promoters60/1033217
aagaggat

SEQ ID NO: 104601 - DNA, 10 bp, Unknown
  misc_feature (1)..( 10): Result.002 file - promoters60/1033217
tttatttata

SEQ ID NO: 104602 - DNA, 10 bp, Unknown
  misc_feature (1)..( 10): Result.002 file - promoters60/1033217
tttttttata

SEQ ID NO: 104603 - DNA, 7 bp, Unknown
  misc_feature (1)..( 7): Result.002 file - promoters60/1033217
tcttaaa

SEQ ID NO: 104604 - DNA, 7 bp, Unknown
  misc_feature (1)..( 7): Result.002 file - promoters60/1033217
tctaaaa

SEQ ID NO: 104605 - DNA, 11 bp, Unknown
  misc_feature (1)..( 11): Result.002 file - promoters60/1033262
agttgaattta

SEQ ID NO: 104606 - DNA, 11 bp, Unknown
  misc_feature (1)..( 11): Result.002 file - promoters60/1033262
agtggaaatta

SEQ ID NO: 104607 - DNA, 11 bp, Unknown
  misc_feature (1)..( 11): Result.002 file - promoters60/1033262
attacaattta

SEQ ID NO: 104608 - DNA, 11 bp, Unknown
  misc_feature (1)..( 11): Result.002 file - promoters60/1033262
actggcaatgt

SEQ ID NO: 104609 - DNA, 11 bp, Unknown
  misc_feature (1)..( 11): Result.002 file - promoters60/1033262
ttcctaaatta

SEQ ID NO: 104610 - DNA, 11 bp, Unknown
  misc_feature (1)..( 11): Result.002 file - promoters60/1033262
aatccaaatta

SEQ ID NO: 104611 - DNA, 13 bp, Unknown
  misc_feature (1)..( 13): Result.002 file - promoters60/1033262
tcggaacaaaatc

SEQ ID NO: 104612 - DNA, 13 bp, Unknown
  misc_feature (1)..( 13): Result.002 file - promoters60/1033262
aaagaataaatat

SEQ ID NO: 104613 - DNA, 13 bp, Unknown
  misc_feature (1)..( 13): Result.002 file - promoters60/1033262
tagaaacaaaatc

SEQ ID NO: 104614 - DNA, 13 bp, Unknown
  misc_feature (1)..( 13): Result.002 file - promoters60/1033262
acagaaaaaaaga

SEQ ID NO: 104615 - DNA, 13 bp, Unknown
  misc_feature (1)..( 13): Result.002 file - promoters60/1033262
tagcaacaagtat

SEQ ID NO: 104616 - DNA, 13 bp, Unknown
  misc_feature (1)..( 13): Result.002 file - promoters60/1033262
taaacataaaagc

SEQ ID NO: 104617 - DNA, 14 bp, Unknown
  misc_feature (1)..( 14): Result.002 file - promoters60/1033262
cctttataaaaccc

SEQ ID NO: 104618 - DNA, 14 bp, Unknown
  misc_feature (1)..( 14): Result.002 file - promoters60/1033262
gaaatataaattag

SEQ ID NO: 104619 - DNA, 14 bp, Unknown
  misc_feature (1)..( 14): Result.002 file - promoters60/1033262
ggcctataaaatgc

SEQ ID NO: 104620 - DNA, 14 bp, Unknown
  misc_feature (1)..( 14): Result.002 file - promoters60/1033262
cccttataaaaatc

SEQ ID NO: 104621 - DNA, 14 bp, Unknown
  misc_feature (1)..( 14): Result.002 file - promoters60/1033262
taacaataaagatc

SEQ ID NO: 104622 - DNA, 14 bp, Unknown
  misc_feature (1)..( 14): Result.002 file - promoters60/1033262
cccatatatatata

SEQ ID NO: 104623 - DNA, 14 bp, Unknown
  misc_feature (1)..( 14): Result.002 file - promoters60/1033360
gggccaaagtatct

SEQ ID NO: 104624 - DNA, 14 bp, Unknown
  misc_feature (1)..( 14): Result.002 file - promoters60/1033360
tttttaaattatta

SEQ ID NO: 104625 - DNA, 14 bp, Unknown
  misc_feature (1)..( 14): Result.002 file - promoters60/1033360
tgtttaaataatta

SEQ ID NO: 104626 - DNA, 14 bp, Unknown
  misc_feature (1)..( 14): Result.002 file - promoters60/1033360
atagtaaatgaagc

SEQ ID NO: 104627 - DNA, 14 bp, Unknown
  misc_feature (1)..( 14): Result.002 file - promoters60/1033360
tgtgtaaagctgta

SEQ ID NO: 104628 - DNA, 11 bp, Unknown
  misc_feature (1)..( 11): Result.002 file - promoters60/1033360
taaaatttcac

SEQ ID NO: 104629 - DNA, 11 bp, Unknown
  misc_feature (1)..( 11): Result.002 file - promoters60/1033360
taaattttaca

SEQ ID NO: 104630 - DNA, 11 bp, Unknown
  misc_feature (1)..( 11): Result.002 file - promoters60/1033360
acaattttttg

SEQ ID NO: 104631 - DNA, 11 bp, Unknown
  misc_feature (1)..( 11): Result.002 file - promoters60/1033360
ttaattttaat

SEQ ID NO: 104632 - DNA, 11 bp, Unknown
  misc_feature (1)..( 11): Result.002 file - promoters60/1033360
aagatttgttg

SEQ ID NO: 104633 - DNA, 16 bp, Unknown
  misc_feature (1)..( 16): Result.002 file - promoters60/1033360
atgtgatattaattac

SEQ ID NO: 104634 - DNA, 16 bp, Unknown
  misc_feature (1)..( 16): Result.002 file - promoters60/1033360
gagatacattgattac

SEQ ID NO: 104635 - DNA, 16 bp, Unknown
  misc_feature (1)..( 16): Result.002 file - promoters60/1033360
atgagatagtaaatga

SEQ ID NO: 104636 - DNA, 16 bp, Unknown
  misc_feature (1)..( 16): Result.002 file - promoters60/1033360
tcctcttatcaattca

SEQ ID NO: 104637 - DNA, 16 bp, Unknown
  misc_feature (1)..( 16): Result.002 file - promoters60/1033360
caaatttagtaagcgg

SEQ ID NO: 104638 - DNA, 8 bp, Unknown
  misc_feature (1)..( 8): Result.002 file - promoters60/1033360
agtgattt

SEQ ID NO: 104639 - DNA, 8 bp, Unknown
  misc_feature (1)..( 8): Result.002 file - promoters60/1033360
gttgattt

SEQ ID NO: 104640 - DNA, 8 bp, Unknown
  misc_feature (1)..( 8): Result.002 file - promoters60/1033360
attggttt

SEQ ID NO: 104641 - DNA, 8 bp, Unknown
  misc_feature (1)..( 8): Result.002 file - promoters60/1033360
gtttattc

SEQ ID NO: 104642 - DNA, 8 bp, Unknown
  misc_feature (1)..( 8): Result.002 file - promoters60/1033360
atttgttt

SEQ ID NO: 104643 - DNA, 12 bp, Unknown
  misc_feature (1)..( 12): Result.002 file - promoters60/1033360
tattattttgaa

SEQ ID NO: 104644 - DNA, 12 bp, Unknown
  misc_feature (1)..( 12): Result.002 file - promoters60/1033360
tagcattatgat

SEQ ID NO: 104645 - DNA, 12 bp, Unknown
  misc_feature (1)..( 12): Result.002 file - promoters60/1033360
gtttatttttta

SEQ ID NO: 104646 - DNA, 12 bp, Unknown
  misc_feature (1)..( 12): Result.002 file - promoters60/1033360
gttgattttctt

SEQ ID NO: 104647 - DNA, 12 bp, Unknown
  misc_feature (1)..( 12): Result.002 file - promoters60/1033360
gtttattcatgt

SEQ ID NO: 104648 - DNA, 12 bp, Unknown
  misc_feature (1)..( 12): Result.002 file - promoters60/1033360
ttgttttaggat

SEQ ID NO: 104649 - DNA, 14 bp, Unknown
  misc_feature (1)..( 14): Result.002 file - promoters60/1033360
taacaataaatttt

SEQ ID NO: 104650 - DNA, 14 bp, Unknown
  misc_feature (1)..( 14): Result.002 file - promoters60/1033360
gcttaataaatctg

SEQ ID NO: 104651 - DNA, 14 bp, Unknown
  misc_feature (1)..( 14): Result.002 file - promoters60/1033360
taagaataaacaaa

SEQ ID NO: 104652 - DNA, 14 bp, Unknown
  misc_feature (1)..( 14): Result.002 file - promoters60/1033360
ttttactaagacat

SEQ ID NO: 104653 - DNA, 14 bp, Unknown
  misc_feature (1)..( 14): Result.002 file - promoters60/1033360
cctgtgtaaagctg

SEQ ID NO: 104654 - DNA, 11 bp, Unknown
  misc_feature (1)..( 11): Result.002 file - promoters60/1033430
cttttggtaaa

SEQ ID NO: 104655 - DNA, 11 bp, Unknown
  misc_feature (1)..( 11): Result.002 file - promoters60/1033430
cttttgttttt

SEQ ID NO: 104656 - DNA, 11 bp, Unknown
  misc_feature (1)..( 11): Result.002 file - promoters60/1033430
gatttggtttt

SEQ ID NO: 104657 - DNA, 11 bp, Unknown
  misc_feature (1)..( 11): Result.002 file - promoters60/1033430
gtcttggttgg

SEQ ID NO: 104658 - DNA, 7 bp, Unknown
  misc_feature (1)..( 7): Result.002 file - promoters60/1033430
ttacttt

SEQ ID NO: 104659 - DNA, 7 bp, Unknown
  misc_feature (1)..( 7): Result.002 file - promoters60/1033430
ttaattt

SEQ ID NO: 104660 - DNA, 7 bp, Unknown
  misc_feature (1)..( 7): Result.002 file - promoters60/1033430
ataattt

SEQ ID NO: 104661 - DNA, 9 bp, Unknown
  misc_feature (1)..( 9): Result.002 file - promoters60/1033430
tttggtaaa

SEQ ID NO: 104662 - DNA, 9 bp, Unknown
  misc_feature (1)..( 9): Result.002 file - promoters60/1033430
tttggtttt

SEQ ID NO: 104663 - DNA, 9 bp, Unknown
  misc_feature (1)..( 9): Result.002 file - promoters60/1033430
ttttgtttt

SEQ ID NO: 104664 - DNA, 9 bp, Unknown
  misc_feature (1)..( 9): Result.002 file - promoters60/1033430
cttggttgg

SEQ ID NO: 104665 - DNA, 7 bp, Unknown
  misc_feature (1)..( 7): Result.002 file - promoters60/1033430
tttataa

SEQ ID NO: 104666 - DNA, 7 bp, Unknown
  misc_feature (1)..( 7): Result.002 file - promoters60/1033430
gttataa

SEQ ID NO: 104667 - DNA, 7 bp, Unknown
  misc_feature (1)..( 7): Result.002 file - promoters60/1033430
gttttaa

SEQ ID NO: 104668 - DNA, 9 bp, Unknown
  misc_feature (1)..( 9): Result.002 file - promoters60/1033430
taattttca

SEQ ID NO: 104669 - DNA, 9 bp, Unknown
  misc_feature (1)..( 9): Result.002 file - promoters60/1033430
taaatttct

SEQ ID NO: 104670 - DNA, 9 bp, Unknown
  misc_feature (1)..( 9): Result.002 file - promoters60/1033430
ggtatttct

SEQ ID NO: 104671 - DNA, 13 bp, Unknown
  misc_feature (1)..( 13): Result.002 file - promoters60/1033430
ccgattcaattcc

SEQ ID NO: 104672 - DNA, 13 bp, Unknown
  misc_feature (1)..( 13): Result.002 file - promoters60/1033430
ttgattcaaaatt

SEQ ID NO: 104673 - DNA, 13 bp, Unknown
  misc_feature (1)..( 13): Result.002 file - promoters60/1033430
ttgaatcaatatt

SEQ ID NO: 104674 - DNA, 8 bp, Unknown
  misc_feature (1)..( 8): Result.002 file - promoters60/1033430
ttttgtct

SEQ ID NO: 104675 - DNA, 8 bp, Unknown
  misc_feature (1)..( 8): Result.002 file - promoters60/1033430
atttctct

SEQ ID NO: 104676 - DNA, 8 bp, Unknown
  misc_feature (1)..( 8): Result.002 file - promoters60/1033430
atttctgc

SEQ ID NO: 104677 - DNA, 13 bp, Unknown
  misc_feature (1)..( 13): Result.002 file - promoters60/1033430
ttggatcaacaat

SEQ ID NO: 104678 - DNA, 13 bp, Unknown
  misc_feature (1)..( 13): Result.002 file - promoters60/1033430
ttgaatcaatatt

SEQ ID NO: 104679 - DNA, 13 bp, Unknown
  misc_feature (1)..( 13): Result.002 file - promoters60/1033430
ttgattcaaaatt

SEQ ID NO: 104680 - DNA, 6 bp, Unknown
  misc_feature (1)..( 6): Result.002 file - promoters60/1033430
tggatt

SEQ ID NO: 104681 - DNA, 6 bp, Unknown
  misc_feature (1)..( 6): Result.002 file - promoters60/1033430
tggatt

SEQ ID NO: 104682 - DNA, 6 bp, Unknown
  misc_feature (1)..( 6): Result.002 file - promoters60/1033430
tggatt

SEQ ID NO: 104683 - DNA, 13 bp, Unknown
  misc_feature (1)..( 13): Result.002 file - promoters60/1033430
tttaggaaaaatt

SEQ ID NO: 104684 - DNA, 13 bp, Unknown
  misc_feature (1)..( 13): Result.002 file - promoters60/1033430
ttgattcaaaatt

SEQ ID NO: 104685 - DNA, 13 bp, Unknown
  misc_feature (1)..( 13): Result.002 file - promoters60/1033430
ttgaatcaatatt

SEQ ID NO: 104686 - DNA, 6 bp, Unknown
  misc_feature (1)..( 6): Result.002 file - promoters60/1033526
ttgaag

SEQ ID NO: 104687 - DNA, 6 bp, Unknown
  misc_feature (1)..( 6): Result.002 file - promoters60/1033526
ttgaag

SEQ ID NO: 104688 - DNA, 6 bp, Unknown
  misc_feature (1)..( 6): Result.002 file - promoters60/1033526
acgagc

SEQ ID NO: 104689 - DNA, 6 bp, Unknown
  misc_feature (1)..( 6): Result.002 file - promoters60/1033526
acgagc

SEQ ID NO: 104690 - DNA, 8 bp, Unknown
  misc_feature (1)..( 8): Result.002 file - promoters60/1033526
cttacttt

SEQ ID NO: 104691 - DNA, 8 bp, Unknown
  misc_feature (1)..( 8): Result.002 file - promoters60/1033526
ctttcttt

SEQ ID NO: 104692 - DNA, 7 bp, Unknown
  misc_feature (1)..( 7): Result.002 file - promoters60/1033526
cttttgt

SEQ ID NO: 104693 - DNA, 7 bp, Unknown
  misc_feature (1)..( 7): Result.002 file - promoters60/1033526
cttttgt

SEQ ID NO: 104694 - DNA, 10 bp, Unknown
  misc_feature (1)..( 10): Result.002 file - promoters60/1033526
ttgtttctct

SEQ ID NO: 104695 - DNA, 10 bp, Unknown
  misc_feature (1)..( 10): Result.002 file - promoters60/1033526
ttgtttgtct

SEQ ID NO: 104696 - DNA, 7 bp, Unknown
  misc_feature (1)..( 7): Result.002 file - promoters60/1033526
acttact

SEQ ID NO: 104697 - DNA, 7 bp, Unknown
  misc_feature (1)..( 7): Result.002 file - promoters60/1033526
actgact

SEQ ID NO: 104698 - DNA, 7 bp, Unknown
  misc_feature (1)..( 7): Result.002 file - promoters60/1033526
agattat

SEQ ID NO: 104699 - DNA, 7 bp, Unknown
  misc_feature (1)..( 7): Result.002 file - promoters60/1033526
agattat

SEQ ID NO: 104700 - DNA, 7 bp, Unknown
  misc_feature (1)..( 7): Result.002 file - promoters60/1033526
tattatt

SEQ ID NO: 104701 - DNA, 7 bp, Unknown
  misc_feature (1)..( 7): Result.002 file - promoters60/1033526
tatgatt

SEQ ID NO: 104702 - DNA, 7 bp, Unknown
  misc_feature (1)..( 7): Result.002 file - promoters60/1033526
gcaatta

SEQ ID NO: 104703 - DNA, 7 bp, Unknown
  misc_feature (1)..( 7): Result.002 file - promoters60/1033526
gcagtta

SEQ ID NO: 104704 - DNA, 9 bp, Unknown
  misc_feature (1)..( 9): Result.002 file - promoters60/1033526
aagacaatt

SEQ ID NO: 104705 - DNA, 9 bp, Unknown
  misc_feature (1)..( 9): Result.002 file - promoters60/1033526
aagaaaatt

SEQ ID NO: 104706 - DNA, 7 bp, Unknown
  misc_feature (1)..( 7): Result.002 file - promoters60/1033526
gaccttg

SEQ ID NO: 104707 - DNA, 7 bp, Unknown
  misc_feature (1)..( 7): Result.002 file - promoters60/1033526
gacattg

SEQ ID NO: 104708 - DNA, 6 bp, Unknown
  misc_feature (1)..( 6): Result.002 file - promoters60/1033526
cttgat

SEQ ID NO: 104709 - DNA, 6 bp, Unknown
  misc_feature (1)..( 6): Result.002 file - promoters60/1033526
cttgat

SEQ ID NO: 104710 - DNA, 7 bp, Unknown
  misc_feature (1)..( 7): Result.002 file - promoters60/1033526
gaggtaa

SEQ ID NO: 104711 - DNA, 7 bp, Unknown
  misc_feature (1)..( 7): Result.002 file - promoters60/1033526
gaggtaa

SEQ ID NO: 104712 - DNA, 8 bp, Unknown
  misc_feature (1)..( 8): Result.002 file - promoters60/1033526
tcttcatt

SEQ ID NO: 104713 - DNA, 8 bp, Unknown
  misc_feature (1)..( 8): Result.002 file - promoters60/1033526
tctgcatt

SEQ ID NO: 104714 - DNA, 8 bp, Unknown
  misc_feature (1)..( 8): Result.002 file - promoters60/1033526
tttatatc

SEQ ID NO: 104715 - DNA, 8 bp, Unknown
  misc_feature (1)..( 8): Result.002 file - promoters60/1033526
tttttatc

SEQ ID NO: 104716 - DNA, 6 bp, Unknown
  misc_feature (1)..( 6): Result.002 file - promoters60/1033526
atcttc

SEQ ID NO: 104717 - DNA, 6 bp, Unknown
  misc_feature (1)..( 6): Result.002 file - promoters60/1033526
atcttc

SEQ ID NO: 104718 - DNA, 7 bp, Unknown
  misc_feature (1)..( 7): Result.002 file - promoters60/1033526
tgagatt

SEQ ID NO: 104719 - DNA, 7 bp, Unknown
  misc_feature (1)..( 7): Result.002 file - promoters60/1033526
tgatatt

SEQ ID NO: 104720 - DNA, 8 bp, Unknown
  misc_feature (1)..( 8): Result.002 file - promoters60/1033526
tatattta

SEQ ID NO: 104721 - DNA, 8 bp, Unknown
  misc_feature (1)..( 8): Result.002 file - promoters60/1033526
tatgttta

SEQ ID NO: 104722 - DNA, 6 bp, Unknown
  misc_feature (1)..( 6): Result.002 file - promoters60/1033679
gttgta

SEQ ID NO: 104723 - DNA, 6 bp, Unknown
  misc_feature (1)..( 6): Result.002 file - promoters60/1033679
gttgta

SEQ ID NO: 104724 - DNA, 6 bp, Unknown
  misc_feature (1)..( 6): Result.002 file - promoters60/1033679
aaacaa

SEQ ID NO: 104725 - DNA, 6 bp, Unknown
  misc_feature (1)..( 6): Result.002 file - promoters60/1033679
aaacaa

SEQ ID NO: 104726 - DNA, 6 bp, Unknown
  misc_feature (1)..( 6): Result.002 file - promoters60/1033679
acaatc

SEQ ID NO: 104727 - DNA, 6 bp, Unknown
  misc_feature (1)..( 6): Result.002 file - promoters60/1033679
acaatc

SEQ ID NO: 104728 - DNA, 7 bp, Unknown
  misc_feature (1)..( 7): Result.002 file - promoters60/1033679
ctatttc

SEQ ID NO: 104729 - DNA, 7 bp, Unknown
  misc_feature (1)..( 7): Result.002 file - promoters60/1033679
ctagttc

SEQ ID NO: 104730 - DNA, 6 bp, Unknown
  misc_feature (1)..( 6): Result.002 file - promoters60/1033679
gcgttt

SEQ ID NO: 104731 - DNA, 6 bp, Unknown
  misc_feature (1)..( 6): Result.002 file - promoters60/1033679
gcgttt

SEQ ID NO: 104732 - DNA, 8 bp, Unknown
  misc_feature (1)..( 8): Result.002 file - promoters60/1033679
gtaaaaat

SEQ ID NO: 104733 - DNA, 8 bp, Unknown
  misc_feature (1)..( 8): Result.002 file - promoters60/1033679
gtaaaaat

SEQ ID NO: 104734 - DNA, 7 bp, Unknown
  misc_feature (1)..( 7): Result.002 file - promoters60/1033679
acattgt

SEQ ID NO: 104735 - DNA, 7 bp, Unknown
  misc_feature (1)..( 7): Result.002 file - promoters60/1033679
acattgt

SEQ ID NO: 104736 - DNA, 6 bp, Unknown
  misc_feature (1)..( 6): Result.002 file - promoters60/1033679
caaaaa

SEQ ID NO: 104737 - DNA, 6 bp, Unknown
  misc_feature (1)..( 6): Result.002 file - promoters60/1033679
caaaaa

SEQ ID NO: 104738 - DNA, 8 bp, Unknown
  misc_feature (1)..( 8): Result.002 file - promoters60/1033679
ttgttcta

SEQ ID NO: 104739 - DNA, 8 bp, Unknown
  misc_feature (1)..( 8): Result.002 file - promoters60/1033679
ttgttcta

SEQ ID NO: 104740 - DNA, 6 bp, Unknown
  misc_feature (1)..( 6): Result.002 file - promoters60/1033679
aaaaac

SEQ ID NO: 104741 - DNA, 6 bp, Unknown
  misc_feature (1)..( 6): Result.002 file - promoters60/1033679
aaaaac

SEQ ID NO: 104742 - DNA, 6 bp, Unknown
  misc_feature (1)..( 6): Result.002 file - promoters60/1033679
ttaaaa

SEQ ID NO: 104743 - DNA, 6 bp, Unknown
  misc_feature (1)..( 6): Result.002 file - promoters60/1033679
ttaaaa

SEQ ID NO: 104744 - DNA, 7 bp, Unknown
  misc_feature (1)..( 7): Result.002 file - promoters60/1033679
agtattc

SEQ ID NO: 104745 - DNA, 7 bp, Unknown
  misc_feature (1)..( 7): Result.002 file - promoters60/1033679
agttttc

SEQ ID NO: 104746 - DNA, 6 bp, Unknown
  misc_feature (1)..( 6): Result.002 file - promoters60/1033679
aatgga

SEQ ID NO: 104747 - DNA, 6 bp, Unknown
  misc_feature (1)..( 6): Result.002 file - promoters60/1033679
aatgga

SEQ ID NO: 104748 - DNA, 6 bp, Unknown
  misc_feature (1)..( 6): Result.002 file - promoters60/1033679
ttcata

SEQ ID NO: 104749 - DNA, 6 bp, Unknown
  misc_feature (1)..( 6): Result.002 file - promoters60/1033679
ttcata

SEQ ID NO: 104750 - DNA, 6 bp, Unknown
  misc_feature (1)..( 6): Result.002 file - promoters60/1033679
cccaat

SEQ ID NO: 104751 - DNA, 6 bp, Unknown
  misc_feature (1)..( 6): Result.002 file - promoters60/1033679
cccaat

SEQ ID NO: 104752 - DNA, 6 bp, Unknown
  misc_feature (1)..( 6): Result.002 file - promoters60/1033679
ttacgt

SEQ ID NO: 104753 - DNA, 6 bp, Unknown
  misc_feature (1)..( 6): Result.002 file - promoters60/1033679
ttacgt

SEQ ID NO: 104754 - DNA, 6 bp, Unknown
  misc_feature (1)..( 6): Result.002 file - promoters60/1033716
ttaaaa

SEQ ID NO: 104755 - DNA, 6 bp, Unknown
  misc_feature (1)..( 6): Result.002 file - promoters60/1033716
ttaaaa

SEQ ID NO: 104756 - DNA, 6 bp, Unknown
  misc_feature (1)..( 6): Result.002 file - promoters60/1033716
aaaaga

SEQ ID NO: 104757 - DNA, 6 bp, Unknown
  misc_feature (1)..( 6): Result.002 file - promoters60/1033716
aaaaga

SEQ ID NO: 104758 - DNA, 6 bp, Unknown
  misc_feature (1)..( 6): Result.002 file - promoters60/1033716
aaaacg

SEQ ID NO: 104759 - DNA, 6 bp, Unknown
  misc_feature (1)..( 6): Result.002 file - promoters60/1033716
aaaacg

SEQ ID NO: 104760 - DNA, 8 bp, Unknown
  misc_feature (1)..( 8): Result.002 file - promoters60/1033716
gtattaac

SEQ ID NO: 104761 - DNA, 8 bp, Unknown
  misc_feature (1)..( 8): Result.002 file - promoters60/1033716
gtagtaac

SEQ ID NO: 104762 - DNA, 6 bp, Unknown
  misc_feature (1)..( 6): Result.002 file - promoters60/1033716
agatga

SEQ ID NO: 104763 - DNA, 6 bp, Unknown
  misc_feature (1)..( 6): Result.002 file - promoters60/1033716
agatga

SEQ ID NO: 104764 - DNA, 10 bp, Unknown
  misc_feature (1)..( 10): Result.002 file - promoters60/1033716
aaaagtaaaa

SEQ ID NO: 104765 - DNA, 10 bp, Unknown
  misc_feature (1)..( 10): Result.002 file - promoters60/1033716
aaaagaaaaa

SEQ ID NO: 104766 - DNA, 7 bp, Unknown
  misc_feature (1)..( 7): Result.002 file - promoters60/1033716
agattct

SEQ ID NO: 104767 - DNA, 7 bp, Unknown
  misc_feature (1)..( 7): Result.002 file - promoters60/1033716
agattct

SEQ ID NO: 104768 - DNA, 8 bp, Unknown
  misc_feature (1)..( 8): Result.002 file - promoters60/1033716
ctcagagc

SEQ ID NO: 104769 - DNA, 8 bp, Unknown
  misc_feature (1)..( 8): Result.002 file - promoters60/1033716
ctcaaagc

SEQ ID NO: 104770 - DNA, 6 bp, Unknown
  misc_feature (1)..( 6): Result.002 file - promoters60/1033716
attatc

SEQ ID NO: 104771 - DNA, 6 bp, Unknown
  misc_feature (1)..( 6): Result.002 file - promoters60/1033716
attatc

SEQ ID NO: 104772 - DNA, 9 bp, Unknown
  misc_feature (1)..( 9): Result.002 file - promoters60/1033716
tatttaaaa

SEQ ID NO: 104773 - DNA, 9 bp, Unknown
  misc_feature (1)..( 9): Result.002 file - promoters60/1033716
tattgaaaa

SEQ ID NO: 104774 - DNA, 8 bp, Unknown
  misc_feature (1)..( 8): Result.002 file - promoters60/1033716
aaaacgac

SEQ ID NO: 104775 - DNA, 8 bp, Unknown
  misc_feature (1)..( 8): Result.002 file - promoters60/1033716
aaaacgac

SEQ ID NO: 104776 - DNA, 9 bp, Unknown
  misc_feature (1)..( 9): Result.002 file - promoters60/1033716
gggtaagag

SEQ ID NO: 104777 - DNA, 9 bp, Unknown
  misc_feature (1)..( 9): Result.002 file - promoters60/1033716
gggtaagag

SEQ ID NO: 104778 - DNA, 8 bp, Unknown
  misc_feature (1)..( 8): Result.002 file - promoters60/1033716
aatcgaat

SEQ ID NO: 104779 - DNA, 8 bp, Unknown
  misc_feature (1)..( 8): Result.002 file - promoters60/1033716
aatctaat

SEQ ID NO: 104780 - DNA, 7 bp, Unknown
  misc_feature (1)..( 7): Result.002 file - promoters60/1033716
tattggt

SEQ ID NO: 104781 - DNA, 7 bp, Unknown
  misc_feature (1)..( 7): Result.002 file - promoters60/1033716
tattggt

SEQ ID NO: 104782 - DNA, 7 bp, Unknown
  misc_feature (1)..( 7): Result.002 file - promoters60/1033716
ttctcat

SEQ ID NO: 104783 - DNA, 7 bp, Unknown
  misc_feature (1)..( 7): Result.002 file - promoters60/1033716
ttctcat

SEQ ID NO: 104784 - DNA, 10 bp, Unknown
  misc_feature (1)..( 10): Result.002 file - promoters60/1033723
atggaaatta

SEQ ID NO: 104785 - DNA, 10 bp, Unknown
  misc_feature (1)..( 10): Result.002 file - promoters60/1033723
atggtaatta

SEQ ID NO: 104786 - DNA, 7 bp, Unknown
  misc_feature (1)..( 7): Result.002 file - promoters60/1033723
gattatg

SEQ ID NO: 104787 - DNA, 7 bp, Unknown
  misc_feature (1)..( 7): Result.002 file - promoters60/1033723
gatgatg

SEQ ID NO: 104788 - DNA, 7 bp, Unknown
  misc_feature (1)..( 7): Result.002 file - promoters60/1033723
atgaaga

SEQ ID NO: 104789 - DNA, 7 bp, Unknown
  misc_feature (1)..( 7): Result.002 file - promoters60/1033723
atgaaga

SEQ ID NO: 104790 - DNA, 7 bp, Unknown
  misc_feature (1)..( 7): Result.002 file - promoters60/1033723
ctgaaga

SEQ ID NO: 104791 - DNA, 7 bp, Unknown
  misc_feature (1)..( 7): Result.002 file - promoters60/1033723
agaagga

SEQ ID NO: 104792 - DNA, 7 bp, Unknown
  misc_feature (1)..( 7): Result.002 file - promoters60/1033723
agacgga

SEQ ID NO: 104793 - DNA, 6 bp, Unknown
  misc_feature (1)..( 6): Result.002 file - promoters60/1033723
ataatt

SEQ ID NO: 104794 - DNA, 6 bp, Unknown
  misc_feature (1)..( 6): Result.002 file - promoters60/1033723
ataatt

SEQ ID NO: 104795 - DNA, 9 bp, Unknown
  misc_feature (1)..( 9): Result.002 file - promoters60/1033723
ggatctggt

SEQ ID NO: 104796 - DNA, 9 bp, Unknown
  misc_feature (1)..( 9): Result.002 file - promoters60/1033723
ggatcgggt

SEQ ID NO: 104797 - DNA, 6 bp, Unknown
  misc_feature (1)..( 6): Result.002 file - promoters60/1033723
ttcgga

SEQ ID NO: 104798 - DNA, 6 bp, Unknown
  misc_feature (1)..( 6): Result.002 file - promoters60/1033723
ttcgga

SEQ ID NO: 104799 - DNA, 6 bp, Unknown
  misc_feature (1)..( 6): Result.002 file - promoters60/1033723
cggcga

SEQ ID NO: 104800 - DNA, 6 bp, Unknown
  misc_feature (1)..( 6): Result.002 file - promoters60/1033723
cggcga

SEQ ID NO: 104801 - DNA, 8 bp, Unknown
  misc_feature (1)..( 8): Result.002 file - promoters60/1033723
ggaggatc

SEQ ID NO: 104802 - DNA, 8 bp, Unknown
  misc_feature (1)..( 8): Result.002 file - promoters60/1033723
ggaggatc

SEQ ID NO: 104803 - DNA, 11 bp, Unknown
  misc_feature (1)..( 11): Result.002 file - promoters60/1033723
gaatggagatg

SEQ ID NO: 104804 - DNA, 11 bp, Unknown
  misc_feature (1)..( 11): Result.002 file - promoters60/1033723
gaagggagatg

SEQ ID NO: 104805 - DNA, 11 bp, Unknown
  misc_feature (1)..( 11): Result.002 file - promoters60/1033781
taaagcaaaac

SEQ ID NO: 104806 - DNA, 11 bp, Unknown
  misc_feature (1)..( 11): Result.002 file - promoters60/1033781
tggagcaaata

SEQ ID NO: 104807 - DNA, 11 bp, Unknown
  misc_feature (1)..( 11): Result.002 file - promoters60/1033781
taaaacaaaaa

SEQ ID NO: 104808 - DNA, 11 bp, Unknown
  misc_feature (1)..( 11): Result.002 file - promoters60/1033781
aatcacaaaac

SEQ ID NO: 104809 - DNA, 12 bp, Unknown
  misc_feature (1)..( 12): Result.002 file - promoters60/1033781
ccaatcataaaa

SEQ ID NO: 104810 - DNA, 12 bp, Unknown
  misc_feature (1)..( 12): Result.002 file - promoters60/1033781
agaatcattaat

SEQ ID NO: 104811 - DNA, 13 bp, Unknown
  misc_feature (1)..( 13): Result.002 file - promoters60/1033781
aggcccatattta

SEQ ID NO: 104812 - DNA, 13 bp, Unknown
  misc_feature (1)..( 13): Result.002 file - promoters60/1033781
cggcccaaattta

SEQ ID NO: 104813 - DNA, 13 bp, Unknown
  misc_feature (1)..( 13): Result.002 file - promoters60/1033781
aggcccaataaat

SEQ ID NO: 104814 - DNA, 13 bp, Unknown
  misc_feature (1)..( 13): Result.002 file - promoters60/1033781
taaaacaaattag

SEQ ID NO: 104815 - DNA, 13 bp, Unknown
  misc_feature (1)..( 13): Result.002 file - promoters60/1033781
aggcccaacaaaa

SEQ ID NO: 104816 - DNA, 13 bp, Unknown
  misc_feature (1)..( 13): Result.002 file - promoters60/1033781
aggcccaataact

SEQ ID NO: 104817 - DNA, 9 bp, Unknown
  misc_feature (1)..( 9): Result.002 file - promoters60/1033781
aaataaatt

SEQ ID NO: 104818 - DNA, 9 bp, Unknown
  misc_feature (1)..( 9): Result.002 file - promoters60/1033781
aaaaaaagt

SEQ ID NO: 104819 - DNA, 9 bp, Unknown
  misc_feature (1)..( 9): Result.002 file - promoters60/1033781
tcataaatc

SEQ ID NO: 104820 - DNA, 9 bp, Unknown
  misc_feature (1)..( 9): Result.002 file - promoters60/1033781
acataaaca

SEQ ID NO: 104821 - DNA, 9 bp, Unknown
  misc_feature (1)..( 9): Result.002 file - promoters60/1033781
tcataaaag

SEQ ID NO: 104822 - DNA, 9 bp, Unknown
  misc_feature (1)..( 9): Result.002 file - promoters60/1033781
tcattaatc

SEQ ID NO: 104823 - DNA, 12 bp, Unknown
  misc_feature (1)..( 12): Result.002 file - promoters60/1033781
taattaaactgg

SEQ ID NO: 104824 - DNA, 12 bp, Unknown
  misc_feature (1)..( 12): Result.002 file - promoters60/1033781
agattaaaaaaa

SEQ ID NO: 104825 - DNA, 12 bp, Unknown
  misc_feature (1)..( 12): Result.002 file - promoters60/1033781
taactaaattgg

SEQ ID NO: 104826 - DNA, 12 bp, Unknown
  misc_feature (1)..( 12): Result.002 file - promoters60/1033781
ctgctgaattgg

SEQ ID NO: 104827 - DNA, 12 bp, Unknown
  misc_feature (1)..( 12): Result.002 file - promoters60/1033781
cttatgatttgc

SEQ ID NO: 104828 - DNA, 12 bp, Unknown
  misc_feature (1)..( 12): Result.002 file - promoters60/1033781
ttactaaaagtt

SEQ ID NO: 104829 - DNA, 11 bp, Unknown
  misc_feature (1)..( 11): Result.002 file - promoters60/1033781
ttcaaaaaaga

SEQ ID NO: 104830 - DNA, 11 bp, Unknown
  misc_feature (1)..( 11): Result.002 file - promoters60/1033781
cttaaaaaact

SEQ ID NO: 104831 - DNA, 11 bp, Unknown
  misc_feature (1)..( 11): Result.002 file - promoters60/1033781
ttcaaaaaaaa

SEQ ID NO: 104832 - DNA, 11 bp, Unknown
  misc_feature (1)..( 11): Result.002 file - promoters60/1033781
tataataaact

SEQ ID NO: 104833 - DNA, 11 bp, Unknown
  misc_feature (1)..( 11): Result.002 file - promoters60/1033781
atcaacaaatg

SEQ ID NO: 104834 - DNA, 11 bp, Unknown
  misc_feature (1)..( 11): Result.002 file - promoters60/1033781
tgccaaaaacc

SEQ ID NO: 104835 - DNA, 14 bp, Unknown
  misc_feature (1)..( 14): Result.002 file - promoters60/1033841
caatgggctgggcc

SEQ ID NO: 104836 - DNA, 14 bp, Unknown
  misc_feature (1)..( 14): Result.002 file - promoters60/1033841
ttttgggcttctta

SEQ ID NO: 104837 - DNA, 14 bp, Unknown
  misc_feature (1)..( 14): Result.002 file - promoters60/1033841
aaataggcccaaca

SEQ ID NO: 104838 - DNA, 14 bp, Unknown
  misc_feature (1)..( 14): Result.002 file - promoters60/1033841
aattgggcttttta

SEQ ID NO: 104839 - DNA, 14 bp, Unknown
  misc_feature (1)..( 14): Result.002 file - promoters60/1033841
aattgggattattt

SEQ ID NO: 104840 - DNA, 14 bp, Unknown
  misc_feature (1)..( 14): Result.002 file - promoters60/1033841
taatgggcctttag

SEQ ID NO: 104841 - DNA, 7 bp, Unknown
  misc_feature (1)..( 7): Result.002 file - promoters60/1033849
attcact

SEQ ID NO: 104842 - DNA, 7 bp, Unknown
  misc_feature (1)..( 7): Result.002 file - promoters60/1033849
attcact

SEQ ID NO: 104843 - DNA, 6 bp, Unknown
  misc_feature (1)..( 6): Result.002 file - promoters60/1033849
taaaga

SEQ ID NO: 104844 - DNA, 6 bp, Unknown
  misc_feature (1)..( 6): Result.002 file - promoters60/1033849
taaaga

SEQ ID NO: 104845 - DNA, 11 bp, Unknown
  misc_feature (1)..( 11): Result.002 file - promoters60/1033849
acagtttataa

SEQ ID NO: 104846 - DNA, 11 bp, Unknown
  misc_feature (1)..( 11): Result.002 file - promoters60/1033849
acaatttataa

SEQ ID NO: 104847 - DNA, 7 bp, Unknown
  misc_feature (1)..( 7): Result.002 file - promoters60/1033849
gtaacta

SEQ ID NO: 104848 - DNA, 7 bp, Unknown
  misc_feature (1)..( 7): Result.002 file - promoters60/1033849
gtaacta

SEQ ID NO: 104849 - DNA, 7 bp, Unknown
  misc_feature (1)..( 7): Result.002 file - promoters60/1033849
aattttt

SEQ ID NO: 104850 - DNA, 7 bp, Unknown
  misc_feature (1)..( 7): Result.002 file - promoters60/1033849
aattttt

SEQ ID NO: 104851 - DNA, 7 bp, Unknown
  misc_feature (1)..( 7): Result.002 file - promoters60/1033849
tttgttt

SEQ ID NO: 104852 - DNA, 7 bp, Unknown
  misc_feature (1)..( 7): Result.002 file - promoters60/1033849
tttgttt

SEQ ID NO: 104853 - DNA, 7 bp, Unknown
  misc_feature (1)..( 7): Result.002 file - promoters60/1033849
tgtcaaa

SEQ ID NO: 104854 - DNA, 7 bp, Unknown
  misc_feature (1)..( 7): Result.002 file - promoters60/1033849
tgtgaaa

SEQ ID NO: 104855 - DNA, 7 bp, Unknown
  misc_feature (1)..( 7): Result.002 file - promoters60/1033849
tagtaaa

SEQ ID NO: 104856 - DNA, 7 bp, Unknown
  misc_feature (1)..( 7): Result.002 file - promoters60/1033849
tagaaaa

SEQ ID NO: 104857 - DNA, 7 bp, Unknown
  misc_feature (1)..( 7): Result.002 file - promoters60/1033849
tatgtaa

SEQ ID NO: 104858 - DNA, 7 bp, Unknown
  misc_feature (1)..( 7): Result.002 file - promoters60/1033849
tatataa

SEQ ID NO: 104859 - DNA, 8 bp, Unknown
  misc_feature (1)..( 8): Result.002 file - promoters60/1033849
atatttac

SEQ ID NO: 104860 - DNA, 8 bp, Unknown
  misc_feature (1)..( 8): Result.002 file - promoters60/1033849
atatatac

SEQ ID NO: 104861 - DNA, 6 bp, Unknown
  misc_feature (1)..( 6): Result.002 file - promoters60/1033849
tagata

SEQ ID NO: 104862 - DNA, 6 bp, Unknown
  misc_feature (1)..( 6): Result.002 file - promoters60/1033849
tagata

SEQ ID NO: 104863 - DNA, 7 bp, Unknown
  misc_feature (1)..( 7): Result.002 file - promoters60/1033849
caaaaat

SEQ ID NO: 104864 - DNA, 7 bp, Unknown
  misc_feature (1)..( 7): Result.002 file - promoters60/1033849
caaaaag

SEQ ID NO: 104865 - DNA, 7 bp, Unknown
  misc_feature (1)..( 7): Result.002 file - promoters60/1033849
gaaaaag

SEQ ID NO: 104866 - DNA, 6 bp, Unknown
  misc_feature (1)..( 6): Result.002 file - promoters60/1033849
gcaata

SEQ ID NO: 104867 - DNA, 6 bp, Unknown
  misc_feature (1)..( 6): Result.002 file - promoters60/1033849
gcaata

SEQ ID NO: 104868 - DNA, 7 bp, Unknown
  misc_feature (1)..( 7): Result.002 file - promoters60/1033849
aaactat

SEQ ID NO: 104869 - DNA, 7 bp, Unknown
  misc_feature (1)..( 7): Result.002 file - promoters60/1033849
aaactat

SEQ ID NO: 104870 - DNA, 6 bp, Unknown
  misc_feature (1)..( 6): Result.002 file - promoters60/1033849
aaaata

SEQ ID NO: 104871 - DNA, 6 bp, Unknown
  misc_feature (1)..( 6): Result.002 file - promoters60/1033849
aaaata

SEQ ID NO: 104872 - DNA, 13 bp, Unknown
  misc_feature (1)..( 13): Result.002 file - promoters60/1033865
aaatgctttttat

SEQ ID NO: 104873 - DNA, 13 bp, Unknown
  misc_feature (1)..( 13): Result.002 file - promoters60/1033865
aaaagctaatttt

SEQ ID NO: 104874 - DNA, 13 bp, Unknown
  misc_feature (1)..( 13): Result.002 file - promoters60/1033865
ggatgctttttaa

SEQ ID NO: 104875 - DNA, 13 bp, Unknown
  misc_feature (1)..( 13): Result.002 file - promoters60/1033865
aaaagctaatttt

SEQ ID NO: 104876 - DNA, 13 bp, Unknown
  misc_feature (1)..( 13): Result.002 file - promoters60/1033865
tatatatttttaa

SEQ ID NO: 104877 - DNA, 13 bp, Unknown
  misc_feature (1)..( 13): Result.002 file - promoters60/1033865
ggattcttacttt

SEQ ID NO: 104878 - DNA, 13 bp, Unknown
  misc_feature (1)..( 13): Result.002 file - promoters60/1033865
tgatttttttata

SEQ ID NO: 104879 - DNA, 13 bp, Unknown
  misc_feature (1)..( 13): Result.002 file - promoters60/1033865
agattctttggtg

SEQ ID NO: 104880 - DNA, 11 bp, Unknown
  misc_feature (1)..( 11): Result.002 file - promoters60/1033865
gttattgggtt

SEQ ID NO: 104881 - DNA, 11 bp, Unknown
  misc_feature (1)..( 11): Result.002 file - promoters60/1033865
atgatttggtc

SEQ ID NO: 104882 - DNA, 11 bp, Unknown
  misc_feature (1)..( 11): Result.002 file - promoters60/1033865
atgatttggtc

SEQ ID NO: 104883 - DNA, 11 bp, Unknown
  misc_feature (1)..( 11): Result.002 file - promoters60/1033865
tttgttgtgtt

SEQ ID NO: 104884 - DNA, 11 bp, Unknown
  misc_feature (1)..( 11): Result.002 file - promoters60/1033865
tgtattttttg

SEQ ID NO: 104885 - DNA, 11 bp, Unknown
  misc_feature (1)..( 11): Result.002 file - promoters60/1033865
agtttttagta

SEQ ID NO: 104886 - DNA, 12 bp, Unknown
  misc_feature (1)..( 12): Result.002 file - promoters60/1033865
atgctttttata

SEQ ID NO: 104887 - DNA, 12 bp, Unknown
  misc_feature (1)..( 12): Result.002 file - promoters60/1033865
tatatttttaaa

SEQ ID NO: 104888 - DNA, 12 bp, Unknown
  misc_feature (1)..( 12): Result.002 file - promoters60/1033865
atgctttttaac

SEQ ID NO: 104889 - DNA, 12 bp, Unknown
  misc_feature (1)..( 12): Result.002 file - promoters60/1033865
ttactttttcct

SEQ ID NO: 104890 - DNA, 12 bp, Unknown
  misc_feature (1)..( 12): Result.002 file - promoters60/1033865
gatttttttata

SEQ ID NO: 104891 - DNA, 13 bp, Unknown
  misc_feature (1)..( 13): Result.002 file - promoters60/1033865
gagattctttggt

SEQ ID NO: 104892 - DNA, 13 bp, Unknown
  misc_feature (1)..( 13): Result.002 file - promoters60/1033865
aagattctagaaa

SEQ ID NO: 104893 - DNA, 14 bp, Unknown
  misc_feature (1)..( 14): Result.002 file - promoters60/1033865
tagtaagattctag

SEQ ID NO: 104894 - DNA, 14 bp, Unknown
  misc_feature (1)..( 14): Result.002 file - promoters60/1033865
aactaggattctta

SEQ ID NO: 104895 - DNA, 14 bp, Unknown
  misc_feature (1)..( 14): Result.002 file - promoters60/1033865
aagagagattcttt

SEQ ID NO: 104896 - DNA, 14 bp, Unknown
  misc_feature (1)..( 14): Result.002 file - promoters60/1033865
tttatatattttta

SEQ ID NO: 104897 - DNA, 14 bp, Unknown
  misc_feature (1)..( 14): Result.002 file - promoters60/1033865
tttatatattttgt

SEQ ID NO: 104898 - DNA, 14 bp, Unknown
  misc_feature (1)..( 14): Result.002 file - promoters60/1033865
accatggatgcttt

SEQ ID NO: 104899 - DNA, 14 bp, Unknown
  misc_feature (1)..( 14): Result.002 file - promoters60/1033865
tagtaagattctag

SEQ ID NO: 104900 - DNA, 9 bp, Unknown
  misc_feature (1)..( 9): Result.002 file - promoters60/1034030
atattaaat

SEQ ID NO: 104901 - DNA, 9 bp, Unknown
  misc_feature (1)..( 9): Result.002 file - promoters60/1034030
tttttaaat

SEQ ID NO: 104902 - DNA, 9 bp, Unknown
  misc_feature (1)..( 9): Result.002 file - promoters60/1034030
tttttcaat

SEQ ID NO: 104903 - DNA, 12 bp, Unknown
  misc_feature (1)..( 12): Result.002 file - promoters60/1034030
tataagtcaatt

SEQ ID NO: 104904 - DNA, 12 bp, Unknown
  misc_feature (1)..( 12): Result.002 file - promoters60/1034030
tattagtaaata

SEQ ID NO: 104905 - DNA, 12 bp, Unknown
  misc_feature (1)..( 12): Result.002 file - promoters60/1034030
cttttttcaatt

SEQ ID NO: 104906 - DNA, 12 bp, Unknown
  misc_feature (1)..( 12): Result.002 file - promoters60/1034030
cattagtgaccc

SEQ ID NO: 104907 - DNA, 12 bp, Unknown
  misc_feature (1)..( 12): Result.002 file - promoters60/1034030
aaaccaaaagtt

SEQ ID NO: 104908 - DNA, 12 bp, Unknown
  misc_feature (1)..( 12): Result.002 file - promoters60/1034030
aaatcaaataag

SEQ ID NO: 104909 - DNA, 13 bp, Unknown
  misc_feature (1)..( 13): Result.002 file - promoters60/1034030
tagccacaagcgt

SEQ ID NO: 104910 - DNA, 13 bp, Unknown
  misc_feature (1)..( 13): Result.002 file - promoters60/1034030
aaagagaaagtca

SEQ ID NO: 104911 - DNA, 6 bp, Unknown
  misc_feature (1)..( 6): Result.002 file - promoters60/1034034
tttatt

SEQ ID NO: 104912 - DNA, 6 bp, Unknown
  misc_feature (1)..( 6): Result.002 file - promoters60/1034034
tttatt

SEQ ID NO: 104913 - DNA, 7 bp, Unknown
  misc_feature (1)..( 7): Result.002 file - promoters60/1034034
ttggggt

SEQ ID NO: 104914 - DNA, 7 bp, Unknown
  misc_feature (1)..( 7): Result.002 file - promoters60/1034034
ttgcggt

SEQ ID NO: 104915 - DNA, 7 bp, Unknown
  misc_feature (1)..( 7): Result.002 file - promoters60/1034034
cttctgt

SEQ ID NO: 104916 - DNA, 7 bp, Unknown
  misc_feature (1)..( 7): Result.002 file - promoters60/1034034
cttgtgt

SEQ ID NO: 104917 - DNA, 7 bp, Unknown
  misc_feature (1)..( 7): Result.002 file - promoters60/1034034
ttactcc

SEQ ID NO: 104918 - DNA, 7 bp, Unknown
  misc_feature (1)..( 7): Result.002 file - promoters60/1034034
ttattcc

SEQ ID NO: 104919 - DNA, 9 bp, Unknown
  misc_feature (1)..( 9): Result.002 file - promoters60/1034034
tttggattt

SEQ ID NO: 104920 - DNA, 9 bp, Unknown
  misc_feature (1)..( 9): Result.002 file - promoters60/1034034
tttggtttt

SEQ ID NO: 104921 - DNA, 7 bp, Unknown
  misc_feature (1)..( 7): Result.002 file - promoters60/1034034
agatatg

SEQ ID NO: 104922 - DNA, 7 bp, Unknown
  misc_feature (1)..( 7): Result.002 file - promoters60/1034034
agaaatg

SEQ ID NO: 104923 - DNA, 6 bp, Unknown
  misc_feature (1)..( 6): Result.002 file - promoters60/1034034
gagaag

SEQ ID NO: 104924 - DNA, 6 bp, Unknown
  misc_feature (1)..( 6): Result.002 file - promoters60/1034034
gagaag

SEQ ID NO: 104925 - DNA, 7 bp, Unknown
  misc_feature (1)..( 7): Result.002 file - promoters60/1034034
agaattt

SEQ ID NO: 104926 - DNA, 7 bp, Unknown
  misc_feature (1)..( 7): Result.002 file - promoters60/1034034
agagttt

SEQ ID NO: 104927 - DNA, 8 bp, Unknown
  misc_feature (1)..( 8): Result.002 file - promoters60/1034034
tcaaagat

SEQ ID NO: 104928 - DNA, 8 bp, Unknown
  misc_feature (1)..( 8): Result.002 file - promoters60/1034034
tcagagat

SEQ ID NO: 104929 - DNA, 8 bp, Unknown
  misc_feature (1)..( 8): Result.002 file - promoters60/1034034
ttcaattc

SEQ ID NO: 104930 - DNA, 8 bp, Unknown
  misc_feature (1)..( 8): Result.002 file - promoters60/1034034
ttcgattc

SEQ ID NO: 104931 - DNA, 8 bp, Unknown
  misc_feature (1)..( 8): Result.002 file - promoters60/1034034
gaacaaac

SEQ ID NO: 104932 - DNA, 8 bp, Unknown
  misc_feature (1)..( 8): Result.002 file - promoters60/1034034
gaagaaac

SEQ ID NO: 104933 - DNA, 6 bp, Unknown
  misc_feature (1)..( 6): Result.002 file - promoters60/1034034
gaatca

SEQ ID NO: 104934 - DNA, 6 bp, Unknown
  misc_feature (1)..( 6): Result.002 file - promoters60/1034034
gaatca

SEQ ID NO: 104935 - DNA, 7 bp, Unknown
  misc_feature (1)..( 7): Result.002 file - promoters60/1034034
tccggtt

SEQ ID NO: 104936 - DNA, 7 bp, Unknown
  misc_feature (1)..( 7): Result.002 file - promoters60/1034034
tccagtt

SEQ ID NO: 104937 - DNA, 6 bp, Unknown
  misc_feature (1)..( 6): Result.002 file - promoters60/1034034
tttccg

SEQ ID NO: 104938 - DNA, 6 bp, Unknown
  misc_feature (1)..( 6): Result.002 file - promoters60/1034034
tttccg

SEQ ID NO: 104939 - DNA, 6 bp, Unknown
  misc_feature (1)..( 6): Result.002 file - promoters60/1034034
ataaat

SEQ ID NO: 104940 - DNA, 6 bp, Unknown
  misc_feature (1)..( 6): Result.002 file - promoters60/1034034
ataaat

SEQ ID NO: 104941 - DNA, 6 bp, Unknown
  misc_feature (1)..( 6): Result.002 file - promoters60/1034034
aaccct

SEQ ID NO: 104942 - DNA, 6 bp, Unknown
  misc_feature (1)..( 6): Result.002 file - promoters60/1034034
aaccct

SEQ ID NO: 104943 - DNA, 6 bp, Unknown
  misc_feature (1)..( 6): Result.002 file - promoters60/1034119
aataat

SEQ ID NO: 104944 - DNA, 6 bp, Unknown
  misc_feature (1)..( 6): Result.002 file - promoters60/1034119
aataat

SEQ ID NO: 104945 - DNA, 11 bp, Unknown
  misc_feature (1)..( 11): Result.002 file - promoters60/1034119
ataataataat

SEQ ID NO: 104946 - DNA, 11 bp, Unknown
  misc_feature (1)..( 11): Result.002 file - promoters60/1034119
ataataataat

SEQ ID NO: 104947 - DNA, 7 bp, Unknown
  misc_feature (1)..( 7): Result.002 file - promoters60/1034119
atcgtca

SEQ ID NO: 104948 - DNA, 7 bp, Unknown
  misc_feature (1)..( 7): Result.002 file - promoters60/1034119
atcttca

SEQ ID NO: 104949 - DNA, 10 bp, Unknown
  misc_feature (1)..( 10): Result.002 file - promoters60/1034119
aacatgaggc

SEQ ID NO: 104950 - DNA, 10 bp, Unknown
  misc_feature (1)..( 10): Result.002 file - promoters60/1034119
aacataaggc

SEQ ID NO: 104951 - DNA, 6 bp, Unknown
  misc_feature (1)..( 6): Result.002 file - promoters60/1034119
aattta

SEQ ID NO: 104952 - DNA, 6 bp, Unknown
  misc_feature (1)..( 6): Result.002 file - promoters60/1034119
aattta

SEQ ID NO: 104953 - DNA, 6 bp, Unknown
  misc_feature (1)..( 6): Result.002 file - promoters60/1034119
tttatt

SEQ ID NO: 104954 - DNA, 6 bp, Unknown
  misc_feature (1)..( 6): Result.002 file - promoters60/1034119
tttatt

SEQ ID NO: 104955 - DNA, 7 bp, Unknown
  misc_feature (1)..( 7): Result.002 file - promoters60/1034119
tatgtta

SEQ ID NO: 104956 - DNA, 7 bp, Unknown
  misc_feature (1)..( 7): Result.002 file - promoters60/1034119
tatttta

SEQ ID NO: 104957 - DNA, 6 bp, Unknown
  misc_feature (1)..( 6): Result.002 file - promoters60/1034119
taaaaa

SEQ ID NO: 104958 - DNA, 6 bp, Unknown
  misc_feature (1)..( 6): Result.002 file - promoters60/1034119
taaaaa

SEQ ID NO: 104959 - DNA, 6 bp, Unknown
  misc_feature (1)..( 6): Result.002 file - promoters60/1034119
tataaa

SEQ ID NO: 104960 - DNA, 6 bp, Unknown
  misc_feature (1)..( 6): Result.002 file - promoters60/1034119
tataaa

SEQ ID NO: 104961 - DNA, 10 bp, Unknown
  misc_feature (1)..( 10): Result.002 file - promoters60/1034137
ataaagaaag

SEQ ID NO: 104962 - DNA, 10 bp, Unknown
  misc_feature (1)..( 10): Result.002 file - promoters60/1034137
ttaaaaaaaa

SEQ ID NO: 104963 - DNA, 10 bp, Unknown
  misc_feature (1)..( 10): Result.002 file - promoters60/1034137
aaaaaaaaaa

SEQ ID NO: 104964 - DNA, 10 bp, Unknown
  misc_feature (1)..( 10): Result.002 file - promoters60/1034137
caaaacaaaa

SEQ ID NO: 104965 - DNA, 10 bp, Unknown
  misc_feature (1)..( 10): Result.002 file - promoters60/1034137
ttaaaaaagg

SEQ ID NO: 104966 - DNA, 11 bp, Unknown
  misc_feature (1)..( 11): Result.002 file - promoters60/1034137
acaaagggata

SEQ ID NO: 104967 - DNA, 11 bp, Unknown
  misc_feature (1)..( 11): Result.002 file - promoters60/1034137
ataaatggaaa

SEQ ID NO: 104968 - DNA, 11 bp, Unknown
  misc_feature (1)..( 11): Result.002 file - promoters60/1034137
atatatgtgat

SEQ ID NO: 104969 - DNA, 11 bp, Unknown
  misc_feature (1)..( 11): Result.002 file - promoters60/1034137
caaaatggaaa

SEQ ID NO: 104970 - DNA, 34 bp, Unknown; identical to SEQ ID NO: 76977
  misc_feature (1)..( 34): Result.002 file - promoters60/1034137

SEQ ID NO: 104971 - DNA, 34 bp, Unknown
  misc_feature (1)..( 34): Result.002 file - promoters60/1034137
tgggatttataaataatagtctacaatcaagaaa

SEQ ID NO: 104972 - DNA, 34 bp, Unknown
  misc_feature (1)..( 34): Result.002 file - promoters60/1034137
tcagttttataaaaaaggcttcaaggccgagagt

SEQ ID NO: 104973 - DNA, 34 bp, Unknown; identical to SEQ ID NO: 76979
  misc_feature (1)..( 34): Result.002 file - promoters60/1034137

SEQ ID NO: 104974 - DNA, 8 bp, Unknown
  misc_feature (1)..( 8): Result.002 file - promoters60/1034145
taataagt

SEQ ID NO: 104975 - DNA, 8 bp, Unknown
  misc_feature (1)..( 8): Result.002 file - promoters60/1034145
taaaaagt

SEQ ID NO: 104976 - DNA, 8 bp, Unknown
  misc_feature (1)..( 8): Result.002 file - promoters60/1034145
taataagt

SEQ ID NO: 104977 - DNA, 6 bp, Unknown
  misc_feature (1)..( 6): Result.002 file - promoters60/1034145
atatcc

SEQ ID NO: 104978 - DNA, 6 bp, Unknown
  misc_feature (1)..( 6): Result.002 file - promoters60/1034145
atatcc

SEQ ID NO: 104979 - DNA, 8 bp, Unknown
  misc_feature (1)..( 8): Result.002 file - promoters60/1034145
tctatatt

SEQ ID NO: 104980 - DNA, 8 bp, Unknown
  misc_feature (1)..( 8): Result.002 file - promoters60/1034145
cctatata

SEQ ID NO: 104981 - DNA, 8 bp, Unknown
  misc_feature (1)..( 8): Result.002 file - promoters60/1034145
tgtatata

SEQ ID NO: 104982 - DNA, 7 bp, Unknown
  misc_feature (1)..( 7): Result.002 file - promoters60/1034145
aaaaaat

SEQ ID NO: 104983 - DNA, 7 bp, Unknown
  misc_feature (1)..( 7): Result.002 file - promoters60/1034145
aaacaat

SEQ ID NO: 104984 - DNA, 9 bp, Unknown
  misc_feature (1)..( 9): Result.002 file - promoters60/1034145
aaagagagt

SEQ ID NO: 104985 - DNA, 9 bp, Unknown
  misc_feature (1)..( 9): Result.002 file - promoters60/1034145
aaagagagt

SEQ ID NO: 104986 - DNA, 6 bp, Unknown
  misc_feature (1)..( 6): Result.002 file - promoters60/1034145
ctttat

SEQ ID NO: 104987 - DNA, 6 bp, Unknown
  misc_feature (1)..( 6): Result.002 file - promoters60/1034145
ctttat

SEQ ID NO: 104988 - DNA, 10 bp, Unknown
  misc_feature (1)..( 10): Result.002 file - promoters60/1034145
ctaatatgaa

SEQ ID NO: 104989 - DNA, 10 bp, Unknown
  misc_feature (1)..( 10): Result.002 file - promoters60/1034145
ctaatttgaa

SEQ ID NO: 104990 - DNA, 10 bp, Unknown
  misc_feature (1)..( 10): Result.002 file - promoters60/1034145
aaaatatgaa

SEQ ID NO: 104991 - DNA, 7 bp, Unknown
  misc_feature (1)..( 7): Result.002 file - promoters60/1034145
tctagca

SEQ ID NO: 104992 - DNA, 7 bp, Unknown
  misc_feature (1)..( 7): Result.002 file - promoters60/1034145
tctagca

SEQ ID NO: 104993 - DNA, 7 bp, Unknown
  misc_feature (1)..( 7): Result.002 file - promoters60/1034145
aaatgag

SEQ ID NO: 104994 - DNA, 7 bp, Unknown
  misc_feature (1)..( 7): Result.002 file - promoters60/1034145
aaaagag

SEQ ID NO: 104995 - DNA, 6 bp, Unknown
  misc_feature (1)..( 6): Result.002 file - promoters60/1034145
agcctt

SEQ ID NO: 104996 - DNA, 6 bp, Unknown
  misc_feature (1)..( 6): Result.002 file - promoters60/1034145
agcctt

SEQ ID NO: 104997 - DNA, 7 bp, Unknown
  misc_feature (1)..( 7): Result.002 file - promoters60/1034145
gagcaaa

SEQ ID NO: 104998 - DNA, 7 bp, Unknown
  misc_feature (1)..( 7): Result.002 file - promoters60/1034145
gaggaaa

SEQ ID NO: 104999 - DNA, 7 bp, Unknown
  misc_feature (1)..( 7): Result.002 file - promoters60/1034145
ttgttgt

SEQ ID NO: 105000 - DNA, 7 bp, Unknown
  misc_feature (1)..( 7): Result.002 file - promoters60/1034145
ttgttgt

SEQ ID NO: 105001 - DNA, 9 bp, Unknown
  misc_feature (1)..( 9): Result.002 file - promoters60/1034145
ttgaatttt

SEQ ID NO: 105002 - DNA, 9 bp, Unknown
  misc_feature (1)..( 9): Result.002 file - promoters60/1034145
ttgtatttt

SEQ ID NO: 105003 - DNA, 6 bp, Unknown
  misc_feature (1)..( 6): Result.002 file - promoters60/1034145
ttttga

SEQ ID NO: 105004 - DNA, 6 bp, Unknown
  misc_feature (1)..( 6): Result.002 file - promoters60/1034145
ttttga

SEQ ID NO: 105005 - DNA, 8 bp, Unknown
  misc_feature (1)..( 8): Result.002 file - promoters60/1034145
aagagatt

SEQ ID NO: 105006 - DNA, 8 bp, Unknown
  misc_feature (1)..( 8): Result.002 file - promoters60/1034145
aagatatt

SEQ ID NO: 105007 - DNA, 6 bp, Unknown
  misc_feature (1)..( 6): Result.002 file - promoters60/1034145
taaaaa

SEQ ID NO: 105008 - DNA, 6 bp, Unknown
  misc_feature (1)..( 6): Result.002 file - promoters60/1034145
taaaaa

SEQ ID NO: 105009 - DNA, 11 bp, Unknown
  misc_feature (1)..( 11): Result.002 file - promoters60/1034306
gaaataaatta

SEQ ID NO: 105010 - DNA, 11 bp, Unknown
  misc_feature (1)..( 11): Result.002 file - promoters60/1034306
tgaataaattg

SEQ ID NO: 105011 - DNA, 12 bp, Unknown
  misc_feature (1)..( 12): Result.002 file - promoters60/1034306
tgaagtaaccgt

SEQ ID NO: 105012 - DNA, 12 bp, Unknown
  misc_feature (1)..( 12): Result.002 file - promoters60/1034306
cactttaaatta

SEQ ID NO: 105013 - DNA, 9 bp, Unknown
  misc_feature (1)..( 9): Result.002 file - promoters60/1034306
taaataaat

SEQ ID NO: 105014 - DNA, 9 bp, Unknown
  misc_feature (1)..( 9): Result.002 file - promoters60/1034306
taattaaaa

SEQ ID NO: 105015 - DNA, 9 bp, Unknown
  misc_feature (1)..( 9): Result.002 file - promoters60/1034306
caaataaaa

SEQ ID NO: 105016 - DNA, 9 bp, Unknown
  misc_feature (1)..( 9): Result.002 file - promoters60/1034306
actataaaa

SEQ ID NO: 105017 - DNA, 12 bp, Unknown
  misc_feature (1)..( 12): Result.002 file - promoters60/1034306
tttttttaactg

SEQ ID NO: 105018 - DNA, 12 bp, Unknown
  misc_feature (1)..( 12): Result.002 file - promoters60/1034306
ctcttttaatat

SEQ ID NO: 105019 - DNA, 12 bp, Unknown
  misc_feature (1)..( 12): Result.002 file - promoters60/1034306
attttttagtta

SEQ ID NO: 105020 - DNA, 12 bp, Unknown
  misc_feature (1)..( 12): Result.002 file - promoters60/1034306
attatttcccat

SEQ ID NO: 105021 - DNA, 12 bp, Unknown
  misc_feature (1)..( 12): Result.002 file - promoters60/1034306
ttcgtttgatat

SEQ ID NO: 105022 - DNA, 11 bp, Unknown
  misc_feature (1)..( 11): Result.002 file - promoters60/1034306
aaacatataac

SEQ ID NO: 105023 - DNA, 11 bp, Unknown
  misc_feature (1)..( 11): Result.002 file - promoters60/1034306
gactataaaac

SEQ ID NO: 105024 - DNA, 11 bp, Unknown
  misc_feature (1)..( 11): Result.002 file - promoters60/1034306
aaacaaataaa

SEQ ID NO: 105025 - DNA, 11 bp, Unknown
  misc_feature (1)..( 11): Result.002 file - promoters60/1034306
cattaaacaac

SEQ ID NO: 105026 - DNA, 9 bp, Unknown
  misc_feature (1)..( 9): Result.002 file - promoters60/1034306
atattattt

SEQ ID NO: 105027 - DNA, 9 bp, Unknown
  misc_feature (1)..( 9): Result.002 file - promoters60/1034306
acatttttt

SEQ ID NO: 105028 - DNA, 9 bp, Unknown
  misc_feature (1)..( 9): Result.002 file - promoters60/1034306
tcacgtttt

SEQ ID NO: 105029 - DNA, 9 bp, Unknown
  misc_feature (1)..( 9): Result.002 file - promoters60/1034306
acatctttg

SEQ ID NO: 105030 - DNA, 11 bp, Unknown
  misc_feature (1)..( 11): Result.002 file - promoters60/1034306
gataatctgaa

SEQ ID NO: 105031 - DNA, 11 bp, Unknown
  misc_feature (1)..( 11): Result.002 file - promoters60/1034306
tttaatatgaa

SEQ ID NO: 105032 - DNA, 11 bp, Unknown
  misc_feature (1)..( 11): Result.002 file - promoters60/1034306
tttgatatata

SEQ ID NO: 105033 - DNA, 11 bp, Unknown
  misc_feature (1)..( 11): Result.002 file - promoters60/1034306
tataatatttt

SEQ ID NO: 105034 - DNA, 9 bp, Unknown
  misc_feature (1)..( 9): Result.002 file - promoters60/1034306
gttagataa

SEQ ID NO: 105035 - DNA, 9 bp, Unknown
  misc_feature (1)..( 9): Result.002 file - promoters60/1034306
gtttgatat

SEQ ID NO: 105036 - DNA, 9 bp, Unknown
  misc_feature (1)..( 9): Result.002 file - promoters60/1034306
tttatatat

SEQ ID NO: 105037 - DNA, 9 bp, Unknown
  misc_feature (1)..( 9): Result.002 file - promoters60/1034306
ttttaatat

SEQ ID NO: 105038 - DNA, 9 bp, Unknown
  misc_feature (1)..( 9): Result.002 file - promoters60/1034322
tatatatag

SEQ ID NO: 105039 - DNA, 9 bp, Unknown
  misc_feature (1)..( 9): Result.002 file - promoters60/1034322
tatataaat

SEQ ID NO: 105040 - DNA, 9 bp, Unknown
  misc_feature (1)..( 9): Result.002 file - promoters60/1034322
tataaatat

SEQ ID NO: 105041 - DNA, 9 bp, Unknown
  misc_feature (1)..( 9): Result.002 file - promoters60/1034322
tatatattt

SEQ ID NO: 105042 - DNA, 9 bp, Unknown
  misc_feature (1)..( 9): Result.002 file - promoters60/1034322
tatacaaat

SEQ ID NO: 105043 - DNA, 9 bp, Unknown
  misc_feature (1)..( 9): Result.002 file - promoters60/1034322
aacaaatct

SEQ ID NO: 105044 - DNA, 9 bp, Unknown
  misc_feature (1)..( 9): Result.002 file - promoters60/1034322
tataaactc

SEQ ID NO: 105045 - DNA, 10 bp, Unknown
  misc_feature (1)..( 10): Result.002 file - promoters60/1034349
tttaattaaa

SEQ ID NO: 105046 - DNA, 10 bp, Unknown
  misc_feature (1)..( 10): Result.002 file - promoters60/1034349
aacaataaaa

SEQ ID NO: 105047 - DNA, 10 bp, Unknown
  misc_feature (1)..( 10): Result.002 file - promoters60/1034349
gtcaaaaaac

SEQ ID NO: 105048 - DNA, 10 bp, Unknown
  misc_feature (1)..( 10): Result.002 file - promoters60/1034349
agcaaaaatt

SEQ ID NO: 105049 - DNA, 10 bp, Unknown
  misc_feature (1)..( 10): Result.002 file - promoters60/1034349
gtcacaaaat

SEQ ID NO: 105050 - DNA, 10 bp, Unknown
  misc_feature (1)..( 10): Result.002 file - promoters60/1034349
tatatttaag

SEQ ID NO: 105051 - DNA, 10 bp, Unknown
  misc_feature (1)..( 10): Result.002 file - promoters60/1034349
tatacttaag

SEQ ID NO: 105052 - DNA, 10 bp, Unknown
  misc_feature (1)..( 10): Result.002 file - promoters60/1034349
ccaattgaag

SEQ ID NO: 105053 - DNA, 10 bp, Unknown
  misc_feature (1)..( 10): Result.002 file - promoters60/1034349
aaggtttaag

SEQ ID NO: 105054 - DNA, 10 bp, Unknown
  misc_feature (1)..( 10): Result.002 file - promoters60/1034349
atagtttaaa

SEQ ID NO: 105055 - DNA, 10 bp, Unknown
  misc_feature (1)..( 10): Result.002 file - promoters60/1034349
tatacaaatc

SEQ ID NO: 105056 - DNA, 10 bp, Unknown
  misc_feature (1)..( 10): Result.002 file - promoters60/1034349
tatataaacc

SEQ ID NO: 105057 - DNA, 10 bp, Unknown
  misc_feature (1)..( 10): Result.002 file - promoters60/1034349
aatataaata

SEQ ID NO: 105058 - DNA, 10 bp, Unknown
  misc_feature (1)..( 10): Result.002 file - promoters60/1034349
tttataaact

SEQ ID NO: 105059 - DNA, 10 bp, Unknown
  misc_feature (1)..( 10): Result.002 file - promoters60/1034349
gctataaata

SEQ ID NO: 105060 - DNA, 14 bp, Unknown
  misc_feature (1)..( 14): Result.002 file - promoters60/1034349
tttaataaaccaat

SEQ ID NO: 105061 - DNA, 14 bp, Unknown
  misc_feature (1)..( 14): Result.002 file - promoters60/1034349
aacgacaaaacaag

SEQ ID NO: 105062 - DNA, 14 bp, Unknown
  misc_feature (1)..( 14): Result.002 file - promoters60/1034349
gcttatcaactaat

SEQ ID NO: 105063 - DNA, 14 bp, Unknown
  misc_feature (1)..( 14): Result.002 file - promoters60/1034349
aacaacaaaaaaag

SEQ ID NO: 105064 - DNA, 14 bp, Unknown
  misc_feature (1)..( 14): Result.002 file - promoters60/1034349
taatgttcactaat

SEQ ID NO: 105065 - DNA, 10 bp, Unknown
  misc_feature (1)..( 10): Result.002 file - promoters60/1034353
ataataggcc

SEQ ID NO: 105066 - DNA, 10 bp, Unknown
  misc_feature (1)..( 10): Result.002 file - promoters60/1034353
ataatagata

SEQ ID NO: 105067 - DNA, 10 bp, Unknown
  misc_feature (1)..( 10): Result.002 file - promoters60/1034353
ataagaggct

SEQ ID NO: 105068 - DNA, 10 bp, Unknown
  misc_feature (1)..( 10): Result.002 file - promoters60/1034353
cgaattgata

SEQ ID NO: 105069 - DNA, 9 bp, Unknown
  misc_feature (1)..( 9): Result.002 file - promoters60/1034497
agattttct

SEQ ID NO: 105070 - DNA, 9 bp, Unknown
  misc_feature (1)..( 9): Result.002 file - promoters60/1034497
tcattatct

SEQ ID NO: 105071 - DNA, 9 bp, Unknown
  misc_feature (1)..( 9): Result.002 file - promoters60/1034497
agattttaa

SEQ ID NO: 105072 - DNA, 14 bp, Unknown
  misc_feature (1)..( 14): Result.002 file - promoters60/1034497
gacatatttcattt

SEQ ID NO: 105073 - DNA, 14 bp, Unknown
  misc_feature (1)..( 14): Result.002 file - promoters60/1034497
gacatttttttatt

SEQ ID NO: 105074 - DNA, 14 bp, Unknown
  misc_feature (1)..( 14): Result.002 file - promoters60/1034497
tttgtattttattt

SEQ ID NO: 105075 - DNA, 10 bp, Unknown
  misc_feature (1)..( 10): Result.002 file - promoters60/1034497
tatttcattt

SEQ ID NO: 105076 - DNA, 10 bp, Unknown
  misc_feature (1)..( 10): Result.002 file - promoters60/1034497
ttttttattt

SEQ ID NO: 105077 - DNA, 10 bp, Unknown
  misc_feature (1)..( 10): Result.002 file - promoters60/1034497
tattttattt

SEQ ID NO: 105078 - DNA, 9 bp, Unknown
  misc_feature (1)..( 9): Result.002 file - promoters60/1034497
ttttaatcg

SEQ ID NO: 105079 - DNA, 9 bp, Unknown
  misc_feature (1)..( 9): Result.002 file - promoters60/1034497
tttaaataa

SEQ ID NO: 105080 - DNA, 9 bp, Unknown
  misc_feature (1)..( 9): Result.002 file - promoters60/1034497
tcttactcg

SEQ ID NO: 105081 - DNA, 9 bp, Unknown
  misc_feature (1)..( 9): Result.002 file - promoters60/1034497
attaaatat

SEQ ID NO: 105082 - DNA, 12 bp, Unknown
  misc_feature (1)..( 12): Result.002 file - promoters60/1034497
ttttaatcgatc

SEQ ID NO: 105083 - DNA, 12 bp, Unknown
  misc_feature (1)..( 12): Result.002 file - promoters60/1034497
aaataattgatt

SEQ ID NO: 105084 - DNA, 12 bp, Unknown
  misc_feature (1)..( 12): Result.002 file - promoters60/1034497
tcttactcggta

SEQ ID NO: 105085 - DNA, 12 bp, Unknown
  misc_feature (1)..( 12): Result.002 file - promoters60/1034497
atttattctatt

SEQ ID NO: 105086 - DNA, 8 bp, Unknown
  misc_feature (1)..( 8): Result.002 file - promoters60/1034497
tattacca

SEQ ID NO: 105087 - DNA, 8 bp, Unknown
  misc_feature (1)..( 8): Result.002 file - promoters60/1034497
aattacca

SEQ ID NO: 105088 - DNA, 8 bp, Unknown
  misc_feature (1)..( 8): Result.002 file - promoters60/1034497
tactacca

SEQ ID NO: 105089 - DNA, 11 bp, Unknown
  misc_feature (1)..( 11): Result.002 file - promoters60/1034497
gtttacttgct

SEQ ID NO: 105090 - DNA, 11 bp, Unknown
  misc_feature (1)..( 11): Result.002 file - promoters60/1034497
atttatttgtg

SEQ ID NO: 105091 - DNA, 11 bp, Unknown
  misc_feature (1)..( 11): Result.002 file - promoters60/1034497
atttattagtg

SEQ ID NO: 105092 - DNA, 11 bp, Unknown
  misc_feature (1)..( 11): Result.002 file - promoters60/1034497
ctttattctta

SEQ ID NO: 105093 - DNA, 8 bp, Unknown
  misc_feature (1)..( 8): Result.002 file - promoters60/1034497
tagtacta

SEQ ID NO: 105094 - DNA, 8 bp, Unknown
  misc_feature (1)..( 8): Result.002 file - promoters60/1034497
atgtacta

SEQ ID NO: 105095 - DNA, 8 bp, Unknown
  misc_feature (1)..( 8): Result.002 file - promoters60/1034497
atgaactc

SEQ ID NO: 105096 - DNA, 9 bp, Unknown
  misc_feature (1)..( 9): Result.002 file - promoters60/1034497
accatgtat

SEQ ID NO: 105097 - DNA, 9 bp, Unknown
  misc_feature (1)..( 9): Result.002 file - promoters60/1034497
accaagtag

SEQ ID NO: 105098 - DNA, 9 bp, Unknown
  misc_feature (1)..( 9): Result.002 file - promoters60/1034497
aaaaagtag

SEQ ID NO: 105099 - DNA, 11 bp, Unknown
  misc_feature (1)..( 11): Result.002 file - promoters60/1034497
atttattagtg

SEQ ID NO: 105100 - DNA, 11 bp, Unknown
  misc_feature (1)..( 11): Result.002 file - promoters60/1034497
ctttattctta

SEQ ID NO: 105101 - DNA, 11 bp, Unknown
  misc_feature (1)..( 11): Result.002 file - promoters60/1034497
atttatttgtg

SEQ ID NO: 105102 - DNA, 10 bp, Unknown
  misc_feature (1)..( 10): Result.002 file - promoters60/1034497
attcaaataa

SEQ ID NO: 105103 - DNA, 10 bp, Unknown
  misc_feature (1)..( 10): Result.002 file - promoters60/1034497
attcaattct

SEQ ID NO: 105104 - DNA, 10 bp, Unknown
  misc_feature (1)..( 10): Result.002 file - promoters60/1034497
tttcatttct

SEQ ID NO: 105105 - DNA, 10 bp, Unknown
  misc_feature (1)..( 10): Result.002 file - promoters60/1034497
ttatattttc

SEQ ID NO: 105106 - DNA, 10 bp, Unknown
  misc_feature (1)..( 10): Result.002 file - promoters60/1034497
ttagattttt

SEQ ID NO: 105107 - DNA, 10 bp, Unknown
  misc_feature (1)..( 10): Result.002 file - promoters60/1034497
taatatcttc

SEQ ID NO: 105108 - DNA, 9 bp, Unknown
  misc_feature (1)..( 9): Result.002 file - promoters60/1034652
gaaaaaaag

SEQ ID NO: 105109 - DNA, 9 bp, Unknown
  misc_feature (1)..( 9): Result.002 file - promoters60/1034652
caaacaaat

SEQ ID NO: 105110 - DNA, 9 bp, Unknown
  misc_feature (1)..( 9): Result.002 file - promoters60/1034652
aaaagaaac

SEQ ID NO: 105111 - DNA, 9 bp, Unknown
  misc_feature (1)..( 9): Result.002 file - promoters60/1034652
caaagaaag

SEQ ID NO: 105112 - DNA, 9 bp, Unknown
  misc_feature (1)..( 9): Result.002 file - promoters60/1034652
caaaaaaaa

SEQ ID NO: 105113 - DNA, 9 bp, Unknown
  misc_feature (1)..( 9): Result.002 file - promoters60/1034652
caaacacaa

SEQ ID NO: 105114 - DNA, 9 bp, Unknown
  misc_feature (1)..( 9): Result.002 file - promoters60/1034652
caaggaaag

SEQ ID NO: 105115 - DNA, 10 bp, Unknown
  misc_feature (1)..( 10): Result.002 file - promoters60/1034692
tcacttgcac

SEQ ID NO: 105116 - DNA, 10 bp, Unknown
  misc_feature (1)..( 10): Result.002 file - promoters60/1034692
attcttacac

SEQ ID NO: 105117 - DNA, 10 bp, Unknown
  misc_feature (1)..( 10): Result.002 file - promoters60/1034692
atttttactt

SEQ ID NO: 105118 - DNA, 9 bp, Unknown
  misc_feature (1)..( 9): Result.002 file - promoters60/1034692
caaatcaac

SEQ ID NO: 105119 - DNA, 9 bp, Unknown
  misc_feature (1)..( 9): Result.002 file - promoters60/1034692
aaaatcaac

SEQ ID NO: 105120 - DNA, 9 bp, Unknown
  misc_feature (1)..( 9): Result.002 file - promoters60/1034692
aaaaacaat

SEQ ID NO: 105121 - DNA, 8 bp, Unknown
  misc_feature (1)..( 8): Result.002 file - promoters60/1034692
aaaaggaa

SEQ ID NO: 105122 - DNA, 8 bp, Unknown
  misc_feature (1)..( 8): Result.002 file - promoters60/1034692
aaatggaa

SEQ ID NO: 105123 - DNA, 8 bp, Unknown
  misc_feature (1)..( 8): Result.002 file - promoters60/1034692
aaaacgaa

SEQ ID NO: 105124 - DNA, 9 bp, Unknown
  misc_feature (1)..( 9): Result.002 file - promoters60/1034715
tgtctgatg

SEQ ID NO: 105125 - DNA, 9 bp, Unknown
  misc_feature (1)..( 9): Result.002 file - promoters60/1034715
tgtcagatg

SEQ ID NO: 105126 - DNA, 6 bp, Unknown
  misc_feature (1)..( 6): Result.002 file - promoters60/1034715
tagttt

SEQ ID NO: 105127 - DNA, 6 bp, Unknown
  misc_feature (1)..( 6): Result.002 file - promoters60/1034715
tagttt

SEQ ID NO: 105128 - DNA, 7 bp, Unknown
  misc_feature (1)..( 7): Result.002 file - promoters60/1034715
tagctca

SEQ ID NO: 105129 - DNA, 7 bp, Unknown
  misc_feature (1)..( 7): Result.002 file - promoters60/1034715
tagatca

SEQ ID NO: 105130 - DNA, 6 bp, Unknown
  misc_feature (1)..( 6): Result.002 file - promoters60/1034715
ccgtga

SEQ ID NO: 105131 - DNA, 6 bp, Unknown
  misc_feature (1)..( 6): Result.002 file - promoters60/1034715
ccgtga

SEQ ID NO: 105132 - DNA, 7 bp, Unknown
  misc_feature (1)..( 7): Result.002 file - promoters60/1034715
tcttctg

SEQ ID NO: 105133 - DNA, 7 bp, Unknown
  misc_feature (1)..( 7): Result.002 file - promoters60/1034715
tcttctg

SEQ ID NO: 105134 - DNA, 6 bp, Unknown
  misc_feature (1)..( 6): Result.002 file - promoters60/1034715
catttt

SEQ ID NO: 105135 - DNA, 6 bp, Unknown
  misc_feature (1)..( 6): Result.002 file - promoters60/1034715
catttt

SEQ ID NO: 105136 - DNA, 9 bp, Unknown
  misc_feature (1)..( 9): Result.002 file - promoters60/1034715
tttacagat

SEQ ID NO: 105137 - DNA, 9 bp, Unknown
  misc_feature (1)..( 9): Result.002 file - promoters60/1034715
ttttcagat

SEQ ID NO: 105138 - DNA, 7 bp, Unknown
  misc_feature (1)..( 7): Result.002 file - promoters60/1034715
cagtgaa

SEQ ID NO: 105139 - DNA, 7 bp, Unknown
  misc_feature (1)..( 7): Result.002 file - promoters60/1034715
cagggaa

SEQ ID NO: 105140 - DNA, 9 bp, Unknown
  misc_feature (1)..( 9): Result.002 file - promoters60/1034810
aactaggca

SEQ ID NO: 105141 - DNA, 9 bp, Unknown
  misc_feature (1)..( 9): Result.002 file - promoters60/1034810
aacaaggca

SEQ ID NO: 105142 - DNA, 7 bp, Unknown
  misc_feature (1)..( 7): Result.002 file - promoters60/1034810
gagtgtt

SEQ ID NO: 105143 - DNA, 7 bp, Unknown
  misc_feature (1)..( 7): Result.002 file - promoters60/1034810
gagtgtt

SEQ ID NO: 105144 - DNA, 6 bp, Unknown
  misc_feature (1)..( 6): Result.002 file - promoters60/1034810
ggaagc

SEQ ID NO: 105145 - DNA, 6 bp, Unknown
  misc_feature (1)..( 6): Result.002 file - promoters60/1034810
ggaagc

SEQ ID NO: 105146 - DNA, 7 bp, Unknown
  misc_feature (1)..( 7): Result.002 file - promoters60/1034810
aaaggtg

SEQ ID NO: 105147 - DNA, 7 bp, Unknown
  misc_feature (1)..( 7): Result.002 file - promoters60/1034810
aaaagtg

SEQ ID NO: 105148 - DNA, 6 bp, Unknown
  misc_feature (1)..( 6): Result.002 file - promoters60/1034810
atacac

SEQ ID NO: 105149 - DNA, 6 bp, Unknown
  misc_feature (1)..( 6): Result.002 file - promoters60/1034810
atacac

SEQ ID NO: 105150 - DNA, 9 bp, Unknown
  misc_feature (1)..( 9): Result.002 file - promoters60/1034810
cattgactt

SEQ ID NO: 105151 - DNA, 9 bp, Unknown
  misc_feature (1)..( 9): Result.002 file - promoters60/1034810
cattaactt

SEQ ID NO: 105152 - DNA, 8 bp, Unknown
  misc_feature (1)..( 8): Result.002 file - promoters60/1034810
gctgaact

SEQ ID NO: 105153 - DNA, 8 bp, Unknown
  misc_feature (1)..( 8): Result.002 file - promoters60/1034810
gctggact

SEQ ID NO: 105154 - DNA, 6 bp, Unknown
  misc_feature (1)..( 6): Result.002 file - promoters60/1034810
cttagg

SEQ ID NO: 105155 - DNA, 6 bp, Unknown
  misc_feature (1)..( 6): Result.002 file - promoters60/1034810
cttagg

SEQ ID NO: 105156 - DNA, 6 bp, Unknown
  misc_feature (1)..( 6): Result.002 file - promoters60/1034810
tcttga

SEQ ID NO: 105157 - DNA, 6 bp, Unknown
  misc_feature (1)..( 6): Result.002 file - promoters60/1034810
tcttga

SEQ ID NO: 105158 - DNA, 8 bp, Unknown
  misc_feature (1)..( 8): Result.002 file - promoters60/1034810
gttcattg

SEQ ID NO: 105159 - DNA, 8 bp, Unknown
  misc_feature (1)..( 8): Result.002 file - promoters60/1034810
gttcattg

SEQ ID NO: 105160 - DNA, 6 bp, Unknown
  misc_feature (1)..( 6): Result.002 file - promoters60/1034810
ggcttg

SEQ ID NO: 105161 - DNA, 6 bp, Unknown
  misc_feature (1)..( 6): Result.002 file - promoters60/1034810
ggcttg

SEQ ID NO: 105162 - DNA, 10 bp, Unknown
  misc_feature (1)..( 10): Result.002 file - promoters60/1034837
tcaataaact

SEQ ID NO: 105163 - DNA, 10 bp, Unknown
  misc_feature (1)..( 10): Result.002 file - promoters60/1034837
tcaacaaaat

SEQ ID NO: 105164 - DNA, 10 bp, Unknown
  misc_feature (1)..( 10): Result.002 file - promoters60/1034837
aaaacaaatc

SEQ ID NO: 105165 - DNA, 10 bp, Unknown
  misc_feature (1)..( 10): Result.002 file - promoters60/1034837
ggaaaaaaat

SEQ ID NO: 105166 - DNA, 10 bp, Unknown
  misc_feature (1)..( 10): Result.002 file - promoters60/1034837
ataacaaata

SEQ ID NO: 105167 - DNA, 12 bp, Unknown
  misc_feature (1)..( 12): Result.002 file - promoters60/1034837
caacaatgtaca

SEQ ID NO: 105168 - DNA, 12 bp, Unknown
  misc_feature (1)..( 12): Result.002 file - promoters60/1034837
caataatttaca

SEQ ID NO: 105169 - DNA, 12 bp, Unknown
  misc_feature (1)..( 12): Result.002 file - promoters60/1034837
acacaatataca

SEQ ID NO: 105170 - DNA, 12 bp, Unknown
  misc_feature (1)..( 12): Result.002 file - promoters60/1034837
agatattttaaa

SEQ ID NO: 105171 - DNA, 12 bp, Unknown
  misc_feature (1)..( 12): Result.002 file - promoters60/1034837
tgaaaatttata

SEQ ID NO: 105172 - DNA, 12 bp, Unknown
  misc_feature (1)..( 12): Result.002 file - promoters60/1034837
ttaaaaatccaa

SEQ ID NO: 105173 - DNA, 12 bp, Unknown
  misc_feature (1)..( 12): Result.002 file - promoters60/1034837
ttaaaaacattt

SEQ ID NO: 105174 - DNA, 12 bp, Unknown
  misc_feature (1)..( 12): Result.002 file - promoters60/1034837
ttaaaaacaatt

SEQ ID NO: 105175 - DNA, 12 bp, Unknown
  misc_feature (1)..( 12): Result.002 file - promoters60/1034837
ttaacaaccttt

SEQ ID NO: 105176 - DNA, 8 bp, Unknown
  misc_feature (1)..( 8): Result.002 file - promoters60/1034837
attcataa

SEQ ID NO: 105177 - DNA, 8 bp, Unknown
  misc_feature (1)..( 8): Result.002 file - promoters60/1034837
attcattg

SEQ ID NO: 105178 - DNA, 8 bp, Unknown
  misc_feature (1)..( 8): Result.002 file - promoters60/1034837
attaattt

SEQ ID NO: 105179 - DNA, 9 bp, Unknown
  misc_feature (1)..( 9): Result.002 file - promoters60/1034837
attaaattg

SEQ ID NO: 105180 - DNA, 13 bp, Unknown
  misc_feature (1)..( 13): Result.002 file - promoters60/1034870
agtacaatgcaat

SEQ ID NO: 105181 - DNA, 13 bp, Unknown
  misc_feature (1)..( 13): Result.002 file - promoters60/1034870
agtgtaatgaaat

SEQ ID NO: 105182 - DNA, 13 bp, Unknown
  misc_feature (1)..( 13): Result.002 file - promoters60/1034870
aacagaataaaaa

SEQ ID NO: 105183 - DNA, 13 bp, Unknown
  misc_feature (1)..( 13): Result.002 file - promoters60/1034870
ccagccatgaaag

SEQ ID NO: 105184 - DNA, 13 bp, Unknown
  misc_feature (1)..( 13): Result.002 file - promoters60/1034870
aacagagtaattg

SEQ ID NO: 105185 - DNA, 8 bp, Unknown
  misc_feature (1)..( 8): Result.002 file - promoters60/1034962
atttttaa

SEQ ID NO: 105186 - DNA, 8 bp, Unknown
  misc_feature (1)..( 8): Result.002 file - promoters60/1034962
attttttt

SEQ ID NO: 105187 - DNA, 9 bp, Unknown
  misc_feature (1)..( 9): Result.002 file - promoters60/1034962
ttttgtttc

SEQ ID NO: 105188 - DNA, 7 bp, Unknown
  misc_feature (1)..( 7): Result.002 file - promoters60/1034962
aatatta

SEQ ID NO: 105189 - DNA, 7 bp, Unknown
  misc_feature (1)..( 7): Result.002 file - promoters60/1034962
aatttta

SEQ ID NO: 105190 - DNA, 7 bp, Unknown
  misc_feature (1)..( 7): Result.002 file - promoters60/1034962
aattaaa

SEQ ID NO: 105191 - DNA, 7 bp, Unknown
  misc_feature (1)..( 7): Result.002 file - promoters60/1034962
aatgaaa

SEQ ID NO: 105192 - DNA, 9 bp, Unknown
  misc_feature (1)..( 9): Result.002 file - promoters60/1034962
aaatcattt

SEQ ID NO: 105193 - DNA, 9 bp, Unknown
  misc_feature (1)..( 9): Result.002 file - promoters60/1034962
caatgattt

SEQ ID NO: 105194 - DNA, 9 bp, Unknown
  misc_feature (1)..( 9): Result.002 file - promoters60/1034962
caattattc

SEQ ID NO: 105195 - DNA, 6 bp, Unknown
  misc_feature (1)..( 6): Result.002 file - promoters60/1034962
gattta

SEQ ID NO: 105196 - DNA, 6 bp, Unknown
  misc_feature (1)..( 6): Result.002 file - promoters60/1034962
gattta

SEQ ID NO: 105197 - DNA, 7 bp, Unknown
  misc_feature (1)..( 7): Result.002 file - promoters60/1034962
agaacat

SEQ ID NO: 105198 - DNA, 7 bp, Unknown
  misc_feature (1)..( 7): Result.002 file - promoters60/1034962
agaccat

SEQ ID NO: 105199 - DNA, 8 bp, Unknown
  misc_feature (1)..( 8): Result.002 file - promoters60/1034962
taatccac

SEQ ID NO: 105200 - DNA, 8 bp, Unknown
  misc_feature (1)..( 8): Result.002 file - promoters60/1034962
taattcac

SEQ ID NO: 105201 - DNA, 11 bp, Unknown
  misc_feature (1)..( 11): Result.002 file - promoters60/1034962
tctgatgacaa

SEQ ID NO: 105202 - DNA, 11 bp, Unknown
  misc_feature (1)..( 11): Result.002 file - promoters60/1034962
tctgataacaa

SEQ ID NO: 105203 - DNA, 6 bp, Unknown
  misc_feature (1)..( 6): Result.002 file - promoters60/1034962
tcaatt

SEQ ID NO: 105204 - DNA, 6 bp, Unknown
  misc_feature (1)..( 6): Result.002 file - promoters60/1034962
tcaatt

SEQ ID NO: 105205 - DNA, 7 bp, Unknown
  misc_feature (1)..( 7): Result.002 file - promoters60/1034962
aataaat

SEQ ID NO: 105206 - DNA, 7 bp, Unknown
  misc_feature (1)..( 7): Result.002 file - promoters60/1034962
aattaat

SEQ ID NO: 105207 - DNA, 8 bp, Unknown
  misc_feature (1)..( 8): Result.002 file - promoters60/1034962
tctaggga

SEQ ID NO: 105208 - DNA, 8 bp, Unknown
  misc_feature (1)..( 8): Result.002 file - promoters60/1034962
tctaggga

SEQ ID NO: 105209 - DNA, 10 bp, Unknown
  misc_feature (1)..( 10): Result.002 file - promoters60/1034962
aatttaaaag

SEQ ID NO: 105210 - DNA, 10 bp, Unknown
  misc_feature (1)..( 10): Result.002 file - promoters60/1034962
aatttaaaag

SEQ ID NO: 105211 - DNA, 7 bp, Unknown
  misc_feature (1)..( 7): Result.002 file - promoters60/1034962
ttctgtt

SEQ ID NO: 105212 - DNA, 7 bp, Unknown
  misc_feature (1)..( 7): Result.002 file - promoters60/1034962
ttcggtt

SEQ ID NO: 105213 - DNA, 7 bp, Unknown
  misc_feature (1)..( 7): Result.002 file - promoters60/1034962
gaataga

SEQ ID NO: 105214 - DNA, 7 bp, Unknown
  misc_feature (1)..( 7): Result.002 file - promoters60/1034962
gaagaga

SEQ ID NO: 105215 - DNA, 7 bp, Unknown
  misc_feature (1)..( 7): Result.002 file - promoters60/1034962
tatttta

SEQ ID NO: 105216 - DNA, 7 bp, Unknown
  misc_feature (1)..( 7): Result.002 file - promoters60/1034962
tatttta

SEQ ID NO: 105217 - DNA, 7 bp, Unknown
  misc_feature (1)..( 7): Result.002 file - promoters60/1034962
tttagaa

SEQ ID NO: 105218 - DNA, 7 bp, Unknown
  misc_feature (1)..( 7): Result.002 file - promoters60/1034962
tttagaa

SEQ ID NO: 105219 - DNA, 7 bp, Unknown
  misc_feature (1)..( 7): Result.002 file - promoters60/1034962
cttcctc

SEQ ID NO: 105220 - DNA, 7 bp, Unknown
  misc_feature (1)..( 7): Result.002 file - promoters60/1034962
cttcctc

SEQ ID NO: 105221 - DNA, 7 bp, Unknown
  misc_feature (1)..( 7): Result.002 file - promoters60/1035027
tttctat

SEQ ID NO: 105222 - DNA, 7 bp, Unknown
  misc_feature (1)..( 7): Result.002 file - promoters60/1035027
tttatat

SEQ ID NO: 105223 - DNA, 7 bp, Unknown
  misc_feature (1)..( 7): Result.002 file - promoters60/1035027
gtagata

SEQ ID NO: 105224 - DNA, 7 bp, Unknown
  misc_feature (1)..( 7): Result.002 file - promoters60/1035027
gtaaata

SEQ ID NO: 105225 - DNA, 6 bp, Unknown
  misc_feature (1)..( 6): Result.002 file - promoters60/1035027
atatat

SEQ ID NO: 105226 - DNA, 6 bp, Unknown
  misc_feature (1)..( 6): Result.002 file - promoters60/1035027
atatat

SEQ ID NO: 105227 - DNA, 8 bp, Unknown
  misc_feature (1)..( 8): Result.002 file - promoters60/1035027
aatataca

SEQ ID NO: 105228 - DNA, 8 bp, Unknown
  misc_feature (1)..( 8): Result.002 file - promoters60/1035027
aatttaca

SEQ ID NO: 105229 - DNA, 7 bp, Unknown
  misc_feature (1)..( 7): Result.002 file - promoters60/1035027
aaagaaa

SEQ ID NO: 105230 - DNA, 7 bp, Unknown
  misc_feature (1)..( 7): Result.002 file - promoters60/1035027
aaacaaa

SEQ ID NO: 105231 - DNA, 7 bp, Unknown
  misc_feature (1)..( 7): Result.002 file - promoters60/1035027
aaagaaa

SEQ ID NO: 105232 - DNA, 12 bp, Unknown
  misc_feature (1)..( 12): Result.002 file - promoters60/1035027
aattgtatgtta

SEQ ID NO: 105233 - DNA, 12 bp, Unknown
  misc_feature (1)..( 12): Result.002 file - promoters60/1035027
aattttatttta

SEQ ID NO: 105234 - DNA, 12 bp, Unknown
  misc_feature (1)..( 12): Result.002 file - promoters60/1035027
aataatattttt

SEQ ID NO: 105235 - DNA, 6 bp, Unknown
  misc_feature (1)..( 6): Result.002 file - promoters60/1035027
tttcct

SEQ ID NO: 105236 - DNA, 6 bp, Unknown
  misc_feature (1)..( 6): Result.002 file - promoters60/1035027
tttcct

SEQ ID NO: 105237 - DNA, 6 bp, Unknown
  misc_feature (1)..( 6): Result.002 file - promoters60/1035027
caaact

SEQ ID NO: 105238 - DNA, 6 bp, Unknown
  misc_feature (1)..( 6): Result.002 file - promoters60/1035027
caaact

SEQ ID NO: 105239 - DNA, 6 bp, Unknown
  misc_feature (1)..( 6): Result.002 file - promoters60/1035027
ctatac

SEQ ID NO: 105240 - DNA, 6 bp, Unknown
  misc_feature (1)..( 6): Result.002 file - promoters60/1035027
ctatac

SEQ ID NO: 105241 - DNA, 6 bp, Unknown
  misc_feature (1)..( 6): Result.002 file - promoters60/1035027
tttgtt

SEQ ID NO: 105242 - DNA, 6 bp, Unknown
  misc_feature (1)..( 6): Result.002 file - promoters60/1035027
tttgtt

SEQ ID NO: 105243 - DNA, 7 bp, Unknown
  misc_feature (1)..( 7): Result.002 file - promoters60/1035027
aatagaa

SEQ ID NO: 105244 - DNA, 7 bp, Unknown
  misc_feature (1)..( 7): Result.002 file - promoters60/1035027
aatggaa

SEQ ID NO: 105245 - DNA, 7 bp, Unknown
  misc_feature (1)..( 7): Result.002 file - promoters60/1035027
taataat

SEQ ID NO: 105246 - DNA, 7 bp, Unknown
  misc_feature (1)..( 7): Result.002 file - promoters60/1035027
aaataat

SEQ ID NO: 105247 - DNA, 7 bp, Unknown
  misc_feature (1)..( 7): Result.002 file - promoters60/1035027
aaacaat

SEQ ID NO: 105248 - DNA, 7 bp, Unknown
  misc_feature (1)..( 7): Result.002 file - promoters60/1035027
aattaat

SEQ ID NO: 105249 - DNA, 7 bp, Unknown
  misc_feature (1)..( 7): Result.002 file - promoters60/1035027
aatcaat

SEQ ID NO: 105250 - DNA, 8 bp, Unknown
  misc_feature (1)..( 8): Result.002 file - promoters60/1035027
aactaatc

SEQ ID NO: 105251 - DNA, 8 bp, Unknown
  misc_feature (1)..( 8): Result.002 file - promoters60/1035027
aactaatc

SEQ ID NO: 105252 - DNA, 13 bp, Unknown
  misc_feature (1)..( 13): Result.002 file - promoters60/1035027
ctttctctttttt

SEQ ID NO: 105253 - DNA, 13 bp, Unknown
  misc_feature (1)..( 13): Result.002 file - promoters60/1035027
ctttcactttttt

SEQ ID NO: 105254 - DNA, 9 bp, Unknown
  misc_feature (1)..( 9): Result.002 file - promoters60/1035027
attaaaaaa

SEQ ID NO: 105255 - DNA, 9 bp, Unknown
  misc_feature (1)..( 9): Result.002 file - promoters60/1035027
attaaaaaa

SEQ ID NO: 105256 - DNA, 15 bp, Unknown
  misc_feature (1)..( 15): Result.002 file - promoters60/1035027
aaatagaagaaaatg

SEQ ID NO: 105257 - DNA, 15 bp, Unknown
  misc_feature (1)..( 15): Result.002 file - promoters60/1035027
aaaaagaagataatg

SEQ ID NO: 105258 - DNA, 7 bp, Unknown
  misc_feature (1)..( 7): Result.002 file - promoters60/1035027
tatgaac

SEQ ID NO: 105259 - DNA, 7 bp, Unknown
  misc_feature (1)..( 7): Result.002 file - promoters60/1035027
tataaac

SEQ ID NO: 105260 - DNA, 6 bp, Unknown
  misc_feature (1)..( 6): Result.002 file - promoters60/1035027
agtatt

SEQ ID NO: 105261 - DNA, 6 bp, Unknown
  misc_feature (1)..( 6): Result.002 file - promoters60/1035027
agtatt

SEQ ID NO: 105262 - DNA, 6 bp, Unknown
  misc_feature (1)..( 6): Result.002 file - promoters60/1035027
tattta

SEQ ID NO: 105263 - DNA, 6 bp, Unknown
  misc_feature (1)..( 6): Result.002 file - promoters60/1035027
tattta

SEQ ID NO: 105264 - DNA, 6 bp, Unknown
  misc_feature (1)..( 6): Result.002 file - promoters60/1035027
aaataa

SEQ ID NO: 105265 - DNA, 6 bp, Unknown
  misc_feature (1)..( 6): Result.002 file - promoters60/1035027
aaataa

SEQ ID NO: 105266 - DNA, 9 bp, Unknown
  misc_feature (1)..( 9): Result.002 file - promoters60/1035027
gaaaacagt

SEQ ID NO: 105267 - DNA, 9 bp, Unknown
  misc_feature (1)..( 9): Result.002 file - promoters60/1035027
gaaaagagt

SEQ ID NO: 105268 - DNA, 13 bp, Unknown
  misc_feature (1)..( 13): Result.002 file - promoters60/1035083
aaatgtttgtatt

SEQ ID NO: 105269 - DNA, 13 bp, Unknown
  misc_feature (1)..( 13): Result.002 file - promoters60/1035083
ccacaattgtatt

SEQ ID NO: 105270 - DNA, 13 bp, Unknown
  misc_feature (1)..( 13): Result.002 file - promoters60/1035083
ccacatttggatt

SEQ ID NO: 105271 - DNA, 13 bp, Unknown
  misc_feature (1)..( 13): Result.002 file - promoters60/1035083
caatctttgtatc

SEQ ID NO: 105272 - DNA, 13 bp, Unknown
  misc_feature (1)..( 13): Result.002 file - promoters60/1035083
caatctttgtttt

SEQ ID NO: 105273 - DNA, 15 bp, Unknown
  misc_feature (1)..( 15): Result.002 file - promoters60/1035083
ttatttttgaagaat

SEQ ID NO: 105274 - DNA, 15 bp, Unknown
  misc_feature (1)..( 15): Result.002 file - promoters60/1035083
ctatttatgacgagg

SEQ ID NO: 105275 - DNA, 15 bp, Unknown
  misc_feature (1)..( 15): Result.002 file - promoters60/1035083
acaattttgatgaat

SEQ ID NO: 105276 - DNA, 15 bp, Unknown
  misc_feature (1)..( 15): Result.002 file - promoters60/1035083
atattttaattcatg

SEQ ID NO: 105277 - DNA, 15 bp, Unknown
  misc_feature (1)..( 15): Result.002 file - promoters60/1035083
gtttttttttttttt

SEQ ID NO: 105278 - DNA, 15 bp, Unknown
  misc_feature (1)..( 15): Result.002 file - promoters60/1035083
gtagatttgctgaat

SEQ ID NO: 105279 - DNA, 15 bp, Unknown
  misc_feature (1)..( 15): Result.002 file - promoters60/1035083
tgattttacaccact

SEQ ID NO: 105280 - DNA, 14 bp, Unknown
  misc_feature (1)..( 14): Result.002 file - promoters60/1035083
tgcattagttcttc

SEQ ID NO: 105281 - DNA, 14 bp, Unknown
  misc_feature (1)..( 14): Result.002 file - promoters60/1035083
taaatttgttatgt

SEQ ID NO: 105282 - DNA, 14 bp, Unknown
  misc_feature (1)..( 14): Result.002 file - promoters60/1035083
attattatttctcg

SEQ ID NO: 105283 - DNA, 14 bp, Unknown
  misc_feature (1)..( 14): Result.002 file - promoters60/1035083
taaattttttaaaa

SEQ ID NO: 105284 - DNA, 14 bp, Unknown
  misc_feature (1)..( 14): Result.002 file - promoters60/1035083
tatacgttttaaaa

SEQ ID NO: 105285 - DNA, 11 bp, Unknown
  misc_feature (1)..( 11): Result.002 file - promoters60/1035083
cttatataaac

SEQ ID NO: 105286 - DNA, 11 bp, Unknown
  misc_feature (1)..( 11): Result.002 file - promoters60/1035083
tatatataata

SEQ ID NO: 105287 - DNA, 11 bp, Unknown
  misc_feature (1)..( 11): Result.002 file - promoters60/1035083
tataaataaaa

SEQ ID NO: 105288 - DNA, 11 bp, Unknown
  misc_feature (1)..( 11): Result.002 file - promoters60/1035083
gctataaaaac

SEQ ID NO: 105289 - DNA, 11 bp, Unknown
  misc_feature (1)..( 11): Result.002 file - promoters60/1035083
cccataaaagc

SEQ ID NO: 105290 - DNA, 11 bp, Unknown
  misc_feature (1)..( 11): Result.002 file - promoters60/1035083
gataaatatcc

SEQ ID NO: 105291 - DNA, 10 bp, Unknown
  misc_feature (1)..( 10): Result.002 file - promoters60/1035083
tataaacaaa

SEQ ID NO: 105292 - DNA, 10 bp, Unknown
  misc_feature (1)..( 10): Result.002 file - promoters60/1035083
aataaccaaa

SEQ ID NO: 105293 - DNA, 10 bp, Unknown
  misc_feature (1)..( 10): Result.002 file - promoters60/1035083
tataaataaa

SEQ ID NO: 105294 - DNA, 10 bp, Unknown
  misc_feature (1)..( 10): Result.002 file - promoters60/1035083
tataaaaacc

SEQ ID NO: 105295 - DNA, 10 bp, Unknown
  misc_feature (1)..( 10): Result.002 file - promoters60/1035083
cataaaagca

SEQ ID NO: 105296 - DNA, 11 bp, Unknown
  misc_feature (1)..( 11): Result.002 file - promoters60/1035083
caaaatttgta

SEQ ID NO: 105297 - DNA, 11 bp, Unknown
  misc_feature (1)..( 11): Result.002 file - promoters60/1035083
caatattttaa

SEQ ID NO: 105298 - DNA, 11 bp, Unknown
  misc_feature (1)..( 11): Result.002 file - promoters60/1035083
gaatatgtttt

SEQ ID NO: 105299 - DNA, 11 bp, Unknown
  misc_feature (1)..( 11): Result.002 file - promoters60/1035083
aattattttac

SEQ ID NO: 105300 - DNA, 11 bp, Unknown
  misc_feature (1)..( 11): Result.002 file - promoters60/1035083
gctgattttac

SEQ ID NO: 105301 - DNA, 10 bp, Unknown
  misc_feature (1)..( 10): Result.002 file - promoters60/1035083
tataattatg

SEQ ID NO: 105302 - DNA, 10 bp, Unknown
  misc_feature (1)..( 10): Result.002 file - promoters60/1035083
aataataatg

SEQ ID NO: 105303 - DNA, 10 bp, Unknown
  misc_feature (1)..( 10): Result.002 file - promoters60/1035083
tattattatt

SEQ ID NO: 105304 - DNA, 10 bp, Unknown
  misc_feature (1)..( 10): Result.002 file - promoters60/1035083
taatataagt

SEQ ID NO: 105305 - DNA, 10 bp, Unknown
  misc_feature (1)..( 10): Result.002 file - promoters60/1035083
ccatattata

SEQ ID NO: 105306 - DNA, 12 bp, Unknown
  misc_feature (1)..( 12): Result.002 file - promoters60/1035083
tggataccacaa

SEQ ID NO: 105307 - DNA, 12 bp, Unknown
  misc_feature (1)..( 12): Result.002 file - promoters60/1035083
gttataccatca

SEQ ID NO: 105308 - DNA, 12 bp, Unknown
  misc_feature (1)..( 12): Result.002 file - promoters60/1035083
gttttaccttaa

SEQ ID NO: 105309 - DNA, 12 bp, Unknown
  misc_feature (1)..( 12): Result.002 file - promoters60/1035083
actataccacat

SEQ ID NO: 105310 - DNA, 12 bp, Unknown
  misc_feature (1)..( 12): Result.002 file - promoters60/1035083
ttaatacgacat

SEQ ID NO: 105311 - DNA, 7 bp, Unknown
  misc_feature (1)..( 7): Result.002 file - promoters60/1035097
aaaataa

SEQ ID NO: 105312 - DNA, 7 bp, Unknown
  misc_feature (1)..( 7): Result.002 file - promoters60/1035097
aaattaa

SEQ ID NO: 105313 - DNA, 7 bp, Unknown
  misc_feature (1)..( 7): Result.002 file - promoters60/1035097
aaaataa

SEQ ID NO: 105314 - DNA, 8 bp, Unknown
  misc_feature (1)..( 8): Result.002 file - promoters60/1035097
gaaaaaat

SEQ ID NO: 105315 - DNA, 8 bp, Unknown
  misc_feature (1)..( 8): Result.002 file - promoters60/1035097
caaaaaat

SEQ ID NO: 105316 - DNA, 8 bp, Unknown
  misc_feature (1)..( 8): Result.002 file - promoters60/1035097
gaagaaag

SEQ ID NO: 105317 - DNA, 9 bp, Unknown
  misc_feature (1)..( 9): Result.002 file - promoters60/1035117
tattttttg

SEQ ID NO: 105318 - DNA, 9 bp, Unknown
  misc_feature (1)..( 9): Result.002 file - promoters60/1035117
tattctttg

SEQ ID NO: 105319 - DNA, 9 bp, Unknown
  misc_feature (1)..( 9): Result.002 file - promoters60/1035117
tgttttttc

SEQ ID NO: 105320 - DNA, 9 bp, Unknown
  misc_feature (1)..( 9): Result.002 file - promoters60/1035117
tatttttca

SEQ ID NO: 105321 - DNA, 9 bp, Unknown
  misc_feature (1)..( 9): Result.002 file - promoters60/1035117
tattcttca

SEQ ID NO: 105322 - DNA, 7 bp, Unknown
  misc_feature (1)..( 7): Result.002 file - promoters60/1035117
aaagtct

SEQ ID NO: 105323 - DNA, 7 bp, Unknown
  misc_feature (1)..( 7): Result.002 file - promoters60/1035117
aaactct

SEQ ID NO: 105324 - DNA, 9 bp, Unknown
  misc_feature (1)..( 9): Result.002 file - promoters60/1035117
ctttgttat

SEQ ID NO: 105325 - DNA, 9 bp, Unknown
  misc_feature (1)..( 9): Result.002 file - promoters60/1035117
ctttgtaag

SEQ ID NO: 105326 - DNA, 9 bp, Unknown
  misc_feature (1)..( 9): Result.002 file - promoters60/1035117
atttgatat

SEQ ID NO: 105327 - DNA, 6 bp, Unknown
  misc_feature (1)..( 6): Result.002 file - promoters60/1035117
tataca

SEQ ID NO: 105328 - DNA, 6 bp, Unknown
  misc_feature (1)..( 6): Result.002 file - promoters60/1035117
tataca

SEQ ID NO: 105329 - DNA, 10 bp, Unknown
  misc_feature (1)..( 10): Result.002 file - promoters60/1035117
ccaataaaaa

SEQ ID NO: 105330 - DNA, 10 bp, Unknown
  misc_feature (1)..( 10): Result.002 file - promoters60/1035117
tctatagaaa

SEQ ID NO: 105331 - DNA, 10 bp, Unknown
  misc_feature (1)..( 10): Result.002 file - promoters60/1035117
tctttagatt

SEQ ID NO: 105332 - DNA, 6 bp, Unknown
  misc_feature (1)..( 6): Result.002 file - promoters60/1035117
aaaact

SEQ ID NO: 105333 - DNA, 6 bp, Unknown
  misc_feature (1)..( 6): Result.002 file - promoters60/1035117
aaaact

SEQ ID NO: 105334 - DNA, 6 bp, Unknown
  misc_feature (1)..( 6): Result.002 file - promoters60/1035117
ctttta

SEQ ID NO: 105335 - DNA, 6 bp, Unknown
  misc_feature (1)..( 6): Result.002 file - promoters60/1035117
ctttta

SEQ ID NO: 105336 - DNA, 8 bp, Unknown
  misc_feature (1)..( 8): Result.002 file - promoters60/1035117
agcaaaaa

SEQ ID NO: 105337 - DNA, 8 bp, Unknown
  misc_feature (1)..( 8): Result.002 file - promoters60/1035117
atcaaaaa

SEQ ID NO: 105338 - DNA, 8 bp, Unknown
  misc_feature (1)..( 8): Result.002 file - promoters60/1035117
atcaaaat

SEQ ID NO: 105339 - DNA, 8 bp, Unknown
  misc_feature (1)..( 8): Result.002 file - promoters60/1035117
ttaaagtt

SEQ ID NO: 105340 - DNA, 8 bp, Unknown
  misc_feature (1)..( 8): Result.002 file - promoters60/1035117
ttaaagtt

SEQ ID NO: 105341 - DNA, 11 bp, Unknown
  misc_feature (1)..( 11): Result.002 file - promoters60/1035117
aaacaacaaat

SEQ ID NO: 105342 - DNA, 11 bp, Unknown
  misc_feature (1)..( 11): Result.002 file - promoters60/1035117
aaataacaaat

SEQ ID NO: 105343 - DNA, 7 bp, Unknown
  misc_feature (1)..( 7): Result.002 file - promoters60/1035117
ctattta

SEQ ID NO: 105344 - DNA, 7 bp, Unknown
  misc_feature (1)..( 7): Result.002 file - promoters60/1035117
ctattta

SEQ ID NO: 105345 - DNA, 8 bp, Unknown
  misc_feature (1)..( 8): Result.002 file - promoters60/1035117
gatatgtc

SEQ ID NO: 105346 - DNA, 8 bp, Unknown
  misc_feature (1)..( 8): Result.002 file - promoters60/1035117
gatgtgtc

SEQ ID NO: 105347 - DNA, 11 bp, Unknown
  misc_feature (1)..( 11): Result.002 file - promoters60/1035117
tttatttaatt

SEQ ID NO: 105348 - DNA, 11 bp, Unknown
  misc_feature (1)..( 11): Result.002 file - promoters60/1035117
tttctttcatt

SEQ ID NO: 105349 - DNA, 8 bp, Unknown
  misc_feature (1)..( 8): Result.002 file - promoters60/1035117
tattacaa

SEQ ID NO: 105350 - DNA, 8 bp, Unknown
  misc_feature (1)..( 8): Result.002 file - promoters60/1035117
tataacaa

SEQ ID NO: 105351 - DNA, 6 bp, Unknown
  misc_feature (1)..( 6): Result.002 file - promoters60/1035117
aaaatc

SEQ ID NO: 105352 - DNA, 6 bp, Unknown
  misc_feature (1)..( 6): Result.002 file - promoters60/1035117
aaaatc

SEQ ID NO: 105353 - DNA, 8 bp, Unknown
  misc_feature (1)..( 8): Result.002 file - promoters60/1035117
ttacatat

SEQ ID NO: 105354 - DNA, 8 bp, Unknown
  misc_feature (1)..( 8): Result.002 file - promoters60/1035117
ttacttat

SEQ ID NO: 105355 - DNA, 7 bp, Unknown
  misc_feature (1)..( 7): Result.002 file - promoters60/1035117
acgattc

SEQ ID NO: 105356 - DNA, 7 bp, Unknown
  misc_feature (1)..( 7): Result.002 file - promoters60/1035117
acgattc

SEQ ID NO: 105357 - DNA, 8 bp, Unknown
  misc_feature (1)..( 8): Result.002 file - promoters60/1035160
atttattt

SEQ ID NO: 105358 - DNA, 8 bp, Unknown
  misc_feature (1)..( 8): Result.002 file - promoters60/1035160
attgattt

SEQ ID NO: 105359 - DNA, 10 bp, Unknown
  misc_feature (1)..( 10): Result.002 file - promoters60/1035160
atttgaggat

SEQ ID NO: 105360 - DNA, 10 bp, Unknown
  misc_feature (1)..( 10): Result.002 file - promoters60/1035160
attttaggat

SEQ ID NO: 105361 - DNA, 9 bp, Unknown
  misc_feature (1)..( 9): Result.002 file - promoters60/1035160
tttgaccat

SEQ ID NO: 105362 - DNA, 9 bp, Unknown
  misc_feature (1)..( 9): Result.002 file - promoters60/1035160
tttgaacat

SEQ ID NO: 105363 - DNA, 10 bp, Unknown
  misc_feature (1)..( 10): Result.002 file - promoters60/1035160
aaaactcgtg

SEQ ID NO: 105364 - DNA, 10 bp, Unknown
  misc_feature (1)..( 10): Result.002 file - promoters60/1035160
aaaacacgtg

SEQ ID NO: 105365 - DNA, 7 bp, Unknown
  misc_feature (1)..( 7): Result.002 file - promoters60/1035160
tctatat

SEQ ID NO: 105366 - DNA, 7 bp, Unknown
  misc_feature (1)..( 7): Result.002 file - promoters60/1035160
tctctat

SEQ ID NO: 105367 - DNA, 7 bp, Unknown
  misc_feature (1)..( 7): Result.002 file - promoters60/1035160
caatgaa

SEQ ID NO: 105368 - DNA, 7 bp, Unknown
  misc_feature (1)..( 7): Result.002 file - promoters60/1035160
caacgaa

SEQ ID NO: 105369 - DNA, 9 bp, Unknown
  misc_feature (1)..( 9): Result.002 file - promoters60/1035160
gaaaacgtg

SEQ ID NO: 105370 - DNA, 9 bp, Unknown
  misc_feature (1)..( 9): Result.002 file - promoters60/1035160
gaaaacagg

SEQ ID NO: 105371 - DNA, 9 bp, Unknown
  misc_feature (1)..( 9): Result.002 file - promoters60/1035160
aaaaaaagg

SEQ ID NO: 105372 - DNA, 8 bp, Unknown
  misc_feature (1)..( 8): Result.002 file - promoters60/1035172
ctataaat

SEQ ID NO: 105373 - DNA, 8 bp, Unknown
  misc_feature (1)..( 8): Result.002 file - promoters60/1035172
atataaag

SEQ ID NO: 105374 - DNA, 8 bp, Unknown
  misc_feature (1)..( 8): Result.002 file - promoters60/1035172
ctataaaa

SEQ ID NO: 105375 - DNA, 8 bp, Unknown
  misc_feature (1)..( 8): Result.002 file - promoters60/1035172
ggataaag

SEQ ID NO: 105376 - DNA, 9 bp, Unknown
  misc_feature (1)..( 9): Result.002 file - promoters60/1035172
ctatataac

SEQ ID NO: 105377 - DNA, 8 bp, Unknown
  misc_feature (1)..( 8): Result.002 file - promoters60/1035172
aaaattat

SEQ ID NO: 105378 - DNA, 8 bp, Unknown
  misc_feature (1)..( 8): Result.002 file - promoters60/1035172
aaaattaa

SEQ ID NO: 105379 - DNA, 8 bp, Unknown
  misc_feature (1)..( 8): Result.002 file - promoters60/1035172
aataataa

SEQ ID NO: 105380 - DNA, 8 bp, Unknown
  misc_feature (1)..( 8): Result.002 file - promoters60/1035172
aaaaatag

SEQ ID NO: 105381 - DNA, 8 bp, Unknown
  misc_feature (1)..( 8): Result.002 file - promoters60/1035172
aaacatag

SEQ ID NO: 105382 - DNA, 10 bp, Unknown
  misc_feature (1)..( 10): Result.002 file - promoters60/1035176
taaataaaag

SEQ ID NO: 105383 - DNA, 10 bp, Unknown
  misc_feature (1)..( 10): Result.002 file - promoters60/1035176
gatataaaaa

SEQ ID NO: 105384 - DNA, 10 bp, Unknown
  misc_feature (1)..( 10): Result.002 file - promoters60/1035176
gaaagaaaga

SEQ ID NO: 105385 - DNA, 10 bp, Unknown
  misc_feature (1)..( 10): Result.002 file - promoters60/1035176
attataaaat

SEQ ID NO: 105386 - DNA, 10 bp, Unknown
  misc_feature (1)..( 10): Result.002 file - promoters60/1035176
attagaaaat

SEQ ID NO: 105387 - DNA, 10 bp, Unknown
  misc_feature (1)..( 10): Result.002 file - promoters60/1035176
attctaaaaa

SEQ ID NO: 105388 - DNA, 11 bp, Unknown
  misc_feature (1)..( 11): Result.002 file - promoters60/1035176
cattatatata

SEQ ID NO: 105389 - DNA, 11 bp, Unknown
  misc_feature (1)..( 11): Result.002 file - promoters60/1035176
acatatataaa

SEQ ID NO: 105390 - DNA, 11 bp, Unknown
  misc_feature (1)..( 11): Result.002 file - promoters60/1035176
gcctatatata

SEQ ID NO: 105391 - DNA, 11 bp, Unknown
  misc_feature (1)..( 11): Result.002 file - promoters60/1035176
ccttataaata

SEQ ID NO: 105392 - DNA, 11 bp, Unknown
  misc_feature (1)..( 11): Result.002 file - promoters60/1035176
ccacataaatg

SEQ ID NO: 105393 - DNA, 11 bp, Unknown
  misc_feature (1)..( 11): Result.002 file - promoters60/1035176
ccttaaaaacc

SEQ ID NO: 105394 - DNA, 12 bp, Unknown
  misc_feature (1)..( 12): Result.002 file - promoters60/1035176
atccaaaatgaa

SEQ ID NO: 105395 - DNA, 12 bp, Unknown
  misc_feature (1)..( 12): Result.002 file - promoters60/1035176
ttaaaaaaagaa

SEQ ID NO: 105396 - DNA, 12 bp, Unknown
  misc_feature (1)..( 12): Result.002 file - promoters60/1035176
ccataaaaaata

SEQ ID NO: 105397 - DNA, 12 bp, Unknown
  misc_feature (1)..( 12): Result.002 file - promoters60/1035176
ttctaaaaagtt

SEQ ID NO: 105398 - DNA, 12 bp, Unknown
  misc_feature (1)..( 12): Result.002 file - promoters60/1035176
tgtgaaaaaaaa

SEQ ID NO: 105399 - DNA, 12 bp, Unknown
  misc_feature (1)..( 12): Result.002 file - promoters60/1035176
agtcaaacaaat

SEQ ID NO: 105400 - DNA, 12 bp, Unknown
  misc_feature (1)..( 12): Result.002 file - promoters60/1035176
ttagaaacagac

SEQ ID NO: 105401 - DNA, 10 bp, Unknown
  misc_feature (1)..( 10): Result.002 file - promoters60/1035176
taaaaaatat

SEQ ID NO: 105402 - DNA, 10 bp, Unknown
  misc_feature (1)..( 10): Result.002 file - promoters60/1035176
taaaaaaaga

SEQ ID NO: 105403 - DNA, 10 bp, Unknown
  misc_feature (1)..( 10): Result.002 file - promoters60/1035176
taaaaagtta

SEQ ID NO: 105404 - DNA, 10 bp, Unknown
  misc_feature (1)..( 10): Result.002 file - promoters60/1035176
gaaaaaaaaa

SEQ ID NO: 105405 - DNA, 11 bp, Unknown
  misc_feature (1)..( 11): Result.002 file - promoters60/1035176
caaacaaatgt

SEQ ID NO: 105406 - DNA, 11 bp, Unknown
  misc_feature (1)..( 11): Result.002 file - promoters60/1035176
ttagaaacaga

SEQ ID NO: 105407 - DNA, 9 bp, Unknown
  misc_feature (1)..( 9): Result.002 file - promoters60/1035267
tcaaataat

SEQ ID NO: 105408 - DNA, 9 bp, Unknown
  misc_feature (1)..( 9): Result.002 file - promoters60/1035267
gaaaacaat

SEQ ID NO: 105409 - DNA, 9 bp, Unknown
  misc_feature (1)..( 9): Result.002 file - promoters60/1035267
acaaattta

SEQ ID NO: 105410 - DNA, 9 bp, Unknown
  misc_feature (1)..( 9): Result.002 file - promoters60/1035267
taaaattta

SEQ ID NO: 105411 - DNA, 10 bp, Unknown
  misc_feature (1)..( 10): Result.002 file - promoters60/1035267
aatttgtctt

SEQ ID NO: 105412 - DNA, 10 bp, Unknown
  misc_feature (1)..( 10): Result.002 file - promoters60/1035267
tatttatcta

SEQ ID NO: 105413 - DNA, 10 bp, Unknown
  misc_feature (1)..( 10): Result.002 file - promoters60/1035267
aatctgttta

SEQ ID NO: 105414 - DNA, 10 bp, Unknown
  misc_feature (1)..( 10): Result.002 file - promoters60/1035267
attttgttta

SEQ ID NO: 105415 - DNA, 7 bp, Unknown
  misc_feature (1)..( 7): Result.002 file - promoters60/1035306
tgtggtt

SEQ ID NO: 105416 - DNA, 7 bp, Unknown
  misc_feature (1)..( 7): Result.002 file - promoters60/1035306
tgtagtt

SEQ ID NO: 105417 - DNA, 6 bp, Unknown
  misc_feature (1)..( 6): Result.002 file - promoters60/1035306
cgtaaa

SEQ ID NO: 105418 - DNA, 6 bp, Unknown
  misc_feature (1)..( 6): Result.002 file - promoters60/1035306
cgtaaa

SEQ ID NO: 105419 - DNA, 8 bp, Unknown
  misc_feature (1)..( 8): Result.002 file - promoters60/1035306
taaatcaa

SEQ ID NO: 105420 - DNA, 8 bp, Unknown
  misc_feature (1)..( 8): Result.002 file - promoters60/1035306
taaaacaa

SEQ ID NO: 105421 - DNA, 11 bp, Unknown
  misc_feature (1)..( 11): Result.002 file - promoters60/1035306
caaataatatt

SEQ ID NO: 105422 - DNA, 11 bp, Unknown
  misc_feature (1)..( 11): Result.002 file - promoters60/1035306
caattaatatt

SEQ ID NO: 105423 - DNA, 6 bp, Unknown
  misc_feature (1)..( 6): Result.002 file - promoters60/1035306
atattt

SEQ ID NO: 105424 - DNA, 6 bp, Unknown
  misc_feature (1)..( 6): Result.002 file - promoters60/1035306
atattt

SEQ ID NO: 105425 - DNA, 6 bp, Unknown
  misc_feature (1)..( 6): Result.002 file - promoters60/1035306
ttgtat

SEQ ID NO: 105426 - DNA, 6 bp, Unknown
  misc_feature (1)..( 6): Result.002 file - promoters60/1035306
ttgtat

SEQ ID NO: 105427 - DNA, 7 bp, Unknown
  misc_feature (1)..( 7): Result.002 file - promoters60/1035306
atattaa

SEQ ID NO: 105428 - DNA, 7 bp, Unknown
  misc_feature (1)..( 7): Result.002 file - promoters60/1035306
ataataa

SEQ ID NO: 105429 - DNA, 7 bp, Unknown
  misc_feature (1)..( 7): Result.002 file - promoters60/1035306
tatctat

SEQ ID NO: 105430 - DNA, 7 bp, Unknown
  misc_feature (1)..( 7): Result.002 file - promoters60/1035306
tatatat

SEQ ID NO: 105431 - DNA, 7 bp, Unknown
  misc_feature (1)..( 7): Result.002 file - promoters60/1035306
tgtaaaa

SEQ ID NO: 105432 - DNA, 7 bp, Unknown
  misc_feature (1)..( 7): Result.002 file - promoters60/1035306
tgttaaa

SEQ ID NO: 105433 - DNA, 6 bp, Unknown
  misc_feature (1)..( 6): Result.002 file - promoters60/1035306
gtagaa

SEQ ID NO: 105434 - DNA, 6 bp, Unknown
  misc_feature (1)..( 6): Result.002 file - promoters60/1035306
gtagaa

SEQ ID NO: 105435 - DNA, 8 bp, Unknown
  misc_feature (1)..( 8): Result.002 file - promoters60/1035306
aacatgca

SEQ ID NO: 105436 - DNA, 8 bp, Unknown
  misc_feature (1)..( 8): Result.002 file - promoters60/1035306
aacgtgca

SEQ ID NO: 105437 - DNA, 10 bp, Unknown
  misc_feature (1)..( 10): Result.002 file - promoters60/1035306
ctttaaaaaa

SEQ ID NO: 105438 - DNA, 10 bp, Unknown
  misc_feature (1)..( 10): Result.002 file - promoters60/1035306
ctttaaaaaa

SEQ ID NO: 105439 - DNA, 9 bp, Unknown
  misc_feature (1)..( 9): Result.002 file - promoters60/1035306
tattataat

SEQ ID NO: 105440 - DNA, 9 bp, Unknown
  misc_feature (1)..( 9): Result.002 file - promoters60/1035306
tattaaaat

SEQ ID NO: 105441 - DNA, 7 bp, Unknown
  misc_feature (1)..( 7): Result.002 file - promoters60/1035306
atcaaat

SEQ ID NO: 105442 - DNA, 7 bp, Unknown
  misc_feature (1)..( 7): Result.002 file - promoters60/1035306
atcgaat

SEQ ID NO: 105443 - DNA, 6 bp, Unknown
  misc_feature (1)..( 6): Result.002 file - promoters60/1035306
aattat

SEQ ID NO: 105444 - DNA, 6 bp, Unknown
  misc_feature (1)..( 6): Result.002 file - promoters60/1035306
aattat

SEQ ID NO: 105445 - DNA, 11 bp, Unknown
  misc_feature (1)..( 11): Result.002 file - promoters60/1035306
atttataaaat

SEQ ID NO: 105446 - DNA, 11 bp, Unknown
  misc_feature (1)..( 11): Result.002 file - promoters60/1035306
atttataaaat

SEQ ID NO: 105447 - DNA, 9 bp, Unknown
  misc_feature (1)..( 9): Result.002 file - promoters60/1035306
aaaagttat

SEQ ID NO: 105448 - DNA, 9 bp, Unknown
  misc_feature (1)..( 9): Result.002 file - promoters60/1035306
aaaggttat

SEQ ID NO: 105449 - DNA, 12 bp, Unknown
  misc_feature (1)..( 12): Result.002 file - promoters60/1035312
tgaatcaaaacc

SEQ ID NO: 105450 - DNA, 12 bp, Unknown
  misc_feature (1)..( 12): Result.002 file - promoters60/1035312
aaaatcaaaaat

SEQ ID NO: 105451 - DNA, 12 bp, Unknown
  misc_feature (1)..( 12): Result.002 file - promoters60/1035312
tgattcactctt

SEQ ID NO: 105452 - DNA, 12 bp, Unknown
  misc_feature (1)..( 12): Result.002 file - promoters60/1035312
catgtcaaaaag

SEQ ID NO: 105453 - DNA, 12 bp, Unknown
  misc_feature (1)..( 12): Result.002 file - promoters60/1035312
ttaatcaacaat

SEQ ID NO: 105454 - DNA, 12 bp, Unknown
  misc_feature (1)..( 12): Result.002 file - promoters60/1035312
atgggcaataat

SEQ ID NO: 105455 - DNA, 12 bp, Unknown
  misc_feature (1)..( 12): Result.002 file - promoters60/1035312
aaattcaaggtt

SEQ ID NO: 105456 - DNA, 10 bp, Unknown
  misc_feature (1)..( 10): Result.002 file - promoters60/1035312
aagggttttt

SEQ ID NO: 105457 - DNA, 10 bp, Unknown
  misc_feature (1)..( 10): Result.002 file - promoters60/1035312
ataagttttt

SEQ ID NO: 105458 - DNA, 10 bp, Unknown
  misc_feature (1)..( 10): Result.002 file - promoters60/1035312
acttgttttt

SEQ ID NO: 105459 - DNA, 10 bp, Unknown
  misc_feature (1)..( 10): Result.002 file - promoters60/1035312
tagtgtattt

SEQ ID NO: 105460 - DNA, 10 bp, Unknown
  misc_feature (1)..( 10): Result.002 file - promoters60/1035312
taaggtttca

SEQ ID NO: 105461 - DNA, 10 bp, Unknown
  misc_feature (1)..( 10): Result.002 file - promoters60/1035312
cattgatttg

SEQ ID NO: 105462 - DNA, 6 bp, Unknown
  misc_feature (1)..( 6): Result.002 file - promoters60/1035323
acaaaa

SEQ ID NO: 105463 - DNA, 6 bp, Unknown
  misc_feature (1)..( 6): Result.002 file - promoters60/1035323
acaaaa

SEQ ID NO: 105464 - DNA, 6 bp, Unknown
  misc_feature (1)..( 6): Result.002 file - promoters60/1035323
ttgaaa

SEQ ID NO: 105465 - DNA, 6 bp, Unknown
  misc_feature (1)..( 6): Result.002 file - promoters60/1035323
ttgaaa

SEQ ID NO: 105466 - DNA, 7 bp, Unknown
  misc_feature (1)..( 7): Result.002 file - promoters60/1035323
ttcgttt

SEQ ID NO: 105467 - DNA, 7 bp, Unknown
  misc_feature (1)..( 7): Result.002 file - promoters60/1035323
ttccttt

SEQ ID NO: 105468 - DNA, 8 bp, Unknown
  misc_feature (1)..( 8): Result.002 file - promoters60/1035323
tttctttt

SEQ ID NO: 105469 - DNA, 8 bp, Unknown
  misc_feature (1)..( 8): Result.002 file - promoters60/1035323
tttatttt

SEQ ID NO: 105470 - DNA, 8 bp, Unknown
  misc_feature (1)..( 8): Result.002 file - promoters60/1035323
tttatttc

SEQ ID NO: 105471 - DNA, 7 bp, Unknown
  misc_feature (1)..( 7): Result.002 file - promoters60/1035323
ttcttct

SEQ ID NO: 105472 - DNA, 7 bp, Unknown
  misc_feature (1)..( 7): Result.002 file - promoters60/1035323
ttcgtct

SEQ ID NO: 105473 - DNA, 6 bp, Unknown
  misc_feature (1)..( 6): Result.002 file - promoters60/1035323
tgatca

SEQ ID NO: 105474 - DNA, 6 bp, Unknown
  misc_feature (1)..( 6): Result.002 file - promoters60/1035323
tgatca

SEQ ID NO: 105475 - DNA, 9 bp, Unknown
  misc_feature (1)..( 9): Result.002 file - promoters60/1035323
tgaacaact

SEQ ID NO: 105476 - DNA, 9 bp, Unknown
  misc_feature (1)..( 9): Result.002 file - promoters60/1035323
tgaaccact

SEQ ID NO: 105477 - DNA, 12 bp, Unknown
  misc_feature (1)..( 12): Result.002 file - promoters60/1035323
tttttgaaattc

SEQ ID NO: 105478 - DNA, 12 bp, Unknown
  misc_feature (1)..( 12): Result.002 file - promoters60/1035323
tttctgaaattt

SEQ ID NO: 105479 - DNA, 12 bp, Unknown
  misc_feature (1)..( 12): Result.002 file - promoters60/1035323
ctgatcaaattt

SEQ ID NO: 105480 - DNA, 8 bp, Unknown
  misc_feature (1)..( 8): Result.002 file - promoters60/1035323
caactgta

SEQ ID NO: 105481 - DNA, 8 bp, Unknown
  misc_feature (1)..( 8): Result.002 file - promoters60/1035323
aaactgtt

SEQ ID NO: 105482 - DNA, 8 bp, Unknown
  misc_feature (1)..( 8): Result.002 file - promoters60/1035323
aaattgtt

SEQ ID NO: 105483 - DNA, 6 bp, Unknown
  misc_feature (1)..( 6): Result.002 file - promoters60/1035323
taataa

SEQ ID NO: 105484 - DNA, 6 bp, Unknown
  misc_feature (1)..( 6): Result.002 file - promoters60/1035323
taataa

SEQ ID NO: 105485 - DNA, 6 bp, Unknown
  misc_feature (1)..( 6): Result.002 file - promoters60/1035323
ttttct

SEQ ID NO: 105486 - DNA, 6 bp, Unknown
  misc_feature (1)..( 6): Result.002 file - promoters60/1035323
ttttct

SEQ ID NO: 105487 - DNA, 7 bp, Unknown
  misc_feature (1)..( 7): Result.002 file - promoters60/1035323
atcgtca

SEQ ID NO: 105488 - DNA, 7 bp, Unknown
  misc_feature (1)..( 7): Result.002 file - promoters60/1035323
atcttca

SEQ ID NO: 105489 - DNA, 7 bp, Unknown
  misc_feature (1)..( 7): Result.002 file - promoters60/1035323
aaaccgg

SEQ ID NO: 105490 - DNA, 7 bp, Unknown
  misc_feature (1)..( 7): Result.002 file - promoters60/1035323
aaaccgg

SEQ ID NO: 105491 - DNA, 9 bp, Unknown
  misc_feature (1)..( 9): Result.002 file - promoters60/1035323
cttttttcc

SEQ ID NO: 105492 - DNA, 9 bp, Unknown
  misc_feature (1)..( 9): Result.002 file - promoters60/1035323
cttttttcc

SEQ ID NO: 105493 - DNA, 6 bp, Unknown
  misc_feature (1)..( 6): Result.002 file - promoters60/1035323
aatttg

SEQ ID NO: 105494 - DNA, 6 bp, Unknown
  misc_feature (1)..( 6): Result.002 file - promoters60/1035323
aatttg

SEQ ID NO: 105495 - DNA, 7 bp, Unknown
  misc_feature (1)..( 7): Result.002 file - promoters60/1035323
ttgttaa

SEQ ID NO: 105496 - DNA, 7 bp, Unknown
  misc_feature (1)..( 7): Result.002 file - promoters60/1035323
ttgataa

SEQ ID NO: 105497 - DNA, 6 bp, Unknown
  misc_feature (1)..( 6): Result.002 file - promoters60/1035323
gtatat

SEQ ID NO: 105498 - DNA, 6 bp, Unknown
  misc_feature (1)..( 6): Result.002 file - promoters60/1035323
gtatat

SEQ ID NO: 105499 - DNA, 6 bp, Unknown
  misc_feature (1)..( 6): Result.002 file - promoters60/1035373
taaagg

SEQ ID NO: 105500 - DNA, 6 bp, Unknown
  misc_feature (1)..( 6): Result.002 file - promoters60/1035373
taaagg

SEQ ID NO: 105501 - DNA, 7 bp, Unknown
  misc_feature (1)..( 7): Result.002 file - promoters60/1035373
ctacaaa

SEQ ID NO: 105502 - DNA, 7 bp, Unknown
  misc_feature (1)..( 7): Result.002 file - promoters60/1035373
ctataaa

SEQ ID NO: 105503 - DNA, 7 bp, Unknown
  misc_feature (1)..( 7): Result.002 file - promoters60/1035373
aaacgct

SEQ ID NO: 105504 - DNA, 7 bp, Unknown
  misc_feature (1)..( 7): Result.002 file - promoters60/1035373
aaaggct

SEQ ID NO: 105505 - DNA, 7 bp, Unknown
  misc_feature (1)..( 7): Result.002 file - promoters60/1035373
atttaga

SEQ ID NO: 105506 - DNA, 7 bp, Unknown
  misc_feature (1)..( 7): Result.002 file - promoters60/1035373
attgaga

SEQ ID NO: 105507 - DNA, 7 bp, Unknown
  misc_feature (1)..( 7): Result.002 file - promoters60/1035373
gatccag

SEQ ID NO: 105508 - DNA, 7 bp, Unknown
  misc_feature (1)..( 7): Result.002 file - promoters60/1035373
gatacag

SEQ ID NO: 105509 - DNA, 6 bp, Unknown
  misc_feature (1)..( 6): Result.002 file - promoters60/1035373
attcca

SEQ ID NO: 105510 - DNA, 6 bp, Unknown
  misc_feature (1)..( 6): Result.002 file - promoters60/1035373
attcca

SEQ ID NO: 105511 - DNA, 7 bp, Unknown
  misc_feature (1)..( 7): Result.002 file - promoters60/1035373
aaacctg

SEQ ID NO: 105512 - DNA, 7 bp, Unknown
  misc_feature (1)..( 7): Result.002 file - promoters60/1035373
aaagctg

SEQ ID NO: 105513 - DNA, 6 bp, Unknown
  misc_feature (1)..( 6): Result.002 file - promoters60/1035373
tttgac

SEQ ID NO: 105514 - DNA, 6 bp, Unknown
  misc_feature (1)..( 6): Result.002 file - promoters60/1035373
tttgac

SEQ ID NO: 105515 - DNA, 6 bp, Unknown
  misc_feature (1)..( 6): Result.002 file - promoters60/1035373
acggta

SEQ ID NO: 105516 - DNA, 6 bp, Unknown
  misc_feature (1)..( 6): Result.002 file - promoters60/1035373
acggta

SEQ ID NO: 105517 - DNA, 7 bp, Unknown
  misc_feature (1)..( 7): Result.002 file - promoters60/1035373
tcacgtt

SEQ ID NO: 105518 - DNA, 7 bp, Unknown
  misc_feature (1)..( 7): Result.002 file - promoters60/1035373
tcaagtt

SEQ ID NO: 105519 - DNA, 9 bp, Unknown
  misc_feature (1)..( 9): Result.002 file - promoters60/1035373
atttgattt

SEQ ID NO: 105520 - DNA, 9 bp, Unknown
  misc_feature (1)..( 9): Result.002 file - promoters60/1035373
atttaattt

SEQ ID NO: 105521 - DNA, 7 bp, Unknown
  misc_feature (1)..( 7): Result.002 file - promoters60/1035507
caaaagt

SEQ ID NO: 105522 - DNA, 7 bp, Unknown
  misc_feature (1)..( 7): Result.002 file - promoters60/1035507
aaaaagt

SEQ ID NO: 105523 - DNA, 8 bp, Unknown
  misc_feature (1)..( 8): Result.002 file - promoters60/1035507
taaagagt

SEQ ID NO: 105524 - DNA, 10 bp, Unknown
  misc_feature (1)..( 10): Result.002 file - promoters60/1035507
tttcagtttc

SEQ ID NO: 105525 - DNA, 10 bp, Unknown
  misc_feature (1)..( 10): Result.002 file - promoters60/1035507
tttcattttt

SEQ ID NO: 105526 - DNA, 10 bp, Unknown
  misc_feature (1)..( 10): Result.002 file - promoters60/1035507
caagattttt

SEQ ID NO: 105527 - DNA, 10 bp, Unknown
  misc_feature (1)..( 10): Result.002 file - promoters60/1035507
aattattttc

SEQ ID NO: 105528 - DNA, 9 bp, Unknown
  misc_feature (1)..( 9): Result.002 file - promoters60/1035507
ttcaatttg

SEQ ID NO: 105529 - DNA, 9 bp, Unknown
  misc_feature (1)..( 9): Result.002 file - promoters60/1035507
tacaaattg

SEQ ID NO: 105530 - DNA, 9 bp, Unknown
  misc_feature (1)..( 9): Result.002 file - promoters60/1035507
ttcaattgg

SEQ ID NO: 105531 - DNA, 12 bp, Unknown
  misc_feature (1)..( 12): Result.002 file - promoters60/1035507
aatttggttaat

SEQ ID NO: 105532 - DNA, 12 bp, Unknown
  misc_feature (1)..( 12): Result.002 file - promoters60/1035507
tctttgtttatt

SEQ ID NO: 105533 - DNA, 12 bp, Unknown
  misc_feature (1)..( 12): Result.002 file - promoters60/1035507
tctttatttatt

SEQ ID NO: 105534 - DNA, 7 bp, Unknown
  misc_feature (1)..( 7): Result.002 file - promoters60/1035507
tataaaa

SEQ ID NO: 105535 - DNA, 7 bp, Unknown
  misc_feature (1)..( 7): Result.002 file - promoters60/1035507
cataaaa

SEQ ID NO: 105536 - DNA, 7 bp, Unknown
  misc_feature (1)..( 7): Result.002 file - promoters60/1035507
cattaaa

SEQ ID NO: 105537 - DNA, 7 bp, Unknown
  misc_feature (1)..( 7): Result.002 file - promoters60/1035623
ttagcca

SEQ ID NO: 105538 - DNA, 7 bp, Unknown
  misc_feature (1)..( 7): Result.002 file - promoters60/1035623
ttatcca

SEQ ID NO: 105539 - DNA, 7 bp, Unknown
  misc_feature (1)..( 7): Result.002 file - promoters60/1035623
cagggac

SEQ ID NO: 105540 - DNA, 7 bp, Unknown
  misc_feature (1)..( 7): Result.002 file - promoters60/1035623
cagagac

SEQ ID NO: 105541 - DNA, 6 bp, Unknown
  misc_feature (1)..( 6): Result.002 file - promoters60/1035623
tttgtt

SEQ ID NO: 105542 - DNA, 6 bp, Unknown
  misc_feature (1)..( 6): Result.002 file - promoters60/1035623
tttgtt

SEQ ID NO: 105543 - DNA, 6 bp, Unknown
  misc_feature (1)..( 6): Result.002 file - promoters60/1035623
cttctt

SEQ ID NO: 105544 - DNA, 6 bp, Unknown
  misc_feature (1)..( 6): Result.002 file - promoters60/1035623
cttctt

SEQ ID NO: 105545 - DNA, 7 bp, Unknown
  misc_feature (1)..( 7): Result.002 file - promoters60/1035623
ttctgga

SEQ ID NO: 105546 - DNA, 7 bp, Unknown
  misc_feature (1)..( 7): Result.002 file - promoters60/1035623
ttctgga

SEQ ID NO: 105547 - DNA, 7 bp, Unknown
  misc_feature (1)..( 7): Result.002 file - promoters60/1035623
tgtatat

SEQ ID NO: 105548 - DNA, 7 bp, Unknown
  misc_feature (1)..( 7): Result.002 file - promoters60/1035623
tgtctat

SEQ ID NO: 105549 - DNA, 8 bp, Unknown
  misc_feature (1)..( 8): Result.002 file - promoters60/1035623
tctggttt

SEQ ID NO: 105550 - DNA, 8 bp, Unknown
  misc_feature (1)..( 8): Result.002 file - promoters60/1035623
tctggttt

SEQ ID NO: 105551 - DNA, 7 bp, Unknown
  misc_feature (1)..( 7): Result.002 file - promoters60/1035623
tttactt

SEQ ID NO: 105552 - DNA, 7 bp, Unknown
  misc_feature (1)..( 7): Result.002 file - promoters60/1035623
tttgctt

SEQ ID NO: 105553 - DNA, 8 bp, Unknown
  misc_feature (1)..( 8): Result.002 file - promoters60/1035623
cttttctc

SEQ ID NO: 105554 - DNA, 8 bp, Unknown
  misc_feature (1)..( 8): Result.002 file - promoters60/1035623
cttgtctc

SEQ ID NO: 105555 - DNA, 7 bp, Unknown
  misc_feature (1)..( 7): Result.002 file - promoters60/1035623
ttgaagc

SEQ ID NO: 105556 - DNA, 7 bp, Unknown
  misc_feature (1)..( 7): Result.002 file - promoters60/1035623
ttgaagc

SEQ ID NO: 105557 - DNA, 6 bp, Unknown
  misc_feature (1)..( 6): Result.002 file - promoters60/1035623
cctttt

SEQ ID NO: 105558 - DNA, 6 bp, Unknown
  misc_feature (1)..( 6): Result.002 file - promoters60/1035623
cctttt

SEQ ID NO: 105559 - DNA, 7 bp, Unknown
  misc_feature (1)..( 7): Result.002 file - promoters60/1035623
ttttttt

SEQ ID NO: 105560 - DNA, 7 bp, Unknown
  misc_feature (1)..( 7): Result.002 file - promoters60/1035623
ttttttt

SEQ ID NO: 105561 - DNA, 7 bp, Unknown
  misc_feature (1)..( 7): Result.002 file - promoters60/1035623
ggcctat

SEQ ID NO: 105562 - DNA, 7 bp, Unknown
  misc_feature (1)..( 7): Result.002 file - promoters60/1035623
ggcctat

SEQ ID NO: 105563 - DNA, 8 bp, Unknown
  misc_feature (1)..( 8): Result.002 file - promoters60/1035632
agataaaa

SEQ ID NO: 105564 - DNA, 8 bp, Unknown
  misc_feature (1)..( 8): Result.002 file - promoters60/1035632
tgattaaa

SEQ ID NO: 105565 - DNA, 8 bp, Unknown
  misc_feature (1)..( 8): Result.002 file - promoters60/1035632
taataaaa

SEQ ID NO: 105566 - DNA, 8 bp, Unknown
  misc_feature (1)..( 8): Result.002 file - promoters60/1035632
ccataaaa

SEQ ID NO: 105567 - DNA, 8 bp, Unknown
  misc_feature (1)..( 8): Result.002 file - promoters60/1035632
taatgaaa

SEQ ID NO: 105568 - DNA, 8 bp, Unknown
  misc_feature (1)..( 8): Result.002 file - promoters60/1035632
gaataaat

SEQ ID NO: 105569 - DNA, 11 bp, Unknown
  misc_feature (1)..( 11): Result.002 file - promoters60/1035632
gacaaaagata

SEQ ID NO: 105570 - DNA, 11 bp, Unknown
  misc_feature (1)..( 11): Result.002 file - promoters60/1035632
tataaaaaata

SEQ ID NO: 105571 - DNA, 11 bp, Unknown
  misc_feature (1)..( 11): Result.002 file - promoters60/1035632
cacaaaagaat

SEQ ID NO: 105572 - DNA, 11 bp, Unknown
  misc_feature (1)..( 11): Result.002 file - promoters60/1035632
aacacaagtga

SEQ ID NO: 105573 - DNA, 11 bp, Unknown
  misc_feature (1)..( 11): Result.002 file - promoters60/1035632
aacacacacta

SEQ ID NO: 105574 - DNA, 11 bp, Unknown
  misc_feature (1)..( 11): Result.002 file - promoters60/1035632
ctgaaaacaaa

SEQ ID NO: 105575 - DNA, 11 bp, Unknown
  misc_feature (1)..( 11): Result.002 file - promoters60/1035632
cataaaaaatt

SEQ ID NO: 105576 - DNA, 10 bp, Unknown
  misc_feature (1)..( 10): Result.002 file - promoters60/1035632
gtgtttttct

SEQ ID NO: 105577 - DNA, 10 bp, Unknown
  misc_feature (1)..( 10): Result.002 file - promoters60/1035632
tgatttttct

SEQ ID NO: 105578 - DNA, 10 bp, Unknown
  misc_feature (1)..( 10): Result.002 file - promoters60/1035632
cagttttttt

SEQ ID NO: 105579 - DNA, 10 bp, Unknown
  misc_feature (1)..( 10): Result.002 file - promoters60/1035632
agcgttttct

SEQ ID NO: 105580 - DNA, 10 bp, Unknown
  misc_feature (1)..( 10): Result.002 file - promoters60/1035632
tgatttttaa

SEQ ID NO: 105581 - DNA, 10 bp, Unknown
  misc_feature (1)..( 10): Result.002 file - promoters60/1035632
acgtttgtat

SEQ ID NO: 105582 - DNA, 8 bp, Unknown
  misc_feature (1)..( 8): Result.002 file - promoters60/1035632
ttttctgt

SEQ ID NO: 105583 - DNA, 8 bp, Unknown
  misc_feature (1)..( 8): Result.002 file - promoters60/1035632
atttttgt

SEQ ID NO: 105584 - DNA, 8 bp, Unknown
  misc_feature (1)..( 8): Result.002 file - promoters60/1035632
ttttctat

SEQ ID NO: 105585 - DNA, 8 bp, Unknown
  misc_feature (1)..( 8): Result.002 file - promoters60/1035632
atttttaa

SEQ ID NO: 105586 - DNA, 8 bp, Unknown
  misc_feature (1)..( 8): Result.002 file - promoters60/1035632
gtttgtat

SEQ ID NO: 105587 - DNA, 8 bp, Unknown
  misc_feature (1)..( 8): Result.002 file - promoters60/1035632
ttttcttc

SEQ ID NO: 105588 - DNA, 7 bp, Unknown
  misc_feature (1)..( 7): Result.002 file - promoters60/1035665
gtgcaat

SEQ ID NO: 105589 - DNA, 7 bp, Unknown
  misc_feature (1)..( 7): Result.002 file - promoters60/1035665
gtgaaat

SEQ ID NO: 105590 - DNA, 7 bp, Unknown
  misc_feature (1)..( 7): Result.002 file - promoters60/1035665
taagtta

SEQ ID NO: 105591 - DNA, 7 bp, Unknown
  misc_feature (1)..( 7): Result.002 file - promoters60/1035665
taaatta

SEQ ID NO: 105592 - DNA, 7 bp, Unknown
  misc_feature (1)..( 7): Result.002 file - promoters60/1035665
taattta

SEQ ID NO: 105593 - DNA, 16 bp, Unknown
  misc_feature (1)..( 16): Result.002 file - promoters60/1035665
ttaattattaattttt

SEQ ID NO: 105594 - DNA, 16 bp, Unknown
  misc_feature (1)..( 16): Result.002 file - promoters60/1035665
ttctcaaggaatcttt

SEQ ID NO: 105595 - DNA, 16 bp, Unknown
  misc_feature (1)..( 16): Result.002 file - promoters60/1035665
ttatttactaatttat

SEQ ID NO: 105596 - DNA, 7 bp, Unknown
  misc_feature (1)..( 7): Result.002 file - promoters60/1035665
catctta

SEQ ID NO: 105597 - DNA, 7 bp, Unknown
  misc_feature (1)..( 7): Result.002 file - promoters60/1035665
catgtta

SEQ ID NO: 105598 - DNA, 7 bp, Unknown
  misc_feature (1)..( 7): Result.002 file - promoters60/1035665
tgcattt

SEQ ID NO: 105599 - DNA, 7 bp, Unknown
  misc_feature (1)..( 7): Result.002 file - promoters60/1035665
tgcgttt

SEQ ID NO: 105600 - DNA, 6 bp, Unknown
  misc_feature (1)..( 6): Result.002 file - promoters60/1035665
ttaaaa

SEQ ID NO: 105601 - DNA, 6 bp, Unknown
  misc_feature (1)..( 6): Result.002 file - promoters60/1035665
ttaaaa

SEQ ID NO: 105602 - DNA, 7 bp, Unknown
  misc_feature (1)..( 7): Result.002 file - promoters60/1035665
aaaagta

SEQ ID NO: 105603 - DNA, 7 bp, Unknown
  misc_feature (1)..( 7): Result.002 file - promoters60/1035665
aaaagta

SEQ ID NO: 105604 - DNA, 9 bp, Unknown
  misc_feature (1)..( 9): Result.002 file - promoters60/1035665
atcagtttt

SEQ ID NO: 105605 - DNA, 9 bp, Unknown
  misc_feature (1)..( 9): Result.002 file - promoters60/1035665
atcattttt

SEQ ID NO: 105606 - DNA, 8 bp, Unknown
  misc_feature (1)..( 8): Result.002 file - promoters60/1035665
tgattttt

SEQ ID NO: 105607 - DNA, 8 bp, Unknown
  misc_feature (1)..( 8): Result.002 file - promoters60/1035665
tgaatttt

SEQ ID NO: 105608 - DNA, 6 bp, Unknown
  misc_feature (1)..( 6): Result.002 file - promoters60/1035665
tttgtt

SEQ ID NO: 105609 - DNA, 6 bp, Unknown
  misc_feature (1)..( 6): Result.002 file - promoters60/1035665
tttgtt

SEQ ID NO: 105610 - DNA, 8 bp, Unknown
  misc_feature (1)..( 8): Result.002 file - promoters60/1035665
gtttcata

SEQ ID NO: 105611 - DNA, 8 bp, Unknown
  misc_feature (1)..( 8): Result.002 file - promoters60/1035665
atttcatt

SEQ ID NO: 105612 - DNA, 8 bp, Unknown
  misc_feature (1)..( 8): Result.002 file - promoters60/1035665
atttgatt

SEQ ID NO: 105613 - DNA, 6 bp, Unknown
  misc_feature (1)..( 6): Result.002 file - promoters60/1035665
aaaaaa

SEQ ID NO: 105614 - DNA, 6 bp, Unknown
  misc_feature (1)..( 6): Result.002 file - promoters60/1035665
aaaaaa

SEQ ID NO: 105615 - DNA, 8 bp, Unknown
  misc_feature (1)..( 8): Result.002 file - promoters60/1035665
caaaaact

SEQ ID NO: 105616 - DNA, 8 bp, Unknown
  misc_feature (1)..( 8): Result.002 file - promoters60/1035665
caaaaact

SEQ ID NO: 105617 - DNA, 9 bp, Unknown
  misc_feature (1)..( 9): Result.002 file - promoters60/1035665
ttgggcctt

SEQ ID NO: 105618 - DNA, 9 bp, Unknown
  misc_feature (1)..( 9): Result.002 file - promoters60/1035665
atgggcctt

SEQ ID NO: 105619 - DNA, 9 bp, Unknown
  misc_feature (1)..( 9): Result.002 file - promoters60/1035665
ttgggcttt

SEQ ID NO: 105620 - DNA, 12 bp, Unknown
  misc_feature (1)..( 12): Result.002 file - promoters60/1035665
tttttttttttt

SEQ ID NO: 105621 - DNA, 12 bp, Unknown
  misc_feature (1)..( 12): Result.002 file - promoters60/1035665
ttttctttattt

SEQ ID NO: 105622 - DNA, 8 bp, Unknown
  misc_feature (1)..( 8): Result.002 file - promoters60/1035665
ttaattat

SEQ ID NO: 105623 - DNA, 8 bp, Unknown
  misc_feature (1)..( 8): Result.002 file - promoters60/1035665
ttaaatat

SEQ ID NO: 105624 - DNA, 6 bp, Unknown
  misc_feature (1)..( 6): Result.002 file - promoters60/1035665
tttaat

SEQ ID NO: 105625 - DNA, 6 bp, Unknown
  misc_feature (1)..( 6): Result.002 file - promoters60/1035665
tttaat

SEQ ID NO: 105626 - DNA, 6 bp, Unknown
  misc_feature (1)..( 6): Result.002 file - promoters60/1035665
ccaagt

SEQ ID NO: 105627 - DNA, 6 bp, Unknown
  misc_feature (1)..( 6): Result.002 file - promoters60/1035665
ccaagt

SEQ ID NO: 105628 - DNA, 11 bp, Unknown
  misc_feature (1)..( 11): Result.002 file - promoters60/1035665
taaattttgtt

SEQ ID NO: 105629 - DNA, 11 bp, Unknown
  misc_feature (1)..( 11): Result.002 file - promoters60/1035665
taaaatttgat

SEQ ID NO: 105630 - DNA, 11 bp, Unknown
  misc_feature (1)..( 11): Result.002 file - promoters60/1035665
ttgatttcatt

SEQ ID NO: 105631 - DNA, 7 bp, Unknown
  misc_feature (1)..( 7): Result.002 file - promoters60/1035665
aaatagt

SEQ ID NO: 105632 - DNA, 7 bp, Unknown
  misc_feature (1)..( 7): Result.002 file - promoters60/1035665
aaaaagt

SEQ ID NO: 105633 - DNA, 6 bp, Unknown
  misc_feature (1)..( 6): Result.002 file - promoters60/1035665
caaaaa

SEQ ID NO: 105634 - DNA, 6 bp, Unknown
  misc_feature (1)..( 6): Result.002 file - promoters60/1035665
caaaaa

SEQ ID NO: 105635 - DNA, 6 bp, Unknown
  misc_feature (1)..( 6): Result.002 file - promoters60/1035665
ttgtgt

SEQ ID NO: 105636 - DNA, 6 bp, Unknown
  misc_feature (1)..( 6): Result.002 file - promoters60/1035665
ttgtgt

SEQ ID NO: 105637 - DNA, 11 bp, Unknown
  misc_feature (1)..( 11): Result.002 file - promoters60/1035665
gtttgacatat

SEQ ID NO: 105638 - DNA, 11 bp, Unknown
  misc_feature (1)..( 11): Result.002 file - promoters60/1035665
gtttgacatat

SEQ ID NO: 105639 - DNA, 7 bp, Unknown
  misc_feature (1)..( 7): Result.002 file - promoters60/1035665
ttatttc

SEQ ID NO: 105640 - DNA, 7 bp, Unknown
  misc_feature (1)..( 7): Result.002 file - promoters60/1035665
ttacttc

SEQ ID NO: 105641 - DNA, 6 bp, Unknown
  misc_feature (1)..( 6): Result.002 file - promoters60/1035665
tttgat

SEQ ID NO: 105642 - DNA, 6 bp, Unknown
  misc_feature (1)..( 6): Result.002 file - promoters60/1035665
tttgat

SEQ ID NO: 105643 - DNA, 12 bp, Unknown
  misc_feature (1)..( 12): Result.002 file - promoters60/1375217
attacaaaacta

SEQ ID NO: 105644 - DNA, 12 bp, Unknown
  misc_feature (1)..( 12): Result.002 file - promoters60/1375217
tatacaaaaaaa

SEQ ID NO: 105645 - DNA, 12 bp, Unknown
  misc_feature (1)..( 12): Result.002 file - promoters60/1375217
ttgacaaataaa

SEQ ID NO: 105646 - DNA, 12 bp, Unknown
  misc_feature (1)..( 12): Result.002 file - promoters60/1375217
tatacaagaaca

SEQ ID NO: 105647 - DNA, 10 bp, Unknown
  misc_feature (1)..( 10): Result.002 file - promoters60/1375217
tgaaaaaacg

SEQ ID NO: 105648 - DNA, 12 bp, Unknown
  misc_feature (1)..( 12): Result.002 file - promoters60/1375217
agttcaaataat

SEQ ID NO: 105649 - DNA, 10 bp, Unknown
  misc_feature (1)..( 10): Result.002 file - promoters60/1375217
aaaatattaa

SEQ ID NO: 105650 - DNA, 10 bp, Unknown
  misc_feature (1)..( 10): Result.002 file - promoters60/1375217
taaaaattaa

SEQ ID NO: 105651 - DNA, 10 bp, Unknown
  misc_feature (1)..( 10): Result.002 file - promoters60/1375217
caaagattta

SEQ ID NO: 105652 - DNA, 10 bp, Unknown
  misc_feature (1)..( 10): Result.002 file - promoters60/1375217
gtaaaatttc

SEQ ID NO: 105653 - DNA, 10 bp, Unknown
  misc_feature (1)..( 10): Result.002 file - promoters60/1375217
taacaattct

SEQ ID NO: 105654 - DNA, 10 bp, Unknown
  misc_feature (1)..( 10): Result.002 file - promoters60/1375217
ccaaaattca

SEQ ID NO: 105655 - DNA, 9 bp, Unknown
  misc_feature (1)..( 9): Result.002 file - promoters60/1375217
aaaaataaa

SEQ ID NO: 105656 - DNA, 9 bp, Unknown
  misc_feature (1)..( 9): Result.002 file - promoters60/1375217
aaaattaat

SEQ ID NO: 105657 - DNA, 10 bp, Unknown
  misc_feature (1)..( 10): Result.002 file - promoters60/1375217
ataaaataca

SEQ ID NO: 105658 - DNA, 9 bp, Unknown
  misc_feature (1)..( 9): Result.002 file - promoters60/1375217
aaaaattta

SEQ ID NO: 105659 - DNA, 10 bp, Unknown
  misc_feature (1)..( 10): Result.002 file - promoters60/1375217
aatgaatatt

SEQ ID NO: 105660 - DNA, 10 bp, Unknown
  misc_feature (1)..( 10): Result.002 file - promoters60/1375217
agataatatt

SEQ ID NO: 105661 - DNA, 10 bp, Unknown
  misc_feature (1)..( 10): Result.002 file - promoters60/1375217
caatattatt

SEQ ID NO: 105662 - DNA, 9 bp, Unknown
  misc_feature (1)..( 9): Result.002 file - promoters60/1375217
aataaaagc

SEQ ID NO: 105663 - DNA, 9 bp, Unknown
  misc_feature (1)..( 9): Result.002 file - promoters60/1375217
aataaaatt

SEQ ID NO: 105664 - DNA, 9 bp, Unknown
  misc_feature (1)..( 9): Result.002 file - promoters60/1375217
tataaaata

SEQ ID NO: 105665 - DNA, 9 bp, Unknown
  misc_feature (1)..( 9): Result.002 file - promoters60/1375217
gataatatt

SEQ ID NO: 105666 - DNA, 9 bp, Unknown
  misc_feature (1)..( 9): Result.002 file - promoters60/1375217
aatattatt

SEQ ID NO: 105667 - DNA, 10 bp, Unknown
  misc_feature (1)..( 10): Result.002 file - promoters60/1375217
tttacaaact

SEQ ID NO: 105668 - DNA, 10 bp, Unknown
  misc_feature (1)..( 10): Result.002 file - promoters60/1375217
aatgaatatt

SEQ ID NO: 105669 - DNA, 10 bp, Unknown
  misc_feature (1)..( 10): Result.002 file - promoters60/1375217
aatacaaata

SEQ ID NO: 105670 - DNA, 9 bp, Unknown
  misc_feature (1)..( 9): Result.002 file - promoters60/1375217
aaaacaaac

SEQ ID NO: 105671 - DNA, 9 bp, Unknown
  misc_feature (1)..( 9): Result.002 file - promoters60/1375217
taaataaat

SEQ ID NO: 105672 - DNA, 9 bp, Unknown
  misc_feature (1)..( 9): Result.002 file - promoters60/1375217
caaacaaat

SEQ ID NO: 105673 - DNA, 9 bp, Unknown
  misc_feature (1)..( 9): Result.002 file - promoters60/1375217
taaaaaaag

SEQ ID NO: 105674 - DNA, 9 bp, Unknown
  misc_feature (1)..( 9): Result.002 file - promoters60/1375217
aaaacaatt

SEQ ID NO: 105675 - DNA, 9 bp, Unknown
  misc_feature (1)..( 9): Result.002 file - promoters60/1375217
gaaacaaat

SEQ ID NO: 105676 - DNA, 9 bp, Unknown
  misc_feature (1)..( 9): Result.002 file - promoters60/1375217
gtcataaat

SEQ ID NO: 105677 - DNA, 10 bp, Unknown
  misc_feature (1)..( 10): Result.002 file - promoters60/1375217
atattattag

SEQ ID NO: 105678 - DNA, 10 bp, Unknown
  misc_feature (1)..( 10): Result.002 file - promoters60/1375217
atattattag

SEQ ID NO: 105679 - DNA, 10 bp, Unknown
  misc_feature (1)..( 10): Result.002 file - promoters60/1375217
ttattatatt

SEQ ID NO: 105680 - DNA, 10 bp, Unknown
  misc_feature (1)..( 10): Result.002 file - promoters60/1375217
atataattat

SEQ ID NO: 105681 - DNA, 10 bp, Unknown
  misc_feature (1)..( 10): Result.002 file - promoters60/1375217
aaattattta

SEQ ID NO: 105682 - DNA, 10 bp, Unknown
  misc_feature (1)..( 10): Result.002 file - promoters60/1375217
atacaatgaa

SEQ ID NO: 105683 - DNA, 10 bp, Unknown
  misc_feature (1)..( 10): Result.002 file - promoters60/1375217
tgtttgttta

SEQ ID NO: 105684 - DNA, 10 bp, Unknown
  misc_feature (1)..( 10): Result.002 file - promoters60/1375217
tttttatttc

SEQ ID NO: 105685 - DNA, 10 bp, Unknown
  misc_feature (1)..( 10): Result.002 file - promoters60/1375217
cttttgtttc

SEQ ID NO: 105686 - DNA, 10 bp, Unknown
  misc_feature (1)..( 10): Result.002 file - promoters60/1375217
actttttttg

SEQ ID NO: 105687 - DNA, 10 bp, Unknown
  misc_feature (1)..( 10): Result.002 file - promoters60/1375217
tgtttttttc

SEQ ID NO: 105688 - DNA, 10 bp, Unknown
  misc_feature (1)..( 10): Result.002 file - promoters60/1375217
catttttttc

SEQ ID NO: 105689 - DNA, 10 bp, Unknown
  misc_feature (1)..( 10): Result.002 file - promoters60/1375217
aaattatttt

SEQ ID NO: 105690 - DNA, 9 bp, Unknown
  misc_feature (1)..( 9): Result.002 file - promoters60/1375217
attaaaatc

SEQ ID NO: 105691 - DNA, 9 bp, Unknown
  misc_feature (1)..( 9): Result.002 file - promoters60/1375217
gttaaaaat

SEQ ID NO: 105692 - DNA, 9 bp, Unknown
  misc_feature (1)..( 9): Result.002 file - promoters60/1375217
aataaaaaa

SEQ ID NO: 105693 - DNA, 9 bp, Unknown
  misc_feature (1)..( 9): Result.002 file - promoters60/1375217
tctaaaaaa

SEQ ID NO: 105694 - DNA, 9 bp, Unknown
  misc_feature (1)..( 9): Result.002 file - promoters60/1375217
cagaaaaaa

SEQ ID NO: 105695 - DNA, 10 bp, Unknown
  misc_feature (1)..( 10): Result.002 file - promoters60/1375217
ttcaaagaaa

SEQ ID NO: 105696 - DNA, 13 bp, Unknown
  misc_feature (1)..( 13): Result.002 file - promoters60/1375217
tccattatatata

SEQ ID NO: 105697 - DNA, 13 bp, Unknown
  misc_feature (1)..( 13): Result.002 file - promoters60/1375217
acgcctatatata

SEQ ID NO: 105698 - DNA, 13 bp, Unknown
  misc_feature (1)..( 13): Result.002 file - promoters60/1375217
tcttgtatatata

SEQ ID NO: 105699 - DNA, 13 bp, Unknown
  misc_feature (1)..( 13): Result.002 file - promoters60/1375217
tcctttatatata

SEQ ID NO: 105700 - DNA, 13 bp, Unknown
  misc_feature (1)..( 13): Result.002 file - promoters60/1375217
tcctttttagttc

SEQ ID NO: 105701 - DNA, 13 bp, Unknown
  misc_feature (1)..( 13): Result.002 file - promoters60/1375217
cacattatataaa

SEQ ID NO: 105702 - DNA, 12 bp, Unknown
  misc_feature (1)..( 12): Result.002 file - promoters60/1375217
aatgaaaaacaa

SEQ ID NO: 105703 - DNA, 12 bp, Unknown
  misc_feature (1)..( 12): Result.002 file - promoters60/1375217
gaagaaaaaata

SEQ ID NO: 105704 - DNA, 12 bp, Unknown
  misc_feature (1)..( 12): Result.002 file - promoters60/1375217
agttaaaaaata

SEQ ID NO: 105705 - DNA, 12 bp, Unknown
  misc_feature (1)..( 12): Result.002 file - promoters60/1375217
atttacaaacaa

SEQ ID NO: 105706 - DNA, 12 bp, Unknown
  misc_feature (1)..( 12): Result.002 file - promoters60/1375217
ttcaaaacaatt

SEQ ID NO: 105707 - DNA, 12 bp, Unknown
  misc_feature (1)..( 12): Result.002 file - promoters60/1375217
ctttacaaccat

SEQ ID NO: 105708 - DNA, 12 bp, Unknown
  misc_feature (1)..( 12): Result.002 file - promoters60/1375217
atttacatacac

SEQ ID NO: 105709 - DNA, 9 bp, Unknown
  misc_feature (1)..( 9): Result.002 file - promoters60/1375217
ttaatattt

SEQ ID NO: 105710 - DNA, 9 bp, Unknown
  misc_feature (1)..( 9): Result.002 file - promoters60/1375217
tcaatatta

SEQ ID NO: 105711 - DNA, 9 bp, Unknown
  misc_feature (1)..( 9): Result.002 file - promoters60/1375217
ataatattt

SEQ ID NO: 105712 - DNA, 9 bp, Unknown
  misc_feature (1)..( 9): Result.002 file - promoters60/1375217
ccaacattc

SEQ ID NO: 105713 - DNA, 9 bp, Unknown
  misc_feature (1)..( 9): Result.002 file - promoters60/1375217
tgaatattt

SEQ ID NO: 105714 - DNA, 9 bp, Unknown
  misc_feature (1)..( 9): Result.002 file - promoters60/1375217
tatatattt

SEQ ID NO: 105715 - DNA, 8 bp, Unknown
  misc_feature (1)..( 8): Result.002 file - promoters60/1375217
aaattttt

SEQ ID NO: 105716 - DNA, 8 bp, Unknown
  misc_feature (1)..( 8): Result.002 file - promoters60/1375217
taatcttt

SEQ ID NO: 105717 - DNA, 8 bp, Unknown
  misc_feature (1)..( 8): Result.002 file - promoters60/1375217
taagtttc

SEQ ID NO: 105718 - DNA, 8 bp, Unknown
  misc_feature (1)..( 8): Result.002 file - promoters60/1375217
gaaattta

SEQ ID NO: 105719 - DNA, 8 bp, Unknown
  misc_feature (1)..( 8): Result.002 file - promoters60/1375217
aaatgttt

SEQ ID NO: 105720 - DNA, 8 bp, Unknown
  misc_feature (1)..( 8): Result.002 file - promoters60/1375217
ggatcttt

SEQ ID NO: 105721 - DNA, 10 bp, Unknown
  misc_feature (1)..( 10): Result.002 file - promoters60/1375217
agttaaaaaa

SEQ ID NO: 105722 - DNA, 10 bp, Unknown
  misc_feature (1)..( 10): Result.002 file - promoters60/1375217
cgttaaagtt

SEQ ID NO: 105723 - DNA, 11 bp, Unknown
  misc_feature (1)..( 11): Result.002 file - promoters60/1375217
atttacaaaca

SEQ ID NO: 105724 - DNA, 11 bp, Unknown
  misc_feature (1)..( 11): Result.002 file - promoters60/1375217
agttaaaaagt

SEQ ID NO: 105725 - DNA, 11 bp, Unknown
  misc_feature (1)..( 11): Result.002 file - promoters60/1375217
ctttacaacca

SEQ ID NO: 105726 - DNA, 11 bp, Unknown
  misc_feature (1)..( 11): Result.002 file - promoters60/1375217
atttacataca

SEQ ID NO: 105727 - DNA, 12 bp, Unknown
  misc_feature (1)..( 12): Result.002 file - promoters60/1375252
gtatatatataa

SEQ ID NO: 105728 - DNA, 12 bp, Unknown
  misc_feature (1)..( 12): Result.002 file - promoters60/1375252
atatttatatag

SEQ ID NO: 105729 - DNA, 12 bp, Unknown
  misc_feature (1)..( 12): Result.002 file - promoters60/1375252
caataaaaagca

SEQ ID NO: 105730 - DNA, 12 bp, Unknown
  misc_feature (1)..( 12): Result.002 file - promoters60/1375252
atatataaacaa

SEQ ID NO: 105731 - DNA, 12 bp, Unknown
  misc_feature (1)..( 12): Result.002 file - promoters60/1375252
acagttaaatag

SEQ ID NO: 105732 - DNA, 12 bp, Unknown
  misc_feature (1)..( 12): Result.002 file - promoters60/1375252
atatttgtatca

SEQ ID NO: 105733 - DNA, 12 bp, Unknown
  misc_feature (1)..( 12): Result.002 file - promoters60/1375252
tctgttaaaatc

SEQ ID NO: 105734 - DNA, 12 bp, Unknown
  misc_feature (1)..( 12): Result.002 file - promoters60/1375252
gactttaaattg

SEQ ID NO: 105735 - DNA, 14 bp, Unknown
  misc_feature (1)..( 14): Result.002 file - promoters60/1375252
gtggcttgttttct

SEQ ID NO: 105736 - DNA, 14 bp, Unknown
  misc_feature (1)..( 14): Result.002 file - promoters60/1375252
cttacttgtttaaa

SEQ ID NO: 105737 - DNA, 14 bp, Unknown
  misc_feature (1)..( 14): Result.002 file - promoters60/1375252
gtggcatgtttgat

SEQ ID NO: 105738 - DNA, 14 bp, Unknown
  misc_feature (1)..( 14): Result.002 file - promoters60/1375252
tgaagctgtctaag

SEQ ID NO: 105739 - DNA, 14 bp, Unknown
  misc_feature (1)..( 14): Result.002 file - promoters60/1375252
ccaccatttttcta

SEQ ID NO: 105740 - DNA, 14 bp, Unknown
  misc_feature (1)..( 14): Result.002 file - promoters60/1375252
atgcaatttatcta

SEQ ID NO: 105741 - DNA, 7 bp, Unknown
  misc_feature (1)..( 7): Result.002 file - promoters60/1375266
gaaacgt

SEQ ID NO: 105742 - DNA, 7 bp, Unknown
  misc_feature (1)..( 7): Result.002 file - promoters60/1375266
gaatcgt

SEQ ID NO: 105743 - DNA, 6 bp, Unknown
  misc_feature (1)..( 6): Result.002 file - promoters60/1375266
tctctc

SEQ ID NO: 105744 - DNA, 6 bp, Unknown
  misc_feature (1)..( 6): Result.002 file - promoters60/1375266
tctctc

SEQ ID NO: 105745 - DNA, 8 bp, Unknown
  misc_feature (1)..( 8): Result.002 file - promoters60/1375266
ccgataac

SEQ ID NO: 105746 - DNA, 8 bp, Unknown
  misc_feature (1)..( 8): Result.002 file - promoters60/1375266
ccgttaac

SEQ ID NO: 105747 - DNA, 6 bp, Unknown
  misc_feature (1)..( 6): Result.002 file - promoters60/1375266
ttgaag

SEQ ID NO: 105748 - DNA, 6 bp, Unknown
  misc_feature (1)..( 6): Result.002 file - promoters60/1375266
ttgaag

SEQ ID NO: 105749 - DNA, 7 bp, Unknown
  misc_feature (1)..( 7): Result.002 file - promoters60/1375266
aaaaaaa

SEQ ID NO: 105750 - DNA, 7 bp, Unknown
  misc_feature (1)..( 7): Result.002 file - promoters60/1375266
aaacaaa

SEQ ID NO: 105751 - DNA, 7 bp, Unknown
  misc_feature (1)..( 7): Result.002 file - promoters60/1375266
acaaaat

SEQ ID NO: 105752 - DNA, 7 bp, Unknown
  misc_feature (1)..( 7): Result.002 file - promoters60/1375266
acataat

SEQ ID NO: 105753 - DNA, 8 bp, Unknown
  misc_feature (1)..( 8): Result.002 file - promoters60/1375266
ataaaaaa

SEQ ID NO: 105754 - DNA, 8 bp, Unknown
  misc_feature (1)..( 8): Result.002 file - promoters60/1375266
ataaaaaa

SEQ ID NO: 105755 - DNA, 9 bp, Unknown
  misc_feature (1)..( 9): Result.002 file - promoters60/1375266
taaataaaa

SEQ ID NO: 105756 - DNA, 9 bp, Unknown
  misc_feature (1)..( 9): Result.002 file - promoters60/1375266
taagtaaaa

SEQ ID NO: 105757 - DNA, 7 bp, Unknown
  misc_feature (1)..( 7): Result.002 file - promoters60/1375266
atgttga

SEQ ID NO: 105758 - DNA, 7 bp, Unknown
  misc_feature (1)..( 7): Result.002 file - promoters60/1375266
atgatga

SEQ ID NO: 105759 - DNA, 8 bp, Unknown
  misc_feature (1)..( 8): Result.002 file - promoters60/1375266
attgtttt

SEQ ID NO: 105760 - DNA, 8 bp, Unknown
  misc_feature (1)..( 8): Result.002 file - promoters60/1375266
attttttt

SEQ ID NO: 105761 - DNA, 8 bp, Unknown
  misc_feature (1)..( 8): Result.002 file - promoters60/1375266
tgattatt

SEQ ID NO: 105762 - DNA, 8 bp, Unknown
  misc_feature (1)..( 8): Result.002 file - promoters60/1375266
tgagtatt

SEQ ID NO: 105763 - DNA, 8 bp, Unknown
  misc_feature (1)..( 8): Result.002 file - promoters60/1375266
aagatgat

SEQ ID NO: 105764 - DNA, 8 bp, Unknown
  misc_feature (1)..( 8): Result.002 file - promoters60/1375266
aagaggat

SEQ ID NO: 105765 - DNA, 10 bp, Unknown
  misc_feature (1)..( 10): Result.002 file - promoters60/1375266
tttatttata

SEQ ID NO: 105766 - DNA, 10 bp, Unknown
  misc_feature (1)..( 10): Result.002 file - promoters60/1375266
tttttttata

SEQ ID NO: 105767 - DNA, 7 bp, Unknown
  misc_feature (1)..( 7): Result.002 file - promoters60/1375266
tcttaaa

SEQ ID NO: 105768 - DNA, 7 bp, Unknown
  misc_feature (1)..( 7): Result.002 file - promoters60/1375266
tctaaaa

SEQ ID NO: 105769 - DNA, 6 bp, Unknown
  misc_feature (1)..( 6): Result.002 file - promoters60/1375329
aaaaca

SEQ ID NO: 105770 - DNA, 6 bp, Unknown
  misc_feature (1)..( 6): Result.002 file - promoters60/1375329
aaaaca

SEQ ID NO: 105771 - DNA, 7 bp, Unknown
  misc_feature (1)..( 7): Result.002 file - promoters60/1375329
atcatga

SEQ ID NO: 105772 - DNA, 7 bp, Unknown
  misc_feature (1)..( 7): Result.002 file - promoters60/1375329
atcttga

SEQ ID NO: 105773 - DNA, 6 bp, Unknown
  misc_feature (1)..( 6): Result.002 file - promoters60/1375329
gtttta

SEQ ID NO: 105774 - DNA, 6 bp, Unknown
  misc_feature (1)..( 6): Result.002 file - promoters60/1375329
gtttta

SEQ ID NO: 105775 - DNA, 7 bp, Unknown
  misc_feature (1)..( 7): Result.002 file - promoters60/1375329
tttatgt

SEQ ID NO: 105776 - DNA, 7 bp, Unknown
  misc_feature (1)..( 7): Result.002 file - promoters60/1375329
tttatgt

SEQ ID NO: 105777 - DNA, 7 bp, Unknown
  misc_feature (1)..( 7): Result.002 file - promoters60/1375329
ttaaaac

SEQ ID NO: 105778 - DNA, 7 bp, Unknown
  misc_feature (1)..( 7): Result.002 file - promoters60/1375329
ttataac

SEQ ID NO: 105779 - DNA, 8 bp, Unknown
  misc_feature (1)..( 8): Result.002 file - promoters60/1375329
tctgtttg

SEQ ID NO: 105780 - DNA, 8 bp, Unknown
  misc_feature (1)..( 8): Result.002 file - promoters60/1375329
tctgtttg

SEQ ID NO: 105781 - DNA, 8 bp, Unknown
  misc_feature (1)..( 8): Result.002 file - promoters60/1375329
aaaaacat

SEQ ID NO: 105782 - DNA, 8 bp, Unknown
  misc_feature (1)..( 8): Result.002 file - promoters60/1375329
aaaaacat

SEQ ID NO: 105783 - DNA, 7 bp, Unknown
  misc_feature (1)..( 7): Result.002 file - promoters60/1375329
aaccaat

SEQ ID NO: 105784 - DNA, 7 bp, Unknown
  misc_feature (1)..( 7): Result.002 file - promoters60/1375329
aaccaat

SEQ ID NO: 105785 - DNA, 6 bp, Unknown
  misc_feature (1)..( 6): Result.002 file - promoters60/1375329
cctata

SEQ ID NO: 105786 - DNA, 6 bp, Unknown
  misc_feature (1)..( 6): Result.002 file - promoters60/1375329
cctata

SEQ ID NO: 105787 - DNA, 15 bp, Unknown
  misc_feature (1)..( 15): Result.002 file - promoters60/1375329
aaggcaggctgtcac

SEQ ID NO: 105788 - DNA, 15 bp, Unknown
  misc_feature (1)..( 15): Result.002 file - promoters60/1375329
aaggcaggctgtcac

SEQ ID NO: 105789 - DNA, 27 bp, Unknown
  misc_feature (1)..( 27): Result.002 file - promoters60/1375329
tggcggaccccaacaaattatcaaatc

SEQ ID NO: 105790 - DNA, 27 bp, Unknown
  misc_feature (1)..( 27): Result.002 file - promoters60/1375329
tggcggaccccaaccaattatcaaatc

SEQ ID NO: 105791 - DNA, 8 bp, Unknown
  misc_feature (1)..( 8): Result.002 file - promoters60/1375329
aataaatt

SEQ ID NO: 105792 - DNA, 8 bp, Unknown
  misc_feature (1)..( 8): Result.002 file - promoters60/1375329
aatcaatt

SEQ ID NO: 105793 - DNA, 10 bp, Unknown
  misc_feature (1)..( 10): Result.002 file - promoters60/1375329
aaaccaatcc

SEQ ID NO: 105794 - DNA, 10 bp, Unknown
  misc_feature (1)..( 10): Result.002 file - promoters60/1375329
aaaccgatcc

SEQ ID NO: 105795 - DNA, 10 bp, Unknown
  misc_feature (1)..( 10): Result.002 file - promoters60/1375329
ataacaataa

SEQ ID NO: 105796 - DNA, 10 bp, Unknown
  misc_feature (1)..( 10): Result.002 file - promoters60/1375329
ataagaataa

SEQ ID NO: 105797 - DNA, 7 bp, Unknown
  misc_feature (1)..( 7): Result.002 file - promoters60/1375329
taagtaa

SEQ ID NO: 105798 - DNA, 7 bp, Unknown
  misc_feature (1)..( 7): Result.002 file - promoters60/1375329
taaataa

SEQ ID NO: 105799 - DNA, 8 bp, Unknown
  misc_feature (1)..( 8): Result.002 file - promoters60/1375329
acaacctt

SEQ ID NO: 105800 - DNA, 8 bp, Unknown
  misc_feature (1)..( 8): Result.002 file - promoters60/1375329
acaagctt

SEQ ID NO: 105801 - DNA, 6 bp, Unknown
  misc_feature (1)..( 6): Result.002 file - promoters60/1375329
cttaca

SEQ ID NO: 105802 - DNA, 6 bp, Unknown
  misc_feature (1)..( 6): Result.002 file - promoters60/1375329
cttaca

SEQ ID NO: 105803 - DNA, 7 bp, Unknown
  misc_feature (1)..( 7): Result.002 file - promoters60/1375329
ttctttt

SEQ ID NO: 105804 - DNA, 7 bp, Unknown
  misc_feature (1)..( 7): Result.002 file - promoters60/1375329
ttccttt

SEQ ID NO: 105805 - DNA, 8 bp, Unknown
  misc_feature (1)..( 8): Result.002 file - promoters60/1375456
gcttcgtt

SEQ ID NO: 105806 - DNA, 8 bp, Unknown
  misc_feature (1)..( 8): Result.002 file - promoters60/1375456
gcttcgtt

SEQ ID NO: 105807 - DNA, 7 bp, Unknown
  misc_feature (1)..( 7): Result.002 file - promoters60/1375456
aaaagca

SEQ ID NO: 105808 - DNA, 7 bp, Unknown
  misc_feature (1)..( 7): Result.002 file - promoters60/1375456
aaaagca

SEQ ID NO: 105809 - DNA, 9 bp, Unknown
  misc_feature (1)..( 9): Result.002 file - promoters60/1375456
ttggaacaa

SEQ ID NO: 105810 - DNA, 9 bp, Unknown
  misc_feature (1)..( 9): Result.002 file - promoters60/1375456
ttggaaaag

SEQ ID NO: 105811 - DNA, 9 bp, Unknown
  misc_feature (1)..( 9): Result.002 file - promoters60/1375456
ttgaaacaa

SEQ ID NO: 105812 - DNA, 9 bp, Unknown
  misc_feature (1)..( 9): Result.002 file - promoters60/1375456
agaaagaag

SEQ ID NO: 105813 - DNA, 9 bp, Unknown
  misc_feature (1)..( 9): Result.002 file - promoters60/1375456
agaaagctt

SEQ ID NO: 105814 - DNA, 9 bp, Unknown
  misc_feature (1)..( 9): Result.002 file - promoters60/1375456
tgaaacaaa

SEQ ID NO: 105815 - DNA, 9 bp, Unknown
  misc_feature (1)..( 9): Result.002 file - promoters60/1375456
agaaagaag

SEQ ID NO: 105816 - DNA, 9 bp, Unknown
  misc_feature (1)..( 9): Result.002 file - promoters60/1375456
gaaaagaaa

SEQ ID NO: 105817 - DNA, 10 bp, Unknown
  misc_feature (1)..( 10): Result.002 file - promoters60/1375456
ggaaatgaaa

SEQ ID NO: 105818 - DNA, 6 bp, Unknown
  misc_feature (1)..( 6): Result.002 file - promoters60/1375456
gaagaa

SEQ ID NO: 105819 - DNA, 6 bp, Unknown
  misc_feature (1)..( 6): Result.002 file - promoters60/1375456
gaagaa

SEQ ID NO: 105820 - DNA, 6 bp, Unknown
  misc_feature (1)..( 6): Result.002 file - promoters60/1375456
ttctct

SEQ ID NO: 105821 - DNA, 6 bp, Unknown
  misc_feature (1)..( 6): Result.002 file - promoters60/1375456
ttctct

SEQ ID NO: 105822 - DNA, 11 bp, Unknown
  misc_feature (1)..( 11): Result.002 file - promoters60/1375456
gaagtatagaa

SEQ ID NO: 105823 - DNA, 11 bp, Unknown
  misc_feature (1)..( 11): Result.002 file - promoters60/1375456
gaaatatctta

SEQ ID NO: 105824 - DNA, 11 bp, Unknown
  misc_feature (1)..( 11): Result.002 file - promoters60/1375456
aaaataaaata

SEQ ID NO: 105825 - DNA, 6 bp, Unknown
  misc_feature (1)..( 6): Result.002 file - promoters60/1375456
agtaaa

SEQ ID NO: 105826 - DNA, 6 bp, Unknown
  misc_feature (1)..( 6): Result.002 file - promoters60/1375456
agtaaa

SEQ ID NO: 105827 - DNA, 7 bp, Unknown
  misc_feature (1)..( 7): Result.002 file - promoters60/1375456
aatcggg

SEQ ID NO: 105828 - DNA, 7 bp, Unknown
  misc_feature (1)..( 7): Result.002 file - promoters60/1375456
aattggg

SEQ ID NO: 105829 - DNA, 7 bp, Unknown
  misc_feature (1)..( 7): Result.002 file - promoters60/1375456
cccacta

SEQ ID NO: 105830 - DNA, 7 bp, Unknown
  misc_feature (1)..( 7): Result.002 file - promoters60/1375456
cccacta

SEQ ID NO: 105831 - DNA, 9 bp, Unknown
  misc_feature (1)..( 9): Result.002 file - promoters60/1375456
aaagaaaag

SEQ ID NO: 105832 - DNA, 9 bp, Unknown
  misc_feature (1)..( 9): Result.002 file - promoters60/1375456
aaagtaaag

SEQ ID NO: 105833 - DNA, 7 bp, Unknown
  misc_feature (1)..( 7): Result.002 file - promoters60/1375456
gtatata

SEQ ID NO: 105834 - DNA, 7 bp, Unknown
  misc_feature (1)..( 7): Result.002 file - promoters60/1375456
gtatata

SEQ ID NO: 105835 - DNA, 8 bp, Unknown
  misc_feature (1)..( 8): Result.002 file - promoters60/1375471
tataattt

SEQ ID NO: 105836 - DNA, 8 bp, Unknown
  misc_feature (1)..( 8): Result.002 file - promoters60/1375471
gataattc

SEQ ID NO: 105837 - DNA, 8 bp, Unknown
  misc_feature (1)..( 8): Result.002 file - promoters60/1375471
tttaattc

SEQ ID NO: 105838 - DNA, 8 bp, Unknown
  misc_feature (1)..( 8): Result.002 file - promoters60/1375471
tttgatta

SEQ ID NO: 105839 - DNA, 8 bp, Unknown
  misc_feature (1)..( 8): Result.002 file - promoters60/1375471
attaattg

SEQ ID NO: 105840 - DNA, 9 bp, Unknown
  misc_feature (1)..( 9): Result.002 file - promoters60/1375471
gaatttaat

SEQ ID NO: 105841 - DNA, 9 bp, Unknown
  misc_feature (1)..( 9): Result.002 file - promoters60/1375471
gaattttac

SEQ ID NO: 105842 - DNA, 9 bp, Unknown
  misc_feature (1)..( 9): Result.002 file - promoters60/1375471
taatctaac

SEQ ID NO: 105843 - DNA, 9 bp, Unknown
  misc_feature (1)..( 9): Result.002 file - promoters60/1375471
aattctaac

SEQ ID NO: 105844 - DNA, 9 bp, Unknown
  misc_feature (1)..( 9): Result.002 file - promoters60/1375471
ttttctaaa

SEQ ID NO: 105845 - DNA, 11 bp, Unknown
  misc_feature (1)..( 11): Result.002 file - promoters60/1375471
aagaaataaat

SEQ ID NO: 105846 - DNA, 11 bp, Unknown
  misc_feature (1)..( 11): Result.002 file - promoters60/1375471
acaaaataaaa

SEQ ID NO: 105847 - DNA, 11 bp, Unknown
  misc_feature (1)..( 11): Result.002 file - promoters60/1375471
aagaaaaaaat

SEQ ID NO: 105848 - DNA, 11 bp, Unknown
  misc_feature (1)..( 11): Result.002 file - promoters60/1375471
ctaaaataata

SEQ ID NO: 105849 - DNA, 11 bp, Unknown
  misc_feature (1)..( 11): Result.002 file - promoters60/1375471
acagaataaaa

SEQ ID NO: 105850 - DNA, 11 bp, Unknown
  misc_feature (1)..( 11): Result.002 file - promoters60/1375471
acaaaatctcc

SEQ ID NO: 105851 - DNA, 13 bp, Unknown
  misc_feature (1)..( 13): Result.002 file - promoters60/1375471
tgataaaatttca

SEQ ID NO: 105852 - DNA, 13 bp, Unknown
  misc_feature (1)..( 13): Result.002 file - promoters60/1375471
aaatacaatctcc

SEQ ID NO: 105853 - DNA, 13 bp, Unknown
  misc_feature (1)..( 13): Result.002 file - promoters60/1375471
tgatcaaatccga

SEQ ID NO: 105854 - DNA, 13 bp, Unknown
  misc_feature (1)..( 13): Result.002 file - promoters60/1375471
ttataatattagt

SEQ ID NO: 105855 - DNA, 13 bp, Unknown
  misc_feature (1)..( 13): Result.002 file - promoters60/1375471
tcacaaaatttta

SEQ ID NO: 105856 - DNA, 10 bp, Unknown
  misc_feature (1)..( 10): Result.002 file - promoters60/1375471
caaacttatc

SEQ ID NO: 105857 - DNA, 10 bp, Unknown
  misc_feature (1)..( 10): Result.002 file - promoters60/1375471
caaaattata

SEQ ID NO: 105858 - DNA, 10 bp, Unknown
  misc_feature (1)..( 10): Result.002 file - promoters60/1375471
caatatttgt

SEQ ID NO: 105859 - DNA, 10 bp, Unknown
  misc_feature (1)..( 10): Result.002 file - promoters60/1375471
tgatattata

SEQ ID NO: 105860 - DNA, 10 bp, Unknown
  misc_feature (1)..( 10): Result.002 file - promoters60/1375471
caatatgtgc

SEQ ID NO: 105861 - DNA, 8 bp, Unknown
  misc_feature (1)..( 8): Result.002 file - promoters60/1375474
taatttca

SEQ ID NO: 105862 - DNA, 8 bp, Unknown
  misc_feature (1)..( 8): Result.002 file - promoters60/1375474
taatgtca

SEQ ID NO: 105863 - DNA, 7 bp, Unknown
  misc_feature (1)..( 7): Result.002 file - promoters60/1375474
atgccat

SEQ ID NO: 105864 - DNA, 7 bp, Unknown
  misc_feature (1)..( 7): Result.002 file - promoters60/1375474
atgccat

SEQ ID NO: 105865 - DNA, 6 bp, Unknown
  misc_feature (1)..( 6): Result.002 file - promoters60/1375474
attagt

SEQ ID NO: 105866 - DNA, 6 bp, Unknown
  misc_feature (1)..( 6): Result.002 file - promoters60/1375474
attagt

SEQ ID NO: 105867 - DNA, 7 bp, Unknown
  misc_feature (1)..( 7): Result.002 file - promoters60/1375474
tcatata

SEQ ID NO: 105868 - DNA, 7 bp, Unknown
  misc_feature (1)..( 7): Result.002 file - promoters60/1375474
tcatata

SEQ ID NO: 105869 - DNA, 10 bp, Unknown
  misc_feature (1)..( 10): Result.002 file - promoters60/1375474
aaacataaaa

SEQ ID NO: 105870 - DNA, 10 bp, Unknown
  misc_feature (1)..( 10): Result.002 file - promoters60/1375474
aaacctaaat

SEQ ID NO: 105871 - DNA, 10 bp, Unknown
  misc_feature (1)..( 10): Result.002 file - promoters60/1375474
ccgcctcaat

SEQ ID NO: 105872 - DNA, 9 bp, Unknown
  misc_feature (1)..( 9): Result.002 file - promoters60/1375474
gtagtatta

SEQ ID NO: 105873 - DNA, 9 bp, Unknown
  misc_feature (1)..( 9): Result.002 file - promoters60/1375474
gtattatta

SEQ ID NO: 105874 - DNA, 7 bp, Unknown
  misc_feature (1)..( 7): Result.002 file - promoters60/1375474
aatgtaa

SEQ ID NO: 105875 - DNA, 7 bp, Unknown
  misc_feature (1)..( 7): Result.002 file - promoters60/1375474
aatttaa

SEQ ID NO: 105876 - DNA, 6 bp, Unknown
  misc_feature (1)..( 6): Result.002 file - promoters60/1375474
aaccaa

SEQ ID NO: 105877 - DNA, 6 bp, Unknown
  misc_feature (1)..( 6): Result.002 file - promoters60/1375474
aaccaa

SEQ ID NO: 105878 - DNA, 10 bp, Unknown
  misc_feature (1)..( 10): Result.002 file - promoters60/1375474
tatcatattt

SEQ ID NO: 105879 - DNA, 10 bp, Unknown
  misc_feature (1)..( 10): Result.002 file - promoters60/1375474
tatcatcttt

SEQ ID NO: 105880 - DNA, 8 bp, Unknown
  misc_feature (1)..( 8): Result.002 file - promoters60/1375474
aatacgtt

SEQ ID NO: 105881 - DNA, 8 bp, Unknown
  misc_feature (1)..( 8): Result.002 file - promoters60/1375474
aatatgtt

SEQ ID NO: 105882 - DNA, 10 bp, Unknown
  misc_feature (1)..( 10): Result.002 file - promoters60/1375474
ttatttgttc

SEQ ID NO: 105883 - DNA, 10 bp, Unknown
  misc_feature (1)..( 10): Result.002 file - promoters60/1375474
cactttcttc

SEQ ID NO: 105884 - DNA, 10 bp, Unknown
  misc_feature (1)..( 10): Result.002 file - promoters60/1375474
cactctctta

SEQ ID NO: 105885 - DNA, 6 bp, Unknown
  misc_feature (1)..( 6): Result.002 file - promoters60/1375474
aagttg

SEQ ID NO: 105886 - DNA, 6 bp, Unknown
  misc_feature (1)..( 6): Result.002 file - promoters60/1375474
aagttg

SEQ ID NO: 105887 - DNA, 6 bp, Unknown
  misc_feature (1)..( 6): Result.002 file - promoters60/1375474
cattct

SEQ ID NO: 105888 - DNA, 6 bp, Unknown
  misc_feature (1)..( 6): Result.002 file - promoters60/1375474
cattct

SEQ ID NO: 105889 - DNA, 6 bp, Unknown
  misc_feature (1)..( 6): Result.002 file - promoters60/1375474
tctgga

SEQ ID NO: 105890 - DNA, 6 bp, Unknown
  misc_feature (1)..( 6): Result.002 file - promoters60/1375474
tctgga

SEQ ID NO: 105891 - DNA, 7 bp, Unknown
  misc_feature (1)..( 7): Result.002 file - promoters60/1375474
attttta

SEQ ID NO: 105892 - DNA, 7 bp, Unknown
  misc_feature (1)..( 7): Result.002 file - promoters60/1375474
attgtta

SEQ ID NO: 105893 - DNA, 10 bp, Unknown
  misc_feature (1)..( 10): Result.002 file - promoters60/1375547
cgatagacag

SEQ ID NO: 105894 - DNA, 10 bp, Unknown
  misc_feature (1)..( 10): Result.002 file - promoters60/1375547
cgaaagacag

SEQ ID NO: 105895 - DNA, 11 bp, Unknown
  misc_feature (1)..( 11): Result.002 file - promoters60/1375547
ctttatttgat

SEQ ID NO: 105896 - DNA, 11 bp, Unknown
  misc_feature (1)..( 11): Result.002 file - promoters60/1375547
gtttattgata

SEQ ID NO: 105897 - DNA, 11 bp, Unknown
  misc_feature (1)..( 11): Result.002 file - promoters60/1375547
ctttattcgat

SEQ ID NO: 105898 - DNA, 8 bp, Unknown
  misc_feature (1)..( 8): Result.002 file - promoters60/1375547
ataactgg

SEQ ID NO: 105899 - DNA, 8 bp, Unknown
  misc_feature (1)..( 8): Result.002 file - promoters60/1375547
ataattgg

SEQ ID NO: 105900 - DNA, 7 bp, Unknown
  misc_feature (1)..( 7): Result.002 file - promoters60/1375547
cttcttc

SEQ ID NO: 105901 - DNA, 7 bp, Unknown
  misc_feature (1)..( 7): Result.002 file - promoters60/1375547
cttattc

SEQ ID NO: 105902 - DNA, 6 bp, Unknown
  misc_feature (1)..( 6): Result.002 file - promoters60/1375547
ttcatc

SEQ ID NO: 105903 - DNA, 6 bp, Unknown
  misc_feature (1)..( 6): Result.002 file - promoters60/1375547
ttcatc

SEQ ID NO: 105904 - DNA, 7 bp, Unknown
  misc_feature (1)..( 7): Result.002 file - promoters60/1375547
atttgtt

SEQ ID NO: 105905 - DNA, 7 bp, Unknown
  misc_feature (1)..( 7): Result.002 file - promoters60/1375547
atttgtt

SEQ ID NO: 105906 - DNA, 6 bp, Unknown
  misc_feature (1)..( 6): Result.002 file - promoters60/1375547
tctcgc

SEQ ID NO: 105907 - DNA, 6 bp, Unknown
  misc_feature (1)..( 6): Result.002 file - promoters60/1375547
tctcgc

SEQ ID NO: 105908 - DNA, 6 bp, Unknown
  misc_feature (1)..( 6): Result.002 file - promoters60/1375547
gaacat

SEQ ID NO: 105909 - DNA, 6 bp, Unknown
  misc_feature (1)..( 6): Result.002 file - promoters60/1375547
gaacat

SEQ ID NO: 105910 - DNA, 6 bp, Unknown
  misc_feature (1)..( 6): Result.002 file - promoters60/1375547
aagaaa

SEQ ID NO: 105911 - DNA, 6 bp, Unknown
  misc_feature (1)..( 6): Result.002 file - promoters60/1375547
aagaaa

SEQ ID NO: 105912 - DNA, 6 bp, Unknown
  misc_feature (1)..( 6): Result.002 file - promoters60/1375547
acgccg

SEQ ID NO: 105913 - DNA, 6 bp, Unknown
  misc_feature (1)..( 6): Result.002 file - promoters60/1375547
acgccg

SEQ ID NO: 105914 - DNA, 6 bp, Unknown
  misc_feature (1)..( 6): Result.002 file - promoters60/1375547
gcggcg

SEQ ID NO: 105915 - DNA, 6 bp, Unknown
  misc_feature (1)..( 6): Result.002 file - promoters60/1375547
gcggcg

SEQ ID NO: 105916 - DNA, 7 bp, Unknown
  misc_feature (1)..( 7): Result.002 file - promoters60/1375547
gttcgtt

SEQ ID NO: 105917 - DNA, 7 bp, Unknown
  misc_feature (1)..( 7): Result.002 file - promoters60/1375547
gtttgtt

SEQ ID NO: 105918 - DNA, 7 bp, Unknown
  misc_feature (1)..( 7): Result.002 file - promoters60/1375547
tttattc

SEQ ID NO: 105919 - DNA, 7 bp, Unknown
  misc_feature (1)..( 7): Result.002 file - promoters60/1375547
ttttttc

SEQ ID NO: 105920 - DNA, 6 bp, Unknown
  misc_feature (1)..( 6): Result.002 file - promoters60/1375570
tgaaga

SEQ ID NO: 105921 - DNA, 6 bp, Unknown
  misc_feature (1)..( 6): Result.002 file - promoters60/1375570
tgaaga

SEQ ID NO: 105922 - DNA, 6 bp, Unknown
  misc_feature (1)..( 6): Result.002 file - promoters60/1375570
tgttac

SEQ ID NO: 105923 - DNA, 6 bp, Unknown
  misc_feature (1)..( 6): Result.002 file - promoters60/1375570
tgttac

SEQ ID NO: 105924 - DNA, 7 bp, Unknown
  misc_feature (1)..( 7): Result.002 file - promoters60/1375570
agaagaa

SEQ ID NO: 105925 - DNA, 7 bp, Unknown
  misc_feature (1)..( 7): Result.002 file - promoters60/1375570
agaagaa

SEQ ID NO: 105926 - DNA, 6 bp, Unknown
  misc_feature (1)..( 6): Result.002 file - promoters60/1375570
tggaag

SEQ ID NO: 105927 - DNA, 6 bp, Unknown
  misc_feature (1)..( 6): Result.002 file - promoters60/1375570
tggaag

SEQ ID NO: 105928 - DNA, 11 bp, Unknown
  misc_feature (1)..( 11): Result.002 file - promoters60/1375570
tgtgatgatgt

SEQ ID NO: 105929 - DNA, 11 bp, Unknown
  misc_feature (1)..( 11): Result.002 file - promoters60/1375570
tgttatgatgt

SEQ ID NO: 105930 - DNA, 10 bp, Unknown
  misc_feature (1)..( 10): Result.002 file - promoters60/1375570
aaatggaacc

SEQ ID NO: 105931 - DNA, 10 bp, Unknown
  misc_feature (1)..( 10): Result.002 file - promoters60/1375570
aaatcgaacc

SEQ ID NO: 105932 - DNA, 7 bp, Unknown
  misc_feature (1)..( 7): Result.002 file - promoters60/1375570
tgaacaa

SEQ ID NO: 105933 - DNA, 7 bp, Unknown
  misc_feature (1)..( 7): Result.002 file - promoters60/1375570
tgaacaa

SEQ ID NO: 105934 - DNA, 6 bp, Unknown
  misc_feature (1)..( 6): Result.002 file - promoters60/1375570
tgaaag

SEQ ID NO: 105935 - DNA, 6 bp, Unknown
  misc_feature (1)..( 6): Result.002 file - promoters60/1375570
tgaaag

SEQ ID NO: 105936 - DNA, 6 bp, Unknown
  misc_feature (1)..( 6): Result.002 file - promoters60/1375570
tttgtc

SEQ ID NO: 105937 - DNA, 6 bp, Unknown
  misc_feature (1)..( 6): Result.002 file - promoters60/1375570
tttgtc

SEQ ID NO: 105938 - DNA, 7 bp, Unknown
  misc_feature (1)..( 7): Result.002 file - promoters60/1375570
aaggaca

SEQ ID NO: 105939 - DNA, 7 bp, Unknown
  misc_feature (1)..( 7): Result.002 file - promoters60/1375570
aagtaca

SEQ ID NO: 105940 - DNA, 7 bp, Unknown
  misc_feature (1)..( 7): Result.002 file - promoters60/1375570
gtcaagg

SEQ ID NO: 105941 - DNA, 7 bp, Unknown
  misc_feature (1)..( 7): Result.002 file - promoters60/1375570
gtcaagg

SEQ ID NO: 105942 - DNA, 6 bp, Unknown
  misc_feature (1)..( 6): Result.002 file - promoters60/1375570
gttgga

SEQ ID NO: 105943 - DNA, 6 bp, Unknown
  misc_feature (1)..( 6): Result.002 file - promoters60/1375570
gttgga

SEQ ID NO: 105944 - DNA, 7 bp, Unknown
  misc_feature (1)..( 7): Result.002 file - promoters60/1375570
gagtttc

SEQ ID NO: 105945 - DNA, 7 bp, Unknown
  misc_feature (1)..( 7): Result.002 file - promoters60/1375570
gagcttc

SEQ ID NO: 105946 - DNA, 8 bp, Unknown
  misc_feature (1)..( 8): Result.002 file - promoters60/1375615
atcatatt

SEQ ID NO: 105947 - DNA, 8 bp, Unknown
  misc_feature (1)..( 8): Result.002 file - promoters60/1375615
atcatatt

SEQ ID NO: 105948 - DNA, 8 bp, Unknown
  misc_feature (1)..( 8): Result.002 file - promoters60/1375615
atcatatt

SEQ ID NO: 105949 - DNA, 9 bp, Unknown
  misc_feature (1)..( 9): Result.002 file - promoters60/1375615
tttgtagtg

SEQ ID NO: 105950 - DNA, 9 bp, Unknown
  misc_feature (1)..( 9): Result.002 file - promoters60/1375615
attgtagct

SEQ ID NO: 105951 - DNA, 9 bp, Unknown
  misc_feature (1)..( 9): Result.002 file - promoters60/1375615
tttgttgtg

SEQ ID NO: 105952 - DNA, 8 bp, Unknown
  misc_feature (1)..( 8): Result.002 file - promoters60/1375615
tgatttgt

SEQ ID NO: 105953 - DNA, 8 bp, Unknown
  misc_feature (1)..( 8): Result.002 file - promoters60/1375615
agatatgt

SEQ ID NO: 105954 - DNA, 8 bp, Unknown
  misc_feature (1)..( 8): Result.002 file - promoters60/1375615
tgatttgg

SEQ ID NO: 105955 - DNA, 6 bp, Unknown
  misc_feature (1)..( 6): Result.002 file - promoters60/1375615
atattt

SEQ ID NO: 105956 - DNA, 6 bp, Unknown
  misc_feature (1)..( 6): Result.002 file - promoters60/1375615
atattt

SEQ ID NO: 105957 - DNA, 7 bp, Unknown
  misc_feature (1)..( 7): Result.002 file - promoters60/1375615
gtttgtt

SEQ ID NO: 105958 - DNA, 7 bp, Unknown
  misc_feature (1)..( 7): Result.002 file - promoters60/1375615
gtttgtg

SEQ ID NO: 105959 - DNA, 7 bp, Unknown
  misc_feature (1)..( 7): Result.002 file - promoters60/1375615
ttttgtt

SEQ ID NO: 105960 - DNA, 6 bp, Unknown
  misc_feature (1)..( 6): Result.002 file - promoters60/1375615
tgatgt

SEQ ID NO: 105961 - DNA, 6 bp, Unknown
  misc_feature (1)..( 6): Result.002 file - promoters60/1375615
tgatgt

SEQ ID NO: 105962 - DNA, 8 bp, Unknown
  misc_feature (1)..( 8): Result.002 file - promoters60/1375615
tgtttgtt

SEQ ID NO: 105963 - DNA, 8 bp, Unknown
  misc_feature (1)..( 8): Result.002 file - promoters60/1375615
gatttgtt

SEQ ID NO: 105964 - DNA, 8 bp, Unknown
  misc_feature (1)..( 8): Result.002 file - promoters60/1375615
gatatgta

SEQ ID NO: 105965 - DNA, 7 bp, Unknown
  misc_feature (1)..( 7): Result.002 file - promoters60/1375615
gttttgt

SEQ ID NO: 105966 - DNA, 7 bp, Unknown
  misc_feature (1)..( 7): Result.002 file - promoters60/1375615
gttttgt

SEQ ID NO: 105967 - DNA, 7 bp, Unknown
  misc_feature (1)..( 7): Result.002 file - promoters60/1375615
aagaaca

SEQ ID NO: 105968 - DNA, 7 bp, Unknown
  misc_feature (1)..( 7): Result.002 file - promoters60/1375615
aagaaca

SEQ ID NO: 105969 - DNA, 6 bp, Unknown
  misc_feature (1)..( 6): Result.002 file - promoters60/1375615
tgtgat

SEQ ID NO: 105970 - DNA, 6 bp, Unknown
  misc_feature (1)..( 6): Result.002 file - promoters60/1375615
tgtgat

SEQ ID NO: 105971 - DNA, 8 bp, Unknown
  misc_feature (1)..( 8): Result.002 file - promoters60/1375615
atagtttg

SEQ ID NO: 105972 - DNA, 8 bp, Unknown
  misc_feature (1)..( 8): Result.002 file - promoters60/1375615
ataatttg

SEQ ID NO: 105973 - DNA, 8 bp, Unknown
  misc_feature (1)..( 8): Result.002 file - promoters60/1375615
agtatgtt

SEQ ID NO: 105974 - DNA, 8 bp, Unknown
  misc_feature (1)..( 8): Result.002 file - promoters60/1375615
agtttgtt

SEQ ID NO: 105975 - DNA, 6 bp, Unknown
  misc_feature (1)..( 6): Result.002 file - promoters60/1375615
tgtttg

SEQ ID NO: 105976 - DNA, 6 bp, Unknown
  misc_feature (1)..( 6): Result.002 file - promoters60/1375615
tgtttg

SEQ ID NO: 105977 - DNA, 6 bp, Unknown
  misc_feature (1)..( 6): Result.002 file - promoters60/1375615
gagttt

SEQ ID NO: 105978 - DNA, 6 bp, Unknown
  misc_feature (1)..( 6): Result.002 file - promoters60/1375615
gagttt

SEQ ID NO: 105979 - DNA, 6 bp, Unknown
  misc_feature (1)..( 6): Result.002 file - promoters60/1375615
ctgatt

SEQ ID NO: 105980 - DNA, 6 bp, Unknown
  misc_feature (1)..( 6): Result.002 file - promoters60/1375615
ctgatt

SEQ ID NO: 105981 - DNA, 6 bp, Unknown
  misc_feature (1)..( 6): Result.002 file - promoters60/1375615
ttagtt

SEQ ID NO: 105982 - DNA, 6 bp, Unknown
  misc_feature (1)..( 6): Result.002 file - promoters60/1375615
ttagtt

SEQ ID NO: 105983 - DNA, 12 bp, Unknown
  misc_feature (1)..( 12): Result.002 file - promoters60/1375634
attcttttatca

SEQ ID NO: 105984 - DNA, 12 bp, Unknown
  misc_feature (1)..( 12): Result.002 file - promoters60/1375634
ttgtttttgtca

SEQ ID NO: 105985 - DNA, 12 bp, Unknown
  misc_feature (1)..( 12): Result.002 file - promoters60/1375634
tcaattttataa

SEQ ID NO: 105986 - DNA, 12 bp, Unknown
  misc_feature (1)..( 12): Result.002 file - promoters60/1375634
tcaatcttattg

SEQ ID NO: 105987 - DNA, 7 bp, Unknown
  misc_feature (1)..( 7): Result.002 file - promoters60/1375634
aaatatc

SEQ ID NO: 105988 - DNA, 7 bp, Unknown
  misc_feature (1)..( 7): Result.002 file - promoters60/1375634
aaatatg

SEQ ID NO: 105989 - DNA, 7 bp, Unknown
  misc_feature (1)..( 7): Result.002 file - promoters60/1375634
taatatg

SEQ ID NO: 105990 - DNA, 9 bp, Unknown
  misc_feature (1)..( 9): Result.002 file - promoters60/1375634
tatatatac

SEQ ID NO: 105991 - DNA, 9 bp, Unknown
  misc_feature (1)..( 9): Result.002 file - promoters60/1375634
aatatgtac

SEQ ID NO: 105992 - DNA, 9 bp, Unknown
  misc_feature (1)..( 9): Result.002 file - promoters60/1375634
aatatgttg

SEQ ID NO: 105993 - DNA, 8 bp, Unknown
  misc_feature (1)..( 8): Result.002 file - promoters60/1375634
aaatcaat

SEQ ID NO: 105994 - DNA, 8 bp, Unknown
  misc_feature (1)..( 8): Result.002 file - promoters60/1375634
aaaacaac

SEQ ID NO: 105995 - DNA, 8 bp, Unknown
  misc_feature (1)..( 8): Result.002 file - promoters60/1375634
aaaagaac

SEQ ID NO: 105996 - DNA, 9 bp, Unknown
  misc_feature (1)..( 9): Result.002 file - promoters60/1375634
tgtatggtg

SEQ ID NO: 105997 - DNA, 9 bp, Unknown
  misc_feature (1)..( 9): Result.002 file - promoters60/1375634
tgtatgcat

SEQ ID NO: 105998 - DNA, 9 bp, Unknown
  misc_feature (1)..( 9): Result.002 file - promoters60/1375634
agtaagcat

SEQ ID NO: 105999 - DNA, 10 bp, Unknown
  misc_feature (1)..( 10): Result.002 file - promoters60/1375634
ttaattttta

SEQ ID NO: 106000 - DNA, 10 bp, Unknown
  misc_feature (1)..( 10): Result.002 file - promoters60/1375634
tcaattttat

SEQ ID NO: 106001 - DNA, 10 bp, Unknown
  misc_feature (1)..( 10): Result.002 file - promoters60/1375634
tcaatcttat

SEQ ID NO: 106002 - DNA, 10 bp, Unknown
  misc_feature (1)..( 10): Result.002 file - promoters60/1375634
taatttttat

SEQ ID NO: 106003 - DNA, 10 bp, Unknown
  misc_feature (1)..( 10): Result.002 file - promoters60/1375634
tcaattttat

SEQ ID NO: 106004 - DNA, 10 bp, Unknown
  misc_feature (1)..( 10): Result.002 file - promoters60/1375634
tcaatcttat

SEQ ID NO: 106005 - DNA, 9 bp, Unknown
  misc_feature (1)..( 9): Result.002 file - promoters60/1375634
tatataaat

SEQ ID NO: 106006 - DNA, 9 bp, Unknown
  misc_feature (1)..( 9): Result.002 file - promoters60/1375634
tatttaaaa

SEQ ID NO: 106007 - DNA, 9 bp, Unknown
  misc_feature (1)..( 9): Result.002 file - promoters60/1375634
ttcttaaaa

SEQ ID NO: 106008 - DNA, 6 bp, Unknown
  misc_feature (1)..( 6): Result.002 file - promoters60/1375634
aaactt

SEQ ID NO: 106009 - DNA, 6 bp, Unknown
  misc_feature (1)..( 6): Result.002 file - promoters60/1375634
aaactt

SEQ ID NO: 106010 - DNA, 6 bp, Unknown
  misc_feature (1)..( 6): Result.002 file - promoters60/1375634
aaactt

SEQ ID NO: 106011 - DNA, 9 bp, Unknown
  misc_feature (1)..( 9): Result.002 file - promoters60/1375793
tgtttgttt

SEQ ID NO: 106012 - DNA, 9 bp, Unknown
  misc_feature (1)..( 9): Result.002 file - promoters60/1375793
tgttagttt

SEQ ID NO: 106013 - DNA, 9 bp, Unknown
  misc_feature (1)..( 9): Result.002 file - promoters60/1375793
ggtttgtaa

SEQ ID NO: 106014 - DNA, 7 bp, Unknown
  misc_feature (1)..( 7): Result.002 file - promoters60/1375957
taaacat

SEQ ID NO: 106015 - DNA, 7 bp, Unknown
  misc_feature (1)..( 7): Result.002 file - promoters60/1375957
taaacat

SEQ ID NO: 106016 - DNA, 7 bp, Unknown
  misc_feature (1)..( 7): Result.002 file - promoters60/1375957
aaaacat

SEQ ID NO: 106017 - DNA, 16 bp, Unknown
  misc_feature (1)..( 16): Result.002 file - promoters60/1375957
ttaactttacgttctt

SEQ ID NO: 106018 - DNA, 16 bp, Unknown
  misc_feature (1)..( 16): Result.002 file - promoters60/1375957
ttaactgataaaatat

SEQ ID NO: 106019 - DNA, 17 bp, Unknown
  misc_feature (1)..( 17): Result.002 file - promoters60/1375957
ataatctaattgataaa

SEQ ID NO: 106020 - DNA, 8 bp, Unknown
  misc_feature (1)..( 8): Result.002 file - promoters60/1375957
agatttta

SEQ ID NO: 106021 - DNA, 8 bp, Unknown
  misc_feature (1)..( 8): Result.002 file - promoters60/1375957
agatttta

SEQ ID NO: 106022 - DNA, 8 bp, Unknown
  misc_feature (1)..( 8): Result.002 file - promoters60/1375957
aaatttta

SEQ ID NO: 106023 - DNA, 10 bp, Unknown
  misc_feature (1)..( 10): Result.002 file - promoters60/1375957
taaaatatat

SEQ ID NO: 106024 - DNA, 10 bp, Unknown
  misc_feature (1)..( 10): Result.002 file - promoters60/1375957
aataatatat

SEQ ID NO: 106025 - DNA, 10 bp, Unknown
  misc_feature (1)..( 10): Result.002 file - promoters60/1375957
ataaatatgc

SEQ ID NO: 106026 - DNA, 10 bp, Unknown
  misc_feature (1)..( 10): Result.002 file - promoters60/1375957
ataaatttaa

SEQ ID NO: 106027 - DNA, 9 bp, Unknown
  misc_feature (1)..( 9): Result.002 file - promoters60/1375957
ttttgttgc

SEQ ID NO: 106028 - DNA, 11 bp, Unknown
  misc_feature (1)..( 11): Result.002 file - promoters60/1375957
tctttggttct

SEQ ID NO: 106029 - DNA, 11 bp, Unknown
  misc_feature (1)..( 11): Result.002 file - promoters60/1375957
gtttttgtagg

SEQ ID NO: 106030 - DNA, 11 bp, Unknown
  misc_feature (1)..( 11): Result.002 file - promoters60/1375957
tttttagtcat

SEQ ID NO: 106031 - DNA, 9 bp, Unknown
  misc_feature (1)..( 9): Result.002 file - promoters60/1375957
cttattatg

SEQ ID NO: 106032 - DNA, 9 bp, Unknown
  misc_feature (1)..( 9): Result.002 file - promoters60/1375957
cttattatt

SEQ ID NO: 106033 - DNA, 9 bp, Unknown
  misc_feature (1)..( 9): Result.002 file - promoters60/1375957
tctatgatg

SEQ ID NO: 106034 - DNA, 9 bp, Unknown
  misc_feature (1)..( 9): Result.002 file - promoters60/1375957
aacctattt

SEQ ID NO: 106035 - DNA, 9 bp, Unknown
  misc_feature (1)..( 9): Result.002 file - promoters60/1375957
aacgtatat

SEQ ID NO: 106036 - DNA, 9 bp, Unknown
  misc_feature (1)..( 9): Result.002 file - promoters60/1375957
taccgattt

SEQ ID NO: 106037 - DNA, 7 bp, Unknown
  misc_feature (1)..( 7): Result.002 file - promoters60/1375975
tttgatt

SEQ ID NO: 106038 - DNA, 7 bp, Unknown
  misc_feature (1)..( 7): Result.002 file - promoters60/1375975
tttcatt

SEQ ID NO: 106039 - DNA, 6 bp, Unknown
  misc_feature (1)..( 6): Result.002 file - promoters60/1375975
aatgtt

SEQ ID NO: 106040 - DNA, 6 bp, Unknown
  misc_feature (1)..( 6): Result.002 file - promoters60/1375975
aatgtt

SEQ ID NO: 106041 - DNA, 8 bp, Unknown
  misc_feature (1)..( 8): Result.002 file - promoters60/1375975
aatcttct

SEQ ID NO: 106042 - DNA, 8 bp, Unknown
  misc_feature (1)..( 8): Result.002 file - promoters60/1375975
aattttct

SEQ ID NO: 106043 - DNA, 7 bp, Unknown
  misc_feature (1)..( 7): Result.002 file - promoters60/1375975
acttaaa

SEQ ID NO: 106044 - DNA, 7 bp, Unknown
  misc_feature (1)..( 7): Result.002 file - promoters60/1375975
actgaaa

SEQ ID NO: 106045 - DNA, 8 bp, Unknown
  misc_feature (1)..( 8): Result.002 file - promoters60/1375975
ttaaaata

SEQ ID NO: 106046 - DNA, 8 bp, Unknown
  misc_feature (1)..( 8): Result.002 file - promoters60/1375975
ttagaata

SEQ ID NO: 106047 - DNA, 7 bp, Unknown
  misc_feature (1)..( 7): Result.002 file - promoters60/1375975
aatttaa

SEQ ID NO: 106048 - DNA, 7 bp, Unknown
  misc_feature (1)..( 7): Result.002 file - promoters60/1375975
aatataa

SEQ ID NO: 106049 - DNA, 7 bp, Unknown
  misc_feature (1)..( 7): Result.002 file - promoters60/1375975
ttggatg

SEQ ID NO: 106050 - DNA, 7 bp, Unknown
  misc_feature (1)..( 7): Result.002 file - promoters60/1375975
ttggatg

SEQ ID NO: 106051 - DNA, 7 bp, Unknown
  misc_feature (1)..( 7): Result.002 file - promoters60/1375975
gttgata

SEQ ID NO: 106052 - DNA, 7 bp, Unknown
  misc_feature (1)..( 7): Result.002 file - promoters60/1375975
gttcata

SEQ ID NO: 106053 - DNA, 9 bp, Unknown
  misc_feature (1)..( 9): Result.002 file - promoters60/1375975
atgtagctt

SEQ ID NO: 106054 - DNA, 9 bp, Unknown
  misc_feature (1)..( 9): Result.002 file - promoters60/1375975
atgtagata

SEQ ID NO: 106055 - DNA, 9 bp, Unknown
  misc_feature (1)..( 9): Result.002 file - promoters60/1375975
ttgtaaata

SEQ ID NO: 106056 - DNA, 6 bp, Unknown
  misc_feature (1)..( 6): Result.002 file - promoters60/1375975
gaatat

SEQ ID NO: 106057 - DNA, 6 bp, Unknown
  misc_feature (1)..( 6): Result.002 file - promoters60/1375975
gaatat

SEQ ID NO: 106058 - DNA, 7 bp, Unknown
  misc_feature (1)..( 7): Result.002 file - promoters60/1375975
aaccgtt

SEQ ID NO: 106059 - DNA, 7 bp, Unknown
  misc_feature (1)..( 7): Result.002 file - promoters60/1375975
aacagtt

SEQ ID NO: 106060 - DNA, 7 bp, Unknown
  misc_feature (1)..( 7): Result.002 file - promoters60/1375975
caaaatt

SEQ ID NO: 106061 - DNA, 7 bp, Unknown
  misc_feature (1)..( 7): Result.002 file - promoters60/1375975
aaaaatt

SEQ ID NO: 106062 - DNA, 7 bp, Unknown
  misc_feature (1)..( 7): Result.002 file - promoters60/1375975
aaaaatg

SEQ ID NO: 106063 - DNA, 8 bp, Unknown
  misc_feature (1)..( 8): Result.002 file - promoters60/1375975
atccatca

SEQ ID NO: 106064 - DNA, 8 bp, Unknown
  misc_feature (1)..( 8): Result.002 file - promoters60/1375975
atccttca

SEQ ID NO: 106065 - DNA, 8 bp, Unknown
  misc_feature (1)..( 8): Result.002 file - promoters60/1375975
aaagtcta

SEQ ID NO: 106066 - DNA, 8 bp, Unknown
  misc_feature (1)..( 8): Result.002 file - promoters60/1375975
aaaggcta

SEQ ID NO: 106067 - DNA, 6 bp, Unknown
  misc_feature (1)..( 6): Result.002 file - promoters60/1375975
caaaaa

SEQ ID NO: 106068 - DNA, 6 bp, Unknown
  misc_feature (1)..( 6): Result.002 file - promoters60/1375975
caaaaa

SEQ ID NO: 106069 - DNA, 8 bp, Unknown
  misc_feature (1)..( 8): Result.002 file - promoters60/1375975
aaataaaa

SEQ ID NO: 106070 - DNA, 8 bp, Unknown
  misc_feature (1)..( 8): Result.002 file - promoters60/1375975
aaataaaa

SEQ ID NO: 106071 - DNA, 6 bp, Unknown
  misc_feature (1)..( 6): Result.002 file - promoters60/1375975
tgaaat

SEQ ID NO: 106072 - DNA, 6 bp, Unknown
  misc_feature (1)..( 6): Result.002 file - promoters60/1375975
tgaaat

SEQ ID NO: 106073 - DNA, 6 bp, Unknown
  misc_feature (1)..( 6): Result.002 file - promoters60/1375975
atatta

SEQ ID NO: 106074 - DNA, 6 bp, Unknown
  misc_feature (1)..( 6): Result.002 file - promoters60/1375975
atatta

SEQ ID NO: 106075 - DNA, 6 bp, Unknown
  misc_feature (1)..( 6): Result.002 file - promoters60/1375975
aagaat

SEQ ID NO: 106076 - DNA, 6 bp, Unknown
  misc_feature (1)..( 6): Result.002 file - promoters60/1375975
aagaat

SEQ ID NO: 106077 - DNA, 8 bp, Unknown
  misc_feature (1)..( 8): Result.002 file - promoters60/1375975
cttttaat

SEQ ID NO: 106078 - DNA, 8 bp, Unknown
  misc_feature (1)..( 8): Result.002 file - promoters60/1375975
cttataat

SEQ ID NO: 106079 - DNA, 6 bp, Unknown
  misc_feature (1)..( 6): Result.002 file - promoters60/1375975
atttgg

SEQ ID NO: 106080 - DNA, 6 bp, Unknown
  misc_feature (1)..( 6): Result.002 file - promoters60/1375975
atttgg

SEQ ID NO: 106081 - DNA, 7 bp, Unknown
  misc_feature (1)..( 7): Result.002 file - promoters60/1375975
ttaattt

SEQ ID NO: 106082 - DNA, 7 bp, Unknown
  misc_feature (1)..( 7): Result.002 file - promoters60/1375975
ttatttt

SEQ ID NO: 106083 - DNA, 7 bp, Unknown
  misc_feature (1)..( 7): Result.002 file - promoters60/1376361
cgatcat

SEQ ID NO: 106084 - DNA, 7 bp, Unknown
  misc_feature (1)..( 7): Result.002 file - promoters60/1376361
tgatcat

SEQ ID NO: 106085 - DNA, 7 bp, Unknown
  misc_feature (1)..( 7): Result.002 file - promoters60/1376361
cgaccat

SEQ ID NO: 106086 - DNA, 7 bp, Unknown
  misc_feature (1)..( 7): Result.002 file - promoters60/1376361
cgagcat

SEQ ID NO: 106087 - DNA, 14 bp, Unknown
  misc_feature (1)..( 14): Result.002 file - promoters60/1376455
gacagaaatgtcaa

SEQ ID NO: 106088 - DNA, 14 bp, Unknown
  misc_feature (1)..( 14): Result.002 file - promoters60/1376455
aatagaattgttga

SEQ ID NO: 106089 - DNA, 14 bp, Unknown
  misc_feature (1)..( 14): Result.002 file - promoters60/1376455
taaaaaaatgtagt

SEQ ID NO: 106090 - DNA, 14 bp, Unknown
  misc_feature (1)..( 14): Result.002 file - promoters60/1376455
gcctaaaatatcaa

SEQ ID NO: 106091 - DNA, 14 bp, Unknown
  misc_feature (1)..( 14): Result.002 file - promoters60/1376455
attataaaatacag

SEQ ID NO: 106092 - DNA, 14 bp, Unknown
  misc_feature (1)..( 14): Result.002 file - promoters60/1376455
tttagaaaagtctc

SEQ ID NO: 106093 - DNA, 14 bp, Unknown
  misc_feature (1)..( 14): Result.002 file - promoters60/1376455
ttttgaacgcctaa

SEQ ID NO: 106094 - DNA, 16 bp, Unknown
  misc_feature (1)..( 16): Result.002 file - promoters60/1376455
aacgaaaaataaataa

SEQ ID NO: 106095 - DNA, 16 bp, Unknown
  misc_feature (1)..( 16): Result.002 file - promoters60/1376455
attataaaatacagta

SEQ ID NO: 106096 - DNA, 16 bp, Unknown
  misc_feature (1)..( 16): Result.002 file - promoters60/1376455
aaatgtaaataaataa

SEQ ID NO: 106097 - DNA, 16 bp, Unknown
  misc_feature (1)..( 16): Result.002 file - promoters60/1376455
cgaatagaattgttga

SEQ ID NO: 106098 - DNA, 16 bp, Unknown
  misc_feature (1)..( 16): Result.002 file - promoters60/1376455
attctaaaatcttcca

SEQ ID NO: 106099 - DNA, 16 bp, Unknown
  misc_feature (1)..( 16): Result.002 file - promoters60/1376455
cttgataaatacaaga

SEQ ID NO: 106100 - DNA, 16 bp, Unknown
  misc_feature (1)..( 16): Result.002 file - promoters60/1376455
ttaaccgattaatact

SEQ ID NO: 106101 - DNA, 16 bp, Unknown
  misc_feature (1)..( 16): Result.002 file - promoters60/1376455
tctcttcaatacacgc

SEQ ID NO: 106102 - DNA, 12 bp, Unknown
  misc_feature (1)..( 12): Result.002 file - promoters60/1376455
aataaataaaag

SEQ ID NO: 106103 - DNA, 12 bp, Unknown
  misc_feature (1)..( 12): Result.002 file - promoters60/1376455
acattataaaat

SEQ ID NO: 106104 - DNA, 12 bp, Unknown
  misc_feature (1)..( 12): Result.002 file - promoters60/1376455
tgtaaataaata

SEQ ID NO: 106105 - DNA, 12 bp, Unknown
  misc_feature (1)..( 12): Result.002 file - promoters60/1376455
gataaatacaag

SEQ ID NO: 106106 - DNA, 12 bp, Unknown
  misc_feature (1)..( 12): Result.002 file - promoters60/1376455
tccgaatagaat

SEQ ID NO: 106107 - DNA, 12 bp, Unknown
  misc_feature (1)..( 12): Result.002 file - promoters60/1376455
gaattctaaaat

SEQ ID NO: 106108 - DNA, 12 bp, Unknown
  misc_feature (1)..( 12): Result.002 file - promoters60/1376455
gattaatactaa

SEQ ID NO: 106109 - DNA, 12 bp, Unknown
  misc_feature (1)..( 12): Result.002 file - promoters60/1376455
cttcaatacacg

SEQ ID NO: 106110 - DNA, 12 bp, Unknown
  misc_feature (1)..( 12): Result.002 file - promoters60/1376455
atgaaaaacaaa

SEQ ID NO: 106111 - DNA, 12 bp, Unknown
  misc_feature (1)..( 12): Result.002 file - promoters60/1376455
attttaaaaaaa

SEQ ID NO: 106112 - DNA, 12 bp, Unknown
  misc_feature (1)..( 12): Result.002 file - promoters60/1376455
catctaaataaa

SEQ ID NO: 106113 - DNA, 12 bp, Unknown
  misc_feature (1)..( 12): Result.002 file - promoters60/1376455
ttgagaaaaagg

SEQ ID NO: 106114 - DNA, 12 bp, Unknown
  misc_feature (1)..( 12): Result.002 file - promoters60/1376455
attacaaatatg

SEQ ID NO: 106115 - DNA, 12 bp, Unknown
  misc_feature (1)..( 12): Result.002 file - promoters60/1376455
attacattttgc

SEQ ID NO: 106116 - DNA, 12 bp, Unknown
  misc_feature (1)..( 12): Result.002 file - promoters60/1376455
attgcattgacc

SEQ ID NO: 106117 - DNA, 8 bp, Unknown
  misc_feature (1)..( 8): Result.002 file - promoters60/1376650
caaaccaa

SEQ ID NO: 106118 - DNA, 8 bp, Unknown
  misc_feature (1)..( 8): Result.002 file - promoters60/1376650
gaaatcaa

SEQ ID NO: 106119 - DNA, 8 bp, Unknown
  misc_feature (1)..( 8): Result.002 file - promoters60/1376650
gaactcag

SEQ ID NO: 106120 - DNA, 8 bp, Unknown
  misc_feature (1)..( 8): Result.002 file - promoters60/1376650
taacacag

SEQ ID NO: 106121 - DNA, 8 bp, Unknown
  misc_feature (1)..( 8): Result.002 file - promoters60/1376650
gaactcag

SEQ ID NO: 106122 - DNA, 8 bp, Unknown
  misc_feature (1)..( 8): Result.002 file - promoters60/1376650
gaaatcaa

SEQ ID NO: 106123 - DNA, 9 bp, Unknown
  misc_feature (1)..( 9): Result.002 file - promoters60/1376650
ccgaaaaaa

SEQ ID NO: 106124 - DNA, 9 bp, Unknown
  misc_feature (1)..( 9): Result.002 file - promoters60/1376650
aagaaaaaa

SEQ ID NO: 106125 - DNA, 9 bp, Unknown
  misc_feature (1)..( 9): Result.002 file - promoters60/1376650
aagacaaaa

SEQ ID NO: 106126 - DNA, 8 bp, Unknown
  misc_feature (1)..( 8): Result.002 file - promoters60/1376650
tgggaaat

SEQ ID NO: 106127 - DNA, 8 bp, Unknown
  misc_feature (1)..( 8): Result.002 file - promoters60/1376650
tggaaaag

SEQ ID NO: 106128 - DNA, 8 bp, Unknown
  misc_feature (1)..( 8): Result.002 file - promoters60/1376650
agggaaat

SEQ ID NO: 106129 - DNA, 9 bp, Unknown
  misc_feature (1)..( 9): Result.002 file - promoters60/1376650
atatataaa

SEQ ID NO: 106130 - DNA, 9 bp, Unknown
  misc_feature (1)..( 9): Result.002 file - promoters60/1376650
gtatataaa

SEQ ID NO: 106131 - DNA, 9 bp, Unknown
  misc_feature (1)..( 9): Result.002 file - promoters60/1376650
atatattta

SEQ ID NO: 106132 - DNA, 9 bp, Unknown
  misc_feature (1)..( 9): Result.002 file - promoters60/1376650
tgaaacaca

SEQ ID NO: 106133 - DNA, 9 bp, Unknown
  misc_feature (1)..( 9): Result.002 file - promoters60/1376650
tgaaacaaa

SEQ ID NO: 106134 - DNA, 9 bp, Unknown
  misc_feature (1)..( 9): Result.002 file - promoters60/1376650
agaaagaaa

SEQ ID NO: 106135 - DNA, 6 bp, Unknown
  misc_feature (1)..( 6): Result.002 file - promoters60/1376726
agaatt

SEQ ID NO: 106136 - DNA, 6 bp, Unknown
  misc_feature (1)..( 6): Result.002 file - promoters60/1376726
agaatt

SEQ ID NO: 106137 - DNA, 8 bp, Unknown
  misc_feature (1)..( 8): Result.002 file - promoters60/1376726
agtttgat

SEQ ID NO: 106138 - DNA, 8 bp, Unknown
  misc_feature (1)..( 8): Result.002 file - promoters60/1376726
agtttgat

SEQ ID NO: 106139 - DNA, 7 bp, Unknown
  misc_feature (1)..( 7): Result.002 file - promoters60/1376726
attagaa

SEQ ID NO: 106140 - DNA, 7 bp, Unknown
  misc_feature (1)..( 7): Result.002 file - promoters60/1376726
attagaa

SEQ ID NO: 106141 - DNA, 8 bp, Unknown
  misc_feature (1)..( 8): Result.002 file - promoters60/1376726
taataatc

SEQ ID NO: 106142 - DNA, 8 bp, Unknown
  misc_feature (1)..( 8): Result.002 file - promoters60/1376726
taaaaata

SEQ ID NO: 106143 - DNA, 8 bp, Unknown
  misc_feature (1)..( 8): Result.002 file - promoters60/1376726
aaattatc

SEQ ID NO: 106144 - DNA, 7 bp, Unknown
  misc_feature (1)..( 7): Result.002 file - promoters60/1376726
aataaaa

SEQ ID NO: 106145 - DNA, 7 bp, Unknown
  misc_feature (1)..( 7): Result.002 file - promoters60/1376726
aattaaa

SEQ ID NO: 106146 - DNA, 7 bp, Unknown
  misc_feature (1)..( 7): Result.002 file - promoters60/1376726
cagagga

SEQ ID NO: 106147 - DNA, 7 bp, Unknown
  misc_feature (1)..( 7): Result.002 file - promoters60/1376726
cagcgga

SEQ ID NO: 106148 - DNA, 7 bp, Unknown
  misc_feature (1)..( 7): Result.002 file - promoters60/1376726
ttttgac

SEQ ID NO: 106149 - DNA, 7 bp, Unknown
  misc_feature (1)..( 7): Result.002 file - promoters60/1376726
tttggac

SEQ ID NO: 106150 - DNA, 6 bp, Unknown
  misc_feature (1)..( 6): Result.002 file - promoters60/1376726
ctggga

SEQ ID NO: 106151 - DNA, 6 bp, Unknown
  misc_feature (1)..( 6): Result.002 file - promoters60/1376726
ctggga

SEQ ID NO: 106152 - DNA, 7 bp, Unknown
  misc_feature (1)..( 7): Result.002 file - promoters60/1376726
atctgat

SEQ ID NO: 106153 - DNA, 7 bp, Unknown
  misc_feature (1)..( 7): Result.002 file - promoters60/1376726
atctgat

SEQ ID NO: 106154 - DNA, 8 bp, Unknown
  misc_feature (1)..( 8): Result.002 file - promoters60/1376726
tctttatt

SEQ ID NO: 106155 - DNA, 8 bp, Unknown
  misc_feature (1)..( 8): Result.002 file - promoters60/1376726
tcttaatt

SEQ ID NO: 106156 - DNA, 8 bp, Unknown
  misc_feature (1)..( 8): Result.002 file - promoters60/1376726
tattttct

SEQ ID NO: 106157 - DNA, 8 bp, Unknown
  misc_feature (1)..( 8): Result.002 file - promoters60/1376726
tattctct

SEQ ID NO: 106158 - DNA, 7 bp, Unknown
  misc_feature (1)..( 7): Result.002 file - promoters60/1376726
aaattct

SEQ ID NO: 106159 - DNA, 7 bp, Unknown
  misc_feature (1)..( 7): Result.002 file - promoters60/1376726
aaaatct

SEQ ID NO: 106160 - DNA, 7 bp, Unknown
  misc_feature (1)..( 7): Result.002 file - promoters60/1376726
aaaaatt

SEQ ID NO: 106161 - DNA, 7 bp, Unknown
  misc_feature (1)..( 7): Result.002 file - promoters60/1376726
aaagatt

SEQ ID NO: 106162 - DNA, 10 bp, Unknown
  misc_feature (1)..( 10): Result.002 file - promoters60/1376726
aatttcattt

SEQ ID NO: 106163 - DNA, 10 bp, Unknown
  misc_feature (1)..( 10): Result.002 file - promoters60/1376726
aattacattt

SEQ ID NO: 106164 - DNA, 6 bp, Unknown
  misc_feature (1)..( 6): Result.002 file - promoters60/1376881
taaaca

SEQ ID NO: 106165 - DNA, 6 bp, Unknown
  misc_feature (1)..( 6): Result.002 file - promoters60/1376881
taaaca

SEQ ID NO: 106166 - DNA, 6 bp, Unknown
  misc_feature (1)..( 6): Result.002 file - promoters60/1376881
ttaata

SEQ ID NO: 106167 - DNA, 6 bp, Unknown
  misc_feature (1)..( 6): Result.002 file - promoters60/1376881
ttaata

SEQ ID NO: 106168 - DNA, 6 bp, Unknown
  misc_feature (1)..( 6): Result.002 file - promoters60/1376881
agtaaa

SEQ ID NO: 106169 - DNA, 6 bp, Unknown
  misc_feature (1)..( 6): Result.002 file - promoters60/1376881
agtaaa

SEQ ID NO: 106170 - DNA, 6 bp, Unknown
  misc_feature (1)..( 6): Result.002 file - promoters60/1376881
agtaaa

SEQ ID NO: 106171 - DNA, 8 bp, Unknown
  misc_feature (1)..( 8): Result.002 file - promoters60/1376881
aaaatcct

SEQ ID NO: 106172 - DNA, 8 bp, Unknown
  misc_feature (1)..( 8): Result.002 file - promoters60/1376881
aaaaccct

SEQ ID NO: 106173 - DNA, 7 bp, Unknown
  misc_feature (1)..( 7): Result.002 file - promoters60/1376881
gctggtt

SEQ ID NO: 106174 - DNA, 7 bp, Unknown
  misc_feature (1)..( 7): Result.002 file - promoters60/1376881
gctggtt

SEQ ID NO: 106175 - DNA, 10 bp, Unknown
  misc_feature (1)..( 10): Result.002 file - promoters60/1376881
aagagaatga

SEQ ID NO: 106176 - DNA, 10 bp, Unknown
  misc_feature (1)..( 10): Result.002 file - promoters60/1376881
aagagagtga

SEQ ID NO: 106177 - DNA, 10 bp, Unknown
  misc_feature (1)..( 10): Result.002 file - promoters60/1376881
tcaacaaaaa

SEQ ID NO: 106178 - DNA, 10 bp, Unknown
  misc_feature (1)..( 10): Result.002 file - promoters60/1376881
gaaacaaaaa

SEQ ID NO: 106179 - DNA, 10 bp, Unknown
  misc_feature (1)..( 10): Result.002 file - promoters60/1376881
gaaagaaagc

SEQ ID NO: 106180 - DNA, 11 bp, Unknown
  misc_feature (1)..( 11): Result.002 file - promoters60/1376881
tgaacgtcatt

SEQ ID NO: 106181 - DNA, 11 bp, Unknown
  misc_feature (1)..( 11): Result.002 file - promoters60/1376881
tgaccgtcatt

SEQ ID NO: 106182 - DNA, 7 bp, Unknown
  misc_feature (1)..( 7): Result.002 file - promoters60/1376881
aatcggg

SEQ ID NO: 106183 - DNA, 7 bp, Unknown
  misc_feature (1)..( 7): Result.002 file - promoters60/1376881
aattggg

SEQ ID NO: 106184 - DNA, 10 bp, Unknown
  misc_feature (1)..( 10): Result.002 file - promoters60/1376881
ggaaaagaaa

SEQ ID NO: 106185 - DNA, 10 bp, Unknown
  misc_feature (1)..( 10): Result.002 file - promoters60/1376881
ggaaatgaaa

SEQ ID NO: 106186 - DNA, 7 bp, Unknown
  misc_feature (1)..( 7): Result.002 file - promoters60/1376881
cccacta

SEQ ID NO: 106187 - DNA, 7 bp, Unknown
  misc_feature (1)..( 7): Result.002 file - promoters60/1376881
cccacta

SEQ ID NO: 106188 - DNA, 9 bp, Unknown
  misc_feature (1)..( 9): Result.002 file - promoters60/1376881
aaagaaaag

SEQ ID NO: 106189 - DNA, 9 bp, Unknown
  misc_feature (1)..( 9): Result.002 file - promoters60/1376881
aaagtaaag

SEQ ID NO: 106190 - DNA, 7 bp, Unknown
  misc_feature (1)..( 7): Result.002 file - promoters60/1376881
gtatata

SEQ ID NO: 106191 - DNA, 7 bp, Unknown
  misc_feature (1)..( 7): Result.002 file - promoters60/1376881
gtatata

SEQ ID NO: 106192 - DNA, 8 bp, Unknown
  misc_feature (1)..( 8): Result.002 file - promoters60/1376888
ttttttat

SEQ ID NO: 106193 - DNA, 8 bp, Unknown
  misc_feature (1)..( 8): Result.002 file - promoters60/1376888
ctttatat

SEQ ID NO: 106194 - DNA, 9 bp, Unknown
  misc_feature (1)..( 9): Result.002 file - promoters60/1376888
ctttgttac

SEQ ID NO: 106195 - DNA, 9 bp, Unknown
  misc_feature (1)..( 9): Result.002 file - promoters60/1376888
atttattaa

SEQ ID NO: 106196 - DNA, 7 bp, Unknown
  misc_feature (1)..( 7): Result.002 file - promoters60/1376888
gatattt

SEQ ID NO: 106197 - DNA, 7 bp, Unknown
  misc_feature (1)..( 7): Result.002 file - promoters60/1376888
tatattt

SEQ ID NO: 106198 - DNA, 7 bp, Unknown
  misc_feature (1)..( 7): Result.002 file - promoters60/1376888
tatattg

SEQ ID NO: 106199 - DNA, 8 bp, Unknown
  misc_feature (1)..( 8): Result.002 file - promoters60/1376888
cttatttt

SEQ ID NO: 106200 - DNA, 8 bp, Unknown
  misc_feature (1)..( 8): Result.002 file - promoters60/1376888
tttagttt

SEQ ID NO: 106201 - DNA, 8 bp, Unknown
  misc_feature (1)..( 8): Result.002 file - promoters60/1376888
ttttgttt

SEQ ID NO: 106202 - DNA, 8 bp, Unknown
  misc_feature (1)..( 8): Result.002 file - promoters60/1376888
ttttcttt

SEQ ID NO: 106203 - DNA, 8 bp, Unknown
  misc_feature (1)..( 8): Result.002 file - promoters60/1376888
ttttgttt

SEQ ID NO: 106204 - DNA, 8 bp, Unknown
  misc_feature (1)..( 8): Result.002 file - promoters60/1376888
tttagttt

SEQ ID NO: 106205 - DNA, 6 bp, Unknown
  misc_feature (1)..( 6): Result.002 file - promoters60/1376902
taatgc

SEQ ID NO: 106206 - DNA, 6 bp, Unknown
  misc_feature (1)..( 6): Result.002 file - promoters60/1376902
taatgc

SEQ ID NO: 106207 - DNA, 7 bp, Unknown
  misc_feature (1)..( 7): Result.002 file - promoters60/1376902
atactaa

SEQ ID NO: 106208 - DNA, 7 bp, Unknown
  misc_feature (1)..( 7): Result.002 file - promoters60/1376902
atagtaa

SEQ ID NO: 106209 - DNA, 8 bp, Unknown
  misc_feature (1)..( 8): Result.002 file - promoters60/1376902
aaggttaa

SEQ ID NO: 106210 - DNA, 8 bp, Unknown
  misc_feature (1)..( 8): Result.002 file - promoters60/1376902
aagggtaa

SEQ ID NO: 106211 - DNA, 7 bp, Unknown
  misc_feature (1)..( 7): Result.002 file - promoters60/1376902
tttgttg

SEQ ID NO: 106212 - DNA, 7 bp, Unknown
  misc_feature (1)..( 7): Result.002 file - promoters60/1376902
ttttttg

SEQ ID NO: 106213 - DNA, 7 bp, Unknown
  misc_feature (1)..( 7): Result.002 file - promoters60/1376902
ttctatt

SEQ ID NO: 106214 - DNA, 7 bp, Unknown
  misc_feature (1)..( 7): Result.002 file - promoters60/1376902
ttccatt

SEQ ID NO: 106215 - DNA, 7 bp, Unknown
  misc_feature (1)..( 7): Result.002 file - promoters60/1376902
acaaact

SEQ ID NO: 106216 - DNA, 7 bp, Unknown
  misc_feature (1)..( 7): Result.002 file - promoters60/1376902
acacact

SEQ ID NO: 106217 - DNA, 7 bp, Unknown
  misc_feature (1)..( 7): Result.002 file - promoters60/1376902
ccttttg

SEQ ID NO: 106218 - DNA, 7 bp, Unknown
  misc_feature (1)..( 7): Result.002 file - promoters60/1376902
ccttttg

SEQ ID NO: 106219 - DNA, 8 bp, Unknown
  misc_feature (1)..( 8): Result.002 file - promoters60/1376902
caacatca

SEQ ID NO: 106220 - DNA, 8 bp, Unknown
  misc_feature (1)..( 8): Result.002 file - promoters60/1376902
caatatca

SEQ ID NO: 106221 - DNA, 7 bp, Unknown
  misc_feature (1)..( 7): Result.002 file - promoters60/1376902
aacattt

SEQ ID NO: 106222 - DNA, 7 bp, Unknown
  misc_feature (1)..( 7): Result.002 file - promoters60/1376902
aactttt

SEQ ID NO: 106223 - DNA, 6 bp, Unknown
  misc_feature (1)..( 6): Result.002 file - promoters60/1376902
cttctt

SEQ ID NO: 106224 - DNA, 6 bp, Unknown
  misc_feature (1)..( 6): Result.002 file - promoters60/1376902
cttctt

SEQ ID NO: 106225 - DNA, 6 bp, Unknown
  misc_feature (1)..( 6): Result.002 file - promoters60/1376902
catctc

SEQ ID NO: 106226 - DNA, 6 bp, Unknown
  misc_feature (1)..( 6): Result.002 file - promoters60/1376902
catctc

SEQ ID NO: 106227 - DNA, 6 bp, Unknown
  misc_feature (1)..( 6): Result.002 file - promoters60/1376902
agtttt

SEQ ID NO: 106228 - DNA, 6 bp, Unknown
  misc_feature (1)..( 6): Result.002 file - promoters60/1376902
agtttt

SEQ ID NO: 106229 - DNA, 7 bp, Unknown
  misc_feature (1)..( 7): Result.002 file - promoters60/1376902
acataaa

SEQ ID NO: 106230 - DNA, 7 bp, Unknown
  misc_feature (1)..( 7): Result.002 file - promoters60/1376902
acaaaaa

SEQ ID NO: 106231 - DNA, 11 bp, Unknown
  misc_feature (1)..( 11): Result.002 file - promoters60/1376958
aatgatacaaa

SEQ ID NO: 106232 - DNA, 11 bp, Unknown
  misc_feature (1)..( 11): Result.002 file - promoters60/1376958
aatcatacaac

SEQ ID NO: 106233 - DNA, 11 bp, Unknown
  misc_feature (1)..( 11): Result.002 file - promoters60/1376958
atacatagaaa

SEQ ID NO: 106234 - DNA, 6 bp, Unknown
  misc_feature (1)..( 6): Result.002 file - promoters60/1376958
tcttga

SEQ ID NO: 106235 - DNA, 6 bp, Unknown
  misc_feature (1)..( 6): Result.002 file - promoters60/1376958
tcttga

SEQ ID NO: 106236 - DNA, 7 bp, Unknown
  misc_feature (1)..( 7): Result.002 file - promoters60/1376958
tagtata

SEQ ID NO: 106237 - DNA, 7 bp, Unknown
  misc_feature (1)..( 7): Result.002 file - promoters60/1376958
tagaata

SEQ ID NO: 106238 - DNA, 11 bp, Unknown
  misc_feature (1)..( 11): Result.002 file - promoters60/1376958
acacgttaagt

SEQ ID NO: 106239 - DNA, 11 bp, Unknown
  misc_feature (1)..( 11): Result.002 file - promoters60/1376958
acacattaagt

SEQ ID NO: 106240 - DNA, 11 bp, Unknown
  misc_feature (1)..( 11): Result.002 file - promoters60/1376958
gataattaaga

SEQ ID NO: 106241 - DNA, 7 bp, Unknown
  misc_feature (1)..( 7): Result.002 file - promoters60/1376958
caaataa

SEQ ID NO: 106242 - DNA, 7 bp, Unknown
  misc_feature (1)..( 7): Result.002 file - promoters60/1376958
caagtaa

SEQ ID NO: 106243 - DNA, 7 bp, Unknown
  misc_feature (1)..( 7): Result.002 file - promoters60/1376958
ctatata

SEQ ID NO: 106244 - DNA, 7 bp, Unknown
  misc_feature (1)..( 7): Result.002 file - promoters60/1376958
ctaaata

SEQ ID NO: 106245 - DNA, 6 bp, Unknown
  misc_feature (1)..( 6): Result.002 file - promoters60/1376958
tataaa

SEQ ID NO: 106246 - DNA, 6 bp, Unknown
  misc_feature (1)..( 6): Result.002 file - promoters60/1376958
tataaa

SEQ ID NO: 106247 - DNA, 7 bp, Unknown
  misc_feature (1)..( 7): Result.002 file - promoters60/1376958
cacacaa

SEQ ID NO: 106248 - DNA, 7 bp, Unknown
  misc_feature (1)..( 7): Result.002 file - promoters60/1376958
cacccaa

SEQ ID NO: 106249 - DNA, 7 bp, Unknown
  misc_feature (1)..( 7): Result.002 file - promoters60/1376958
aatatca

SEQ ID NO: 106250 - DNA, 7 bp, Unknown
  misc_feature (1)..( 7): Result.002 file - promoters60/1376958
aatctca

SEQ ID NO: 106251 - DNA, 8 bp, Unknown
  misc_feature (1)..( 8): Result.002 file - promoters60/1376958
atacaaat

SEQ ID NO: 106252 - DNA, 8 bp, Unknown
  misc_feature (1)..( 8): Result.002 file - promoters60/1376958
atagaaat

SEQ ID NO: 106253 - DNA, 7 bp, Unknown
  misc_feature (1)..( 7): Result.002 file - promoters60/1376958
atacata

SEQ ID NO: 106254 - DNA, 7 bp, Unknown
  misc_feature (1)..( 7): Result.002 file - promoters60/1376958
ataaata

SEQ ID NO: 106255 - DNA, 8 bp, Unknown
  misc_feature (1)..( 8): Result.002 file - promoters60/1376958
aatattaa

SEQ ID NO: 106256 - DNA, 8 bp, Unknown
  misc_feature (1)..( 8): Result.002 file - promoters60/1376958
aataataa

SEQ ID NO: 106257 - DNA, 8 bp, Unknown
  misc_feature (1)..( 8): Result.002 file - promoters60/1376958
acaagaag

SEQ ID NO: 106258 - DNA, 8 bp, Unknown
  misc_feature (1)..( 8): Result.002 file - promoters60/1376958
acaaaaag

SEQ ID NO: 106259 - DNA, 6 bp, Unknown
  misc_feature (1)..( 6): Result.002 file - promoters60/1376958
ataaac

SEQ ID NO: 106260 - DNA, 6 bp, Unknown
  misc_feature (1)..( 6): Result.002 file - promoters60/1376958
ataaac

SEQ ID NO: 106261 - DNA, 7 bp, Unknown
  misc_feature (1)..( 7): Result.002 file - promoters60/1376958
tgaacaa

SEQ ID NO: 106262 - DNA, 7 bp, Unknown
  misc_feature (1)..( 7): Result.002 file - promoters60/1376958
tgatcaa

SEQ ID NO: 106263 - DNA, 6 bp, Unknown
  misc_feature (1)..( 6): Result.002 file - promoters60/1376958
cgatta

SEQ ID NO: 106264 - DNA, 6 bp, Unknown
  misc_feature (1)..( 6): Result.002 file - promoters60/1376958
cgatta

SEQ ID NO: 106265 - DNA, 6 bp, Unknown
  misc_feature (1)..( 6): Result.002 file - promoters60/1376958
ttttga

SEQ ID NO: 106266 - DNA, 6 bp, Unknown
  misc_feature (1)..( 6): Result.002 file - promoters60/1376958
ttttga

SEQ ID NO: 106267 - DNA, 6 bp, Unknown
  misc_feature (1)..( 6): Result.002 file - promoters60/1376958
acagta

SEQ ID NO: 106268 - DNA, 6 bp, Unknown
  misc_feature (1)..( 6): Result.002 file - promoters60/1376958
acagta

SEQ ID NO: 106269 - DNA, 7 bp, Unknown
  misc_feature (1)..( 7): Result.002 file - promoters60/1376958
taaaata

SEQ ID NO: 106270 - DNA, 7 bp, Unknown
  misc_feature (1)..( 7): Result.002 file - promoters60/1376958
taatata

SEQ ID NO: 106271 - DNA, 6 bp, Unknown
  misc_feature (1)..( 6): Result.002 file - promoters60/1376958
ttgaca

SEQ ID NO: 106272 - DNA, 6 bp, Unknown
  misc_feature (1)..( 6): Result.002 file - promoters60/1376958
ttgaca

SEQ ID NO: 106273 - DNA, 7 bp, Unknown
  misc_feature (1)..( 7): Result.002 file - promoters60/1376958
aaccaag

SEQ ID NO: 106274 - DNA, 7 bp, Unknown
  misc_feature (1)..( 7): Result.002 file - promoters60/1376958
aacgaag

SEQ ID NO: 106275 - DNA, 8 bp, Unknown
  misc_feature (1)..( 8): Result.002 file - promoters60/1376958
acgatgac

SEQ ID NO: 106276 - DNA, 8 bp, Unknown
  misc_feature (1)..( 8): Result.002 file - promoters60/1376958
acgatgac

SEQ ID NO: 106277 - DNA, 6 bp, Unknown
  misc_feature (1)..( 6): Result.002 file - promoters60/1377045
aatatc

SEQ ID NO: 106278 - DNA, 6 bp, Unknown
  misc_feature (1)..( 6): Result.002 file - promoters60/1377045
aatatc

SEQ ID NO: 106279 - DNA, 6 bp, Unknown
  misc_feature (1)..( 6): Result.002 file - promoters60/1377045
aatgaa

SEQ ID NO: 106280 - DNA, 6 bp, Unknown
  misc_feature (1)..( 6): Result.002 file - promoters60/1377045
aatgaa

SEQ ID NO: 106281 - DNA, 7 bp, Unknown
  misc_feature (1)..( 7): Result.002 file - promoters60/1377045
ataattg

SEQ ID NO: 106282 - DNA, 7 bp, Unknown
  misc_feature (1)..( 7): Result.002 file - promoters60/1377045
atatttg

SEQ ID NO: 106283 - DNA, 6 bp, Unknown
  misc_feature (1)..( 6): Result.002 file - promoters60/1377045
gggtaa

SEQ ID NO: 106284 - DNA, 6 bp, Unknown
  misc_feature (1)..( 6): Result.002 file - promoters60/1377045
gggtaa

SEQ ID NO: 106285 - DNA, 8 bp, Unknown
  misc_feature (1)..( 8): Result.002 file - promoters60/1377045
aaagaaaa

SEQ ID NO: 106286 - DNA, 8 bp, Unknown
  misc_feature (1)..( 8): Result.002 file - promoters60/1377045
aaagaaaa

SEQ ID NO: 106287 - DNA, 8 bp, Unknown
  misc_feature (1)..( 8): Result.002 file - promoters60/1377045
aaaacaaa

SEQ ID NO: 106288 - DNA, 8 bp, Unknown
  misc_feature (1)..( 8): Result.002 file - promoters60/1377045
aaaataaa

SEQ ID NO: 106289 - DNA, 8 bp, Unknown
  misc_feature (1)..( 8): Result.002 file - promoters60/1377045
ttttgaaa

SEQ ID NO: 106290 - DNA, 8 bp, Unknown
  misc_feature (1)..( 8): Result.002 file - promoters60/1377045
tttttaaa

SEQ ID NO: 106291 - DNA, 6 bp, Unknown
  misc_feature (1)..( 6): Result.002 file - promoters60/1377045
agttaa

SEQ ID NO: 106292 - DNA, 6 bp, Unknown
  misc_feature (1)..( 6): Result.002 file - promoters60/1377045
agttaa

SEQ ID NO: 106293 - DNA, 6 bp, Unknown
  misc_feature (1)..( 6): Result.002 file - promoters60/1377045
accaaa

SEQ ID NO: 106294 - DNA, 6 bp, Unknown
  misc_feature (1)..( 6): Result.002 file - promoters60/1377045
accaaa

SEQ ID NO: 106295 - DNA, 8 bp, Unknown
  misc_feature (1)..( 8): Result.002 file - promoters60/1377045
aatgcttt

SEQ ID NO: 106296 - DNA, 8 bp, Unknown
  misc_feature (1)..( 8): Result.002 file - promoters60/1377045
aatggttt

SEQ ID NO: 106297 - DNA, 7 bp, Unknown
  misc_feature (1)..( 7): Result.002 file - promoters60/1377045
atatttt

SEQ ID NO: 106298 - DNA, 7 bp, Unknown
  misc_feature (1)..( 7): Result.002 file - promoters60/1377045
atatttt

SEQ ID NO: 106299 - DNA, 7 bp, Unknown
  misc_feature (1)..( 7): Result.002 file - promoters60/1377045
aaataaa

SEQ ID NO: 106300 - DNA, 7 bp, Unknown
  misc_feature (1)..( 7): Result.002 file - promoters60/1377045
aaataaa

SEQ ID NO: 106301 - DNA, 7 bp, Unknown
  misc_feature (1)..( 7): Result.002 file - promoters60/1377045
gtaaaac

SEQ ID NO: 106302 - DNA, 7 bp, Unknown
  misc_feature (1)..( 7): Result.002 file - promoters60/1377045
gtaaaac

SEQ ID NO: 106303 - DNA, 6 bp, Unknown
  misc_feature (1)..( 6): Result.002 file - promoters60/1377045
caaagg

SEQ ID NO: 106304 - DNA, 6 bp, Unknown
  misc_feature (1)..( 6): Result.002 file - promoters60/1377045
caaagg

SEQ ID NO: 106305 - DNA, 9 bp, Unknown
  misc_feature (1)..( 9): Result.002 file - promoters60/1377139
agttgaaga

SEQ ID NO: 106306 - DNA, 9 bp, Unknown
  misc_feature (1)..( 9): Result.002 file - promoters60/1377139
agttgaatc

SEQ ID NO: 106307 - DNA, 9 bp, Unknown
  misc_feature (1)..( 9): Result.002 file - promoters60/1377139
tcttggaga

SEQ ID NO: 106308 - DNA, 8 bp, Unknown
  misc_feature (1)..( 8): Result.002 file - promoters60/1377139
gaaactct

SEQ ID NO: 106309 - DNA, 8 bp, Unknown
  misc_feature (1)..( 8): Result.002 file - promoters60/1377139
gaatctct

SEQ ID NO: 106310 - DNA, 8 bp, Unknown
  misc_feature (1)..( 8): Result.002 file - promoters60/1377139
gaaagtct

SEQ ID NO: 106311 - DNA, 12 bp, Unknown
  misc_feature (1)..( 12): Result.002 file - promoters60/1377139
gattttgtctat

SEQ ID NO: 106312 - DNA, 12 bp, Unknown
  misc_feature (1)..( 12): Result.002 file - promoters60/1377139
gatgttgtttat

SEQ ID NO: 106313 - DNA, 12 bp, Unknown
  misc_feature (1)..( 12): Result.002 file - promoters60/1377139
tgagttattttc

SEQ ID NO: 106314 - DNA, 11 bp, Unknown
  misc_feature (1)..( 11): Result.002 file - promoters60/1377139
tcaagttaaac

SEQ ID NO: 106315 - DNA, 11 bp, Unknown
  misc_feature (1)..( 11): Result.002 file - promoters60/1377139
tcaatttaaaa

SEQ ID NO: 106316 - DNA, 11 bp, Unknown
  misc_feature (1)..( 11): Result.002 file - promoters60/1377139
gctttttaaag

SEQ ID NO: 106317 - DNA, 8 bp, Unknown
  misc_feature (1)..( 8): Result.002 file - promoters60/1377139
tttgagaa

SEQ ID NO: 106318 - DNA, 8 bp, Unknown
  misc_feature (1)..( 8): Result.002 file - promoters60/1377139
tttgagag

SEQ ID NO: 106319 - DNA, 8 bp, Unknown
  misc_feature (1)..( 8): Result.002 file - promoters60/1377139
actgagag

SEQ ID NO: 106320 - DNA, 10 bp, Unknown
  misc_feature (1)..( 10): Result.002 file - promoters60/1377192
taaaaaaaaa

SEQ ID NO: 106321 - DNA, 10 bp, Unknown
  misc_feature (1)..( 10): Result.002 file - promoters60/1377192
taacaaactt

SEQ ID NO: 106322 - DNA, 11 bp, Unknown
  misc_feature (1)..( 11): Result.002 file - promoters60/1377192
taaagaaaaag

SEQ ID NO: 106323 - DNA, 16 bp, Unknown
  misc_feature (1)..( 16): Result.002 file - promoters60/1377192
ttttttcaaaagcttg

SEQ ID NO: 106324 - DNA, 16 bp, Unknown
  misc_feature (1)..( 16): Result.002 file - promoters60/1377192
tttactcaacagcttg

SEQ ID NO: 106325 - DNA, 16 bp, Unknown
  misc_feature (1)..( 16): Result.002 file - promoters60/1377192
tttactaaaccaaaaa

SEQ ID NO: 106326 - DNA, 13 bp, Unknown
  misc_feature (1)..( 13): Result.002 file - promoters60/1377192
agcgaaacaaaaa

SEQ ID NO: 106327 - DNA, 13 bp, Unknown
  misc_feature (1)..( 13): Result.002 file - promoters60/1377192
aattgttcaaaaa

SEQ ID NO: 106328 - DNA, 13 bp, Unknown
  misc_feature (1)..( 13): Result.002 file - promoters60/1377192
aaataaacaaagg

SEQ ID NO: 106329 - DNA, 11 bp, Unknown
  misc_feature (1)..( 11): Result.002 file - promoters60/1377192
taaatatttaa

SEQ ID NO: 106330 - DNA, 11 bp, Unknown
  misc_feature (1)..( 11): Result.002 file - promoters60/1377192
ttaatctttaa

SEQ ID NO: 106331 - DNA, 11 bp, Unknown
  misc_feature (1)..( 11): Result.002 file - promoters60/1377192
ttaaacttgga

SEQ ID NO: 106332 - DNA, 9 bp, Unknown
  misc_feature (1)..( 9): Result.002 file - promoters60/1377192
aaaaaaagt

SEQ ID NO: 106333 - DNA, 9 bp, Unknown
  misc_feature (1)..( 9): Result.002 file - promoters60/1377192
aaagaaaca

SEQ ID NO: 106334 - DNA, 9 bp, Unknown
  misc_feature (1)..( 9): Result.002 file - promoters60/1377192
aaagtaaca

SEQ ID NO: 106335 - DNA, 10 bp, Unknown
  misc_feature (1)..( 10): Result.002 file - promoters60/1377192
ttctttaaca

SEQ ID NO: 106336 - DNA, 10 bp, Unknown
  misc_feature (1)..( 10): Result.002 file - promoters60/1377192
cgttttcaca

SEQ ID NO: 106337 - DNA, 10 bp, Unknown
  misc_feature (1)..( 10): Result.002 file - promoters60/1377192
cgtcttcact

SEQ ID NO: 106338 - DNA, 11 bp, Unknown
  misc_feature (1)..( 11): Result.002 file - promoters60/1377192
cgtcttcacta

SEQ ID NO: 106339 - DNA, 11 bp, Unknown
  misc_feature (1)..( 11): Result.002 file - promoters60/1377192
gacattcccta

SEQ ID NO: 106340 - DNA, 11 bp, Unknown
  misc_feature (1)..( 11): Result.002 file - promoters60/1377192
cgttttcacac

SEQ ID NO: 106341 - DNA, 8 bp, Unknown
  misc_feature (1)..( 8): Result.002 file - promoters60/1377197
gaaagaaa

SEQ ID NO: 106342 - DNA, 8 bp, Unknown
  misc_feature (1)..( 8): Result.002 file - promoters60/1377197
gaaagaag

SEQ ID NO: 106343 - DNA, 8 bp, Unknown
  misc_feature (1)..( 8): Result.002 file - promoters60/1377197
aaaacaaa

SEQ ID NO: 106344 - DNA, 8 bp, Unknown
  misc_feature (1)..( 8): Result.002 file - promoters60/1377197
caaataaa

SEQ ID NO: 106345 - DNA, 8 bp, Unknown
  misc_feature (1)..( 8): Result.002 file - promoters60/1377197
caaatcaa

SEQ ID NO: 106346 - DNA, 9 bp, Unknown
  misc_feature (1)..( 9): Result.002 file - promoters60/1377197
aaagaaaga

SEQ ID NO: 106347 - DNA, 9 bp, Unknown
  misc_feature (1)..( 9): Result.002 file - promoters60/1377197
gcagagaga

SEQ ID NO: 106348 - DNA, 9 bp, Unknown
  misc_feature (1)..( 9): Result.002 file - promoters60/1377197
aaacaaatg

SEQ ID NO: 106349 - DNA, 9 bp, Unknown
  misc_feature (1)..( 9): Result.002 file - promoters60/1377197
aaataaaat

SEQ ID NO: 106350 - DNA, 9 bp, Unknown
  misc_feature (1)..( 9): Result.002 file - promoters60/1377197
aaatcaatg

SEQ ID NO: 106351 - DNA, 7 bp, Unknown
  misc_feature (1)..( 7): Result.002 file - promoters60/1377197
ataaaaa

SEQ ID NO: 106352 - DNA, 7 bp, Unknown
  misc_feature (1)..( 7): Result.002 file - promoters60/1377197
ataaaaa

SEQ ID NO: 106353 - DNA, 7 bp, Unknown
  misc_feature (1)..( 7): Result.002 file - promoters60/1377197
ataaaat

SEQ ID NO: 106354 - DNA, 7 bp, Unknown
  misc_feature (1)..( 7): Result.002 file - promoters60/1377197
atataaa

SEQ ID NO: 106355 - DNA, 13 bp, Unknown
  misc_feature (1)..( 13): Result.002 file - promoters60/1377197
tttatgaaagaag

SEQ ID NO: 106356 - DNA, 13 bp, Unknown
  misc_feature (1)..( 13): Result.002 file - promoters60/1377197
ggaaaaaaaaaag

SEQ ID NO: 106357 - DNA, 13 bp, Unknown
  misc_feature (1)..( 13): Result.002 file - promoters60/1377197
aatcaaaaataag

SEQ ID NO: 106358 - DNA, 13 bp, Unknown
  misc_feature (1)..( 13): Result.002 file - promoters60/1377197
atatgtaaaacga

SEQ ID NO: 106359 - DNA, 11 bp, Unknown
  misc_feature (1)..( 11): Result.002 file - promoters60/1377268
ctaatcagaaa

SEQ ID NO: 106360 - DNA, 11 bp, Unknown
  misc_feature (1)..( 11): Result.002 file - promoters60/1377268
ctaattagaaa

SEQ ID NO: 106361 - DNA, 7 bp, Unknown
  misc_feature (1)..( 7): Result.002 file - promoters60/1377268
tcttttt

SEQ ID NO: 106362 - DNA, 7 bp, Unknown
  misc_feature (1)..( 7): Result.002 file - promoters60/1377268
tctattt

SEQ ID NO: 106363 - DNA, 10 bp, Unknown
  misc_feature (1)..( 10): Result.002 file - promoters60/1377268
aaactaaaac

SEQ ID NO: 106364 - DNA, 10 bp, Unknown
  misc_feature (1)..( 10): Result.002 file - promoters60/1377268
aaactactta

SEQ ID NO: 106365 - DNA, 10 bp, Unknown
  misc_feature (1)..( 10): Result.002 file - promoters60/1377268
aaactacaac

SEQ ID NO: 106366 - DNA, 10 bp, Unknown
  misc_feature (1)..( 10): Result.002 file - promoters60/1377268
aaacgtgaaa

SEQ ID NO: 106367 - DNA, 10 bp, Unknown
  misc_feature (1)..( 10): Result.002 file - promoters60/1377268
taacgtggca

SEQ ID NO: 106368 - DNA, 10 bp, Unknown
  misc_feature (1)..( 10): Result.002 file - promoters60/1377268
aaacgtaaaa

SEQ ID NO: 106369 - DNA, 6 bp, Unknown
  misc_feature (1)..( 6): Result.002 file - promoters60/1377268
tttact

SEQ ID NO: 106370 - DNA, 6 bp, Unknown
  misc_feature (1)..( 6): Result.002 file - promoters60/1377268
tttact

SEQ ID NO: 106371 - DNA, 14 bp, Unknown
  misc_feature (1)..( 14): Result.002 file - promoters60/1377268
tacctttttttaac

SEQ ID NO: 106372 - DNA, 14 bp, Unknown
  misc_feature (1)..( 14): Result.002 file - promoters60/1377268
tactttttgttaac

SEQ ID NO: 106373 - DNA, 6 bp, Unknown
  misc_feature (1)..( 6): Result.002 file - promoters60/1377268
acaatt

SEQ ID NO: 106374 - DNA, 6 bp, Unknown
  misc_feature (1)..( 6): Result.002 file - promoters60/1377268
acaatt

SEQ ID NO: 106375 - DNA, 6 bp, Unknown
  misc_feature (1)..( 6): Result.002 file - promoters60/1377268
cttcaa

SEQ ID NO: 106376 - DNA, 6 bp, Unknown
  misc_feature (1)..( 6): Result.002 file - promoters60/1377268
cttcaa

SEQ ID NO: 106377 - DNA, 6 bp, Unknown
  misc_feature (1)..( 6): Result.002 file - promoters60/1377268
tattta

SEQ ID NO: 106378 - DNA, 6 bp, Unknown
  misc_feature (1)..( 6): Result.002 file - promoters60/1377268
tattta

SEQ ID NO: 106379 - DNA, 7 bp, Unknown
  misc_feature (1)..( 7): Result.002 file - promoters60/1377268
ctaccaa

SEQ ID NO: 106380 - DNA, 7 bp, Unknown
  misc_feature (1)..( 7): Result.002 file - promoters60/1377268
ctaccaa

SEQ ID NO: 106381 - DNA, 7 bp, Unknown
  misc_feature (1)..( 7): Result.002 file - promoters60/1377268
tacgaaa

SEQ ID NO: 106382 - DNA, 7 bp, Unknown
  misc_feature (1)..( 7): Result.002 file - promoters60/1377268
tactaaa

SEQ ID NO: 106383 - DNA, 7 bp, Unknown
  misc_feature (1)..( 7): Result.002 file - promoters60/1377268
agatata

SEQ ID NO: 106384 - DNA, 7 bp, Unknown
  misc_feature (1)..( 7): Result.002 file - promoters60/1377268
agaaata

SEQ ID NO: 106385 - DNA, 8 bp, Unknown
  misc_feature (1)..( 8): Result.002 file - promoters60/1377268
taagatta

SEQ ID NO: 106386 - DNA, 8 bp, Unknown
  misc_feature (1)..( 8): Result.002 file - promoters60/1377268
taagttta

SEQ ID NO: 106387 - DNA, 11 bp, Unknown
  misc_feature (1)..( 11): Result.002 file - promoters60/1377268
acaatataaac

SEQ ID NO: 106388 - DNA, 11 bp, Unknown
  misc_feature (1)..( 11): Result.002 file - promoters60/1377268
tatatataaag

SEQ ID NO: 106389 - DNA, 11 bp, Unknown
  misc_feature (1)..( 11): Result.002 file - promoters60/1377268
tatatataaag

SEQ ID NO: 106390 - DNA, 6 bp, Unknown
  misc_feature (1)..( 6): Result.002 file - promoters60/1377268
aatatt

SEQ ID NO: 106391 - DNA, 6 bp, Unknown
  misc_feature (1)..( 6): Result.002 file - promoters60/1377268
aatatt

SEQ ID NO: 106392 - DNA, 6 bp, Unknown
  misc_feature (1)..( 6): Result.002 file - promoters60/1377268
acttat

SEQ ID NO: 106393 - DNA, 6 bp, Unknown
  misc_feature (1)..( 6): Result.002 file - promoters60/1377268
acttat

SEQ ID NO: 106394 - DNA, 6 bp, Unknown
  misc_feature (1)..( 6): Result.002 file - promoters60/1377268
ataaac

SEQ ID NO: 106395 - DNA, 6 bp, Unknown
  misc_feature (1)..( 6): Result.002 file - promoters60/1377268
ataaac

SEQ ID NO: 106396 - DNA, 6 bp, Unknown
  misc_feature (1)..( 6): Result.002 file - promoters60/1377268
aagata

SEQ ID NO: 106397 - DNA, 6 bp, Unknown
  misc_feature (1)..( 6): Result.002 file - promoters60/1377268
aagata

SEQ ID NO: 106398 - DNA, 7 bp, Unknown
  misc_feature (1)..( 7): Result.002 file - promoters60/1377268
atttatt

SEQ ID NO: 106399 - DNA, 7 bp, Unknown
  misc_feature (1)..( 7): Result.002 file - promoters60/1377268
atttatt

SEQ ID NO: 106400 - DNA, 12 bp, Unknown
  misc_feature (1)..( 12): Result.002 file - promoters60/1377412
cgctatttgtaa

SEQ ID NO: 106401 - DNA, 12 bp, Unknown
  misc_feature (1)..( 12): Result.002 file - promoters60/1377412
aactatttttta

SEQ ID NO: 106402 - DNA, 12 bp, Unknown
  misc_feature (1)..( 12): Result.002 file - promoters60/1377412
tactgtttgctt

SEQ ID NO: 106403 - DNA, 12 bp, Unknown
  misc_feature (1)..( 12): Result.002 file - promoters60/1377412
acgtgttagctt

SEQ ID NO: 106404 - DNA, 12 bp, Unknown
  misc_feature (1)..( 12): Result.002 file - promoters60/1377412
tactgtgaattc

SEQ ID NO: 106405 - DNA, 7 bp, Unknown
  misc_feature (1)..( 7): Result.002 file - promoters60/1377472
aaaacaa

SEQ ID NO: 106406 - DNA, 7 bp, Unknown
  misc_feature (1)..( 7): Result.002 file - promoters60/1377472
aaaacat

SEQ ID NO: 106407 - DNA, 7 bp, Unknown
  misc_feature (1)..( 7): Result.002 file - promoters60/1377472
aaatcaa

SEQ ID NO: 106408 - DNA, 8 bp, Unknown
  misc_feature (1)..( 8): Result.002 file - promoters60/1377472
aatctttt

SEQ ID NO: 106409 - DNA, 8 bp, Unknown
  misc_feature (1)..( 8): Result.002 file - promoters60/1377472
catcgttt

SEQ ID NO: 106410 - DNA, 8 bp, Unknown
  misc_feature (1)..( 8): Result.002 file - promoters60/1377472
catcgtcg

SEQ ID NO: 106411 - DNA, 8 bp, Unknown
  misc_feature (1)..( 8): Result.002 file - promoters60/1377472
tattattt

SEQ ID NO: 106412 - DNA, 8 bp, Unknown
  misc_feature (1)..( 8): Result.002 file - promoters60/1377472
gattcttt

SEQ ID NO: 106413 - DNA, 8 bp, Unknown
  misc_feature (1)..( 8): Result.002 file - promoters60/1377472
gattctct

SEQ ID NO: 106414 - DNA, 7 bp, Unknown
  misc_feature (1)..( 7): Result.002 file - promoters60/1377522
gttcctt

SEQ ID NO: 106415 - DNA, 7 bp, Unknown
  misc_feature (1)..( 7): Result.002 file - promoters60/1377522
gtttctt

SEQ ID NO: 106416 - DNA, 7 bp, Unknown
  misc_feature (1)..( 7): Result.002 file - promoters60/1377522
gttcctc

SEQ ID NO: 106417 - DNA, 8 bp, Unknown
  misc_feature (1)..( 8): Result.002 file - promoters60/1377522
aaatgtta

SEQ ID NO: 106418 - DNA, 8 bp, Unknown
  misc_feature (1)..( 8): Result.002 file - promoters60/1377522
aaaagttt

SEQ ID NO: 106419 - DNA, 8 bp, Unknown
  misc_feature (1)..( 8): Result.002 file - promoters60/1377522
caatttta

SEQ ID NO: 106420 - DNA, 7 bp, Unknown
  misc_feature (1)..( 7): Result.002 file - promoters60/1377522
gttgatt

SEQ ID NO: 106421 - DNA, 7 bp, Unknown
  misc_feature (1)..( 7): Result.002 file - promoters60/1377522
gttgatg

SEQ ID NO: 106422 - DNA, 7 bp, Unknown
  misc_feature (1)..( 7): Result.002 file - promoters60/1377522
gttaatt

SEQ ID NO: 106423 - DNA, 8 bp, Unknown
  misc_feature (1)..( 8): Result.002 file - promoters60/1377522
cgacatgt

SEQ ID NO: 106424 - DNA, 8 bp, Unknown
  misc_feature (1)..( 8): Result.002 file - promoters60/1377522
cgacatta

SEQ ID NO: 106425 - DNA, 8 bp, Unknown
  misc_feature (1)..( 8): Result.002 file - promoters60/1377522
cgacatgt

SEQ ID NO: 106426 - DNA, 8 bp, Unknown
  misc_feature (1)..( 8): Result.002 file - promoters60/1377522
acacatgt

SEQ ID NO: 106427 - DNA, 6 bp, Unknown
  misc_feature (1)..( 6): Result.002 file - promoters60/1377522
acatgt

SEQ ID NO: 106428 - DNA, 6 bp, Unknown
  misc_feature (1)..( 6): Result.002 file - promoters60/1377522
acatgt

SEQ ID NO: 106429 - DNA, 6 bp, Unknown
  misc_feature (1)..( 6): Result.002 file - promoters60/1377522
acatgt

SEQ ID NO: 106430 - DNA, 7 bp, Unknown
  misc_feature (1)..( 7): Result.002 file - promoters60/1377564
attttac

SEQ ID NO: 106431 - DNA, 7 bp, Unknown
  misc_feature (1)..( 7): Result.002 file - promoters60/1377564
tttttac

SEQ ID NO: 106432 - DNA, 7 bp, Unknown
  misc_feature (1)..( 7): Result.002 file - promoters60/1377564
attttaa

SEQ ID NO: 106433 - DNA, 9 bp, Unknown
  misc_feature (1)..( 9): Result.002 file - promoters60/1377564
ttgtattaa

SEQ ID NO: 106434 - DNA, 9 bp, Unknown
  misc_feature (1)..( 9): Result.002 file - promoters60/1377564
aagtaataa

SEQ ID NO: 106435 - DNA, 9 bp, Unknown
  misc_feature (1)..( 9): Result.002 file - promoters60/1377564
aagaaatga

SEQ ID NO: 106436 - DNA, 7 bp, Unknown
  misc_feature (1)..( 7): Result.002 file - promoters60/1377564
caaaatt

SEQ ID NO: 106437 - DNA, 7 bp, Unknown
  misc_feature (1)..( 7): Result.002 file - promoters60/1377564
caaaatc

SEQ ID NO: 106438 - DNA, 7 bp, Unknown
  misc_feature (1)..( 7): Result.002 file - promoters60/1377564
taaaatc

SEQ ID NO: 106439 - DNA, 8 bp, Unknown
  misc_feature (1)..( 8): Result.002 file - promoters60/1377564
ttatgtca

SEQ ID NO: 106440 - DNA, 8 bp, Unknown
  misc_feature (1)..( 8): Result.002 file - promoters60/1377564
ttatgtct

SEQ ID NO: 106441 - DNA, 8 bp, Unknown
  misc_feature (1)..( 8): Result.002 file - promoters60/1377564
acatgtct

SEQ ID NO: 106442 - DNA, 7 bp, Unknown
  misc_feature (1)..( 7): Result.002 file - promoters60/1377564
gatggat

SEQ ID NO: 106443 - DNA, 7 bp, Unknown
  misc_feature (1)..( 7): Result.002 file - promoters60/1377564
gatcgat

SEQ ID NO: 106444 - DNA, 7 bp, Unknown
  misc_feature (1)..( 7): Result.002 file - promoters60/1377564
gatcgaa

SEQ ID NO: 106445 - DNA, 10 bp, Unknown
  misc_feature (1)..( 10): Result.002 file - promoters60/1377642
taaaaatgaa

SEQ ID NO: 106446 - DNA, 10 bp, Unknown
  misc_feature (1)..( 10): Result.002 file - promoters60/1377642
taaaaagtct

SEQ ID NO: 106447 - DNA, 10 bp, Unknown
  misc_feature (1)..( 10): Result.002 file - promoters60/1377642
aaaaaaagaa

SEQ ID NO: 106448 - DNA, 10 bp, Unknown
  misc_feature (1)..( 10): Result.002 file - promoters60/1377642
caaaaatctt

SEQ ID NO: 106449 - DNA, 10 bp, Unknown
  misc_feature (1)..( 10): Result.002 file - promoters60/1377642
gaaaaagggt

SEQ ID NO: 106450 - DNA, 13 bp, Unknown
  misc_feature (1)..( 13): Result.002 file - promoters60/1377642
actcataataaat

SEQ ID NO: 106451 - DNA, 13 bp, Unknown
  misc_feature (1)..( 13): Result.002 file - promoters60/1377642
tcatataatagta

SEQ ID NO: 106452 - DNA, 13 bp, Unknown
  misc_feature (1)..( 13): Result.002 file - promoters60/1377642
atttataatataa

SEQ ID NO: 106453 - DNA, 13 bp, Unknown
  misc_feature (1)..( 13): Result.002 file - promoters60/1377642
acttataatgaat

SEQ ID NO: 106454 - DNA, 12 bp, Unknown
  misc_feature (1)..( 12): Result.002 file - promoters60/1377642
atataataaata

SEQ ID NO: 106455 - DNA, 12 bp, Unknown
  misc_feature (1)..( 12): Result.002 file - promoters60/1377642
gcataaaaaata

SEQ ID NO: 106456 - DNA, 12 bp, Unknown
  misc_feature (1)..( 12): Result.002 file - promoters60/1377642
ttattatacttc

SEQ ID NO: 106457 - DNA, 12 bp, Unknown
  misc_feature (1)..( 12): Result.002 file - promoters60/1377642
atataattatct

SEQ ID NO: 106458 - DNA, 12 bp, Unknown
  misc_feature (1)..( 12): Result.002 file - promoters60/1377642
gtttaataacaa

SEQ ID NO: 106459 - DNA, 12 bp, Unknown
  misc_feature (1)..( 12): Result.002 file - promoters60/1377642
ctaaaatataat

SEQ ID NO: 106460 - DNA, 11 bp, Unknown
  misc_feature (1)..( 11): Result.002 file - promoters60/1377642
tgtatatatat

SEQ ID NO: 106461 - DNA, 11 bp, Unknown
  misc_feature (1)..( 11): Result.002 file - promoters60/1377642
aaaataaatag

SEQ ID NO: 106462 - DNA, 11 bp, Unknown
  misc_feature (1)..( 11): Result.002 file - promoters60/1377642
aaaatatataa

SEQ ID NO: 106463 - DNA, 11 bp, Unknown
  misc_feature (1)..( 11): Result.002 file - promoters60/1377642
agaataaaaat

SEQ ID NO: 106464 - DNA, 11 bp, Unknown
  misc_feature (1)..( 11): Result.002 file - promoters60/1377642
aaaatataata

SEQ ID NO: 106465 - DNA, 12 bp, Unknown
  misc_feature (1)..( 12): Result.002 file - promoters60/1377642
tagaaattaata

SEQ ID NO: 106466 - DNA, 12 bp, Unknown
  misc_feature (1)..( 12): Result.002 file - promoters60/1377642
agataattaagt

SEQ ID NO: 106467 - DNA, 11 bp, Unknown
  misc_feature (1)..( 11): Result.002 file - promoters60/1377642
taaaatcaata

SEQ ID NO: 106468 - DNA, 11 bp, Unknown
  misc_feature (1)..( 11): Result.002 file - promoters60/1377642
tttaattatta

SEQ ID NO: 106469 - DNA, 12 bp, Unknown
  misc_feature (1)..( 12): Result.002 file - promoters60/1377642
ataacatcactt

SEQ ID NO: 106470 - DNA, 12 bp, Unknown
  misc_feature (1)..( 12): Result.002 file - promoters60/1377642
ttttatcacaag

SEQ ID NO: 106471 - DNA, 12 bp, Unknown
  misc_feature (1)..( 12): Result.002 file - promoters60/1377642
ttttgtcaacga

SEQ ID NO: 106472 - DNA, 12 bp, Unknown
  misc_feature (1)..( 12): Result.002 file - promoters60/1377642
gtataacaataa

SEQ ID NO: 106473 - DNA, 12 bp, Unknown
  misc_feature (1)..( 12): Result.002 file - promoters60/1377642
cggtgtaaacga

SEQ ID NO: 106474 - DNA, 12 bp, Unknown
  misc_feature (1)..( 12): Result.002 file - promoters60/1377642
ttttgtatctaa

SEQ ID NO: 106475 - DNA, 8 bp, Unknown
  misc_feature (1)..( 8): Result.002 file - promoters60/1377642
atatatat

SEQ ID NO: 106476 - DNA, 8 bp, Unknown
  misc_feature (1)..( 8): Result.002 file - promoters60/1377642
atatttat

SEQ ID NO: 106477 - DNA, 8 bp, Unknown
  misc_feature (1)..( 8): Result.002 file - promoters60/1377642
caatttat

SEQ ID NO: 106478 - DNA, 8 bp, Unknown
  misc_feature (1)..( 8): Result.002 file - promoters60/1377642
taatttat

SEQ ID NO: 106479 - DNA, 8 bp, Unknown
  misc_feature (1)..( 8): Result.002 file - promoters60/1377642
aatcaaaa

SEQ ID NO: 106480 - DNA, 8 bp, Unknown
  misc_feature (1)..( 8): Result.002 file - promoters60/1377642
aatcaaat

SEQ ID NO: 106481 - DNA, 9 bp, Unknown
  misc_feature (1)..( 9): Result.002 file - promoters60/1377642
gatccaaac

SEQ ID NO: 106482 - DNA, 9 bp, Unknown
  misc_feature (1)..( 9): Result.002 file - promoters60/1377642
ctttcaaat

SEQ ID NO: 106483 - DNA, 9 bp, Unknown
  misc_feature (1)..( 9): Result.002 file - promoters60/1377642
tatcctaac

SEQ ID NO: 106484 - DNA, 11 bp, Unknown
  misc_feature (1)..( 11): Result.002 file - promoters60/1377642
ctagacacgta

SEQ ID NO: 106485 - DNA, 11 bp, Unknown
  misc_feature (1)..( 11): Result.002 file - promoters60/1377642
atcaacacgta

SEQ ID NO: 106486 - DNA, 11 bp, Unknown
  misc_feature (1)..( 11): Result.002 file - promoters60/1377642
aaagagacgaa

SEQ ID NO: 106487 - DNA, 11 bp, Unknown
  misc_feature (1)..( 11): Result.002 file - promoters60/1377642
aaaaagaatac

SEQ ID NO: 106488 - DNA, 9 bp, Unknown
  misc_feature (1)..( 9): Result.002 file - promoters60/1377642
aaactatac

SEQ ID NO: 106489 - DNA, 9 bp, Unknown
  misc_feature (1)..( 9): Result.002 file - promoters60/1377642
ttactttac

SEQ ID NO: 106490 - DNA, 9 bp, Unknown
  misc_feature (1)..( 9): Result.002 file - promoters60/1377642
aatctttac

SEQ ID NO: 106491 - DNA, 9 bp, Unknown
  misc_feature (1)..( 9): Result.002 file - promoters60/1377642
ttaattttt

SEQ ID NO: 106492 - DNA, 10 bp, Unknown
  misc_feature (1)..( 10): Result.002 file - promoters60/1377642
ctttgttggt

SEQ ID NO: 106493 - DNA, 10 bp, Unknown
  misc_feature (1)..( 10): Result.002 file - promoters60/1377642
ttttattgat

SEQ ID NO: 106494 - DNA, 10 bp, Unknown
  misc_feature (1)..( 10): Result.002 file - promoters60/1377642
cgttactgat

SEQ ID NO: 106495 - DNA, 10 bp, Unknown
  misc_feature (1)..( 10): Result.002 file - promoters60/1377642
ttttatcgag

SEQ ID NO: 106496 - DNA, 8 bp, Unknown
  misc_feature (1)..( 8): Result.002 file - promoters60/1377642
tttaaaac

SEQ ID NO: 106497 - DNA, 8 bp, Unknown
  misc_feature (1)..( 8): Result.002 file - promoters60/1377642
tttcaaat

SEQ ID NO: 106498 - DNA, 8 bp, Unknown
  misc_feature (1)..( 8): Result.002 file - promoters60/1377642
aatcaaat

SEQ ID NO: 106499 - DNA, 8 bp, Unknown
  misc_feature (1)..( 8): Result.002 file - promoters60/1377642
tttgaaat

SEQ ID NO: 106500 - DNA, 11 bp, Unknown
  misc_feature (1)..( 11): Result.002 file - promoters60/1377642
tgtgcaaaaat

SEQ ID NO: 106501 - DNA, 11 bp, Unknown
  misc_feature (1)..( 11): Result.002 file - promoters60/1377642
tgaccaaaaaa

SEQ ID NO: 106502 - DNA, 11 bp, Unknown
  misc_feature (1)..( 11): Result.002 file - promoters60/1377642
tgtccaaaaat

SEQ ID NO: 106503 - DNA, 11 bp, Unknown
  misc_feature (1)..( 11): Result.002 file - promoters60/1377642
agacgaaaaag

SEQ ID NO: 106504 - DNA, 8 bp, Unknown
  misc_feature (1)..( 8): Result.002 file - promoters60/1377642
ttataatg

SEQ ID NO: 106505 - DNA, 8 bp, Unknown
  misc_feature (1)..( 8): Result.002 file - promoters60/1377642
atataata

SEQ ID NO: 106506 - DNA, 8 bp, Unknown
  misc_feature (1)..( 8): Result.002 file - promoters60/1377642
ttattata

SEQ ID NO: 106507 - DNA, 8 bp, Unknown
  misc_feature (1)..( 8): Result.002 file - promoters60/1377642
ataaaatc

SEQ ID NO: 106508 - DNA, 7 bp, Unknown
  misc_feature (1)..( 7): Result.002 file - promoters60/1377642
cattttt

SEQ ID NO: 106509 - DNA, 7 bp, Unknown
  misc_feature (1)..( 7): Result.002 file - promoters60/1377642
tattttt

SEQ ID NO: 106510 - DNA, 7 bp, Unknown
  misc_feature (1)..( 7): Result.002 file - promoters60/1377642
aattttt

SEQ ID NO: 106511 - DNA, 7 bp, Unknown
  misc_feature (1)..( 7): Result.002 file - promoters60/1377642
aatcttt

SEQ ID NO: 106512 - DNA, 10 bp, Unknown
  misc_feature (1)..( 10): Result.002 file - promoters60/1377680
aaatcatttt

SEQ ID NO: 106513 - DNA, 10 bp, Unknown
  misc_feature (1)..( 10): Result.002 file - promoters60/1377680
aaataatttt

SEQ ID NO: 106514 - DNA, 10 bp, Unknown
  misc_feature (1)..( 10): Result.002 file - promoters60/1377680
caatcatatt

SEQ ID NO: 106515 - DNA, 10 bp, Unknown
  misc_feature (1)..( 10): Result.002 file - promoters60/1377680
ctatcataat

SEQ ID NO: 106516 - DNA, 10 bp, Unknown
  misc_feature (1)..( 10): Result.002 file - promoters60/1377680
atatgatata

SEQ ID NO: 106517 - DNA, 10 bp, Unknown
  misc_feature (1)..( 10): Result.002 file - promoters60/1377680
aaataaagtg

SEQ ID NO: 106518 - DNA, 6 bp, Unknown
  misc_feature (1)..( 6): Result.002 file - promoters60/1377687
attcaa

SEQ ID NO: 106519 - DNA, 6 bp, Unknown
  misc_feature (1)..( 6): Result.002 file - promoters60/1377687
attcaa

SEQ ID NO: 106520 - DNA, 7 bp, Unknown
  misc_feature (1)..( 7): Result.002 file - promoters60/1377687
cttttct

SEQ ID NO: 106521 - DNA, 7 bp, Unknown
  misc_feature (1)..( 7): Result.002 file - promoters60/1377687
cttatct

SEQ ID NO: 106522 - DNA, 7 bp, Unknown
  misc_feature (1)..( 7): Result.002 file - promoters60/1377687
gttatct

SEQ ID NO: 106523 - DNA, 8 bp, Unknown
  misc_feature (1)..( 8): Result.002 file - promoters60/1377687
tctagaac

SEQ ID NO: 106524 - DNA, 8 bp, Unknown
  misc_feature (1)..( 8): Result.002 file - promoters60/1377687
tctaaaac

SEQ ID NO: 106525 - DNA, 8 bp, Unknown
  misc_feature (1)..( 8): Result.002 file - promoters60/1377687
aaaacaat

SEQ ID NO: 106526 - DNA, 8 bp, Unknown
  misc_feature (1)..( 8): Result.002 file - promoters60/1377687
aaaaaaat

SEQ ID NO: 106527 - DNA, 8 bp, Unknown
  misc_feature (1)..( 8): Result.002 file - promoters60/1377687
aaaccaag

SEQ ID NO: 106528 - DNA, 6 bp, Unknown
  misc_feature (1)..( 6): Result.002 file - promoters60/1377687
gcaaaa

SEQ ID NO: 106529 - DNA, 6 bp, Unknown
  misc_feature (1)..( 6): Result.002 file - promoters60/1377687
gcaaaa

SEQ ID NO: 106530 - DNA, 8 bp, Unknown
  misc_feature (1)..( 8): Result.002 file - promoters60/1377687
tatttata

SEQ ID NO: 106531 - DNA, 8 bp, Unknown
  misc_feature (1)..( 8): Result.002 file - promoters60/1377687
tatatata

SEQ ID NO: 106532 - DNA, 8 bp, Unknown
  misc_feature (1)..( 8): Result.002 file - promoters60/1377687
ttcaaaac

SEQ ID NO: 106533 - DNA, 8 bp, Unknown
  misc_feature (1)..( 8): Result.002 file - promoters60/1377687
ttcataac

SEQ ID NO: 106534 - DNA, 15 bp, Unknown
  misc_feature (1)..( 15): Result.002 file - promoters60/1377687
actaaaataactcac

SEQ ID NO: 106535 - DNA, 15 bp, Unknown
  misc_feature (1)..( 15): Result.002 file - promoters60/1377687
acagaaataaatcac

SEQ ID NO: 106536 - DNA, 15 bp, Unknown
  misc_feature (1)..( 15): Result.002 file - promoters60/1377687
acacaaatatgccaa

SEQ ID NO: 106537 - DNA, 6 bp, Unknown
  misc_feature (1)..( 6): Result.002 file - promoters60/1377687
tactaa

SEQ ID NO: 106538 - DNA, 6 bp, Unknown
  misc_feature (1)..( 6): Result.002 file - promoters60/1377687
tactaa

SEQ ID NO: 106539 - DNA, 7 bp, Unknown
  misc_feature (1)..( 7): Result.002 file - promoters60/1377687
aaaatca

SEQ ID NO: 106540 - DNA, 7 bp, Unknown
  misc_feature (1)..( 7): Result.002 file - promoters60/1377687
aaattca

SEQ ID NO: 106541 - DNA, 6 bp, Unknown
  misc_feature (1)..( 6): Result.002 file - promoters60/1377687
aattat

SEQ ID NO: 106542 - DNA, 6 bp, Unknown
  misc_feature (1)..( 6): Result.002 file - promoters60/1377687
aattat

SEQ ID NO: 106543 - DNA, 7 bp, Unknown
  misc_feature (1)..( 7): Result.002 file - promoters60/1377687
ataaatt

SEQ ID NO: 106544 - DNA, 7 bp, Unknown
  misc_feature (1)..( 7): Result.002 file - promoters60/1377687
atacatt

SEQ ID NO: 106545 - DNA, 8 bp, Unknown
  misc_feature (1)..( 8): Result.002 file - promoters60/1377714
gaagccag

SEQ ID NO: 106546 - DNA, 8 bp, Unknown
  misc_feature (1)..( 8): Result.002 file - promoters60/1377714
gaaaccac

SEQ ID NO: 106547 - DNA, 8 bp, Unknown
  misc_feature (1)..( 8): Result.002 file - promoters60/1377714
caaaacac

SEQ ID NO: 106548 - DNA, 8 bp, Unknown
  misc_feature (1)..( 8): Result.002 file - promoters60/1377714
gaagaaat

SEQ ID NO: 106549 - DNA, 8 bp, Unknown
  misc_feature (1)..( 8): Result.002 file - promoters60/1377714
aaagaaaa

SEQ ID NO: 106550 - DNA, 8 bp, Unknown
  misc_feature (1)..( 8): Result.002 file - promoters60/1377714
gaacaaat

SEQ ID NO: 106551 - DNA, 13 bp, Unknown
  misc_feature (1)..( 13): Result.002 file - promoters60/1377714
gttatgatttctt

SEQ ID NO: 106552 - DNA, 13 bp, Unknown
  misc_feature (1)..( 13): Result.002 file - promoters60/1377714
gttataatttttt

SEQ ID NO: 106553 - DNA, 13 bp, Unknown
  misc_feature (1)..( 13): Result.002 file - promoters60/1377714
gttacaatttttt

SEQ ID NO: 106554 - DNA, 8 bp, Unknown
  misc_feature (1)..( 8): Result.002 file - promoters60/1377714
atgagata

SEQ ID NO: 106555 - DNA, 8 bp, Unknown
  misc_feature (1)..( 8): Result.002 file - promoters60/1377714
ttgatata

SEQ ID NO: 106556 - DNA, 8 bp, Unknown
  misc_feature (1)..( 8): Result.002 file - promoters60/1377714
ttgttatg

SEQ ID NO: 106557 - DNA, 7 bp, Unknown
  misc_feature (1)..( 7): Result.002 file - promoters60/1377718
gtcgaaa

SEQ ID NO: 106558 - DNA, 7 bp, Unknown
  misc_feature (1)..( 7): Result.002 file - promoters60/1377718
gtctaaa

SEQ ID NO: 106559 - DNA, 7 bp, Unknown
  misc_feature (1)..( 7): Result.002 file - promoters60/1377718
aaacatt

SEQ ID NO: 106560 - DNA, 7 bp, Unknown
  misc_feature (1)..( 7): Result.002 file - promoters60/1377718
aaatatt

SEQ ID NO: 106561 - DNA, 10 bp, Unknown
  misc_feature (1)..( 10): Result.002 file - promoters60/1377718
taaatttgct

SEQ ID NO: 106562 - DNA, 10 bp, Unknown
  misc_feature (1)..( 10): Result.002 file - promoters60/1377718
taaatttaaa

SEQ ID NO: 106563 - DNA, 10 bp, Unknown
  misc_feature (1)..( 10): Result.002 file - promoters60/1377718
tgaatctgct

SEQ ID NO: 106564 - DNA, 9 bp, Unknown
  misc_feature (1)..( 9): Result.002 file - promoters60/1377718
tcagttaga

SEQ ID NO: 106565 - DNA, 9 bp, Unknown
  misc_feature (1)..( 9): Result.002 file - promoters60/1377718
tcagtaaga

SEQ ID NO: 106566 - DNA, 7 bp, Unknown
  misc_feature (1)..( 7): Result.002 file - promoters60/1377718
tttattg

SEQ ID NO: 106567 - DNA, 7 bp, Unknown
  misc_feature (1)..( 7): Result.002 file - promoters60/1377718
tttcttg

SEQ ID NO: 106568 - DNA, 7 bp, Unknown
  misc_feature (1)..( 7): Result.002 file - promoters60/1377718
tgaaaaa

SEQ ID NO: 106569 - DNA, 7 bp, Unknown
  misc_feature (1)..( 7): Result.002 file - promoters60/1377718
tgaaaaa

SEQ ID NO: 106570 - DNA, 6 bp, Unknown
  misc_feature (1)..( 6): Result.002 file - promoters60/1377718
aatatt

SEQ ID NO: 106571 - DNA, 6 bp, Unknown
  misc_feature (1)..( 6): Result.002 file - promoters60/1377718
aatatt

SEQ ID NO: 106572 - DNA, 12 bp, Unknown
  misc_feature (1)..( 12): Result.002 file - promoters60/1377718
ttagtttggtct

SEQ ID NO: 106573 - DNA, 12 bp, Unknown
  misc_feature (1)..( 12): Result.002 file - promoters60/1377718
ttagtttgttct

SEQ ID NO: 106574 - DNA, 6 bp, Unknown
  misc_feature (1)..( 6): Result.002 file - promoters60/1377718
ttttat

SEQ ID NO: 106575 - DNA, 6 bp, Unknown
  misc_feature (1)..( 6): Result.002 file - promoters60/1377718
ttttat

SEQ ID NO: 106576 - DNA, 9 bp, Unknown
  misc_feature (1)..( 9): Result.002 file - promoters60/1377718
attataaga

SEQ ID NO: 106577 - DNA, 9 bp, Unknown
  misc_feature (1)..( 9): Result.002 file - promoters60/1377718
attagaaga

SEQ ID NO: 106578 - DNA, 7 bp, Unknown
  misc_feature (1)..( 7): Result.002 file - promoters60/1377734
tatttgc

SEQ ID NO: 106579 - DNA, 7 bp, Unknown
  misc_feature (1)..( 7): Result.002 file - promoters60/1377734
tatgtgc

SEQ ID NO: 106580 - DNA, 6 bp, Unknown
  misc_feature (1)..( 6): Result.002 file - promoters60/1377734
tcatct

SEQ ID NO: 106581 - DNA, 6 bp, Unknown
  misc_feature (1)..( 6): Result.002 file - promoters60/1377734
tcatct

SEQ ID NO: 106582 - DNA, 6 bp, Unknown
  misc_feature (1)..( 6): Result.002 file - promoters60/1377734
ttttcc

SEQ ID NO: 106583 - DNA, 6 bp, Unknown
  misc_feature (1)..( 6): Result.002 file - promoters60/1377734
ttttcc

SEQ ID NO: 106584 - DNA, 7 bp, Unknown
  misc_feature (1)..( 7): Result.002 file - promoters60/1377734
ttagttt

SEQ ID NO: 106585 - DNA, 7 bp, Unknown
  misc_feature (1)..( 7): Result.002 file - promoters60/1377734
ttagttt

SEQ ID NO: 106586 - DNA, 6 bp, Unknown
  misc_feature (1)..( 6): Result.002 file - promoters60/1377734
agagct

SEQ ID NO: 106587 - DNA, 6 bp, Unknown
  misc_feature (1)..( 6): Result.002 file - promoters60/1377734
agagct

SEQ ID NO: 106588 - DNA, 7 bp, Unknown
  misc_feature (1)..( 7): Result.002 file - promoters60/1377734
taataat

SEQ ID NO: 106589 - DNA, 7 bp, Unknown
  misc_feature (1)..( 7): Result.002 file - promoters60/1377734
taaaaat

SEQ ID NO: 106590 - DNA, 7 bp, Unknown
  misc_feature (1)..( 7): Result.002 file - promoters60/1377734
tttgatt

SEQ ID NO: 106591 - DNA, 7 bp, Unknown
  misc_feature (1)..( 7): Result.002 file - promoters60/1377734
tttaatt

SEQ ID NO: 106592 - DNA, 8 bp, Unknown
  misc_feature (1)..( 8): Result.002 file - promoters60/1377734
tgaagtat

SEQ ID NO: 106593 - DNA, 8 bp, Unknown
  misc_feature (1)..( 8): Result.002 file - promoters60/1377734
tgaaatat

SEQ ID NO: 106594 - DNA, 7 bp, Unknown
  misc_feature (1)..( 7): Result.002 file - promoters60/1377734
gtgactc

SEQ ID NO: 106595 - DNA, 7 bp, Unknown
  misc_feature (1)..( 7): Result.002 file - promoters60/1377734
ttgactc

SEQ ID NO: 106596 - DNA, 7 bp, Unknown
  misc_feature (1)..( 7): Result.002 file - promoters60/1377734
ttgacta

SEQ ID NO: 106597 - DNA, 6 bp, Unknown
  misc_feature (1)..( 6): Result.002 file - promoters60/1377734
ctaaat

SEQ ID NO: 106598 - DNA, 6 bp, Unknown
  misc_feature (1)..( 6): Result.002 file - promoters60/1377734
ctaaat

SEQ ID NO: 106599 - DNA, 9 bp, Unknown
  misc_feature (1)..( 9): Result.002 file - promoters60/1377734
gagcctgat

SEQ ID NO: 106600 - DNA, 9 bp, Unknown
  misc_feature (1)..( 9): Result.002 file - promoters60/1377734
gagtctgat

SEQ ID NO: 106601 - DNA, 6 bp, Unknown
  misc_feature (1)..( 6): Result.002 file - promoters60/1377734
aattgc

SEQ ID NO: 106602 - DNA, 6 bp, Unknown
  misc_feature (1)..( 6): Result.002 file - promoters60/1377734
aattgc

SEQ ID NO: 106603 - DNA, 6 bp, Unknown
  misc_feature (1)..( 6): Result.002 file - promoters60/1377734
tccaaa

SEQ ID NO: 106604 - DNA, 6 bp, Unknown
  misc_feature (1)..( 6): Result.002 file - promoters60/1377734
tccaaa

SEQ ID NO: 106605 - DNA, 6 bp, Unknown
  misc_feature (1)..( 6): Result.002 file - promoters60/1377734
aaacga

SEQ ID NO: 106606 - DNA, 6 bp, Unknown
  misc_feature (1)..( 6): Result.002 file - promoters60/1377734
aaacga

SEQ ID NO: 106607 - DNA, 6 bp, Unknown
  misc_feature (1)..( 6): Result.002 file - promoters60/1377734
tctaaa

SEQ ID NO: 106608 - DNA, 6 bp, Unknown
  misc_feature (1)..( 6): Result.002 file - promoters60/1377734
tctaaa

SEQ ID NO: 106609 - DNA, 8 bp, Unknown
  misc_feature (1)..( 8): Result.002 file - promoters60/1377734
aacacaaa

SEQ ID NO: 106610 - DNA, 8 bp, Unknown
  misc_feature (1)..( 8): Result.002 file - promoters60/1377734
aacaaaaa

SEQ ID NO: 106611 - DNA, 8 bp, Unknown
  misc_feature (1)..( 8): Result.002 file - promoters60/1377734
ccaagacg

SEQ ID NO: 106612 - DNA, 8 bp, Unknown
  misc_feature (1)..( 8): Result.002 file - promoters60/1377734
ccaagacg

SEQ ID NO: 106613 - DNA, 7 bp, Unknown
  misc_feature (1)..( 7): Result.002 file - promoters60/1377734
aggccca

SEQ ID NO: 106614 - DNA, 7 bp, Unknown
  misc_feature (1)..( 7): Result.002 file - promoters60/1377734
aggccca

SEQ ID NO: 106615 - DNA, 6 bp, Unknown
  misc_feature (1)..( 6): Result.002 file - promoters60/1377835
ttgttt

SEQ ID NO: 106616 - DNA, 6 bp, Unknown
  misc_feature (1)..( 6): Result.002 file - promoters60/1377835
ttgttt

SEQ ID NO: 106617 - DNA, 6 bp, Unknown
  misc_feature (1)..( 6): Result.002 file - promoters60/1377835
tatttt

SEQ ID NO: 106618 - DNA, 6 bp, Unknown
  misc_feature (1)..( 6): Result.002 file - promoters60/1377835
tatttt

SEQ ID NO: 106619 - DNA, 7 bp, Unknown
  misc_feature (1)..( 7): Result.002 file - promoters60/1377835
tttgctt

SEQ ID NO: 106620 - DNA, 7 bp, Unknown
  misc_feature (1)..( 7): Result.002 file - promoters60/1377835
tttactt

SEQ ID NO: 106621 - DNA, 6 bp, Unknown
  misc_feature (1)..( 6): Result.002 file - promoters60/1377835
aaaaga

SEQ ID NO: 106622 - DNA, 6 bp, Unknown
  misc_feature (1)..( 6): Result.002 file - promoters60/1377835
aaaaga

SEQ ID NO: 106623 - DNA, 6 bp, Unknown
  misc_feature (1)..( 6): Result.002 file - promoters60/1377835
aataaa

SEQ ID NO: 106624 - DNA, 6 bp, Unknown
  misc_feature (1)..( 6): Result.002 file - promoters60/1377835
aataaa

SEQ ID NO: 106625 - DNA, 7 bp, Unknown
  misc_feature (1)..( 7): Result.002 file - promoters60/1377835
ttcttcc

SEQ ID NO: 106626 - DNA, 7 bp, Unknown
  misc_feature (1)..( 7): Result.002 file - promoters60/1377835
ttcctcc

SEQ ID NO: 106627 - DNA, 10 bp, Unknown
  misc_feature (1)..( 10): Result.002 file - promoters60/1377835
gtacaaagta

SEQ ID NO: 106628 - DNA, 10 bp, Unknown
  misc_feature (1)..( 10): Result.002 file - promoters60/1377835
gtaaaaattt

SEQ ID NO: 106629 - DNA, 10 bp, Unknown
  misc_feature (1)..( 10): Result.002 file - promoters60/1377835
ctaaatattt

SEQ ID NO: 106630 - DNA, 7 bp, Unknown
  misc_feature (1)..( 7): Result.002 file - promoters60/1377835
ttggtca

SEQ ID NO: 106631 - DNA, 7 bp, Unknown
  misc_feature (1)..( 7): Result.002 file - promoters60/1377835
ttgctca

SEQ ID NO: 106632 - DNA, 7 bp, Unknown
  misc_feature (1)..( 7): Result.002 file - promoters60/1377835
ccactaa

SEQ ID NO: 106633 - DNA, 7 bp, Unknown
  misc_feature (1)..( 7): Result.002 file - promoters60/1377835
ccattaa

SEQ ID NO: 106634 - DNA, 6 bp, Unknown
  misc_feature (1)..( 6): Result.002 file - promoters60/1377835
ataaaa

SEQ ID NO: 106635 - DNA, 6 bp, Unknown
  misc_feature (1)..( 6): Result.002 file - promoters60/1377835
ataaaa

SEQ ID NO: 106636 - DNA, 8 bp, Unknown
  misc_feature (1)..( 8): Result.002 file - promoters60/1377835
tttatttt

SEQ ID NO: 106637 - DNA, 8 bp, Unknown
  misc_feature (1)..( 8): Result.002 file - promoters60/1377835
tttctttt

SEQ ID NO: 106638 - DNA, 6 bp, Unknown
  misc_feature (1)..( 6): Result.002 file - promoters60/1377835
tttact

SEQ ID NO: 106639 - DNA, 6 bp, Unknown
  misc_feature (1)..( 6): Result.002 file - promoters60/1377835
tttact

SEQ ID NO: 106640 - DNA, 9 bp, Unknown
  misc_feature (1)..( 9): Result.002 file - promoters60/1377835
cttattttt

SEQ ID NO: 106641 - DNA, 9 bp, Unknown
  misc_feature (1)..( 9): Result.002 file - promoters60/1377835
cttagtttt

SEQ ID NO: 106642 - DNA, 8 bp, Unknown
  misc_feature (1)..( 8): Result.002 file - promoters60/1377835
tttgtttg

SEQ ID NO: 106643 - DNA, 8 bp, Unknown
  misc_feature (1)..( 8): Result.002 file - promoters60/1377835
tttgtttg

SEQ ID NO: 106644 - DNA, 6 bp, Unknown
  misc_feature (1)..( 6): Result.002 file - promoters60/1377835
aagttt

SEQ ID NO: 106645 - DNA, 6 bp, Unknown
  misc_feature (1)..( 6): Result.002 file - promoters60/1377835
aagttt

SEQ ID NO: 106646 - DNA, 10 bp, Unknown
  misc_feature (1)..( 10): Result.002 file - promoters60/1377835
caaagtaatt

SEQ ID NO: 106647 - DNA, 10 bp, Unknown
  misc_feature (1)..( 10): Result.002 file - promoters60/1377835
caaactaatt

SEQ ID NO: 106648 - DNA, 7 bp, Unknown
  misc_feature (1)..( 7): Result.002 file - promoters60/1377835
attggaa

SEQ ID NO: 106649 - DNA, 7 bp, Unknown
  misc_feature (1)..( 7): Result.002 file - promoters60/1377835
attagaa

SEQ ID NO: 106650 - DNA, 8 bp, Unknown
  misc_feature (1)..( 8): Result.002 file - promoters60/1377835
aacaaaat

SEQ ID NO: 106651 - DNA, 8 bp, Unknown
  misc_feature (1)..( 8): Result.002 file - promoters60/1377835
aactaaat

SEQ ID NO: 106652 - DNA, 9 bp, Unknown
  misc_feature (1)..( 9): Result.002 file - promoters60/1377847
gaaaatatt

SEQ ID NO: 106653 - DNA, 9 bp, Unknown
  misc_feature (1)..( 9): Result.002 file - promoters60/1377847
aaaaataag

SEQ ID NO: 106654 - DNA, 9 bp, Unknown
  misc_feature (1)..( 9): Result.002 file - promoters60/1377847
aaaaattaa

SEQ ID NO: 106655 - DNA, 9 bp, Unknown
  misc_feature (1)..( 9): Result.002 file - promoters60/1377847
aaacatatt

SEQ ID NO: 106656 - DNA, 9 bp, Unknown
  misc_feature (1)..( 9): Result.002 file - promoters60/1377847
taaaatttc

SEQ ID NO: 106657 - DNA, 9 bp, Unknown
  misc_feature (1)..( 9): Result.002 file - promoters60/1377847
caaaattca

SEQ ID NO: 106658 - DNA, 12 bp, Unknown
  misc_feature (1)..( 12): Result.002 file - promoters60/1377847
gaaaaataaata

SEQ ID NO: 106659 - DNA, 12 bp, Unknown
  misc_feature (1)..( 12): Result.002 file - promoters60/1377847
tattaataaagc

SEQ ID NO: 106660 - DNA, 12 bp, Unknown
  misc_feature (1)..( 12): Result.002 file - promoters60/1377847
ataaaattaata

SEQ ID NO: 106661 - DNA, 12 bp, Unknown
  misc_feature (1)..( 12): Result.002 file - promoters60/1377847
atattattaact

SEQ ID NO: 106662 - DNA, 12 bp, Unknown
  misc_feature (1)..( 12): Result.002 file - promoters60/1377847
agataatatttc

SEQ ID NO: 106663 - DNA, 12 bp, Unknown
  misc_feature (1)..( 12): Result.002 file - promoters60/1377847
acattataaaat

SEQ ID NO: 106664 - DNA, 12 bp, Unknown
  misc_feature (1)..( 12): Result.002 file - promoters60/1377847
aaccgattaata

SEQ ID NO: 106665 - DNA, 12 bp, Unknown
  misc_feature (1)..( 12): Result.002 file - promoters60/1377847
aatttacaaact

SEQ ID NO: 106666 - DNA, 9 bp, Unknown
  misc_feature (1)..( 9): Result.002 file - promoters60/1377847
aaaacaaac

SEQ ID NO: 106667 - DNA, 9 bp, Unknown
  misc_feature (1)..( 9): Result.002 file - promoters60/1377847
aaaaaaaag

SEQ ID NO: 106668 - DNA, 9 bp, Unknown
  misc_feature (1)..( 9): Result.002 file - promoters60/1377847
taaataaat

SEQ ID NO: 106669 - DNA, 9 bp, Unknown
  misc_feature (1)..( 9): Result.002 file - promoters60/1377847
caaacaaat

SEQ ID NO: 106670 - DNA, 9 bp, Unknown
  misc_feature (1)..( 9): Result.002 file - promoters60/1377847
taaaaaaag

SEQ ID NO: 106671 - DNA, 9 bp, Unknown
  misc_feature (1)..( 9): Result.002 file - promoters60/1377847
aaaacaatt

SEQ ID NO: 106672 - DNA, 9 bp, Unknown
  misc_feature (1)..( 9): Result.002 file - promoters60/1377847
taaataaat

SEQ ID NO: 106673 - DNA, 9 bp, Unknown
  misc_feature (1)..( 9): Result.002 file - promoters60/1377847
gtcataaat

SEQ ID NO: 106674 - DNA, 13 bp, Unknown
  misc_feature (1)..( 13): Result.002 file - promoters60/1377847
attacaaaactac

SEQ ID NO: 106675 - DNA, 13 bp, Unknown
  misc_feature (1)..( 13): Result.002 file - promoters60/1377847
tatacaaaaaaag

SEQ ID NO: 106676 - DNA, 13 bp, Unknown
  misc_feature (1)..( 13): Result.002 file - promoters60/1377847
ctcccaaaaataa

SEQ ID NO: 106677 - DNA, 13 bp, Unknown
  misc_feature (1)..( 13): Result.002 file - promoters60/1377847
attcctaaaatca

SEQ ID NO: 106678 - DNA, 13 bp, Unknown
  misc_feature (1)..( 13): Result.002 file - promoters60/1377847
acaaataaacata

SEQ ID NO: 106679 - DNA, 13 bp, Unknown
  misc_feature (1)..( 13): Result.002 file - promoters60/1377847
tattcaagatgat

SEQ ID NO: 106680 - DNA, 13 bp, Unknown
  misc_feature (1)..( 13): Result.002 file - promoters60/1377847
aataaataaaagc

SEQ ID NO: 106681 - DNA, 13 bp, Unknown
  misc_feature (1)..( 13): Result.002 file - promoters60/1377847
aaacaataaaatt

SEQ ID NO: 106682 - DNA, 13 bp, Unknown
  misc_feature (1)..( 13): Result.002 file - promoters60/1377847
acattataaaata

SEQ ID NO: 106683 - DNA, 13 bp, Unknown
  misc_feature (1)..( 13): Result.002 file - promoters60/1377847
aaacagtaaaacc

SEQ ID NO: 106684 - DNA, 13 bp, Unknown
  misc_feature (1)..( 13): Result.002 file - promoters60/1377847
aggagataatatt

SEQ ID NO: 106685 - DNA, 14 bp, Unknown
  misc_feature (1)..( 14): Result.002 file - promoters60/1377847
aaaatttacaaact

SEQ ID NO: 106686 - DNA, 10 bp, Unknown
  misc_feature (1)..( 10): Result.002 file - promoters60/1377847
atattattag

SEQ ID NO: 106687 - DNA, 10 bp, Unknown
  misc_feature (1)..( 10): Result.002 file - promoters60/1377847
atattattag

SEQ ID NO: 106688 - DNA, 10 bp, Unknown
  misc_feature (1)..( 10): Result.002 file - promoters60/1377847
ttattatatt

SEQ ID NO: 106689 - DNA, 10 bp, Unknown
  misc_feature (1)..( 10): Result.002 file - promoters60/1377847
atataattat

SEQ ID NO: 106690 - DNA, 10 bp, Unknown
  misc_feature (1)..( 10): Result.002 file - promoters60/1377847
ttattatgtg

SEQ ID NO: 106691 - DNA, 10 bp, Unknown
  misc_feature (1)..( 10): Result.002 file - promoters60/1377847
atacaatgaa

SEQ ID NO: 106692 - DNA, 9 bp, Unknown
  misc_feature (1)..( 9): Result.002 file - promoters60/1377847
caaccaact

SEQ ID NO: 106693 - DNA, 9 bp, Unknown
  misc_feature (1)..( 9): Result.002 file - promoters60/1377847
aaaccaatg

SEQ ID NO: 106694 - DNA, 9 bp, Unknown
  misc_feature (1)..( 9): Result.002 file - promoters60/1377847
gaacaaact

SEQ ID NO: 106695 - DNA, 9 bp, Unknown
  misc_feature (1)..( 9): Result.002 file - promoters60/1377847
agaccaatc

SEQ ID NO: 106696 - DNA, 9 bp, Unknown
  misc_feature (1)..( 9): Result.002 file - promoters60/1377847
aaatcaaat

SEQ ID NO: 106697 - DNA, 10 bp, Unknown
  misc_feature (1)..( 10): Result.002 file - promoters60/1377847
aaattcaatg

SEQ ID NO: 106698 - DNA, 10 bp, Unknown
  misc_feature (1)..( 10): Result.002 file - promoters60/1377847
gaaaaacaaa

SEQ ID NO: 106699 - DNA, 10 bp, Unknown
  misc_feature (1)..( 10): Result.002 file - promoters60/1377847
gaaaaaatag

SEQ ID NO: 106700 - DNA, 10 bp, Unknown
  misc_feature (1)..( 10): Result.002 file - promoters60/1377847
gaaaaaaaag

SEQ ID NO: 106701 - DNA, 10 bp, Unknown
  misc_feature (1)..( 10): Result.002 file - promoters60/1377847
taaaaaatat

SEQ ID NO: 106702 - DNA, 10 bp, Unknown
  misc_feature (1)..( 10): Result.002 file - promoters60/1377847
taaacattga

SEQ ID NO: 106703 - DNA, 10 bp, Unknown
  misc_feature (1)..( 10): Result.002 file - promoters60/1377847
aaaacaattc

SEQ ID NO: 106704 - DNA, 10 bp, Unknown
  misc_feature (1)..( 10): Result.002 file - promoters60/1377847
tatacaatga

SEQ ID NO: 106705 - DNA, 9 bp, Unknown
  misc_feature (1)..( 9): Result.002 file - promoters60/1377847
aaatttttg

SEQ ID NO: 106706 - DNA, 9 bp, Unknown
  misc_feature (1)..( 9): Result.002 file - promoters60/1377847
taatcttta

SEQ ID NO: 106707 - DNA, 9 bp, Unknown
  misc_feature (1)..( 9): Result.002 file - promoters60/1377847
taagtttcc

SEQ ID NO: 106708 - DNA, 9 bp, Unknown
  misc_feature (1)..( 9): Result.002 file - promoters60/1377847
caatgttta

SEQ ID NO: 106709 - DNA, 9 bp, Unknown
  misc_feature (1)..( 9): Result.002 file - promoters60/1377847
aaatgtttg

SEQ ID NO: 106710 - DNA, 9 bp, Unknown
  misc_feature (1)..( 9): Result.002 file - promoters60/1377847
aattgttta

SEQ ID NO: 106711 - DNA, 10 bp, Unknown
  misc_feature (1)..( 10): Result.002 file - promoters60/1378049
gaaaatatta

SEQ ID NO: 106712 - DNA, 10 bp, Unknown
  misc_feature (1)..( 10): Result.002 file - promoters60/1378049
aaaaataaga

SEQ ID NO: 106713 - DNA, 10 bp, Unknown
  misc_feature (1)..( 10): Result.002 file - promoters60/1378049
aaaaattaaa

SEQ ID NO: 106714 - DNA, 10 bp, Unknown
  misc_feature (1)..( 10): Result.002 file - promoters60/1378049
tcaaatattg

SEQ ID NO: 106715 - DNA, 10 bp, Unknown
  misc_feature (1)..( 10): Result.002 file - promoters60/1378049
taaaatttca

SEQ ID NO: 106716 - DNA, 10 bp, Unknown
  misc_feature (1)..( 10): Result.002 file - promoters60/1378049
caaaattgac

SEQ ID NO: 106717 - DNA, 10 bp, Unknown
  misc_feature (1)..( 10): Result.002 file - promoters60/1378049
agaaatttca

SEQ ID NO: 106718 - DNA, 8 bp, Unknown
  misc_feature (1)..( 8): Result.002 file - promoters60/1378049
aaaacaaa

SEQ ID NO: 106719 - DNA, 8 bp, Unknown
  misc_feature (1)..( 8): Result.002 file - promoters60/1378049
aaaaaaaa

SEQ ID NO: 106720 - DNA, 8 bp, Unknown
  misc_feature (1)..( 8): Result.002 file - promoters60/1378049
ggaacaaa

SEQ ID NO: 106721 - DNA, 8 bp, Unknown
  misc_feature (1)..( 8): Result.002 file - promoters60/1378049
taaataaa

SEQ ID NO: 106722 - DNA, 8 bp, Unknown
  misc_feature (1)..( 8): Result.002 file - promoters60/1378049
caaacaaa

SEQ ID NO: 106723 - DNA, 8 bp, Unknown
  misc_feature (1)..( 8): Result.002 file - promoters60/1378049
agaaaaaa

SEQ ID NO: 106724 - DNA, 8 bp, Unknown
  misc_feature (1)..( 8): Result.002 file - promoters60/1378049
aaaatata

SEQ ID NO: 106725 - DNA, 14 bp, Unknown
  misc_feature (1)..( 14): Result.002 file - promoters60/1378049
aaattgggactaaa

SEQ ID NO: 106726 - DNA, 14 bp, Unknown
  misc_feature (1)..( 14): Result.002 file - promoters60/1378049
ttatttggataaaa

SEQ ID NO: 106727 - DNA, 14 bp, Unknown
  misc_feature (1)..( 14): Result.002 file - promoters60/1378049
tcctttgaataaaa

SEQ ID NO: 106728 - DNA, 14 bp, Unknown
  misc_feature (1)..( 14): Result.002 file - promoters60/1378049
tccgttgacacgta

SEQ ID NO: 106729 - DNA, 14 bp, Unknown
  misc_feature (1)..( 14): Result.002 file - promoters60/1378049
ccaattaaaaagga

SEQ ID NO: 106730 - DNA, 14 bp, Unknown
  misc_feature (1)..( 14): Result.002 file - promoters60/1378049
aaaggtcaataaat

SEQ ID NO: 106731 - DNA, 12 bp, Unknown
  misc_feature (1)..( 12): Result.002 file - promoters60/1378049
ttgagtttaggc

SEQ ID NO: 106732 - DNA, 12 bp, Unknown
  misc_feature (1)..( 12): Result.002 file - promoters60/1378049
ttgacttttgac

SEQ ID NO: 106733 - DNA, 12 bp, Unknown
  misc_feature (1)..( 12): Result.002 file - promoters60/1378049
gatagtttaaaa

SEQ ID NO: 106734 - DNA, 12 bp, Unknown
  misc_feature (1)..( 12): Result.002 file - promoters60/1378049
ttggcttctatt

SEQ ID NO: 106735 - DNA, 12 bp, Unknown
  misc_feature (1)..( 12): Result.002 file - promoters60/1378049
ataagtttcaaa

SEQ ID NO: 106736 - DNA, 12 bp, Unknown
  misc_feature (1)..( 12): Result.002 file - promoters60/1378049
taaagttttgtc

SEQ ID NO: 106737 - DNA, 12 bp, Unknown
  misc_feature (1)..( 12): Result.002 file - promoters60/1378049
ttacaaaactac

SEQ ID NO: 106738 - DNA, 12 bp, Unknown
  misc_feature (1)..( 12): Result.002 file - promoters60/1378049
atacaaaaaaag

SEQ ID NO: 106739 - DNA, 12 bp, Unknown
  misc_feature (1)..( 12): Result.002 file - promoters60/1378049
tcccaaaaataa

SEQ ID NO: 106740 - DNA, 12 bp, Unknown
  misc_feature (1)..( 12): Result.002 file - promoters60/1378049
ttcctaaaatca

SEQ ID NO: 106741 - DNA, 12 bp, Unknown
  misc_feature (1)..( 12): Result.002 file - promoters60/1378049
aaacataagttt

SEQ ID NO: 106742 - DNA, 12 bp, Unknown
  misc_feature (1)..( 12): Result.002 file - promoters60/1378049
acccaaaattga

SEQ ID NO: 106743 - DNA, 12 bp, Unknown
  misc_feature (1)..( 12): Result.002 file - promoters60/1378049
tgtcataaattt

SEQ ID NO: 106744 - DNA, 12 bp, Unknown
  misc_feature (1)..( 12): Result.002 file - promoters60/1378049
ttatatatagaa

SEQ ID NO: 106745 - DNA, 12 bp, Unknown
  misc_feature (1)..( 12): Result.002 file - promoters60/1378049
ctatatataaaa

SEQ ID NO: 106746 - DNA, 12 bp, Unknown
  misc_feature (1)..( 12): Result.002 file - promoters60/1378049
ttatatataacc

SEQ ID NO: 106747 - DNA, 12 bp, Unknown
  misc_feature (1)..( 12): Result.002 file - promoters60/1378049
atataaataaca

SEQ ID NO: 106748 - DNA, 12 bp, Unknown
  misc_feature (1)..( 12): Result.002 file - promoters60/1378049
ctataaattaca

SEQ ID NO: 106749 - DNA, 12 bp, Unknown
  misc_feature (1)..( 12): Result.002 file - promoters60/1378049
ccatataaattt

SEQ ID NO: 106750 - DNA, 12 bp, Unknown
  misc_feature (1)..( 12): Result.002 file - promoters60/1378049
agatataataca

SEQ ID NO: 106751 - DNA, 16 bp, Unknown
  misc_feature (1)..( 16): Result.002 file - promoters60/1378049
ttcgtagattgcgtga

SEQ ID NO: 106752 - DNA, 16 bp, Unknown
  misc_feature (1)..( 16): Result.002 file - promoters60/1378049
tttttagtttgtgtgc

SEQ ID NO: 106753 - DNA, 16 bp, Unknown
  misc_feature (1)..( 16): Result.002 file - promoters60/1378049
attgtatatttagttg

SEQ ID NO: 106754 - DNA, 16 bp, Unknown
  misc_feature (1)..( 16): Result.002 file - promoters60/1378049
catgtcagtttcgttt

SEQ ID NO: 106755 - DNA, 16 bp, Unknown
  misc_feature (1)..( 16): Result.002 file - promoters60/1378049
atttaatattttcaga

SEQ ID NO: 106756 - DNA, 16 bp, Unknown
  misc_feature (1)..( 16): Result.002 file - promoters60/1378049
taaaaatctcgtgtgc

SEQ ID NO: 106757 - DNA, 16 bp, Unknown
  misc_feature (1)..( 16): Result.002 file - promoters60/1378049
tttttaatttgtgtct

SEQ ID NO: 106758 - DNA, 14 bp, Unknown
  misc_feature (1)..( 14): Result.002 file - promoters60/1378088
caaatattttattc

SEQ ID NO: 106759 - DNA, 14 bp, Unknown
  misc_feature (1)..( 14): Result.002 file - promoters60/1378088
aacttattttatga

SEQ ID NO: 106760 - DNA, 14 bp, Unknown
  misc_feature (1)..( 14): Result.002 file - promoters60/1378088
aaatctttttgtga

SEQ ID NO: 106761 - DNA, 14 bp, Unknown
  misc_feature (1)..( 14): Result.002 file - promoters60/1378088
aaattattttaatt

SEQ ID NO: 106762 - DNA, 14 bp, Unknown
  misc_feature (1)..( 14): Result.002 file - promoters60/1378088
aactaatttagcgt

SEQ ID NO: 106763 - DNA, 10 bp, Unknown
  misc_feature (1)..( 10): Result.002 file - promoters60/1378088
caaaatttta

SEQ ID NO: 106764 - DNA, 10 bp, Unknown
  misc_feature (1)..( 10): Result.002 file - promoters60/1378088
aaaaattggg

SEQ ID NO: 106765 - DNA, 10 bp, Unknown
  misc_feature (1)..( 10): Result.002 file - promoters60/1378088
taaagtttta

SEQ ID NO: 106766 - DNA, 11 bp, Unknown
  misc_feature (1)..( 11): Result.002 file - promoters60/1378088
taataatcctt

SEQ ID NO: 106767 - DNA, 11 bp, Unknown
  misc_feature (1)..( 11): Result.002 file - promoters60/1378088
aaaattcggat

SEQ ID NO: 106768 - DNA, 11 bp, Unknown
  misc_feature (1)..( 11): Result.002 file - promoters60/1378088
aaaattgaatc

SEQ ID NO: 106769 - DNA, 11 bp, Unknown
  misc_feature (1)..( 11): Result.002 file - promoters60/1378088
caaattgtttt

SEQ ID NO: 106770 - DNA, 11 bp, Unknown
  misc_feature (1)..( 11): Result.002 file - promoters60/1378088
taaattatttt

SEQ ID NO: 106771 - DNA, 13 bp, Unknown
  misc_feature (1)..( 13): Result.002 file - promoters60/1378088
caaaaaatctgga

SEQ ID NO: 106772 - DNA, 13 bp, Unknown
  misc_feature (1)..( 13): Result.002 file - promoters60/1378088
taaaaaaacatat

SEQ ID NO: 106773 - DNA, 13 bp, Unknown
  misc_feature (1)..( 13): Result.002 file - promoters60/1378088
aaaaaaaacattg

SEQ ID NO: 106774 - DNA, 13 bp, Unknown
  misc_feature (1)..( 13): Result.002 file - promoters60/1378088
taaaaagagaaaa

SEQ ID NO: 106775 - DNA, 8 bp, Unknown
  misc_feature (1)..( 8): Result.002 file - promoters60/1378088
gatattta

SEQ ID NO: 106776 - DNA, 8 bp, Unknown
  misc_feature (1)..( 8): Result.002 file - promoters60/1378088
catatttt

SEQ ID NO: 106777 - DNA, 8 bp, Unknown
  misc_feature (1)..( 8): Result.002 file - promoters60/1378088
aatactta

SEQ ID NO: 106778 - DNA, 8 bp, Unknown
  misc_feature (1)..( 8): Result.002 file - promoters60/1378088
aatatttt

SEQ ID NO: 106779 - DNA, 8 bp, Unknown
  misc_feature (1)..( 8): Result.002 file - promoters60/1378088
catattac

SEQ ID NO: 106780 - DNA, 7 bp, Unknown
  misc_feature (1)..( 7): Result.002 file - promoters60/1378088
aagattt

SEQ ID NO: 106781 - DNA, 7 bp, Unknown
  misc_feature (1)..( 7): Result.002 file - promoters60/1378088
tagattt

SEQ ID NO: 106782 - DNA, 7 bp, Unknown
  misc_feature (1)..( 7): Result.002 file - promoters60/1378088
cagattt

SEQ ID NO: 106783 - DNA, 7 bp, Unknown
  misc_feature (1)..( 7): Result.002 file - promoters60/1378088
tagattt

SEQ ID NO: 106784 - DNA, 11 bp, Unknown
  misc_feature (1)..( 11): Result.002 file - promoters60/1378088
tctaaatttta

SEQ ID NO: 106785 - DNA, 11 bp, Unknown
  misc_feature (1)..( 11): Result.002 file - promoters60/1378088
aaattatttta

SEQ ID NO: 106786 - DNA, 11 bp, Unknown
  misc_feature (1)..( 11): Result.002 file - promoters60/1378088
aacttatttta

SEQ ID NO: 106787 - DNA, 11 bp, Unknown
  misc_feature (1)..( 11): Result.002 file - promoters60/1378088
aactaatttag

SEQ ID NO: 106788 - DNA, 13 bp, Unknown
  misc_feature (1)..( 13): Result.002 file - promoters60/1378088
aattggatccgaa

SEQ ID NO: 106789 - DNA, 13 bp, Unknown
  misc_feature (1)..( 13): Result.002 file - promoters60/1378088
aattagatttttt

SEQ ID NO: 106790 - DNA, 13 bp, Unknown
  misc_feature (1)..( 13): Result.002 file - promoters60/1378088
atctagatttgtg

SEQ ID NO: 106791 - DNA, 13 bp, Unknown
  misc_feature (1)..( 13): Result.002 file - promoters60/1378088
tattcgatctttt

SEQ ID NO: 106792 - DNA, 9 bp, Unknown
  misc_feature (1)..( 9): Result.002 file - promoters60/1378088
aaaatctgg

SEQ ID NO: 106793 - DNA, 9 bp, Unknown
  misc_feature (1)..( 9): Result.002 file - promoters60/1378088
aaaatcatt

SEQ ID NO: 106794 - DNA, 9 bp, Unknown
  misc_feature (1)..( 9): Result.002 file - promoters60/1378088
aaaaacata

SEQ ID NO: 106795 - DNA, 9 bp, Unknown
  misc_feature (1)..( 9): Result.002 file - promoters60/1378088
aaaaacatt

SEQ ID NO: 106796 - DNA, 9 bp, Unknown
  misc_feature (1)..( 9): Result.002 file - promoters60/1378088
taaaacaat

SEQ ID NO: 106797 - DNA, 9 bp, Unknown
  misc_feature (1)..( 9): Result.002 file - promoters60/1378088
taaaaatct

SEQ ID NO: 106798 - DNA, 9 bp, Unknown
  misc_feature (1)..( 9): Result.002 file - promoters60/1378088
taaaaatta

SEQ ID NO: 106799 - DNA, 9 bp, Unknown
  misc_feature (1)..( 9): Result.002 file - promoters60/1378088
acaaaatta

SEQ ID NO: 106800 - DNA, 9 bp, Unknown
  misc_feature (1)..( 9): Result.002 file - promoters60/1378088
actaaatta

SEQ ID NO: 106801 - DNA, 7 bp, Unknown
  misc_feature (1)..( 7): Result.002 file - promoters60/1378088
taaaaat

SEQ ID NO: 106802 - DNA, 7 bp, Unknown
  misc_feature (1)..( 7): Result.002 file - promoters60/1378088
taaaaaa

SEQ ID NO: 106803 - DNA, 7 bp, Unknown
  misc_feature (1)..( 7): Result.002 file - promoters60/1378088
taaaaac

SEQ ID NO: 106804 - DNA, 7 bp, Unknown
  misc_feature (1)..( 7): Result.002 file - promoters60/1378088
taataat

SEQ ID NO: 106805 - DNA, 8 bp, Unknown
  misc_feature (1)..( 8): Result.002 file - promoters60/1378088
aatcatat

SEQ ID NO: 106806 - DNA, 8 bp, Unknown
  misc_feature (1)..( 8): Result.002 file - promoters60/1378088
aattataa

SEQ ID NO: 106807 - DNA, 8 bp, Unknown
  misc_feature (1)..( 8): Result.002 file - promoters60/1378088
tttcatat

SEQ ID NO: 106808 - DNA, 8 bp, Unknown
  misc_feature (1)..( 8): Result.002 file - promoters60/1378088
acttataa

SEQ ID NO: 106809 - DNA, 20 bp, Unknown
  misc_feature (1)..( 20): Result.002 file - promoters60/1378088
ttgtcaactatgaattattg

SEQ ID NO: 106810 - DNA, 20 bp, Unknown
  misc_feature (1)..( 20): Result.002 file - promoters60/1378088
attttaatcaacaataattt

SEQ ID NO: 106811 - DNA, 20 bp, Unknown
  misc_feature (1)..( 20): Result.002 file - promoters60/1378088
gaaatattattcaataataa

SEQ ID NO: 106812 - DNA, 20 bp, Unknown
  misc_feature (1)..( 20): Result.002 file - promoters60/1378088
cttataaaaattagaaatgc

SEQ ID NO: 106813 - DNA, 11 bp, Unknown
  misc_feature (1)..( 11): Result.002 file - promoters60/1378088
ttactttttta

SEQ ID NO: 106814 - DNA, 11 bp, Unknown
  misc_feature (1)..( 11): Result.002 file - promoters60/1378088
ccaatttgtta

SEQ ID NO: 106815 - DNA, 11 bp, Unknown
  misc_feature (1)..( 11): Result.002 file - promoters60/1378088
ttcgttttttt

SEQ ID NO: 106816 - DNA, 11 bp, Unknown
  misc_feature (1)..( 11): Result.002 file - promoters60/1378088
tacattttatc

SEQ ID NO: 106817 - DNA, 10 bp, Unknown
  misc_feature (1)..( 10): Result.002 file - promoters60/1378088
attttataat

SEQ ID NO: 106818 - DNA, 10 bp, Unknown
  misc_feature (1)..( 10): Result.002 file - promoters60/1378088
attttatagg

SEQ ID NO: 106819 - DNA, 10 bp, Unknown
  misc_feature (1)..( 10): Result.002 file - promoters60/1378088
tttttaattc

SEQ ID NO: 106820 - DNA, 10 bp, Unknown
  misc_feature (1)..( 10): Result.002 file - promoters60/1378088
actttaaaat

SEQ ID NO: 106821 - DNA, 13 bp, Unknown
  misc_feature (1)..( 13): Result.002 file - promoters60/1378088
ttagaagaagtta

SEQ ID NO: 106822 - DNA, 13 bp, Unknown
  misc_feature (1)..( 13): Result.002 file - promoters60/1378088
ttataagaagaaa

SEQ ID NO: 106823 - DNA, 13 bp, Unknown
  misc_feature (1)..( 13): Result.002 file - promoters60/1378088
taaaaagagaaaa

SEQ ID NO: 106824 - DNA, 13 bp, Unknown
  misc_feature (1)..( 13): Result.002 file - promoters60/1378088
ttataaaacaatt

SEQ ID NO: 106825 - DNA, 9 bp, Unknown
  misc_feature (1)..( 9): Result.002 file - promoters60/1378088
gttagaaat

SEQ ID NO: 106826 - DNA, 9 bp, Unknown
  misc_feature (1)..( 9): Result.002 file - promoters60/1378088
gttaaaaac

SEQ ID NO: 106827 - DNA, 9 bp, Unknown
  misc_feature (1)..( 9): Result.002 file - promoters60/1378088
cttataaaa

SEQ ID NO: 106828 - DNA, 9 bp, Unknown
  misc_feature (1)..( 9): Result.002 file - promoters60/1378088
taaaaaaac

SEQ ID NO: 106829 - DNA, 9 bp, Unknown
  misc_feature (1)..( 9): Result.002 file - promoters60/1378088
attataaga

SEQ ID NO: 106830 - DNA, 12 bp, Unknown
  misc_feature (1)..( 12): Result.002 file - promoters60/1378088
ttaaaaactttg

SEQ ID NO: 106831 - DNA, 12 bp, Unknown
  misc_feature (1)..( 12): Result.002 file - promoters60/1378088
aaaaaaacattg

SEQ ID NO: 106832 - DNA, 12 bp, Unknown
  misc_feature (1)..( 12): Result.002 file - promoters60/1378088
ttaaaaactaaa

SEQ ID NO: 106833 - DNA, 12 bp, Unknown
  misc_feature (1)..( 12): Result.002 file - promoters60/1378088
tataaaacaatt

SEQ ID NO: 106834 - DNA, 9 bp, Unknown
  misc_feature (1)..( 9): Result.002 file - promoters60/1378088
ttaatcaac

SEQ ID NO: 106835 - DNA, 9 bp, Unknown
  misc_feature (1)..( 9): Result.002 file - promoters60/1378088
aaaattaac

SEQ ID NO: 106836 - DNA, 9 bp, Unknown
  misc_feature (1)..( 9): Result.002 file - promoters60/1378088
aaaattaga

SEQ ID NO: 106837 - DNA, 9 bp, Unknown
  misc_feature (1)..( 9): Result.002 file - promoters60/1378088
taaattagt

SEQ ID NO: 106838 - DNA, 12 bp, Unknown
  misc_feature (1)..( 12): Result.002 file - promoters60/1378088
ccaaaaataaat

SEQ ID NO: 106839 - DNA, 12 bp, Unknown
  misc_feature (1)..( 12): Result.002 file - promoters60/1378088
caagaaaaaaat

SEQ ID NO: 106840 - DNA, 12 bp, Unknown
  misc_feature (1)..( 12): Result.002 file - promoters60/1378088
aagcaaaaattc

SEQ ID NO: 106841 - DNA, 12 bp, Unknown
  misc_feature (1)..( 12): Result.002 file - promoters60/1378088
ttttaaaaataa

SEQ ID NO: 106842 - DNA, 8 bp, Unknown
  misc_feature (1)..( 8): Result.002 file - promoters60/1378088
aaaacata

SEQ ID NO: 106843 - DNA, 8 bp, Unknown
  misc_feature (1)..( 8): Result.002 file - promoters60/1378088
aaaacaaa

SEQ ID NO: 106844 - DNA, 8 bp, Unknown
  misc_feature (1)..( 8): Result.002 file - promoters60/1378088
aaaaaaaa

SEQ ID NO: 106845 - DNA, 8 bp, Unknown
  misc_feature (1)..( 8): Result.002 file - promoters60/1378088
aaaacaat

SEQ ID NO: 106846 - DNA, 9 bp, Unknown
  misc_feature (1)..( 9): Result.002 file - promoters60/1378287
atttgagag

SEQ ID NO: 106847 - DNA, 9 bp, Unknown
  misc_feature (1)..( 9): Result.002 file - promoters60/1378287
ttttgagtg

SEQ ID NO: 106848 - DNA, 9 bp, Unknown
  misc_feature (1)..( 9): Result.002 file - promoters60/1378287
acttgggag

SEQ ID NO: 106849 - DNA, 9 bp, Unknown
  misc_feature (1)..( 9): Result.002 file - promoters60/1378287
atttgattc

SEQ ID NO: 106850 - DNA, 11 bp, Unknown
  misc_feature (1)..( 11): Result.002 file - promoters60/1378287
gttatgtgaca

SEQ ID NO: 106851 - DNA, 11 bp, Unknown
  misc_feature (1)..( 11): Result.002 file - promoters60/1378287
aaaatgtgaaa

SEQ ID NO: 106852 - DNA, 11 bp, Unknown
  misc_feature (1)..( 11): Result.002 file - promoters60/1378287
aaactgtgaaa

SEQ ID NO: 106853 - DNA, 11 bp, Unknown
  misc_feature (1)..( 11): Result.002 file - promoters60/1378287
gctttgtgaaa

SEQ ID NO: 106854 - DNA, 8 bp, Unknown
  misc_feature (1)..( 8): Result.002 file - promoters60/1378287
aaaaattg

SEQ ID NO: 106855 - DNA, 8 bp, Unknown
  misc_feature (1)..( 8): Result.002 file - promoters60/1378287
aaatattt

SEQ ID NO: 106856 - DNA, 8 bp, Unknown
  misc_feature (1)..( 8): Result.002 file - promoters60/1378287
aaatcgaa

SEQ ID NO: 106857 - DNA, 8 bp, Unknown
  misc_feature (1)..( 8): Result.002 file - promoters60/1378287
caatattc

SEQ ID NO: 106858 - DNA, 10 bp, Unknown
  misc_feature (1)..( 10): Result.002 file - promoters60/1378287
aaaattgaaa

SEQ ID NO: 106859 - DNA, 10 bp, Unknown
  misc_feature (1)..( 10): Result.002 file - promoters60/1378287
tgaatttaaa

SEQ ID NO: 106860 - DNA, 10 bp, Unknown
  misc_feature (1)..( 10): Result.002 file - promoters60/1378287
caaatcgaag

SEQ ID NO: 106861 - DNA, 10 bp, Unknown
  misc_feature (1)..( 10): Result.002 file - promoters60/1378287
tgaatttgta

SEQ ID NO: 106862 - DNA, 8 bp, Unknown
  misc_feature (1)..( 8): Result.002 file - promoters60/1378297
taagattt

SEQ ID NO: 106863 - DNA, 8 bp, Unknown
  misc_feature (1)..( 8): Result.002 file - promoters60/1378297
taatattt

SEQ ID NO: 106864 - DNA, 9 bp, Unknown
  misc_feature (1)..( 9): Result.002 file - promoters60/1378297
atatgattt

SEQ ID NO: 106865 - DNA, 9 bp, Unknown
  misc_feature (1)..( 9): Result.002 file - promoters60/1378297
aaatggttt

SEQ ID NO: 106866 - DNA, 9 bp, Unknown
  misc_feature (1)..( 9): Result.002 file - promoters60/1378297
aaatggttt

SEQ ID NO: 106867 - DNA, 6 bp, Unknown
  misc_feature (1)..( 6): Result.002 file - promoters60/1378297
aaaaaa

SEQ ID NO: 106868 - DNA, 6 bp, Unknown
  misc_feature (1)..( 6): Result.002 file - promoters60/1378297
aaaaaa

SEQ ID NO: 106869 - DNA, 6 bp, Unknown
  misc_feature (1)..( 6): Result.002 file - promoters60/1378297
aaaaat

SEQ ID NO: 106870 - DNA, 6 bp, Unknown
  misc_feature (1)..( 6): Result.002 file - promoters60/1378297
aaaaat

SEQ ID NO: 106871 - DNA, 7 bp, Unknown
  misc_feature (1)..( 7): Result.002 file - promoters60/1378297
aaacaaa

SEQ ID NO: 106872 - DNA, 7 bp, Unknown
  misc_feature (1)..( 7): Result.002 file - promoters60/1378297
aaacaaa

SEQ ID NO: 106873 - DNA, 6 bp, Unknown
  misc_feature (1)..( 6): Result.002 file - promoters60/1378297
aaataa

SEQ ID NO: 106874 - DNA, 6 bp, Unknown
  misc_feature (1)..( 6): Result.002 file - promoters60/1378297
aaataa

SEQ ID NO: 106875 - DNA, 6 bp, Unknown
  misc_feature (1)..( 6): Result.002 file - promoters60/1378297
atttcc

SEQ ID NO: 106876 - DNA, 6 bp, Unknown
  misc_feature (1)..( 6): Result.002 file - promoters60/1378297
atttcc

SEQ ID NO: 106877 - DNA, 8 bp, Unknown
  misc_feature (1)..( 8): Result.002 file - promoters60/1378297
aaataatc

SEQ ID NO: 106878 - DNA, 8 bp, Unknown
  misc_feature (1)..( 8): Result.002 file - promoters60/1378297
aaataatc

SEQ ID NO: 106879 - DNA, 6 bp, Unknown
  misc_feature (1)..( 6): Result.002 file - promoters60/1378297
aaaatc

SEQ ID NO: 106880 - DNA, 6 bp, Unknown
  misc_feature (1)..( 6): Result.002 file - promoters60/1378297
aaaatc

SEQ ID NO: 106881 - DNA, 7 bp, Unknown
  misc_feature (1)..( 7): Result.002 file - promoters60/1378297
tattctt

SEQ ID NO: 106882 - DNA, 7 bp, Unknown
  misc_feature (1)..( 7): Result.002 file - promoters60/1378297
tatgctt

SEQ ID NO: 106883 - DNA, 8 bp, Unknown
  misc_feature (1)..( 8): Result.002 file - promoters60/1378297
aaaataca

SEQ ID NO: 106884 - DNA, 8 bp, Unknown
  misc_feature (1)..( 8): Result.002 file - promoters60/1378297
aaaataca

SEQ ID NO: 106885 - DNA, 6 bp, Unknown
  misc_feature (1)..( 6): Result.002 file - promoters60/1378297
ttgatc

SEQ ID NO: 106886 - DNA, 6 bp, Unknown
  misc_feature (1)..( 6): Result.002 file - promoters60/1378297
ttgatc

SEQ ID NO: 106887 - DNA, 6 bp, Unknown
  misc_feature (1)..( 6): Result.002 file - promoters60/1378297
cacaga

SEQ ID NO: 106888 - DNA, 6 bp, Unknown
  misc_feature (1)..( 6): Result.002 file - promoters60/1378297
cacaga

SEQ ID NO: 106889 - DNA, 7 bp, Unknown
  misc_feature (1)..( 7): Result.002 file - promoters60/1378297
tacatta

SEQ ID NO: 106890 - DNA, 7 bp, Unknown
  misc_feature (1)..( 7): Result.002 file - promoters60/1378297
tacatta

SEQ ID NO: 106891 - DNA, 10 bp, Unknown
  misc_feature (1)..( 10): Result.002 file - promoters60/1378297
tgatatcatt

SEQ ID NO: 106892 - DNA, 10 bp, Unknown
  misc_feature (1)..( 10): Result.002 file - promoters60/1378297
tgatattatt

SEQ ID NO: 106893 - DNA, 9 bp, Unknown
  misc_feature (1)..( 9): Result.002 file - promoters60/1378297
ataaagaaa

SEQ ID NO: 106894 - DNA, 9 bp, Unknown
  misc_feature (1)..( 9): Result.002 file - promoters60/1378297
ataatgaaa

SEQ ID NO: 106895 - DNA, 7 bp, Unknown
  misc_feature (1)..( 7): Result.002 file - promoters60/1378297
gtggagc

SEQ ID NO: 106896 - DNA, 7 bp, Unknown
  misc_feature (1)..( 7): Result.002 file - promoters60/1378297
gtggagc

SEQ ID NO: 106897 - DNA, 8 bp, Unknown
  misc_feature (1)..( 8): Result.002 file - promoters60/1378297
gcttttgc

SEQ ID NO: 106898 - DNA, 8 bp, Unknown
  misc_feature (1)..( 8): Result.002 file - promoters60/1378297
gcttttgc

SEQ ID NO: 106899 - DNA, 6 bp, Unknown
  misc_feature (1)..( 6): Result.002 file - promoters60/1378333
cgtgga

SEQ ID NO: 106900 - DNA, 6 bp, Unknown
  misc_feature (1)..( 6): Result.002 file - promoters60/1378333
cgtgga

SEQ ID NO: 106901 - DNA, 7 bp, Unknown
  misc_feature (1)..( 7): Result.002 file - promoters60/1378333
gctaaaa

SEQ ID NO: 106902 - DNA, 7 bp, Unknown
  misc_feature (1)..( 7): Result.002 file - promoters60/1378333
gctgaaa

SEQ ID NO: 106903 - DNA, 7 bp, Unknown
  misc_feature (1)..( 7): Result.002 file - promoters60/1378333
tctgaaa

SEQ ID NO: 106904 - DNA, 6 bp, Unknown
  misc_feature (1)..( 6): Result.002 file - promoters60/1378333
attcaa

SEQ ID NO: 106905 - DNA, 6 bp, Unknown
  misc_feature (1)..( 6): Result.002 file - promoters60/1378333
attcaa

SEQ ID NO: 106906 - DNA, 9 bp, Unknown
  misc_feature (1)..( 9): Result.002 file - promoters60/1378333
tttggattt

SEQ ID NO: 106907 - DNA, 9 bp, Unknown
  misc_feature (1)..( 9): Result.002 file - promoters60/1378333
ttttgattt

SEQ ID NO: 106908 - DNA, 8 bp, Unknown
  misc_feature (1)..( 8): Result.002 file - promoters60/1378333
cacaccgt

SEQ ID NO: 106909 - DNA, 8 bp, Unknown
  misc_feature (1)..( 8): Result.002 file - promoters60/1378333
cacatcgt

SEQ ID NO: 106910 - DNA, 7 bp, Unknown
  misc_feature (1)..( 7): Result.002 file - promoters60/1378333
gtggatt

SEQ ID NO: 106911 - DNA, 7 bp, Unknown
  misc_feature (1)..( 7): Result.002 file - promoters60/1378333
gtgaatt

SEQ ID NO: 106912 - DNA, 6 bp, Unknown
  misc_feature (1)..( 6): Result.002 file - promoters60/1378333
ccgttg

SEQ ID NO: 106913 - DNA, 6 bp, Unknown
  misc_feature (1)..( 6): Result.002 file - promoters60/1378333
ccgttg

SEQ ID NO: 106914 - DNA, 6 bp, Unknown
  misc_feature (1)..( 6): Result.002 file - promoters60/1378333
atcgta

SEQ ID NO: 106915 - DNA, 6 bp, Unknown
  misc_feature (1)..( 6): Result.002 file - promoters60/1378333
atcgta

SEQ ID NO: 106916 - DNA, 6 bp, Unknown
  misc_feature (1)..( 6): Result.002 file - promoters60/1378333
agtcga

SEQ ID NO: 106917 - DNA, 6 bp, Unknown
  misc_feature (1)..( 6): Result.002 file - promoters60/1378333
agtcga

SEQ ID NO: 106918 - DNA, 9 bp, Unknown
  misc_feature (1)..( 9): Result.002 file - promoters60/1378333
gtgtcctct

SEQ ID NO: 106919 - DNA, 9 bp, Unknown
  misc_feature (1)..( 9): Result.002 file - promoters60/1378333
gtgtgctct

SEQ ID NO: 106920 - DNA, 6 bp, Unknown
  misc_feature (1)..( 6): Result.002 file - promoters60/1378333
aaccgt

SEQ ID NO: 106921 - DNA, 6 bp, Unknown
  misc_feature (1)..( 6): Result.002 file - promoters60/1378333
aaccgt

SEQ ID NO: 106922 - DNA, 7 bp, Unknown
  misc_feature (1)..( 7): Result.002 file - promoters60/1378333
aatacaa

SEQ ID NO: 106923 - DNA, 7 bp, Unknown
  misc_feature (1)..( 7): Result.002 file - promoters60/1378333
aatgcaa

SEQ ID NO: 106924 - DNA, 7 bp, Unknown
  misc_feature (1)..( 7): Result.002 file - promoters60/1378333
agatagg

SEQ ID NO: 106925 - DNA, 7 bp, Unknown
  misc_feature (1)..( 7): Result.002 file - promoters60/1378333
agaaagg

SEQ ID NO: 106926 - DNA, 7 bp, Unknown
  misc_feature (1)..( 7): Result.002 file - promoters60/1378333
ttgaaga

SEQ ID NO: 106927 - DNA, 7 bp, Unknown
  misc_feature (1)..( 7): Result.002 file - promoters60/1378333
ttgcaga

SEQ ID NO: 106928 - DNA, 7 bp, Unknown
  misc_feature (1)..( 7): Result.002 file - promoters60/1378333
cgtggat

SEQ ID NO: 106929 - DNA, 7 bp, Unknown
  misc_feature (1)..( 7): Result.002 file - promoters60/1378333
cgtggat

SEQ ID NO: 106930 - DNA, 7 bp, Unknown
  misc_feature (1)..( 7): Result.002 file - promoters60/1378333
catcgag

SEQ ID NO: 106931 - DNA, 7 bp, Unknown
  misc_feature (1)..( 7): Result.002 file - promoters60/1378333
cattgag

SEQ ID NO: 106932 - DNA, 6 bp, Unknown
  misc_feature (1)..( 6): Result.002 file - promoters60/1378333
atcgga

SEQ ID NO: 106933 - DNA, 6 bp, Unknown
  misc_feature (1)..( 6): Result.002 file - promoters60/1378333
atcgga

SEQ ID NO: 106934 - DNA, 8 bp, Unknown
  misc_feature (1)..( 8): Result.002 file - promoters60/1378333
gtaagttt

SEQ ID NO: 106935 - DNA, 8 bp, Unknown
  misc_feature (1)..( 8): Result.002 file - promoters60/1378333
gtacgttt

SEQ ID NO: 106936 - DNA, 7 bp, Unknown
  misc_feature (1)..( 7): Result.002 file - promoters60/1378333
ctacaca

SEQ ID NO: 106937 - DNA, 7 bp, Unknown
  misc_feature (1)..( 7): Result.002 file - promoters60/1378333
ctaaaca

SEQ ID NO: 106938 - DNA, 14 bp, Unknown
  misc_feature (1)..( 14): Result.002 file - promoters60/1378393
gaaaatctcataat

SEQ ID NO: 106939 - DNA, 14 bp, Unknown
  misc_feature (1)..( 14): Result.002 file - promoters60/1378393
gataatatcagaat

SEQ ID NO: 106940 - DNA, 14 bp, Unknown
  misc_feature (1)..( 14): Result.002 file - promoters60/1378393
ataaatctggaatc

SEQ ID NO: 106941 - DNA, 14 bp, Unknown
  misc_feature (1)..( 14): Result.002 file - promoters60/1378393
taaaatcaaccaat

SEQ ID NO: 106942 - DNA, 14 bp, Unknown
  misc_feature (1)..( 14): Result.002 file - promoters60/1378393
cagaataacataat

SEQ ID NO: 106943 - DNA, 14 bp, Unknown
  misc_feature (1)..( 14): Result.002 file - promoters60/1378393
tgatgtatcagtag

SEQ ID NO: 106944 - DNA, 15 bp, Unknown
  misc_feature (1)..( 15): Result.002 file - promoters60/1378400
cccatagctccttaa

SEQ ID NO: 106945 - DNA, 15 bp, Unknown
  misc_feature (1)..( 15): Result.002 file - promoters60/1378400
cccatagctccttaa

SEQ ID NO: 106946 - DNA, 7 bp, Unknown
  misc_feature (1)..( 7): Result.002 file - promoters60/1378400
tttggtt

SEQ ID NO: 106947 - DNA, 7 bp, Unknown
  misc_feature (1)..( 7): Result.002 file - promoters60/1378400
tttggtt

SEQ ID NO: 106948 - DNA, 8 bp, Unknown
  misc_feature (1)..( 8): Result.002 file - promoters60/1378400
gaaaagaa

SEQ ID NO: 106949 - DNA, 8 bp, Unknown
  misc_feature (1)..( 8): Result.002 file - promoters60/1378400
gaagagaa

SEQ ID NO: 106950 - DNA, 8 bp, Unknown
  misc_feature (1)..( 8): Result.002 file - promoters60/1378400
gaagagaa

SEQ ID NO: 106951 - DNA, 14 bp, Unknown
  misc_feature (1)..( 14): Result.002 file - promoters60/1378400
atagcttaccttta

SEQ ID NO: 106952 - DNA, 14 bp, Unknown
  misc_feature (1)..( 14): Result.002 file - promoters60/1378400
ttagcttcagcttc

SEQ ID NO: 106953 - DNA, 14 bp, Unknown
  misc_feature (1)..( 14): Result.002 file - promoters60/1378400
ttagcttcagcttc

SEQ ID NO: 106954 - DNA, 14 bp, Unknown
  misc_feature (1)..( 14): Result.002 file - promoters60/1378400
agagagagagagag

SEQ ID NO: 106955 - DNA, 14 bp, Unknown
  misc_feature (1)..( 14): Result.002 file - promoters60/1378400
agagagagagagag

SEQ ID NO: 106956 - DNA, 14 bp, Unknown
  misc_feature (1)..( 14): Result.002 file - promoters60/1378400
agagagagaggtga

SEQ ID NO: 106957 - DNA, 7 bp, Unknown
  misc_feature (1)..( 7): Result.002 file - promoters60/1378400
agagaag

SEQ ID NO: 106958 - DNA, 7 bp, Unknown
  misc_feature (1)..( 7): Result.002 file - promoters60/1378400
agagaag

SEQ ID NO: 106959 - DNA, 7 bp, Unknown
  misc_feature (1)..( 7): Result.002 file - promoters60/1378400
ggatcaa

SEQ ID NO: 106960 - DNA, 7 bp, Unknown
  misc_feature (1)..( 7): Result.002 file - promoters60/1378400
ggatcaa

SEQ ID NO: 106961 - DNA, 11 bp, Unknown
  misc_feature (1)..( 11): Result.002 file - promoters60/1378400
attcagggttt

SEQ ID NO: 106962 - DNA, 11 bp, Unknown
  misc_feature (1)..( 11): Result.002 file - promoters60/1378400
attcaggtttt

SEQ ID NO: 106963 - DNA, 8 bp, Unknown
  misc_feature (1)..( 8): Result.002 file - promoters60/1378400
aaacgatt

SEQ ID NO: 106964 - DNA, 8 bp, Unknown
  misc_feature (1)..( 8): Result.002 file - promoters60/1378400
aaacaatt

SEQ ID NO: 106965 - DNA, 7 bp, Unknown
  misc_feature (1)..( 7): Result.002 file - promoters60/1378400
aacgcga

SEQ ID NO: 106966 - DNA, 7 bp, Unknown
  misc_feature (1)..( 7): Result.002 file - promoters60/1378400
aacgcga

SEQ ID NO: 106967 - DNA, 8 bp, Unknown
  misc_feature (1)..( 8): Result.002 file - promoters60/1378400
aaagagaa

SEQ ID NO: 106968 - DNA, 8 bp, Unknown
  misc_feature (1)..( 8): Result.002 file - promoters60/1378400
aaagagaa

SEQ ID NO: 106969 - DNA, 8 bp, Unknown
  misc_feature (1)..( 8): Result.002 file - promoters60/1378400
aacgcgaa

SEQ ID NO: 106970 - DNA, 8 bp, Unknown
  misc_feature (1)..( 8): Result.002 file - promoters60/1378400
aacgtgaa

SEQ ID NO: 106971 - DNA, 6 bp, Unknown
  misc_feature (1)..( 6): Result.002 file - promoters60/1378400
ttatat

SEQ ID NO: 106972 - DNA, 6 bp, Unknown
  misc_feature (1)..( 6): Result.002 file - promoters60/1378400
ttatat

SEQ ID NO: 106973 - DNA, 7 bp, Unknown
  misc_feature (1)..( 7): Result.002 file - promoters60/1378400
tttggtt

SEQ ID NO: 106974 - DNA, 7 bp, Unknown
  misc_feature (1)..( 7): Result.002 file - promoters60/1378400
tttggtt

SEQ ID NO: 106975 - DNA, 6 bp, Unknown
  misc_feature (1)..( 6): Result.002 file - promoters60/1378400
tagctt

SEQ ID NO: 106976 - DNA, 6 bp, Unknown
  misc_feature (1)..( 6): Result.002 file - promoters60/1378400
tagctt

SEQ ID NO: 106977 - DNA, 7 bp, Unknown
  misc_feature (1)..( 7): Result.002 file - promoters60/1378400
aacgcga

SEQ ID NO: 106978 - DNA, 7 bp, Unknown
  misc_feature (1)..( 7): Result.002 file - promoters60/1378400
aacgcga

SEQ ID NO: 106979 - DNA, 7 bp, Unknown
  misc_feature (1)..( 7): Result.002 file - promoters60/1378458
gcttctc

SEQ ID NO: 106980 - DNA, 7 bp, Unknown
  misc_feature (1)..( 7): Result.002 file - promoters60/1378458
gcttctc

SEQ ID NO: 106981 - DNA, 8 bp, Unknown
  misc_feature (1)..( 8): Result.002 file - promoters60/1378458
gaagcaaa

SEQ ID NO: 106982 - DNA, 8 bp, Unknown
  misc_feature (1)..( 8): Result.002 file - promoters60/1378458
aaagaaaa

SEQ ID NO: 106983 - DNA, 8 bp, Unknown
  misc_feature (1)..( 8): Result.002 file - promoters60/1378458
aaagaata

SEQ ID NO: 106984 - DNA, 9 bp, Unknown
  misc_feature (1)..( 9): Result.002 file - promoters60/1378458
aaccaatcc

SEQ ID NO: 106985 - DNA, 9 bp, Unknown
  misc_feature (1)..( 9): Result.002 file - promoters60/1378458
aaccactcc

SEQ ID NO: 106986 - DNA, 6 bp, Unknown
  misc_feature (1)..( 6): Result.002 file - promoters60/1378458
tgtcaa

SEQ ID NO: 106987 - DNA, 6 bp, Unknown
  misc_feature (1)..( 6): Result.002 file - promoters60/1378458
tgtcaa

SEQ ID NO: 106988 - DNA, 10 bp, Unknown
  misc_feature (1)..( 10): Result.002 file - promoters60/1378458
ttcttgatta

SEQ ID NO: 106989 - DNA, 10 bp, Unknown
  misc_feature (1)..( 10): Result.002 file - promoters60/1378458
ttcttcatta

SEQ ID NO: 106990 - DNA, 8 bp, Unknown
  misc_feature (1)..( 8): Result.002 file - promoters60/1378458
gatgggaa

SEQ ID NO: 106991 - DNA, 8 bp, Unknown
  misc_feature (1)..( 8): Result.002 file - promoters60/1378458
gatgtgaa

SEQ ID NO: 106992 - DNA, 7 bp, Unknown
  misc_feature (1)..( 7): Result.002 file - promoters60/1378458
tctgcag

SEQ ID NO: 106993 - DNA, 7 bp, Unknown
  misc_feature (1)..( 7): Result.002 file - promoters60/1378458
tcttcag

SEQ ID NO: 106994 - DNA, 7 bp, Unknown
  misc_feature (1)..( 7): Result.002 file - promoters60/1378458
gtcctat

SEQ ID NO: 106995 - DNA, 7 bp, Unknown
  misc_feature (1)..( 7): Result.002 file - promoters60/1378458
gtcttat

SEQ ID NO: 106996 - DNA, 7 bp, Unknown
  misc_feature (1)..( 7): Result.002 file - promoters60/1378458
tggtggg

SEQ ID NO: 106997 - DNA, 7 bp, Unknown
  misc_feature (1)..( 7): Result.002 file - promoters60/1378458
tggtggg

SEQ ID NO: 106998 - DNA, 7 bp, Unknown
  misc_feature (1)..( 7): Result.002 file - promoters60/1378458
gaagttg

SEQ ID NO: 106999 - DNA, 7 bp, Unknown
  misc_feature (1)..( 7): Result.002 file - promoters60/1378458
gaagttg

SEQ ID NO: 107000 - DNA, 8 bp, Unknown
  misc_feature (1)..( 8): Result.002 file - promoters60/1378458
tttagctt

SEQ ID NO: 107001 - DNA, 8 bp, Unknown
  misc_feature (1)..( 8): Result.002 file - promoters60/1378458
tttatctt

SEQ ID NO: 107002 - DNA, 6 bp, Unknown
  misc_feature (1)..( 6): Result.002 file - promoters60/1378458
gaatta

SEQ ID NO: 107003 - DNA, 6 bp, Unknown
  misc_feature (1)..( 6): Result.002 file - promoters60/1378458
gaatta

SEQ ID NO: 107004 - DNA, 6 bp, Unknown
  misc_feature (1)..( 6): Result.002 file - promoters60/1378458
gcggaa

SEQ ID NO: 107005 - DNA, 6 bp, Unknown
  misc_feature (1)..( 6): Result.002 file - promoters60/1378458
gcggaa

SEQ ID NO: 107006 - DNA, 7 bp, Unknown
  misc_feature (1)..( 7): Result.002 file - promoters60/1378458
tattttc

SEQ ID NO: 107007 - DNA, 7 bp, Unknown
  misc_feature (1)..( 7): Result.002 file - promoters60/1378458
tatcttc

SEQ ID NO: 107008 - DNA, 6 bp, Unknown
  misc_feature (1)..( 6): Result.002 file - promoters60/1378458
tccttg

SEQ ID NO: 107009 - DNA, 6 bp, Unknown
  misc_feature (1)..( 6): Result.002 file - promoters60/1378458
tccttg

SEQ ID NO: 107010 - DNA, 7 bp, Unknown
  misc_feature (1)..( 7): Result.002 file - promoters60/1378458
gatatat

SEQ ID NO: 107011 - DNA, 7 bp, Unknown
  misc_feature (1)..( 7): Result.002 file - promoters60/1378458
gatgtat

SEQ ID NO: 107012 - DNA, 10 bp, Unknown
  misc_feature (1)..( 10): Result.002 file - promoters60/1378528
agtttttgaa

SEQ ID NO: 107013 - DNA, 10 bp, Unknown
  misc_feature (1)..( 10): Result.002 file - promoters60/1378528
taattttgaa

SEQ ID NO: 107014 - DNA, 10 bp, Unknown
  misc_feature (1)..( 10): Result.002 file - promoters60/1378528
taatattggt

SEQ ID NO: 107015 - DNA, 7 bp, Unknown
  misc_feature (1)..( 7): Result.002 file - promoters60/1378528
aaagaaa

SEQ ID NO: 107016 - DNA, 7 bp, Unknown
  misc_feature (1)..( 7): Result.002 file - promoters60/1378528
aaaaaaa

SEQ ID NO: 107017 - DNA, 7 bp, Unknown
  misc_feature (1)..( 7): Result.002 file - promoters60/1378528
aaataat

SEQ ID NO: 107018 - DNA, 9 bp, Unknown
  misc_feature (1)..( 9): Result.002 file - promoters60/1378528
gtgatttag

SEQ ID NO: 107019 - DNA, 9 bp, Unknown
  misc_feature (1)..( 9): Result.002 file - promoters60/1378528
agtatttag

SEQ ID NO: 107020 - DNA, 9 bp, Unknown
  misc_feature (1)..( 9): Result.002 file - promoters60/1378528
agtttttac

SEQ ID NO: 107021 - DNA, 7 bp, Unknown
  misc_feature (1)..( 7): Result.002 file - promoters60/1378528
aatacaa

SEQ ID NO: 107022 - DNA, 7 bp, Unknown
  misc_feature (1)..( 7): Result.002 file - promoters60/1378528
tatacaa

SEQ ID NO: 107023 - DNA, 7 bp, Unknown
  misc_feature (1)..( 7): Result.002 file - promoters60/1378528
tattcaa

SEQ ID NO: 107024 - DNA, 11 bp, Unknown
  misc_feature (1)..( 11): Result.002 file - promoters60/1378528
ccaaaattgat

SEQ ID NO: 107025 - DNA, 11 bp, Unknown
  misc_feature (1)..( 11): Result.002 file - promoters60/1378528
ccaaaataaaa

SEQ ID NO: 107026 - DNA, 11 bp, Unknown
  misc_feature (1)..( 11): Result.002 file - promoters60/1378528
ctaaaaaaaaa

SEQ ID NO: 107027 - DNA, 9 bp, Unknown
  misc_feature (1)..( 9): Result.002 file - promoters60/1378528
atataatat

SEQ ID NO: 107028 - DNA, 9 bp, Unknown
  misc_feature (1)..( 9): Result.002 file - promoters60/1378528
ataaaataa

SEQ ID NO: 107029 - DNA, 9 bp, Unknown
  misc_feature (1)..( 9): Result.002 file - promoters60/1378528
atacaataa

SEQ ID NO: 107030 - DNA, 9 bp, Unknown
  misc_feature (1)..( 9): Result.002 file - promoters60/1378528
aaaaaaaaa

SEQ ID NO: 107031 - DNA, 9 bp, Unknown
  misc_feature (1)..( 9): Result.002 file - promoters60/1378528
tttgtaatt

SEQ ID NO: 107032 - DNA, 9 bp, Unknown
  misc_feature (1)..( 9): Result.002 file - promoters60/1378528
tttttaatt

SEQ ID NO: 107033 - DNA, 9 bp, Unknown
  misc_feature (1)..( 9): Result.002 file - promoters60/1378528
gttttaagg

SEQ ID NO: 107034 - DNA, 11 bp, Unknown
  misc_feature (1)..( 11): Result.002 file - promoters60/1378528
ttttaaagatt

SEQ ID NO: 107035 - DNA, 11 bp, Unknown
  misc_feature (1)..( 11): Result.002 file - promoters60/1378528
tttaaaacatt

SEQ ID NO: 107036 - DNA, 11 bp, Unknown
  misc_feature (1)..( 11): Result.002 file - promoters60/1378528
aagaaatcata

SEQ ID NO: 107037 - DNA, 6 bp, Unknown
  misc_feature (1)..( 6): Result.002 file - promoters60/1378528
ttttct

SEQ ID NO: 107038 - DNA, 6 bp, Unknown
  misc_feature (1)..( 6): Result.002 file - promoters60/1378528
ttttct

SEQ ID NO: 107039 - DNA, 6 bp, Unknown
  misc_feature (1)..( 6): Result.002 file - promoters60/1378528
ttttct

SEQ ID NO: 107040 - DNA, 7 bp, Unknown
  misc_feature (1)..( 7): Result.002 file - promoters60/1378622
tttttta

SEQ ID NO: 107041 - DNA, 7 bp, Unknown
  misc_feature (1)..( 7): Result.002 file - promoters60/1378622
tttatta

SEQ ID NO: 107042 - DNA, 8 bp, Unknown
  misc_feature (1)..( 8): Result.002 file - promoters60/1378622
tttatcta

SEQ ID NO: 107043 - DNA, 8 bp, Unknown
  misc_feature (1)..( 8): Result.002 file - promoters60/1378622
tttttcta

SEQ ID NO: 107044 - DNA, 6 bp, Unknown
  misc_feature (1)..( 6): Result.002 file - promoters60/1378622
attttt

SEQ ID NO: 107045 - DNA, 6 bp, Unknown
  misc_feature (1)..( 6): Result.002 file - promoters60/1378622
attttt

SEQ ID NO: 107046 - DNA, 8 bp, Unknown
  misc_feature (1)..( 8): Result.002 file - promoters60/1378622
aaagattt

SEQ ID NO: 107047 - DNA, 8 bp, Unknown
  misc_feature (1)..( 8): Result.002 file - promoters60/1378622
aaagattt

SEQ ID NO: 107048 - DNA, 8 bp, Unknown
  misc_feature (1)..( 8): Result.002 file - promoters60/1378622
taagattg

SEQ ID NO: 107049 - DNA, 8 bp, Unknown
  misc_feature (1)..( 8): Result.002 file - promoters60/1378622
ggtatttg

SEQ ID NO: 107050 - DNA, 8 bp, Unknown
  misc_feature (1)..( 8): Result.002 file - promoters60/1378622
ggtgtttg

SEQ ID NO: 107051 - DNA, 6 bp, Unknown
  misc_feature (1)..( 6): Result.002 file - promoters60/1378622
atgaat

SEQ ID NO: 107052 - DNA, 6 bp, Unknown
  misc_feature (1)..( 6): Result.002 file - promoters60/1378622
atgaat

SEQ ID NO: 107053 - DNA, 7 bp, Unknown
  misc_feature (1)..( 7): Result.002 file - promoters60/1378622
ttacaat

SEQ ID NO: 107054 - DNA, 7 bp, Unknown
  misc_feature (1)..( 7): Result.002 file - promoters60/1378622
ttataat

SEQ ID NO: 107055 - DNA, 9 bp, Unknown
  misc_feature (1)..( 9): Result.002 file - promoters60/1378622
aattataaa

SEQ ID NO: 107056 - DNA, 9 bp, Unknown
  misc_feature (1)..( 9): Result.002 file - promoters60/1378622
aattttaac

SEQ ID NO: 107057 - DNA, 9 bp, Unknown
  misc_feature (1)..( 9): Result.002 file - promoters60/1378622
cctttgacc

SEQ ID NO: 107058 - DNA, 14 bp, Unknown
  misc_feature (1)..( 14): Result.002 file - promoters60/1378622
aatttctcccaaaa

SEQ ID NO: 107059 - DNA, 14 bp, Unknown
  misc_feature (1)..( 14): Result.002 file - promoters60/1378622
aatttctgccaaaa

SEQ ID NO: 107060 - DNA, 14 bp, Unknown
  misc_feature (1)..( 14): Result.002 file - promoters60/1378622
tatttctcttatcc

SEQ ID NO: 107061 - DNA, 8 bp, Unknown
  misc_feature (1)..( 8): Result.002 file - promoters60/1378622
ataaactt

SEQ ID NO: 107062 - DNA, 8 bp, Unknown
  misc_feature (1)..( 8): Result.002 file - promoters60/1378622
ttaacctt

SEQ ID NO: 107063 - DNA, 8 bp, Unknown
  misc_feature (1)..( 8): Result.002 file - promoters60/1378622
ttaaccct

SEQ ID NO: 107064 - DNA, 13 bp, Unknown
  misc_feature (1)..( 13): Result.002 file - promoters60/1378622
ttgaatcaatatt

SEQ ID NO: 107065 - DNA, 13 bp, Unknown
  misc_feature (1)..( 13): Result.002 file - promoters60/1378622
ttgattcaaaatt

SEQ ID NO: 107066 - DNA, 7 bp, Unknown
  misc_feature (1)..( 7): Result.002 file - promoters60/1378622
tggattt

SEQ ID NO: 107067 - DNA, 7 bp, Unknown
  misc_feature (1)..( 7): Result.002 file - promoters60/1378622
tggattt

SEQ ID NO: 107068 - DNA, 6 bp, Unknown
  misc_feature (1)..( 6): Result.002 file - promoters60/1378622
ttggtt

SEQ ID NO: 107069 - DNA, 6 bp, Unknown
  misc_feature (1)..( 6): Result.002 file - promoters60/1378622
ttggtt

SEQ ID NO: 107070 - DNA, 7 bp, Unknown
  misc_feature (1)..( 7): Result.002 file - promoters60/1378622
ctcactc

SEQ ID NO: 107071 - DNA, 7 bp, Unknown
  misc_feature (1)..( 7): Result.002 file - promoters60/1378622
ctcgctc

SEQ ID NO: 107072 - DNA, 10 bp, Unknown
  misc_feature (1)..( 10): Result.002 file - promoters60/1378692
atttataaac

SEQ ID NO: 107073 - DNA, 10 bp, Unknown
  misc_feature (1)..( 10): Result.002 file - promoters60/1378692
atttataagt

SEQ ID NO: 107074 - DNA, 10 bp, Unknown
  misc_feature (1)..( 10): Result.002 file - promoters60/1378692
gattataaac

SEQ ID NO: 107075 - DNA, 10 bp, Unknown
  misc_feature (1)..( 10): Result.002 file - promoters60/1378692
atttatatta

SEQ ID NO: 107076 - DNA, 8 bp, Unknown
  misc_feature (1)..( 8): Result.002 file - promoters60/1378692
aataatta

SEQ ID NO: 107077 - DNA, 8 bp, Unknown
  misc_feature (1)..( 8): Result.002 file - promoters60/1378692
aatattta

SEQ ID NO: 107078 - DNA, 8 bp, Unknown
  misc_feature (1)..( 8): Result.002 file - promoters60/1378692
aatttttt

SEQ ID NO: 107079 - DNA, 8 bp, Unknown
  misc_feature (1)..( 8): Result.002 file - promoters60/1378692
gatatttt

SEQ ID NO: 107080 - DNA, 12 bp, Unknown
  misc_feature (1)..( 12): Result.002 file - promoters60/1378692
cgctatttctct

SEQ ID NO: 107081 - DNA, 12 bp, Unknown
  misc_feature (1)..( 12): Result.002 file - promoters60/1378692
ttctatttgtct

SEQ ID NO: 107082 - DNA, 12 bp, Unknown
  misc_feature (1)..( 12): Result.002 file - promoters60/1378692
cgctattcctga

SEQ ID NO: 107083 - DNA, 12 bp, Unknown
  misc_feature (1)..( 12): Result.002 file - promoters60/1378692
taaattttgtca

SEQ ID NO: 107084 - DNA, 10 bp, Unknown
  misc_feature (1)..( 10): Result.002 file - promoters60/1378692
gatttataat

SEQ ID NO: 107085 - DNA, 10 bp, Unknown
  misc_feature (1)..( 10): Result.002 file - promoters60/1378692
gatttctaat

SEQ ID NO: 107086 - DNA, 10 bp, Unknown
  misc_feature (1)..( 10): Result.002 file - promoters60/1378692
attttataat

SEQ ID NO: 107087 - DNA, 11 bp, Unknown
  misc_feature (1)..( 11): Result.002 file - promoters60/1378692
actttcataaa

SEQ ID NO: 107088 - DNA, 9 bp, Unknown
  misc_feature (1)..( 9): Result.002 file - promoters60/1378692
tccacaatg

SEQ ID NO: 107089 - DNA, 9 bp, Unknown
  misc_feature (1)..( 9): Result.002 file - promoters60/1378692
aatacaatg

SEQ ID NO: 107090 - DNA, 9 bp, Unknown
  misc_feature (1)..( 9): Result.002 file - promoters60/1378692
tatataatt

SEQ ID NO: 107091 - DNA, 9 bp, Unknown
  misc_feature (1)..( 9): Result.002 file - promoters60/1378692
tttacaata

SEQ ID NO: 107092 - DNA, 9 bp, Unknown
  misc_feature (1)..( 9): Result.002 file - promoters60/1378692
tatataaag

SEQ ID NO: 107093 - DNA, 8 bp, Unknown
  misc_feature (1)..( 8): Result.002 file - promoters60/1378692
aacaatca

SEQ ID NO: 107094 - DNA, 8 bp, Unknown
  misc_feature (1)..( 8): Result.002 file - promoters60/1378692
tacaatcc

SEQ ID NO: 107095 - DNA, 8 bp, Unknown
  misc_feature (1)..( 8): Result.002 file - promoters60/1378692
accaatca

SEQ ID NO: 107096 - DNA, 8 bp, Unknown
  misc_feature (1)..( 8): Result.002 file - promoters60/1378692
aataatag

SEQ ID NO: 107097 - DNA, 9 bp, Unknown
  misc_feature (1)..( 9): Result.002 file - promoters60/1378692
tattatccg

SEQ ID NO: 107098 - DNA, 9 bp, Unknown
  misc_feature (1)..( 9): Result.002 file - promoters60/1378692
tattatcat

SEQ ID NO: 107099 - DNA, 9 bp, Unknown
  misc_feature (1)..( 9): Result.002 file - promoters60/1378692
tattataaa

SEQ ID NO: 107100 - DNA, 9 bp, Unknown
  misc_feature (1)..( 9): Result.002 file - promoters60/1378692
gattataaa

SEQ ID NO: 107101 - DNA, 9 bp, Unknown
  misc_feature (1)..( 9): Result.002 file - promoters60/1378692
ggtattatt

SEQ ID NO: 107102 - DNA, 9 bp, Unknown
  misc_feature (1)..( 9): Result.002 file - promoters60/1378692
gatattatt

SEQ ID NO: 107103 - DNA, 9 bp, Unknown
  misc_feature (1)..( 9): Result.002 file - promoters60/1378692
gatcttaag

SEQ ID NO: 107104 - DNA, 9 bp, Unknown
  misc_feature (1)..( 9): Result.002 file - promoters60/1378692
catattacc

SEQ ID NO: 107105 - DNA, 6 bp, Unknown
  misc_feature (1)..( 6): Result.002 file - promoters60/1378800
gttttt

SEQ ID NO: 107106 - DNA, 6 bp, Unknown
  misc_feature (1)..( 6): Result.002 file - promoters60/1378800
gttttt

SEQ ID NO: 107107 - DNA, 6 bp, Unknown
  misc_feature (1)..( 6): Result.002 file - promoters60/1378800
gttttt

SEQ ID NO: 107108 - DNA, 8 bp, Unknown
  misc_feature (1)..( 8): Result.002 file - promoters60/1378800
gtttcttt

SEQ ID NO: 107109 - DNA, 8 bp, Unknown
  misc_feature (1)..( 8): Result.002 file - promoters60/1378800
ttttcttt

SEQ ID NO: 107110 - DNA, 8 bp, Unknown
  misc_feature (1)..( 8): Result.002 file - promoters60/1378800
gttttttt

SEQ ID NO: 107111 - DNA, 7 bp, Unknown
  misc_feature (1)..( 7): Result.002 file - promoters60/1378800
tttcttt

SEQ ID NO: 107112 - DNA, 7 bp, Unknown
  misc_feature (1)..( 7): Result.002 file - promoters60/1378800
tttctta

SEQ ID NO: 107113 - DNA, 7 bp, Unknown
  misc_feature (1)..( 7): Result.002 file - promoters60/1378800
ttttttt

SEQ ID NO: 107114 - DNA, 8 bp, Unknown
  misc_feature (1)..( 8): Result.002 file - promoters60/1378800
atttttta

SEQ ID NO: 107115 - DNA, 8 bp, Unknown
  misc_feature (1)..( 8): Result.002 file - promoters60/1378800
atttttct

SEQ ID NO: 107116 - DNA, 8 bp, Unknown
  misc_feature (1)..( 8): Result.002 file - promoters60/1378800
ttttttta

SEQ ID NO: 107117 - DNA, 9 bp, Unknown
  misc_feature (1)..( 9): Result.002 file - promoters60/1378800
ttttttaaa

SEQ ID NO: 107118 - DNA, 9 bp, Unknown
  misc_feature (1)..( 9): Result.002 file - promoters60/1378800
attttcaaa

SEQ ID NO: 107119 - DNA, 9 bp, Unknown
  misc_feature (1)..( 9): Result.002 file - promoters60/1378800
ttttttaca

SEQ ID NO: 107120 - DNA, 8 bp, Unknown
  misc_feature (1)..( 8): Result.002 file - promoters60/1378800
tttaaaaa

SEQ ID NO: 107121 - DNA, 8 bp, Unknown
  misc_feature (1)..( 8): Result.002 file - promoters60/1378800
cataaaaa

SEQ ID NO: 107122 - DNA, 8 bp, Unknown
  misc_feature (1)..( 8): Result.002 file - promoters60/1378800
catataaa

SEQ ID NO: 107123 - DNA, 6 bp, Unknown
  misc_feature (1)..( 6): Result.002 file - promoters60/1378880
tgaata

SEQ ID NO: 107124 - DNA, 6 bp, Unknown
  misc_feature (1)..( 6): Result.002 file - promoters60/1378880
tgaata

SEQ ID NO: 107125 - DNA, 6 bp, Unknown
  misc_feature (1)..( 6): Result.002 file - promoters60/1378880
tgaata

SEQ ID NO: 107126 - DNA, 7 bp, Unknown
  misc_feature (1)..( 7): Result.002 file - promoters60/1378880
aaagaaa

SEQ ID NO: 107127 - DNA, 7 bp, Unknown
  misc_feature (1)..( 7): Result.002 file - promoters60/1378880
gaagaaa

SEQ ID NO: 107128 - DNA, 7 bp, Unknown
  misc_feature (1)..( 7): Result.002 file - promoters60/1378880
aaataaa

SEQ ID NO: 107129 - DNA, 7 bp, Unknown
  misc_feature (1)..( 7): Result.002 file - promoters60/1378880
aaaatat

SEQ ID NO: 107130 - DNA, 7 bp, Unknown
  misc_feature (1)..( 7): Result.002 file - promoters60/1378880
aaactat

SEQ ID NO: 107131 - DNA, 6 bp, Unknown
  misc_feature (1)..( 6): Result.002 file - promoters60/1378880
tcacaa

SEQ ID NO: 107132 - DNA, 6 bp, Unknown
  misc_feature (1)..( 6): Result.002 file - promoters60/1378880
tcacaa

SEQ ID NO: 107133 - DNA, 6 bp, Unknown
  misc_feature (1)..( 6): Result.002 file - promoters60/1378880
tcacaa

SEQ ID NO: 107134 - DNA, 7 bp, Unknown
  misc_feature (1)..( 7): Result.002 file - promoters60/1378880
atctaac

SEQ ID NO: 107135 - DNA, 7 bp, Unknown
  misc_feature (1)..( 7): Result.002 file - promoters60/1378880
atctaac

SEQ ID NO: 107136 - DNA, 15 bp, Unknown
  misc_feature (1)..( 15): Result.002 file - promoters60/1378880
gcttatgatgtgtcg

SEQ ID NO: 107137 - DNA, 15 bp, Unknown
  misc_feature (1)..( 15): Result.002 file - promoters60/1378880
gcttatgatgtgtcg

SEQ ID NO: 107138 - DNA, 7 bp, Unknown
  misc_feature (1)..( 7): Result.002 file - promoters60/1378880
atacaaa

SEQ ID NO: 107139 - DNA, 7 bp, Unknown
  misc_feature (1)..( 7): Result.002 file - promoters60/1378880
atataaa

SEQ ID NO: 107140 - DNA, 7 bp, Unknown
  misc_feature (1)..( 7): Result.002 file - promoters60/1378880
atatata

SEQ ID NO: 107141 - DNA, 7 bp, Unknown
  misc_feature (1)..( 7): Result.002 file - promoters60/1378880
atatata

SEQ ID NO: 107142 - DNA, 7 bp, Unknown
  misc_feature (1)..( 7): Result.002 file - promoters60/1378880
aaaatat

SEQ ID NO: 107143 - DNA, 7 bp, Unknown
  misc_feature (1)..( 7): Result.002 file - promoters60/1378880
aaaatat

SEQ ID NO: 107144 - DNA, 7 bp, Unknown
  misc_feature (1)..( 7): Result.002 file - promoters60/1378880
aaacaaa

SEQ ID NO: 107145 - DNA, 7 bp, Unknown
  misc_feature (1)..( 7): Result.002 file - promoters60/1378880
aaagaaa

SEQ ID NO: 107146 - DNA, 8 bp, Unknown
  misc_feature (1)..( 8): Result.002 file - promoters60/1378880
ctaaattc

SEQ ID NO: 107147 - DNA, 8 bp, Unknown
  misc_feature (1)..( 8): Result.002 file - promoters60/1378880
ctaatttc

SEQ ID NO: 107148 - DNA, 8 bp, Unknown
  misc_feature (1)..( 8): Result.002 file - promoters60/1378880
ttaatttt

SEQ ID NO: 107149 - DNA, 6 bp, Unknown
  misc_feature (1)..( 6): Result.002 file - promoters60/1378880
gattct

SEQ ID NO: 107150 - DNA, 6 bp, Unknown
  misc_feature (1)..( 6): Result.002 file - promoters60/1378880
gattct

SEQ ID NO: 107151 - DNA, 7 bp, Unknown
  misc_feature (1)..( 7): Result.002 file - promoters60/1378880
cacctgt

SEQ ID NO: 107152 - DNA, 7 bp, Unknown
  misc_feature (1)..( 7): Result.002 file - promoters60/1378880
cacgtgt

SEQ ID NO: 107153 - DNA, 9 bp, Unknown
  misc_feature (1)..( 9): Result.002 file - promoters60/1378880
ttcaccata

SEQ ID NO: 107154 - DNA, 9 bp, Unknown
  misc_feature (1)..( 9): Result.002 file - promoters60/1378880
ttcacaata

SEQ ID NO: 107155 - DNA, 6 bp, Unknown
  misc_feature (1)..( 6): Result.002 file - promoters60/1378880
gcaaag

SEQ ID NO: 107156 - DNA, 6 bp, Unknown
  misc_feature (1)..( 6): Result.002 file - promoters60/1378880
gcaaag

SEQ ID NO: 107157 - DNA, 6 bp, Unknown
  misc_feature (1)..( 6): Result.002 file - promoters60/1378880
gtaacg

SEQ ID NO: 107158 - DNA, 6 bp, Unknown
  misc_feature (1)..( 6): Result.002 file - promoters60/1378880
gtaacg

SEQ ID NO: 107159 - DNA, 6 bp, Unknown
  misc_feature (1)..( 6): Result.002 file - promoters60/1378888
cttttg

SEQ ID NO: 107160 - DNA, 6 bp, Unknown
  misc_feature (1)..( 6): Result.002 file - promoters60/1378888
cttttg

SEQ ID NO: 107161 - DNA, 6 bp, Unknown
  misc_feature (1)..( 6): Result.002 file - promoters60/1378888
atctct

SEQ ID NO: 107162 - DNA, 6 bp, Unknown
  misc_feature (1)..( 6): Result.002 file - promoters60/1378888
atctct

SEQ ID NO: 107163 - DNA, 11 bp, Unknown
  misc_feature (1)..( 11): Result.002 file - promoters60/1378888
caagtatctga

SEQ ID NO: 107164 - DNA, 11 bp, Unknown
  misc_feature (1)..( 11): Result.002 file - promoters60/1378888
aaagtttctga

SEQ ID NO: 107165 - DNA, 11 bp, Unknown
  misc_feature (1)..( 11): Result.002 file - promoters60/1378888
caattattttc

SEQ ID NO: 107166 - DNA, 6 bp, Unknown
  misc_feature (1)..( 6): Result.002 file - promoters60/1378888
tttcat

SEQ ID NO: 107167 - DNA, 6 bp, Unknown
  misc_feature (1)..( 6): Result.002 file - promoters60/1378888
tttcat

SEQ ID NO: 107168 - DNA, 6 bp, Unknown
  misc_feature (1)..( 6): Result.002 file - promoters60/1378888
gaaatt

SEQ ID NO: 107169 - DNA, 6 bp, Unknown
  misc_feature (1)..( 6): Result.002 file - promoters60/1378888
gaaatt

SEQ ID NO: 107170 - DNA, 7 bp, Unknown
  misc_feature (1)..( 7): Result.002 file - promoters60/1378888
agtttga

SEQ ID NO: 107171 - DNA, 7 bp, Unknown
  misc_feature (1)..( 7): Result.002 file - promoters60/1378888
agtttga

SEQ ID NO: 107172 - DNA, 8 bp, Unknown
  misc_feature (1)..( 8): Result.002 file - promoters60/1378888
actacttt

SEQ ID NO: 107173 - DNA, 8 bp, Unknown
  misc_feature (1)..( 8): Result.002 file - promoters60/1378888
actgcttt

SEQ ID NO: 107174 - DNA, 8 bp, Unknown
  misc_feature (1)..( 8): Result.002 file - promoters60/1378888
tgtcagaa

SEQ ID NO: 107175 - DNA, 8 bp, Unknown
  misc_feature (1)..( 8): Result.002 file - promoters60/1378888
tgttagaa

SEQ ID NO: 107176 - DNA, 6 bp, Unknown
  misc_feature (1)..( 6): Result.002 file - promoters60/1378888
attact

SEQ ID NO: 107177 - DNA, 6 bp, Unknown
  misc_feature (1)..( 6): Result.002 file - promoters60/1378888
attact

SEQ ID NO: 107178 - DNA, 8 bp, Unknown
  misc_feature (1)..( 8): Result.002 file - promoters60/1378888
ttgaaatt

SEQ ID NO: 107179 - DNA, 8 bp, Unknown
  misc_feature (1)..( 8): Result.002 file - promoters60/1378888
ttgtaatt

SEQ ID NO: 107180 - DNA, 8 bp, Unknown
  misc_feature (1)..( 8): Result.002 file - promoters60/1378888
atatttca

SEQ ID NO: 107181 - DNA, 8 bp, Unknown
  misc_feature (1)..( 8): Result.002 file - promoters60/1378888
atatttgt

SEQ ID NO: 107182 - DNA, 8 bp, Unknown
  misc_feature (1)..( 8): Result.002 file - promoters60/1378888
gtatctgt

SEQ ID NO: 107183 - DNA, 7 bp, Unknown
  misc_feature (1)..( 7): Result.002 file - promoters60/1378888
tatctat

SEQ ID NO: 107184 - DNA, 7 bp, Unknown
  misc_feature (1)..( 7): Result.002 file - promoters60/1378888
tatttat

SEQ ID NO: 107185 - DNA, 8 bp, Unknown
  misc_feature (1)..( 8): Result.002 file - promoters60/1378888
ttgaatga

SEQ ID NO: 107186 - DNA, 8 bp, Unknown
  misc_feature (1)..( 8): Result.002 file - promoters60/1378888
ttgtatga

SEQ ID NO: 107187 - DNA, 6 bp, Unknown
  misc_feature (1)..( 6): Result.002 file - promoters60/1378888
aaaaat

SEQ ID NO: 107188 - DNA, 6 bp, Unknown
  misc_feature (1)..( 6): Result.002 file - promoters60/1378888
aaaaat

SEQ ID NO: 107189 - DNA, 6 bp, Unknown
  misc_feature (1)..( 6): Result.002 file - promoters60/1378888
tttcag

SEQ ID NO: 107190 - DNA, 6 bp, Unknown
  misc_feature (1)..( 6): Result.002 file - promoters60/1378888
tttcag

SEQ ID NO: 107191 - DNA, 7 bp, Unknown
  misc_feature (1)..( 7): Result.002 file - promoters60/1378888
aaaatga

SEQ ID NO: 107192 - DNA, 7 bp, Unknown
  misc_feature (1)..( 7): Result.002 file - promoters60/1378888
aaagtga

SEQ ID NO: 107193 - DNA, 6 bp, Unknown
  misc_feature (1)..( 6): Result.002 file - promoters60/1378888
tgtatt

SEQ ID NO: 107194 - DNA, 6 bp, Unknown
  misc_feature (1)..( 6): Result.002 file - promoters60/1378888
tgtatt

SEQ ID NO: 107195 - DNA, 7 bp, Unknown
  misc_feature (1)..( 7): Result.002 file - promoters60/1378888
attgtat

SEQ ID NO: 107196 - DNA, 7 bp, Unknown
  misc_feature (1)..( 7): Result.002 file - promoters60/1378888
attgtat

SEQ ID NO: 107197 - DNA, 9 bp, Unknown
  misc_feature (1)..( 9): Result.002 file - promoters60/1378888
tttctgttt

SEQ ID NO: 107198 - DNA, 9 bp, Unknown
  misc_feature (1)..( 9): Result.002 file - promoters60/1378888
tttttgttt

SEQ ID NO: 107199 - DNA, 8 bp, Unknown
  misc_feature (1)..( 8): Result.002 file - promoters60/1378888
cttaaaat

SEQ ID NO: 107200 - DNA, 8 bp, Unknown
  misc_feature (1)..( 8): Result.002 file - promoters60/1378888
cttataat

SEQ ID NO: 107201 - DNA, 11 bp, Unknown
  misc_feature (1)..( 11): Result.002 file - promoters60/1378888
aaataataatt

SEQ ID NO: 107202 - DNA, 11 bp, Unknown
  misc_feature (1)..( 11): Result.002 file - promoters60/1378888
aaataataatt

SEQ ID NO: 107203 - DNA, 6 bp, Unknown
  misc_feature (1)..( 6): Result.002 file - promoters60/1378888
acaaaa

SEQ ID NO: 107204 - DNA, 6 bp, Unknown
  misc_feature (1)..( 6): Result.002 file - promoters60/1378888
acaaaa

SEQ ID NO: 107205 - DNA, 6 bp, Unknown
  misc_feature (1)..( 6): Result.002 file - promoters60/1379005
ttaaaa

SEQ ID NO: 107206 - DNA, 6 bp, Unknown
  misc_feature (1)..( 6): Result.002 file - promoters60/1379005
ttaaaa

SEQ ID NO: 107207 - DNA, 6 bp, Unknown
  misc_feature (1)..( 6): Result.002 file - promoters60/1379005
taaaac

SEQ ID NO: 107208 - DNA, 6 bp, Unknown
  misc_feature (1)..( 6): Result.002 file - promoters60/1379005
taaaac

SEQ ID NO: 107209 - DNA, 6 bp, Unknown
  misc_feature (1)..( 6): Result.002 file - promoters60/1379005
aaactt

SEQ ID NO: 107210 - DNA, 6 bp, Unknown
  misc_feature (1)..( 6): Result.002 file - promoters60/1379005
aaactt

SEQ ID NO: 107211 - DNA, 7 bp, Unknown
  misc_feature (1)..( 7): Result.002 file - promoters60/1379005
cacgatc

SEQ ID NO: 107212 - DNA, 7 bp, Unknown
  misc_feature (1)..( 7): Result.002 file - promoters60/1379005
cacaatc

SEQ ID NO: 107213 - DNA, 7 bp, Unknown
  misc_feature (1)..( 7): Result.002 file - promoters60/1379005
aaagcaa

SEQ ID NO: 107214 - DNA, 7 bp, Unknown
  misc_feature (1)..( 7): Result.002 file - promoters60/1379005
aaaccaa

SEQ ID NO: 107215 - DNA, 7 bp, Unknown
  misc_feature (1)..( 7): Result.002 file - promoters60/1379005
aaagcaa

SEQ ID NO: 107216 - DNA, 7 bp, Unknown
  misc_feature (1)..( 7): Result.002 file - promoters60/1379005
aaaccaa

SEQ ID NO: 107217 - DNA, 6 bp, Unknown
  misc_feature (1)..( 6): Result.002 file - promoters60/1379005
aataaa

SEQ ID NO: 107218 - DNA, 6 bp, Unknown
  misc_feature (1)..( 6): Result.002 file - promoters60/1379005
aataaa

SEQ ID NO: 107219 - DNA, 7 bp, Unknown
  misc_feature (1)..( 7): Result.002 file - promoters60/1379005
aagaaga

SEQ ID NO: 107220 - DNA, 7 bp, Unknown
  misc_feature (1)..( 7): Result.002 file - promoters60/1379005
aagaaga

SEQ ID NO: 107221 - DNA, 9 bp, Unknown
  misc_feature (1)..( 9): Result.002 file - promoters60/1379005
aaacattta

SEQ ID NO: 107222 - DNA, 9 bp, Unknown
  misc_feature (1)..( 9): Result.002 file - promoters60/1379005
ttacagtta

SEQ ID NO: 107223 - DNA, 9 bp, Unknown
  misc_feature (1)..( 9): Result.002 file - promoters60/1379005
ttatagtca

SEQ ID NO: 107224 - DNA, 6 bp, Unknown
  misc_feature (1)..( 6): Result.002 file - promoters60/1379005
cagaaa

SEQ ID NO: 107225 - DNA, 6 bp, Unknown
  misc_feature (1)..( 6): Result.002 file - promoters60/1379005
cagaaa

SEQ ID NO: 107226 - DNA, 7 bp, Unknown
  misc_feature (1)..( 7): Result.002 file - promoters60/1379005
tccgcca

SEQ ID NO: 107227 - DNA, 7 bp, Unknown
  misc_feature (1)..( 7): Result.002 file - promoters60/1379005
tccacca

SEQ ID NO: 107228 - DNA, 6 bp, Unknown
  misc_feature (1)..( 6): Result.002 file - promoters60/1379005
ttttga

SEQ ID NO: 107229 - DNA, 6 bp, Unknown
  misc_feature (1)..( 6): Result.002 file - promoters60/1379005
ttttga

SEQ ID NO: 107230 - DNA, 6 bp, Unknown
  misc_feature (1)..( 6): Result.002 file - promoters60/1379005
tcttct

SEQ ID NO: 107231 - DNA, 6 bp, Unknown
  misc_feature (1)..( 6): Result.002 file - promoters60/1379005
tcttct

SEQ ID NO: 107232 - DNA, 7 bp, Unknown
  misc_feature (1)..( 7): Result.002 file - promoters60/1379005
cacacca

SEQ ID NO: 107233 - DNA, 7 bp, Unknown
  misc_feature (1)..( 7): Result.002 file - promoters60/1379005
cacccca

SEQ ID NO: 107234 - DNA, 11 bp, Unknown
  misc_feature (1)..( 11): Result.002 file - promoters60/1379005
ctttcttgttt

SEQ ID NO: 107235 - DNA, 11 bp, Unknown
  misc_feature (1)..( 11): Result.002 file - promoters60/1379005
ctttcttcttt

SEQ ID NO: 107236 - DNA, 8 bp, Unknown
  misc_feature (1)..( 8): Result.002 file - promoters60/1379005
tttgcttc

SEQ ID NO: 107237 - DNA, 8 bp, Unknown
  misc_feature (1)..( 8): Result.002 file - promoters60/1379005
ttttcttc

SEQ ID NO: 107238 - DNA, 7 bp, Unknown
  misc_feature (1)..( 7): Result.002 file - promoters60/1379005
caagttg

SEQ ID NO: 107239 - DNA, 7 bp, Unknown
  misc_feature (1)..( 7): Result.002 file - promoters60/1379005
caatttg

SEQ ID NO: 107240 - DNA, 8 bp, Unknown
  misc_feature (1)..( 8): Result.002 file - promoters60/1379005
taaaaaaa

SEQ ID NO: 107241 - DNA, 8 bp, Unknown
  misc_feature (1)..( 8): Result.002 file - promoters60/1379005
taagaaaa

SEQ ID NO: 107242 - DNA, 8 bp, Unknown
  misc_feature (1)..( 8): Result.002 file - promoters60/1379005
caataaaa

SEQ ID NO: 107243 - DNA, 8 bp, Unknown
  misc_feature (1)..( 8): Result.002 file - promoters60/1379005
caagaaaa

SEQ ID NO: 107244 - DNA, 8 bp, Unknown
  misc_feature (1)..( 8): Result.002 file - promoters60/1379005
aagaatct

SEQ ID NO: 107245 - DNA, 8 bp, Unknown
  misc_feature (1)..( 8): Result.002 file - promoters60/1379005
aaggatct

SEQ ID NO: 107246 - DNA, 8 bp, Unknown
  misc_feature (1)..( 8): Result.002 file - promoters60/1379005
tccaccaa

SEQ ID NO: 107247 - DNA, 8 bp, Unknown
  misc_feature (1)..( 8): Result.002 file - promoters60/1379005
tccaacaa

SEQ ID NO: 107248 - DNA, 7 bp, Unknown
  misc_feature (1)..( 7): Result.002 file - promoters60/1379014
ttagttt

SEQ ID NO: 107249 - DNA, 7 bp, Unknown
  misc_feature (1)..( 7): Result.002 file - promoters60/1379014
ttatttt

SEQ ID NO: 107250 - DNA, 7 bp, Unknown
  misc_feature (1)..( 7): Result.002 file - promoters60/1379014
aaaaaag

SEQ ID NO: 107251 - DNA, 7 bp, Unknown
  misc_feature (1)..( 7): Result.002 file - promoters60/1379014
aaagaag

SEQ ID NO: 107252 - DNA, 7 bp, Unknown
  misc_feature (1)..( 7): Result.002 file - promoters60/1379014
catgcaa

SEQ ID NO: 107253 - DNA, 7 bp, Unknown
  misc_feature (1)..( 7): Result.002 file - promoters60/1379014
catacaa

SEQ ID NO: 107254 - DNA, 7 bp, Unknown
  misc_feature (1)..( 7): Result.002 file - promoters60/1379014
gatgcaa

SEQ ID NO: 107255 - DNA, 6 bp, Unknown
  misc_feature (1)..( 6): Result.002 file - promoters60/1379014
cataga

SEQ ID NO: 107256 - DNA, 6 bp, Unknown
  misc_feature (1)..( 6): Result.002 file - promoters60/1379014
cataga

SEQ ID NO: 107257 - DNA, 7 bp, Unknown
  misc_feature (1)..( 7): Result.002 file - promoters60/1379014
aatctat

SEQ ID NO: 107258 - DNA, 7 bp, Unknown
  misc_feature (1)..( 7): Result.002 file - promoters60/1379014
aatttat

SEQ ID NO: 107259 - DNA, 6 bp, Unknown
  misc_feature (1)..( 6): Result.002 file - promoters60/1379014
caaaac

SEQ ID NO: 107260 - DNA, 6 bp, Unknown
  misc_feature (1)..( 6): Result.002 file - promoters60/1379014
caaaac

SEQ ID NO: 107261 - DNA, 6 bp, Unknown
  misc_feature (1)..( 6): Result.002 file - promoters60/1379014
ccaaaa

SEQ ID NO: 107262 - DNA, 6 bp, Unknown
  misc_feature (1)..( 6): Result.002 file - promoters60/1379014
ccaaaa

SEQ ID NO: 107263 - DNA, 6 bp, Unknown
  misc_feature (1)..( 6): Result.002 file - promoters60/1379014
atacaa

SEQ ID NO: 107264 - DNA, 6 bp, Unknown
  misc_feature (1)..( 6): Result.002 file - promoters60/1379014
atacaa

SEQ ID NO: 107265 - DNA, 6 bp, Unknown
  misc_feature (1)..( 6): Result.002 file - promoters60/1379014
aaattc

SEQ ID NO: 107266 - DNA, 6 bp, Unknown
  misc_feature (1)..( 6): Result.002 file - promoters60/1379014
aaattc

SEQ ID NO: 107267 - DNA, 8 bp, Unknown
  misc_feature (1)..( 8): Result.002 file - promoters60/1379014
aatttacc

SEQ ID NO: 107268 - DNA, 8 bp, Unknown
  misc_feature (1)..( 8): Result.002 file - promoters60/1379014
aatttaaa

SEQ ID NO: 107269 - DNA, 8 bp, Unknown
  misc_feature (1)..( 8): Result.002 file - promoters60/1379014
aattcaaa

SEQ ID NO: 107270 - DNA, 6 bp, Unknown
  misc_feature (1)..( 6): Result.002 file - promoters60/1379014
aaataa

SEQ ID NO: 107271 - DNA, 6 bp, Unknown
  misc_feature (1)..( 6): Result.002 file - promoters60/1379014
aaataa

SEQ ID NO: 107272 - DNA, 6 bp, Unknown
  misc_feature (1)..( 6): Result.002 file - promoters60/1379014
taaata

SEQ ID NO: 107273 - DNA, 6 bp, Unknown
  misc_feature (1)..( 6): Result.002 file - promoters60/1379014
taaata

SEQ ID NO: 107274 - DNA, 6 bp, Unknown
  misc_feature (1)..( 6): Result.002 file - promoters60/1379014
atgaag

SEQ ID NO: 107275 - DNA, 6 bp, Unknown
  misc_feature (1)..( 6): Result.002 file - promoters60/1379014
atgaag

SEQ ID NO: 107276 - DNA, 11 bp, Unknown
  misc_feature (1)..( 11): Result.002 file - promoters60/1379014
tttctctttca

SEQ ID NO: 107277 - DNA, 11 bp, Unknown
  misc_feature (1)..( 11): Result.002 file - promoters60/1379014
tttttctttca

SEQ ID NO: 107278 - DNA, 6 bp, Unknown
  misc_feature (1)..( 6): Result.002 file - promoters60/1379014
acaatt

SEQ ID NO: 107279 - DNA, 6 bp, Unknown
  misc_feature (1)..( 6): Result.002 file - promoters60/1379014
acaatt

SEQ ID NO: 107280 - DNA, 6 bp, Unknown
  misc_feature (1)..( 6): Result.002 file - promoters60/1379014
aaaata

SEQ ID NO: 107281 - DNA, 6 bp, Unknown
  misc_feature (1)..( 6): Result.002 file - promoters60/1379014
aaaata

SEQ ID NO: 107282 - DNA, 7 bp, Unknown
  misc_feature (1)..( 7): Result.002 file - promoters60/1379014
aaagaga

SEQ ID NO: 107283 - DNA, 7 bp, Unknown
  misc_feature (1)..( 7): Result.002 file - promoters60/1379014
aaaaaga

SEQ ID NO: 107284 - DNA, 6 bp, Unknown
  misc_feature (1)..( 6): Result.002 file - promoters60/1379014
atagac

SEQ ID NO: 107285 - DNA, 6 bp, Unknown
  misc_feature (1)..( 6): Result.002 file - promoters60/1379014
atagac

SEQ ID NO: 107286 - DNA, 7 bp, Unknown
  misc_feature (1)..( 7): Result.002 file - promoters60/1379014
agaattt

SEQ ID NO: 107287 - DNA, 7 bp, Unknown
  misc_feature (1)..( 7): Result.002 file - promoters60/1379014
agacttt

SEQ ID NO: 107288 - DNA, 11 bp, Unknown
  misc_feature (1)..( 11): Result.002 file - promoters60/1379037
tttaaataaaa

SEQ ID NO: 107289 - DNA, 11 bp, Unknown
  misc_feature (1)..( 11): Result.002 file - promoters60/1379037
ttcaaataaaa

SEQ ID NO: 107290 - DNA, 11 bp, Unknown
  misc_feature (1)..( 11): Result.002 file - promoters60/1379037
ttctaatatcc

SEQ ID NO: 107291 - DNA, 10 bp, Unknown
  misc_feature (1)..( 10): Result.002 file - promoters60/1379037
ctaaaatagt

SEQ ID NO: 107292 - DNA, 10 bp, Unknown
  misc_feature (1)..( 10): Result.002 file - promoters60/1379037
tcaaaatagc

SEQ ID NO: 107293 - DNA, 10 bp, Unknown
  misc_feature (1)..( 10): Result.002 file - promoters60/1379037
ctacaatttt

SEQ ID NO: 107294 - DNA, 10 bp, Unknown
  misc_feature (1)..( 10): Result.002 file - promoters60/1379037
tcaaaaagca

SEQ ID NO: 107295 - DNA, 9 bp, Unknown
  misc_feature (1)..( 9): Result.002 file - promoters60/1379037
aagaaaaaa

SEQ ID NO: 107296 - DNA, 9 bp, Unknown
  misc_feature (1)..( 9): Result.002 file - promoters60/1379037
aagaaacct

SEQ ID NO: 107297 - DNA, 9 bp, Unknown
  misc_feature (1)..( 9): Result.002 file - promoters60/1379037
aagaaaaaa

SEQ ID NO: 107298 - DNA, 11 bp, Unknown
  misc_feature (1)..( 11): Result.002 file - promoters60/1379037
aaaaaactcaa

SEQ ID NO: 107299 - DNA, 11 bp, Unknown
  misc_feature (1)..( 11): Result.002 file - promoters60/1379037
agaaacctcaa

SEQ ID NO: 107300 - DNA, 11 bp, Unknown
  misc_feature (1)..( 11): Result.002 file - promoters60/1379037
aaaaaacttag

SEQ ID NO: 107301 - DNA, 12 bp, Unknown
  misc_feature (1)..( 12): Result.002 file - promoters60/1379037
aaataaatggaa

SEQ ID NO: 107302 - DNA, 12 bp, Unknown
  misc_feature (1)..( 12): Result.002 file - promoters60/1379037
aaagaaagggaa

SEQ ID NO: 107303 - DNA, 12 bp, Unknown
  misc_feature (1)..( 12): Result.002 file - promoters60/1379037
taataattggcg

SEQ ID NO: 107304 - DNA, 8 bp, Unknown
  misc_feature (1)..( 8): Result.002 file - promoters60/1379037
cagaaagt

SEQ ID NO: 107305 - DNA, 8 bp, Unknown
  misc_feature (1)..( 8): Result.002 file - promoters60/1379037
gagaaaga

SEQ ID NO: 107306 - DNA, 8 bp, Unknown
  misc_feature (1)..( 8): Result.002 file - promoters60/1379037
aacaaaaa

SEQ ID NO: 107307 - DNA, 10 bp, Unknown
  misc_feature (1)..( 10): Result.002 file - promoters60/1379037
aataagaaaa

SEQ ID NO: 107308 - DNA, 10 bp, Unknown
  misc_feature (1)..( 10): Result.002 file - promoters60/1379037
gaaaagaaaa

SEQ ID NO: 107309 - DNA, 11 bp, Unknown
  misc_feature (1)..( 11): Result.002 file - promoters60/1379037
ggaaatgaaat

SEQ ID NO: 107310 - DNA, 9 bp, Unknown
  misc_feature (1)..( 9): Result.002 file - promoters60/1379037
aaataaatg

SEQ ID NO: 107311 - DNA, 9 bp, Unknown
  misc_feature (1)..( 9): Result.002 file - promoters60/1379037
aaataaaat

SEQ ID NO: 107312 - DNA, 10 bp, Unknown
  misc_feature (1)..( 10): Result.002 file - promoters60/1379037
aaatgaaata

SEQ ID NO: 107313 - DNA, 9 bp, Unknown
  misc_feature (1)..( 9): Result.002 file - promoters60/1379037
caagtaaga

SEQ ID NO: 107314 - DNA, 9 bp, Unknown
  misc_feature (1)..( 9): Result.002 file - promoters60/1379037
aaagtaaag

SEQ ID NO: 107315 - DNA, 9 bp, Unknown
  misc_feature (1)..( 9): Result.002 file - promoters60/1379037
aaagaaaag

SEQ ID NO: 107316 - DNA, 8 bp, Unknown
  misc_feature (1)..( 8): Result.002 file - promoters60/1379043
attttatt

SEQ ID NO: 107317 - DNA, 8 bp, Unknown
  misc_feature (1)..( 8): Result.002 file - promoters60/1379043
atttgatt

SEQ ID NO: 107318 - DNA, 7 bp, Unknown
  misc_feature (1)..( 7): Result.002 file - promoters60/1379043
ttctccc

SEQ ID NO: 107319 - DNA, 7 bp, Unknown
  misc_feature (1)..( 7): Result.002 file - promoters60/1379043
ttctccc

SEQ ID NO: 107320 - DNA, 7 bp, Unknown
  misc_feature (1)..( 7): Result.002 file - promoters60/1379043
acaatct

SEQ ID NO: 107321 - DNA, 7 bp, Unknown
  misc_feature (1)..( 7): Result.002 file - promoters60/1379043
acactct

SEQ ID NO: 107322 - DNA, 7 bp, Unknown
  misc_feature (1)..( 7): Result.002 file - promoters60/1379043
tctatat

SEQ ID NO: 107323 - DNA, 7 bp, Unknown
  misc_feature (1)..( 7): Result.002 file - promoters60/1379043
tctttat

SEQ ID NO: 107324 - DNA, 8 bp, Unknown
  misc_feature (1)..( 8): Result.002 file - promoters60/1379043
tatctttg

SEQ ID NO: 107325 - DNA, 8 bp, Unknown
  misc_feature (1)..( 8): Result.002 file - promoters60/1379043
tatcgttg

SEQ ID NO: 107326 - DNA, 6 bp, Unknown
  misc_feature (1)..( 6): Result.002 file - promoters60/1379043
ctccaa

SEQ ID NO: 107327 - DNA, 6 bp, Unknown
  misc_feature (1)..( 6): Result.002 file - promoters60/1379043
ctccaa

SEQ ID NO: 107328 - DNA, 6 bp, Unknown
  misc_feature (1)..( 6): Result.002 file - promoters60/1379043
ttaaca

SEQ ID NO: 107329 - DNA, 6 bp, Unknown
  misc_feature (1)..( 6): Result.002 file - promoters60/1379043
ttaaca

SEQ ID NO: 107330 - DNA, 6 bp, Unknown
  misc_feature (1)..( 6): Result.002 file - promoters60/1379043
gtggac

SEQ ID NO: 107331 - DNA, 6 bp, Unknown
  misc_feature (1)..( 6): Result.002 file - promoters60/1379043
gtggac

SEQ ID NO: 107332 - DNA, 6 bp, Unknown
  misc_feature (1)..( 6): Result.002 file - promoters60/1379043
attata

SEQ ID NO: 107333 - DNA, 6 bp, Unknown
  misc_feature (1)..( 6): Result.002 file - promoters60/1379043
attata

SEQ ID NO: 107334 - DNA, 6 bp, Unknown
  misc_feature (1)..( 6): Result.002 file - promoters60/1379043
tatttt

SEQ ID NO: 107335 - DNA, 6 bp, Unknown
  misc_feature (1)..( 6): Result.002 file - promoters60/1379043
tatttt

SEQ ID NO: 107336 - DNA, 11 bp, Unknown
  misc_feature (1)..( 11): Result.002 file - promoters60/1379043
ccaaatattaa

SEQ ID NO: 107337 - DNA, 11 bp, Unknown
  misc_feature (1)..( 11): Result.002 file - promoters60/1379043
ccatatattaa

SEQ ID NO: 107338 - DNA, 6 bp, Unknown
  misc_feature (1)..( 6): Result.002 file - promoters60/1379043
ataaaa

SEQ ID NO: 107339 - DNA, 6 bp, Unknown
  misc_feature (1)..( 6): Result.002 file - promoters60/1379043
ataaaa

SEQ ID NO: 107340 - DNA, 8 bp, Unknown
  misc_feature (1)..( 8): Result.002 file - promoters60/1379043
aaaataag

SEQ ID NO: 107341 - DNA, 8 bp, Unknown
  misc_feature (1)..( 8): Result.002 file - promoters60/1379043
aaaagaag

SEQ ID NO: 107342 - DNA, 7 bp, Unknown
  misc_feature (1)..( 7): Result.002 file - promoters60/1379043
aaaaaga

SEQ ID NO: 107343 - DNA, 7 bp, Unknown
  misc_feature (1)..( 7): Result.002 file - promoters60/1379043
aaaaaga

SEQ ID NO: 107344 - DNA, 7 bp, Unknown
  misc_feature (1)..( 7): Result.002 file - promoters60/1379043
aaaacaa

SEQ ID NO: 107345 - DNA, 7 bp, Unknown
  misc_feature (1)..( 7): Result.002 file - promoters60/1379043
aaaacaa

SEQ ID NO: 107346 - DNA, 6 bp, Unknown
  misc_feature (1)..( 6): Result.002 file - promoters60/1379043
ggtctc

SEQ ID NO: 107347 - DNA, 6 bp, Unknown
  misc_feature (1)..( 6): Result.002 file - promoters60/1379043
ggtctc

SEQ ID NO: 107348 - DNA, 7 bp, Unknown
  misc_feature (1)..( 7): Result.002 file - promoters60/1379043
ctaattt

SEQ ID NO: 107349 - DNA, 7 bp, Unknown
  misc_feature (1)..( 7): Result.002 file - promoters60/1379043
ctagttt

SEQ ID NO: 107350 - DNA, 6 bp, Unknown
  misc_feature (1)..( 6): Result.002 file - promoters60/1379043
tttgga

SEQ ID NO: 107351 - DNA, 6 bp, Unknown
  misc_feature (1)..( 6): Result.002 file - promoters60/1379043
tttgga

SEQ ID NO: 107352 - DNA, 6 bp, Unknown
  misc_feature (1)..( 6): Result.002 file - promoters60/1379043
gatttg

SEQ ID NO: 107353 - DNA, 6 bp, Unknown
  misc_feature (1)..( 6): Result.002 file - promoters60/1379043
gatttg

SEQ ID NO: 107354 - DNA, 8 bp, Unknown
  misc_feature (1)..( 8): Result.002 file - promoters60/1379043
aaaacttt

SEQ ID NO: 107355 - DNA, 8 bp, Unknown
  misc_feature (1)..( 8): Result.002 file - promoters60/1379043
aaatcttt

SEQ ID NO: 107356 - DNA, 6 bp, Unknown
  misc_feature (1)..( 6): Result.002 file - promoters60/1379050
aacaaa

SEQ ID NO: 107357 - DNA, 6 bp, Unknown
  misc_feature (1)..( 6): Result.002 file - promoters60/1379050
aacaaa

SEQ ID NO: 107358 - DNA, 7 bp, Unknown
  misc_feature (1)..( 7): Result.002 file - promoters60/1379050
tttaaac

SEQ ID NO: 107359 - DNA, 7 bp, Unknown
  misc_feature (1)..( 7): Result.002 file - promoters60/1379050
tttaaac

SEQ ID NO: 107360 - DNA, 7 bp, Unknown
  misc_feature (1)..( 7): Result.002 file - promoters60/1379050
cttaaac

SEQ ID NO: 107361 - DNA, 6 bp, Unknown
  misc_feature (1)..( 6): Result.002 file - promoters60/1379050
tgaaga

SEQ ID NO: 107362 - DNA, 6 bp, Unknown
  misc_feature (1)..( 6): Result.002 file - promoters60/1379050
tgaaga

SEQ ID NO: 107363 - DNA, 9 bp, Unknown
  misc_feature (1)..( 9): Result.002 file - promoters60/1379050
tgaaggaaa

SEQ ID NO: 107364 - DNA, 9 bp, Unknown
  misc_feature (1)..( 9): Result.002 file - promoters60/1379050
tgaatgaaa

SEQ ID NO: 107365 - DNA, 6 bp, Unknown
  misc_feature (1)..( 6): Result.002 file - promoters60/1379050
tctctc

SEQ ID NO: 107366 - DNA, 6 bp, Unknown
  misc_feature (1)..( 6): Result.002 file - promoters60/1379050
tctctc

SEQ ID NO: 107367 - DNA, 7 bp, Unknown
  misc_feature (1)..( 7): Result.002 file - promoters60/1379050
taaggag

SEQ ID NO: 107368 - DNA, 7 bp, Unknown
  misc_feature (1)..( 7): Result.002 file - promoters60/1379050
taaagag

SEQ ID NO: 107369 - DNA, 6 bp, Unknown
  misc_feature (1)..( 6): Result.002 file - promoters60/1379050
acgctt

SEQ ID NO: 107370 - DNA, 6 bp, Unknown
  misc_feature (1)..( 6): Result.002 file - promoters60/1379050
acgctt

SEQ ID NO: 107371 - DNA, 7 bp, Unknown
  misc_feature (1)..( 7): Result.002 file - promoters60/1379050
tatataa

SEQ ID NO: 107372 - DNA, 7 bp, Unknown
  misc_feature (1)..( 7): Result.002 file - promoters60/1379050
tatttaa

SEQ ID NO: 107373 - DNA, 7 bp, Unknown
  misc_feature (1)..( 7): Result.002 file - promoters60/1379050
cttgtat

SEQ ID NO: 107374 - DNA, 7 bp, Unknown
  misc_feature (1)..( 7): Result.002 file - promoters60/1379050
cttttat

SEQ ID NO: 107375 - DNA, 7 bp, Unknown
  misc_feature (1)..( 7): Result.002 file - promoters60/1379050
cgaggaa

SEQ ID NO: 107376 - DNA, 7 bp, Unknown
  misc_feature (1)..( 7): Result.002 file - promoters60/1379050
cgatgaa

SEQ ID NO: 107377 - DNA, 7 bp, Unknown
  misc_feature (1)..( 7): Result.002 file - promoters60/1379050
ttacacg

SEQ ID NO: 107378 - DNA, 7 bp, Unknown
  misc_feature (1)..( 7): Result.002 file - promoters60/1379050
ttatacg

SEQ ID NO: 107379 - DNA, 8 bp, Unknown
  misc_feature (1)..( 8): Result.002 file - promoters60/1379050
agatgttt

SEQ ID NO: 107380 - DNA, 8 bp, Unknown
  misc_feature (1)..( 8): Result.002 file - promoters60/1379050
agattttt

SEQ ID NO: 107381 - DNA, 9 bp, Unknown
  misc_feature (1)..( 9): Result.002 file - promoters60/1379050
gaggtttat

SEQ ID NO: 107382 - DNA, 9 bp, Unknown
  misc_feature (1)..( 9): Result.002 file - promoters60/1379050
gaggtttat

SEQ ID NO: 107383 - DNA, 6 bp, Unknown
  misc_feature (1)..( 6): Result.002 file - promoters60/1379050
ctaata

SEQ ID NO: 107384 - DNA, 6 bp, Unknown
  misc_feature (1)..( 6): Result.002 file - promoters60/1379050
ctaata

SEQ ID NO: 107385 - DNA, 7 bp, Unknown
  misc_feature (1)..( 7): Result.002 file - promoters60/1379050
aattata

SEQ ID NO: 107386 - DNA, 7 bp, Unknown
  misc_feature (1)..( 7): Result.002 file - promoters60/1379050
aattata

SEQ ID NO: 107387 - DNA, 7 bp, Unknown
  misc_feature (1)..( 7): Result.002 file - promoters60/1379075
tatgtta

SEQ ID NO: 107388 - DNA, 7 bp, Unknown
  misc_feature (1)..( 7): Result.002 file - promoters60/1379075
tatctta

SEQ ID NO: 107389 - DNA, 6 bp, Unknown
  misc_feature (1)..( 6): Result.002 file - promoters60/1379075
tattaa

SEQ ID NO: 107390 - DNA, 6 bp, Unknown
  misc_feature (1)..( 6): Result.002 file - promoters60/1379075
tattaa

SEQ ID NO: 107391 - DNA, 9 bp, Unknown
  misc_feature (1)..( 9): Result.002 file - promoters60/1379075
gaatataaa

SEQ ID NO: 107392 - DNA, 9 bp, Unknown
  misc_feature (1)..( 9): Result.002 file - promoters60/1379075
gactataaa

SEQ ID NO: 107393 - DNA, 9 bp, Unknown
  misc_feature (1)..( 9): Result.002 file - promoters60/1379075
gaagataat

SEQ ID NO: 107394 - DNA, 8 bp, Unknown
  misc_feature (1)..( 8): Result.002 file - promoters60/1379075
aaaataac

SEQ ID NO: 107395 - DNA, 8 bp, Unknown
  misc_feature (1)..( 8): Result.002 file - promoters60/1379075
aaattaaa

SEQ ID NO: 107396 - DNA, 8 bp, Unknown
  misc_feature (1)..( 8): Result.002 file - promoters60/1379075
taattaaa

SEQ ID NO: 107397 - DNA, 10 bp, Unknown
  misc_feature (1)..( 10): Result.002 file - promoters60/1379075
ttttaacaaa

SEQ ID NO: 107398 - DNA, 10 bp, Unknown
  misc_feature (1)..( 10): Result.002 file - promoters60/1379075
tttaaacaaa

SEQ ID NO: 107399 - DNA, 6 bp, Unknown
  misc_feature (1)..( 6): Result.002 file - promoters60/1379075
attaat

SEQ ID NO: 107400 - DNA, 6 bp, Unknown
  misc_feature (1)..( 6): Result.002 file - promoters60/1379075
attaat

SEQ ID NO: 107401 - DNA, 12 bp, Unknown
  misc_feature (1)..( 12): Result.002 file - promoters60/1379075
atttaaaattaa

SEQ ID NO: 107402 - DNA, 12 bp, Unknown
  misc_feature (1)..( 12): Result.002 file - promoters60/1379075
attaaaaaataa

SEQ ID NO: 107403 - DNA, 6 bp, Unknown
  misc_feature (1)..( 6): Result.002 file - promoters60/1379075
taaaat

SEQ ID NO: 107404 - DNA, 6 bp, Unknown
  misc_feature (1)..( 6): Result.002 file - promoters60/1379075
taaaat

SEQ ID NO: 107405 - DNA, 9 bp, Unknown
  misc_feature (1)..( 9): Result.002 file - promoters60/1379075
ccataaaca

SEQ ID NO: 107406 - DNA, 9 bp, Unknown
  misc_feature (1)..( 9): Result.002 file - promoters60/1379075
gaataaaca

SEQ ID NO: 107407 - DNA, 9 bp, Unknown
  misc_feature (1)..( 9): Result.002 file - promoters60/1379075
ccaaaaagg

SEQ ID NO: 107408 - DNA, 7 bp, Unknown
  misc_feature (1)..( 7): Result.002 file - promoters60/1379075
agaagaa

SEQ ID NO: 107409 - DNA, 7 bp, Unknown
  misc_feature (1)..( 7): Result.002 file - promoters60/1379075
agacgaa

SEQ ID NO: 107410 - DNA, 6 bp, Unknown
  misc_feature (1)..( 6): Result.002 file - promoters60/1379075
cgttaa

SEQ ID NO: 107411 - DNA, 6 bp, Unknown
  misc_feature (1)..( 6): Result.002 file - promoters60/1379075
cgttaa

SEQ ID NO: 107412 - DNA, 6 bp, Unknown
  misc_feature (1)..( 6): Result.002 file - promoters60/1379075
ttttta

SEQ ID NO: 107413 - DNA, 6 bp, Unknown
  misc_feature (1)..( 6): Result.002 file - promoters60/1379075
ttttta

SEQ ID NO: 107414 - DNA, 11 bp, Unknown
  misc_feature (1)..( 11): Result.002 file - promoters60/1379075
ataaataaata

SEQ ID NO: 107415 - DNA, 11 bp, Unknown
  misc_feature (1)..( 11): Result.002 file - promoters60/1379075
ataaataaata

SEQ ID NO: 107416 - DNA, 7 bp, Unknown
  misc_feature (1)..( 7): Result.002 file - promoters60/1379075
taacttt

SEQ ID NO: 107417 - DNA, 7 bp, Unknown
  misc_feature (1)..( 7): Result.002 file - promoters60/1379075
aaacttt

SEQ ID NO: 107418 - DNA, 7 bp, Unknown
  misc_feature (1)..( 7): Result.002 file - promoters60/1379075
aaactta

SEQ ID NO: 107419 - DNA, 13 bp, Unknown
  misc_feature (1)..( 13): Result.002 file - promoters60/1379075
ctttttaatgcat

SEQ ID NO: 107420 - DNA, 13 bp, Unknown
  misc_feature (1)..( 13): Result.002 file - promoters60/1379075
cttttaaatactt

SEQ ID NO: 107421 - DNA, 13 bp, Unknown
  misc_feature (1)..( 13): Result.002 file - promoters60/1379075
aaattaaaaactt

SEQ ID NO: 107422 - DNA, 13 bp, Unknown
  misc_feature (1)..( 13): Result.002 file - promoters60/1379075
taagatatttttt

SEQ ID NO: 107423 - DNA, 13 bp, Unknown
  misc_feature (1)..( 13): Result.002 file - promoters60/1379075
ttaaatacttttt

SEQ ID NO: 107424 - DNA, 13 bp, Unknown
  misc_feature (1)..( 13): Result.002 file - promoters60/1379075
ttaaaaacttacc

SEQ ID NO: 107425 - DNA, 15 bp, Unknown
  misc_feature (1)..( 15): Result.002 file - promoters60/1379075
tttcattttcaattt

SEQ ID NO: 107426 - DNA, 15 bp, Unknown
  misc_feature (1)..( 15): Result.002 file - promoters60/1379075
tttaattctcagttt

SEQ ID NO: 107427 - DNA, 6 bp, Unknown
  misc_feature (1)..( 6): Result.002 file - promoters60/1379075
gtattc

SEQ ID NO: 107428 - DNA, 6 bp, Unknown
  misc_feature (1)..( 6): Result.002 file - promoters60/1379075
gtattc

SEQ ID NO: 107429 - DNA, 7 bp, Unknown
  misc_feature (1)..( 7): Result.002 file - promoters60/1379075
tgttgct

SEQ ID NO: 107430 - DNA, 7 bp, Unknown
  misc_feature (1)..( 7): Result.002 file - promoters60/1379075
tgtagct

SEQ ID NO: 107431 - DNA, 8 bp, Unknown
  misc_feature (1)..( 8): Result.002 file - promoters60/1379075
ggataaga

SEQ ID NO: 107432 - DNA, 8 bp, Unknown
  misc_feature (1)..( 8): Result.002 file - promoters60/1379075
ggattaga

SEQ ID NO: 107433 - DNA, 7 bp, Unknown
  misc_feature (1)..( 7): Result.002 file - promoters60/1379075
tttatga

SEQ ID NO: 107434 - DNA, 7 bp, Unknown
  misc_feature (1)..( 7): Result.002 file - promoters60/1379075
tttatga

SEQ ID NO: 107435 - DNA, 8 bp, Unknown
  misc_feature (1)..( 8): Result.002 file - promoters60/1379075
aattaccc

SEQ ID NO: 107436 - DNA, 8 bp, Unknown
  misc_feature (1)..( 8): Result.002 file - promoters60/1379075
aatcaccc

SEQ ID NO: 107437 - DNA, 8 bp, Unknown
  misc_feature (1)..( 8): Result.002 file - promoters60/1379141
aatcattt

SEQ ID NO: 107438 - DNA, 8 bp, Unknown
  misc_feature (1)..( 8): Result.002 file - promoters60/1379141
aattattt

SEQ ID NO: 107439 - DNA, 7 bp, Unknown
  misc_feature (1)..( 7): Result.002 file - promoters60/1379141
aaaatta

SEQ ID NO: 107440 - DNA, 7 bp, Unknown
  misc_feature (1)..( 7): Result.002 file - promoters60/1379141
aaactta

SEQ ID NO: 107441 - DNA, 8 bp, Unknown
  misc_feature (1)..( 8): Result.002 file - promoters60/1379141
tatcggtt

SEQ ID NO: 107442 - DNA, 8 bp, Unknown
  misc_feature (1)..( 8): Result.002 file - promoters60/1379141
tatgggtt

SEQ ID NO: 107443 - DNA, 9 bp, Unknown
  misc_feature (1)..( 9): Result.002 file - promoters60/1379141
tttcactaa

SEQ ID NO: 107444 - DNA, 9 bp, Unknown
  misc_feature (1)..( 9): Result.002 file - promoters60/1379141
tttcaataa

SEQ ID NO: 107445 - DNA, 7 bp, Unknown
  misc_feature (1)..( 7): Result.002 file - promoters60/1379141
tattttc

SEQ ID NO: 107446 - DNA, 7 bp, Unknown
  misc_feature (1)..( 7): Result.002 file - promoters60/1379141
tattttc

SEQ ID NO: 107447 - DNA, 9 bp, Unknown
  misc_feature (1)..( 9): Result.002 file - promoters60/1379141
aaataaaat

SEQ ID NO: 107448 - DNA, 9 bp, Unknown
  misc_feature (1)..( 9): Result.002 file - promoters60/1379141
gcatataat

SEQ ID NO: 107449 - DNA, 9 bp, Unknown
  misc_feature (1)..( 9): Result.002 file - promoters60/1379141
aaataaaat

SEQ ID NO: 107450 - DNA, 6 bp, Unknown
  misc_feature (1)..( 6): Result.002 file - promoters60/1379141
taacaa

SEQ ID NO: 107451 - DNA, 6 bp, Unknown
  misc_feature (1)..( 6): Result.002 file - promoters60/1379141
taacaa

SEQ ID NO: 107452 - DNA, 8 bp, Unknown
  misc_feature (1)..( 8): Result.002 file - promoters60/1379141
tagttgat

SEQ ID NO: 107453 - DNA, 8 bp, Unknown
  misc_feature (1)..( 8): Result.002 file - promoters60/1379141
aagttgat

SEQ ID NO: 107454 - DNA, 8 bp, Unknown
  misc_feature (1)..( 8): Result.002 file - promoters60/1379141
aagttgtt

SEQ ID NO: 107455 - DNA, 6 bp, Unknown
  misc_feature (1)..( 6): Result.002 file - promoters60/1379141
tagtat

SEQ ID NO: 107456 - DNA, 6 bp, Unknown
  misc_feature (1)..( 6): Result.002 file - promoters60/1379141
tagtat

SEQ ID NO: 107457 - DNA, 8 bp, Unknown
  misc_feature (1)..( 8): Result.002 file - promoters60/1379141
tttcagga

SEQ ID NO: 107458 - DNA, 8 bp, Unknown
  misc_feature (1)..( 8): Result.002 file - promoters60/1379141
tttgagga

SEQ ID NO: 107459 - DNA, 7 bp, Unknown
  misc_feature (1)..( 7): Result.002 file - promoters60/1379141
tcataaa

SEQ ID NO: 107460 - DNA, 7 bp, Unknown
  misc_feature (1)..( 7): Result.002 file - promoters60/1379141
tcacaaa

SEQ ID NO: 107461 - DNA, 7 bp, Unknown
  misc_feature (1)..( 7): Result.002 file - promoters60/1379141
aattaaa

SEQ ID NO: 107462 - DNA, 7 bp, Unknown
  misc_feature (1)..( 7): Result.002 file - promoters60/1379141
aataaaa

SEQ ID NO: 107463 - DNA, 9 bp, Unknown
  misc_feature (1)..( 9): Result.002 file - promoters60/1379141
taaaaaaat

SEQ ID NO: 107464 - DNA, 9 bp, Unknown
  misc_feature (1)..( 9): Result.002 file - promoters60/1379141
taaaaaaat

SEQ ID NO: 107465 - DNA, 7 bp, Unknown
  misc_feature (1)..( 7): Result.002 file - promoters60/1379141
acggttc

SEQ ID NO: 107466 - DNA, 7 bp, Unknown
  misc_feature (1)..( 7): Result.002 file - promoters60/1379141
acgtttc

SEQ ID NO: 107467 - DNA, 9 bp, Unknown
  misc_feature (1)..( 9): Result.002 file - promoters60/1379141
aagaattta

SEQ ID NO: 107468 - DNA, 9 bp, Unknown
  misc_feature (1)..( 9): Result.002 file - promoters60/1379141
aagagttta

SEQ ID NO: 107469 - DNA, 6 bp, Unknown
  misc_feature (1)..( 6): Result.002 file - promoters60/1379141
tttttg

SEQ ID NO: 107470 - DNA, 6 bp, Unknown
  misc_feature (1)..( 6): Result.002 file - promoters60/1379141
tttttg

SEQ ID NO: 107471 - DNA, 6 bp, Unknown
  misc_feature (1)..( 6): Result.002 file - promoters60/1379141
ttagct

SEQ ID NO: 107472 - DNA, 6 bp, Unknown
  misc_feature (1)..( 6): Result.002 file - promoters60/1379141
ttagct

SEQ ID NO: 107473 - DNA, 8 bp, Unknown
  misc_feature (1)..( 8): Result.002 file - promoters60/1379141
taagcata

SEQ ID NO: 107474 - DNA, 8 bp, Unknown
  misc_feature (1)..( 8): Result.002 file - promoters60/1379141
taagaata

SEQ ID NO: 107475 - DNA, 6 bp, Unknown
  misc_feature (1)..( 6): Result.002 file - promoters60/1379141
caaaaa

SEQ ID NO: 107476 - DNA, 6 bp, Unknown
  misc_feature (1)..( 6): Result.002 file - promoters60/1379141
caaaaa

SEQ ID NO: 107477 - DNA, 7 bp, Unknown
  misc_feature (1)..( 7): Result.002 file - promoters60/1379141
ttcctct

SEQ ID NO: 107478 - DNA, 7 bp, Unknown
  misc_feature (1)..( 7): Result.002 file - promoters60/1379141
ttcttct

SEQ ID NO: 107479 - DNA, 7 bp, Unknown
  misc_feature (1)..( 7): Result.002 file - promoters60/1379166
ttgttat

SEQ ID NO: 107480 - DNA, 7 bp, Unknown
  misc_feature (1)..( 7): Result.002 file - promoters60/1379166
ttgctat

SEQ ID NO: 107481 - DNA, 7 bp, Unknown
  misc_feature (1)..( 7): Result.002 file - promoters60/1379166
gttttgt

SEQ ID NO: 107482 - DNA, 7 bp, Unknown
  misc_feature (1)..( 7): Result.002 file - promoters60/1379166
gttttgt

SEQ ID NO: 107483 - DNA, 7 bp, Unknown
  misc_feature (1)..( 7): Result.002 file - promoters60/1379166
aaattaa

SEQ ID NO: 107484 - DNA, 7 bp, Unknown
  misc_feature (1)..( 7): Result.002 file - promoters60/1379166
aaattaa

SEQ ID NO: 107485 - DNA, 6 bp, Unknown
  misc_feature (1)..( 6): Result.002 file - promoters60/1379166
atctcc

SEQ ID NO: 107486 - DNA, 6 bp, Unknown
  misc_feature (1)..( 6): Result.002 file - promoters60/1379166
atctcc

SEQ ID NO: 107487 - DNA, 6 bp, Unknown
  misc_feature (1)..( 6): Result.002 file - promoters60/1379166
ctaaat

SEQ ID NO: 107488 - DNA, 6 bp, Unknown
  misc_feature (1)..( 6): Result.002 file - promoters60/1379166
ctaaat

SEQ ID NO: 107489 - DNA, 6 bp, Unknown
  misc_feature (1)..( 6): Result.002 file - promoters60/1379166
attttg

SEQ ID NO: 107490 - DNA, 6 bp, Unknown
  misc_feature (1)..( 6): Result.002 file - promoters60/1379166
attttg

SEQ ID NO: 107491 - DNA, 6 bp, Unknown
  misc_feature (1)..( 6): Result.002 file - promoters60/1379166
tttgtt

SEQ ID NO: 107492 - DNA, 6 bp, Unknown
  misc_feature (1)..( 6): Result.002 file - promoters60/1379166
tttgtt

SEQ ID NO: 107493 - DNA, 8 bp, Unknown
  misc_feature (1)..( 8): Result.002 file - promoters60/1379166
cattgtta

SEQ ID NO: 107494 - DNA, 8 bp, Unknown
  misc_feature (1)..( 8): Result.002 file - promoters60/1379166
cattgtta

SEQ ID NO: 107495 - DNA, 7 bp, Unknown
  misc_feature (1)..( 7): Result.002 file - promoters60/1379166
aacaaaa

SEQ ID NO: 107496 - DNA, 7 bp, Unknown
  misc_feature (1)..( 7): Result.002 file - promoters60/1379166
aactaaa

SEQ ID NO: 107497 - DNA, 7 bp, Unknown
  misc_feature (1)..( 7): Result.002 file - promoters60/1379166
aaatctt

SEQ ID NO: 107498 - DNA, 7 bp, Unknown
  misc_feature (1)..( 7): Result.002 file - promoters60/1379166
aaaactt

SEQ ID NO: 107499 - DNA, 6 bp, Unknown
  misc_feature (1)..( 6): Result.002 file - promoters60/1379166
ttattg

SEQ ID NO: 107500 - DNA, 6 bp, Unknown
  misc_feature (1)..( 6): Result.002 file - promoters60/1379166
ttattg

SEQ ID NO: 107501 - DNA, 6 bp, Unknown
  misc_feature (1)..( 6): Result.002 file - promoters60/1379166
agaaga

SEQ ID NO: 107502 - DNA, 6 bp, Unknown
  misc_feature (1)..( 6): Result.002 file - promoters60/1379166
agaaga

SEQ ID NO: 107503 - DNA, 6 bp, Unknown
  misc_feature (1)..( 6): Result.002 file - promoters60/1379166
tggtta

SEQ ID NO: 107504 - DNA, 6 bp, Unknown
  misc_feature (1)..( 6): Result.002 file - promoters60/1379166
tggtta

SEQ ID NO: 107505 - DNA, 8 bp, Unknown
  misc_feature (1)..( 8): Result.002 file - promoters60/1379166
atcgagaa

SEQ ID NO: 107506 - DNA, 8 bp, Unknown
  misc_feature (1)..( 8): Result.002 file - promoters60/1379166
atcgcgaa

SEQ ID NO: 107507 - DNA, 6 bp, Unknown
  misc_feature (1)..( 6): Result.002 file - promoters60/1379166
cgattc

SEQ ID NO: 107508 - DNA, 6 bp, Unknown
  misc_feature (1)..( 6): Result.002 file - promoters60/1379166
cgattc

SEQ ID NO: 107509 - DNA, 7 bp, Unknown
  misc_feature (1)..( 7): Result.002 file - promoters60/1379166
tccgaag

SEQ ID NO: 107510 - DNA, 7 bp, Unknown
  misc_feature (1)..( 7): Result.002 file - promoters60/1379166
tccaaag

SEQ ID NO: 107511 - DNA, 7 bp, Unknown
  misc_feature (1)..( 7): Result.002 file - promoters60/1379166
aaaacaa

SEQ ID NO: 107512 - DNA, 7 bp, Unknown
  misc_feature (1)..( 7): Result.002 file - promoters60/1379166
aaaccaa

SEQ ID NO: 107513 - DNA, 12 bp, Unknown
  misc_feature (1)..( 12): Result.002 file - promoters60/1379201
caaatttgccaa

SEQ ID NO: 107514 - DNA, 12 bp, Unknown
  misc_feature (1)..( 12): Result.002 file - promoters60/1379201
caaattacggag

SEQ ID NO: 107515 - DNA, 12 bp, Unknown
  misc_feature (1)..( 12): Result.002 file - promoters60/1379201
aaaatacgaaga

SEQ ID NO: 107516 - DNA, 8 bp, Unknown
  misc_feature (1)..( 8): Result.002 file - promoters60/1379201
acatttta

SEQ ID NO: 107517 - DNA, 8 bp, Unknown
  misc_feature (1)..( 8): Result.002 file - promoters60/1379201
acatttct

SEQ ID NO: 107518 - DNA, 8 bp, Unknown
  misc_feature (1)..( 8): Result.002 file - promoters60/1379201
ccatttta

SEQ ID NO: 107519 - DNA, 12 bp, Unknown
  misc_feature (1)..( 12): Result.002 file - promoters60/1379201
ggtcaacgaagt

SEQ ID NO: 107520 - DNA, 12 bp, Unknown
  misc_feature (1)..( 12): Result.002 file - promoters60/1379201
aaaatacgaaga

SEQ ID NO: 107521 - DNA, 12 bp, Unknown
  misc_feature (1)..( 12): Result.002 file - promoters60/1379201
aaattacggaga

SEQ ID NO: 107522 - DNA, 10 bp, Unknown
  misc_feature (1)..( 10): Result.002 file - promoters60/1379201
ccgaatctga

SEQ ID NO: 107523 - DNA, 10 bp, Unknown
  misc_feature (1)..( 10): Result.002 file - promoters60/1379201
ccgattctct

SEQ ID NO: 107524 - DNA, 10 bp, Unknown
  misc_feature (1)..( 10): Result.002 file - promoters60/1379201
tagatgctct

SEQ ID NO: 107525 - DNA, 6 bp, Unknown
  misc_feature (1)..( 6): Result.002 file - promoters60/1379229
atttat

SEQ ID NO: 107526 - DNA, 6 bp, Unknown
  misc_feature (1)..( 6): Result.002 file - promoters60/1379229
atttat

SEQ ID NO: 107527 - DNA, 7 bp, Unknown
  misc_feature (1)..( 7): Result.002 file - promoters60/1379229
taataga

SEQ ID NO: 107528 - DNA, 7 bp, Unknown
  misc_feature (1)..( 7): Result.002 file - promoters60/1379229
taaaaga

SEQ ID NO: 107529 - DNA, 8 bp, Unknown
  misc_feature (1)..( 8): Result.002 file - promoters60/1379229
tttaaaaa

SEQ ID NO: 107530 - DNA, 8 bp, Unknown
  misc_feature (1)..( 8): Result.002 file - promoters60/1379229
tttaaaaa

SEQ ID NO: 107531 - DNA, 6 bp, Unknown
  misc_feature (1)..( 6): Result.002 file - promoters60/1379229
tgaaat

SEQ ID NO: 107532 - DNA, 6 bp, Unknown
  misc_feature (1)..( 6): Result.002 file - promoters60/1379229
tgaaat

SEQ ID NO: 107533 - DNA, 9 bp, Unknown
  misc_feature (1)..( 9): Result.002 file - promoters60/1379229
acaaaagaa

SEQ ID NO: 107534 - DNA, 9 bp, Unknown
  misc_feature (1)..( 9): Result.002 file - promoters60/1379229
acaaaagaa

SEQ ID NO: 107535 - DNA, 9 bp, Unknown
  misc_feature (1)..( 9): Result.002 file - promoters60/1379229
ggtcccacc

SEQ ID NO: 107536 - DNA, 9 bp, Unknown
  misc_feature (1)..( 9): Result.002 file - promoters60/1379229
ggtcacacc

SEQ ID NO: 107537 - DNA, 6 bp, Unknown
  misc_feature (1)..( 6): Result.002 file - promoters60/1379229
ataatt

SEQ ID NO: 107538 - DNA, 6 bp, Unknown
  misc_feature (1)..( 6): Result.002 file - promoters60/1379229
ataatt

SEQ ID NO: 107539 - DNA, 6 bp, Unknown
  misc_feature (1)..( 6): Result.002 file - promoters60/1379229
tgaaga

SEQ ID NO: 107540 - DNA, 6 bp, Unknown
  misc_feature (1)..( 6): Result.002 file - promoters60/1379229
tgaaga

SEQ ID NO: 107541 - DNA, 6 bp, Unknown
  misc_feature (1)..( 6): Result.002 file - promoters60/1379229
acaaat

SEQ ID NO: 107542 - DNA, 6 bp, Unknown
  misc_feature (1)..( 6): Result.002 file - promoters60/1379229
acaaat

SEQ ID NO: 107543 - DNA, 6 bp, Unknown
  misc_feature (1)..( 6): Result.002 file - promoters60/1379229
gatacc

SEQ ID NO: 107544 - DNA, 6 bp, Unknown
  misc_feature (1)..( 6): Result.002 file - promoters60/1379229
gatacc

SEQ ID NO: 107545 - DNA, 6 bp, Unknown
  misc_feature (1)..( 6): Result.002 file - promoters60/1379229
tagata

SEQ ID NO: 107546 - DNA, 6 bp, Unknown
  misc_feature (1)..( 6): Result.002 file - promoters60/1379229
tagata

SEQ ID NO: 107547 - DNA, 9 bp, Unknown
  misc_feature (1)..( 9): Result.002 file - promoters60/1379229
actaaactc

SEQ ID NO: 107548 - DNA, 9 bp, Unknown
  misc_feature (1)..( 9): Result.002 file - promoters60/1379229
actacactc

SEQ ID NO: 107549 - DNA, 6 bp, Unknown
  misc_feature (1)..( 6): Result.002 file - promoters60/1379239
atttta

SEQ ID NO: 107550 - DNA, 6 bp, Unknown
  misc_feature (1)..( 6): Result.002 file - promoters60/1379239
atttta

SEQ ID NO: 107551 - DNA, 9 bp, Unknown
  misc_feature (1)..( 9): Result.002 file - promoters60/1379239
aaattaaac

SEQ ID NO: 107552 - DNA, 9 bp, Unknown
  misc_feature (1)..( 9): Result.002 file - promoters60/1379239
aaatcaaat

SEQ ID NO: 107553 - DNA, 9 bp, Unknown
  misc_feature (1)..( 9): Result.002 file - promoters60/1379239
ctattaaac

SEQ ID NO: 107554 - DNA, 6 bp, Unknown
  misc_feature (1)..( 6): Result.002 file - promoters60/1379239
agttaa

SEQ ID NO: 107555 - DNA, 6 bp, Unknown
  misc_feature (1)..( 6): Result.002 file - promoters60/1379239
agttaa

SEQ ID NO: 107556 - DNA, 9 bp, Unknown
  misc_feature (1)..( 9): Result.002 file - promoters60/1379239
atacccggt

SEQ ID NO: 107557 - DNA, 9 bp, Unknown
  misc_feature (1)..( 9): Result.002 file - promoters60/1379239
atacgcggt

SEQ ID NO: 107558 - DNA, 9 bp, Unknown
  misc_feature (1)..( 9): Result.002 file - promoters60/1379239
tataaaaac

SEQ ID NO: 107559 - DNA, 9 bp, Unknown
  misc_feature (1)..( 9): Result.002 file - promoters60/1379239
tataaacac

SEQ ID NO: 107560 - DNA, 9 bp, Unknown
  misc_feature (1)..( 9): Result.002 file - promoters60/1379239
gataaaaac

SEQ ID NO: 107561 - DNA, 6 bp, Unknown
  misc_feature (1)..( 6): Result.002 file - promoters60/1379239
ttggaa

SEQ ID NO: 107562 - DNA, 6 bp, Unknown
  misc_feature (1)..( 6): Result.002 file - promoters60/1379239
ttggaa

SEQ ID NO: 107563 - DNA, 8 bp, Unknown
  misc_feature (1)..( 8): Result.002 file - promoters60/1379239
aactttag

SEQ ID NO: 107564 - DNA, 8 bp, Unknown
  misc_feature (1)..( 8): Result.002 file - promoters60/1379239
aacattag

SEQ ID NO: 107565 - DNA, 8 bp, Unknown
  misc_feature (1)..( 8): Result.002 file - promoters60/1379239
caataaat

SEQ ID NO: 107566 - DNA, 8 bp, Unknown
  misc_feature (1)..( 8): Result.002 file - promoters60/1379239
caatcaat

SEQ ID NO: 107567 - DNA, 7 bp, Unknown
  misc_feature (1)..( 7): Result.002 file - promoters60/1379239
tccaatt

SEQ ID NO: 107568 - DNA, 7 bp, Unknown
  misc_feature (1)..( 7): Result.002 file - promoters60/1379239
tccaatt

SEQ ID NO: 107569 - DNA, 6 bp, Unknown
  misc_feature (1)..( 6): Result.002 file - promoters60/1379239
tttgtt

SEQ ID NO: 107570 - DNA, 6 bp, Unknown
  misc_feature (1)..( 6): Result.002 file - promoters60/1379239
tttgtt

SEQ ID NO: 107571 - DNA, 8 bp, Unknown
  misc_feature (1)..( 8): Result.002 file - promoters60/1379239
gaaagaaa

SEQ ID NO: 107572 - DNA, 8 bp, Unknown
  misc_feature (1)..( 8): Result.002 file - promoters60/1379239
taaacaaa

SEQ ID NO: 107573 - DNA, 8 bp, Unknown
  misc_feature (1)..( 8): Result.002 file - promoters60/1379239
acaacaaa

SEQ ID NO: 107574 - DNA, 6 bp, Unknown
  misc_feature (1)..( 6): Result.002 file - promoters60/1379239
cagaaa

SEQ ID NO: 107575 - DNA, 6 bp, Unknown
  misc_feature (1)..( 6): Result.002 file - promoters60/1379239
cagaaa

SEQ ID NO: 107576 - DNA, 7 bp, Unknown
  misc_feature (1)..( 7): Result.002 file - promoters60/1379239
ttctaga

SEQ ID NO: 107577 - DNA, 7 bp, Unknown
  misc_feature (1)..( 7): Result.002 file - promoters60/1379239
ttcaaga

SEQ ID NO: 107578 - DNA, 8 bp, Unknown
  misc_feature (1)..( 8): Result.002 file - promoters60/1379239
aatctctc

SEQ ID NO: 107579 - DNA, 8 bp, Unknown
  misc_feature (1)..( 8): Result.002 file - promoters60/1379239
aatatctc

SEQ ID NO: 107580 - DNA, 6 bp, Unknown
  misc_feature (1)..( 6): Result.002 file - promoters60/1379239
taatgt

SEQ ID NO: 107581 - DNA, 6 bp, Unknown
  misc_feature (1)..( 6): Result.002 file - promoters60/1379239
taatgt

SEQ ID NO: 107582 - DNA, 6 bp, Unknown
  misc_feature (1)..( 6): Result.002 file - promoters60/1379239
tcgact

SEQ ID NO: 107583 - DNA, 6 bp, Unknown
  misc_feature (1)..( 6): Result.002 file - promoters60/1379239
tcgact

SEQ ID NO: 107584 - DNA, 8 bp, Unknown
  misc_feature (1)..( 8): Result.002 file - promoters60/1379239
aaattata

SEQ ID NO: 107585 - DNA, 8 bp, Unknown
  misc_feature (1)..( 8): Result.002 file - promoters60/1379239
aaataata

SEQ ID NO: 107586 - DNA, 7 bp, Unknown
  misc_feature (1)..( 7): Result.002 file - promoters60/1379239
tatagct

SEQ ID NO: 107587 - DNA, 7 bp, Unknown
  misc_feature (1)..( 7): Result.002 file - promoters60/1379239
tatcgct

SEQ ID NO: 107588 - DNA, 9 bp, Unknown
  misc_feature (1)..( 9): Result.002 file - promoters60/1379607
tttctaaaa

SEQ ID NO: 107589 - DNA, 9 bp, Unknown
  misc_feature (1)..( 9): Result.002 file - promoters60/1379607
tagctaaaa

SEQ ID NO: 107590 - DNA, 9 bp, Unknown
  misc_feature (1)..( 9): Result.002 file - promoters60/1379607
tttataaac

SEQ ID NO: 107591 - DNA, 9 bp, Unknown
  misc_feature (1)..( 9): Result.002 file - promoters60/1379607
gttataaag

SEQ ID NO: 107592 - DNA, 8 bp, Unknown
  misc_feature (1)..( 8): Result.002 file - promoters60/1379607
ttaattta

SEQ ID NO: 107593 - DNA, 8 bp, Unknown
  misc_feature (1)..( 8): Result.002 file - promoters60/1379607
ttaattaa

SEQ ID NO: 107594 - DNA, 8 bp, Unknown
  misc_feature (1)..( 8): Result.002 file - promoters60/1379607
ataatttc

SEQ ID NO: 107595 - DNA, 8 bp, Unknown
  misc_feature (1)..( 8): Result.002 file - promoters60/1379607
taaattaa

SEQ ID NO: 107596 - DNA, 8 bp, Unknown
  misc_feature (1)..( 8): Result.002 file - promoters60/1379607
taatttaa

SEQ ID NO: 107597 - DNA, 8 bp, Unknown
  misc_feature (1)..( 8): Result.002 file - promoters60/1379607
aaatttaa

SEQ ID NO: 107598 - DNA, 8 bp, Unknown
  misc_feature (1)..( 8): Result.002 file - promoters60/1379607
taatttcc

SEQ ID NO: 107599 - DNA, 8 bp, Unknown
  misc_feature (1)..( 8): Result.002 file - promoters60/1379607
taaattaa

SEQ ID NO: 107600 - DNA, 7 bp, Unknown
  misc_feature (1)..( 7): Result.002 file - promoters60/1379671
tggcgag

SEQ ID NO: 107601 - DNA, 7 bp, Unknown
  misc_feature (1)..( 7): Result.002 file - promoters60/1379671
tggagag

SEQ ID NO: 107602 - DNA, 6 bp, Unknown
  misc_feature (1)..( 6): Result.002 file - promoters60/1379671
agtatc

SEQ ID NO: 107603 - DNA, 6 bp, Unknown
  misc_feature (1)..( 6): Result.002 file - promoters60/1379671
agtatc

SEQ ID NO: 107604 - DNA, 7 bp, Unknown
  misc_feature (1)..( 7): Result.002 file - promoters60/1379671
tgatctt

SEQ ID NO: 107605 - DNA, 7 bp, Unknown
  misc_feature (1)..( 7): Result.002 file - promoters60/1379671
tgatctt

SEQ ID NO: 107606 - DNA, 7 bp, Unknown
  misc_feature (1)..( 7): Result.002 file - promoters60/1379671
acagagt

SEQ ID NO: 107607 - DNA, 7 bp, Unknown
  misc_feature (1)..( 7): Result.002 file - promoters60/1379671
acaaagt

SEQ ID NO: 107608 - DNA, 6 bp, Unknown
  misc_feature (1)..( 6): Result.002 file - promoters60/1379671
attatt

SEQ ID NO: 107609 - DNA, 6 bp, Unknown
  misc_feature (1)..( 6): Result.002 file - promoters60/1379671
attatt

SEQ ID NO: 107610 - DNA, 7 bp, Unknown
  misc_feature (1)..( 7): Result.002 file - promoters60/1379671
attgtgt

SEQ ID NO: 107611 - DNA, 7 bp, Unknown
  misc_feature (1)..( 7): Result.002 file - promoters60/1379671
attttgt

SEQ ID NO: 107612 - DNA, 6 bp, Unknown
  misc_feature (1)..( 6): Result.002 file - promoters60/1379671
cttcag

SEQ ID NO: 107613 - DNA, 6 bp, Unknown
  misc_feature (1)..( 6): Result.002 file - promoters60/1379671
cttcag

SEQ ID NO: 107614 - DNA, 6 bp, Unknown
  misc_feature (1)..( 6): Result.002 file - promoters60/1379671
ttaata

SEQ ID NO: 107615 - DNA, 6 bp, Unknown
  misc_feature (1)..( 6): Result.002 file - promoters60/1379671
ttaata

SEQ ID NO: 107616 - DNA, 9 bp, Unknown
  misc_feature (1)..( 9): Result.002 file - promoters60/1379671
gaatatatt

SEQ ID NO: 107617 - DNA, 9 bp, Unknown
  misc_feature (1)..( 9): Result.002 file - promoters60/1379671
gaataaatt

SEQ ID NO: 107618 - DNA, 7 bp, Unknown
  misc_feature (1)..( 7): Result.002 file - promoters60/1379671
caccacc

SEQ ID NO: 107619 - DNA, 7 bp, Unknown
  misc_feature (1)..( 7): Result.002 file - promoters60/1379671
caccacc

SEQ ID NO: 107620 - DNA, 7 bp, Unknown
  misc_feature (1)..( 7): Result.002 file - promoters60/1379671
gtatcaa

SEQ ID NO: 107621 - DNA, 7 bp, Unknown
  misc_feature (1)..( 7): Result.002 file - promoters60/1379671
gtatcaa

SEQ ID NO: 107622 - DNA, 9 bp, Unknown
  misc_feature (1)..( 9): Result.002 file - promoters60/1379671
aattaccaa

SEQ ID NO: 107623 - DNA, 9 bp, Unknown
  misc_feature (1)..( 9): Result.002 file - promoters60/1379671
aataaccaa

SEQ ID NO: 107624 - DNA, 8 bp, Unknown
  misc_feature (1)..( 8): Result.002 file - promoters60/1379671
cagctatt

SEQ ID NO: 107625 - DNA, 8 bp, Unknown
  misc_feature (1)..( 8): Result.002 file - promoters60/1379671
cagttatt

SEQ ID NO: 107626 - DNA, 7 bp, Unknown
  misc_feature (1)..( 7): Result.002 file - promoters60/1379671
attgttg

SEQ ID NO: 107627 - DNA, 7 bp, Unknown
  misc_feature (1)..( 7): Result.002 file - promoters60/1379671
atttttg

SEQ ID NO: 107628 - DNA, 8 bp, Unknown
  misc_feature (1)..( 8): Result.002 file - promoters60/1379671
catataaa

SEQ ID NO: 107629 - DNA, 8 bp, Unknown
  misc_feature (1)..( 8): Result.002 file - promoters60/1379671
cataaaaa

SEQ ID NO: 107630 - DNA, 7 bp, Unknown
  misc_feature (1)..( 7): Result.002 file - promoters60/1379671
acagatt

SEQ ID NO: 107631 - DNA, 7 bp, Unknown
  misc_feature (1)..( 7): Result.002 file - promoters60/1379671
acatatt

SEQ ID NO: 107632 - DNA, 7 bp, Unknown
  misc_feature (1)..( 7): Result.002 file - promoters60/1379671
tttagtt

SEQ ID NO: 107633 - DNA, 7 bp, Unknown
  misc_feature (1)..( 7): Result.002 file - promoters60/1379671
ttttgtt

SEQ ID NO: 107634 - DNA, 8 bp, Unknown
  misc_feature (1)..( 8): Result.002 file - promoters60/1379671
ttcacaaa

SEQ ID NO: 107635 - DNA, 8 bp, Unknown
  misc_feature (1)..( 8): Result.002 file - promoters60/1379671
ttcaaaaa

SEQ ID NO: 107636 - DNA, 7 bp, Unknown
  misc_feature (1)..( 7): Result.002 file - promoters60/1379818
agatcgt

SEQ ID NO: 107637 - DNA, 7 bp, Unknown
  misc_feature (1)..( 7): Result.002 file - promoters60/1379818
agaacgt

SEQ ID NO: 107638 - DNA, 6 bp, Unknown
  misc_feature (1)..( 6): Result.002 file - promoters60/1379818
gttttg

SEQ ID NO: 107639 - DNA, 6 bp, Unknown
  misc_feature (1)..( 6): Result.002 file - promoters60/1379818
gttttg

SEQ ID NO: 107640 - DNA, 6 bp, Unknown
  misc_feature (1)..( 6): Result.002 file - promoters60/1379818
tgtata

SEQ ID NO: 107641 - DNA, 6 bp, Unknown
  misc_feature (1)..( 6): Result.002 file - promoters60/1379818
tgtata

SEQ ID NO: 107642 - DNA, 8 bp, Unknown
  misc_feature (1)..( 8): Result.002 file - promoters60/1379818
tgtcaatt

SEQ ID NO: 107643 - DNA, 8 bp, Unknown
  misc_feature (1)..( 8): Result.002 file - promoters60/1379818
tgtcaatt

SEQ ID NO: 107644 - DNA, 6 bp, Unknown
  misc_feature (1)..( 6): Result.002 file - promoters60/1379818
aattca

SEQ ID NO: 107645 - DNA, 6 bp, Unknown
  misc_feature (1)..( 6): Result.002 file - promoters60/1379818
aattca

SEQ ID NO: 107646 - DNA, 6 bp, Unknown
  misc_feature (1)..( 6): Result.002 file - promoters60/1379818
ttttta

SEQ ID NO: 107647 - DNA, 6 bp, Unknown
  misc_feature (1)..( 6): Result.002 file - promoters60/1379818
ttttta

SEQ ID NO: 107648 - DNA, 9 bp, Unknown
  misc_feature (1)..( 9): Result.002 file - promoters60/1379818
aaaatctct

SEQ ID NO: 107649 - DNA, 9 bp, Unknown
  misc_feature (1)..( 9): Result.002 file - promoters60/1379818
aaaatctct

SEQ ID NO: 107650 - DNA, 6 bp, Unknown
  misc_feature (1)..( 6): Result.002 file - promoters60/1379818
gaatta

SEQ ID NO: 107651 - DNA, 6 bp, Unknown
  misc_feature (1)..( 6): Result.002 file - promoters60/1379818
gaatta

SEQ ID NO: 107652 - DNA, 8 bp, Unknown
  misc_feature (1)..( 8): Result.002 file - promoters60/1379818
attttttt

SEQ ID NO: 107653 - DNA, 8 bp, Unknown
  misc_feature (1)..( 8): Result.002 file - promoters60/1379818
atttattt

SEQ ID NO: 107654 - DNA, 11 bp, Unknown
  misc_feature (1)..( 11): Result.002 file - promoters60/1379818
tactgttttag

SEQ ID NO: 107655 - DNA, 11 bp, Unknown
  misc_feature (1)..( 11): Result.002 file - promoters60/1379818
tactgtattag

SEQ ID NO: 107656 - DNA, 6 bp, Unknown
  misc_feature (1)..( 6): Result.002 file - promoters60/1379818
aatatt

SEQ ID NO: 107657 - DNA, 6 bp, Unknown
  misc_feature (1)..( 6): Result.002 file - promoters60/1379818
aatatt

SEQ ID NO: 107658 - DNA, 6 bp, Unknown
  misc_feature (1)..( 6): Result.002 file - promoters60/1379818
tataat

SEQ ID NO: 107659 - DNA, 6 bp, Unknown
  misc_feature (1)..( 6): Result.002 file - promoters60/1379818
tataat

SEQ ID NO: 107660 - DNA, 8 bp, Unknown
  misc_feature (1)..( 8): Result.002 file - promoters60/1379818
taatatta

SEQ ID NO: 107661 - DNA, 8 bp, Unknown
  misc_feature (1)..( 8): Result.002 file - promoters60/1379818
taatctta

SEQ ID NO: 107662 - DNA, 8 bp, Unknown
  misc_feature (1)..( 8): Result.002 file - promoters60/1379818
attaaaaa

SEQ ID NO: 107663 - DNA, 8 bp, Unknown
  misc_feature (1)..( 8): Result.002 file - promoters60/1379818
attagaaa

SEQ ID NO: 107664 - DNA, 6 bp, Unknown
  misc_feature (1)..( 6): Result.002 file - promoters60/1379981
cgatta

SEQ ID NO: 107665 - DNA, 6 bp, Unknown
  misc_feature (1)..( 6): Result.002 file - promoters60/1379981
cgatta

SEQ ID NO: 107666 - DNA, 6 bp, Unknown
  misc_feature (1)..( 6): Result.002 file - promoters60/1379981
atttaa

SEQ ID NO: 107667 - DNA, 6 bp, Unknown
  misc_feature (1)..( 6): Result.002 file - promoters60/1379981
atttaa

SEQ ID NO: 107668 - DNA, 7 bp, Unknown
  misc_feature (1)..( 7): Result.002 file - promoters60/1379981
tcatttt

SEQ ID NO: 107669 - DNA, 7 bp, Unknown
  misc_feature (1)..( 7): Result.002 file - promoters60/1379981
tcatttt

SEQ ID NO: 107670 - DNA, 8 bp, Unknown
  misc_feature (1)..( 8): Result.002 file - promoters60/1379981
ttttaata

SEQ ID NO: 107671 - DNA, 8 bp, Unknown
  misc_feature (1)..( 8): Result.002 file - promoters60/1379981
ttttaaga

SEQ ID NO: 107672 - DNA, 8 bp, Unknown
  misc_feature (1)..( 8): Result.002 file - promoters60/1379981
ctttatta

SEQ ID NO: 107673 - DNA, 7 bp, Unknown
  misc_feature (1)..( 7): Result.002 file - promoters60/1379981
gttatgt

SEQ ID NO: 107674 - DNA, 7 bp, Unknown
  misc_feature (1)..( 7): Result.002 file - promoters60/1379981
gttatgt

SEQ ID NO: 107675 - DNA, 9 bp, Unknown
  misc_feature (1)..( 9): Result.002 file - promoters60/1379981
attaataaa

SEQ ID NO: 107676 - DNA, 9 bp, Unknown
  misc_feature (1)..( 9): Result.002 file - promoters60/1379981
atttataaa

SEQ ID NO: 107677 - DNA, 10 bp, Unknown
  misc_feature (1)..( 10): Result.002 file - promoters60/1379981
ctaataaatt

SEQ ID NO: 107678 - DNA, 10 bp, Unknown
  misc_feature (1)..( 10): Result.002 file - promoters60/1379981
tttttaaatt

SEQ ID NO: 107679 - DNA, 10 bp, Unknown
  misc_feature (1)..( 10): Result.002 file - promoters60/1379981
aaagtaaaca

SEQ ID NO: 107680 - DNA, 8 bp, Unknown
  misc_feature (1)..( 8): Result.002 file - promoters60/1379981
cattcttt

SEQ ID NO: 107681 - DNA, 8 bp, Unknown
  misc_feature (1)..( 8): Result.002 file - promoters60/1379981
catttttt

SEQ ID NO: 107682 - DNA, 7 bp, Unknown
  misc_feature (1)..( 7): Result.002 file - promoters60/1379981
tgtttca

SEQ ID NO: 107683 - DNA, 7 bp, Unknown
  misc_feature (1)..( 7): Result.002 file - promoters60/1379981
tgtttca

SEQ ID NO: 107684 - DNA, 10 bp, Unknown
  misc_feature (1)..( 10): Result.002 file - promoters60/1379981
cttaaataat

SEQ ID NO: 107685 - DNA, 10 bp, Unknown
  misc_feature (1)..( 10): Result.002 file - promoters60/1379981
cttaaatatt

SEQ ID NO: 107686 - DNA, 10 bp, Unknown
  misc_feature (1)..( 10): Result.002 file - promoters60/1379981
cacaaagaat

SEQ ID NO: 107687 - DNA, 7 bp, Unknown
  misc_feature (1)..( 7): Result.002 file - promoters60/1379981
aatgttt

SEQ ID NO: 107688 - DNA, 7 bp, Unknown
  misc_feature (1)..( 7): Result.002 file - promoters60/1379981
aatattt

SEQ ID NO: 107689 - DNA, 7 bp, Unknown
  misc_feature (1)..( 7): Result.002 file - promoters60/1379981
ttctttc

SEQ ID NO: 107690 - DNA, 7 bp, Unknown
  misc_feature (1)..( 7): Result.002 file - promoters60/1379981
ttcattc

SEQ ID NO: 107691 - DNA, 6 bp, Unknown
  misc_feature (1)..( 6): Result.002 file - promoters60/1379981
aaatct

SEQ ID NO: 107692 - DNA, 6 bp, Unknown
  misc_feature (1)..( 6): Result.002 file - promoters60/1379981
aaatct

SEQ ID NO: 107693 - DNA, 7 bp, Unknown
  misc_feature (1)..( 7): Result.002 file - promoters60/1379981
atatata

SEQ ID NO: 107694 - DNA, 7 bp, Unknown
  misc_feature (1)..( 7): Result.002 file - promoters60/1379981
ataaata

SEQ ID NO: 107695 - DNA, 6 bp, Unknown
  misc_feature (1)..( 6): Result.002 file - promoters60/1379981
aatttt

SEQ ID NO: 107696 - DNA, 6 bp, Unknown
  misc_feature (1)..( 6): Result.002 file - promoters60/1379981
aatttt

SEQ ID NO: 107697 - DNA, 6 bp, Unknown
  misc_feature (1)..( 6): Result.002 file - promoters60/1379981
aaaaag

SEQ ID NO: 107698 - DNA, 6 bp, Unknown
  misc_feature (1)..( 6): Result.002 file - promoters60/1379981
aaaaag

SEQ ID NO: 107699 - DNA, 7 bp, Unknown
  misc_feature (1)..( 7): Result.002 file - promoters60/1379981
aagctat

SEQ ID NO: 107700 - DNA, 7 bp, Unknown
  misc_feature (1)..( 7): Result.002 file - promoters60/1379981
aagatat

SEQ ID NO: 107701 - DNA, 7 bp, Unknown
  misc_feature (1)..( 7): Result.002 file - promoters60/1379981
aaagcac

SEQ ID NO: 107702 - DNA, 7 bp, Unknown
  misc_feature (1)..( 7): Result.002 file - promoters60/1379981
aaaccac

SEQ ID NO: 107703 - DNA, 8 bp, Unknown
  misc_feature (1)..( 8): Result.002 file - promoters60/1379981
aaaataag

SEQ ID NO: 107704 - DNA, 8 bp, Unknown
  misc_feature (1)..( 8): Result.002 file - promoters60/1379981
aaactaag

SEQ ID NO: 107705 - DNA, 8 bp, Unknown
  misc_feature (1)..( 8): Result.002 file - promoters60/1379981
taagttgt

SEQ ID NO: 107706 - DNA, 8 bp, Unknown
  misc_feature (1)..( 8): Result.002 file - promoters60/1379981
taaattgt

SEQ ID NO: 107707 - DNA, 6 bp, Unknown
  misc_feature (1)..( 6): Result.002 file - promoters60/1379981
atagat

SEQ ID NO: 107708 - DNA, 6 bp, Unknown
  misc_feature (1)..( 6): Result.002 file - promoters60/1379981
atagat

SEQ ID NO: 107709 - DNA, 7 bp, Unknown
  misc_feature (1)..( 7): Result.002 file - promoters60/1379981
agatata

SEQ ID NO: 107710 - DNA, 7 bp, Unknown
  misc_feature (1)..( 7): Result.002 file - promoters60/1379981
agagata

SEQ ID NO: 107711 - DNA, 6 bp, Unknown
  misc_feature (1)..( 6): Result.002 file - promoters60/1379981
ttttgg

SEQ ID NO: 107712 - DNA, 6 bp, Unknown
  misc_feature (1)..( 6): Result.002 file - promoters60/1379981
ttttgg

SEQ ID NO: 107713 - DNA, 6 bp, Unknown
  misc_feature (1)..( 6): Result.002 file - promoters60/1379981
taagat

SEQ ID NO: 107714 - DNA, 6 bp, Unknown
  misc_feature (1)..( 6): Result.002 file - promoters60/1379981
taagat

SEQ ID NO: 107715 - DNA, 6 bp, Unknown
  misc_feature (1)..( 6): Result.002 file - promoters60/1379981
aaagaa

SEQ ID NO: 107716 - DNA, 6 bp, Unknown
  misc_feature (1)..( 6): Result.002 file - promoters60/1379981
aaagaa

SEQ ID NO: 107717 - DNA, 12 bp, Unknown
  misc_feature (1)..( 12): Result.002 file - promoters60/1379981
aaaaacaaaaca

SEQ ID NO: 107718 - DNA, 12 bp, Unknown
  misc_feature (1)..( 12): Result.002 file - promoters60/1379981
aaacacaataca

SEQ ID NO: 107719 - DNA, 6 bp, Unknown
  misc_feature (1)..( 6): Result.002 file - promoters60/1379981
aaaaat

SEQ ID NO: 107720 - DNA, 6 bp, Unknown
  misc_feature (1)..( 6): Result.002 file - promoters60/1379981
aaaaat

SEQ ID NO: 107721 - DNA, 6 bp, Unknown
  misc_feature (1)..( 6): Result.002 file - promoters60/1379981
taaccc

SEQ ID NO: 107722 - DNA, 6 bp, Unknown
  misc_feature (1)..( 6): Result.002 file - promoters60/1379981
taaccc

SEQ ID NO: 107723 - DNA, 6 bp, Unknown
  misc_feature (1)..( 6): Result.002 file - promoters60/1379998
aacata

SEQ ID NO: 107724 - DNA, 6 bp, Unknown
  misc_feature (1)..( 6): Result.002 file - promoters60/1379998
aacata

SEQ ID NO: 107725 - DNA, 6 bp, Unknown
  misc_feature (1)..( 6): Result.002 file - promoters60/1379998
gagata

SEQ ID NO: 107726 - DNA, 6 bp, Unknown
  misc_feature (1)..( 6): Result.002 file - promoters60/1379998
gagata

SEQ ID NO: 107727 - DNA, 7 bp, Unknown
  misc_feature (1)..( 7): Result.002 file - promoters60/1379998
tttataa

SEQ ID NO: 107728 - DNA, 7 bp, Unknown
  misc_feature (1)..( 7): Result.002 file - promoters60/1379998
tttgtaa

SEQ ID NO: 107729 - DNA, 6 bp, Unknown
  misc_feature (1)..( 6): Result.002 file - promoters60/1379998
caaaaa

SEQ ID NO: 107730 - DNA, 6 bp, Unknown
  misc_feature (1)..( 6): Result.002 file - promoters60/1379998
caaaaa

SEQ ID NO: 107731 - DNA, 8 bp, Unknown
  misc_feature (1)..( 8): Result.002 file - promoters60/1379998
gtcccaaa

SEQ ID NO: 107732 - DNA, 8 bp, Unknown
  misc_feature (1)..( 8): Result.002 file - promoters60/1379998
gtcacaaa

SEQ ID NO: 107733 - DNA, 6 bp, Unknown
  misc_feature (1)..( 6): Result.002 file - promoters60/1379998
atattt

SEQ ID NO: 107734 - DNA, 6 bp, Unknown
  misc_feature (1)..( 6): Result.002 file - promoters60/1379998
atattt

SEQ ID NO: 107735 - DNA, 7 bp, Unknown
  misc_feature (1)..( 7): Result.002 file - promoters60/1379998
aaaacaa

SEQ ID NO: 107736 - DNA, 7 bp, Unknown
  misc_feature (1)..( 7): Result.002 file - promoters60/1379998
aaatcaa

SEQ ID NO: 107737 - DNA, 6 bp, Unknown
  misc_feature (1)..( 6): Result.002 file - promoters60/1379998
agtaaa

SEQ ID NO: 107738 - DNA, 6 bp, Unknown
  misc_feature (1)..( 6): Result.002 file - promoters60/1379998
agtaaa

SEQ ID NO: 107739 - DNA, 6 bp, Unknown
  misc_feature (1)..( 6): Result.002 file - promoters60/1379998
ttccaa

SEQ ID NO: 107740 - DNA, 6 bp, Unknown
  misc_feature (1)..( 6): Result.002 file - promoters60/1379998
ttccaa

SEQ ID NO: 107741 - DNA, 6 bp, Unknown
  misc_feature (1)..( 6): Result.002 file - promoters60/1379998
gttttc

SEQ ID NO: 107742 - DNA, 6 bp, Unknown
  misc_feature (1)..( 6): Result.002 file - promoters60/1379998
gttttc

SEQ ID NO: 107743 - DNA, 7 bp, Unknown
  misc_feature (1)..( 7): Result.002 file - promoters60/1379998
tttcgaa

SEQ ID NO: 107744 - DNA, 7 bp, Unknown
  misc_feature (1)..( 7): Result.002 file - promoters60/1379998
tttcgaa

SEQ ID NO: 107745 - DNA, 8 bp, Unknown
  misc_feature (1)..( 8): Result.002 file - promoters60/1379998
ttttgttt

SEQ ID NO: 107746 - DNA, 8 bp, Unknown
  misc_feature (1)..( 8): Result.002 file - promoters60/1379998
ttttgttt

SEQ ID NO: 107747 - DNA, 6 bp, Unknown
  misc_feature (1)..( 6): Result.002 file - promoters60/1379998
tttgtt

SEQ ID NO: 107748 - DNA, 6 bp, Unknown
  misc_feature (1)..( 6): Result.002 file - promoters60/1379998
tttgtt

SEQ ID NO: 107749 - DNA, 7 bp, Unknown
  misc_feature (1)..( 7): Result.002 file - promoters60/1379998
aaagctt

SEQ ID NO: 107750 - DNA, 7 bp, Unknown
  misc_feature (1)..( 7): Result.002 file - promoters60/1379998
aaaactt

SEQ ID NO: 107751 - DNA, 7 bp, Unknown
  misc_feature (1)..( 7): Result.002 file - promoters60/1379998
atttaag

SEQ ID NO: 107752 - DNA, 7 bp, Unknown
  misc_feature (1)..( 7): Result.002 file - promoters60/1379998
attaaag

SEQ ID NO: 107753 - DNA, 6 bp, Unknown
  misc_feature (1)..( 6): Result.002 file - promoters60/1379998
agtaaa

SEQ ID NO: 107754 - DNA, 6 bp, Unknown
  misc_feature (1)..( 6): Result.002 file - promoters60/1379998
agtaaa

SEQ ID NO: 107755 - DNA, 7 bp, Unknown
  misc_feature (1)..( 7): Result.002 file - promoters60/1379998
aatcggg

SEQ ID NO: 107756 - DNA, 7 bp, Unknown
  misc_feature (1)..( 7): Result.002 file - promoters60/1379998
aattggg

SEQ ID NO: 107757 - DNA, 8 bp, Unknown
  misc_feature (1)..( 8): Result.002 file - promoters60/1379998
gaaagaaa

SEQ ID NO: 107758 - DNA, 8 bp, Unknown
  misc_feature (1)..( 8): Result.002 file - promoters60/1379998
gaaacaaa

SEQ ID NO: 107759 - DNA, 10 bp, Unknown
  misc_feature (1)..( 10): Result.002 file - promoters60/1379998
ggaaaagaaa

SEQ ID NO: 107760 - DNA, 10 bp, Unknown
  misc_feature (1)..( 10): Result.002 file - promoters60/1379998
ggaaatgaaa

SEQ ID NO: 107761 - DNA, 7 bp, Unknown
  misc_feature (1)..( 7): Result.002 file - promoters60/1379998
cccacta

SEQ ID NO: 107762 - DNA, 7 bp, Unknown
  misc_feature (1)..( 7): Result.002 file - promoters60/1379998
cccacta

SEQ ID NO: 107763 - DNA, 9 bp, Unknown
  misc_feature (1)..( 9): Result.002 file - promoters60/1379998
aaagaaaag

SEQ ID NO: 107764 - DNA, 9 bp, Unknown
  misc_feature (1)..( 9): Result.002 file - promoters60/1379998
aaagtaaag

SEQ ID NO: 107765 - DNA, 7 bp, Unknown
  misc_feature (1)..( 7): Result.002 file - promoters60/1379998
gtatata

SEQ ID NO: 107766 - DNA, 7 bp, Unknown
  misc_feature (1)..( 7): Result.002 file - promoters60/1379998
gtatata

SEQ ID NO: 107767 - DNA, 9 bp, Unknown
  misc_feature (1)..( 9): Result.002 file - promoters60/1380309
acaaatcta

SEQ ID NO: 107768 - DNA, 9 bp, Unknown
  misc_feature (1)..( 9): Result.002 file - promoters60/1380309
ataaaccta

SEQ ID NO: 107769 - DNA, 9 bp, Unknown
  misc_feature (1)..( 9): Result.002 file - promoters60/1380309
acaaatcaa

SEQ ID NO: 107770 - DNA, 8 bp, Unknown
  misc_feature (1)..( 8): Result.002 file - promoters60/1380309
taaatata

SEQ ID NO: 107771 - DNA, 8 bp, Unknown
  misc_feature (1)..( 8): Result.002 file - promoters60/1380309
taaatata

SEQ ID NO: 107772 - DNA, 6 bp, Unknown
  misc_feature (1)..( 6): Result.002 file - promoters60/1380309
tataaa

SEQ ID NO: 107773 - DNA, 6 bp, Unknown
  misc_feature (1)..( 6): Result.002 file - promoters60/1380309
tataaa

SEQ ID NO: 107774 - DNA, 12 bp, Unknown
  misc_feature (1)..( 12): Result.002 file - promoters60/1380309
agtttaatattt

SEQ ID NO: 107775 - DNA, 12 bp, Unknown
  misc_feature (1)..( 12): Result.002 file - promoters60/1380309
agtctaagacaa

SEQ ID NO: 107776 - DNA, 12 bp, Unknown
  misc_feature (1)..( 12): Result.002 file - promoters60/1380309
aacttaaacttt

SEQ ID NO: 107777 - DNA, 9 bp, Unknown
  misc_feature (1)..( 9): Result.002 file - promoters60/1380309
atcagtact

SEQ ID NO: 107778 - DNA, 9 bp, Unknown
  misc_feature (1)..( 9): Result.002 file - promoters60/1380309
atcaatact

SEQ ID NO: 107779 - DNA, 7 bp, Unknown
  misc_feature (1)..( 7): Result.002 file - promoters60/1380309
ttttatt

SEQ ID NO: 107780 - DNA, 7 bp, Unknown
  misc_feature (1)..( 7): Result.002 file - promoters60/1380309
tttaatt

SEQ ID NO: 107781 - DNA, 7 bp, Unknown
  misc_feature (1)..( 7): Result.002 file - promoters60/1380309
aaatagt

SEQ ID NO: 107782 - DNA, 7 bp, Unknown
  misc_feature (1)..( 7): Result.002 file - promoters60/1380309
aaacagt

SEQ ID NO: 107783 - DNA, 6 bp, Unknown
  misc_feature (1)..( 6): Result.002 file - promoters60/1380309
aaaaat

SEQ ID NO: 107784 - DNA, 6 bp, Unknown
  misc_feature (1)..( 6): Result.002 file - promoters60/1380309
aaaaat

SEQ ID NO: 107785 - DNA, 10 bp, Unknown
  misc_feature (1)..( 10): Result.002 file - promoters60/1380309
atgtaacaaa

SEQ ID NO: 107786 - DNA, 10 bp, Unknown
  misc_feature (1)..( 10): Result.002 file - promoters60/1380309
atggaacaaa

SEQ ID NO: 107787 - DNA, 10 bp, Unknown
  misc_feature (1)..( 10): Result.002 file - promoters60/1380309
aataattaaa

SEQ ID NO: 107788 - DNA, 10 bp, Unknown
  misc_feature (1)..( 10): Result.002 file - promoters60/1380309
aatagttaaa

SEQ ID NO: 107789 - DNA, 7 bp, Unknown
  misc_feature (1)..( 7): Result.002 file - promoters60/1380309
atttaag

SEQ ID NO: 107790 - DNA, 7 bp, Unknown
  misc_feature (1)..( 7): Result.002 file - promoters60/1380309
attgaag

SEQ ID NO: 107791 - DNA, 7 bp, Unknown
  misc_feature (1)..( 7): Result.002 file - promoters60/1380309
tataaat

SEQ ID NO: 107792 - DNA, 7 bp, Unknown
  misc_feature (1)..( 7): Result.002 file - promoters60/1380309
tatcaat

SEQ ID NO: 107793 - DNA, 8 bp, Unknown
  misc_feature (1)..( 8): Result.002 file - promoters60/1380309
tcttaaaa

SEQ ID NO: 107794 - DNA, 8 bp, Unknown
  misc_feature (1)..( 8): Result.002 file - promoters60/1380309
tcttgaaa

SEQ ID NO: 107795 - DNA, 6 bp, Unknown
  misc_feature (1)..( 6): Result.002 file - promoters60/1380309
gtagtt

SEQ ID NO: 107796 - DNA, 6 bp, Unknown
  misc_feature (1)..( 6): Result.002 file - promoters60/1380309
gtagtt

SEQ ID NO: 107797 - DNA, 6 bp, Unknown
  misc_feature (1)..( 6): Result.002 file - promoters60/1380309
gtatat

SEQ ID NO: 107798 - DNA, 6 bp, Unknown
  misc_feature (1)..( 6): Result.002 file - promoters60/1380309
gtatat

SEQ ID NO: 107799 - DNA, 7 bp, Unknown
  misc_feature (1)..( 7): Result.002 file - promoters60/1380309
taaacaa

SEQ ID NO: 107800 - DNA, 7 bp, Unknown
  misc_feature (1)..( 7): Result.002 file - promoters60/1380309
taatcaa

SEQ ID NO: 107801 - DNA, 6 bp, Unknown
  misc_feature (1)..( 6): Result.002 file - promoters60/1380309
tggaag

SEQ ID NO: 107802 - DNA, 6 bp, Unknown
  misc_feature (1)..( 6): Result.002 file - promoters60/1380309
tggaag

SEQ ID NO: 107803 - DNA, 6 bp, Unknown
  misc_feature (1)..( 6): Result.002 file - promoters60/1380309
tttgtt

SEQ ID NO: 107804 - DNA, 6 bp, Unknown
  misc_feature (1)..( 6): Result.002 file - promoters60/1380309
tttgtt

SEQ ID NO: 107805 - DNA, 6 bp, Unknown
  misc_feature (1)..( 6): Result.002 file - promoters60/1380309
ttttta

SEQ ID NO: 107806 - DNA, 6 bp, Unknown
  misc_feature (1)..( 6): Result.002 file - promoters60/1380309
ttttta

SEQ ID NO: 107807 - DNA, 12 bp, Unknown
  misc_feature (1)..( 12): Result.002 file - promoters60/1380385
tggtaacactgt

SEQ ID NO: 107808 - DNA, 12 bp, Unknown
  misc_feature (1)..( 12): Result.002 file - promoters60/1380385
tggaaacattgt

SEQ ID NO: 107809 - DNA, 8 bp, Unknown
  misc_feature (1)..( 8): Result.002 file - promoters60/1380385
tgtcattt

SEQ ID NO: 107810 - DNA, 8 bp, Unknown
  misc_feature (1)..( 8): Result.002 file - promoters60/1380385
tgtccttt

SEQ ID NO: 107811 - DNA, 6 bp, Unknown
  misc_feature (1)..( 6): Result.002 file - promoters60/1380385
agacag

SEQ ID NO: 107812 - DNA, 6 bp, Unknown
  misc_feature (1)..( 6): Result.002 file - promoters60/1380385
agacag

SEQ ID NO: 107813 - DNA, 9 bp, Unknown
  misc_feature (1)..( 9): Result.002 file - promoters60/1380385
ggctggatc

SEQ ID NO: 107814 - DNA, 9 bp, Unknown
  misc_feature (1)..( 9): Result.002 file - promoters60/1380385
ggctgaatc

SEQ ID NO: 107815 - DNA, 6 bp, Unknown
  misc_feature (1)..( 6): Result.002 file - promoters60/1380385
tctgac

SEQ ID NO: 107816 - DNA, 6 bp, Unknown
  misc_feature (1)..( 6): Result.002 file - promoters60/1380385
tctgac

SEQ ID NO: 107817 - DNA, 6 bp, Unknown
  misc_feature (1)..( 6): Result.002 file - promoters60/1380385
ttgtgt

SEQ ID NO: 107818 - DNA, 6 bp, Unknown
  misc_feature (1)..( 6): Result.002 file - promoters60/1380385
ttgtgt

SEQ ID NO: 107819 - DNA, 8 bp, Unknown
  misc_feature (1)..( 8): Result.002 file - promoters60/1380385
attatcaa

SEQ ID NO: 107820 - DNA, 8 bp, Unknown
  misc_feature (1)..( 8): Result.002 file - promoters60/1380385
attttcaa

SEQ ID NO: 107821 - DNA, 7 bp, Unknown
  misc_feature (1)..( 7): Result.002 file - promoters60/1380385
tttctct

SEQ ID NO: 107822 - DNA, 7 bp, Unknown
  misc_feature (1)..( 7): Result.002 file - promoters60/1380385
tttttct

SEQ ID NO: 107823 - DNA, 6 bp, Unknown
  misc_feature (1)..( 6): Result.002 file - promoters60/1380385
cttttt

SEQ ID NO: 107824 - DNA, 6 bp, Unknown
  misc_feature (1)..( 6): Result.002 file - promoters60/1380385
cttttt

SEQ ID NO: 107825 - DNA, 9 bp, Unknown
  misc_feature (1)..( 9): Result.002 file - promoters60/1380389
caaaaatat

SEQ ID NO: 107826 - DNA, 9 bp, Unknown
  misc_feature (1)..( 9): Result.002 file - promoters60/1380389
caaaattat

SEQ ID NO: 107827 - DNA, 9 bp, Unknown
  misc_feature (1)..( 9): Result.002 file - promoters60/1380389
gaaagatat

SEQ ID NO: 107828 - DNA, 7 bp, Unknown
  misc_feature (1)..( 7): Result.002 file - promoters60/1380389
caaaacg

SEQ ID NO: 107829 - DNA, 7 bp, Unknown
  misc_feature (1)..( 7): Result.002 file - promoters60/1380389
caagacg

SEQ ID NO: 107830 - DNA, 7 bp, Unknown
  misc_feature (1)..( 7): Result.002 file - promoters60/1380389
caagacg

SEQ ID NO: 107831 - DNA, 8 bp, Unknown
  misc_feature (1)..( 8): Result.002 file - promoters60/1380389
cttgcttt

SEQ ID NO: 107832 - DNA, 8 bp, Unknown
  misc_feature (1)..( 8): Result.002 file - promoters60/1380389
tttggttt

SEQ ID NO: 107833 - DNA, 9 bp, Unknown
  misc_feature (1)..( 9): Result.002 file - promoters60/1380389
tttaggtct

SEQ ID NO: 107834 - DNA, 8 bp, Unknown
  misc_feature (1)..( 8): Result.002 file - promoters60/1380389
taaattca

SEQ ID NO: 107835 - DNA, 8 bp, Unknown
  misc_feature (1)..( 8): Result.002 file - promoters60/1380389
taaattga

SEQ ID NO: 107836 - DNA, 8 bp, Unknown
  misc_feature (1)..( 8): Result.002 file - promoters60/1380389
taaactga

SEQ ID NO: 107837 - DNA, 9 bp, Unknown
  misc_feature (1)..( 9): Result.002 file - promoters60/1380389
aaaaacagt

SEQ ID NO: 107838 - DNA, 9 bp, Unknown
  misc_feature (1)..( 9): Result.002 file - promoters60/1380389
aaaaacatt

SEQ ID NO: 107839 - DNA, 9 bp, Unknown
  misc_feature (1)..( 9): Result.002 file - promoters60/1380389
gaacacaaa

SEQ ID NO: 107840 - DNA, 7 bp, Unknown
  misc_feature (1)..( 7): Result.002 file - promoters60/1380418
aagagat

SEQ ID NO: 107841 - DNA, 7 bp, Unknown
  misc_feature (1)..( 7): Result.002 file - promoters60/1380418
aagagat

SEQ ID NO: 107842 - DNA, 7 bp, Unknown
  misc_feature (1)..( 7): Result.002 file - promoters60/1380418
agtttct

SEQ ID NO: 107843 - DNA, 7 bp, Unknown
  misc_feature (1)..( 7): Result.002 file - promoters60/1380418
agtttct

SEQ ID NO: 107844 - DNA, 10 bp, Unknown
  misc_feature (1)..( 10): Result.002 file - promoters60/1380418
aaaaatcgtt

SEQ ID NO: 107845 - DNA, 10 bp, Unknown
  misc_feature (1)..( 10): Result.002 file - promoters60/1380418
aaaaatggtt

SEQ ID NO: 107846 - DNA, 10 bp, Unknown
  misc_feature (1)..( 10): Result.002 file - promoters60/1380418
aaaaatgctg

SEQ ID NO: 107847 - DNA, 7 bp, Unknown
  misc_feature (1)..( 7): Result.002 file - promoters60/1380418
ttttgtt

SEQ ID NO: 107848 - DNA, 7 bp, Unknown
  misc_feature (1)..( 7): Result.002 file - promoters60/1380418
ttttgtt

SEQ ID NO: 107849 - DNA, 8 bp, Unknown
  misc_feature (1)..( 8): Result.002 file - promoters60/1380418
cagtgata

SEQ ID NO: 107850 - DNA, 8 bp, Unknown
  misc_feature (1)..( 8): Result.002 file - promoters60/1380418
cagttata

SEQ ID NO: 107851 - DNA, 10 bp, Unknown
  misc_feature (1)..( 10): Result.002 file - promoters60/1380418
agatgagttt

SEQ ID NO: 107852 - DNA, 10 bp, Unknown
  misc_feature (1)..( 10): Result.002 file - promoters60/1380418
agattagttt

SEQ ID NO: 107853 - DNA, 7 bp, Unknown
  misc_feature (1)..( 7): Result.002 file - promoters60/1380418
caaaatg

SEQ ID NO: 107854 - DNA, 7 bp, Unknown
  misc_feature (1)..( 7): Result.002 file - promoters60/1380418
caatatg

SEQ ID NO: 107855 - DNA, 7 bp, Unknown
  misc_feature (1)..( 7): Result.002 file - promoters60/1380418
caaccaa

SEQ ID NO: 107856 - DNA, 7 bp, Unknown
  misc_feature (1)..( 7): Result.002 file - promoters60/1380418
caaccaa

SEQ ID NO: 107857 - DNA, 7 bp, Unknown
  misc_feature (1)..( 7): Result.002 file - promoters60/1380418
acaagaa

SEQ ID NO: 107858 - DNA, 7 bp, Unknown
  misc_feature (1)..( 7): Result.002 file - promoters60/1380418
acaagaa

SEQ ID NO: 107859 - DNA, 7 bp, Unknown
  misc_feature (1)..( 7): Result.002 file - promoters60/1380437
aactatt

SEQ ID NO: 107860 - DNA, 7 bp, Unknown
  misc_feature (1)..( 7): Result.002 file - promoters60/1380437
aacaatt

SEQ ID NO: 107861 - DNA, 11 bp, Unknown
  misc_feature (1)..( 11): Result.002 file - promoters60/1380437
tttcaaataaa

SEQ ID NO: 107862 - DNA, 11 bp, Unknown
  misc_feature (1)..( 11): Result.002 file - promoters60/1380437
tttcagataaa

SEQ ID NO: 107863 - DNA, 7 bp, Unknown
  misc_feature (1)..( 7): Result.002 file - promoters60/1380437
tcaattt

SEQ ID NO: 107864 - DNA, 7 bp, Unknown
  misc_feature (1)..( 7): Result.002 file - promoters60/1380437
tcacttt

SEQ ID NO: 107865 - DNA, 6 bp, Unknown
  misc_feature (1)..( 6): Result.002 file - promoters60/1380437
tttgta

SEQ ID NO: 107866 - DNA, 6 bp, Unknown
  misc_feature (1)..( 6): Result.002 file - promoters60/1380437
tttgta

SEQ ID NO: 107867 - DNA, 7 bp, Unknown
  misc_feature (1)..( 7): Result.002 file - promoters60/1380437
aacaaaa

SEQ ID NO: 107868 - DNA, 7 bp, Unknown
  misc_feature (1)..( 7): Result.002 file - promoters60/1380437
cacaaaa

SEQ ID NO: 107869 - DNA, 7 bp, Unknown
  misc_feature (1)..( 7): Result.002 file - promoters60/1380437
aactaaa

SEQ ID NO: 107870 - DNA, 6 bp, Unknown
  misc_feature (1)..( 6): Result.002 file - promoters60/1380437
gatatt

SEQ ID NO: 107871 - DNA, 6 bp, Unknown
  misc_feature (1)..( 6): Result.002 file - promoters60/1380437
gatatt

SEQ ID NO: 107872 - DNA, 6 bp, Unknown
  misc_feature (1)..( 6): Result.002 file - promoters60/1380437
tattta

SEQ ID NO: 107873 - DNA, 6 bp, Unknown
  misc_feature (1)..( 6): Result.002 file - promoters60/1380437
tattta

SEQ ID NO: 107874 - DNA, 12 bp, Unknown
  misc_feature (1)..( 12): Result.002 file - promoters60/1380437
aaaacaagataa

SEQ ID NO: 107875 - DNA, 12 bp, Unknown
  misc_feature (1)..( 12): Result.002 file - promoters60/1380437
aaatcaagttaa

SEQ ID NO: 107876 - DNA, 11 bp, Unknown
  misc_feature (1)..( 11): Result.002 file - promoters60/1380437
aaagggttaaa

SEQ ID NO: 107877 - DNA, 11 bp, Unknown
  misc_feature (1)..( 11): Result.002 file - promoters60/1380437
aaaggggtaaa

SEQ ID NO: 107878 - DNA, 9 bp, Unknown
  misc_feature (1)..( 9): Result.002 file - promoters60/1380437
gaagaaaag

SEQ ID NO: 107879 - DNA, 9 bp, Unknown
  misc_feature (1)..( 9): Result.002 file - promoters60/1380437
aaagaaaag

SEQ ID NO: 107880 - DNA, 9 bp, Unknown
  misc_feature (1)..( 9): Result.002 file - promoters60/1380437
aaagtaaag

SEQ ID NO: 107881 - DNA, 6 bp, Unknown
  misc_feature (1)..( 6): Result.002 file - promoters60/1380437
aaatcg

SEQ ID NO: 107882 - DNA, 6 bp, Unknown
  misc_feature (1)..( 6): Result.002 file - promoters60/1380437
aaatcg

SEQ ID NO: 107883 - DNA, 6 bp, Unknown
  misc_feature (1)..( 6): Result.002 file - promoters60/1380437
agagta

SEQ ID NO: 107884 - DNA, 6 bp, Unknown
  misc_feature (1)..( 6): Result.002 file - promoters60/1380437
agagta

SEQ ID NO: 107885 - DNA, 6 bp, Unknown
  misc_feature (1)..( 6): Result.002 file - promoters60/1380437
taaaaa

SEQ ID NO: 107886 - DNA, 6 bp, Unknown
  misc_feature (1)..( 6): Result.002 file - promoters60/1380437
taaaaa

SEQ ID NO: 107887 - DNA, 7 bp, Unknown
  misc_feature (1)..( 7): Result.002 file - promoters60/1380437
tttcttg

SEQ ID NO: 107888 - DNA, 7 bp, Unknown
  misc_feature (1)..( 7): Result.002 file - promoters60/1380437
tttgttg

SEQ ID NO: 107889 - DNA, 7 bp, Unknown
  misc_feature (1)..( 7): Result.002 file - promoters60/1380437
ttgttat

SEQ ID NO: 107890 - DNA, 7 bp, Unknown
  misc_feature (1)..( 7): Result.002 file - promoters60/1380437
ttgttat

SEQ ID NO: 107891 - DNA, 6 bp, Unknown
  misc_feature (1)..( 6): Result.002 file - promoters60/1380437
aatatc

SEQ ID NO: 107892 - DNA, 6 bp, Unknown
  misc_feature (1)..( 6): Result.002 file - promoters60/1380437
aatatc

SEQ ID NO: 107893 - DNA, 7 bp, Unknown
  misc_feature (1)..( 7): Result.002 file - promoters60/1380437
aaaacaa

SEQ ID NO: 107894 - DNA, 7 bp, Unknown
  misc_feature (1)..( 7): Result.002 file - promoters60/1380437
aaaccaa

SEQ ID NO: 107895 - DNA, 7 bp, Unknown
  misc_feature (1)..( 7): Result.002 file - promoters60/1380437
gtcaaaa

SEQ ID NO: 107896 - DNA, 7 bp, Unknown
  misc_feature (1)..( 7): Result.002 file - promoters60/1380437
gtctaaa

SEQ ID NO: 107897 - DNA, 6 bp, Unknown
  misc_feature (1)..( 6): Result.002 file - promoters60/1380437
agtaaa

SEQ ID NO: 107898 - DNA, 6 bp, Unknown
  misc_feature (1)..( 6): Result.002 file - promoters60/1380437
agtaaa

SEQ ID NO: 107899 - DNA, 7 bp, Unknown
  misc_feature (1)..( 7): Result.002 file - promoters60/1380437
aatcggg

SEQ ID NO: 107900 - DNA, 7 bp, Unknown
  misc_feature (1)..( 7): Result.002 file - promoters60/1380437
aattggg

SEQ ID NO: 107901 - DNA, 8 bp, Unknown
  misc_feature (1)..( 8): Result.002 file - promoters60/1380437
gaaagaaa

SEQ ID NO: 107902 - DNA, 8 bp, Unknown
  misc_feature (1)..( 8): Result.002 file - promoters60/1380437
gaaacaaa

SEQ ID NO: 107903 - DNA, 10 bp, Unknown
  misc_feature (1)..( 10): Result.002 file - promoters60/1380437
ggaaaagaaa

SEQ ID NO: 107904 - DNA, 10 bp, Unknown
  misc_feature (1)..( 10): Result.002 file - promoters60/1380437
ggaaatgaaa

SEQ ID NO: 107905 - DNA, 7 bp, Unknown
  misc_feature (1)..( 7): Result.002 file - promoters60/1380437
cccacta

SEQ ID NO: 107906 - DNA, 7 bp, Unknown
  misc_feature (1)..( 7): Result.002 file - promoters60/1380437
cccacta

SEQ ID NO: 107907 - DNA, 7 bp, Unknown
  misc_feature (1)..( 7): Result.002 file - promoters60/1380437
gtatata

SEQ ID NO: 107908 - DNA, 7 bp, Unknown
  misc_feature (1)..( 7): Result.002 file - promoters60/1380437
gtatata

SEQ ID NO: 107909 - DNA, 6 bp, Unknown
  misc_feature (1)..( 6): Result.002 file - promoters60/1380478
ctgatg

SEQ ID NO: 107910 - DNA, 6 bp, Unknown
  misc_feature (1)..( 6): Result.002 file - promoters60/1380478
ctgatg

SEQ ID NO: 107911 - DNA, 6 bp, Unknown
  misc_feature (1)..( 6): Result.002 file - promoters60/1380478
cattac

SEQ ID NO: 107912 - DNA, 6 bp, Unknown
  misc_feature (1)..( 6): Result.002 file - promoters60/1380478
cattac

SEQ ID NO: 107913 - DNA, 6 bp, Unknown
  misc_feature (1)..( 6): Result.002 file - promoters60/1380478
catttt

SEQ ID NO: 107914 - DNA, 6 bp, Unknown
  misc_feature (1)..( 6): Result.002 file - promoters60/1380478
catttt

SEQ ID NO: 107915 - DNA, 7 bp, Unknown
  misc_feature (1)..( 7): Result.002 file - promoters60/1380478
tattcaa

SEQ ID NO: 107916 - DNA, 7 bp, Unknown
  misc_feature (1)..( 7): Result.002 file - promoters60/1380478
tatacaa

SEQ ID NO: 107917 - DNA, 8 bp, Unknown
  misc_feature (1)..( 8): Result.002 file - promoters60/1380478
ggtgtgat

SEQ ID NO: 107918 - DNA, 8 bp, Unknown
  misc_feature (1)..( 8): Result.002 file - promoters60/1380478
ggtgggat

SEQ ID NO: 107919 - DNA, 6 bp, Unknown
  misc_feature (1)..( 6): Result.002 file - promoters60/1380478
tggaaa

SEQ ID NO: 107920 - DNA, 6 bp, Unknown
  misc_feature (1)..( 6): Result.002 file - promoters60/1380478
tggaaa

SEQ ID NO: 107921 - DNA, 8 bp, Unknown
  misc_feature (1)..( 8): Result.002 file - promoters60/1380478
caacacca

SEQ ID NO: 107922 - DNA, 8 bp, Unknown
  misc_feature (1)..( 8): Result.002 file - promoters60/1380478
caactcca

SEQ ID NO: 107923 - DNA, 7 bp, Unknown
  misc_feature (1)..( 7): Result.002 file - promoters60/1380478
ttacttg

SEQ ID NO: 107924 - DNA, 7 bp, Unknown
  misc_feature (1)..( 7): Result.002 file - promoters60/1380478
ttaattg

SEQ ID NO: 107925 - DNA, 8 bp, Unknown
  misc_feature (1)..( 8): Result.002 file - promoters60/1380478
actttata

SEQ ID NO: 107926 - DNA, 8 bp, Unknown
  misc_feature (1)..( 8): Result.002 file - promoters60/1380478
acttcata

SEQ ID NO: 107927 - DNA, 7 bp, Unknown
  misc_feature (1)..( 7): Result.002 file - promoters60/1380478
catttcc

SEQ ID NO: 107928 - DNA, 7 bp, Unknown
  misc_feature (1)..( 7): Result.002 file - promoters60/1380478
catatcc

SEQ ID NO: 107929 - DNA, 9 bp, Unknown
  misc_feature (1)..( 9): Result.002 file - promoters60/1380519
tctcaaact

SEQ ID NO: 107930 - DNA, 9 bp, Unknown
  misc_feature (1)..( 9): Result.002 file - promoters60/1380519
tctaaaaag

SEQ ID NO: 107931 - DNA, 9 bp, Unknown
  misc_feature (1)..( 9): Result.002 file - promoters60/1380519
tatcatact

SEQ ID NO: 107932 - DNA, 8 bp, Unknown
  misc_feature (1)..( 8): Result.002 file - promoters60/1380519
gagcaaaa

SEQ ID NO: 107933 - DNA, 8 bp, Unknown
  misc_feature (1)..( 8): Result.002 file - promoters60/1380519
gagaaaaa

SEQ ID NO: 107934 - DNA, 8 bp, Unknown
  misc_feature (1)..( 8): Result.002 file - promoters60/1380519
gagcaatg

SEQ ID NO: 107935 - DNA, 7 bp, Unknown
  misc_feature (1)..( 7): Result.002 file - promoters60/1380545
attgatt

SEQ ID NO: 107936 - DNA, 7 bp, Unknown
  misc_feature (1)..( 7): Result.002 file - promoters60/1380545
atttatt

SEQ ID NO: 107937 - DNA, 9 bp, Unknown
  misc_feature (1)..( 9): Result.002 file - promoters60/1380545
tgttcatac

SEQ ID NO: 107938 - DNA, 9 bp, Unknown
  misc_feature (1)..( 9): Result.002 file - promoters60/1380545
tgttaataa

SEQ ID NO: 107939 - DNA, 9 bp, Unknown
  misc_feature (1)..( 9): Result.002 file - promoters60/1380545
tcttcatac

SEQ ID NO: 107940 - DNA, 6 bp, Unknown
  misc_feature (1)..( 6): Result.002 file - promoters60/1380545
ataaac

SEQ ID NO: 107941 - DNA, 6 bp, Unknown
  misc_feature (1)..( 6): Result.002 file - promoters60/1380545
ataaac

SEQ ID NO: 107942 - DNA, 9 bp, Unknown
  misc_feature (1)..( 9): Result.002 file - promoters60/1380545
gttataaaa

SEQ ID NO: 107943 - DNA, 9 bp, Unknown
  misc_feature (1)..( 9): Result.002 file - promoters60/1380545
gttataaaa

SEQ ID NO: 107944 - DNA, 6 bp, Unknown
  misc_feature (1)..( 6): Result.002 file - promoters60/1380545
ttaacc

SEQ ID NO: 107945 - DNA, 6 bp, Unknown
  misc_feature (1)..( 6): Result.002 file - promoters60/1380545
ttaacc

SEQ ID NO: 107946 - DNA, 8 bp, Unknown
  misc_feature (1)..( 8): Result.002 file - promoters60/1380545
acaaaatg

SEQ ID NO: 107947 - DNA, 8 bp, Unknown
  misc_feature (1)..( 8): Result.002 file - promoters60/1380545
acacaatg

SEQ ID NO: 107948 - DNA, 9 bp, Unknown
  misc_feature (1)..( 9): Result.002 file - promoters60/1380545
caaaaaaac

SEQ ID NO: 107949 - DNA, 9 bp, Unknown
  misc_feature (1)..( 9): Result.002 file - promoters60/1380545
caacaaaac

SEQ ID NO: 107950 - DNA, 9 bp, Unknown
  misc_feature (1)..( 9): Result.002 file - promoters60/1380545
aatcctaat

SEQ ID NO: 107951 - DNA, 9 bp, Unknown
  misc_feature (1)..( 9): Result.002 file - promoters60/1380545
aatcataat

SEQ ID NO: 107952 - DNA, 7 bp, Unknown
  misc_feature (1)..( 7): Result.002 file - promoters60/1380545
tgaacag

SEQ ID NO: 107953 - DNA, 7 bp, Unknown
  misc_feature (1)..( 7): Result.002 file - promoters60/1380545
tgaacag

SEQ ID NO: 107954 - DNA, 6 bp, Unknown
  misc_feature (1)..( 6): Result.002 file - promoters60/1380545
actcaa

SEQ ID NO: 107955 - DNA, 6 bp, Unknown
  misc_feature (1)..( 6): Result.002 file - promoters60/1380545
actcaa

SEQ ID NO: 107956 - DNA, 7 bp, Unknown
  misc_feature (1)..( 7): Result.002 file - promoters60/1380545
caacgta

SEQ ID NO: 107957 - DNA, 7 bp, Unknown
  misc_feature (1)..( 7): Result.002 file - promoters60/1380545
caaggta

SEQ ID NO: 107958 - DNA, 8 bp, Unknown
  misc_feature (1)..( 8): Result.002 file - promoters60/1380545
ttagacac

SEQ ID NO: 107959 - DNA, 8 bp, Unknown
  misc_feature (1)..( 8): Result.002 file - promoters60/1380545
ttagacac

SEQ ID NO: 107960 - DNA, 11 bp, Unknown
  misc_feature (1)..( 11): Result.002 file - promoters60/1380708
taacatttttt

SEQ ID NO: 107961 - DNA, 11 bp, Unknown
  misc_feature (1)..( 11): Result.002 file - promoters60/1380708
taagatttttg

SEQ ID NO: 107962 - DNA, 11 bp, Unknown
  misc_feature (1)..( 11): Result.002 file - promoters60/1380708
tagaatttttt

SEQ ID NO: 107963 - DNA, 9 bp, Unknown
  misc_feature (1)..( 9): Result.002 file - promoters60/1380708
tttaatcag

SEQ ID NO: 107964 - DNA, 9 bp, Unknown
  misc_feature (1)..( 9): Result.002 file - promoters60/1380708
tttattcag

SEQ ID NO: 107965 - DNA, 9 bp, Unknown
  misc_feature (1)..( 9): Result.002 file - promoters60/1380708
gttattcga

SEQ ID NO: 107966 - DNA, 6 bp, Unknown
  misc_feature (1)..( 6): Result.002 file - promoters60/1380708
tgcaat

SEQ ID NO: 107967 - DNA, 6 bp, Unknown
  misc_feature (1)..( 6): Result.002 file - promoters60/1380708
tgcaat

SEQ ID NO: 107968 - DNA, 8 bp, Unknown
  misc_feature (1)..( 8): Result.002 file - promoters60/1380708
ttcattta

SEQ ID NO: 107969 - DNA, 8 bp, Unknown
  misc_feature (1)..( 8): Result.002 file - promoters60/1380708
ttcattta

SEQ ID NO: 107970 - DNA, 6 bp, Unknown
  misc_feature (1)..( 6): Result.002 file - promoters60/1380708
tatttt

SEQ ID NO: 107971 - DNA, 6 bp, Unknown
  misc_feature (1)..( 6): Result.002 file - promoters60/1380708
tatttt

SEQ ID NO: 107972 - DNA, 6 bp, Unknown
  misc_feature (1)..( 6): Result.002 file - promoters60/1380708
taattt

SEQ ID NO: 107973 - DNA, 6 bp, Unknown
  misc_feature (1)..( 6): Result.002 file - promoters60/1380708
taattt

SEQ ID NO: 107974 - DNA, 6 bp, Unknown
  misc_feature (1)..( 6): Result.002 file - promoters60/1380708
tttcac

SEQ ID NO: 107975 - DNA, 6 bp, Unknown
  misc_feature (1)..( 6): Result.002 file - promoters60/1380708
tttcac

SEQ ID NO: 107976 - DNA, 7 bp, Unknown
  misc_feature (1)..( 7): Result.002 file - promoters60/1380708
attttca

SEQ ID NO: 107977 - DNA, 7 bp, Unknown
  misc_feature (1)..( 7): Result.002 file - promoters60/1380708
attctca

SEQ ID NO: 107978 - DNA, 7 bp, Unknown
  misc_feature (1)..( 7): Result.002 file - promoters60/1380708
atgttat

SEQ ID NO: 107979 - DNA, 7 bp, Unknown
  misc_feature (1)..( 7): Result.002 file - promoters60/1380708
atggtat

SEQ ID NO: 107980 - DNA, 6 bp, Unknown
  misc_feature (1)..( 6): Result.002 file - promoters60/1380708
aatatt

SEQ ID NO: 107981 - DNA, 6 bp, Unknown
  misc_feature (1)..( 6): Result.002 file - promoters60/1380708
aatatt

SEQ ID NO: 107982 - DNA, 6 bp, Unknown
  misc_feature (1)..( 6): Result.002 file - promoters60/1380708
gaaaat

SEQ ID NO: 107983 - DNA, 6 bp, Unknown
  misc_feature (1)..( 6): Result.002 file - promoters60/1380708
gaaaat

SEQ ID NO: 107984 - DNA, 7 bp, Unknown
  misc_feature (1)..( 7): Result.002 file - promoters60/1380708
taaatct

SEQ ID NO: 107985 - DNA, 7 bp, Unknown
  misc_feature (1)..( 7): Result.002 file - promoters60/1380708
taactct

SEQ ID NO: 107986 - DNA, 12 bp, Unknown
  misc_feature (1)..( 12): Result.002 file - promoters60/1380708
aaaaaatctctg

SEQ ID NO: 107987 - DNA, 12 bp, Unknown
  misc_feature (1)..( 12): Result.002 file - promoters60/1380708
aaataatctctg

SEQ ID NO: 107988 - DNA, 7 bp, Unknown
  misc_feature (1)..( 7): Result.002 file - promoters60/1380708
aattttt

SEQ ID NO: 107989 - DNA, 7 bp, Unknown
  misc_feature (1)..( 7): Result.002 file - promoters60/1380708
aattttt

SEQ ID NO: 107990 - DNA, 7 bp, Unknown
  misc_feature (1)..( 7): Result.002 file - promoters60/1380708
ttaatgt

SEQ ID NO: 107991 - DNA, 7 bp, Unknown
  misc_feature (1)..( 7): Result.002 file - promoters60/1380708
ttattgt

SEQ ID NO: 107992 - DNA, 6 bp, Unknown
  misc_feature (1)..( 6): Result.002 file - promoters60/1380708
aatttt

SEQ ID NO: 107993 - DNA, 6 bp, Unknown
  misc_feature (1)..( 6): Result.002 file - promoters60/1380708
aatttt

SEQ ID NO: 107994 - DNA, 6 bp, Unknown
  misc_feature (1)..( 6): Result.002 file - promoters60/1380708
tattcg

SEQ ID NO: 107995 - DNA, 6 bp, Unknown
  misc_feature (1)..( 6): Result.002 file - promoters60/1380708
tattcg

SEQ ID NO: 107996 - DNA, 6 bp, Unknown
  misc_feature (1)..( 6): Result.002 file - promoters60/1380708
acctat

SEQ ID NO: 107997 - DNA, 6 bp, Unknown
  misc_feature (1)..( 6): Result.002 file - promoters60/1380708
acctat

SEQ ID NO: 107998 - DNA, 8 bp, Unknown
  misc_feature (1)..( 8): Result.002 file - promoters60/1380708
caaaactt

SEQ ID NO: 107999 - DNA, 8 bp, Unknown
  misc_feature (1)..( 8): Result.002 file - promoters60/1380708
caaatctt

SEQ ID NO: 108000 - DNA, 7 bp, Unknown
  misc_feature (1)..( 7): Result.002 file - promoters60/1380708
gaataaa

SEQ ID NO: 108001 - DNA, 7 bp, Unknown
  misc_feature (1)..( 7): Result.002 file - promoters60/1380708
gaaaaaa

SEQ ID NO: 108002 - DNA, 6 bp, Unknown
  misc_feature (1)..( 6): Result.002 file - promoters60/1380708
atttaa

SEQ ID NO: 108003 - DNA, 6 bp, Unknown
  misc_feature (1)..( 6): Result.002 file - promoters60/1380708
atttaa

SEQ ID NO: 108004 - DNA, 6 bp, Unknown
  misc_feature (1)..( 6): Result.002 file - promoters60/1380708
taaaat

SEQ ID NO: 108005 - DNA, 6 bp, Unknown
  misc_feature (1)..( 6): Result.002 file - promoters60/1380708
taaaat

SEQ ID NO: 108006 - DNA, 7 bp, Unknown
  misc_feature (1)..( 7): Result.002 file - promoters60/1380708
aaagtca

SEQ ID NO: 108007 - DNA, 7 bp, Unknown
  misc_feature (1)..( 7): Result.002 file - promoters60/1380708
aaaatca

SEQ ID NO: 108008 - DNA, 6 bp, Unknown
  misc_feature (1)..( 6): Result.002 file - promoters60/1380708
tcacat

SEQ ID NO: 108009 - DNA, 6 bp, Unknown
  misc_feature (1)..( 6): Result.002 file - promoters60/1380708
tcacat

SEQ ID NO: 108010 - DNA, 6 bp, Unknown
  misc_feature (1)..( 6): Result.002 file - promoters60/1380708
aatcat

SEQ ID NO: 108011 - DNA, 6 bp, Unknown
  misc_feature (1)..( 6): Result.002 file - promoters60/1380708
aatcat

SEQ ID NO: 108012 - DNA, 6 bp, Unknown
  misc_feature (1)..( 6): Result.002 file - promoters60/1380708
tttgta

SEQ ID NO: 108013 - DNA, 6 bp, Unknown
  misc_feature (1)..( 6): Result.002 file - promoters60/1380708
tttgta

SEQ ID NO: 108014 - DNA, 9 bp, Unknown
  misc_feature (1)..( 9): Result.002 file - promoters60/1380738
tctaaatta

SEQ ID NO: 108015 - DNA, 9 bp, Unknown
  misc_feature (1)..( 9): Result.002 file - promoters60/1380738
tctagatta

SEQ ID NO: 108016 - DNA, 7 bp, Unknown
  misc_feature (1)..( 7): Result.002 file - promoters60/1380738
tatttgt

SEQ ID NO: 108017 - DNA, 7 bp, Unknown
  misc_feature (1)..( 7): Result.002 file - promoters60/1380738
tatctgt

SEQ ID NO: 108018 - DNA, 10 bp, Unknown
  misc_feature (1)..( 10): Result.002 file - promoters60/1380738
tgttcattta

SEQ ID NO: 108019 - DNA, 10 bp, Unknown
  misc_feature (1)..( 10): Result.002 file - promoters60/1380738
tgtgcatttg

SEQ ID NO: 108020 - DNA, 10 bp, Unknown
  misc_feature (1)..( 10): Result.002 file - promoters60/1380738
cgttaattta

SEQ ID NO: 108021 - DNA, 6 bp, Unknown
  misc_feature (1)..( 6): Result.002 file - promoters60/1380738
acgtgt

SEQ ID NO: 108022 - DNA, 6 bp, Unknown
  misc_feature (1)..( 6): Result.002 file - promoters60/1380738
acgtgt

SEQ ID NO: 108023 - DNA, 7 bp, Unknown
  misc_feature (1)..( 7): Result.002 file - promoters60/1380738
ggcttaa

SEQ ID NO: 108024 - DNA, 7 bp, Unknown
  misc_feature (1)..( 7): Result.002 file - promoters60/1380738
ggcttaa

SEQ ID NO: 108025 - DNA, 8 bp, Unknown
  misc_feature (1)..( 8): Result.002 file - promoters60/1380738
ggtccggg

SEQ ID NO: 108026 - DNA, 8 bp, Unknown
  misc_feature (1)..( 8): Result.002 file - promoters60/1380738
ggtcaggg

SEQ ID NO: 108027 - DNA, 8 bp, Unknown
  misc_feature (1)..( 8): Result.002 file - promoters60/1380738
gacaagag

SEQ ID NO: 108028 - DNA, 8 bp, Unknown
  misc_feature (1)..( 8): Result.002 file - promoters60/1380738
gacgagag

SEQ ID NO: 108029 - DNA, 6 bp, Unknown
  misc_feature (1)..( 6): Result.002 file - promoters60/1380738
ttttta

SEQ ID NO: 108030 - DNA, 6 bp, Unknown
  misc_feature (1)..( 6): Result.002 file - promoters60/1380738
ttttta

SEQ ID NO: 108031 - DNA, 7 bp, Unknown
  misc_feature (1)..( 7): Result.002 file - promoters60/1380738
aaataca

SEQ ID NO: 108032 - DNA, 7 bp, Unknown
  misc_feature (1)..( 7): Result.002 file - promoters60/1380738
aaaaaca

SEQ ID NO: 108033 - DNA, 6 bp, Unknown
  misc_feature (1)..( 6): Result.002 file - promoters60/1380738
aagaaa

SEQ ID NO: 108034 - DNA, 6 bp, Unknown
  misc_feature (1)..( 6): Result.002 file - promoters60/1380738
aagaaa

SEQ ID NO: 108035 - DNA, 6 bp, Unknown
  misc_feature (1)..( 6): Result.002 file - promoters60/1380738
taattt

SEQ ID NO: 108036 - DNA, 6 bp, Unknown
  misc_feature (1)..( 6): Result.002 file - promoters60/1380738
taattt

SEQ ID NO: 108037 - DNA, 6 bp, Unknown
  misc_feature (1)..( 6): Result.002 file - promoters60/1380738
tttacc

SEQ ID NO: 108038 - DNA, 6 bp, Unknown
  misc_feature (1)..( 6): Result.002 file - promoters60/1380738
tttacc

SEQ ID NO: 108039 - DNA, 6 bp, Unknown
  misc_feature (1)..( 6): Result.002 file - promoters60/1380738
ttattt

SEQ ID NO: 108040 - DNA, 6 bp, Unknown
  misc_feature (1)..( 6): Result.002 file - promoters60/1380738
ttattt

SEQ ID NO: 108041 - DNA, 8 bp, Unknown
  misc_feature (1)..( 8): Result.002 file - promoters60/1380738
tacattat

SEQ ID NO: 108042 - DNA, 8 bp, Unknown
  misc_feature (1)..( 8): Result.002 file - promoters60/1380738
tacaatat

SEQ ID NO: 108043 - DNA, 8 bp, Unknown
  misc_feature (1)..( 8): Result.002 file - promoters60/1380738
attccaaa

SEQ ID NO: 108044 - DNA, 8 bp, Unknown
  misc_feature (1)..( 8): Result.002 file - promoters60/1380738
attacaaa

SEQ ID NO: 108045 - DNA, 8 bp, Unknown
  misc_feature (1)..( 8): Result.002 file - promoters60/1380738
taatcaaa

SEQ ID NO: 108046 - DNA, 8 bp, Unknown
  misc_feature (1)..( 8): Result.002 file - promoters60/1380738
taattaaa

SEQ ID NO: 108047 - DNA, 7 bp, Unknown
  misc_feature (1)..( 7): Result.002 file - promoters60/1380738
acaaaac

SEQ ID NO: 108048 - DNA, 7 bp, Unknown
  misc_feature (1)..( 7): Result.002 file - promoters60/1380738
acaaaac

SEQ ID NO: 108049 - DNA, 8 bp, Unknown
  misc_feature (1)..( 8): Result.002 file - promoters60/1380738
ctgtcaag

SEQ ID NO: 108050 - DNA, 8 bp, Unknown
  misc_feature (1)..( 8): Result.002 file - promoters60/1380738
ctgacaag

SEQ ID NO: 108051 - DNA, 7 bp, Unknown
  misc_feature (1)..( 7): Result.002 file - promoters60/1380738
atttaaa

SEQ ID NO: 108052 - DNA, 7 bp, Unknown
  misc_feature (1)..( 7): Result.002 file - promoters60/1380738
attaaaa

SEQ ID NO: 108053 - DNA, 6 bp, Unknown
  misc_feature (1)..( 6): Result.002 file - promoters60/1380738
aaaccc

SEQ ID NO: 108054 - DNA, 6 bp, Unknown
  misc_feature (1)..( 6): Result.002 file - promoters60/1380738
aaaccc

SEQ ID NO: 108055 - DNA, 7 bp, Unknown
  misc_feature (1)..( 7): Result.002 file - promoters60/1380797
taaattt

SEQ ID NO: 108056 - DNA, 7 bp, Unknown
  misc_feature (1)..( 7): Result.002 file - promoters60/1380797
taaattt

SEQ ID NO: 108057 - DNA, 7 bp, Unknown
  misc_feature (1)..( 7): Result.002 file - promoters60/1380797
taaaaat

SEQ ID NO: 108058 - DNA, 7 bp, Unknown
  misc_feature (1)..( 7): Result.002 file - promoters60/1380797
taataat

SEQ ID NO: 108059 - DNA, 7 bp, Unknown
  misc_feature (1)..( 7): Result.002 file - promoters60/1380797
tatcatt

SEQ ID NO: 108060 - DNA, 7 bp, Unknown
  misc_feature (1)..( 7): Result.002 file - promoters60/1380797
tatgatt

SEQ ID NO: 108061 - DNA, 8 bp, Unknown
  misc_feature (1)..( 8): Result.002 file - promoters60/1380797
tctgatta

SEQ ID NO: 108062 - DNA, 8 bp, Unknown
  misc_feature (1)..( 8): Result.002 file - promoters60/1380797
tctcatta

SEQ ID NO: 108063 - DNA, 8 bp, Unknown
  misc_feature (1)..( 8): Result.002 file - promoters60/1380797
aaaaaata

SEQ ID NO: 108064 - DNA, 8 bp, Unknown
  misc_feature (1)..( 8): Result.002 file - promoters60/1380797
aaaacata

SEQ ID NO: 108065 - DNA, 7 bp, Unknown
  misc_feature (1)..( 7): Result.002 file - promoters60/1380797
ataatat

SEQ ID NO: 108066 - DNA, 7 bp, Unknown
  misc_feature (1)..( 7): Result.002 file - promoters60/1380797
atagtat

SEQ ID NO: 108067 - DNA, 7 bp, Unknown
  misc_feature (1)..( 7): Result.002 file - promoters60/1380797
atgtatt

SEQ ID NO: 108068 - DNA, 7 bp, Unknown
  misc_feature (1)..( 7): Result.002 file - promoters60/1380797
atgtatt

SEQ ID NO: 108069 - DNA, 8 bp, Unknown
  misc_feature (1)..( 8): Result.002 file - promoters60/1380797
taatgaat

SEQ ID NO: 108070 - DNA, 8 bp, Unknown
  misc_feature (1)..( 8): Result.002 file - promoters60/1380797
caatcaat

SEQ ID NO: 108071 - DNA, 8 bp, Unknown
  misc_feature (1)..( 8): Result.002 file - promoters60/1380797
taatgaat

SEQ ID NO: 108072 - DNA, 12 bp, Unknown
  misc_feature (1)..( 12): Result.002 file - promoters60/1380797
taataaaaaaag

SEQ ID NO: 108073 - DNA, 12 bp, Unknown
  misc_feature (1)..( 12): Result.002 file - promoters60/1380797
taatcaaaaaag

SEQ ID NO: 108074 - DNA, 7 bp, Unknown
  misc_feature (1)..( 7): Result.002 file - promoters60/1380797
aaatagt

SEQ ID NO: 108075 - DNA, 7 bp, Unknown
  misc_feature (1)..( 7): Result.002 file - promoters60/1380797
aaaaagt

SEQ ID NO: 108076 - DNA, 7 bp, Unknown
  misc_feature (1)..( 7): Result.002 file - promoters60/1380797
aaacata

SEQ ID NO: 108077 - DNA, 6 bp, Unknown
  misc_feature (1)..( 6): Result.002 file - promoters60/1380797
tataaa

SEQ ID NO: 108078 - DNA, 6 bp, Unknown
  misc_feature (1)..( 6): Result.002 file - promoters60/1380797
tataaa

SEQ ID NO: 108079 - DNA, 7 bp, Unknown
  misc_feature (1)..( 7): Result.002 file - promoters60/1380797
tttggaa

SEQ ID NO: 108080 - DNA, 7 bp, Unknown
  misc_feature (1)..( 7): Result.002 file - promoters60/1380797
tttggaa

SEQ ID NO: 108081 - DNA, 7 bp, Unknown
  misc_feature (1)..( 7): Result.002 file - promoters60/1380797
aaaggtt

SEQ ID NO: 108082 - DNA, 7 bp, Unknown
  misc_feature (1)..( 7): Result.002 file - promoters60/1380797
aaatgtt

SEQ ID NO: 108083 - DNA, 8 bp, Unknown
  misc_feature (1)..( 8): Result.002 file - promoters60/1380797
tgtaaatg

SEQ ID NO: 108084 - DNA, 8 bp, Unknown
  misc_feature (1)..( 8): Result.002 file - promoters60/1380797
tgtaaatt

SEQ ID NO: 108085 - DNA, 8 bp, Unknown
  misc_feature (1)..( 8): Result.002 file - promoters60/1380797
actaaatt

SEQ ID NO: 108086 - DNA, 8 bp, Unknown
  misc_feature (1)..( 8): Result.002 file - promoters60/1380797
taaagaca

SEQ ID NO: 108087 - DNA, 8 bp, Unknown
  misc_feature (1)..( 8): Result.002 file - promoters60/1380797
taaaaaca

SEQ ID NO: 108088 - DNA, 7 bp, Unknown
  misc_feature (1)..( 7): Result.002 file - promoters60/1380797
caacaaa

SEQ ID NO: 108089 - DNA, 7 bp, Unknown
  misc_feature (1)..( 7): Result.002 file - promoters60/1380797
caagaaa

SEQ ID NO: 108090 - DNA, 8 bp, Unknown
  misc_feature (1)..( 8): Result.002 file - promoters60/1380797
aaagaacg

SEQ ID NO: 108091 - DNA, 8 bp, Unknown
  misc_feature (1)..( 8): Result.002 file - promoters60/1380797
aaataacg

SEQ ID NO: 108092 - DNA, 6 bp, Unknown
  misc_feature (1)..( 6): Result.002 file - promoters60/1380797
acaaat

SEQ ID NO: 108093 - DNA, 6 bp, Unknown
  misc_feature (1)..( 6): Result.002 file - promoters60/1380797
acaaat

SEQ ID NO: 108094 - DNA, 7 bp, Unknown
  misc_feature (1)..( 7): Result.002 file - promoters60/1380797
tttgttg

SEQ ID NO: 108095 - DNA, 7 bp, Unknown
  misc_feature (1)..( 7): Result.002 file - promoters60/1380797
tttcttg

SEQ ID NO: 108096 - DNA, 6 bp, Unknown
  misc_feature (1)..( 6): Result.002 file - promoters60/1380797
taacaa

SEQ ID NO: 108097 - DNA, 6 bp, Unknown
  misc_feature (1)..( 6): Result.002 file - promoters60/1380797
taacaa

SEQ ID NO: 108098 - DNA, 7 bp, Unknown
  misc_feature (1)..( 7): Result.002 file - promoters60/1380797
ttatgga

SEQ ID NO: 108099 - DNA, 7 bp, Unknown
  misc_feature (1)..( 7): Result.002 file - promoters60/1380797
ttatgga

SEQ ID NO: 108100 - DNA, 6 bp, Unknown
  misc_feature (1)..( 6): Result.002 file - promoters60/1380797
cgtttt

SEQ ID NO: 108101 - DNA, 6 bp, Unknown
  misc_feature (1)..( 6): Result.002 file - promoters60/1380797
cgtttt

SEQ ID NO: 108102 - DNA, 6 bp, Unknown
  misc_feature (1)..( 6): Result.002 file - promoters60/1380797
aaatta

SEQ ID NO: 108103 - DNA, 6 bp, Unknown
  misc_feature (1)..( 6): Result.002 file - promoters60/1380797
aaatta

SEQ ID NO: 108104 - DNA, 6 bp, Unknown
  misc_feature (1)..( 6): Result.002 file - promoters60/1380797
agaaaa

SEQ ID NO: 108105 - DNA, 6 bp, Unknown
  misc_feature (1)..( 6): Result.002 file - promoters60/1380797
agaaaa

SEQ ID NO: 108106 - DNA, 10 bp, Unknown
  misc_feature (1)..( 10): Result.002 file - promoters60/1380797
caaatgttta

SEQ ID NO: 108107 - DNA, 10 bp, Unknown
  misc_feature (1)..( 10): Result.002 file - promoters60/1380797
caaatggtta

SEQ ID NO: 108108 - DNA, 9 bp, Unknown
  misc_feature (1)..( 9): Result.002 file - promoters60/1380947
tggggttat

SEQ ID NO: 108109 - DNA, 9 bp, Unknown
  misc_feature (1)..( 9): Result.002 file - promoters60/1380947
tggagtttt

SEQ ID NO: 108110 - DNA, 9 bp, Unknown
  misc_feature (1)..( 9): Result.002 file - promoters60/1380947
agggcttat

SEQ ID NO: 108111 - DNA, 7 bp, Unknown
  misc_feature (1)..( 7): Result.002 file - promoters60/1380947
atcactt

SEQ ID NO: 108112 - DNA, 7 bp, Unknown
  misc_feature (1)..( 7): Result.002 file - promoters60/1380947
atctctt

SEQ ID NO: 108113 - DNA, 6 bp, Unknown
  misc_feature (1)..( 6): Result.002 file - promoters60/1380947
tgaaaa

SEQ ID NO: 108114 - DNA, 6 bp, Unknown
  misc_feature (1)..( 6): Result.002 file - promoters60/1380947
tgaaaa

SEQ ID NO: 108115 - DNA, 8 bp, Unknown
  misc_feature (1)..( 8): Result.002 file - promoters60/1380947
aaaagcaa

SEQ ID NO: 108116 - DNA, 8 bp, Unknown
  misc_feature (1)..( 8): Result.002 file - promoters60/1380947
aaaaacaa

SEQ ID NO: 108117 - DNA, 7 bp, Unknown
  misc_feature (1)..( 7): Result.002 file - promoters60/1380947
aataaca

SEQ ID NO: 108118 - DNA, 7 bp, Unknown
  misc_feature (1)..( 7): Result.002 file - promoters60/1380947
aataaca

SEQ ID NO: 108119 - DNA, 6 bp, Unknown
  misc_feature (1)..( 6): Result.002 file - promoters60/1380947
ttcttc

SEQ ID NO: 108120 - DNA, 6 bp, Unknown
  misc_feature (1)..( 6): Result.002 file - promoters60/1380947
ttcttc

SEQ ID NO: 108121 - DNA, 8 bp, Unknown
  misc_feature (1)..( 8): Result.002 file - promoters60/1380947
ttaatact

SEQ ID NO: 108122 - DNA, 8 bp, Unknown
  misc_feature (1)..( 8): Result.002 file - promoters60/1380947
ttattact

SEQ ID NO: 108123 - DNA, 6 bp, Unknown
  misc_feature (1)..( 6): Result.002 file - promoters60/1380947
aaatat

SEQ ID NO: 108124 - DNA, 6 bp, Unknown
  misc_feature (1)..( 6): Result.002 file - promoters60/1380947
aaatat

SEQ ID NO: 108125 - DNA, 7 bp, Unknown
  misc_feature (1)..( 7): Result.002 file - promoters60/1380947
tattaaa

SEQ ID NO: 108126 - DNA, 7 bp, Unknown
  misc_feature (1)..( 7): Result.002 file - promoters60/1380947
tattaaa

SEQ ID NO: 108127 - DNA, 7 bp, Unknown
  misc_feature (1)..( 7): Result.002 file - promoters60/1380947
gttaatt

SEQ ID NO: 108128 - DNA, 7 bp, Unknown
  misc_feature (1)..( 7): Result.002 file - promoters60/1380947
gttaatt

SEQ ID NO: 108129 - DNA, 7 bp, Unknown
  misc_feature (1)..( 7): Result.002 file - promoters60/1380947
aaaaaca

SEQ ID NO: 108130 - DNA, 7 bp, Unknown
  misc_feature (1)..( 7): Result.002 file - promoters60/1380947
aaacaca

SEQ ID NO: 108131 - DNA, 8 bp, Unknown
  misc_feature (1)..( 8): Result.002 file - promoters60/1380947
tattacaa

SEQ ID NO: 108132 - DNA, 8 bp, Unknown
  misc_feature (1)..( 8): Result.002 file - promoters60/1380947
tataacaa

SEQ ID NO: 108133 - DNA, 7 bp, Unknown
  misc_feature (1)..( 7): Result.002 file - promoters60/1380947
aactctt

SEQ ID NO: 108134 - DNA, 7 bp, Unknown
  misc_feature (1)..( 7): Result.002 file - promoters60/1380947
aacactt

SEQ ID NO: 108135 - DNA, 6 bp, Unknown
  misc_feature (1)..( 6): Result.002 file - promoters60/1380947
atgtct

SEQ ID NO: 108136 - DNA, 6 bp, Unknown
  misc_feature (1)..( 6): Result.002 file - promoters60/1380947
atgtct

SEQ ID NO: 108137 - DNA, 7 bp, Unknown
  misc_feature (1)..( 7): Result.002 file - promoters60/1380947
ttggaga

SEQ ID NO: 108138 - DNA, 7 bp, Unknown
  misc_feature (1)..( 7): Result.002 file - promoters60/1380947
ttggaga

SEQ ID NO: 108139 - DNA, 6 bp, Unknown
  misc_feature (1)..( 6): Result.002 file - promoters60/1380947
gaagat

SEQ ID NO: 108140 - DNA, 6 bp, Unknown
  misc_feature (1)..( 6): Result.002 file - promoters60/1380947
gaagat

SEQ ID NO: 108141 - DNA, 6 bp, Unknown
  misc_feature (1)..( 6): Result.002 file - promoters60/1380947
gatcga

SEQ ID NO: 108142 - DNA, 6 bp, Unknown
  misc_feature (1)..( 6): Result.002 file - promoters60/1380947
gatcga

SEQ ID NO: 108143 - DNA, 6 bp, Unknown
  misc_feature (1)..( 6): Result.002 file - promoters60/1380947
aaatgc

SEQ ID NO: 108144 - DNA, 6 bp, Unknown
  misc_feature (1)..( 6): Result.002 file - promoters60/1380947
aaatgc

SEQ ID NO: 108145 - DNA, 8 bp, Unknown
  misc_feature (1)..( 8): Result.002 file - promoters60/1380947
ggatttgt

SEQ ID NO: 108146 - DNA, 8 bp, Unknown
  misc_feature (1)..( 8): Result.002 file - promoters60/1380947
ggacttgt

SEQ ID NO: 108147 - DNA, 7 bp, Unknown
  misc_feature (1)..( 7): Result.002 file - promoters60/1380963
atatata

SEQ ID NO: 108148 - DNA, 7 bp, Unknown
  misc_feature (1)..( 7): Result.002 file - promoters60/1380963
atatata

SEQ ID NO: 108149 - DNA, 7 bp, Unknown
  misc_feature (1)..( 7): Result.002 file - promoters60/1380963
atatatc

SEQ ID NO: 108150 - DNA, 7 bp, Unknown
  misc_feature (1)..( 7): Result.002 file - promoters60/1380963
tgggtct

SEQ ID NO: 108151 - DNA, 7 bp, Unknown
  misc_feature (1)..( 7): Result.002 file - promoters60/1380963
tggttct

SEQ ID NO: 108152 - DNA, 10 bp, Unknown
  misc_feature (1)..( 10): Result.002 file - promoters60/1380963
tataccttta

SEQ ID NO: 108153 - DNA, 10 bp, Unknown
  misc_feature (1)..( 10): Result.002 file - promoters60/1380963
tatactttta

SEQ ID NO: 108154 - DNA, 10 bp, Unknown
  misc_feature (1)..( 10): Result.002 file - promoters60/1380963
tattctttac

SEQ ID NO: 108155 - DNA, 7 bp, Unknown
  misc_feature (1)..( 7): Result.002 file - promoters60/1380963
accaatt

SEQ ID NO: 108156 - DNA, 7 bp, Unknown
  misc_feature (1)..( 7): Result.002 file - promoters60/1380963
accaatt

SEQ ID NO: 108157 - DNA, 9 bp, Unknown
  misc_feature (1)..( 9): Result.002 file - promoters60/1380963
tatataaca

SEQ ID NO: 108158 - DNA, 9 bp, Unknown
  misc_feature (1)..( 9): Result.002 file - promoters60/1380963
tatataaat

SEQ ID NO: 108159 - DNA, 9 bp, Unknown
  misc_feature (1)..( 9): Result.002 file - promoters60/1380963
aatagaaat

SEQ ID NO: 108160 - DNA, 6 bp, Unknown
  misc_feature (1)..( 6): Result.002 file - promoters60/1380963
taaaat

SEQ ID NO: 108161 - DNA, 6 bp, Unknown
  misc_feature (1)..( 6): Result.002 file - promoters60/1380963
taaaat

SEQ ID NO: 108162 - DNA, 7 bp, Unknown
  misc_feature (1)..( 7): Result.002 file - promoters60/1380963
aatttta

SEQ ID NO: 108163 - DNA, 7 bp, Unknown
  misc_feature (1)..( 7): Result.002 file - promoters60/1380963
aatttta

SEQ ID NO: 108164 - DNA, 6 bp, Unknown
  misc_feature (1)..( 6): Result.002 file - promoters60/1380963
atttct

SEQ ID NO: 108165 - DNA, 6 bp, Unknown
  misc_feature (1)..( 6): Result.002 file - promoters60/1380963
atttct

SEQ ID NO: 108166 - DNA, 6 bp, Unknown
  misc_feature (1)..( 6): Result.002 file - promoters60/1380963
taatgt

SEQ ID NO: 108167 - DNA, 6 bp, Unknown
  misc_feature (1)..( 6): Result.002 file - promoters60/1380963
taatgt

SEQ ID NO: 108168 - DNA, 6 bp, Unknown
  misc_feature (1)..( 6): Result.002 file - promoters60/1380963
tatata

SEQ ID NO: 108169 - DNA, 6 bp, Unknown
  misc_feature (1)..( 6): Result.002 file - promoters60/1380963
tatata

SEQ ID NO: 108170 - DNA, 7 bp, Unknown
  misc_feature (1)..( 7): Result.002 file - promoters60/1380963
aagaaaa

SEQ ID NO: 108171 - DNA, 7 bp, Unknown
  misc_feature (1)..( 7): Result.002 file - promoters60/1380963
aagaaaa

SEQ ID NO: 108172 - DNA, 7 bp, Unknown
  misc_feature (1)..( 7): Result.002 file - promoters60/1380963
cagaaaa

SEQ ID NO: 108173 - DNA, 7 bp, Unknown
  misc_feature (1)..( 7): Result.002 file - promoters60/1380963
atctttt

SEQ ID NO: 108174 - DNA, 7 bp, Unknown
  misc_feature (1)..( 7): Result.002 file - promoters60/1380963
atctttt

SEQ ID NO: 108175 - DNA, 9 bp, Unknown
  misc_feature (1)..( 9): Result.002 file - promoters60/1380963
tttacggtt

SEQ ID NO: 108176 - DNA, 9 bp, Unknown
  misc_feature (1)..( 9): Result.002 file - promoters60/1380963
tttaaggtt

SEQ ID NO: 108177 - DNA, 7 bp, Unknown
  misc_feature (1)..( 7): Result.002 file - promoters60/1380963
tatttgt

SEQ ID NO: 108178 - DNA, 7 bp, Unknown
  misc_feature (1)..( 7): Result.002 file - promoters60/1380963
tatatgt

SEQ ID NO: 108179 - DNA, 7 bp, Unknown
  misc_feature (1)..( 7): Result.002 file - promoters60/1380963
taatatt

SEQ ID NO: 108180 - DNA, 7 bp, Unknown
  misc_feature (1)..( 7): Result.002 file - promoters60/1380963
taaaatt

SEQ ID NO: 108181 - DNA, 8 bp, Unknown
  misc_feature (1)..( 8): Result.002 file - promoters60/1380963
ttatttta

SEQ ID NO: 108182 - DNA, 8 bp, Unknown
  misc_feature (1)..( 8): Result.002 file - promoters60/1380963
ttagttta

SEQ ID NO: 108183 - DNA, 6 bp, Unknown
  misc_feature (1)..( 6): Result.002 file - promoters60/1380963
ttaatg

SEQ ID NO: 108184 - DNA, 6 bp, Unknown
  misc_feature (1)..( 6): Result.002 file - promoters60/1380963
ttaatg

SEQ ID NO: 108185 - DNA, 8 bp, Unknown
  misc_feature (1)..( 8): Result.002 file - promoters60/1380963
tattatat

SEQ ID NO: 108186 - DNA, 8 bp, Unknown
  misc_feature (1)..( 8): Result.002 file - promoters60/1380963
tatcatat

SEQ ID NO: 108187 - DNA, 8 bp, Unknown
  misc_feature (1)..( 8): Result.002 file - promoters60/1380963
tttactgt

SEQ ID NO: 108188 - DNA, 8 bp, Unknown
  misc_feature (1)..( 8): Result.002 file - promoters60/1380963
tttactgt

SEQ ID NO: 108189 - DNA, 6 bp, Unknown
  misc_feature (1)..( 6): Result.002 file - promoters60/1380963
aaaaag

SEQ ID NO: 108190 - DNA, 6 bp, Unknown
  misc_feature (1)..( 6): Result.002 file - promoters60/1380963
aaaaag

SEQ ID NO: 108191 - DNA, 7 bp, Unknown
  misc_feature (1)..( 7): Result.002 file - promoters60/1380963
gtagaat

SEQ ID NO: 108192 - DNA, 7 bp, Unknown
  misc_feature (1)..( 7): Result.002 file - promoters60/1380963
gtacaat

SEQ ID NO: 108193 - DNA, 8 bp, Unknown
  misc_feature (1)..( 8): Result.002 file - promoters60/1380963
ctttacaa

SEQ ID NO: 108194 - DNA, 8 bp, Unknown
  misc_feature (1)..( 8): Result.002 file - promoters60/1380963
cttaacaa

SEQ ID NO: 108195 - DNA, 6 bp, Unknown
  misc_feature (1)..( 6): Result.002 file - promoters60/1380963
tatata

SEQ ID NO: 108196 - DNA, 6 bp, Unknown
  misc_feature (1)..( 6): Result.002 file - promoters60/1380963
tatata

SEQ ID NO: 108197 - DNA, 7 bp, Unknown
  misc_feature (1)..( 7): Result.002 file - promoters60/1380963
aaaagaa

SEQ ID NO: 108198 - DNA, 7 bp, Unknown
  misc_feature (1)..( 7): Result.002 file - promoters60/1380963
aaacgaa

SEQ ID NO: 108199 - DNA, 6 bp, Unknown
  misc_feature (1)..( 6): Result.002 file - promoters60/1380963
gattag

SEQ ID NO: 108200 - DNA, 6 bp, Unknown
  misc_feature (1)..( 6): Result.002 file - promoters60/1380963
gattag

SEQ ID NO: 108201 - DNA, 7 bp, Unknown
  misc_feature (1)..( 7): Result.002 file - promoters60/1380963
attatta

SEQ ID NO: 108202 - DNA, 7 bp, Unknown
  misc_feature (1)..( 7): Result.002 file - promoters60/1380963
attctta

SEQ ID NO: 108203 - DNA, 12 bp, Unknown
  misc_feature (1)..( 12): Result.002 file - promoters60/1381002
actacaattaag

SEQ ID NO: 108204 - DNA, 12 bp, Unknown
  misc_feature (1)..( 12): Result.002 file - promoters60/1381002
actaaaataaag

SEQ ID NO: 108205 - DNA, 12 bp, Unknown
  misc_feature (1)..( 12): Result.002 file - promoters60/1381002
cattaaataata

SEQ ID NO: 108206 - DNA, 12 bp, Unknown
  misc_feature (1)..( 12): Result.002 file - promoters60/1381002
aataaaatctag

SEQ ID NO: 108207 - DNA, 12 bp, Unknown
  misc_feature (1)..( 12): Result.002 file - promoters60/1381002
attaaaattgtc

SEQ ID NO: 108208 - DNA, 12 bp, Unknown
  misc_feature (1)..( 12): Result.002 file - promoters60/1381002
gagaaaaaaaag

SEQ ID NO: 108209 - DNA, 16 bp, Unknown
  misc_feature (1)..( 16): Result.002 file - promoters60/1381002
tcaaaaactttcataa

SEQ ID NO: 108210 - DNA, 16 bp, Unknown
  misc_feature (1)..( 16): Result.002 file - promoters60/1381002
tattaaattttaattg

SEQ ID NO: 108211 - DNA, 16 bp, Unknown
  misc_feature (1)..( 16): Result.002 file - promoters60/1381002
catgttactttcttaa

SEQ ID NO: 108212 - DNA, 16 bp, Unknown
  misc_feature (1)..( 16): Result.002 file - promoters60/1381002
tatcaaattgacttgt

SEQ ID NO: 108213 - DNA, 16 bp, Unknown
  misc_feature (1)..( 16): Result.002 file - promoters60/1381002
attcttacttgttcta

SEQ ID NO: 108214 - DNA, 9 bp, Unknown
  misc_feature (1)..( 9): Result.002 file - promoters60/1381033
atacatatg

SEQ ID NO: 108215 - DNA, 9 bp, Unknown
  misc_feature (1)..( 9): Result.002 file - promoters60/1381033
ataaatatg

SEQ ID NO: 108216 - DNA, 8 bp, Unknown
  misc_feature (1)..( 8): Result.002 file - promoters60/1381033
atatgaaa

SEQ ID NO: 108217 - DNA, 8 bp, Unknown
  misc_feature (1)..( 8): Result.002 file - promoters60/1381033
atattaaa

SEQ ID NO: 108218 - DNA, 9 bp, Unknown
  misc_feature (1)..( 9): Result.002 file - promoters60/1381033
atatcattc

SEQ ID NO: 108219 - DNA, 9 bp, Unknown
  misc_feature (1)..( 9): Result.002 file - promoters60/1381033
atatctttc

SEQ ID NO: 108220 - DNA, 7 bp, Unknown
  misc_feature (1)..( 7): Result.002 file - promoters60/1381033
ttttttc

SEQ ID NO: 108221 - DNA, 7 bp, Unknown
  misc_feature (1)..( 7): Result.002 file - promoters60/1381033
tttattc

SEQ ID NO: 108222 - DNA, 6 bp, Unknown
  misc_feature (1)..( 6): Result.002 file - promoters60/1381033
atgacc

SEQ ID NO: 108223 - DNA, 6 bp, Unknown
  misc_feature (1)..( 6): Result.002 file - promoters60/1381033
atgacc

SEQ ID NO: 108224 - DNA, 11 bp, Unknown
  misc_feature (1)..( 11): Result.002 file - promoters60/1381033
agataatgatt

SEQ ID NO: 108225 - DNA, 11 bp, Unknown
  misc_feature (1)..( 11): Result.002 file - promoters60/1381033
agataataatt

SEQ ID NO: 108226 - DNA, 11 bp, Unknown
  misc_feature (1)..( 11): Result.002 file - promoters60/1381033
caataatgatt

SEQ ID NO: 108227 - DNA, 8 bp, Unknown
  misc_feature (1)..( 8): Result.002 file - promoters60/1381033
gaaaaata

SEQ ID NO: 108228 - DNA, 8 bp, Unknown
  misc_feature (1)..( 8): Result.002 file - promoters60/1381033
gaaacata

SEQ ID NO: 108229 - DNA, 8 bp, Unknown
  misc_feature (1)..( 8): Result.002 file - promoters60/1381033
aacaaaca

SEQ ID NO: 108230 - DNA, 8 bp, Unknown
  misc_feature (1)..( 8): Result.002 file - promoters60/1381033
aacacaca

SEQ ID NO: 108231 - DNA, 8 bp, Unknown
  misc_feature (1)..( 8): Result.002 file - promoters60/1381033
cccacaca

SEQ ID NO: 108232 - DNA, 7 bp, Unknown
  misc_feature (1)..( 7): Result.002 file - promoters60/1381033
aaacaaa

SEQ ID NO: 108233 - DNA, 7 bp, Unknown
  misc_feature (1)..( 7): Result.002 file - promoters60/1381033
aaaaaaa

SEQ ID NO: 108234 - DNA, 6 bp, Unknown
  misc_feature (1)..( 6): Result.002 file - promoters60/1381033
aaatta

SEQ ID NO: 108235 - DNA, 6 bp, Unknown
  misc_feature (1)..( 6): Result.002 file - promoters60/1381033
aaatta

SEQ ID NO: 108236 - DNA, 8 bp, Unknown
  misc_feature (1)..( 8): Result.002 file - promoters60/1381033
actctaaa

SEQ ID NO: 108237 - DNA, 8 bp, Unknown
  misc_feature (1)..( 8): Result.002 file - promoters60/1381033
actttaaa

SEQ ID NO: 108238 - DNA, 6 bp, Unknown
  misc_feature (1)..( 6): Result.002 file - promoters60/1381033
tatgtg

SEQ ID NO: 108239 - DNA, 6 bp, Unknown
  misc_feature (1)..( 6): Result.002 file - promoters60/1381033
tatgtg

SEQ ID NO: 108240 - DNA, 11 bp, Unknown
  misc_feature (1)..( 11): Result.002 file - promoters60/1381033
ctttttttttt

SEQ ID NO: 108241 - DNA, 11 bp, Unknown
  misc_feature (1)..( 11): Result.002 file - promoters60/1381033
ctttttttttt

SEQ ID NO: 108242 - DNA, 7 bp, Unknown
  misc_feature (1)..( 7): Result.002 file - promoters60/1381033
cacaaaa

SEQ ID NO: 108243 - DNA, 7 bp, Unknown
  misc_feature (1)..( 7): Result.002 file - promoters60/1381033
cacaaaa

SEQ ID NO: 108244 - DNA, 6 bp, Unknown
  misc_feature (1)..( 6): Result.002 file - promoters60/1381195
tattct

SEQ ID NO: 108245 - DNA, 6 bp, Unknown
  misc_feature (1)..( 6): Result.002 file - promoters60/1381195
tattct

SEQ ID NO: 108246 - DNA, 7 bp, Unknown
  misc_feature (1)..( 7): Result.002 file - promoters60/1381195
taagtgg

SEQ ID NO: 108247 - DNA, 7 bp, Unknown
  misc_feature (1)..( 7): Result.002 file - promoters60/1381195
taattgg

SEQ ID NO: 108248 - DNA, 7 bp, Unknown
  misc_feature (1)..( 7): Result.002 file - promoters60/1381195
taaatgg

SEQ ID NO: 108249 - DNA, 8 bp, Unknown
  misc_feature (1)..( 8): Result.002 file - promoters60/1381195
atatgtgt

SEQ ID NO: 108250 - DNA, 8 bp, Unknown
  misc_feature (1)..( 8): Result.002 file - promoters60/1381195
atatatgt

SEQ ID NO: 108251 - DNA, 8 bp, Unknown
  misc_feature (1)..( 8): Result.002 file - promoters60/1381195
tcaatatt

SEQ ID NO: 108252 - DNA, 8 bp, Unknown
  misc_feature (1)..( 8): Result.002 file - promoters60/1381195
tcactatt

SEQ ID NO: 108253 - DNA, 7 bp, Unknown
  misc_feature (1)..( 7): Result.002 file - promoters60/1381195
aacatta

SEQ ID NO: 108254 - DNA, 7 bp, Unknown
  misc_feature (1)..( 7): Result.002 file - promoters60/1381195
aacttta

SEQ ID NO: 108255 - DNA, 6 bp, Unknown
  misc_feature (1)..( 6): Result.002 file - promoters60/1381195
ttttgt

SEQ ID NO: 108256 - DNA, 6 bp, Unknown
  misc_feature (1)..( 6): Result.002 file - promoters60/1381195
ttttgt

SEQ ID NO: 108257 - DNA, 6 bp, Unknown
  misc_feature (1)..( 6): Result.002 file - promoters60/1381195
gcttaa

SEQ ID NO: 108258 - DNA, 6 bp, Unknown
  misc_feature (1)..( 6): Result.002 file - promoters60/1381195
gcttaa

SEQ ID NO: 108259 - DNA, 7 bp, Unknown
  misc_feature (1)..( 7): Result.002 file - promoters60/1381195
aacacaa

SEQ ID NO: 108260 - DNA, 7 bp, Unknown
  misc_feature (1)..( 7): Result.002 file - promoters60/1381195
aactcaa

SEQ ID NO: 108261 - DNA, 7 bp, Unknown
  misc_feature (1)..( 7): Result.002 file - promoters60/1381195
attgata

SEQ ID NO: 108262 - DNA, 7 bp, Unknown
  misc_feature (1)..( 7): Result.002 file - promoters60/1381195
atttata

SEQ ID NO: 108263 - DNA, 6 bp, Unknown
  misc_feature (1)..( 6): Result.002 file - promoters60/1381195
taatta

SEQ ID NO: 108264 - DNA, 6 bp, Unknown
  misc_feature (1)..( 6): Result.002 file - promoters60/1381195
taatta

SEQ ID NO: 108265 - DNA, 8 bp, Unknown
  misc_feature (1)..( 8): Result.002 file - promoters60/1381195
ttaactac

SEQ ID NO: 108266 - DNA, 8 bp, Unknown
  misc_feature (1)..( 8): Result.002 file - promoters60/1381195
ttaactac

SEQ ID NO: 108267 - DNA, 6 bp, Unknown
  misc_feature (1)..( 6): Result.002 file - promoters60/1381195
gtaaat

SEQ ID NO: 108268 - DNA, 6 bp, Unknown
  misc_feature (1)..( 6): Result.002 file - promoters60/1381195
gtaaat

SEQ ID NO: 108269 - DNA, 8 bp, Unknown
  misc_feature (1)..( 8): Result.002 file - promoters60/1381195
tttactat

SEQ ID NO: 108270 - DNA, 8 bp, Unknown
  misc_feature (1)..( 8): Result.002 file - promoters60/1381195
tttattat

SEQ ID NO: 108271 - DNA, 7 bp, Unknown
  misc_feature (1)..( 7): Result.002 file - promoters60/1381195
ctttatt

SEQ ID NO: 108272 - DNA, 7 bp, Unknown
  misc_feature (1)..( 7): Result.002 file - promoters60/1381195
ctttatt

SEQ ID NO: 108273 - DNA, 10 bp, Unknown
  misc_feature (1)..( 10): Result.002 file - promoters60/1381195
tgtctagatt

SEQ ID NO: 108274 - DNA, 10 bp, Unknown
  misc_feature (1)..( 10): Result.002 file - promoters60/1381195
tgtttagatt

SEQ ID NO: 108275 - DNA, 6 bp, Unknown
  misc_feature (1)..( 6): Result.002 file - promoters60/1381195
tatagt

SEQ ID NO: 108276 - DNA, 6 bp, Unknown
  misc_feature (1)..( 6): Result.002 file - promoters60/1381195
tatagt

SEQ ID NO: 108277 - DNA, 7 bp, Unknown
  misc_feature (1)..( 7): Result.002 file - promoters60/1381195
attgtaa

SEQ ID NO: 108278 - DNA, 7 bp, Unknown
  misc_feature (1)..( 7): Result.002 file - promoters60/1381195
attgtaa

SEQ ID NO: 108279 - DNA, 6 bp, Unknown
  misc_feature (1)..( 6): Result.002 file - promoters60/1381195
tgattc

SEQ ID NO: 108280 - DNA, 6 bp, Unknown
  misc_feature (1)..( 6): Result.002 file - promoters60/1381195
tgattc

SEQ ID NO: 108281 - DNA, 11 bp, Unknown
  misc_feature (1)..( 11): Result.002 file - promoters60/1381457
ggcttttgacc

SEQ ID NO: 108282 - DNA, 11 bp, Unknown
  misc_feature (1)..( 11): Result.002 file - promoters60/1381457
ggcttatgaat

SEQ ID NO: 108283 - DNA, 11 bp, Unknown
  misc_feature (1)..( 11): Result.002 file - promoters60/1381457
agattttgatt

SEQ ID NO: 108284 - DNA, 11 bp, Unknown
  misc_feature (1)..( 11): Result.002 file - promoters60/1381457
aggttttgaaa

SEQ ID NO: 108285 - DNA, 11 bp, Unknown
  misc_feature (1)..( 11): Result.002 file - promoters60/1381457
gtcttatgtgg

SEQ ID NO: 108286 - DNA, 11 bp, Unknown
  misc_feature (1)..( 11): Result.002 file - promoters60/1381457
taagtataaat

SEQ ID NO: 108287 - DNA, 11 bp, Unknown
  misc_feature (1)..( 11): Result.002 file - promoters60/1381457
tctgtttcatt

SEQ ID NO: 108288 - DNA, 9 bp, Unknown
  misc_feature (1)..( 9): Result.002 file - promoters60/1381494
tgttttaat

SEQ ID NO: 108289 - DNA, 9 bp, Unknown
  misc_feature (1)..( 9): Result.002 file - promoters60/1381494
tgtgttaat

SEQ ID NO: 108290 - DNA, 9 bp, Unknown
  misc_feature (1)..( 9): Result.002 file - promoters60/1381494
aaatggttt

SEQ ID NO: 108291 - DNA, 9 bp, Unknown
  misc_feature (1)..( 9): Result.002 file - promoters60/1381494
aaatgcttt

SEQ ID NO: 108292 - DNA, 7 bp, Unknown
  misc_feature (1)..( 7): Result.002 file - promoters60/1381494
ttctttg

SEQ ID NO: 108293 - DNA, 7 bp, Unknown
  misc_feature (1)..( 7): Result.002 file - promoters60/1381494
ttctttg

SEQ ID NO: 108294 - DNA, 6 bp, Unknown
  misc_feature (1)..( 6): Result.002 file - promoters60/1381494
atttat

SEQ ID NO: 108295 - DNA, 6 bp, Unknown
  misc_feature (1)..( 6): Result.002 file - promoters60/1381494
atttat

SEQ ID NO: 108296 - DNA, 8 bp, Unknown
  misc_feature (1)..( 8): Result.002 file - promoters60/1381494
ggggtaaa

SEQ ID NO: 108297 - DNA, 8 bp, Unknown
  misc_feature (1)..( 8): Result.002 file - promoters60/1381494
ggggtaaa

SEQ ID NO: 108298 - DNA, 7 bp, Unknown
  misc_feature (1)..( 7): Result.002 file - promoters60/1381494
ttatatc

SEQ ID NO: 108299 - DNA, 7 bp, Unknown
  misc_feature (1)..( 7): Result.002 file - promoters60/1381494
ttagatc

SEQ ID NO: 108300 - DNA, 8 bp, Unknown
  misc_feature (1)..( 8): Result.002 file - promoters60/1381494
aatccctg

SEQ ID NO: 108301 - DNA, 8 bp, Unknown
  misc_feature (1)..( 8): Result.002 file - promoters60/1381494
aatctctg

SEQ ID NO: 108302 - DNA, 6 bp, Unknown
  misc_feature (1)..( 6): Result.002 file - promoters60/1381494
tccaaa

SEQ ID NO: 108303 - DNA, 6 bp, Unknown
  misc_feature (1)..( 6): Result.002 file - promoters60/1381494
tccaaa

SEQ ID NO: 108304 - DNA, 8 bp, Unknown
  misc_feature (1)..( 8): Result.002 file - promoters60/1381494
tccataga

SEQ ID NO: 108305 - DNA, 8 bp, Unknown
  misc_feature (1)..( 8): Result.002 file - promoters60/1381494
tccaaaga

SEQ ID NO: 108306 - DNA, 9 bp, Unknown
  misc_feature (1)..( 9): Result.002 file - promoters60/1381494
aatttatgg

SEQ ID NO: 108307 - DNA, 9 bp, Unknown
  misc_feature (1)..( 9): Result.002 file - promoters60/1381494
aattaatgg

SEQ ID NO: 108308 - DNA, 7 bp, Unknown
  misc_feature (1)..( 7): Result.002 file - promoters60/1381494
attttca

SEQ ID NO: 108309 - DNA, 7 bp, Unknown
  misc_feature (1)..( 7): Result.002 file - promoters60/1381494
attgtca

SEQ ID NO: 108310 - DNA, 6 bp, Unknown
  misc_feature (1)..( 6): Result.002 file - promoters60/1381494
agtaaa

SEQ ID NO: 108311 - DNA, 6 bp, Unknown
  misc_feature (1)..( 6): Result.002 file - promoters60/1381494
agtaaa

SEQ ID NO: 108312 - DNA, 7 bp, Unknown
  misc_feature (1)..( 7): Result.002 file - promoters60/1381494
aatcggg

SEQ ID NO: 108313 - DNA, 7 bp, Unknown
  misc_feature (1)..( 7): Result.002 file - promoters60/1381494
aattggg

SEQ ID NO: 108314 - DNA, 8 bp, Unknown
  misc_feature (1)..( 8): Result.002 file - promoters60/1381494
gaaagaaa

SEQ ID NO: 108315 - DNA, 8 bp, Unknown
  misc_feature (1)..( 8): Result.002 file - promoters60/1381494
gaaacaaa

SEQ ID NO: 108316 - DNA, 10 bp, Unknown
  misc_feature (1)..( 10): Result.002 file - promoters60/1381494
ggaaaagaaa

SEQ ID NO: 108317 - DNA, 10 bp, Unknown
  misc_feature (1)..( 10): Result.002 file - promoters60/1381494
ggaaatgaaa

SEQ ID NO: 108318 - DNA, 7 bp, Unknown
  misc_feature (1)..( 7): Result.002 file - promoters60/1381494
cccacta

SEQ ID NO: 108319 - DNA, 7 bp, Unknown
  misc_feature (1)..( 7): Result.002 file - promoters60/1381494
cccacta

SEQ ID NO: 108320 - DNA, 9 bp, Unknown
  misc_feature (1)..( 9): Result.002 file - promoters60/1381494
aaagaaaag

SEQ ID NO: 108321 - DNA, 9 bp, Unknown
  misc_feature (1)..( 9): Result.002 file - promoters60/1381494
aaagtaaag

SEQ ID NO: 108322 - DNA, 7 bp, Unknown
  misc_feature (1)..( 7): Result.002 file - promoters60/1381494
gtatata

SEQ ID NO: 108323 - DNA, 7 bp, Unknown
  misc_feature (1)..( 7): Result.002 file - promoters60/1381494
gtatata

SEQ ID NO: 108324 - DNA, 8 bp, Unknown
  misc_feature (1)..( 8): Result.002 file - promoters60/1381537
ggattctt

SEQ ID NO: 108325 - DNA, 8 bp, Unknown
  misc_feature (1)..( 8): Result.002 file - promoters60/1381537
ggattctt

SEQ ID NO: 108326 - DNA, 8 bp, Unknown
  misc_feature (1)..( 8): Result.002 file - promoters60/1381537
agatggat

SEQ ID NO: 108327 - DNA, 8 bp, Unknown
  misc_feature (1)..( 8): Result.002 file - promoters60/1381537
agatagat

SEQ ID NO: 108328 - DNA, 7 bp, Unknown
  misc_feature (1)..( 7): Result.002 file - promoters60/1381537
catcttc

SEQ ID NO: 108329 - DNA, 7 bp, Unknown
  misc_feature (1)..( 7): Result.002 file - promoters60/1381537
cattttc

SEQ ID NO: 108330 - DNA, 7 bp, Unknown
  misc_feature (1)..( 7): Result.002 file - promoters60/1381537
tcatttt

SEQ ID NO: 108331 - DNA, 7 bp, Unknown
  misc_feature (1)..( 7): Result.002 file - promoters60/1381537
tcacttt

SEQ ID NO: 108332 - DNA, 10 bp, Unknown
  misc_feature (1)..( 10): Result.002 file - promoters60/1381537
aaaatccttt

SEQ ID NO: 108333 - DNA, 10 bp, Unknown
  misc_feature (1)..( 10): Result.002 file - promoters60/1381537
aaaatgcttt

SEQ ID NO: 108334 - DNA, 9 bp, Unknown
  misc_feature (1)..( 9): Result.002 file - promoters60/1381537
taaaacaaa

SEQ ID NO: 108335 - DNA, 9 bp, Unknown
  misc_feature (1)..( 9): Result.002 file - promoters60/1381537
caaaataaa

SEQ ID NO: 108336 - DNA, 9 bp, Unknown
  misc_feature (1)..( 9): Result.002 file - promoters60/1381537
taaaccaat

SEQ ID NO: 108337 - DNA, 7 bp, Unknown
  misc_feature (1)..( 7): Result.002 file - promoters60/1381537
gaaaaat

SEQ ID NO: 108338 - DNA, 7 bp, Unknown
  misc_feature (1)..( 7): Result.002 file - promoters60/1381537
gaagaat

SEQ ID NO: 108339 - DNA, 9 bp, Unknown
  misc_feature (1)..( 9): Result.002 file - promoters60/1381537
tcctcattt

SEQ ID NO: 108340 - DNA, 9 bp, Unknown
  misc_feature (1)..( 9): Result.002 file - promoters60/1381537
tcctaattt

SEQ ID NO: 108341 - DNA, 6 bp, Unknown
  misc_feature (1)..( 6): Result.002 file - promoters60/1381537
tttgtt

SEQ ID NO: 108342 - DNA, 6 bp, Unknown
  misc_feature (1)..( 6): Result.002 file - promoters60/1381537
tttgtt

SEQ ID NO: 108343 - DNA, 6 bp, Unknown
  misc_feature (1)..( 6): Result.002 file - promoters60/1381537
taaagg

SEQ ID NO: 108344 - DNA, 6 bp, Unknown
  misc_feature (1)..( 6): Result.002 file - promoters60/1381537
taaagg

SEQ ID NO: 108345 - DNA, 6 bp, Unknown
  misc_feature (1)..( 6): Result.002 file - promoters60/1381537
ttagat

SEQ ID NO: 108346 - DNA, 6 bp, Unknown
  misc_feature (1)..( 6): Result.002 file - promoters60/1381537
ttagat

SEQ ID NO: 108347 - DNA, 7 bp, Unknown
  misc_feature (1)..( 7): Result.002 file - promoters60/1381537
ggttgaa

SEQ ID NO: 108348 - DNA, 7 bp, Unknown
  misc_feature (1)..( 7): Result.002 file - promoters60/1381537
ggttgaa

SEQ ID NO: 108349 - DNA, 6 bp, Unknown
  misc_feature (1)..( 6): Result.002 file - promoters60/1381537
tttaat

SEQ ID NO: 108350 - DNA, 6 bp, Unknown
  misc_feature (1)..( 6): Result.002 file - promoters60/1381537
tttaat

SEQ ID NO: 108351 - DNA, 8 bp, Unknown
  misc_feature (1)..( 8): Result.002 file - promoters60/1381537
agaaaaaa

SEQ ID NO: 108352 - DNA, 8 bp, Unknown
  misc_feature (1)..( 8): Result.002 file - promoters60/1381537
agaaaaaa

SEQ ID NO: 108353 - DNA, 8 bp, Unknown
  misc_feature (1)..( 8): Result.002 file - promoters60/1381537
aaaataaa

SEQ ID NO: 108354 - DNA, 8 bp, Unknown
  misc_feature (1)..( 8): Result.002 file - promoters60/1381537
aaaaaaaa

SEQ ID NO: 108355 - DNA, 8 bp, Unknown
  misc_feature (1)..( 8): Result.002 file - promoters60/1381537
gcccatta

SEQ ID NO: 108356 - DNA, 8 bp, Unknown
  misc_feature (1)..( 8): Result.002 file - promoters60/1381537
gcccatta

SEQ ID NO: 108357 - DNA, 6 bp, Unknown
  misc_feature (1)..( 6): Result.002 file - promoters60/1381537
agtaaa

SEQ ID NO: 108358 - DNA, 6 bp, Unknown
  misc_feature (1)..( 6): Result.002 file - promoters60/1381537
agtaaa

SEQ ID NO: 108359 - DNA, 7 bp, Unknown
  misc_feature (1)..( 7): Result.002 file - promoters60/1381537
aatcggg

SEQ ID NO: 108360 - DNA, 7 bp, Unknown
  misc_feature (1)..( 7): Result.002 file - promoters60/1381537
aattggg

SEQ ID NO: 108361 - DNA, 8 bp, Unknown
  misc_feature (1)..( 8): Result.002 file - promoters60/1381537
gaaagaaa

SEQ ID NO: 108362 - DNA, 8 bp, Unknown
  misc_feature (1)..( 8): Result.002 file - promoters60/1381537
gaaacaaa

SEQ ID NO: 108363 - DNA, 10 bp, Unknown
  misc_feature (1)..( 10): Result.002 file - promoters60/1381537
ggaaaagaaa

SEQ ID NO: 108364 - DNA, 10 bp, Unknown
  misc_feature (1)..( 10): Result.002 file - promoters60/1381537
ggaaatgaaa

SEQ ID NO: 108365 - DNA, 7 bp, Unknown
  misc_feature (1)..( 7): Result.002 file - promoters60/1381537
cccacta

SEQ ID NO: 108366 - DNA, 7 bp, Unknown
  misc_feature (1)..( 7): Result.002 file - promoters60/1381537
cccacta

SEQ ID NO: 108367 - DNA, 9 bp, Unknown
  misc_feature (1)..( 9): Result.002 file - promoters60/1381537
aaagaaaag

SEQ ID NO: 108368 - DNA, 9 bp, Unknown
  misc_feature (1)..( 9): Result.002 file - promoters60/1381537
aaagtaaag

SEQ ID NO: 108369 - DNA, 7 bp, Unknown
  misc_feature (1)..( 7): Result.002 file - promoters60/1381537
gtatata

SEQ ID NO: 108370 - DNA, 7 bp, Unknown
  misc_feature (1)..( 7): Result.002 file - promoters60/1381537
gtatata

SEQ ID NO: 108371 - DNA, 8 bp, Unknown
  misc_feature (1)..( 8): Result.002 file - promoters60/1381563
tgaagaaa

SEQ ID NO: 108372 - DNA, 8 bp, Unknown
  misc_feature (1)..( 8): Result.002 file - promoters60/1381563
tgatgaat

SEQ ID NO: 108373 - DNA, 8 bp, Unknown
  misc_feature (1)..( 8): Result.002 file - promoters60/1381563
ggataaat

SEQ ID NO: 108374 - DNA, 8 bp, Unknown
  misc_feature (1)..( 8): Result.002 file - promoters60/1381563
agataaaa

SEQ ID NO: 108375 - DNA, 9 bp, Unknown
  misc_feature (1)..( 9): Result.002 file - promoters60/1381563
ttacaaaaa

SEQ ID NO: 108376 - DNA, 9 bp, Unknown
  misc_feature (1)..( 9): Result.002 file - promoters60/1381563
ttagaaaaa

SEQ ID NO: 108377 - DNA, 9 bp, Unknown
  misc_feature (1)..( 9): Result.002 file - promoters60/1381563
gtacaaact

SEQ ID NO: 108378 - DNA, 9 bp, Unknown
  misc_feature (1)..( 9): Result.002 file - promoters60/1381563
ttataaaac

SEQ ID NO: 108379 - DNA, 10 bp, Unknown
  misc_feature (1)..( 10): Result.002 file - promoters60/1381563
gaaagattgt

SEQ ID NO: 108380 - DNA, 10 bp, Unknown
  misc_feature (1)..( 10): Result.002 file - promoters60/1381563
taaagcttgg

SEQ ID NO: 108381 - DNA, 10 bp, Unknown
  misc_feature (1)..( 10): Result.002 file - promoters60/1381563
taaaaattta

SEQ ID NO: 108382 - DNA, 10 bp, Unknown
  misc_feature (1)..( 10): Result.002 file - promoters60/1381563
taaaaaggag

SEQ ID NO: 108383 - DNA, 10 bp, Unknown
  misc_feature (1)..( 10): Result.002 file - promoters60/1381563
taaaagttta

SEQ ID NO: 108384 - DNA, 9 bp, Unknown
  misc_feature (1)..( 9): Result.002 file - promoters60/1381563
tcccactaa

SEQ ID NO: 108385 - DNA, 9 bp, Unknown
  misc_feature (1)..( 9): Result.002 file - promoters60/1381563
aaccattaa

SEQ ID NO: 108386 - DNA, 9 bp, Unknown
  misc_feature (1)..( 9): Result.002 file - promoters60/1381563
aactattct

SEQ ID NO: 108387 - DNA, 9 bp, Unknown
  misc_feature (1)..( 9): Result.002 file - promoters60/1381563
gtccattag

SEQ ID NO: 108388 - DNA, 10 bp, Unknown
  misc_feature (1)..( 10): Result.002 file - promoters60/1381563
ttctttgaat

SEQ ID NO: 108389 - DNA, 10 bp, Unknown
  misc_feature (1)..( 10): Result.002 file - promoters60/1381563
atatttaaat

SEQ ID NO: 108390 - DNA, 10 bp, Unknown
  misc_feature (1)..( 10): Result.002 file - promoters60/1381563
tgatttttgg

SEQ ID NO: 108391 - DNA, 10 bp, Unknown
  misc_feature (1)..( 10): Result.002 file - promoters60/1381563
cactttaaaa

SEQ ID NO: 108392 - DNA, 9 bp, Unknown
  misc_feature (1)..( 9): Result.002 file - promoters60/1381566
cagaaaaac

SEQ ID NO: 108393 - DNA, 9 bp, Unknown
  misc_feature (1)..( 9): Result.002 file - promoters60/1381566
atcaaaaac

SEQ ID NO: 108394 - DNA, 9 bp, Unknown
  misc_feature (1)..( 9): Result.002 file - promoters60/1381566
tagagaaag

SEQ ID NO: 108395 - DNA, 9 bp, Unknown
  misc_feature (1)..( 9): Result.002 file - promoters60/1381566
tagagaagc

SEQ ID NO: 108396 - DNA, 7 bp, Unknown
  misc_feature (1)..( 7): Result.002 file - promoters60/1381615
acacagt

SEQ ID NO: 108397 - DNA, 7 bp, Unknown
  misc_feature (1)..( 7): Result.002 file - promoters60/1381615
acaaagt

SEQ ID NO: 108398 - DNA, 6 bp, Unknown
  misc_feature (1)..( 6): Result.002 file - promoters60/1381615
taacaa

SEQ ID NO: 108399 - DNA, 6 bp, Unknown
  misc_feature (1)..( 6): Result.002 file - promoters60/1381615
taacaa

SEQ ID NO: 108400 - DNA, 6 bp, Unknown
  misc_feature (1)..( 6): Result.002 file - promoters60/1381615
atctga

SEQ ID NO: 108401 - DNA, 6 bp, Unknown
  misc_feature (1)..( 6): Result.002 file - promoters60/1381615
atctga

SEQ ID NO: 108402 - DNA, 8 bp, Unknown
  misc_feature (1)..( 8): Result.002 file - promoters60/1381615
actgttca

SEQ ID NO: 108403 - DNA, 8 bp, Unknown
  misc_feature (1)..( 8): Result.002 file - promoters60/1381615
actcttca

SEQ ID NO: 108404 - DNA, 8 bp, Unknown
  misc_feature (1)..( 8): Result.002 file - promoters60/1381615
atgtgtat

SEQ ID NO: 108405 - DNA, 8 bp, Unknown
  misc_feature (1)..( 8): Result.002 file - promoters60/1381615
atgtatat

SEQ ID NO: 108406 - DNA, 6 bp, Unknown
  misc_feature (1)..( 6): Result.002 file - promoters60/1381615
ctgttt

SEQ ID NO: 108407 - DNA, 6 bp, Unknown
  misc_feature (1)..( 6): Result.002 file - promoters60/1381615
ctgttt

SEQ ID NO: 108408 - DNA, 7 bp, Unknown
  misc_feature (1)..( 7): Result.002 file - promoters60/1381615
tcaacag

SEQ ID NO: 108409 - DNA, 7 bp, Unknown
  misc_feature (1)..( 7): Result.002 file - promoters60/1381615
tcaccag

SEQ ID NO: 108410 - DNA, 7 bp, Unknown
  misc_feature (1)..( 7): Result.002 file - promoters60/1381615
ttacagg

SEQ ID NO: 108411 - DNA, 7 bp, Unknown
  misc_feature (1)..( 7): Result.002 file - promoters60/1381615
ttacagg

SEQ ID NO: 108412 - DNA, 7 bp, Unknown
  misc_feature (1)..( 7): Result.002 file - promoters60/1381615
tacaact

SEQ ID NO: 108413 - DNA, 7 bp, Unknown
  misc_feature (1)..( 7): Result.002 file - promoters60/1381615
tacaact

SEQ ID NO: 108414 - DNA, 9 bp, Unknown
  misc_feature (1)..( 9): Result.002 file - promoters60/1381615
tttgatgat

SEQ ID NO: 108415 - DNA, 9 bp, Unknown
  misc_feature (1)..( 9): Result.002 file - promoters60/1381615
tttcatgat

SEQ ID NO: 108416 - DNA, 6 bp, Unknown
  misc_feature (1)..( 6): Result.002 file - promoters60/1381615
caacat

SEQ ID NO: 108417 - DNA, 6 bp, Unknown
  misc_feature (1)..( 6): Result.002 file - promoters60/1381615
caacat

SEQ ID NO: 108418 - DNA, 10 bp, Unknown
  misc_feature (1)..( 10): Result.002 file - promoters60/1381647
ttctcttaat

SEQ ID NO: 108419 - DNA, 10 bp, Unknown
  misc_feature (1)..( 10): Result.002 file - promoters60/1381647
aagtctgaat

SEQ ID NO: 108420 - DNA, 10 bp, Unknown
  misc_feature (1)..( 10): Result.002 file - promoters60/1381647
aagtttgata

SEQ ID NO: 108421 - DNA, 10 bp, Unknown
  misc_feature (1)..( 10): Result.002 file - promoters60/1381647
aaatatgttg

SEQ ID NO: 108422 - DNA, 9 bp, Unknown
  misc_feature (1)..( 9): Result.002 file - promoters60/1381647
aaatgaaga

SEQ ID NO: 108423 - DNA, 9 bp, Unknown
  misc_feature (1)..( 9): Result.002 file - promoters60/1381647
gaatgaaga

SEQ ID NO: 108424 - DNA, 10 bp, Unknown
  misc_feature (1)..( 10): Result.002 file - promoters60/1381647
aaactgaagc

SEQ ID NO: 108425 - DNA, 10 bp, Unknown
  misc_feature (1)..( 10): Result.002 file - promoters60/1381647
accttcgtcc

SEQ ID NO: 108426 - DNA, 10 bp, Unknown
  misc_feature (1)..( 10): Result.002 file - promoters60/1381647
atcttcttcc

SEQ ID NO: 108427 - DNA, 10 bp, Unknown
  misc_feature (1)..( 10): Result.002 file - promoters60/1381647
atcatctaaa

SEQ ID NO: 108428 - DNA, 9 bp, Unknown
  misc_feature (1)..( 9): Result.002 file - promoters60/1381647
atttccttt

SEQ ID NO: 108429 - DNA, 9 bp, Unknown
  misc_feature (1)..( 9): Result.002 file - promoters60/1381647
gttttcttt

SEQ ID NO: 108430 - DNA, 9 bp, Unknown
  misc_feature (1)..( 9): Result.002 file - promoters60/1381647
gttttcgta

SEQ ID NO: 108431 - DNA, 9 bp, Unknown
  misc_feature (1)..( 9): Result.002 file - promoters60/1381647
ttaattatg

SEQ ID NO: 108432 - DNA, 9 bp, Unknown
  misc_feature (1)..( 9): Result.002 file - promoters60/1381647
ataaatatg

SEQ ID NO: 108433 - DNA, 9 bp, Unknown
  misc_feature (1)..( 9): Result.002 file - promoters60/1381647
ataagtttg

SEQ ID NO: 108434 - DNA, 7 bp, Unknown
  misc_feature (1)..( 7): Result.002 file - promoters60/1381647
tttgttt

SEQ ID NO: 108435 - DNA, 7 bp, Unknown
  misc_feature (1)..( 7): Result.002 file - promoters60/1381647
tttcttt

SEQ ID NO: 108436 - DNA, 7 bp, Unknown
  misc_feature (1)..( 7): Result.002 file - promoters60/1381647
tttgttc

SEQ ID NO: 108437 - DNA, 9 bp, Unknown
  misc_feature (1)..( 9): Result.002 file - promoters60/1381704
gtttccttt

SEQ ID NO: 108438 - DNA, 9 bp, Unknown
  misc_feature (1)..( 9): Result.002 file - promoters60/1381704
gttaccttt

SEQ ID NO: 108439 - DNA, 9 bp, Unknown
  misc_feature (1)..( 9): Result.002 file - promoters60/1381704
gcttcgttt

SEQ ID NO: 108440 - DNA, 8 bp, Unknown
  misc_feature (1)..( 8): Result.002 file - promoters60/1381704
caccaata

SEQ ID NO: 108441 - DNA, 8 bp, Unknown
  misc_feature (1)..( 8): Result.002 file - promoters60/1381704
aaccaata

SEQ ID NO: 108442 - DNA, 8 bp, Unknown
  misc_feature (1)..( 8): Result.002 file - promoters60/1381704
aacaaata

SEQ ID NO: 108443 - DNA, 9 bp, Unknown
  misc_feature (1)..( 9): Result.002 file - promoters60/1381704
tttcctttt

SEQ ID NO: 108444 - DNA, 9 bp, Unknown
  misc_feature (1)..( 9): Result.002 file - promoters60/1381704
ttttcttaa

SEQ ID NO: 108445 - DNA, 9 bp, Unknown
  misc_feature (1)..( 9): Result.002 file - promoters60/1381704
gttcctaat

SEQ ID NO: 108446 - DNA, 10 bp, Unknown
  misc_feature (1)..( 10): Result.002 file - promoters60/1381818
gaaatatagg

SEQ ID NO: 108447 - DNA, 10 bp, Unknown
  misc_feature (1)..( 10): Result.002 file - promoters60/1381818
aaaatattaa

SEQ ID NO: 108448 - DNA, 10 bp, Unknown
  misc_feature (1)..( 10): Result.002 file - promoters60/1381818
taaaaattaa

SEQ ID NO: 108449 - DNA, 10 bp, Unknown
  misc_feature (1)..( 10): Result.002 file - promoters60/1381818
taacaattct

SEQ ID NO: 108450 - DNA, 10 bp, Unknown
  misc_feature (1)..( 10): Result.002 file - promoters60/1381818
ccaaaattca

SEQ ID NO: 108451 - DNA, 10 bp, Unknown
  misc_feature (1)..( 10): Result.002 file - promoters60/1381818
gtaaaatttc

SEQ ID NO: 108452 - DNA, 10 bp, Unknown
  misc_feature (1)..( 10): Result.002 file - promoters60/1381818
ccaaaattga

SEQ ID NO: 108453 - DNA, 9 bp, Unknown
  misc_feature (1)..( 9): Result.002 file - promoters60/1381818
tacaacaaa

SEQ ID NO: 108454 - DNA, 9 bp, Unknown
  misc_feature (1)..( 9): Result.002 file - promoters60/1381818
aaaaacaaa

SEQ ID NO: 108455 - DNA, 9 bp, Unknown
  misc_feature (1)..( 9): Result.002 file - promoters60/1381818
ataaataaa

SEQ ID NO: 108456 - DNA, 9 bp, Unknown
  misc_feature (1)..( 9): Result.002 file - promoters60/1381818
ttaaaaaaa

SEQ ID NO: 108457 - DNA, 9 bp, Unknown
  misc_feature (1)..( 9): Result.002 file - promoters60/1381818
caaaacaat

SEQ ID NO: 108458 - DNA, 9 bp, Unknown
  misc_feature (1)..( 9): Result.002 file - promoters60/1381818
tcaaacaaa

SEQ ID NO: 108459 - DNA, 9 bp, Unknown
  misc_feature (1)..( 9): Result.002 file - promoters60/1381818
caaaacatc

SEQ ID NO: 108460 - DNA, 12 bp, Unknown
  misc_feature (1)..( 12): Result.002 file - promoters60/1381818
ccactatataag

SEQ ID NO: 108461 - DNA, 12 bp, Unknown
  misc_feature (1)..( 12): Result.002 file - promoters60/1381818
ccattatatata

SEQ ID NO: 108462 - DNA, 12 bp, Unknown
  misc_feature (1)..( 12): Result.002 file - promoters60/1381818
cttgtatatata

SEQ ID NO: 108463 - DNA, 12 bp, Unknown
  misc_feature (1)..( 12): Result.002 file - promoters60/1381818
cgcctatatata

SEQ ID NO: 108464 - DNA, 12 bp, Unknown
  misc_feature (1)..( 12): Result.002 file - promoters60/1381818
gtgagatataat

SEQ ID NO: 108465 - DNA, 12 bp, Unknown
  misc_feature (1)..( 12): Result.002 file - promoters60/1381818
gcgctatttaag

SEQ ID NO: 108466 - DNA, 12 bp, Unknown
  misc_feature (1)..( 12): Result.002 file - promoters60/1381818
tttttaaaaatt

SEQ ID NO: 108467 - DNA, 12 bp, Unknown
  misc_feature (1)..( 12): Result.002 file - promoters60/1381818
gggctaaaaatg

SEQ ID NO: 108468 - DNA, 12 bp, Unknown
  misc_feature (1)..( 12): Result.002 file - promoters60/1381818
agtttcaaatac

SEQ ID NO: 108469 - DNA, 12 bp, Unknown
  misc_feature (1)..( 12): Result.002 file - promoters60/1381818
gttttaaatcat

SEQ ID NO: 108470 - DNA, 12 bp, Unknown
  misc_feature (1)..( 12): Result.002 file - promoters60/1381818
gtttccaatatg

SEQ ID NO: 108471 - DNA, 12 bp, Unknown
  misc_feature (1)..( 12): Result.002 file - promoters60/1381818
agagtaaagtga

SEQ ID NO: 108472 - DNA, 12 bp, Unknown
  misc_feature (1)..( 12): Result.002 file - promoters60/1381818
agatcaaatagg

SEQ ID NO: 108473 - DNA, 10 bp, Unknown
  misc_feature (1)..( 10): Result.002 file - promoters60/1381818
gaattcttta

SEQ ID NO: 108474 - DNA, 10 bp, Unknown
  misc_feature (1)..( 10): Result.002 file - promoters60/1381818
taattatttt

SEQ ID NO: 108475 - DNA, 10 bp, Unknown
  misc_feature (1)..( 10): Result.002 file - promoters60/1381818
acattttttt

SEQ ID NO: 108476 - DNA, 10 bp, Unknown
  misc_feature (1)..( 10): Result.002 file - promoters60/1381818
taattctttt

SEQ ID NO: 108477 - DNA, 10 bp, Unknown
  misc_feature (1)..( 10): Result.002 file - promoters60/1381818
atattattag

SEQ ID NO: 108478 - DNA, 10 bp, Unknown
  misc_feature (1)..( 10): Result.002 file - promoters60/1381818
ttattatatt

SEQ ID NO: 108479 - DNA, 10 bp, Unknown
  misc_feature (1)..( 10): Result.002 file - promoters60/1381818
atattattag

SEQ ID NO: 108480 - DNA, 11 bp, Unknown
  misc_feature (1)..( 11): Result.002 file - promoters60/1381818
gacttttgttc

SEQ ID NO: 108481 - DNA, 9 bp, Unknown
  misc_feature (1)..( 9): Result.002 file - promoters60/1381818
aaaaataaa

SEQ ID NO: 108482 - DNA, 9 bp, Unknown
  misc_feature (1)..( 9): Result.002 file - promoters60/1381818
aaaattaat

SEQ ID NO: 108483 - DNA, 9 bp, Unknown
  misc_feature (1)..( 9): Result.002 file - promoters60/1381818
taaaataca

SEQ ID NO: 108484 - DNA, 9 bp, Unknown
  misc_feature (1)..( 9): Result.002 file - promoters60/1381818
aaaaattta

SEQ ID NO: 108485 - DNA, 9 bp, Unknown
  misc_feature (1)..( 9): Result.002 file - promoters60/1381818
gataatatt

SEQ ID NO: 108486 - DNA, 9 bp, Unknown
  misc_feature (1)..( 9): Result.002 file - promoters60/1381818
tttaatatg

SEQ ID NO: 108487 - DNA, 10 bp, Unknown
  misc_feature (1)..( 10): Result.002 file - promoters60/1381818
aaataaaagc

SEQ ID NO: 108488 - DNA, 10 bp, Unknown
  misc_feature (1)..( 10): Result.002 file - promoters60/1381818
caataaaatt

SEQ ID NO: 108489 - DNA, 10 bp, Unknown
  misc_feature (1)..( 10): Result.002 file - promoters60/1381818
ttataaaata

SEQ ID NO: 108490 - DNA, 10 bp, Unknown
  misc_feature (1)..( 10): Result.002 file - promoters60/1381818
agataatatt

SEQ ID NO: 108491 - DNA, 11 bp, Unknown
  misc_feature (1)..( 11): Result.002 file - promoters60/1381818
atttacaaact

SEQ ID NO: 108492 - DNA, 11 bp, Unknown
  misc_feature (1)..( 11): Result.002 file - promoters60/1381818
taatatgaaga

SEQ ID NO: 108493 - DNA, 11 bp, Unknown
  misc_feature (1)..( 11): Result.002 file - promoters60/1381818
atgtttgttta

SEQ ID NO: 108494 - DNA, 11 bp, Unknown
  misc_feature (1)..( 11): Result.002 file - promoters60/1381818
ctttttatttc

SEQ ID NO: 108495 - DNA, 11 bp, Unknown
  misc_feature (1)..( 11): Result.002 file - promoters60/1381818
acttttgtttc

SEQ ID NO: 108496 - DNA, 11 bp, Unknown
  misc_feature (1)..( 11): Result.002 file - promoters60/1381818
acatttttttc

SEQ ID NO: 108497 - DNA, 11 bp, Unknown
  misc_feature (1)..( 11): Result.002 file - promoters60/1381818
ttaattctttt

SEQ ID NO: 108498 - DNA, 11 bp, Unknown
  misc_feature (1)..( 11): Result.002 file - promoters60/1381818
gacttttgttc

SEQ ID NO: 108499 - DNA, 8 bp, Unknown
  misc_feature (1)..( 8): Result.002 file - promoters60/1381896
ttggtttt

SEQ ID NO: 108500 - DNA, 8 bp, Unknown
  misc_feature (1)..( 8): Result.002 file - promoters60/1381896
ttggtttt

SEQ ID NO: 108501 - DNA, 6 bp, Unknown
  misc_feature (1)..( 6): Result.002 file - promoters60/1381896
ctgatg

SEQ ID NO: 108502 - DNA, 6 bp, Unknown
  misc_feature (1)..( 6): Result.002 file - promoters60/1381896
ctgatg

SEQ ID NO: 108503 - DNA, 7 bp, Unknown
  misc_feature (1)..( 7): Result.002 file - promoters60/1381896
ttagaaa

SEQ ID NO: 108504 - DNA, 7 bp, Unknown
  misc_feature (1)..( 7): Result.002 file - promoters60/1381896
ttataaa

SEQ ID NO: 108505 - DNA, 8 bp, Unknown
  misc_feature (1)..( 8): Result.002 file - promoters60/1381896
aaatactc

SEQ ID NO: 108506 - DNA, 8 bp, Unknown
  misc_feature (1)..( 8): Result.002 file - promoters60/1381896
aaagacta

SEQ ID NO: 108507 - DNA, 8 bp, Unknown
  misc_feature (1)..( 8): Result.002 file - promoters60/1381896
ggagacta

SEQ ID NO: 108508 - DNA, 8 bp, Unknown
  misc_feature (1)..( 8): Result.002 file - promoters60/1381896
ctcatgta

SEQ ID NO: 108509 - DNA, 8 bp, Unknown
  misc_feature (1)..( 8): Result.002 file - promoters60/1381896
ctcttgta

SEQ ID NO: 108510 - DNA, 7 bp, Unknown
  misc_feature (1)..( 7): Result.002 file - promoters60/1381896
ttaagaa

SEQ ID NO: 108511 - DNA, 7 bp, Unknown
  misc_feature (1)..( 7): Result.002 file - promoters60/1381896
ttaagat

SEQ ID NO: 108512 - DNA, 7 bp, Unknown
  misc_feature (1)..( 7): Result.002 file - promoters60/1381896
ctaagaa

SEQ ID NO: 108513 - DNA, 10 bp, Unknown
  misc_feature (1)..( 10): Result.002 file - promoters60/1381896
gaatatatat

SEQ ID NO: 108514 - DNA, 10 bp, Unknown
  misc_feature (1)..( 10): Result.002 file - promoters60/1381896
agatatttat

SEQ ID NO: 108515 - DNA, 10 bp, Unknown
  misc_feature (1)..( 10): Result.002 file - promoters60/1381896
agacattcgc

SEQ ID NO: 108516 - DNA, 6 bp, Unknown
  misc_feature (1)..( 6): Result.002 file - promoters60/1381896
ttgaat

SEQ ID NO: 108517 - DNA, 6 bp, Unknown
  misc_feature (1)..( 6): Result.002 file - promoters60/1381896
ttgaat

SEQ ID NO: 108518 - DNA, 7 bp, Unknown
  misc_feature (1)..( 7): Result.002 file - promoters60/1381896
ttctctt

SEQ ID NO: 108519 - DNA, 7 bp, Unknown
  misc_feature (1)..( 7): Result.002 file - promoters60/1381896
ttctctt

SEQ ID NO: 108520 - DNA, 7 bp, Unknown
  misc_feature (1)..( 7): Result.002 file - promoters60/1381896
aaattca

SEQ ID NO: 108521 - DNA, 7 bp, Unknown
  misc_feature (1)..( 7): Result.002 file - promoters60/1381896
aaaatca

SEQ ID NO: 108522 - DNA, 6 bp, Unknown
  misc_feature (1)..( 6): Result.002 file - promoters60/1381896
atgtct

SEQ ID NO: 108523 - DNA, 6 bp, Unknown
  misc_feature (1)..( 6): Result.002 file - promoters60/1381896
atgtct

SEQ ID NO: 108524 - DNA, 7 bp, Unknown
  misc_feature (1)..( 7): Result.002 file - promoters60/1381896
tgtacaa

SEQ ID NO: 108525 - DNA, 7 bp, Unknown
  misc_feature (1)..( 7): Result.002 file - promoters60/1381896
tgttcaa

SEQ ID NO: 108526 - DNA, 7 bp, Unknown
  misc_feature (1)..( 7): Result.002 file - promoters60/1381896
accagac

SEQ ID NO: 108527 - DNA, 7 bp, Unknown
  misc_feature (1)..( 7): Result.002 file - promoters60/1381896
accagac

SEQ ID NO: 108528 - DNA, 7 bp, Unknown
  misc_feature (1)..( 7): Result.002 file - promoters60/1381896
ctttgga

SEQ ID NO: 108529 - DNA, 7 bp, Unknown
  misc_feature (1)..( 7): Result.002 file - promoters60/1381896
cttagga

SEQ ID NO: 108530 - DNA, 7 bp, Unknown
  misc_feature (1)..( 7): Result.002 file - promoters60/1381896
ctatcta

SEQ ID NO: 108531 - DNA, 7 bp, Unknown
  misc_feature (1)..( 7): Result.002 file - promoters60/1381896
ctaccta

SEQ ID NO: 108532 - DNA, 8 bp, Unknown
  misc_feature (1)..( 8): Result.002 file - promoters60/1381896
ttgtagta

SEQ ID NO: 108533 - DNA, 8 bp, Unknown
  misc_feature (1)..( 8): Result.002 file - promoters60/1381896
ttgaagta

SEQ ID NO: 108534 - DNA, 17 bp, Unknown
  misc_feature (1)..( 17): Result.002 file - promoters60/1381926
acacattaatagtgcag

SEQ ID NO: 108535 - DNA, 17 bp, Unknown
  misc_feature (1)..( 17): Result.002 file - promoters60/1381926
tattattaataagtgat

SEQ ID NO: 108536 - DNA, 17 bp, Unknown
  misc_feature (1)..( 17): Result.002 file - promoters60/1381926
gcctattaatgatttca

SEQ ID NO: 108537 - DNA, 17 bp, Unknown
  misc_feature (1)..( 17): Result.002 file - promoters60/1381926
gcccattattgatttca

SEQ ID NO: 108538 - DNA, 10 bp, Unknown
  misc_feature (1)..( 10): Result.002 file - promoters60/1381926
gaaaaagata

SEQ ID NO: 108539 - DNA, 10 bp, Unknown
  misc_feature (1)..( 10): Result.002 file - promoters60/1381926
gaaatagatt

SEQ ID NO: 108540 - DNA, 10 bp, Unknown
  misc_feature (1)..( 10): Result.002 file - promoters60/1381926
ttagtagatt

SEQ ID NO: 108541 - DNA, 10 bp, Unknown
  misc_feature (1)..( 10): Result.002 file - promoters60/1381926
tatataaatt

SEQ ID NO: 108542 - DNA, 18 bp, Unknown
  misc_feature (1)..( 18): Result.002 file - promoters60/1381926
gcccattattgatttcac

SEQ ID NO: 108543 - DNA, 18 bp, Unknown
  misc_feature (1)..( 18): Result.002 file - promoters60/1381926
gattgaatgtgatttacg

SEQ ID NO: 108544 - DNA, 18 bp, Unknown
  misc_feature (1)..( 18): Result.002 file - promoters60/1381926
gcctattaatgatttcat

SEQ ID NO: 108545 - DNA, 18 bp, Unknown
  misc_feature (1)..( 18): Result.002 file - promoters60/1381926
ataatattgtgttttacg

SEQ ID NO: 108546 - DNA, 7 bp, Unknown
  misc_feature (1)..( 7): Result.002 file - promoters60/1382119
gaggaga

SEQ ID NO: 108547 - DNA, 7 bp, Unknown
  misc_feature (1)..( 7): Result.002 file - promoters60/1382119
gaggaga

SEQ ID NO: 108548 - DNA, 6 bp, Unknown
  misc_feature (1)..( 6): Result.002 file - promoters60/1382119
tttctt

SEQ ID NO: 108549 - DNA, 6 bp, Unknown
  misc_feature (1)..( 6): Result.002 file - promoters60/1382119
tttctt

SEQ ID NO: 108550 - DNA, 8 bp, Unknown
  misc_feature (1)..( 8): Result.002 file - promoters60/1382119
attcacca

SEQ ID NO: 108551 - DNA, 8 bp, Unknown
  misc_feature (1)..( 8): Result.002 file - promoters60/1382119
attcacca

SEQ ID NO: 108552 - DNA, 7 bp, Unknown
  misc_feature (1)..( 7): Result.002 file - promoters60/1382119
aatgaaa

SEQ ID NO: 108553 - DNA, 7 bp, Unknown
  misc_feature (1)..( 7): Result.002 file - promoters60/1382119
aattaaa

SEQ ID NO: 108554 - DNA, 8 bp, Unknown
  misc_feature (1)..( 8): Result.002 file - promoters60/1382119
acagagaa

SEQ ID NO: 108555 - DNA, 8 bp, Unknown
  misc_feature (1)..( 8): Result.002 file - promoters60/1382119
acaaagaa

SEQ ID NO: 108556 - DNA, 6 bp, Unknown
  misc_feature (1)..( 6): Result.002 file - promoters60/1382119
aaaata

SEQ ID NO: 108557 - DNA, 6 bp, Unknown
  misc_feature (1)..( 6): Result.002 file - promoters60/1382119
aaaata

SEQ ID NO: 108558 - DNA, 10 bp, Unknown
  misc_feature (1)..( 10): Result.002 file - promoters60/1382119
aataaataaa

SEQ ID NO: 108559 - DNA, 10 bp, Unknown
  misc_feature (1)..( 10): Result.002 file - promoters60/1382119
tataaataaa

SEQ ID NO: 108560 - DNA, 10 bp, Unknown
  misc_feature (1)..( 10): Result.002 file - promoters60/1382119
tataaagaac

SEQ ID NO: 108561 - DNA, 6 bp, Unknown
  misc_feature (1)..( 6): Result.002 file - promoters60/1382119
caaaag

SEQ ID NO: 108562 - DNA, 6 bp, Unknown
  misc_feature (1)..( 6): Result.002 file - promoters60/1382119
caaaag

SEQ ID NO: 108563 - DNA, 8 bp, Unknown
  misc_feature (1)..( 8): Result.002 file - promoters60/1382119
ttctttct

SEQ ID NO: 108564 - DNA, 8 bp, Unknown
  misc_feature (1)..( 8): Result.002 file - promoters60/1382119
ttctctct

SEQ ID NO: 108565 - DNA, 8 bp, Unknown
  misc_feature (1)..( 8): Result.002 file - promoters60/1382119
tattacca

SEQ ID NO: 108566 - DNA, 8 bp, Unknown
  misc_feature (1)..( 8): Result.002 file - promoters60/1382119
tataacca

SEQ ID NO: 108567 - DNA, 8 bp, Unknown
  misc_feature (1)..( 8): Result.002 file - promoters60/1382119
gttttcgt

SEQ ID NO: 108568 - DNA, 8 bp, Unknown
  misc_feature (1)..( 8): Result.002 file - promoters60/1382119
gttatcgt

SEQ ID NO: 108569 - DNA, 8 bp, Unknown
  misc_feature (1)..( 8): Result.002 file - promoters60/1382119
aaaacaaa

SEQ ID NO: 108570 - DNA, 8 bp, Unknown
  misc_feature (1)..( 8): Result.002 file - promoters60/1382119
aaaataaa

SEQ ID NO: 108571 - DNA, 7 bp, Unknown
  misc_feature (1)..( 7): Result.002 file - promoters60/1382134
tgaaatt

SEQ ID NO: 108572 - DNA, 7 bp, Unknown
  misc_feature (1)..( 7): Result.002 file - promoters60/1382134
tgatatt

SEQ ID NO: 108573 - DNA, 7 bp, Unknown
  misc_feature (1)..( 7): Result.002 file - promoters60/1382134
taaacat

SEQ ID NO: 108574 - DNA, 7 bp, Unknown
  misc_feature (1)..( 7): Result.002 file - promoters60/1382134
taaacat

SEQ ID NO: 108575 - DNA, 6 bp, Unknown
  misc_feature (1)..( 6): Result.002 file - promoters60/1382134
ttaact

SEQ ID NO: 108576 - DNA, 6 bp, Unknown
  misc_feature (1)..( 6): Result.002 file - promoters60/1382134
ttaact

SEQ ID NO: 108577 - DNA, 6 bp, Unknown
  misc_feature (1)..( 6): Result.002 file - promoters60/1382134
taaaat

SEQ ID NO: 108578 - DNA, 6 bp, Unknown
  misc_feature (1)..( 6): Result.002 file - promoters60/1382134
taaaat

SEQ ID NO: 108579 - DNA, 8 bp, Unknown
  misc_feature (1)..( 8): Result.002 file - promoters60/1382134
agatttta

SEQ ID NO: 108580 - DNA, 8 bp, Unknown
  misc_feature (1)..( 8): Result.002 file - promoters60/1382134
agatttta

SEQ ID NO: 108581 - DNA, 6 bp, Unknown
  misc_feature (1)..( 6): Result.002 file - promoters60/1382134
taataa

SEQ ID NO: 108582 - DNA, 6 bp, Unknown
  misc_feature (1)..( 6): Result.002 file - promoters60/1382134
taataa

SEQ ID NO: 108583 - DNA, 7 bp, Unknown
  misc_feature (1)..( 7): Result.002 file - promoters60/1382134
aatatat

SEQ ID NO: 108584 - DNA, 7 bp, Unknown
  misc_feature (1)..( 7): Result.002 file - promoters60/1382134
aatatat

SEQ ID NO: 108585 - DNA, 7 bp, Unknown
  misc_feature (1)..( 7): Result.002 file - promoters60/1382134
taccaaa

SEQ ID NO: 108586 - DNA, 7 bp, Unknown
  misc_feature (1)..( 7): Result.002 file - promoters60/1382134
taccaaa

SEQ ID NO: 108587 - DNA, 10 bp, Unknown
  misc_feature (1)..( 10): Result.002 file - promoters60/1382134
acactttttc

SEQ ID NO: 108588 - DNA, 10 bp, Unknown
  misc_feature (1)..( 10): Result.002 file - promoters60/1382134
acaattttta

SEQ ID NO: 108589 - DNA, 10 bp, Unknown
  misc_feature (1)..( 10): Result.002 file - promoters60/1382134
ttggttttta

SEQ ID NO: 108590 - DNA, 6 bp, Unknown
  misc_feature (1)..( 6): Result.002 file - promoters60/1382134
cttcta

SEQ ID NO: 108591 - DNA, 6 bp, Unknown
  misc_feature (1)..( 6): Result.002 file - promoters60/1382134
cttcta

SEQ ID NO: 108592 - DNA, 7 bp, Unknown
  misc_feature (1)..( 7): Result.002 file - promoters60/1382134
cacgtga

SEQ ID NO: 108593 - DNA, 7 bp, Unknown
  misc_feature (1)..( 7): Result.002 file - promoters60/1382134
cacttga

SEQ ID NO: 108594 - DNA, 6 bp, Unknown
  misc_feature (1)..( 6): Result.002 file - promoters60/1382134
aaaaat

SEQ ID NO: 108595 - DNA, 6 bp, Unknown
  misc_feature (1)..( 6): Result.002 file - promoters60/1382134
aaaaat

SEQ ID NO: 108596 - DNA, 6 bp, Unknown
  misc_feature (1)..( 6): Result.002 file - promoters60/1382134
gatgat

SEQ ID NO: 108597 - DNA, 6 bp, Unknown
  misc_feature (1)..( 6): Result.002 file - promoters60/1382134
gatgat

SEQ ID NO: 108598 - DNA, 13 bp, Unknown
  misc_feature (1)..( 13): Result.002 file - promoters60/1382134
atattttaagatt

SEQ ID NO: 108599 - DNA, 13 bp, Unknown
  misc_feature (1)..( 13): Result.002 file - promoters60/1382134
ataatttaaaatt

SEQ ID NO: 108600 - DNA, 8 bp, Unknown
  misc_feature (1)..( 8): Result.002 file - promoters60/1382134
agacgtgt

SEQ ID NO: 108601 - DNA, 8 bp, Unknown
  misc_feature (1)..( 8): Result.002 file - promoters60/1382134
agacgtgt

SEQ ID NO: 108602 - DNA, 6 bp, Unknown
  misc_feature (1)..( 6): Result.002 file - promoters60/1382134
taaaat

SEQ ID NO: 108603 - DNA, 6 bp, Unknown
  misc_feature (1)..( 6): Result.002 file - promoters60/1382134
taaaat

SEQ ID NO: 108604 - DNA, 6 bp, Unknown
  misc_feature (1)..( 6): Result.002 file - promoters60/1382134
aatgtt

SEQ ID NO: 108605 - DNA, 6 bp, Unknown
  misc_feature (1)..( 6): Result.002 file - promoters60/1382134
aatgtt

SEQ ID NO: 108606 - DNA, 6 bp, Unknown
  misc_feature (1)..( 6): Result.002 file - promoters60/1382134
ttaatt

SEQ ID NO: 108607 - DNA, 6 bp, Unknown
  misc_feature (1)..( 6): Result.002 file - promoters60/1382134
ttaatt

SEQ ID NO: 108608 - DNA, 7 bp, Unknown
  misc_feature (1)..( 7): Result.002 file - promoters60/1382134
aatttaa

SEQ ID NO: 108609 - DNA, 7 bp, Unknown
  misc_feature (1)..( 7): Result.002 file - promoters60/1382134
aatttaa

SEQ ID NO: 108610 - DNA, 6 bp, Unknown
  misc_feature (1)..( 6): Result.002 file - promoters60/1382134
ttttaa

SEQ ID NO: 108611 - DNA, 6 bp, Unknown
  misc_feature (1)..( 6): Result.002 file - promoters60/1382134
ttttaa

SEQ ID NO: 108612 - DNA, 9 bp, Unknown
  misc_feature (1)..( 9): Result.002 file - promoters60/1382134
tcaaaataa

SEQ ID NO: 108613 - DNA, 9 bp, Unknown
  misc_feature (1)..( 9): Result.002 file - promoters60/1382134
tcacaataa

SEQ ID NO: 108614 - DNA, 7 bp, Unknown
  misc_feature (1)..( 7): Result.002 file - promoters60/1382134
ataaata

SEQ ID NO: 108615 - DNA, 7 bp, Unknown
  misc_feature (1)..( 7): Result.002 file - promoters60/1382134
atatata

SEQ ID NO: 108616 - DNA, 9 bp, Unknown
  misc_feature (1)..( 9): Result.002 file - promoters60/1382281
attaaatga

SEQ ID NO: 108617 - DNA, 9 bp, Unknown
  misc_feature (1)..( 9): Result.002 file - promoters60/1382281
tgtaaatgt

SEQ ID NO: 108618 - DNA, 9 bp, Unknown
  misc_feature (1)..( 9): Result.002 file - promoters60/1382281
attaaatga

SEQ ID NO: 108619 - DNA, 9 bp, Unknown
  misc_feature (1)..( 9): Result.002 file - promoters60/1382281
aaaataaat

SEQ ID NO: 108620 - DNA, 9 bp, Unknown
  misc_feature (1)..( 9): Result.002 file - promoters60/1382281
aaaataaat

SEQ ID NO: 108621 - DNA, 9 bp, Unknown
  misc_feature (1)..( 9): Result.002 file - promoters60/1382281
aaaagatat

SEQ ID NO: 108622 - DNA, 11 bp, Unknown
  misc_feature (1)..( 11): Result.002 file - promoters60/1382281
ttttcgaaaaa

SEQ ID NO: 108623 - DNA, 11 bp, Unknown
  misc_feature (1)..( 11): Result.002 file - promoters60/1382281
ctttcgacatt

SEQ ID NO: 108624 - DNA, 11 bp, Unknown
  misc_feature (1)..( 11): Result.002 file - promoters60/1382281
ttttcgaaaaa

SEQ ID NO: 108625 - DNA, 10 bp, Unknown
  misc_feature (1)..( 10): Result.002 file - promoters60/1382302
gtttgagtcc

SEQ ID NO: 108626 - DNA, 10 bp, Unknown
  misc_feature (1)..( 10): Result.002 file - promoters60/1382302
gttggagttt

SEQ ID NO: 108627 - DNA, 10 bp, Unknown
  misc_feature (1)..( 10): Result.002 file - promoters60/1382302
tttgaagttt

SEQ ID NO: 108628 - DNA, 10 bp, Unknown
  misc_feature (1)..( 10): Result.002 file - promoters60/1382302
atttataaac

SEQ ID NO: 108629 - DNA, 10 bp, Unknown
  misc_feature (1)..( 10): Result.002 file - promoters60/1382302
gattataaac

SEQ ID NO: 108630 - DNA, 10 bp, Unknown
  misc_feature (1)..( 10): Result.002 file - promoters60/1382302
atttatatta

SEQ ID NO: 108631 - DNA, 9 bp, Unknown
  misc_feature (1)..( 9): Result.002 file - promoters60/1382302
ttatagagt

SEQ ID NO: 108632 - DNA, 9 bp, Unknown
  misc_feature (1)..( 9): Result.002 file - promoters60/1382302
taataaagt

SEQ ID NO: 108633 - DNA, 9 bp, Unknown
  misc_feature (1)..( 9): Result.002 file - promoters60/1382302
taatacagt

SEQ ID NO: 108634 - DNA, 9 bp, Unknown
  misc_feature (1)..( 9): Result.002 file - promoters60/1382302
taaaacaaa

SEQ ID NO: 108635 - DNA, 12 bp, Unknown
  misc_feature (1)..( 12): Result.002 file - promoters60/1382302
ctatttctctaa

SEQ ID NO: 108636 - DNA, 12 bp, Unknown
  misc_feature (1)..( 12): Result.002 file - promoters60/1382302
ctatttgtctca

SEQ ID NO: 108637 - DNA, 12 bp, Unknown
  misc_feature (1)..( 12): Result.002 file - promoters60/1382302
tgtattgtttca

SEQ ID NO: 108638 - DNA, 10 bp, Unknown
  misc_feature (1)..( 10): Result.002 file - promoters60/1382302
gatttataat

SEQ ID NO: 108639 - DNA, 10 bp, Unknown
  misc_feature (1)..( 10): Result.002 file - promoters60/1382302
attttataat

SEQ ID NO: 108640 - DNA, 10 bp, Unknown
  misc_feature (1)..( 10): Result.002 file - promoters60/1382302
attttattct

SEQ ID NO: 108641 - DNA, 7 bp, Unknown
  misc_feature (1)..( 7): Result.002 file - promoters60/1382302
aaacttg

SEQ ID NO: 108642 - DNA, 7 bp, Unknown
  misc_feature (1)..( 7): Result.002 file - promoters60/1382302
aaaattg

SEQ ID NO: 108643 - DNA, 7 bp, Unknown
  misc_feature (1)..( 7): Result.002 file - promoters60/1382302
taaattg

SEQ ID NO: 108644 - DNA, 8 bp, Unknown
  misc_feature (1)..( 8): Result.002 file - promoters60/1382302
gttttatt

SEQ ID NO: 108645 - DNA, 8 bp, Unknown
  misc_feature (1)..( 8): Result.002 file - promoters60/1382302
attttatt

SEQ ID NO: 108646 - DNA, 8 bp, Unknown
  misc_feature (1)..( 8): Result.002 file - promoters60/1382302
attttata

SEQ ID NO: 108647 - DNA, 9 bp, Unknown
  misc_feature (1)..( 9): Result.002 file - promoters60/1382302
agactttgg

SEQ ID NO: 108648 - DNA, 9 bp, Unknown
  misc_feature (1)..( 9): Result.002 file - promoters60/1382302
agattttat

SEQ ID NO: 108649 - DNA, 9 bp, Unknown
  misc_feature (1)..( 9): Result.002 file - promoters60/1382302
atattttat

SEQ ID NO: 108650 - DNA, 10 bp, Unknown
  misc_feature (1)..( 10): Result.002 file - promoters60/1382302
atacaatgaa

SEQ ID NO: 108651 - DNA, 10 bp, Unknown
  misc_feature (1)..( 10): Result.002 file - promoters60/1382302
atataattta

SEQ ID NO: 108652 - DNA, 11 bp, Unknown
  misc_feature (1)..( 11): Result.002 file - promoters60/1382302
atagatatttt

SEQ ID NO: 108653 - DNA, 6 bp, Unknown
  misc_feature (1)..( 6): Result.002 file - promoters60/1382302
ttttct

SEQ ID NO: 108654 - DNA, 6 bp, Unknown
  misc_feature (1)..( 6): Result.002 file - promoters60/1382302
ttttct

SEQ ID NO: 108655 - DNA, 6 bp, Unknown
  misc_feature (1)..( 6): Result.002 file - promoters60/1382302
ttttct

SEQ ID NO: 108656 - DNA, 8 bp, Unknown
  misc_feature (1)..( 8): Result.002 file - promoters60/1382713
atgactac

SEQ ID NO: 108657 - DNA, 8 bp, Unknown
  misc_feature (1)..( 8): Result.002 file - promoters60/1382713
atgactta

SEQ ID NO: 108658 - DNA, 8 bp, Unknown
  misc_feature (1)..( 8): Result.002 file - promoters60/1382713
ttgattta

SEQ ID NO: 108659 - DNA, 7 bp, Unknown
  misc_feature (1)..( 7): Result.002 file - promoters60/1382713
attgtgt

SEQ ID NO: 108660 - DNA, 7 bp, Unknown
  misc_feature (1)..( 7): Result.002 file - promoters60/1382713
attctgt

SEQ ID NO: 108661 - DNA, 7 bp, Unknown
  misc_feature (1)..( 7): Result.002 file - promoters60/1382713
tttgtgt

SEQ ID NO: 108662 - DNA, 8 bp, Unknown
  misc_feature (1)..( 8): Result.002 file - promoters60/1382713
atttttca

SEQ ID NO: 108663 - DNA, 8 bp, Unknown
  misc_feature (1)..( 8): Result.002 file - promoters60/1382713
attattct

SEQ ID NO: 108664 - DNA, 8 bp, Unknown
  misc_feature (1)..( 8): Result.002 file - promoters60/1382713
cttattct

SEQ ID NO: 108665 - DNA, 8 bp, Unknown
  misc_feature (1)..( 8): Result.002 file - promoters60/1382713
ggaataaa

SEQ ID NO: 108666 - DNA, 8 bp, Unknown
  misc_feature (1)..( 8): Result.002 file - promoters60/1382713
tgaagaaa

SEQ ID NO: 108667 - DNA, 8 bp, Unknown
  misc_feature (1)..( 8): Result.002 file - promoters60/1382713
tgaagaat

SEQ ID NO: 108668 - DNA, 10 bp, Unknown
  misc_feature (1)..( 10): Result.002 file - promoters60/1382959
agaaagaaag

SEQ ID NO: 108669 - DNA, 10 bp, Unknown
  misc_feature (1)..( 10): Result.002 file - promoters60/1382959
gtaaataaat

SEQ ID NO: 108670 - DNA, 10 bp, Unknown
  misc_feature (1)..( 10): Result.002 file - promoters60/1382959
aaaaagaacg

SEQ ID NO: 108671 - DNA, 10 bp, Unknown
  misc_feature (1)..( 10): Result.002 file - promoters60/1382959
gctaataaat

SEQ ID NO: 108672 - DNA, 10 bp, Unknown
  misc_feature (1)..( 10): Result.002 file - promoters60/1382959
gtaaataatt

SEQ ID NO: 108673 - DNA, 10 bp, Unknown
  misc_feature (1)..( 10): Result.002 file - promoters60/1382959
gctaataaat

SEQ ID NO: 108674 - DNA, 10 bp, Unknown
  misc_feature (1)..( 10): Result.002 file - promoters60/1382959
acaaataaac

SEQ ID NO: 108675 - DNA, 10 bp, Unknown
  misc_feature (1)..( 10): Result.002 file - promoters60/1382959
gtaaataaat

SEQ ID NO: 108676 - DNA, 10 bp, Unknown
  misc_feature (1)..( 10): Result.002 file - promoters60/1382959
acacataatg

SEQ ID NO: 108677 - DNA, 10 bp, Unknown
  misc_feature (1)..( 10): Result.002 file - promoters60/1382959
gtaaataatt

SEQ ID NO: 108678 - DNA, 10 bp, Unknown
  misc_feature (1)..( 10): Result.002 file - promoters60/1382959
gtatatatgt

SEQ ID NO: 108679 - DNA, 7 bp, Unknown
  misc_feature (1)..( 7): Result.002 file - promoters60/1383074
tagactt

SEQ ID NO: 108680 - DNA, 7 bp, Unknown
  misc_feature (1)..( 7): Result.002 file - promoters60/1383074
tagactt

SEQ ID NO: 108681 - DNA, 7 bp, Unknown
  misc_feature (1)..( 7): Result.002 file - promoters60/1383074
ggtattg

SEQ ID NO: 108682 - DNA, 7 bp, Unknown
  misc_feature (1)..( 7): Result.002 file - promoters60/1383074
ggttttg

SEQ ID NO: 108683 - DNA, 10 bp, Unknown
  misc_feature (1)..( 10): Result.002 file - promoters60/1383074
atatatatat

SEQ ID NO: 108684 - DNA, 10 bp, Unknown
  misc_feature (1)..( 10): Result.002 file - promoters60/1383074
atacatataa

SEQ ID NO: 108685 - DNA, 10 bp, Unknown
  misc_feature (1)..( 10): Result.002 file - promoters60/1383074
tttcatttaa

SEQ ID NO: 108686 - DNA, 6 bp, Unknown
  misc_feature (1)..( 6): Result.002 file - promoters60/1383074
tatgaa

SEQ ID NO: 108687 - DNA, 6 bp, Unknown
  misc_feature (1)..( 6): Result.002 file - promoters60/1383074
tatgaa

SEQ ID NO: 108688 - DNA, 10 bp, Unknown
  misc_feature (1)..( 10): Result.002 file - promoters60/1383074
aaatacaaag

SEQ ID NO: 108689 - DNA, 10 bp, Unknown
  misc_feature (1)..( 10): Result.002 file - promoters60/1383074
atttacaaag

SEQ ID NO: 108690 - DNA, 10 bp, Unknown
  misc_feature (1)..( 10): Result.002 file - promoters60/1383074
aaataaaaat

SEQ ID NO: 108691 - DNA, 7 bp, Unknown
  misc_feature (1)..( 7): Result.002 file - promoters60/1383074
caataat

SEQ ID NO: 108692 - DNA, 7 bp, Unknown
  misc_feature (1)..( 7): Result.002 file - promoters60/1383074
caacaat

SEQ ID NO: 108693 - DNA, 7 bp, Unknown
  misc_feature (1)..( 7): Result.002 file - promoters60/1383074
aaataat

SEQ ID NO: 108694 - DNA, 7 bp, Unknown
  misc_feature (1)..( 7): Result.002 file - promoters60/1383074
aaaaaat

SEQ ID NO: 108695 - DNA, 7 bp, Unknown
  misc_feature (1)..( 7): Result.002 file - promoters60/1383074
aaaaaaa

SEQ ID NO: 108696 - DNA, 8 bp, Unknown
  misc_feature (1)..( 8): Result.002 file - promoters60/1383074
aaataaaa

SEQ ID NO: 108697 - DNA, 11 bp, Unknown
  misc_feature (1)..( 11): Result.002 file - promoters60/1383074
atcaaaagttc

SEQ ID NO: 108698 - DNA, 11 bp, Unknown
  misc_feature (1)..( 11): Result.002 file - promoters60/1383074
aaaaaaaattc

SEQ ID NO: 108699 - DNA, 11 bp, Unknown
  misc_feature (1)..( 11): Result.002 file - promoters60/1383074
aaataaaatat

SEQ ID NO: 108700 - DNA, 7 bp, Unknown
  misc_feature (1)..( 7): Result.002 file - promoters60/1383074
ttgtttt

SEQ ID NO: 108701 - DNA, 7 bp, Unknown
  misc_feature (1)..( 7): Result.002 file - promoters60/1383074
ttgtttt

SEQ ID NO: 108702 - DNA, 7 bp, Unknown
  misc_feature (1)..( 7): Result.002 file - promoters60/1383074
tgatata

SEQ ID NO: 108703 - DNA, 7 bp, Unknown
  misc_feature (1)..( 7): Result.002 file - promoters60/1383074
tgacata

SEQ ID NO: 108704 - DNA, 7 bp, Unknown
  misc_feature (1)..( 7): Result.002 file - promoters60/1383074
atattgt

SEQ ID NO: 108705 - DNA, 7 bp, Unknown
  misc_feature (1)..( 7): Result.002 file - promoters60/1383074
atattgt

SEQ ID NO: 108706 - DNA, 7 bp, Unknown
  misc_feature (1)..( 7): Result.002 file - promoters60/1383074
cataaat

SEQ ID NO: 108707 - DNA, 7 bp, Unknown
  misc_feature (1)..( 7): Result.002 file - promoters60/1383074
catgaat

SEQ ID NO: 108708 - DNA, 8 bp, Unknown
  misc_feature (1)..( 8): Result.002 file - promoters60/1383074
gatcgaag

SEQ ID NO: 108709 - DNA, 8 bp, Unknown
  misc_feature (1)..( 8): Result.002 file - promoters60/1383074
gattgaag

SEQ ID NO: 108710 - DNA, 7 bp, Unknown
  misc_feature (1)..( 7): Result.002 file - promoters60/1383074
aagaatg

SEQ ID NO: 108711 - DNA, 7 bp, Unknown
  misc_feature (1)..( 7): Result.002 file - promoters60/1383074
aaggatg

SEQ ID NO: 108712 - DNA, 7 bp, Unknown
  misc_feature (1)..( 7): Result.002 file - promoters60/1383074
gtatctt

SEQ ID NO: 108713 - DNA, 7 bp, Unknown
  misc_feature (1)..( 7): Result.002 file - promoters60/1383074
gtagctt

SEQ ID NO: 108714 - DNA, 9 bp, Unknown
  misc_feature (1)..( 9): Result.002 file - promoters60/1383074
aagtgaaca

SEQ ID NO: 108715 - DNA, 9 bp, Unknown
  misc_feature (1)..( 9): Result.002 file - promoters60/1383074
aagtaaaca

SEQ ID NO: 108716 - DNA, 6 bp, Unknown
  misc_feature (1)..( 6): Result.002 file - promoters60/1383074
attata

SEQ ID NO: 108717 - DNA, 6 bp, Unknown
  misc_feature (1)..( 6): Result.002 file - promoters60/1383074
attata

SEQ ID NO: 108718 - DNA, 8 bp, Unknown
  misc_feature (1)..( 8): Result.002 file - promoters60/1383074
aaaaaaaa

SEQ ID NO: 108719 - DNA, 8 bp, Unknown
  misc_feature (1)..( 8): Result.002 file - promoters60/1383074
aaataaaa

SEQ ID NO: 108720 - DNA, 7 bp, Unknown
  misc_feature (1)..( 7): Result.002 file - promoters60/1383074
ttggttt

SEQ ID NO: 108721 - DNA, 7 bp, Unknown
  misc_feature (1)..( 7): Result.002 file - promoters60/1383074
ttgtttt

SEQ ID NO: 108722 - DNA, 6 bp, Unknown
  misc_feature (1)..( 6): Result.002 file - promoters60/1383214
cataat

SEQ ID NO: 108723 - DNA, 6 bp, Unknown
  misc_feature (1)..( 6): Result.002 file - promoters60/1383214
cataat

SEQ ID NO: 108724 - DNA, 6 bp, Unknown
  misc_feature (1)..( 6): Result.002 file - promoters60/1383214
tggttt

SEQ ID NO: 108725 - DNA, 6 bp, Unknown
  misc_feature (1)..( 6): Result.002 file - promoters60/1383214
tggttt

SEQ ID NO: 108726 - DNA, 7 bp, Unknown
  misc_feature (1)..( 7): Result.002 file - promoters60/1383214
accagaa

SEQ ID NO: 108727 - DNA, 7 bp, Unknown
  misc_feature (1)..( 7): Result.002 file - promoters60/1383214
acccgaa

SEQ ID NO: 108728 - DNA, 7 bp, Unknown
  misc_feature (1)..( 7): Result.002 file - promoters60/1383214
tcagaac

SEQ ID NO: 108729 - DNA, 7 bp, Unknown
  misc_feature (1)..( 7): Result.002 file - promoters60/1383214
tcaaaac

SEQ ID NO: 108730 - DNA, 8 bp, Unknown
  misc_feature (1)..( 8): Result.002 file - promoters60/1383214
ttttattt

SEQ ID NO: 108731 - DNA, 8 bp, Unknown
  misc_feature (1)..( 8): Result.002 file - promoters60/1383214
tttcattt

SEQ ID NO: 108732 - DNA, 7 bp, Unknown
  misc_feature (1)..( 7): Result.002 file - promoters60/1383214
aaaaatt

SEQ ID NO: 108733 - DNA, 7 bp, Unknown
  misc_feature (1)..( 7): Result.002 file - promoters60/1383214
aaagatt

SEQ ID NO: 108734 - DNA, 8 bp, Unknown
  misc_feature (1)..( 8): Result.002 file - promoters60/1383214
atatataa

SEQ ID NO: 108735 - DNA, 8 bp, Unknown
  misc_feature (1)..( 8): Result.002 file - promoters60/1383214
ataaataa

SEQ ID NO: 108736 - DNA, 12 bp, Unknown
  misc_feature (1)..( 12): Result.002 file - promoters60/1383214
atatctataaag

SEQ ID NO: 108737 - DNA, 12 bp, Unknown
  misc_feature (1)..( 12): Result.002 file - promoters60/1383214
ctatatatattc

SEQ ID NO: 108738 - DNA, 12 bp, Unknown
  misc_feature (1)..( 12): Result.002 file - promoters60/1383214
atatatataaag

SEQ ID NO: 108739 - DNA, 9 bp, Unknown
  misc_feature (1)..( 9): Result.002 file - promoters60/1383214
tttgagtta

SEQ ID NO: 108740 - DNA, 9 bp, Unknown
  misc_feature (1)..( 9): Result.002 file - promoters60/1383214
tttaagttt

SEQ ID NO: 108741 - DNA, 9 bp, Unknown
  misc_feature (1)..( 9): Result.002 file - promoters60/1383214
cataaattt

SEQ ID NO: 108742 - DNA, 9 bp, Unknown
  misc_feature (1)..( 9): Result.002 file - promoters60/1383214
acatggttt

SEQ ID NO: 108743 - DNA, 9 bp, Unknown
  misc_feature (1)..( 9): Result.002 file - promoters60/1383214
acatgtttt

SEQ ID NO: 108744 - DNA, 7 bp, Unknown
  misc_feature (1)..( 7): Result.002 file - promoters60/1383214
aaacata

SEQ ID NO: 108745 - DNA, 7 bp, Unknown
  misc_feature (1)..( 7): Result.002 file - promoters60/1383214
aaatata

SEQ ID NO: 108746 - DNA, 7 bp, Unknown
  misc_feature (1)..( 7): Result.002 file - promoters60/1383214
atataca

SEQ ID NO: 108747 - DNA, 7 bp, Unknown
  misc_feature (1)..( 7): Result.002 file - promoters60/1383214
atataca

SEQ ID NO: 108748 - DNA, 7 bp, Unknown
  misc_feature (1)..( 7): Result.002 file - promoters60/1383214
ttaagtt

SEQ ID NO: 108749 - DNA, 7 bp, Unknown
  misc_feature (1)..( 7): Result.002 file - promoters60/1383214
ttaagtt

SEQ ID NO: 108750 - DNA, 7 bp, Unknown
  misc_feature (1)..( 7): Result.002 file - promoters60/1383214
taaaact

SEQ ID NO: 108751 - DNA, 7 bp, Unknown
  misc_feature (1)..( 7): Result.002 file - promoters60/1383214
taacact

SEQ ID NO: 108752 - DNA, 7 bp, Unknown
  misc_feature (1)..( 7): Result.002 file - promoters60/1383214
aaaatca

SEQ ID NO: 108753 - DNA, 7 bp, Unknown
  misc_feature (1)..( 7): Result.002 file - promoters60/1383214
aaaatca

SEQ ID NO: 108754 - DNA, 8 bp, Unknown
  misc_feature (1)..( 8): Result.002 file - promoters60/1383214
atttacat

SEQ ID NO: 108755 - DNA, 8 bp, Unknown
  misc_feature (1)..( 8): Result.002 file - promoters60/1383214
attcacat

SEQ ID NO: 108756 - DNA, 6 bp, Unknown
  misc_feature (1)..( 6): Result.002 file - promoters60/1383214
atattt

SEQ ID NO: 108757 - DNA, 6 bp, Unknown
  misc_feature (1)..( 6): Result.002 file - promoters60/1383214
atattt

SEQ ID NO: 108758 - DNA, 7 bp, Unknown
  misc_feature (1)..( 7): Result.002 file - promoters60/1383214
tcataaa

SEQ ID NO: 108759 - DNA, 7 bp, Unknown
  misc_feature (1)..( 7): Result.002 file - promoters60/1383214
tcaaaaa

SEQ ID NO: 108760 - DNA, 6 bp, Unknown
  misc_feature (1)..( 6): Result.002 file - promoters60/1383214
attgct

SEQ ID NO: 108761 - DNA, 6 bp, Unknown
  misc_feature (1)..( 6): Result.002 file - promoters60/1383214
attgct

SEQ ID NO: 108762 - DNA, 6 bp, Unknown
  misc_feature (1)..( 6): Result.002 file - promoters60/1383214
atctaa

SEQ ID NO: 108763 - DNA, 6 bp, Unknown
  misc_feature (1)..( 6): Result.002 file - promoters60/1383214
atctaa

SEQ ID NO: 108764 - DNA, 7 bp, Unknown
  misc_feature (1)..( 7): Result.002 file - promoters60/1383214
aaccacc

SEQ ID NO: 108765 - DNA, 7 bp, Unknown
  misc_feature (1)..( 7): Result.002 file - promoters60/1383214
aaccacc

SEQ ID NO: 108766 - DNA, 7 bp, Unknown
  misc_feature (1)..( 7): Result.002 file - promoters60/1383214
atggtca

SEQ ID NO: 108767 - DNA, 7 bp, Unknown
  misc_feature (1)..( 7): Result.002 file - promoters60/1383214
atggtca

SEQ ID NO: 108768 - DNA, 8 bp, Unknown
  misc_feature (1)..( 8): Result.002 file - promoters60/1383214
agaacaat

SEQ ID NO: 108769 - DNA, 8 bp, Unknown
  misc_feature (1)..( 8): Result.002 file - promoters60/1383214
agaccaat

SEQ ID NO: 108770 - DNA, 10 bp, Unknown
  misc_feature (1)..( 10): Result.002 file - promoters60/1383312
tggaaacaat

SEQ ID NO: 108771 - DNA, 10 bp, Unknown
  misc_feature (1)..( 10): Result.002 file - promoters60/1383312
tggagacagc

SEQ ID NO: 108772 - DNA, 10 bp, Unknown
  misc_feature (1)..( 10): Result.002 file - promoters60/1383312
ttgaatcaat

SEQ ID NO: 108773 - DNA, 12 bp, Unknown
  misc_feature (1)..( 12): Result.002 file - promoters60/1383312
gtaatttctttt

SEQ ID NO: 108774 - DNA, 11 bp, Unknown
  misc_feature (1)..( 11): Result.002 file - promoters60/1383312
taatctcttgt

SEQ ID NO: 108775 - DNA, 12 bp, Unknown
  misc_feature (1)..( 12): Result.002 file - promoters60/1383312
ctgatttgtttt

SEQ ID NO: 108776 - DNA, 12 bp, Unknown
  misc_feature (1)..( 12): Result.002 file - promoters60/1383312
ttgatttagggt

SEQ ID NO: 108777 - DNA, 8 bp, Unknown
  misc_feature (1)..( 8): Result.002 file - promoters60/1383312
acaatttt

SEQ ID NO: 108778 - DNA, 8 bp, Unknown
  misc_feature (1)..( 8): Result.002 file - promoters60/1383312
tcaacttt

SEQ ID NO: 108779 - DNA, 8 bp, Unknown
  misc_feature (1)..( 8): Result.002 file - promoters60/1383312
tcaacttc

SEQ ID NO: 108780 - DNA, 11 bp, Unknown
  misc_feature (1)..( 11): Result.002 file - promoters60/1383341
gtataggaaat

SEQ ID NO: 108781 - DNA, 11 bp, Unknown
  misc_feature (1)..( 11): Result.002 file - promoters60/1383341
aaataagaatg

SEQ ID NO: 108782 - DNA, 11 bp, Unknown
  misc_feature (1)..( 11): Result.002 file - promoters60/1383341
aaatagtaaat

SEQ ID NO: 108783 - DNA, 11 bp, Unknown
  misc_feature (1)..( 11): Result.002 file - promoters60/1383341
aaaaaagaaat

SEQ ID NO: 108784 - DNA, 11 bp, Unknown
  misc_feature (1)..( 11): Result.002 file - promoters60/1383341
atttaaaaata

SEQ ID NO: 108785 - DNA, 11 bp, Unknown
  misc_feature (1)..( 11): Result.002 file - promoters60/1383341
atttaaaaatt

SEQ ID NO: 108786 - DNA, 15 bp, Unknown
  misc_feature (1)..( 15): Result.002 file - promoters60/1383341
aaggaaagtaattat

SEQ ID NO: 108787 - DNA, 15 bp, Unknown
  misc_feature (1)..( 15): Result.002 file - promoters60/1383341
ctaaaaagtaaacaa

SEQ ID NO: 108788 - DNA, 15 bp, Unknown
  misc_feature (1)..( 15): Result.002 file - promoters60/1383341
cgttaaattaacgaa

SEQ ID NO: 108789 - DNA, 15 bp, Unknown
  misc_feature (1)..( 15): Result.002 file - promoters60/1383341
ctaaaaagtgggacc

SEQ ID NO: 108790 - DNA, 15 bp, Unknown
  misc_feature (1)..( 15): Result.002 file - promoters60/1383341
ataaaaaaaaacttt

SEQ ID NO: 108791 - DNA, 15 bp, Unknown
  misc_feature (1)..( 15): Result.002 file - promoters60/1383341
taaaaaagaaataaa

SEQ ID NO: 108792 - DNA, 11 bp, Unknown
  misc_feature (1)..( 11): Result.002 file - promoters60/1383341
attttaatctc

SEQ ID NO: 108793 - DNA, 11 bp, Unknown
  misc_feature (1)..( 11): Result.002 file - promoters60/1383341
attataaaata

SEQ ID NO: 108794 - DNA, 11 bp, Unknown
  misc_feature (1)..( 11): Result.002 file - promoters60/1383341
tttttattcta

SEQ ID NO: 108795 - DNA, 12 bp, Unknown
  misc_feature (1)..( 12): Result.002 file - promoters60/1383341
ggtatcaaacac

SEQ ID NO: 108796 - DNA, 12 bp, Unknown
  misc_feature (1)..( 12): Result.002 file - promoters60/1383341
tgttgtattcta

SEQ ID NO: 108797 - DNA, 12 bp, Unknown
  misc_feature (1)..( 12): Result.002 file - promoters60/1383341
ctttttacggcg

SEQ ID NO: 108798 - DNA, 9 bp, Unknown
  misc_feature (1)..( 9): Result.002 file - promoters60/1383341
ctttaattt

SEQ ID NO: 108799 - DNA, 9 bp, Unknown
  misc_feature (1)..( 9): Result.002 file - promoters60/1383341
gtttaatga

SEQ ID NO: 108800 - DNA, 9 bp, Unknown
  misc_feature (1)..( 9): Result.002 file - promoters60/1383341
tttttattc

SEQ ID NO: 108801 - DNA, 9 bp, Unknown
  misc_feature (1)..( 9): Result.002 file - promoters60/1383341
cttgaataa

SEQ ID NO: 108802 - DNA, 9 bp, Unknown
  misc_feature (1)..( 9): Result.002 file - promoters60/1383341
cgttaatgt

SEQ ID NO: 108803 - DNA, 9 bp, Unknown
  misc_feature (1)..( 9): Result.002 file - promoters60/1383341
aattaatct

SEQ ID NO: 108804 - DNA, 9 bp, Unknown
  misc_feature (1)..( 9): Result.002 file - promoters60/1383341
aaatgaaaa

SEQ ID NO: 108805 - DNA, 9 bp, Unknown
  misc_feature (1)..( 9): Result.002 file - promoters60/1383341
aaaagaaat

SEQ ID NO: 108806 - DNA, 9 bp, Unknown
  misc_feature (1)..( 9): Result.002 file - promoters60/1383341
aaatcaaat

SEQ ID NO: 108807 - DNA, 9 bp, Unknown
  misc_feature (1)..( 9): Result.002 file - promoters60/1383341
atatgaaaa

SEQ ID NO: 108808 - DNA, 9 bp, Unknown
  misc_feature (1)..( 9): Result.002 file - promoters60/1383341
aaaaaaaat

SEQ ID NO: 108809 - DNA, 9 bp, Unknown
  misc_feature (1)..( 9): Result.002 file - promoters60/1383341
tttaaaaat

SEQ ID NO: 108810 - DNA, 9 bp, Unknown
  misc_feature (1)..( 9): Result.002 file - promoters60/1383341
tgaaaaatg

SEQ ID NO: 108811 - DNA, 9 bp, Unknown
  misc_feature (1)..( 9): Result.002 file - promoters60/1383341
ttaaaaata

SEQ ID NO: 108812 - DNA, 9 bp, Unknown
  misc_feature (1)..( 9): Result.002 file - promoters60/1383341
atgaaaatg

SEQ ID NO: 108813 - DNA, 9 bp, Unknown
  misc_feature (1)..( 9): Result.002 file - promoters60/1383341
ataagaatg

SEQ ID NO: 108814 - DNA, 9 bp, Unknown
  misc_feature (1)..( 9): Result.002 file - promoters60/1383341
ttaaaaatt

SEQ ID NO: 108815 - DNA, 9 bp, Unknown
  misc_feature (1)..( 9): Result.002 file - promoters60/1383341
ttataaacc

SEQ ID NO: 108816 - DNA, 12 bp, Unknown
  misc_feature (1)..( 12): Result.002 file - promoters60/1383341
tttgaaatggta

SEQ ID NO: 108817 - DNA, 12 bp, Unknown
  misc_feature (1)..( 12): Result.002 file - promoters60/1383341
tttaaaaattcg

SEQ ID NO: 108818 - DNA, 12 bp, Unknown
  misc_feature (1)..( 12): Result.002 file - promoters60/1383341
ggtgaaatagta

SEQ ID NO: 108819 - DNA, 13 bp, Unknown
  misc_feature (1)..( 13): Result.002 file - promoters60/1383341
aataagaatgtca

SEQ ID NO: 108820 - DNA, 13 bp, Unknown
  misc_feature (1)..( 13): Result.002 file - promoters60/1383341
ttagtaaatagtt

SEQ ID NO: 108821 - DNA, 13 bp, Unknown
  misc_feature (1)..( 13): Result.002 file - promoters60/1383341
aataaaaaactca

SEQ ID NO: 108822 - DNA, 12 bp, Unknown
  misc_feature (1)..( 12): Result.002 file - promoters60/1383341
taacaaaaaaaa

SEQ ID NO: 108823 - DNA, 12 bp, Unknown
  misc_feature (1)..( 12): Result.002 file - promoters60/1383341
gtccaaaaaaga

SEQ ID NO: 108824 - DNA, 12 bp, Unknown
  misc_feature (1)..( 12): Result.002 file - promoters60/1383341
taataaaaaact

SEQ ID NO: 108825 - DNA, 12 bp, Unknown
  misc_feature (1)..( 12): Result.002 file - promoters60/1383341
ttataaaaaaga

SEQ ID NO: 108826 - DNA, 12 bp, Unknown
  misc_feature (1)..( 12): Result.002 file - promoters60/1383341
ctggaaacactt

SEQ ID NO: 108827 - DNA, 12 bp, Unknown
  misc_feature (1)..( 12): Result.002 file - promoters60/1383341
atttaaaaattc

SEQ ID NO: 108828 - DNA, 11 bp, Unknown
  misc_feature (1)..( 11): Result.002 file - promoters60/1383485
ccagaattaag

SEQ ID NO: 108829 - DNA, 11 bp, Unknown
  misc_feature (1)..( 11): Result.002 file - promoters60/1383485
ccataattagt

SEQ ID NO: 108830 - DNA, 11 bp, Unknown
  misc_feature (1)..( 11): Result.002 file - promoters60/1383485
atgtaattaag

SEQ ID NO: 108831 - DNA, 11 bp, Unknown
  misc_feature (1)..( 11): Result.002 file - promoters60/1383485
aaatacttaag

SEQ ID NO: 108832 - DNA, 11 bp, Unknown
  misc_feature (1)..( 11): Result.002 file - promoters60/1383485
tcataattttg

SEQ ID NO: 108833 - DNA, 9 bp, Unknown
  misc_feature (1)..( 9): Result.002 file - promoters60/1383485
tgtaaaaat

SEQ ID NO: 108834 - DNA, 9 bp, Unknown
  misc_feature (1)..( 9): Result.002 file - promoters60/1383485
tgtaaataa

SEQ ID NO: 108835 - DNA, 9 bp, Unknown
  misc_feature (1)..( 9): Result.002 file - promoters60/1383485
agtaaaatt

SEQ ID NO: 108836 - DNA, 9 bp, Unknown
  misc_feature (1)..( 9): Result.002 file - promoters60/1383485
ggtacataa

SEQ ID NO: 108837 - DNA, 11 bp, Unknown
  misc_feature (1)..( 11): Result.002 file - promoters60/1383514
aaatacattta

SEQ ID NO: 108838 - DNA, 11 bp, Unknown
  misc_feature (1)..( 11): Result.002 file - promoters60/1383514
aaatacttttt

SEQ ID NO: 108839 - DNA, 11 bp, Unknown
  misc_feature (1)..( 11): Result.002 file - promoters60/1383514
aataacagtta

SEQ ID NO: 108840 - DNA, 10 bp, Unknown
  misc_feature (1)..( 10): Result.002 file - promoters60/1383514
atataaaata

SEQ ID NO: 108841 - DNA, 10 bp, Unknown
  misc_feature (1)..( 10): Result.002 file - promoters60/1383514
gaataaaatg

SEQ ID NO: 108842 - DNA, 10 bp, Unknown
  misc_feature (1)..( 10): Result.002 file - promoters60/1383514
cagtaaaata

SEQ ID NO: 108843 - DNA, 10 bp, Unknown
  misc_feature (1)..( 10): Result.002 file - promoters60/1383514
cagtaaaaaa

SEQ ID NO: 108844 - DNA, 8 bp, Unknown
  misc_feature (1)..( 8): Result.002 file - promoters60/1383514
catataat

SEQ ID NO: 108845 - DNA, 8 bp, Unknown
  misc_feature (1)..( 8): Result.002 file - promoters60/1383514
catctaaa

SEQ ID NO: 108846 - DNA, 8 bp, Unknown
  misc_feature (1)..( 8): Result.002 file - promoters60/1383514
tgtctaaa

SEQ ID NO: 108847 - DNA, 8 bp, Unknown
  misc_feature (1)..( 8): Result.002 file - promoters60/1383514
taacaaac

SEQ ID NO: 108848 - DNA, 8 bp, Unknown
  misc_feature (1)..( 8): Result.002 file - promoters60/1383514
taaaaaaa

SEQ ID NO: 108849 - DNA, 8 bp, Unknown
  misc_feature (1)..( 8): Result.002 file - promoters60/1383514
aaacaaca

SEQ ID NO: 108850 - DNA, 8 bp, Unknown
  misc_feature (1)..( 8): Result.002 file - promoters60/1383514
ataaatac

SEQ ID NO: 108851 - DNA, 8 bp, Unknown
  misc_feature (1)..( 8): Result.002 file - promoters60/1383514
ataaatag

SEQ ID NO: 108852 - DNA, 8 bp, Unknown
  misc_feature (1)..( 8): Result.002 file - promoters60/1383514
ataaatac

SEQ ID NO: 108853 - DNA, 7 bp, Unknown
  misc_feature (1)..( 7): Result.002 file - promoters60/1383514
tttctta

SEQ ID NO: 108854 - DNA, 7 bp, Unknown
  misc_feature (1)..( 7): Result.002 file - promoters60/1383514
tttgtta

SEQ ID NO: 108855 - DNA, 7 bp, Unknown
  misc_feature (1)..( 7): Result.002 file - promoters60/1383514
tttgtta

SEQ ID NO: 108856 - DNA, 8 bp, Unknown
  misc_feature (1)..( 8): Result.002 file - promoters60/1383514
ataacttt

SEQ ID NO: 108857 - DNA, 8 bp, Unknown
  misc_feature (1)..( 8): Result.002 file - promoters60/1383514
atatctta

SEQ ID NO: 108858 - DNA, 8 bp, Unknown
  misc_feature (1)..( 8): Result.002 file - promoters60/1383514
tgatctta

SEQ ID NO: 108859 - DNA, 7 bp, Unknown
  misc_feature (1)..( 7): Result.002 file - promoters60/1383514
aattaaa

SEQ ID NO: 108860 - DNA, 7 bp, Unknown
  misc_feature (1)..( 7): Result.002 file - promoters60/1383514
aataaaa

SEQ ID NO: 108861 - DNA, 7 bp, Unknown
  misc_feature (1)..( 7): Result.002 file - promoters60/1383514
aatcaaa

SEQ ID NO: 108862 - DNA, 14 bp, Unknown
  misc_feature (1)..( 14): Result.002 file - promoters60/1383552
aaagcaaaacacat

SEQ ID NO: 108863 - DNA, 14 bp, Unknown
  misc_feature (1)..( 14): Result.002 file - promoters60/1383552
tccacaaaacatcc

SEQ ID NO: 108864 - DNA, 14 bp, Unknown
  misc_feature (1)..( 14): Result.002 file - promoters60/1383552
acgccaaaagacac

SEQ ID NO: 108865 - DNA, 14 bp, Unknown
  misc_feature (1)..( 14): Result.002 file - promoters60/1383552
tccacgaaactact

SEQ ID NO: 108866 - DNA, 14 bp, Unknown
  misc_feature (1)..( 14): Result.002 file - promoters60/1383552
aactacaaatatcg

SEQ ID NO: 108867 - DNA, 14 bp, Unknown
  misc_feature (1)..( 14): Result.002 file - promoters60/1383552
tcttaaggatatcg

SEQ ID NO: 108868 - DNA, 14 bp, Unknown
  misc_feature (1)..( 14): Result.002 file - promoters60/1383552
gctataagacagta

SEQ ID NO: 108869 - DNA, 13 bp, Unknown
  misc_feature (1)..( 13): Result.002 file - promoters60/1383552
acacatacaaacg

SEQ ID NO: 108870 - DNA, 13 bp, Unknown
  misc_feature (1)..( 13): Result.002 file - promoters60/1383552
atacatacagatc

SEQ ID NO: 108871 - DNA, 13 bp, Unknown
  misc_feature (1)..( 13): Result.002 file - promoters60/1383552
tagcatacaaacg

SEQ ID NO: 108872 - DNA, 13 bp, Unknown
  misc_feature (1)..( 13): Result.002 file - promoters60/1383552
ccaactacaaata

SEQ ID NO: 108873 - DNA, 13 bp, Unknown
  misc_feature (1)..( 13): Result.002 file - promoters60/1383552
cacaaaacatcct

SEQ ID NO: 108874 - DNA, 13 bp, Unknown
  misc_feature (1)..( 13): Result.002 file - promoters60/1383552
caaaagacacgtt

SEQ ID NO: 108875 - DNA, 8 bp, Unknown
  misc_feature (1)..( 8): Result.002 file - promoters60/1383569
atttgaat

SEQ ID NO: 108876 - DNA, 8 bp, Unknown
  misc_feature (1)..( 8): Result.002 file - promoters60/1383569
attttaat

SEQ ID NO: 108877 - DNA, 8 bp, Unknown
  misc_feature (1)..( 8): Result.002 file - promoters60/1383569
attttaaa

SEQ ID NO: 108878 - DNA, 8 bp, Unknown
  misc_feature (1)..( 8): Result.002 file - promoters60/1383569
attttaca

SEQ ID NO: 108879 - DNA, 14 bp, Unknown
  misc_feature (1)..( 14): Result.002 file - promoters60/1383569
ataatagtttaaaa

SEQ ID NO: 108880 - DNA, 14 bp, Unknown
  misc_feature (1)..( 14): Result.002 file - promoters60/1383569
atattagctggtgc

SEQ ID NO: 108881 - DNA, 14 bp, Unknown
  misc_feature (1)..( 14): Result.002 file - promoters60/1383569
ccattggctggtgc

SEQ ID NO: 108882 - DNA, 7 bp, Unknown
  misc_feature (1)..( 7): Result.002 file - promoters60/1383569
gaagatg

SEQ ID NO: 108883 - DNA, 7 bp, Unknown
  misc_feature (1)..( 7): Result.002 file - promoters60/1383569
taagatg

SEQ ID NO: 108884 - DNA, 7 bp, Unknown
  misc_feature (1)..( 7): Result.002 file - promoters60/1383569
taagatt

SEQ ID NO: 108885 - DNA, 11 bp, Unknown
  misc_feature (1)..( 11): Result.002 file - promoters60/1383569
aatgaaatagt

SEQ ID NO: 108886 - DNA, 11 bp, Unknown
  misc_feature (1)..( 11): Result.002 file - promoters60/1383569
taagaaatagt

SEQ ID NO: 108887 - DNA, 11 bp, Unknown
  misc_feature (1)..( 11): Result.002 file - promoters60/1383569
aataaaataaa

SEQ ID NO: 108888 - DNA, 7 bp, Unknown
  misc_feature (1)..( 7): Result.002 file - promoters60/1383569
atttaaa

SEQ ID NO: 108889 - DNA, 7 bp, Unknown
  misc_feature (1)..( 7): Result.002 file - promoters60/1383569
gtttaaa

SEQ ID NO: 108890 - DNA, 7 bp, Unknown
  misc_feature (1)..( 7): Result.002 file - promoters60/1383569
atttaaa

SEQ ID NO: 108891 - DNA, 10 bp, Unknown
  misc_feature (1)..( 10): Result.002 file - promoters60/1383569
aatataaact

SEQ ID NO: 108892 - DNA, 10 bp, Unknown
  misc_feature (1)..( 10): Result.002 file - promoters60/1383569
agtttaaact

SEQ ID NO: 108893 - DNA, 10 bp, Unknown
  misc_feature (1)..( 10): Result.002 file - promoters60/1383569
aatttaaaca

SEQ ID NO: 108894 - DNA, 13 bp, Unknown
  misc_feature (1)..( 13): Result.002 file - promoters60/1383569
aatattaaaataa

SEQ ID NO: 108895 - DNA, 13 bp, Unknown
  misc_feature (1)..( 13): Result.002 file - promoters60/1383569
aatattaatataa

SEQ ID NO: 108896 - DNA, 13 bp, Unknown
  misc_feature (1)..( 13): Result.002 file - promoters60/1383569
aatttaaacagaa

SEQ ID NO: 108897 - DNA, 7 bp, Unknown
  misc_feature (1)..( 7): Result.002 file - promoters60/1383569
aattgat

SEQ ID NO: 108898 - DNA, 7 bp, Unknown
  misc_feature (1)..( 7): Result.002 file - promoters60/1383569
gattgat

SEQ ID NO: 108899 - DNA, 7 bp, Unknown
  misc_feature (1)..( 7): Result.002 file - promoters60/1383569
gattgaa

SEQ ID NO: 108900 - DNA, 13 bp, Unknown
  misc_feature (1)..( 13): Result.002 file - promoters60/1383661
gagactgcatcat

SEQ ID NO: 108901 - DNA, 13 bp, Unknown
  misc_feature (1)..( 13): Result.002 file - promoters60/1383661
atggctgaatctt

SEQ ID NO: 108902 - DNA, 13 bp, Unknown
  misc_feature (1)..( 13): Result.002 file - promoters60/1383661
agacatgaatcag

SEQ ID NO: 108903 - DNA, 13 bp, Unknown
  misc_feature (1)..( 13): Result.002 file - promoters60/1383661
gctccagaagcag

SEQ ID NO: 108904 - DNA, 13 bp, Unknown
  misc_feature (1)..( 13): Result.002 file - promoters60/1383661
atggttgaactca

SEQ ID NO: 108905 - DNA, 14 bp, Unknown
  misc_feature (1)..( 14): Result.002 file - promoters60/1384016
aaagcaaaacacat

SEQ ID NO: 108906 - DNA, 14 bp, Unknown
  misc_feature (1)..( 14): Result.002 file - promoters60/1384016
tccacaaaacatcc

SEQ ID NO: 108907 - DNA, 14 bp, Unknown
  misc_feature (1)..( 14): Result.002 file - promoters60/1384016
tacataaaacaaaa

SEQ ID NO: 108908 - DNA, 14 bp, Unknown
  misc_feature (1)..( 14): Result.002 file - promoters60/1384016
tggagcaaataaat

SEQ ID NO: 108909 - DNA, 14 bp, Unknown
  misc_feature (1)..( 14): Result.002 file - promoters60/1384016
tccacgaaactact

SEQ ID NO: 108910 - DNA, 14 bp, Unknown
  misc_feature (1)..( 14): Result.002 file - promoters60/1384016
gctataagacagta

SEQ ID NO: 108911 - DNA, 7 bp, Unknown
  misc_feature (1)..( 7): Result.002 file - promoters60/1384161
aattttg

SEQ ID NO: 108912 - DNA, 7 bp, Unknown
  misc_feature (1)..( 7): Result.002 file - promoters60/1384161
aatgttg

SEQ ID NO: 108913 - DNA, 12 bp, Unknown
  misc_feature (1)..( 12): Result.002 file - promoters60/1384161
cctgctttaaat

SEQ ID NO: 108914 - DNA, 12 bp, Unknown
  misc_feature (1)..( 12): Result.002 file - promoters60/1384161
tttgctataaat

SEQ ID NO: 108915 - DNA, 12 bp, Unknown
  misc_feature (1)..( 12): Result.002 file - promoters60/1384161
ccttcttccagg

SEQ ID NO: 108916 - DNA, 13 bp, Unknown
  misc_feature (1)..( 13): Result.002 file - promoters60/1384161
tctttttaatttt

SEQ ID NO: 108917 - DNA, 13 bp, Unknown
  misc_feature (1)..( 13): Result.002 file - promoters60/1384161
tctttttaatttt

SEQ ID NO: 108918 - DNA, 13 bp, Unknown
  misc_feature (1)..( 13): Result.002 file - promoters60/1384161
tgctgctaatttg

SEQ ID NO: 108919 - DNA, 7 bp, Unknown
  misc_feature (1)..( 7): Result.002 file - promoters60/1384161
aatatct

SEQ ID NO: 108920 - DNA, 7 bp, Unknown
  misc_feature (1)..( 7): Result.002 file - promoters60/1384161
aatatct

SEQ ID NO: 108921 - DNA, 6 bp, Unknown
  misc_feature (1)..( 6): Result.002 file - promoters60/1384161
ctaaat

SEQ ID NO: 108922 - DNA, 6 bp, Unknown
  misc_feature (1)..( 6): Result.002 file - promoters60/1384161
ctaaat

SEQ ID NO: 108923 - DNA, 7 bp, Unknown
  misc_feature (1)..( 7): Result.002 file - promoters60/1384161
ctgcaaa

SEQ ID NO: 108924 - DNA, 7 bp, Unknown
  misc_feature (1)..( 7): Result.002 file - promoters60/1384161
ctgtaaa

SEQ ID NO: 108925 - DNA, 9 bp, Unknown
  misc_feature (1)..( 9): Result.002 file - promoters60/1384161
taaaattgt

SEQ ID NO: 108926 - DNA, 9 bp, Unknown
  misc_feature (1)..( 9): Result.002 file - promoters60/1384161
taaaaatgt

SEQ ID NO: 108927 - DNA, 6 bp, Unknown
  misc_feature (1)..( 6): Result.002 file - promoters60/1384161
tgttga

SEQ ID NO: 108928 - DNA, 6 bp, Unknown
  misc_feature (1)..( 6): Result.002 file - promoters60/1384161
tgttga

SEQ ID NO: 108929 - DNA, 8 bp, Unknown
  misc_feature (1)..( 8): Result.002 file - promoters60/1384161
cctgaact

SEQ ID NO: 108930 - DNA, 8 bp, Unknown
  misc_feature (1)..( 8): Result.002 file - promoters60/1384161
tttgaact

SEQ ID NO: 108931 - DNA, 8 bp, Unknown
  misc_feature (1)..( 8): Result.002 file - promoters60/1384161
ttttaact

SEQ ID NO: 108932 - DNA, 6 bp, Unknown
  misc_feature (1)..( 6): Result.002 file - promoters60/1384161
cagttg

SEQ ID NO: 108933 - DNA, 6 bp, Unknown
  misc_feature (1)..( 6): Result.002 file - promoters60/1384161
cagttg

SEQ ID NO: 108934 - DNA, 8 bp, Unknown
  misc_feature (1)..( 8): Result.002 file - promoters60/1384161
gtttatta

SEQ ID NO: 108935 - DNA, 8 bp, Unknown
  misc_feature (1)..( 8): Result.002 file - promoters60/1384161
gtttctta

SEQ ID NO: 108936 - DNA, 7 bp, Unknown
  misc_feature (1)..( 7): Result.002 file - promoters60/1384161
tttagct

SEQ ID NO: 108937 - DNA, 7 bp, Unknown
  misc_feature (1)..( 7): Result.002 file - promoters60/1384161
tttagct

SEQ ID NO: 108938 - DNA, 6 bp, Unknown
  misc_feature (1)..( 6): Result.002 file - promoters60/1384161
tctata

SEQ ID NO: 108939 - DNA, 6 bp, Unknown
  misc_feature (1)..( 6): Result.002 file - promoters60/1384161
tctata

SEQ ID NO: 108940 - DNA, 8 bp, Unknown
  misc_feature (1)..( 8): Result.002 file - promoters60/1384161
atattttt

SEQ ID NO: 108941 - DNA, 8 bp, Unknown
  misc_feature (1)..( 8): Result.002 file - promoters60/1384161
atagtttt

SEQ ID NO: 108942 - DNA, 9 bp, Unknown
  misc_feature (1)..( 9): Result.002 file - promoters60/1384161
ttttcttag

SEQ ID NO: 108943 - DNA, 9 bp, Unknown
  misc_feature (1)..( 9): Result.002 file - promoters60/1384161
tttccttag

SEQ ID NO: 108944 - DNA, 7 bp, Unknown
  misc_feature (1)..( 7): Result.002 file - promoters60/1384161
tatatgt

SEQ ID NO: 108945 - DNA, 7 bp, Unknown
  misc_feature (1)..( 7): Result.002 file - promoters60/1384161
tatttgt

SEQ ID NO: 108946 - DNA, 8 bp, Unknown
  misc_feature (1)..( 8): Result.002 file - promoters60/1384161
attgattt

SEQ ID NO: 108947 - DNA, 8 bp, Unknown
  misc_feature (1)..( 8): Result.002 file - promoters60/1384161
atttattt

SEQ ID NO: 108948 - DNA, 15 bp, Unknown
  misc_feature (1)..( 15): Result.002 file - promoters60/1384169
cttaaagaaatgtta

SEQ ID NO: 108949 - DNA, 15 bp, Unknown
  misc_feature (1)..( 15): Result.002 file - promoters60/1384169
aaggaagaaacaaga

SEQ ID NO: 108950 - DNA, 15 bp, Unknown
  misc_feature (1)..( 15): Result.002 file - promoters60/1384169
tttatagaaatatta

SEQ ID NO: 108951 - DNA, 15 bp, Unknown
  misc_feature (1)..( 15): Result.002 file - promoters60/1384169
cttatcaaaaaacgg

SEQ ID NO: 108952 - DNA, 15 bp, Unknown
  misc_feature (1)..( 15): Result.002 file - promoters60/1384169
cttatcagagtataa

SEQ ID NO: 108953 - DNA, 15 bp, Unknown
  misc_feature (1)..( 15): Result.002 file - promoters60/1384169
gtcaaagattaaacc

SEQ ID NO: 108954 - DNA, 8 bp, Unknown
  misc_feature (1)..( 8): Result.002 file - promoters60/1384261
taatattt

SEQ ID NO: 108955 - DNA, 8 bp, Unknown
  misc_feature (1)..( 8): Result.002 file - promoters60/1384261
tgatattt

SEQ ID NO: 108956 - DNA, 8 bp, Unknown
  misc_feature (1)..( 8): Result.002 file - promoters60/1384261
taacatta

SEQ ID NO: 108957 - DNA, 8 bp, Unknown
  misc_feature (1)..( 8): Result.002 file - promoters60/1384261
aaaaaagg

SEQ ID NO: 108958 - DNA, 8 bp, Unknown
  misc_feature (1)..( 8): Result.002 file - promoters60/1384261
aaaaaaat

SEQ ID NO: 108959 - DNA, 8 bp, Unknown
  misc_feature (1)..( 8): Result.002 file - promoters60/1384261
aaaatatc

SEQ ID NO: 108960 - DNA, 6 bp, Unknown
  misc_feature (1)..( 6): Result.002 file - promoters60/1384261
aattta

SEQ ID NO: 108961 - DNA, 6 bp, Unknown
  misc_feature (1)..( 6): Result.002 file - promoters60/1384261
aattta

SEQ ID NO: 108962 - DNA, 6 bp, Unknown
  misc_feature (1)..( 6): Result.002 file - promoters60/1384261
caaata

SEQ ID NO: 108963 - DNA, 6 bp, Unknown
  misc_feature (1)..( 6): Result.002 file - promoters60/1384261
caaata

SEQ ID NO: 108964 - DNA, 8 bp, Unknown
  misc_feature (1)..( 8): Result.002 file - promoters60/1384261
ccaaaata

SEQ ID NO: 108965 - DNA, 8 bp, Unknown
  misc_feature (1)..( 8): Result.002 file - promoters60/1384261
ccaaaata

SEQ ID NO: 108966 - DNA, 6 bp, Unknown
  misc_feature (1)..( 6): Result.002 file - promoters60/1384261
aattta

SEQ ID NO: 108967 - DNA, 6 bp, Unknown
  misc_feature (1)..( 6): Result.002 file - promoters60/1384261
aattta

SEQ ID NO: 108968 - DNA, 10 bp, Unknown
  misc_feature (1)..( 10): Result.002 file - promoters60/1384261
aaaaatttca

SEQ ID NO: 108969 - DNA, 10 bp, Unknown
  misc_feature (1)..( 10): Result.002 file - promoters60/1384261
aaaaataaaa

SEQ ID NO: 108970 - DNA, 10 bp, Unknown
  misc_feature (1)..( 10): Result.002 file - promoters60/1384261
aaaaatattt

SEQ ID NO: 108971 - DNA, 6 bp, Unknown
  misc_feature (1)..( 6): Result.002 file - promoters60/1384261
taaaaa

SEQ ID NO: 108972 - DNA, 6 bp, Unknown
  misc_feature (1)..( 6): Result.002 file - promoters60/1384261
taaaaa

SEQ ID NO: 108973 - DNA, 9 bp, Unknown
  misc_feature (1)..( 9): Result.002 file - promoters60/1384261
attttattc

SEQ ID NO: 108974 - DNA, 9 bp, Unknown
  misc_feature (1)..( 9): Result.002 file - promoters60/1384261
atttcattc

SEQ ID NO: 108975 - DNA, 7 bp, Unknown
  misc_feature (1)..( 7): Result.002 file - promoters60/1384261
attgacc

SEQ ID NO: 108976 - DNA, 7 bp, Unknown
  misc_feature (1)..( 7): Result.002 file - promoters60/1384261
attaacc

SEQ ID NO: 108977 - DNA, 7 bp, Unknown
  misc_feature (1)..( 7): Result.002 file - promoters60/1384261
aaacaga

SEQ ID NO: 108978 - DNA, 7 bp, Unknown
  misc_feature (1)..( 7): Result.002 file - promoters60/1384261
aaagaga

SEQ ID NO: 108979 - DNA, 6 bp, Unknown
  misc_feature (1)..( 6): Result.002 file - promoters60/1384261
aaaatg

SEQ ID NO: 108980 - DNA, 6 bp, Unknown
  misc_feature (1)..( 6): Result.002 file - promoters60/1384261
aaaatg

SEQ ID NO: 108981 - DNA, 7 bp, Unknown
  misc_feature (1)..( 7): Result.002 file - promoters60/1384261
aatcttt

SEQ ID NO: 108982 - DNA, 7 bp, Unknown
  misc_feature (1)..( 7): Result.002 file - promoters60/1384261
aatcttt

SEQ ID NO: 108983 - DNA, 7 bp, Unknown
  misc_feature (1)..( 7): Result.002 file - promoters60/1384261
actaaaa

SEQ ID NO: 108984 - DNA, 7 bp, Unknown
  misc_feature (1)..( 7): Result.002 file - promoters60/1384261
actaaaa

SEQ ID NO: 108985 - DNA, 6 bp, Unknown
  misc_feature (1)..( 6): Result.002 file - promoters60/1384261
aaaatt

SEQ ID NO: 108986 - DNA, 6 bp, Unknown
  misc_feature (1)..( 6): Result.002 file - promoters60/1384261
aaaatt

SEQ ID NO: 108987 - DNA, 11 bp, Unknown
  misc_feature (1)..( 11): Result.002 file - promoters60/1384261
aaagtgaatat

SEQ ID NO: 108988 - DNA, 11 bp, Unknown
  misc_feature (1)..( 11): Result.002 file - promoters60/1384261
aaaatgattat

SEQ ID NO: 108989 - DNA, 7 bp, Unknown
  misc_feature (1)..( 7): Result.002 file - promoters60/1384261
acatatc

SEQ ID NO: 108990 - DNA, 7 bp, Unknown
  misc_feature (1)..( 7): Result.002 file - promoters60/1384261
acagatc

SEQ ID NO: 108991 - DNA, 8 bp, Unknown
  misc_feature (1)..( 8): Result.002 file - promoters60/1384261
tattaaat

SEQ ID NO: 108992 - DNA, 8 bp, Unknown
  misc_feature (1)..( 8): Result.002 file - promoters60/1384261
tatgaaat

SEQ ID NO: 108993 - DNA, 7 bp, Unknown
  misc_feature (1)..( 7): Result.002 file - promoters60/1384261
ctctctt

SEQ ID NO: 108994 - DNA, 7 bp, Unknown
  misc_feature (1)..( 7): Result.002 file - promoters60/1384261
ctccctt

SEQ ID NO: 108995 - DNA, 7 bp, Unknown
  misc_feature (1)..( 7): Result.002 file - promoters60/1384261
aaatagt

SEQ ID NO: 108996 - DNA, 7 bp, Unknown
  misc_feature (1)..( 7): Result.002 file - promoters60/1384261
aaaaagt

SEQ ID NO: 108997 - DNA, 9 bp, Unknown
  misc_feature (1)..( 9): Result.002 file - promoters60/1384329
tcatggatc

SEQ ID NO: 108998 - DNA, 9 bp, Unknown
  misc_feature (1)..( 9): Result.002 file - promoters60/1384329
gtatgaatc

SEQ ID NO: 108999 - DNA, 9 bp, Unknown
  misc_feature (1)..( 9): Result.002 file - promoters60/1384329
gtatgaact

SEQ ID NO: 109000 - DNA, 9 bp, Unknown
  misc_feature (1)..( 9): Result.002 file - promoters60/1384329
actaaaaca

SEQ ID NO: 109001 - DNA, 9 bp, Unknown
  misc_feature (1)..( 9): Result.002 file - promoters60/1384329
aataataca

SEQ ID NO: 109002 - DNA, 9 bp, Unknown
  misc_feature (1)..( 9): Result.002 file - promoters60/1384329
tggaaaaca

SEQ ID NO: 109003 - DNA, 9 bp, Unknown
  misc_feature (1)..( 9): Result.002 file - promoters60/1384329
aatattaca

SEQ ID NO: 109004 - DNA, 7 bp, Unknown
  misc_feature (1)..( 7): Result.002 file - promoters60/1384329
tgaccaa

SEQ ID NO: 109005 - DNA, 7 bp, Unknown
  misc_feature (1)..( 7): Result.002 file - promoters60/1384329
tgaccaa

SEQ ID NO: 109006 - DNA, 7 bp, Unknown
  misc_feature (1)..( 7): Result.002 file - promoters60/1384329
tgatcaa

SEQ ID NO: 109007 - DNA, 7 bp, Unknown
  misc_feature (1)..( 7): Result.002 file - promoters60/1384329
cgaccaa

SEQ ID NO: 109008 - DNA, 7 bp, Unknown
  misc_feature (1)..( 7): Result.002 file - promoters60/1384329
tgaccaa

SEQ ID NO: 109009 - DNA, 7 bp, Unknown
  misc_feature (1)..( 7): Result.002 file - promoters60/1384329
tgatcaa

SEQ ID NO: 109010 - DNA, 7 bp, Unknown
  misc_feature (1)..( 7): Result.002 file - promoters60/1384329
ggaaaaa

SEQ ID NO: 109011 - DNA, 7 bp, Unknown
  misc_feature (1)..( 7): Result.002 file - promoters60/1384329
agaaaaa

SEQ ID NO: 109012 - DNA, 7 bp, Unknown
  misc_feature (1)..( 7): Result.002 file - promoters60/1384329
ggaaaac

SEQ ID NO: 109013 - DNA, 11 bp, Unknown
  misc_feature (1)..( 11): Result.002 file - promoters60/1385347
aaactgtgaaa

SEQ ID NO: 109014 - DNA, 11 bp, Unknown
  misc_feature (1)..( 11): Result.002 file - promoters60/1385347
aaaatgtgaaa

SEQ ID NO: 109015 - DNA, 11 bp, Unknown
  misc_feature (1)..( 11): Result.002 file - promoters60/1385347
aaaataatttt

SEQ ID NO: 109016 - DNA, 12 bp, Unknown
  misc_feature (1)..( 12): Result.002 file - promoters60/1385347
ttgatagtttag

SEQ ID NO: 109017 - DNA, 8 bp, Unknown
  misc_feature (1)..( 8): Result.002 file - promoters60/1385347
aatgtgat

SEQ ID NO: 109018 - DNA, 8 bp, Unknown
  misc_feature (1)..( 8): Result.002 file - promoters60/1385347
tttgtgat

SEQ ID NO: 109019 - DNA, 8 bp, Unknown
  misc_feature (1)..( 8): Result.002 file - promoters60/1385347
tttttgag

SEQ ID NO: 109020 - DNA, 8 bp, Unknown
  misc_feature (1)..( 8): Result.002 file - promoters60/1385347
tttttgcc

SEQ ID NO: 109021 - DNA, 7 bp, Unknown
  misc_feature (1)..( 7): Result.002 file - promoters60/1385347
attttac

SEQ ID NO: 109022 - DNA, 7 bp, Unknown
  misc_feature (1)..( 7): Result.002 file - promoters60/1385347
attttaa

SEQ ID NO: 109023 - DNA, 8 bp, Unknown
  misc_feature (1)..( 8): Result.002 file - promoters60/1385347
tgttttaa

SEQ ID NO: 109024 - DNA, 9 bp, Unknown
  misc_feature (1)..( 9): Result.002 file - promoters60/1385347
atgttgtaa

SEQ ID NO: 109025 - DNA, 8 bp, Unknown
  misc_feature (1)..( 8): Result.002 file - promoters60/1385347
atgaaatg

SEQ ID NO: 109026 - DNA, 8 bp, Unknown
  misc_feature (1)..( 8): Result.002 file - promoters60/1385347
ctgaaatt

SEQ ID NO: 109027 - DNA, 8 bp, Unknown
  misc_feature (1)..( 8): Result.002 file - promoters60/1385347
ttgatatg

SEQ ID NO: 109028 - DNA, 8 bp, Unknown
  misc_feature (1)..( 8): Result.002 file - promoters60/1385347
ctgcaatt

SEQ ID NO: 109029 - DNA, 10 bp, Unknown
  misc_feature (1)..( 10): Result.002 file - promoters60/1385347
ttttaatact

SEQ ID NO: 109030 - DNA, 10 bp, Unknown
  misc_feature (1)..( 10): Result.002 file - promoters60/1385347
ttttaatatt

SEQ ID NO: 109031 - DNA, 10 bp, Unknown
  misc_feature (1)..( 10): Result.002 file - promoters60/1385347
aactaagact

SEQ ID NO: 109032 - DNA, 10 bp, Unknown
  misc_feature (1)..( 10): Result.002 file - promoters60/1385347
ttttaagtag

SEQ ID NO: 109033 - DNA, 7 bp, Unknown
  misc_feature (1)..( 7): Result.002 file - promoters60/1385376
attgttg

SEQ ID NO: 109034 - DNA, 7 bp, Unknown
  misc_feature (1)..( 7): Result.002 file - promoters60/1385376
attgttg

SEQ ID NO: 109035 - DNA, 9 bp, Unknown
  misc_feature (1)..( 9): Result.002 file - promoters60/1385376
taaaaaatt

SEQ ID NO: 109036 - DNA, 9 bp, Unknown
  misc_feature (1)..( 9): Result.002 file - promoters60/1385376
taaaagatt

SEQ ID NO: 109037 - DNA, 9 bp, Unknown
  misc_feature (1)..( 9): Result.002 file - promoters60/1385376
gataagatt

SEQ ID NO: 109038 - DNA, 7 bp, Unknown
  misc_feature (1)..( 7): Result.002 file - promoters60/1385376
ttggttt

SEQ ID NO: 109039 - DNA, 7 bp, Unknown
  misc_feature (1)..( 7): Result.002 file - promoters60/1385376
ttgattt

SEQ ID NO: 109040 - DNA, 7 bp, Unknown
  misc_feature (1)..( 7): Result.002 file - promoters60/1385376
ttggttg

SEQ ID NO: 109041 - DNA, 9 bp, Unknown
  misc_feature (1)..( 9): Result.002 file - promoters60/1385376
tttgatttt

SEQ ID NO: 109042 - DNA, 9 bp, Unknown
  misc_feature (1)..( 9): Result.002 file - promoters60/1385376
tttggtttt

SEQ ID NO: 109043 - DNA, 9 bp, Unknown
  misc_feature (1)..( 9): Result.002 file - promoters60/1385376
cttggttgg

SEQ ID NO: 109044 - DNA, 7 bp, Unknown
  misc_feature (1)..( 7): Result.002 file - promoters60/1385376
aaagaga

SEQ ID NO: 109045 - DNA, 7 bp, Unknown
  misc_feature (1)..( 7): Result.002 file - promoters60/1385376
aaagaga

SEQ ID NO: 109046 - DNA, 8 bp, Unknown
  misc_feature (1)..( 8): Result.002 file - promoters60/1385376
taaatagt

SEQ ID NO: 109047 - DNA, 8 bp, Unknown
  misc_feature (1)..( 8): Result.002 file - promoters60/1385376
taaatagt

SEQ ID NO: 109048 - DNA, 8 bp, Unknown
  misc_feature (1)..( 8): Result.002 file - promoters60/1385376
gaaacaat

SEQ ID NO: 109049 - DNA, 8 bp, Unknown
  misc_feature (1)..( 8): Result.002 file - promoters60/1385376
gaagcaat

SEQ ID NO: 109050 - DNA, 7 bp, Unknown
  misc_feature (1)..( 7): Result.002 file - promoters60/1385376
ataattg

SEQ ID NO: 109051 - DNA, 7 bp, Unknown
  misc_feature (1)..( 7): Result.002 file - promoters60/1385376
ataattg

SEQ ID NO: 109052 - DNA, 6 bp, Unknown
  misc_feature (1)..( 6): Result.002 file - promoters60/1385376
ttttga

SEQ ID NO: 109053 - DNA, 6 bp, Unknown
  misc_feature (1)..( 6): Result.002 file - promoters60/1385376
ttttga

SEQ ID NO: 109054 - DNA, 7 bp, Unknown
  misc_feature (1)..( 7): Result.002 file - promoters60/1385376
tgagatt

SEQ ID NO: 109055 - DNA, 7 bp, Unknown
  misc_feature (1)..( 7): Result.002 file - promoters60/1385376
tgatatt

SEQ ID NO: 109056 - DNA, 6 bp, Unknown
  misc_feature (1)..( 6): Result.002 file - promoters60/1385376
ttggaa

SEQ ID NO: 109057 - DNA, 6 bp, Unknown
  misc_feature (1)..( 6): Result.002 file - promoters60/1385376
ttggaa

SEQ ID NO: 109058 - DNA, 8 bp, Unknown
  misc_feature (1)..( 8): Result.002 file - promoters60/1385376
gaaaatga

SEQ ID NO: 109059 - DNA, 8 bp, Unknown
  misc_feature (1)..( 8): Result.002 file - promoters60/1385376
gaaagtga

SEQ ID NO: 109060 - DNA, 10 bp, Unknown
  misc_feature (1)..( 10): Result.002 file - promoters60/1385376
ttgtggttca

SEQ ID NO: 109061 - DNA, 10 bp, Unknown
  misc_feature (1)..( 10): Result.002 file - promoters60/1385376
ttgaggttca

SEQ ID NO: 109062 - DNA, 9 bp, Unknown
  misc_feature (1)..( 9): Result.002 file - promoters60/1385376
agagggcaa

SEQ ID NO: 109063 - DNA, 9 bp, Unknown
  misc_feature (1)..( 9): Result.002 file - promoters60/1385376
agagagcaa

SEQ ID NO: 109064 - DNA, 7 bp, Unknown
  misc_feature (1)..( 7): Result.002 file - promoters60/1385376
ttgggaa

SEQ ID NO: 109065 - DNA, 7 bp, Unknown
  misc_feature (1)..( 7): Result.002 file - promoters60/1385376
ttgagaa

SEQ ID NO: 109066 - DNA, 6 bp, Unknown
  misc_feature (1)..( 6): Result.002 file - promoters60/1385376
tcttat

SEQ ID NO: 109067 - DNA, 6 bp, Unknown
  misc_feature (1)..( 6): Result.002 file - promoters60/1385376
tcttat

SEQ ID NO: 109068 - DNA, 7 bp, Unknown
  misc_feature (1)..( 7): Result.002 file - promoters60/1385376
aagctgt

SEQ ID NO: 109069 - DNA, 7 bp, Unknown
  misc_feature (1)..( 7): Result.002 file - promoters60/1385376
aagttgt

SEQ ID NO: 109070 - DNA, 8 bp, Unknown
  misc_feature (1)..( 8): Result.002 file - promoters60/1385376
cctcagaa

SEQ ID NO: 109071 - DNA, 8 bp, Unknown
  misc_feature (1)..( 8): Result.002 file - promoters60/1385376
cctaagaa

SEQ ID NO: 109072 - DNA, 13 bp, Unknown
  misc_feature (1)..( 13): Result.002 file - promoters60/1385376
ttgaatcaatatt

SEQ ID NO: 109073 - DNA, 13 bp, Unknown
  misc_feature (1)..( 13): Result.002 file - promoters60/1385376
ttgattcaaaatt

SEQ ID NO: 109074 - DNA, 7 bp, Unknown
  misc_feature (1)..( 7): Result.002 file - promoters60/1385376
tggattt

SEQ ID NO: 109075 - DNA, 7 bp, Unknown
  misc_feature (1)..( 7): Result.002 file - promoters60/1385376
tggattt

SEQ ID NO: 109076 - DNA, 6 bp, Unknown
  misc_feature (1)..( 6): Result.002 file - promoters60/1385376
ttaacc

SEQ ID NO: 109077 - DNA, 6 bp, Unknown
  misc_feature (1)..( 6): Result.002 file - promoters60/1385376
ttaacc

SEQ ID NO: 109078 - DNA, 7 bp, Unknown
  misc_feature (1)..( 7): Result.002 file - promoters60/1385376
ctcactc

SEQ ID NO: 109079 - DNA, 7 bp, Unknown
  misc_feature (1)..( 7): Result.002 file - promoters60/1385376
ctcgctc

SEQ ID NO: 109080 - DNA, 6 bp, Unknown
  misc_feature (1)..( 6): Result.002 file - promoters60/1385376
atttct

SEQ ID NO: 109081 - DNA, 6 bp, Unknown
  misc_feature (1)..( 6): Result.002 file - promoters60/1385376
atttct

SEQ ID NO: 109082 - DNA, 11 bp, Unknown
  misc_feature (1)..( 11): Result.002 file - promoters60/1386215
accaaaattgt

SEQ ID NO: 109083 - DNA, 11 bp, Unknown
  misc_feature (1)..( 11): Result.002 file - promoters60/1386215
ggaaaaattac

SEQ ID NO: 109084 - DNA, 11 bp, Unknown
  misc_feature (1)..( 11): Result.002 file - promoters60/1386215
ttcaaaatttt

SEQ ID NO: 109085 - DNA, 11 bp, Unknown
  misc_feature (1)..( 11): Result.002 file - promoters60/1386215
ttcataatttg

SEQ ID NO: 109086 - DNA, 11 bp, Unknown
  misc_feature (1)..( 11): Result.002 file - promoters60/1386215
aatgtaatttg

SEQ ID NO: 109087 - DNA, 10 bp, Unknown
  misc_feature (1)..( 10): Result.002 file - promoters60/1386215
tttttttcac

SEQ ID NO: 109088 - DNA, 10 bp, Unknown
  misc_feature (1)..( 10): Result.002 file - promoters60/1386215
gctttatcac

SEQ ID NO: 109089 - DNA, 10 bp, Unknown
  misc_feature (1)..( 10): Result.002 file - promoters60/1386215
gattttttgt

SEQ ID NO: 109090 - DNA, 10 bp, Unknown
  misc_feature (1)..( 10): Result.002 file - promoters60/1386215
gctgtatagg

SEQ ID NO: 109091 - DNA, 10 bp, Unknown
  misc_feature (1)..( 10): Result.002 file - promoters60/1386215
accaatttaa

SEQ ID NO: 109092 - DNA, 10 bp, Unknown
  misc_feature (1)..( 10): Result.002 file - promoters60/1386215
tccaatttcc

SEQ ID NO: 109093 - DNA, 10 bp, Unknown
  misc_feature (1)..( 10): Result.002 file - promoters60/1386215
tccaatgttt

SEQ ID NO: 109094 - DNA, 10 bp, Unknown
  misc_feature (1)..( 10): Result.002 file - promoters60/1386215
ccaaatgtcc

SEQ ID NO: 109095 - DNA, 10 bp, Unknown
  misc_feature (1)..( 10): Result.002 file - promoters60/1386215
caaatgttgc

SEQ ID NO: 109096 - DNA, 10 bp, Unknown
  misc_feature (1)..( 10): Result.002 file - promoters60/1386215
aaaatgtgaa

SEQ ID NO: 109097 - DNA, 10 bp, Unknown
  misc_feature (1)..( 10): Result.002 file - promoters60/1386215
aaaatttgaa

SEQ ID NO: 109098 - DNA, 10 bp, Unknown
  misc_feature (1)..( 10): Result.002 file - promoters60/1386215
acaatgtgaa

SEQ ID NO: 109099 - DNA, 10 bp, Unknown
  misc_feature (1)..( 10): Result.002 file - promoters60/1386215
agaatttgac

SEQ ID NO: 109100 - DNA, 9 bp, Unknown
  misc_feature (1)..( 9): Result.002 file - promoters60/1386215
catttgtaa

SEQ ID NO: 109101 - DNA, 9 bp, Unknown
  misc_feature (1)..( 9): Result.002 file - promoters60/1386215
tttttgtat

SEQ ID NO: 109102 - DNA, 9 bp, Unknown
  misc_feature (1)..( 9): Result.002 file - promoters60/1386215
ttcttgtaa

SEQ ID NO: 109103 - DNA, 9 bp, Unknown
  misc_feature (1)..( 9): Result.002 file - promoters60/1386215
gatttgtac

SEQ ID NO: 109104 - DNA, 9 bp, Unknown
  misc_feature (1)..( 9): Result.002 file - promoters60/1386215
gatttgaga

SEQ ID NO: 109105 - DNA, 10 bp, Unknown
  misc_feature (1)..( 10): Result.002 file - promoters60/1386215
aaaatttgaa

SEQ ID NO: 109106 - DNA, 10 bp, Unknown
  misc_feature (1)..( 10): Result.002 file - promoters60/1386215
acaatgtgaa

SEQ ID NO: 109107 - DNA, 10 bp, Unknown
  misc_feature (1)..( 10): Result.002 file - promoters60/1386215
agaatttgac

SEQ ID NO: 109108 - DNA, 10 bp, Unknown
  misc_feature (1)..( 10): Result.002 file - promoters60/1386215
aaaatgtgaa

SEQ ID NO: 109109 - DNA, 6 bp, Unknown
  misc_feature (1)..( 6): Result.002 file - promoters60/1386628
gaacat

SEQ ID NO: 109110 - DNA, 6 bp, Unknown
  misc_feature (1)..( 6): Result.002 file - promoters60/1386628
gaacat

SEQ ID NO: 109111 - DNA, 6 bp, Unknown
  misc_feature (1)..( 6): Result.002 file - promoters60/1386628
gaacat

SEQ ID NO: 109112 - DNA, 9 bp, Unknown
  misc_feature (1)..( 9): Result.002 file - promoters60/1386628
gttttttat

SEQ ID NO: 109113 - DNA, 9 bp, Unknown
  misc_feature (1)..( 9): Result.002 file - promoters60/1386628
atttcttac

SEQ ID NO: 109114 - DNA, 9 bp, Unknown
  misc_feature (1)..( 9): Result.002 file - promoters60/1386628
atttcttac

SEQ ID NO: 109115 - DNA, 9 bp, Unknown
  misc_feature (1)..( 9): Result.002 file - promoters60/1386628
aagatgaga

SEQ ID NO: 109116 - DNA, 9 bp, Unknown
  misc_feature (1)..( 9): Result.002 file - promoters60/1386628
aagatgcta

SEQ ID NO: 109117 - DNA, 9 bp, Unknown
  misc_feature (1)..( 9): Result.002 file - promoters60/1386628
gagattcta

SEQ ID NO: 109118 - DNA, 6 bp, Unknown
  misc_feature (1)..( 6): Result.002 file - promoters60/1386778
tgtttt

SEQ ID NO: 109119 - DNA, 6 bp, Unknown
  misc_feature (1)..( 6): Result.002 file - promoters60/1386778
tgtttt

SEQ ID NO: 109120 - DNA, 6 bp, Unknown
  misc_feature (1)..( 6): Result.002 file - promoters60/1386778
gtaatc

SEQ ID NO: 109121 - DNA, 6 bp, Unknown
  misc_feature (1)..( 6): Result.002 file - promoters60/1386778
gtaatc

SEQ ID NO: 109122 - DNA, 7 bp, Unknown
  misc_feature (1)..( 7): Result.002 file - promoters60/1386778
aagaaat

SEQ ID NO: 109123 - DNA, 7 bp, Unknown
  misc_feature (1)..( 7): Result.002 file - promoters60/1386778
aagcaat

SEQ ID NO: 109124 - DNA, 9 bp, Unknown
  misc_feature (1)..( 9): Result.002 file - promoters60/1386778
aaacaaaaa

SEQ ID NO: 109125 - DNA, 9 bp, Unknown
  misc_feature (1)..( 9): Result.002 file - promoters60/1386778
aaagaaagc

SEQ ID NO: 109126 - DNA, 9 bp, Unknown
  misc_feature (1)..( 9): Result.002 file - promoters60/1386778
aaacaaaaa

SEQ ID NO: 109127 - DNA, 9 bp, Unknown
  misc_feature (1)..( 9): Result.002 file - promoters60/1386778
acaaagaac

SEQ ID NO: 109128 - DNA, 9 bp, Unknown
  misc_feature (1)..( 9): Result.002 file - promoters60/1386778
gaaaagaaa

SEQ ID NO: 109129 - DNA, 10 bp, Unknown
  misc_feature (1)..( 10): Result.002 file - promoters60/1386778
ggaaatgaaa

SEQ ID NO: 109130 - DNA, 14 bp, Unknown
  misc_feature (1)..( 14): Result.002 file - promoters60/1386778
taataaaaaaaagg

SEQ ID NO: 109131 - DNA, 14 bp, Unknown
  misc_feature (1)..( 14): Result.002 file - promoters60/1386778
gtatataaacaagg

SEQ ID NO: 109132 - DNA, 14 bp, Unknown
  misc_feature (1)..( 14): Result.002 file - promoters60/1386778
gtatatatttattt

SEQ ID NO: 109133 - DNA, 7 bp, Unknown
  misc_feature (1)..( 7): Result.002 file - promoters60/1386778
tgagctt

SEQ ID NO: 109134 - DNA, 7 bp, Unknown
  misc_feature (1)..( 7): Result.002 file - promoters60/1386778
tgagctt

SEQ ID NO: 109135 - DNA, 7 bp, Unknown
  misc_feature (1)..( 7): Result.002 file - promoters60/1386778
gaaagat

SEQ ID NO: 109136 - DNA, 7 bp, Unknown
  misc_feature (1)..( 7): Result.002 file - promoters60/1386778
gaaagat

SEQ ID NO: 109137 - DNA, 6 bp, Unknown
  misc_feature (1)..( 6): Result.002 file - promoters60/1386778
ttttaa

SEQ ID NO: 109138 - DNA, 6 bp, Unknown
  misc_feature (1)..( 6): Result.002 file - promoters60/1386778
ttttaa

SEQ ID NO: 109139 - DNA, 7 bp, Unknown
  misc_feature (1)..( 7): Result.002 file - promoters60/1386778
aaaaatt

SEQ ID NO: 109140 - DNA, 7 bp, Unknown
  misc_feature (1)..( 7): Result.002 file - promoters60/1386778
aaacatt

SEQ ID NO: 109141 - DNA, 11 bp, Unknown
  misc_feature (1)..( 11): Result.002 file - promoters60/1386778
ccattttttta

SEQ ID NO: 109142 - DNA, 11 bp, Unknown
  misc_feature (1)..( 11): Result.002 file - promoters60/1386778
ccaatttgtta

SEQ ID NO: 109143 - DNA, 6 bp, Unknown
  misc_feature (1)..( 6): Result.002 file - promoters60/1386778
ataatt

SEQ ID NO: 109144 - DNA, 6 bp, Unknown
  misc_feature (1)..( 6): Result.002 file - promoters60/1386778
ataatt

SEQ ID NO: 109145 - DNA, 7 bp, Unknown
  misc_feature (1)..( 7): Result.002 file - promoters60/1386778
tttgggc

SEQ ID NO: 109146 - DNA, 7 bp, Unknown
  misc_feature (1)..( 7): Result.002 file - promoters60/1386778
tttaggc

SEQ ID NO: 109147 - DNA, 6 bp, Unknown
  misc_feature (1)..( 6): Result.002 file - promoters60/1386778
agtaaa

SEQ ID NO: 109148 - DNA, 6 bp, Unknown
  misc_feature (1)..( 6): Result.002 file - promoters60/1386778
agtaaa

SEQ ID NO: 109149 - DNA, 7 bp, Unknown
  misc_feature (1)..( 7): Result.002 file - promoters60/1386778
aatcggg

SEQ ID NO: 109150 - DNA, 7 bp, Unknown
  misc_feature (1)..( 7): Result.002 file - promoters60/1386778
aattggg

SEQ ID NO: 109151 - DNA, 7 bp, Unknown
  misc_feature (1)..( 7): Result.002 file - promoters60/1386778
cccacta

SEQ ID NO: 109152 - DNA, 7 bp, Unknown
  misc_feature (1)..( 7): Result.002 file - promoters60/1386778
cccacta

SEQ ID NO: 109153 - DNA, 9 bp, Unknown
  misc_feature (1)..( 9): Result.002 file - promoters60/1386778
aaagaaaag

SEQ ID NO: 109154 - DNA, 9 bp, Unknown
  misc_feature (1)..( 9): Result.002 file - promoters60/1386778
aaagtaaag

SEQ ID NO: 109155 - DNA, 8 bp, Unknown
  misc_feature (1)..( 8): Result.002 file - promoters60/1386786
attcttta

SEQ ID NO: 109156 - DNA, 8 bp, Unknown
  misc_feature (1)..( 8): Result.002 file - promoters60/1386786
attcttta

SEQ ID NO: 109157 - DNA, 8 bp, Unknown
  misc_feature (1)..( 8): Result.002 file - promoters60/1386786
tttacttt

SEQ ID NO: 109158 - DNA, 8 bp, Unknown
  misc_feature (1)..( 8): Result.002 file - promoters60/1386786
ttttcttt

SEQ ID NO: 109159 - DNA, 8 bp, Unknown
  misc_feature (1)..( 8): Result.002 file - promoters60/1386786
ccgagctg

SEQ ID NO: 109160 - DNA, 8 bp, Unknown
  misc_feature (1)..( 8): Result.002 file - promoters60/1386786
ccgtgctg

SEQ ID NO: 109161 - DNA, 6 bp, Unknown
  misc_feature (1)..( 6): Result.002 file - promoters60/1386786
attgtt

SEQ ID NO: 109162 - DNA, 6 bp, Unknown
  misc_feature (1)..( 6): Result.002 file - promoters60/1386786
attgtt

SEQ ID NO: 109163 - DNA, 6 bp, Unknown
  misc_feature (1)..( 6): Result.002 file - promoters60/1386786
agtttt

SEQ ID NO: 109164 - DNA, 6 bp, Unknown
  misc_feature (1)..( 6): Result.002 file - promoters60/1386786
agtttt

SEQ ID NO: 109165 - DNA, 8 bp, Unknown
  misc_feature (1)..( 8): Result.002 file - promoters60/1386786
ttttaatt

SEQ ID NO: 109166 - DNA, 8 bp, Unknown
  misc_feature (1)..( 8): Result.002 file - promoters60/1386786
ttttcatt

SEQ ID NO: 109167 - DNA, 6 bp, Unknown
  misc_feature (1)..( 6): Result.002 file - promoters60/1386786
actttt

SEQ ID NO: 109168 - DNA, 6 bp, Unknown
  misc_feature (1)..( 6): Result.002 file - promoters60/1386786
actttt

SEQ ID NO: 109169 - DNA, 9 bp, Unknown
  misc_feature (1)..( 9): Result.002 file - promoters60/1386786
aaaggaatt

SEQ ID NO: 109170 - DNA, 9 bp, Unknown
  misc_feature (1)..( 9): Result.002 file - promoters60/1386786
aaacgaatt

SEQ ID NO: 109171 - DNA, 9 bp, Unknown
  misc_feature (1)..( 9): Result.002 file - promoters60/1386786
aatctgagc

SEQ ID NO: 109172 - DNA, 9 bp, Unknown
  misc_feature (1)..( 9): Result.002 file - promoters60/1386786
aatcagagc

SEQ ID NO: 109173 - DNA, 7 bp, Unknown
  misc_feature (1)..( 7): Result.002 file - promoters60/1386786
cggagag

SEQ ID NO: 109174 - DNA, 7 bp, Unknown
  misc_feature (1)..( 7): Result.002 file - promoters60/1386786
cggcgag

SEQ ID NO: 109175 - DNA, 6 bp, Unknown
  misc_feature (1)..( 6): Result.002 file - promoters60/1386786
ttatct

SEQ ID NO: 109176 - DNA, 6 bp, Unknown
  misc_feature (1)..( 6): Result.002 file - promoters60/1386786
ttatct

SEQ ID NO: 109177 - DNA, 6 bp, Unknown
  misc_feature (1)..( 6): Result.002 file - promoters60/1386786
gattaa

SEQ ID NO: 109178 - DNA, 6 bp, Unknown
  misc_feature (1)..( 6): Result.002 file - promoters60/1386786
gattaa

SEQ ID NO: 109179 - DNA, 6 bp, Unknown
  misc_feature (1)..( 6): Result.002 file - promoters60/1386861
gttata

SEQ ID NO: 109180 - DNA, 6 bp, Unknown
  misc_feature (1)..( 6): Result.002 file - promoters60/1386861
gttata

SEQ ID NO: 109181 - DNA, 7 bp, Unknown
  misc_feature (1)..( 7): Result.002 file - promoters60/1386861
tttgttt

SEQ ID NO: 109182 - DNA, 7 bp, Unknown
  misc_feature (1)..( 7): Result.002 file - promoters60/1386861
tttgttt

SEQ ID NO: 109183 - DNA, 9 bp, Unknown
  misc_feature (1)..( 9): Result.002 file - promoters60/1386861
tttattttc

SEQ ID NO: 109184 - DNA, 9 bp, Unknown
  misc_feature (1)..( 9): Result.002 file - promoters60/1386861
ttttttttt

SEQ ID NO: 109185 - DNA, 9 bp, Unknown
  misc_feature (1)..( 9): Result.002 file - promoters60/1386861
gctatgttc

SEQ ID NO: 109186 - DNA, 6 bp, Unknown
  misc_feature (1)..( 6): Result.002 file - promoters60/1386861
tataaa

SEQ ID NO: 109187 - DNA, 6 bp, Unknown
  misc_feature (1)..( 6): Result.002 file - promoters60/1386861
tataaa

SEQ ID NO: 109188 - DNA, 7 bp, Unknown
  misc_feature (1)..( 7): Result.002 file - promoters60/1386861
tgaattt

SEQ ID NO: 109189 - DNA, 7 bp, Unknown
  misc_feature (1)..( 7): Result.002 file - promoters60/1386861
tgacttt

SEQ ID NO: 109190 - DNA, 7 bp, Unknown
  misc_feature (1)..( 7): Result.002 file - promoters60/1386861
catttga

SEQ ID NO: 109191 - DNA, 7 bp, Unknown
  misc_feature (1)..( 7): Result.002 file - promoters60/1386861
catatga

SEQ ID NO: 109192 - DNA, 7 bp, Unknown
  misc_feature (1)..( 7): Result.002 file - promoters60/1386861
aacctta

SEQ ID NO: 109193 - DNA, 7 bp, Unknown
  misc_feature (1)..( 7): Result.002 file - promoters60/1386861
aacttta

SEQ ID NO: 109194 - DNA, 7 bp, Unknown
  misc_feature (1)..( 7): Result.002 file - promoters60/1386861
atttata

SEQ ID NO: 109195 - DNA, 7 bp, Unknown
  misc_feature (1)..( 7): Result.002 file - promoters60/1386861
attgata

SEQ ID NO: 109196 - DNA, 6 bp, Unknown
  misc_feature (1)..( 6): Result.002 file - promoters60/1386861
cagaaa

SEQ ID NO: 109197 - DNA, 6 bp, Unknown
  misc_feature (1)..( 6): Result.002 file - promoters60/1386861
cagaaa

SEQ ID NO: 109198 - DNA, 9 bp, Unknown
  misc_feature (1)..( 9): Result.002 file - promoters60/1386861
tcatcggtg

SEQ ID NO: 109199 - DNA, 9 bp, Unknown
  misc_feature (1)..( 9): Result.002 file - promoters60/1386861
tcatctgtg

SEQ ID NO: 109200 - DNA, 7 bp, Unknown
  misc_feature (1)..( 7): Result.002 file - promoters60/1386861
gagatct

SEQ ID NO: 109201 - DNA, 7 bp, Unknown
  misc_feature (1)..( 7): Result.002 file - promoters60/1386861
gagttct

SEQ ID NO: 109202 - DNA, 6 bp, Unknown
  misc_feature (1)..( 6): Result.002 file - promoters60/1386861
tttcta

SEQ ID NO: 109203 - DNA, 6 bp, Unknown
  misc_feature (1)..( 6): Result.002 file - promoters60/1386861
tttcta

SEQ ID NO: 109204 - DNA, 6 bp, Unknown
  misc_feature (1)..( 6): Result.002 file - promoters60/1386861
tcttta

SEQ ID NO: 109205 - DNA, 6 bp, Unknown
  misc_feature (1)..( 6): Result.002 file - promoters60/1386861
tcttta

SEQ ID NO: 109206 - DNA, 6 bp, Unknown
  misc_feature (1)..( 6): Result.002 file - promoters60/1386861
taaaga

SEQ ID NO: 109207 - DNA, 6 bp, Unknown
  misc_feature (1)..( 6): Result.002 file - promoters60/1386861
taaaga

SEQ ID NO: 109208 - DNA, 7 bp, Unknown
  misc_feature (1)..( 7): Result.002 file - promoters60/1386861
aagtata

SEQ ID NO: 109209 - DNA, 7 bp, Unknown
  misc_feature (1)..( 7): Result.002 file - promoters60/1386861
aaggata

SEQ ID NO: 109210 - DNA, 9 bp, Unknown
  misc_feature (1)..( 9): Result.002 file - promoters60/1387072
aaacaaaaa

SEQ ID NO: 109211 - DNA, 9 bp, Unknown
  misc_feature (1)..( 9): Result.002 file - promoters60/1387072
aaagaaaca

SEQ ID NO: 109212 - DNA, 9 bp, Unknown
  misc_feature (1)..( 9): Result.002 file - promoters60/1387072
aaagaaaaa

SEQ ID NO: 109213 - DNA, 9 bp, Unknown
  misc_feature (1)..( 9): Result.002 file - promoters60/1387072
ttatttgga

SEQ ID NO: 109214 - DNA, 9 bp, Unknown
  misc_feature (1)..( 9): Result.002 file - promoters60/1387072
atatttgtt

SEQ ID NO: 109215 - DNA, 9 bp, Unknown
  misc_feature (1)..( 9): Result.002 file - promoters60/1387072
ttatgtgga

SEQ ID NO: 109216 - DNA, 7 bp, Unknown
  misc_feature (1)..( 7): Result.002 file - promoters60/1387072
tataaat

SEQ ID NO: 109217 - DNA, 7 bp, Unknown
  misc_feature (1)..( 7): Result.002 file - promoters60/1387072
tataaat

SEQ ID NO: 109218 - DNA, 7 bp, Unknown
  misc_feature (1)..( 7): Result.002 file - promoters60/1387072
tataaaa

SEQ ID NO: 109219 - DNA, 11 bp, Unknown
  misc_feature (1)..( 11): Result.002 file - promoters60/1387123
tgtttgaccat

SEQ ID NO: 109220 - DNA, 11 bp, Unknown
  misc_feature (1)..( 11): Result.002 file - promoters60/1387123
tatttgaacat

SEQ ID NO: 109221 - DNA, 11 bp, Unknown
  misc_feature (1)..( 11): Result.002 file - promoters60/1387123
tgtgtgagttc

SEQ ID NO: 109222 - DNA, 8 bp, Unknown
  misc_feature (1)..( 8): Result.002 file - promoters60/1387123
taacgaac

SEQ ID NO: 109223 - DNA, 8 bp, Unknown
  misc_feature (1)..( 8): Result.002 file - promoters60/1387123
caacgaaa

SEQ ID NO: 109224 - DNA, 8 bp, Unknown
  misc_feature (1)..( 8): Result.002 file - promoters60/1387123
caactaaa

SEQ ID NO: 109225 - DNA, 10 bp, Unknown
  misc_feature (1)..( 10): Result.002 file - promoters60/1387123
aaatcatttt

SEQ ID NO: 109226 - DNA, 10 bp, Unknown
  misc_feature (1)..( 10): Result.002 file - promoters60/1387123
aaataatttt

SEQ ID NO: 109227 - DNA, 10 bp, Unknown
  misc_feature (1)..( 10): Result.002 file - promoters60/1387123
caatcatatt

SEQ ID NO: 109228 - DNA, 10 bp, Unknown
  misc_feature (1)..( 10): Result.002 file - promoters60/1387123
ctatcataat

SEQ ID NO: 109229 - DNA, 9 bp, Unknown
  misc_feature (1)..( 9): Result.002 file - promoters60/1387123
ataggaaat

SEQ ID NO: 109230 - DNA, 9 bp, Unknown
  misc_feature (1)..( 9): Result.002 file - promoters60/1387123
ataagaaaa

SEQ ID NO: 109231 - DNA, 9 bp, Unknown
  misc_feature (1)..( 9): Result.002 file - promoters60/1387123
ataataaaa

SEQ ID NO: 109232 - DNA, 9 bp, Unknown
  misc_feature (1)..( 9): Result.002 file - promoters60/1387123
tcaaccata

SEQ ID NO: 109233 - DNA, 9 bp, Unknown
  misc_feature (1)..( 9): Result.002 file - promoters60/1387123
tcaatcata

SEQ ID NO: 109234 - DNA, 9 bp, Unknown
  misc_feature (1)..( 9): Result.002 file - promoters60/1387123
actatcata

SEQ ID NO: 109235 - DNA, 9 bp, Unknown
  misc_feature (1)..( 9): Result.002 file - promoters60/1387123
taatttatt

SEQ ID NO: 109236 - DNA, 9 bp, Unknown
  misc_feature (1)..( 9): Result.002 file - promoters60/1387123
taatttcat

SEQ ID NO: 109237 - DNA, 9 bp, Unknown
  misc_feature (1)..( 9): Result.002 file - promoters60/1387123
aaatttcat

SEQ ID NO: 109238 - DNA, 9 bp, Unknown
  misc_feature (1)..( 9): Result.002 file - promoters60/1387123
taattttca

SEQ ID NO: 109239 - DNA, 9 bp, Unknown
  misc_feature (1)..( 9): Result.002 file - promoters60/1387123
ataatatgt

SEQ ID NO: 109240 - DNA, 9 bp, Unknown
  misc_feature (1)..( 9): Result.002 file - promoters60/1387123
ataataaaa

SEQ ID NO: 109241 - DNA, 9 bp, Unknown
  misc_feature (1)..( 9): Result.002 file - promoters60/1387123
ataagaaaa

SEQ ID NO: 109242 - DNA, 8 bp, Unknown
  misc_feature (1)..( 8): Result.002 file - promoters60/1387123
gaatttct

SEQ ID NO: 109243 - DNA, 8 bp, Unknown
  misc_feature (1)..( 8): Result.002 file - promoters60/1387123
aaatatct

SEQ ID NO: 109244 - DNA, 8 bp, Unknown
  misc_feature (1)..( 8): Result.002 file - promoters60/1387123
aaatatcc

SEQ ID NO: 109245 - DNA, 7 bp, Unknown
  misc_feature (1)..( 7): Result.002 file - promoters60/1387123
tatcata

SEQ ID NO: 109246 - DNA, 7 bp, Unknown
  misc_feature (1)..( 7): Result.002 file - promoters60/1387123
tattata

SEQ ID NO: 109247 - DNA, 7 bp, Unknown
  misc_feature (1)..( 7): Result.002 file - promoters60/1387123
aatcata

SEQ ID NO: 109248 - DNA, 8 bp, Unknown
  misc_feature (1)..( 8): Result.002 file - promoters60/1387123
taataaag

SEQ ID NO: 109249 - DNA, 8 bp, Unknown
  misc_feature (1)..( 8): Result.002 file - promoters60/1387123
taatcaag

SEQ ID NO: 109250 - DNA, 8 bp, Unknown
  misc_feature (1)..( 8): Result.002 file - promoters60/1387123
taacaaaa

SEQ ID NO: 109251 - DNA, 12 bp, Unknown
  misc_feature (1)..( 12): Result.002 file - promoters60/1387123
ataaattaatgc

SEQ ID NO: 109252 - DNA, 12 bp, Unknown
  misc_feature (1)..( 12): Result.002 file - promoters60/1387123
atatattaatgt

SEQ ID NO: 109253 - DNA, 12 bp, Unknown
  misc_feature (1)..( 12): Result.002 file - promoters60/1387123
tttggttattgt

SEQ ID NO: 109254 - DNA, 6 bp, Unknown
  misc_feature (1)..( 6): Result.002 file - promoters60/1387191
caaaaa

SEQ ID NO: 109255 - DNA, 6 bp, Unknown
  misc_feature (1)..( 6): Result.002 file - promoters60/1387191
caaaaa

SEQ ID NO: 109256 - DNA, 6 bp, Unknown
  misc_feature (1)..( 6): Result.002 file - promoters60/1387191
caaaaa

SEQ ID NO: 109257 - DNA, 6 bp, Unknown
  misc_feature (1)..( 6): Result.002 file - promoters60/1387191
caaaaa

SEQ ID NO: 109258 - DNA, 8 bp, Unknown
  misc_feature (1)..( 8): Result.002 file - promoters60/1387191
tactcaaa

SEQ ID NO: 109259 - DNA, 8 bp, Unknown
  misc_feature (1)..( 8): Result.002 file - promoters60/1387191
tacttaaa

SEQ ID NO: 109260 - DNA, 6 bp, Unknown
  misc_feature (1)..( 6): Result.002 file - promoters60/1387191
tttacc

SEQ ID NO: 109261 - DNA, 6 bp, Unknown
  misc_feature (1)..( 6): Result.002 file - promoters60/1387191
tttacc

SEQ ID NO: 109262 - DNA, 6 bp, Unknown
  misc_feature (1)..( 6): Result.002 file - promoters60/1387191
ctcaaa

SEQ ID NO: 109263 - DNA, 6 bp, Unknown
  misc_feature (1)..( 6): Result.002 file - promoters60/1387191
ctcaaa

SEQ ID NO: 109264 - DNA, 7 bp, Unknown
  misc_feature (1)..( 7): Result.002 file - promoters60/1387191
aatctgg

SEQ ID NO: 109265 - DNA, 7 bp, Unknown
  misc_feature (1)..( 7): Result.002 file - promoters60/1387191
aatttgg

SEQ ID NO: 109266 - DNA, 6 bp, Unknown
  misc_feature (1)..( 6): Result.002 file - promoters60/1387191
aaaatt

SEQ ID NO: 109267 - DNA, 6 bp, Unknown
  misc_feature (1)..( 6): Result.002 file - promoters60/1387191
aaaatt

SEQ ID NO: 109268 - DNA, 9 bp, Unknown
  misc_feature (1)..( 9): Result.002 file - promoters60/1387191
ggtctaaaa

SEQ ID NO: 109269 - DNA, 9 bp, Unknown
  misc_feature (1)..( 9): Result.002 file - promoters60/1387191
ggtcttaaa

SEQ ID NO: 109270 - DNA, 6 bp, Unknown
  misc_feature (1)..( 6): Result.002 file - promoters60/1387191
gaaccg

SEQ ID NO: 109271 - DNA, 6 bp, Unknown
  misc_feature (1)..( 6): Result.002 file - promoters60/1387191
gaaccg

SEQ ID NO: 109272 - DNA, 7 bp, Unknown
  misc_feature (1)..( 7): Result.002 file - promoters60/1387191
ccctatt

SEQ ID NO: 109273 - DNA, 7 bp, Unknown
  misc_feature (1)..( 7): Result.002 file - promoters60/1387191
cccgatt

SEQ ID NO: 109274 - DNA, 7 bp, Unknown
  misc_feature (1)..( 7): Result.002 file - promoters60/1387191
ttaaaaa

SEQ ID NO: 109275 - DNA, 7 bp, Unknown
  misc_feature (1)..( 7): Result.002 file - promoters60/1387191
ttacaaa

SEQ ID NO: 109276 - DNA, 10 bp, Unknown
  misc_feature (1)..( 10): Result.002 file - promoters60/1387191
gtaaacattt

SEQ ID NO: 109277 - DNA, 10 bp, Unknown
  misc_feature (1)..( 10): Result.002 file - promoters60/1387191
gtaaagattt

SEQ ID NO: 109278 - DNA, 8 bp, Unknown
  misc_feature (1)..( 8): Result.002 file - promoters60/1387191
aaggttag

SEQ ID NO: 109279 - DNA, 8 bp, Unknown
  misc_feature (1)..( 8): Result.002 file - promoters60/1387191
aaggatag

SEQ ID NO: 109280 - DNA, 6 bp, Unknown
  misc_feature (1)..( 6): Result.002 file - promoters60/1387211
tcatct

SEQ ID NO: 109281 - DNA, 6 bp, Unknown
  misc_feature (1)..( 6): Result.002 file - promoters60/1387211
tcatct

SEQ ID NO: 109282 - DNA, 8 bp, Unknown
  misc_feature (1)..( 8): Result.002 file - promoters60/1387211
attctaaa

SEQ ID NO: 109283 - DNA, 8 bp, Unknown
  misc_feature (1)..( 8): Result.002 file - promoters60/1387211
attttaat

SEQ ID NO: 109284 - DNA, 8 bp, Unknown
  misc_feature (1)..( 8): Result.002 file - promoters60/1387211
ttttcaat

SEQ ID NO: 109285 - DNA, 9 bp, Unknown
  misc_feature (1)..( 9): Result.002 file - promoters60/1387211
tatgtgtgt

SEQ ID NO: 109286 - DNA, 9 bp, Unknown
  misc_feature (1)..( 9): Result.002 file - promoters60/1387211
tatgtatgt

SEQ ID NO: 109287 - DNA, 7 bp, Unknown
  misc_feature (1)..( 7): Result.002 file - promoters60/1387211
acaaaac

SEQ ID NO: 109288 - DNA, 7 bp, Unknown
  misc_feature (1)..( 7): Result.002 file - promoters60/1387211
acaaaat

SEQ ID NO: 109289 - DNA, 7 bp, Unknown
  misc_feature (1)..( 7): Result.002 file - promoters60/1387211
acaaaac

SEQ ID NO: 109290 - DNA, 7 bp, Unknown
  misc_feature (1)..( 7): Result.002 file - promoters60/1387211
aaacagt

SEQ ID NO: 109291 - DNA, 7 bp, Unknown
  misc_feature (1)..( 7): Result.002 file - promoters60/1387211
aaatagt

SEQ ID NO: 109292 - DNA, 10 bp, Unknown
  misc_feature (1)..( 10): Result.002 file - promoters60/1387211
gctttagata

SEQ ID NO: 109293 - DNA, 10 bp, Unknown
  misc_feature (1)..( 10): Result.002 file - promoters60/1387211
gctttggata

SEQ ID NO: 109294 - DNA, 7 bp, Unknown
  misc_feature (1)..( 7): Result.002 file - promoters60/1387211
ctggata

SEQ ID NO: 109295 - DNA, 7 bp, Unknown
  misc_feature (1)..( 7): Result.002 file - promoters60/1387211
ctgaata

SEQ ID NO: 109296 - DNA, 6 bp, Unknown
  misc_feature (1)..( 6): Result.002 file - promoters60/1387211
aaaaaa

SEQ ID NO: 109297 - DNA, 6 bp, Unknown
  misc_feature (1)..( 6): Result.002 file - promoters60/1387211
aaaaaa

SEQ ID NO: 109298 - DNA, 7 bp, Unknown
  misc_feature (1)..( 7): Result.002 file - promoters60/1387211
aaattat

SEQ ID NO: 109299 - DNA, 7 bp, Unknown
  misc_feature (1)..( 7): Result.002 file - promoters60/1387211
aaaatat

SEQ ID NO: 109300 - DNA, 9 bp, Unknown
  misc_feature (1)..( 9): Result.002 file - promoters60/1387211
aagtcaaaa

SEQ ID NO: 109301 - DNA, 9 bp, Unknown
  misc_feature (1)..( 9): Result.002 file - promoters60/1387211
aagacaaaa

SEQ ID NO: 109302 - DNA, 9 bp, Unknown
  misc_feature (1)..( 9): Result.002 file - promoters60/1387211
ctctctgtt

SEQ ID NO: 109303 - DNA, 9 bp, Unknown
  misc_feature (1)..( 9): Result.002 file - promoters60/1387211
ctctttgtt

SEQ ID NO: 109304 - DNA, 9 bp, Unknown
  misc_feature (1)..( 9): Result.002 file - promoters60/1387211
aattcaact

SEQ ID NO: 109305 - DNA, 9 bp, Unknown
  misc_feature (1)..( 9): Result.002 file - promoters60/1387211
aattaaact

SEQ ID NO: 109306 - DNA, 7 bp, Unknown
  misc_feature (1)..( 7): Result.002 file - promoters60/1387211
attttat

SEQ ID NO: 109307 - DNA, 7 bp, Unknown
  misc_feature (1)..( 7): Result.002 file - promoters60/1387211
attatat

SEQ ID NO: 109308 - DNA, 7 bp, Unknown
  misc_feature (1)..( 7): Result.002 file - promoters60/1387211
attttca

SEQ ID NO: 109309 - DNA, 7 bp, Unknown
  misc_feature (1)..( 7): Result.002 file - promoters60/1387211
attttca

SEQ ID NO: 109310 - DNA, 6 bp, Unknown
  misc_feature (1)..( 6): Result.002 file - promoters60/1387211
tcaatt

SEQ ID NO: 109311 - DNA, 6 bp, Unknown
  misc_feature (1)..( 6): Result.002 file - promoters60/1387211
tcaatt

SEQ ID NO: 109312 - DNA, 9 bp, Unknown
  misc_feature (1)..( 9): Result.002 file - promoters60/1387211
aaaatgaaa

SEQ ID NO: 109313 - DNA, 9 bp, Unknown
  misc_feature (1)..( 9): Result.002 file - promoters60/1387211
aaaaagaaa

SEQ ID NO: 109314 - DNA, 13 bp, Unknown
  misc_feature (1)..( 13): Result.002 file - promoters60/1387349
atttccatcgaat

SEQ ID NO: 109315 - DNA, 13 bp, Unknown
  misc_feature (1)..( 13): Result.002 file - promoters60/1387349
aaacaaatcaaat

SEQ ID NO: 109316 - DNA, 13 bp, Unknown
  misc_feature (1)..( 13): Result.002 file - promoters60/1387349
aaagaaaccaatt

SEQ ID NO: 109317 - DNA, 13 bp, Unknown
  misc_feature (1)..( 13): Result.002 file - promoters60/1387349
tatcaaaccaatg

SEQ ID NO: 109318 - DNA, 13 bp, Unknown
  misc_feature (1)..( 13): Result.002 file - promoters60/1387349
tcagaaacagtaa

SEQ ID NO: 109319 - DNA, 13 bp, Unknown
  misc_feature (1)..( 13): Result.002 file - promoters60/1387349
tcacaaagactaa

SEQ ID NO: 109320 - DNA, 10 bp, Unknown
  misc_feature (1)..( 10): Result.002 file - promoters60/1387349
ccacaaaaca

SEQ ID NO: 109321 - DNA, 10 bp, Unknown
  misc_feature (1)..( 10): Result.002 file - promoters60/1387349
acacaaagta

SEQ ID NO: 109322 - DNA, 10 bp, Unknown
  misc_feature (1)..( 10): Result.002 file - promoters60/1387349
tcacaaagac

SEQ ID NO: 109323 - DNA, 10 bp, Unknown
  misc_feature (1)..( 10): Result.002 file - promoters60/1387349
aaacaaaaac

SEQ ID NO: 109324 - DNA, 10 bp, Unknown
  misc_feature (1)..( 10): Result.002 file - promoters60/1387349
ctaaaaactc

SEQ ID NO: 109325 - DNA, 10 bp, Unknown
  misc_feature (1)..( 10): Result.002 file - promoters60/1387349
ctagaaaccg

SEQ ID NO: 109326 - DNA, 9 bp, Unknown
  misc_feature (1)..( 9): Result.002 file - promoters60/1387349
tcatagata

SEQ ID NO: 109327 - DNA, 9 bp, Unknown
  misc_feature (1)..( 9): Result.002 file - promoters60/1387349
tcaaagaat

SEQ ID NO: 109328 - DNA, 9 bp, Unknown
  misc_feature (1)..( 9): Result.002 file - promoters60/1387349
acaaagact

SEQ ID NO: 109329 - DNA, 9 bp, Unknown
  misc_feature (1)..( 9): Result.002 file - promoters60/1387349
tcaaaggtc

SEQ ID NO: 109330 - DNA, 9 bp, Unknown
  misc_feature (1)..( 9): Result.002 file - promoters60/1387349
taaaataat

SEQ ID NO: 109331 - DNA, 9 bp, Unknown
  misc_feature (1)..( 9): Result.002 file - promoters60/1387349
gcaatggtt

SEQ ID NO: 109332 - DNA, 12 bp, Unknown
  misc_feature (1)..( 12): Result.002 file - promoters60/1387349
tatgtaatgaat

SEQ ID NO: 109333 - DNA, 12 bp, Unknown
  misc_feature (1)..( 12): Result.002 file - promoters60/1387349
aatgtactgaaa

SEQ ID NO: 109334 - DNA, 13 bp, Unknown
  misc_feature (1)..( 13): Result.002 file - promoters60/1387349
gaagaaactgaaa

SEQ ID NO: 109335 - DNA, 12 bp, Unknown
  misc_feature (1)..( 12): Result.002 file - promoters60/1387349
aatgtacttatc

SEQ ID NO: 109336 - DNA, 12 bp, Unknown
  misc_feature (1)..( 12): Result.002 file - promoters60/1387349
attaaattgaac

SEQ ID NO: 109337 - DNA, 13 bp, Unknown
  misc_feature (1)..( 13): Result.002 file - promoters60/1387349
tcagaatctgatg

SEQ ID NO: 109338 - DNA, 6 bp, Unknown
  misc_feature (1)..( 6): Result.002 file - promoters60/1387356
agttta

SEQ ID NO: 109339 - DNA, 6 bp, Unknown
  misc_feature (1)..( 6): Result.002 file - promoters60/1387356
agttta

SEQ ID NO: 109340 - DNA, 7 bp, Unknown
  misc_feature (1)..( 7): Result.002 file - promoters60/1387356
aaaagtt

SEQ ID NO: 109341 - DNA, 7 bp, Unknown
  misc_feature (1)..( 7): Result.002 file - promoters60/1387356
aaaagtt

SEQ ID NO: 109342 - DNA, 6 bp, Unknown
  misc_feature (1)..( 6): Result.002 file - promoters60/1387356
ttaaaa

SEQ ID NO: 109343 - DNA, 6 bp, Unknown
  misc_feature (1)..( 6): Result.002 file - promoters60/1387356
ttaaaa

SEQ ID NO: 109344 - DNA, 6 bp, Unknown
  misc_feature (1)..( 6): Result.002 file - promoters60/1387356
ttaaaa

SEQ ID NO: 109345 - DNA, 6 bp, Unknown
  misc_feature (1)..( 6): Result.002 file - promoters60/1387356
caaaag

SEQ ID NO: 109346 - DNA, 6 bp, Unknown
  misc_feature (1)..( 6): Result.002 file - promoters60/1387356
caaaag

SEQ ID NO: 109347 - DNA, 9 bp, Unknown
  misc_feature (1)..( 9): Result.002 file - promoters60/1387356
aaacctctt

SEQ ID NO: 109348 - DNA, 9 bp, Unknown
  misc_feature (1)..( 9): Result.002 file - promoters60/1387356
aaacatctt

SEQ ID NO: 109349 - DNA, 6 bp, Unknown
  misc_feature (1)..( 6): Result.002 file - promoters60/1387356
caataa

SEQ ID NO: 109350 - DNA, 6 bp, Unknown
  misc_feature (1)..( 6): Result.002 file - promoters60/1387356
caataa

SEQ ID NO: 109351 - DNA, 6 bp, Unknown
  misc_feature (1)..( 6): Result.002 file - promoters60/1387356
gatttt

SEQ ID NO: 109352 - DNA, 6 bp, Unknown
  misc_feature (1)..( 6): Result.002 file - promoters60/1387356
gatttt

SEQ ID NO: 109353 - DNA, 6 bp, Unknown
  misc_feature (1)..( 6): Result.002 file - promoters60/1387356
acacgt

SEQ ID NO: 109354 - DNA, 6 bp, Unknown
  misc_feature (1)..( 6): Result.002 file - promoters60/1387356
acacgt

SEQ ID NO: 109355 - DNA, 11 bp, Unknown
  misc_feature (1)..( 11): Result.002 file - promoters60/1387356
catgtaaaaat

SEQ ID NO: 109356 - DNA, 11 bp, Unknown
  misc_feature (1)..( 11): Result.002 file - promoters60/1387356
aaactaagaat

SEQ ID NO: 109357 - DNA, 11 bp, Unknown
  misc_feature (1)..( 11): Result.002 file - promoters60/1387356
agagtaaaaaa

SEQ ID NO: 109358 - DNA, 6 bp, Unknown
  misc_feature (1)..( 6): Result.002 file - promoters60/1387356
aatgta

SEQ ID NO: 109359 - DNA, 6 bp, Unknown
  misc_feature (1)..( 6): Result.002 file - promoters60/1387356
aatgta

SEQ ID NO: 109360 - DNA, 7 bp, Unknown
  misc_feature (1)..( 7): Result.002 file - promoters60/1387356
catttaa

SEQ ID NO: 109361 - DNA, 7 bp, Unknown
  misc_feature (1)..( 7): Result.002 file - promoters60/1387356
catttaa

SEQ ID NO: 109362 - DNA, 10 bp, Unknown
  misc_feature (1)..( 10): Result.002 file - promoters60/1387356
taaagatttt

SEQ ID NO: 109363 - DNA, 10 bp, Unknown
  misc_feature (1)..( 10): Result.002 file - promoters60/1387356
taaaaatttt

SEQ ID NO: 109364 - DNA, 6 bp, Unknown
  misc_feature (1)..( 6): Result.002 file - promoters60/1387356
ataatt

SEQ ID NO: 109365 - DNA, 6 bp, Unknown
  misc_feature (1)..( 6): Result.002 file - promoters60/1387356
ataatt

SEQ ID NO: 109366 - DNA, 6 bp, Unknown
  misc_feature (1)..( 6): Result.002 file - promoters60/1387356
atacaa

SEQ ID NO: 109367 - DNA, 6 bp, Unknown
  misc_feature (1)..( 6): Result.002 file - promoters60/1387356
atacaa

SEQ ID NO: 109368 - DNA, 6 bp, Unknown
  misc_feature (1)..( 6): Result.002 file - promoters60/1387356
atattt

SEQ ID NO: 109369 - DNA, 6 bp, Unknown
  misc_feature (1)..( 6): Result.002 file - promoters60/1387356
atattt

SEQ ID NO: 109370 - DNA, 13 bp, Unknown
  misc_feature (1)..( 13): Result.002 file - promoters60/1387356
aaagatagacaga

SEQ ID NO: 109371 - DNA, 13 bp, Unknown
  misc_feature (1)..( 13): Result.002 file - promoters60/1387356
aaagaaagaaaga

SEQ ID NO: 109372 - DNA, 7 bp, Unknown
  misc_feature (1)..( 7): Result.002 file - promoters60/1387356
ttataaa

SEQ ID NO: 109373 - DNA, 7 bp, Unknown
  misc_feature (1)..( 7): Result.002 file - promoters60/1387356
ttataaa

SEQ ID NO: 109374 - DNA, 8 bp, Unknown
  misc_feature (1)..( 8): Result.002 file - promoters60/1387417
ctttactg

SEQ ID NO: 109375 - DNA, 8 bp, Unknown
  misc_feature (1)..( 8): Result.002 file - promoters60/1387417
attttctg

SEQ ID NO: 109376 - DNA, 8 bp, Unknown
  misc_feature (1)..( 8): Result.002 file - promoters60/1387417
attttcaa

SEQ ID NO: 109377 - DNA, 7 bp, Unknown
  misc_feature (1)..( 7): Result.002 file - promoters60/1387417
ttcttat

SEQ ID NO: 109378 - DNA, 7 bp, Unknown
  misc_feature (1)..( 7): Result.002 file - promoters60/1387417
ttcatat

SEQ ID NO: 109379 - DNA, 7 bp, Unknown
  misc_feature (1)..( 7): Result.002 file - promoters60/1387417
ttcttac

SEQ ID NO: 109380 - DNA, 9 bp, Unknown
  misc_feature (1)..( 9): Result.002 file - promoters60/1387417
catgatttc

SEQ ID NO: 109381 - DNA, 9 bp, Unknown
  misc_feature (1)..( 9): Result.002 file - promoters60/1387417
aatgttttc

SEQ ID NO: 109382 - DNA, 9 bp, Unknown
  misc_feature (1)..( 9): Result.002 file - promoters60/1387417
aatgctttg

SEQ ID NO: 109383 - DNA, 8 bp, Unknown
  misc_feature (1)..( 8): Result.002 file - promoters60/1387417
aatgatcg

SEQ ID NO: 109384 - DNA, 8 bp, Unknown
  misc_feature (1)..( 8): Result.002 file - promoters60/1387417
tgtgatcg

SEQ ID NO: 109385 - DNA, 8 bp, Unknown
  misc_feature (1)..( 8): Result.002 file - promoters60/1387417
tgtaatcg

SEQ ID NO: 109386 - DNA, 9 bp, Unknown
  misc_feature (1)..( 9): Result.002 file - promoters60/1387417
ttttgctaa

SEQ ID NO: 109387 - DNA, 9 bp, Unknown
  misc_feature (1)..( 9): Result.002 file - promoters60/1387417
ttttgcttc

SEQ ID NO: 109388 - DNA, 9 bp, Unknown
  misc_feature (1)..( 9): Result.002 file - promoters60/1387417
atttggtaa

SEQ ID NO: 109389 - DNA, 8 bp, Unknown
  misc_feature (1)..( 8): Result.002 file - promoters60/1387429
gttctatt

SEQ ID NO: 109390 - DNA, 8 bp, Unknown
  misc_feature (1)..( 8): Result.002 file - promoters60/1387429
gttttatt

SEQ ID NO: 109391 - DNA, 7 bp, Unknown
  misc_feature (1)..( 7): Result.002 file - promoters60/1387429
cctggtt

SEQ ID NO: 109392 - DNA, 7 bp, Unknown
  misc_feature (1)..( 7): Result.002 file - promoters60/1387429
cctagtt

SEQ ID NO: 109393 - DNA, 8 bp, Unknown
  misc_feature (1)..( 8): Result.002 file - promoters60/1387429
caaattat

SEQ ID NO: 109394 - DNA, 8 bp, Unknown
  misc_feature (1)..( 8): Result.002 file - promoters60/1387429
caatttat

SEQ ID NO: 109395 - DNA, 8 bp, Unknown
  misc_feature (1)..( 8): Result.002 file - promoters60/1387429
gaaattag

SEQ ID NO: 109396 - DNA, 7 bp, Unknown
  misc_feature (1)..( 7): Result.002 file - promoters60/1387429
acttaat

SEQ ID NO: 109397 - DNA, 7 bp, Unknown
  misc_feature (1)..( 7): Result.002 file - promoters60/1387429
actcaat

SEQ ID NO: 109398 - DNA, 8 bp, Unknown
  misc_feature (1)..( 8): Result.002 file - promoters60/1387429
tgtaactt

SEQ ID NO: 109399 - DNA, 8 bp, Unknown
  misc_feature (1)..( 8): Result.002 file - promoters60/1387429
tgttactt

SEQ ID NO: 109400 - DNA, 9 bp, Unknown
  misc_feature (1)..( 9): Result.002 file - promoters60/1387429
aataatttc

SEQ ID NO: 109401 - DNA, 9 bp, Unknown
  misc_feature (1)..( 9): Result.002 file - promoters60/1387429
aatgatttg

SEQ ID NO: 109402 - DNA, 9 bp, Unknown
  misc_feature (1)..( 9): Result.002 file - promoters60/1387429
cttgaattg

SEQ ID NO: 109403 - DNA, 6 bp, Unknown
  misc_feature (1)..( 6): Result.002 file - promoters60/1387429
aaaatt

SEQ ID NO: 109404 - DNA, 6 bp, Unknown
  misc_feature (1)..( 6): Result.002 file - promoters60/1387429
aaaatt

SEQ ID NO: 109405 - DNA, 10 bp, Unknown
  misc_feature (1)..( 10): Result.002 file - promoters60/1387429
taaaattaaa

SEQ ID NO: 109406 - DNA, 10 bp, Unknown
  misc_feature (1)..( 10): Result.002 file - promoters60/1387429
taatattaaa

SEQ ID NO: 109407 - DNA, 10 bp, Unknown
  misc_feature (1)..( 10): Result.002 file - promoters60/1387429
gaatattttt

SEQ ID NO: 109408 - DNA, 8 bp, Unknown
  misc_feature (1)..( 8): Result.002 file - promoters60/1387429
aaaagcct

SEQ ID NO: 109409 - DNA, 8 bp, Unknown
  misc_feature (1)..( 8): Result.002 file - promoters60/1387429
aaaaacct

SEQ ID NO: 109410 - DNA, 7 bp, Unknown
  misc_feature (1)..( 7): Result.002 file - promoters60/1387429
aaattgg

SEQ ID NO: 109411 - DNA, 7 bp, Unknown
  misc_feature (1)..( 7): Result.002 file - promoters60/1387429
aaattgg

SEQ ID NO: 109412 - DNA, 7 bp, Unknown
  misc_feature (1)..( 7): Result.002 file - promoters60/1387429
tagtaaa

SEQ ID NO: 109413 - DNA, 7 bp, Unknown
  misc_feature (1)..( 7): Result.002 file - promoters60/1387429
tagaaaa

SEQ ID NO: 109414 - DNA, 7 bp, Unknown
  misc_feature (1)..( 7): Result.002 file - promoters60/1387429
accgcca

SEQ ID NO: 109415 - DNA, 7 bp, Unknown
  misc_feature (1)..( 7): Result.002 file - promoters60/1387429
accgcca

SEQ ID NO: 109416 - DNA, 6 bp, Unknown
  misc_feature (1)..( 6): Result.002 file - promoters60/1387429
cataaa

SEQ ID NO: 109417 - DNA, 6 bp, Unknown
  misc_feature (1)..( 6): Result.002 file - promoters60/1387429
cataaa

SEQ ID NO: 109418 - DNA, 8 bp, Unknown
  misc_feature (1)..( 8): Result.002 file - promoters60/1387429
agtaagaa

SEQ ID NO: 109419 - DNA, 8 bp, Unknown
  misc_feature (1)..( 8): Result.002 file - promoters60/1387429
agtaagaa

SEQ ID NO: 109420 - DNA, 6 bp, Unknown
  misc_feature (1)..( 6): Result.002 file - promoters60/1387429
taagag

SEQ ID NO: 109421 - DNA, 6 bp, Unknown
  misc_feature (1)..( 6): Result.002 file - promoters60/1387429
taagag

SEQ ID NO: 109422 - DNA, 7 bp, Unknown
  misc_feature (1)..( 7): Result.002 file - promoters60/1387429
taatttc

SEQ ID NO: 109423 - DNA, 7 bp, Unknown
  misc_feature (1)..( 7): Result.002 file - promoters60/1387429
taaattc

SEQ ID NO: 109424 - DNA, 9 bp, Unknown
  misc_feature (1)..( 9): Result.002 file - promoters60/1387429
cgattgaat

SEQ ID NO: 109425 - DNA, 9 bp, Unknown
  misc_feature (1)..( 9): Result.002 file - promoters60/1387429
cgattaaat

SEQ ID NO: 109426 - DNA, 9 bp, Unknown
  misc_feature (1)..( 9): Result.002 file - promoters60/1387429
aattttcga

SEQ ID NO: 109427 - DNA, 9 bp, Unknown
  misc_feature (1)..( 9): Result.002 file - promoters60/1387429
aatttgcga

SEQ ID NO: 109428 - DNA, 7 bp, Unknown
  misc_feature (1)..( 7): Result.002 file - promoters60/1387429
tttggaa

SEQ ID NO: 109429 - DNA, 7 bp, Unknown
  misc_feature (1)..( 7): Result.002 file - promoters60/1387429
tttagaa

SEQ ID NO: 109430 - DNA, 8 bp, Unknown
  misc_feature (1)..( 8): Result.002 file - promoters60/1387429
attttaat

SEQ ID NO: 109431 - DNA, 8 bp, Unknown
  misc_feature (1)..( 8): Result.002 file - promoters60/1387429
atttaaat

SEQ ID NO: 109432 - DNA, 12 bp, Unknown
  misc_feature (1)..( 12): Result.002 file - promoters60/1387429
tgaaatatttaa

SEQ ID NO: 109433 - DNA, 12 bp, Unknown
  misc_feature (1)..( 12): Result.002 file - promoters60/1387429
tgaaatagttaa

SEQ ID NO: 109434 - DNA, 12 bp, Unknown
  misc_feature (1)..( 12): Result.002 file - promoters60/1387429
gaaaatagaaga

SEQ ID NO: 109435 - DNA, 6 bp, Unknown
  misc_feature (1)..( 6): Result.002 file - promoters60/1387429
caactt

SEQ ID NO: 109436 - DNA, 6 bp, Unknown
  misc_feature (1)..( 6): Result.002 file - promoters60/1387429
caactt

SEQ ID NO: 109437 - DNA, 7 bp, Unknown
  misc_feature (1)..( 7): Result.002 file - promoters60/1387429
agattgg

SEQ ID NO: 109438 - DNA, 7 bp, Unknown
  misc_feature (1)..( 7): Result.002 file - promoters60/1387429
agattgg

SEQ ID NO: 109439 - DNA, 7 bp, Unknown
  misc_feature (1)..( 7): Result.002 file - promoters60/1387429
ttttctt

SEQ ID NO: 109440 - DNA, 7 bp, Unknown
  misc_feature (1)..( 7): Result.002 file - promoters60/1387429
ttttctt

SEQ ID NO: 109441 - DNA, 6 bp, Unknown
  misc_feature (1)..( 6): Result.002 file - promoters60/1387429
aatgga

SEQ ID NO: 109442 - DNA, 6 bp, Unknown
  misc_feature (1)..( 6): Result.002 file - promoters60/1387429
aatgga

SEQ ID NO: 109443 - DNA, 8 bp, Unknown
  misc_feature (1)..( 8): Result.002 file - promoters60/1387429
gaaattag

SEQ ID NO: 109444 - DNA, 8 bp, Unknown
  misc_feature (1)..( 8): Result.002 file - promoters60/1387429
gaatttag

SEQ ID NO: 109445 - DNA, 6 bp, Unknown
  misc_feature (1)..( 6): Result.002 file - promoters60/1387429
aaaaat

SEQ ID NO: 109446 - DNA, 6 bp, Unknown
  misc_feature (1)..( 6): Result.002 file - promoters60/1387429
aaaaat

SEQ ID NO: 109447 - DNA, 6 bp, Unknown
  misc_feature (1)..( 6): Result.002 file - promoters60/1387429
atttta

SEQ ID NO: 109448 - DNA, 6 bp, Unknown
  misc_feature (1)..( 6): Result.002 file - promoters60/1387429
atttta

SEQ ID NO: 109449 - DNA, 13 bp, Unknown
  misc_feature (1)..( 13): Result.002 file - promoters60/1387449
taaactcttttga

SEQ ID NO: 109450 - DNA, 13 bp, Unknown
  misc_feature (1)..( 13): Result.002 file - promoters60/1387449
tttactatttata

SEQ ID NO: 109451 - DNA, 13 bp, Unknown
  misc_feature (1)..( 13): Result.002 file - promoters60/1387449
tttaatatatatt

SEQ ID NO: 109452 - DNA, 13 bp, Unknown
  misc_feature (1)..( 13): Result.002 file - promoters60/1387449
tgggctttttaac

SEQ ID NO: 109453 - DNA, 13 bp, Unknown
  misc_feature (1)..( 13): Result.002 file - promoters60/1387449
tatccttttcaat

SEQ ID NO: 109454 - DNA, 13 bp, Unknown
  misc_feature (1)..( 13): Result.002 file - promoters60/1387449
gatattatttttt

SEQ ID NO: 109455 - DNA, 13 bp, Unknown
  misc_feature (1)..( 13): Result.002 file - promoters60/1387449
taatttttttcta

SEQ ID NO: 109456 - DNA, 13 bp, Unknown
  misc_feature (1)..( 13): Result.002 file - promoters60/1387449
taatgtttttcta

SEQ ID NO: 109457 - DNA, 13 bp, Unknown
  misc_feature (1)..( 13): Result.002 file - promoters60/1387449
cttggtttttcta

SEQ ID NO: 109458 - DNA, 13 bp, Unknown
  misc_feature (1)..( 13): Result.002 file - promoters60/1387449
taatcttttgggg

SEQ ID NO: 109459 - DNA, 13 bp, Unknown
  misc_feature (1)..( 13): Result.002 file - promoters60/1387449
ttattttttgttc

SEQ ID NO: 109460 - DNA, 13 bp, Unknown
  misc_feature (1)..( 13): Result.002 file - promoters60/1387449
atatatttaaata

SEQ ID NO: 109461 - DNA, 6 bp, Unknown
  misc_feature (1)..( 6): Result.002 file - promoters60/1387524
ttgtgg

SEQ ID NO: 109462 - DNA, 6 bp, Unknown
  misc_feature (1)..( 6): Result.002 file - promoters60/1387524
ttgtgg

SEQ ID NO: 109463 - DNA, 14 bp, Unknown
  misc_feature (1)..( 14): Result.002 file - promoters60/1387524
cttttttcttctaa

SEQ ID NO: 109464 - DNA, 14 bp, Unknown
  misc_feature (1)..( 14): Result.002 file - promoters60/1387524
ctttattcttctaa

SEQ ID NO: 109465 - DNA, 8 bp, Unknown
  misc_feature (1)..( 8): Result.002 file - promoters60/1387524
tgtgccta

SEQ ID NO: 109466 - DNA, 8 bp, Unknown
  misc_feature (1)..( 8): Result.002 file - promoters60/1387524
tgttccta

SEQ ID NO: 109467 - DNA, 8 bp, Unknown
  misc_feature (1)..( 8): Result.002 file - promoters60/1387524
agaaaaca

SEQ ID NO: 109468 - DNA, 8 bp, Unknown
  misc_feature (1)..( 8): Result.002 file - promoters60/1387524
ggaaaacc

SEQ ID NO: 109469 - DNA, 8 bp, Unknown
  misc_feature (1)..( 8): Result.002 file - promoters60/1387524
agaaaaaa

SEQ ID NO: 109470 - DNA, 6 bp, Unknown
  misc_feature (1)..( 6): Result.002 file - promoters60/1387524
gtaaaa

SEQ ID NO: 109471 - DNA, 6 bp, Unknown
  misc_feature (1)..( 6): Result.002 file - promoters60/1387524
gtaaaa

SEQ ID NO: 109472 - DNA, 7 bp, Unknown
  misc_feature (1)..( 7): Result.002 file - promoters60/1387524
aaataga

SEQ ID NO: 109473 - DNA, 7 bp, Unknown
  misc_feature (1)..( 7): Result.002 file - promoters60/1387524
aaaaaga

SEQ ID NO: 109474 - DNA, 10 bp, Unknown
  misc_feature (1)..( 10): Result.002 file - promoters60/1387524
agggataaaa

SEQ ID NO: 109475 - DNA, 10 bp, Unknown
  misc_feature (1)..( 10): Result.002 file - promoters60/1387524
aggggtaaaa

SEQ ID NO: 109476 - DNA, 10 bp, Unknown
  misc_feature (1)..( 10): Result.002 file - promoters60/1387524
attaataaaa

SEQ ID NO: 109477 - DNA, 7 bp, Unknown
  misc_feature (1)..( 7): Result.002 file - promoters60/1387524
tggccct

SEQ ID NO: 109478 - DNA, 7 bp, Unknown
  misc_feature (1)..( 7): Result.002 file - promoters60/1387524
tgggcct

SEQ ID NO: 109479 - DNA, 6 bp, Unknown
  misc_feature (1)..( 6): Result.002 file - promoters60/1387524
gtcctt

SEQ ID NO: 109480 - DNA, 6 bp, Unknown
  misc_feature (1)..( 6): Result.002 file - promoters60/1387524
gtcctt

SEQ ID NO: 109481 - DNA, 8 bp, Unknown
  misc_feature (1)..( 8): Result.002 file - promoters60/1387524
ttatgtat

SEQ ID NO: 109482 - DNA, 8 bp, Unknown
  misc_feature (1)..( 8): Result.002 file - promoters60/1387524
ttatctat

SEQ ID NO: 109483 - DNA, 6 bp, Unknown
  misc_feature (1)..( 6): Result.002 file - promoters60/1387524
gaaccc

SEQ ID NO: 109484 - DNA, 6 bp, Unknown
  misc_feature (1)..( 6): Result.002 file - promoters60/1387524
gaaccc

SEQ ID NO: 109485 - DNA, 8 bp, Unknown
  misc_feature (1)..( 8): Result.002 file - promoters60/1387524
gtctaaat

SEQ ID NO: 109486 - DNA, 8 bp, Unknown
  misc_feature (1)..( 8): Result.002 file - promoters60/1387524
gtctaaat

SEQ ID NO: 109487 - DNA, 6 bp, Unknown
  misc_feature (1)..( 6): Result.002 file - promoters60/1387524
agtaaa

SEQ ID NO: 109488 - DNA, 6 bp, Unknown
  misc_feature (1)..( 6): Result.002 file - promoters60/1387524
agtaaa

SEQ ID NO: 109489 - DNA, 7 bp, Unknown
  misc_feature (1)..( 7): Result.002 file - promoters60/1387524
aatcggg

SEQ ID NO: 109490 - DNA, 7 bp, Unknown
  misc_feature (1)..( 7): Result.002 file - promoters60/1387524
aattggg

SEQ ID NO: 109491 - DNA, 8 bp, Unknown
  misc_feature (1)..( 8): Result.002 file - promoters60/1387524
gaaagaaa

SEQ ID NO: 109492 - DNA, 8 bp, Unknown
  misc_feature (1)..( 8): Result.002 file - promoters60/1387524
gaaacaaa

SEQ ID NO: 109493 - DNA, 10 bp, Unknown
  misc_feature (1)..( 10): Result.002 file - promoters60/1387524
ggaaaagaaa

SEQ ID NO: 109494 - DNA, 10 bp, Unknown
  misc_feature (1)..( 10): Result.002 file - promoters60/1387524
ggaaatgaaa

SEQ ID NO: 109495 - DNA, 7 bp, Unknown
  misc_feature (1)..( 7): Result.002 file - promoters60/1387524
cccacta

SEQ ID NO: 109496 - DNA, 7 bp, Unknown
  misc_feature (1)..( 7): Result.002 file - promoters60/1387524
cccacta

SEQ ID NO: 109497 - DNA, 9 bp, Unknown
  misc_feature (1)..( 9): Result.002 file - promoters60/1387524
aaagaaaag

SEQ ID NO: 109498 - DNA, 9 bp, Unknown
  misc_feature (1)..( 9): Result.002 file - promoters60/1387524
aaagtaaag

SEQ ID NO: 109499 - DNA, 7 bp, Unknown
  misc_feature (1)..( 7): Result.002 file - promoters60/1387524
gtatata

SEQ ID NO: 109500 - DNA, 7 bp, Unknown
  misc_feature (1)..( 7): Result.002 file - promoters60/1387524
gtatata

SEQ ID NO: 109501 - DNA, 9 bp, Unknown
  misc_feature (1)..( 9): Result.002 file - promoters60/1387601
tatttaatg

SEQ ID NO: 109502 - DNA, 9 bp, Unknown
  misc_feature (1)..( 9): Result.002 file - promoters60/1387601
ggtttgatg

SEQ ID NO: 109503 - DNA, 9 bp, Unknown
  misc_feature (1)..( 9): Result.002 file - promoters60/1387601
ggtgtgatt

SEQ ID NO: 109504 - DNA, 11 bp, Unknown
  misc_feature (1)..( 11): Result.002 file - promoters60/1387601
tccaaacagag

SEQ ID NO: 109505 - DNA, 11 bp, Unknown
  misc_feature (1)..( 11): Result.002 file - promoters60/1387601
tccaaacagat

SEQ ID NO: 109506 - DNA, 11 bp, Unknown
  misc_feature (1)..( 11): Result.002 file - promoters60/1387601
ttaaaaaagag

SEQ ID NO: 109507 - DNA, 9 bp, Unknown
  misc_feature (1)..( 9): Result.002 file - promoters60/1387616
aaaaataaa

SEQ ID NO: 109508 - DNA, 9 bp, Unknown
  misc_feature (1)..( 9): Result.002 file - promoters60/1387616
aaacatata

SEQ ID NO: 109509 - DNA, 9 bp, Unknown
  misc_feature (1)..( 9): Result.002 file - promoters60/1387616
aaaattaat

SEQ ID NO: 109510 - DNA, 9 bp, Unknown
  misc_feature (1)..( 9): Result.002 file - promoters60/1387616
aaagaaaga

SEQ ID NO: 109511 - DNA, 10 bp, Unknown
  misc_feature (1)..( 10): Result.002 file - promoters60/1387616
ataaaataca

SEQ ID NO: 109512 - DNA, 10 bp, Unknown
  misc_feature (1)..( 10): Result.002 file - promoters60/1387616
agataatatt

SEQ ID NO: 109513 - DNA, 10 bp, Unknown
  misc_feature (1)..( 10): Result.002 file - promoters60/1387616
aataaatctt

SEQ ID NO: 109514 - DNA, 10 bp, Unknown
  misc_feature (1)..( 10): Result.002 file - promoters60/1387616
caatattatt

SEQ ID NO: 109515 - DNA, 11 bp, Unknown
  misc_feature (1)..( 11): Result.002 file - promoters60/1387616
aataaataaaa

SEQ ID NO: 109516 - DNA, 11 bp, Unknown
  misc_feature (1)..( 11): Result.002 file - promoters60/1387616
tttaattaaac

SEQ ID NO: 109517 - DNA, 11 bp, Unknown
  misc_feature (1)..( 11): Result.002 file - promoters60/1387616
aaacaataaaa

SEQ ID NO: 109518 - DNA, 11 bp, Unknown
  misc_feature (1)..( 11): Result.002 file - promoters60/1387616
gagaaagaaag

SEQ ID NO: 109519 - DNA, 11 bp, Unknown
  misc_feature (1)..( 11): Result.002 file - promoters60/1387616
acattataaaa

SEQ ID NO: 109520 - DNA, 11 bp, Unknown
  misc_feature (1)..( 11): Result.002 file - promoters60/1387616
tccgaataaat

SEQ ID NO: 109521 - DNA, 11 bp, Unknown
  misc_feature (1)..( 11): Result.002 file - promoters60/1387616
tttcatttcca

SEQ ID NO: 109522 - DNA, 10 bp, Unknown
  misc_feature (1)..( 10): Result.002 file - promoters60/1387616
atattattag

SEQ ID NO: 109523 - DNA, 10 bp, Unknown
  misc_feature (1)..( 10): Result.002 file - promoters60/1387616
atattaataa

SEQ ID NO: 109524 - DNA, 10 bp, Unknown
  misc_feature (1)..( 10): Result.002 file - promoters60/1387616
atattattag

SEQ ID NO: 109525 - DNA, 10 bp, Unknown
  misc_feature (1)..( 10): Result.002 file - promoters60/1387616
ttattatatt

SEQ ID NO: 109526 - DNA, 10 bp, Unknown
  misc_feature (1)..( 10): Result.002 file - promoters60/1387616
atataattat

SEQ ID NO: 109527 - DNA, 10 bp, Unknown
  misc_feature (1)..( 10): Result.002 file - promoters60/1387616
atattattaa

SEQ ID NO: 109528 - DNA, 10 bp, Unknown
  misc_feature (1)..( 10): Result.002 file - promoters60/1387616
atacaatgaa

SEQ ID NO: 109529 - DNA, 9 bp, Unknown
  misc_feature (1)..( 9): Result.002 file - promoters60/1387616
aattaaaat

SEQ ID NO: 109530 - DNA, 9 bp, Unknown
  misc_feature (1)..( 9): Result.002 file - promoters60/1387616
aatgaaaaa

SEQ ID NO: 109531 - DNA, 9 bp, Unknown
  misc_feature (1)..( 9): Result.002 file - promoters60/1387616
cgttaaaaa

SEQ ID NO: 109532 - DNA, 9 bp, Unknown
  misc_feature (1)..( 9): Result.002 file - promoters60/1387616
aataaaaaa

SEQ ID NO: 109533 - DNA, 9 bp, Unknown
  misc_feature (1)..( 9): Result.002 file - promoters60/1387616
gatgaaacc

SEQ ID NO: 109534 - DNA, 9 bp, Unknown
  misc_feature (1)..( 9): Result.002 file - promoters60/1387616
cagaaaaaa

SEQ ID NO: 109535 - DNA, 12 bp, Unknown
  misc_feature (1)..( 12): Result.002 file - promoters60/1387616
aaaatattaacc

SEQ ID NO: 109536 - DNA, 12 bp, Unknown
  misc_feature (1)..( 12): Result.002 file - promoters60/1387616
taaaaattaaat

SEQ ID NO: 109537 - DNA, 12 bp, Unknown
  misc_feature (1)..( 12): Result.002 file - promoters60/1387616
gtaaaatttcat

SEQ ID NO: 109538 - DNA, 12 bp, Unknown
  misc_feature (1)..( 12): Result.002 file - promoters60/1387616
gtaaaattccca

SEQ ID NO: 109539 - DNA, 12 bp, Unknown
  misc_feature (1)..( 12): Result.002 file - promoters60/1387616
taacaattctaa

SEQ ID NO: 109540 - DNA, 12 bp, Unknown
  misc_feature (1)..( 12): Result.002 file - promoters60/1387616
gaatgattaaat

SEQ ID NO: 109541 - DNA, 10 bp, Unknown
  misc_feature (1)..( 10): Result.002 file - promoters60/1387616
aaataaataa

SEQ ID NO: 109542 - DNA, 10 bp, Unknown
  misc_feature (1)..( 10): Result.002 file - promoters60/1387616
caataaaatt

SEQ ID NO: 109543 - DNA, 10 bp, Unknown
  misc_feature (1)..( 10): Result.002 file - promoters60/1387616
aaagaaagag

SEQ ID NO: 109544 - DNA, 10 bp, Unknown
  misc_feature (1)..( 10): Result.002 file - promoters60/1387616
gaataaatct

SEQ ID NO: 109545 - DNA, 10 bp, Unknown
  misc_feature (1)..( 10): Result.002 file - promoters60/1387616
agataatatt

SEQ ID NO: 109546 - DNA, 10 bp, Unknown
  misc_feature (1)..( 10): Result.002 file - promoters60/1387616
caatattatt

SEQ ID NO: 109547 - DNA, 14 bp, Unknown
  misc_feature (1)..( 14): Result.002 file - promoters60/1387616
tgaaaaacaaacgt

SEQ ID NO: 109548 - DNA, 14 bp, Unknown
  misc_feature (1)..( 14): Result.002 file - promoters60/1387616
ctataaataaattt

SEQ ID NO: 109549 - DNA, 14 bp, Unknown
  misc_feature (1)..( 14): Result.002 file - promoters60/1387616
agtcaaacaaatgt

SEQ ID NO: 109550 - DNA, 14 bp, Unknown
  misc_feature (1)..( 14): Result.002 file - promoters60/1387616
ttttaaaaaaagaa

SEQ ID NO: 109551 - DNA, 14 bp, Unknown
  misc_feature (1)..( 14): Result.002 file - promoters60/1387616
atgtatatattaat

SEQ ID NO: 109552 - DNA, 14 bp, Unknown
  misc_feature (1)..( 14): Result.002 file - promoters60/1387616
gtcaatattattaa

SEQ ID NO: 109553 - DNA, 14 bp, Unknown
  misc_feature (1)..( 14): Result.002 file - promoters60/1387616
ctggtcataaatgt

SEQ ID NO: 109554 - DNA, 14 bp, Unknown
  misc_feature (1)..( 14): Result.002 file - promoters60/1387616
ttagaaacagactt

SEQ ID NO: 109555 - DNA, 11 bp, Unknown
  misc_feature (1)..( 11): Result.002 file - promoters60/1387616
aacatatagta

SEQ ID NO: 109556 - DNA, 11 bp, Unknown
  misc_feature (1)..( 11): Result.002 file - promoters60/1387616
aaaatatcgta

SEQ ID NO: 109557 - DNA, 11 bp, Unknown
  misc_feature (1)..( 11): Result.002 file - promoters60/1387616
ataatatttca

SEQ ID NO: 109558 - DNA, 11 bp, Unknown
  misc_feature (1)..( 11): Result.002 file - promoters60/1387616
aaaatacagta

SEQ ID NO: 109559 - DNA, 11 bp, Unknown
  misc_feature (1)..( 11): Result.002 file - promoters60/1387616
tcaatattatt

SEQ ID NO: 109560 - DNA, 11 bp, Unknown
  misc_feature (1)..( 11): Result.002 file - promoters60/1387616
agagtaccgta

SEQ ID NO: 109561 - DNA, 12 bp, Unknown
  misc_feature (1)..( 12): Result.002 file - promoters60/1387616
taatctatatgt

SEQ ID NO: 109562 - DNA, 12 bp, Unknown
  misc_feature (1)..( 12): Result.002 file - promoters60/1387616
ttttctataaat

SEQ ID NO: 109563 - DNA, 12 bp, Unknown
  misc_feature (1)..( 12): Result.002 file - promoters60/1387616
aaatgtatcctt

SEQ ID NO: 109564 - DNA, 12 bp, Unknown
  misc_feature (1)..( 12): Result.002 file - promoters60/1387616
ttaactacatgt

SEQ ID NO: 109565 - DNA, 12 bp, Unknown
  misc_feature (1)..( 12): Result.002 file - promoters60/1387616
aaatgtttgtct

SEQ ID NO: 109566 - DNA, 12 bp, Unknown
  misc_feature (1)..( 12): Result.002 file - promoters60/1387616
cagacttcatat

SEQ ID NO: 109567 - DNA, 8 bp, Unknown
  misc_feature (1)..( 8): Result.002 file - promoters60/1387649
gctaggtt

SEQ ID NO: 109568 - DNA, 8 bp, Unknown
  misc_feature (1)..( 8): Result.002 file - promoters60/1387649
gctatgtt

SEQ ID NO: 109569 - DNA, 7 bp, Unknown
  misc_feature (1)..( 7): Result.002 file - promoters60/1387649
ttagatt

SEQ ID NO: 109570 - DNA, 7 bp, Unknown
  misc_feature (1)..( 7): Result.002 file - promoters60/1387649
ttaaatt

SEQ ID NO: 109571 - DNA, 6 bp, Unknown
  misc_feature (1)..( 6): Result.002 file - promoters60/1387649
aaaatg

SEQ ID NO: 109572 - DNA, 6 bp, Unknown
  misc_feature (1)..( 6): Result.002 file - promoters60/1387649
aaaatg

SEQ ID NO: 109573 - DNA, 7 bp, Unknown
  misc_feature (1)..( 7): Result.002 file - promoters60/1387649
aaaggtt

SEQ ID NO: 109574 - DNA, 7 bp, Unknown
  misc_feature (1)..( 7): Result.002 file - promoters60/1387649
aaatgtt

SEQ ID NO: 109575 - DNA, 6 bp, Unknown
  misc_feature (1)..( 6): Result.002 file - promoters60/1387649
taataa

SEQ ID NO: 109576 - DNA, 6 bp, Unknown
  misc_feature (1)..( 6): Result.002 file - promoters60/1387649
taataa

SEQ ID NO: 109577 - DNA, 6 bp, Unknown
  misc_feature (1)..( 6): Result.002 file - promoters60/1387649
tgtcaa

SEQ ID NO: 109578 - DNA, 6 bp, Unknown
  misc_feature (1)..( 6): Result.002 file - promoters60/1387649
tgtcaa

SEQ ID NO: 109579 - DNA, 6 bp, Unknown
  misc_feature (1)..( 6): Result.002 file - promoters60/1387649
tcaatt

SEQ ID NO: 109580 - DNA, 6 bp, Unknown
  misc_feature (1)..( 6): Result.002 file - promoters60/1387649
tcaatt

SEQ ID NO: 109581 - DNA, 7 bp, Unknown
  misc_feature (1)..( 7): Result.002 file - promoters60/1387649
taccata

SEQ ID NO: 109582 - DNA, 7 bp, Unknown
  misc_feature (1)..( 7): Result.002 file - promoters60/1387649
tacgata

SEQ ID NO: 109583 - DNA, 7 bp, Unknown
  misc_feature (1)..( 7): Result.002 file - promoters60/1387649
caaccac

SEQ ID NO: 109584 - DNA, 7 bp, Unknown
  misc_feature (1)..( 7): Result.002 file - promoters60/1387649
caaccac

SEQ ID NO: 109585 - DNA, 6 bp, Unknown
  misc_feature (1)..( 6): Result.002 file - promoters60/1387649
ggctga

SEQ ID NO: 109586 - DNA, 6 bp, Unknown
  misc_feature (1)..( 6): Result.002 file - promoters60/1387649
ggctga

SEQ ID NO: 109587 - DNA, 11 bp, Unknown
  misc_feature (1)..( 11): Result.002 file - promoters60/1387649
aggttctcaga

SEQ ID NO: 109588 - DNA, 11 bp, Unknown
  misc_feature (1)..( 11): Result.002 file - promoters60/1387649
agggtctgaga

SEQ ID NO: 109589 - DNA, 6 bp, Unknown
  misc_feature (1)..( 6): Result.002 file - promoters60/1387649
agattt

SEQ ID NO: 109590 - DNA, 6 bp, Unknown
  misc_feature (1)..( 6): Result.002 file - promoters60/1387649
agattt

SEQ ID NO: 109591 - DNA, 8 bp, Unknown
  misc_feature (1)..( 8): Result.002 file - promoters60/1387671
catataaa

SEQ ID NO: 109592 - DNA, 8 bp, Unknown
  misc_feature (1)..( 8): Result.002 file - promoters60/1387671
catatata

SEQ ID NO: 109593 - DNA, 8 bp, Unknown
  misc_feature (1)..( 8): Result.002 file - promoters60/1387671
tatataaa

SEQ ID NO: 109594 - DNA, 8 bp, Unknown
  misc_feature (1)..( 8): Result.002 file - promoters60/1387671
tatatata

SEQ ID NO: 109595 - DNA, 8 bp, Unknown
  misc_feature (1)..( 8): Result.002 file - promoters60/1387671
tatagata

SEQ ID NO: 109596 - DNA, 8 bp, Unknown
  misc_feature (1)..( 8): Result.002 file - promoters60/1387671
aatacact

SEQ ID NO: 109597 - DNA, 9 bp, Unknown
  misc_feature (1)..( 9): Result.002 file - promoters60/1387671
aataaatta

SEQ ID NO: 109598 - DNA, 9 bp, Unknown
  misc_feature (1)..( 9): Result.002 file - promoters60/1387671
aatacattc

SEQ ID NO: 109599 - DNA, 9 bp, Unknown
  misc_feature (1)..( 9): Result.002 file - promoters60/1387671
aaaaaaagt

SEQ ID NO: 109600 - DNA, 9 bp, Unknown
  misc_feature (1)..( 9): Result.002 file - promoters60/1387671
aatacattt

SEQ ID NO: 109601 - DNA, 9 bp, Unknown
  misc_feature (1)..( 9): Result.002 file - promoters60/1387671
aatacatac

SEQ ID NO: 109602 - DNA, 9 bp, Unknown
  misc_feature (1)..( 9): Result.002 file - promoters60/1387671
taaacattt

SEQ ID NO: 109603 - DNA, 6 bp, Unknown
  misc_feature (1)..( 6): Result.002 file - promoters60/1387793
ttttac

SEQ ID NO: 109604 - DNA, 6 bp, Unknown
  misc_feature (1)..( 6): Result.002 file - promoters60/1387793
ttttac

SEQ ID NO: 109605 - DNA, 6 bp, Unknown
  misc_feature (1)..( 6): Result.002 file - promoters60/1387793
aaaacc

SEQ ID NO: 109606 - DNA, 6 bp, Unknown
  misc_feature (1)..( 6): Result.002 file - promoters60/1387793
aaaacc

SEQ ID NO: 109607 - DNA, 8 bp, Unknown
  misc_feature (1)..( 8): Result.002 file - promoters60/1387793
aaaaaaca

SEQ ID NO: 109608 - DNA, 8 bp, Unknown
  misc_feature (1)..( 8): Result.002 file - promoters60/1387793
aaagaaca

SEQ ID NO: 109609 - DNA, 8 bp, Unknown
  misc_feature (1)..( 8): Result.002 file - promoters60/1387793
caaaaaaa

SEQ ID NO: 109610 - DNA, 8 bp, Unknown
  misc_feature (1)..( 8): Result.002 file - promoters60/1387793
caagaaag

SEQ ID NO: 109611 - DNA, 8 bp, Unknown
  misc_feature (1)..( 8): Result.002 file - promoters60/1387793
taaaaaaa

SEQ ID NO: 109612 - DNA, 7 bp, Unknown
  misc_feature (1)..( 7): Result.002 file - promoters60/1387793
taaattt

SEQ ID NO: 109613 - DNA, 7 bp, Unknown
  misc_feature (1)..( 7): Result.002 file - promoters60/1387793
taatttt

SEQ ID NO: 109614 - DNA, 7 bp, Unknown
  misc_feature (1)..( 7): Result.002 file - promoters60/1387793
ttttgtt

SEQ ID NO: 109615 - DNA, 7 bp, Unknown
  misc_feature (1)..( 7): Result.002 file - promoters60/1387793
ttttgtt

SEQ ID NO: 109616 - DNA, 7 bp, Unknown
  misc_feature (1)..( 7): Result.002 file - promoters60/1387793
ttaaaat

SEQ ID NO: 109617 - DNA, 7 bp, Unknown
  misc_feature (1)..( 7): Result.002 file - promoters60/1387793
ttataat

SEQ ID NO: 109618 - DNA, 8 bp, Unknown
  misc_feature (1)..( 8): Result.002 file - promoters60/1387793
atataatt

SEQ ID NO: 109619 - DNA, 8 bp, Unknown
  misc_feature (1)..( 8): Result.002 file - promoters60/1387793
atataatt

SEQ ID NO: 109620 - DNA, 6 bp, Unknown
  misc_feature (1)..( 6): Result.002 file - promoters60/1387793
gaaaaa

SEQ ID NO: 109621 - DNA, 6 bp, Unknown
  misc_feature (1)..( 6): Result.002 file - promoters60/1387793
gaaaaa

SEQ ID NO: 109622 - DNA, 7 bp, Unknown
  misc_feature (1)..( 7): Result.002 file - promoters60/1387793
aaaatat

SEQ ID NO: 109623 - DNA, 7 bp, Unknown
  misc_feature (1)..( 7): Result.002 file - promoters60/1387793
aaactat

SEQ ID NO: 109624 - DNA, 6 bp, Unknown
  misc_feature (1)..( 6): Result.002 file - promoters60/1387793
aaaact

SEQ ID NO: 109625 - DNA, 6 bp, Unknown
  misc_feature (1)..( 6): Result.002 file - promoters60/1387793
aaaact

SEQ ID NO: 109626 - DNA, 11 bp, Unknown
  misc_feature (1)..( 11): Result.002 file - promoters60/1387793
ctttataaaaa

SEQ ID NO: 109627 - DNA, 11 bp, Unknown
  misc_feature (1)..( 11): Result.002 file - promoters60/1387793
ctttaaaaaaa

SEQ ID NO: 109628 - DNA, 7 bp, Unknown
  misc_feature (1)..( 7): Result.002 file - promoters60/1387793
aaaaatt

SEQ ID NO: 109629 - DNA, 7 bp, Unknown
  misc_feature (1)..( 7): Result.002 file - promoters60/1387793
aaatatt

SEQ ID NO: 109630 - DNA, 6 bp, Unknown
  misc_feature (1)..( 6): Result.002 file - promoters60/1387793
gtgtac

SEQ ID NO: 109631 - DNA, 6 bp, Unknown
  misc_feature (1)..( 6): Result.002 file - promoters60/1387793
gtgtac

SEQ ID NO: 109632 - DNA, 10 bp, Unknown
  misc_feature (1)..( 10): Result.002 file - promoters60/1387793
aaccgtggga

SEQ ID NO: 109633 - DNA, 10 bp, Unknown
  misc_feature (1)..( 10): Result.002 file - promoters60/1387793
aaccgtcgga

SEQ ID NO: 109634 - DNA, 9 bp, Unknown
  misc_feature (1)..( 9): Result.002 file - promoters60/1387793
aaaagggca

SEQ ID NO: 109635 - DNA, 9 bp, Unknown
  misc_feature (1)..( 9): Result.002 file - promoters60/1387793
aaaagggca

SEQ ID NO: 109636 - DNA, 6 bp, Unknown
  misc_feature (1)..( 6): Result.002 file - promoters60/1387793
ttaaaa

SEQ ID NO: 109637 - DNA, 6 bp, Unknown
  misc_feature (1)..( 6): Result.002 file - promoters60/1387793
ttaaaa

SEQ ID NO: 109638 - DNA, 8 bp, Unknown
  misc_feature (1)..( 8): Result.002 file - promoters60/1387818
aacaaaaa

SEQ ID NO: 109639 - DNA, 8 bp, Unknown
  misc_feature (1)..( 8): Result.002 file - promoters60/1387818
cacagaaa

SEQ ID NO: 109640 - DNA, 8 bp, Unknown
  misc_feature (1)..( 8): Result.002 file - promoters60/1387818
aacgaaat

SEQ ID NO: 109641 - DNA, 8 bp, Unknown
  misc_feature (1)..( 8): Result.002 file - promoters60/1387818
gacataaa

SEQ ID NO: 109642 - DNA, 9 bp, Unknown
  misc_feature (1)..( 9): Result.002 file - promoters60/1387818
tcatagata

SEQ ID NO: 109643 - DNA, 9 bp, Unknown
  misc_feature (1)..( 9): Result.002 file - promoters60/1387818
tcaaagaat

SEQ ID NO: 109644 - DNA, 9 bp, Unknown
  misc_feature (1)..( 9): Result.002 file - promoters60/1387818
ttaaagaat

SEQ ID NO: 109645 - DNA, 9 bp, Unknown
  misc_feature (1)..( 9): Result.002 file - promoters60/1387818
ctaacgaaa

SEQ ID NO: 109646 - DNA, 9 bp, Unknown
  misc_feature (1)..( 9): Result.002 file - promoters60/1387818
acttaaaat

SEQ ID NO: 109647 - DNA, 9 bp, Unknown
  misc_feature (1)..( 9): Result.002 file - promoters60/1387818
actaaaaac

SEQ ID NO: 109648 - DNA, 9 bp, Unknown
  misc_feature (1)..( 9): Result.002 file - promoters60/1387818
ggtaaaatc

SEQ ID NO: 109649 - DNA, 9 bp, Unknown
  misc_feature (1)..( 9): Result.002 file - promoters60/1387818
aataaaaaa

SEQ ID NO: 109650 - DNA, 9 bp, Unknown
  misc_feature (1)..( 9): Result.002 file - promoters60/1387818
aaatttttc

SEQ ID NO: 109651 - DNA, 9 bp, Unknown
  misc_feature (1)..( 9): Result.002 file - promoters60/1387818
caatatttc

SEQ ID NO: 109652 - DNA, 9 bp, Unknown
  misc_feature (1)..( 9): Result.002 file - promoters60/1387818
aaagtttcc

SEQ ID NO: 109653 - DNA, 9 bp, Unknown
  misc_feature (1)..( 9): Result.002 file - promoters60/1387818
aaagttgaa

SEQ ID NO: 109654 - DNA, 10 bp, Unknown
  misc_feature (1)..( 10): Result.002 file - promoters60/1387818
gaagagtata

SEQ ID NO: 109655 - DNA, 10 bp, Unknown
  misc_feature (1)..( 10): Result.002 file - promoters60/1387818
taagaatata

SEQ ID NO: 109656 - DNA, 10 bp, Unknown
  misc_feature (1)..( 10): Result.002 file - promoters60/1387818
taacaatggg

SEQ ID NO: 109657 - DNA, 10 bp, Unknown
  misc_feature (1)..( 10): Result.002 file - promoters60/1387818
taagaagaat

SEQ ID NO: 109658 - DNA, 13 bp, Unknown
  misc_feature (1)..( 13): Result.002 file - promoters60/1387818
tttagtaatataa

SEQ ID NO: 109659 - DNA, 13 bp, Unknown
  misc_feature (1)..( 13): Result.002 file - promoters60/1387818
tttattaaaatgc

SEQ ID NO: 109660 - DNA, 13 bp, Unknown
  misc_feature (1)..( 13): Result.002 file - promoters60/1387818
aatagaaatatgt

SEQ ID NO: 109661 - DNA, 13 bp, Unknown
  misc_feature (1)..( 13): Result.002 file - promoters60/1387818
actaagaatgtgt

SEQ ID NO: 109662 - DNA, 10 bp, Unknown
  misc_feature (1)..( 10): Result.002 file - promoters60/1387906
tttgaaggtt

SEQ ID NO: 109663 - DNA, 10 bp, Unknown
  misc_feature (1)..( 10): Result.002 file - promoters60/1387906
gaggaaggtg

SEQ ID NO: 109664 - DNA, 10 bp, Unknown
  misc_feature (1)..( 10): Result.002 file - promoters60/1387906
ttttaaggtt

SEQ ID NO: 109665 - DNA, 7 bp, Unknown
  misc_feature (1)..( 7): Result.002 file - promoters60/1387906
gaaaata

SEQ ID NO: 109666 - DNA, 7 bp, Unknown
  misc_feature (1)..( 7): Result.002 file - promoters60/1387906
gaaaatg

SEQ ID NO: 109667 - DNA, 7 bp, Unknown
  misc_feature (1)..( 7): Result.002 file - promoters60/1387906
taaaata

SEQ ID NO: 109668 - DNA, 11 bp, Unknown
  misc_feature (1)..( 11): Result.002 file - promoters60/1387906
atataacaaca

SEQ ID NO: 109669 - DNA, 11 bp, Unknown
  misc_feature (1)..( 11): Result.002 file - promoters60/1387906
ttttaataaca

SEQ ID NO: 109670 - DNA, 11 bp, Unknown
  misc_feature (1)..( 11): Result.002 file - promoters60/1387906
ttttactaact

SEQ ID NO: 109671 - DNA, 10 bp, Unknown
  misc_feature (1)..( 10): Result.002 file - promoters60/1387906
taaatttgtt

SEQ ID NO: 109672 - DNA, 10 bp, Unknown
  misc_feature (1)..( 10): Result.002 file - promoters60/1387906
aaaatctgtt

SEQ ID NO: 109673 - DNA, 10 bp, Unknown
  misc_feature (1)..( 10): Result.002 file - promoters60/1387906
aaaatcgaac

SEQ ID NO: 109674 - DNA, 9 bp, Unknown
  misc_feature (1)..( 9): Result.002 file - promoters60/1387906
ctttataat

SEQ ID NO: 109675 - DNA, 9 bp, Unknown
  misc_feature (1)..( 9): Result.002 file - promoters60/1387906
cattaaaat

SEQ ID NO: 109676 - DNA, 10 bp, Unknown
  misc_feature (1)..( 10): Result.002 file - promoters60/1387906
acttcataga

SEQ ID NO: 109677 - DNA, 10 bp, Unknown
  misc_feature (1)..( 10): Result.002 file - promoters60/1387947
ttttggaaga

SEQ ID NO: 109678 - DNA, 10 bp, Unknown
  misc_feature (1)..( 10): Result.002 file - promoters60/1387947
aattgtaaga

SEQ ID NO: 109679 - DNA, 10 bp, Unknown
  misc_feature (1)..( 10): Result.002 file - promoters60/1387947
ttttagaata

SEQ ID NO: 109680 - DNA, 7 bp, Unknown
  misc_feature (1)..( 7): Result.002 file - promoters60/1387947
tgtagaa

SEQ ID NO: 109681 - DNA, 7 bp, Unknown
  misc_feature (1)..( 7): Result.002 file - promoters60/1387947
tgtagaa

SEQ ID NO: 109682 - DNA, 6 bp, Unknown
  misc_feature (1)..( 6): Result.002 file - promoters60/1387947
acaatt

SEQ ID NO: 109683 - DNA, 6 bp, Unknown
  misc_feature (1)..( 6): Result.002 file - promoters60/1387947
acaatt

SEQ ID NO: 109684 - DNA, 7 bp, Unknown
  misc_feature (1)..( 7): Result.002 file - promoters60/1387947
attttaa

SEQ ID NO: 109685 - DNA, 7 bp, Unknown
  misc_feature (1)..( 7): Result.002 file - promoters60/1387947
attttaa

SEQ ID NO: 109686 - DNA, 7 bp, Unknown
  misc_feature (1)..( 7): Result.002 file - promoters60/1387947
attaact

SEQ ID NO: 109687 - DNA, 7 bp, Unknown
  misc_feature (1)..( 7): Result.002 file - promoters60/1387947
attaact

SEQ ID NO: 109688 - DNA, 8 bp, Unknown
  misc_feature (1)..( 8): Result.002 file - promoters60/1387947
tggttcta

SEQ ID NO: 109689 - DNA, 8 bp, Unknown
  misc_feature (1)..( 8): Result.002 file - promoters60/1387947
tgggtcta

SEQ ID NO: 109690 - DNA, 6 bp, Unknown
  misc_feature (1)..( 6): Result.002 file - promoters60/1387947
aaaact

SEQ ID NO: 109691 - DNA, 6 bp, Unknown
  misc_feature (1)..( 6): Result.002 file - promoters60/1387947
aaaact

SEQ ID NO: 109692 - DNA, 6 bp, Unknown
  misc_feature (1)..( 6): Result.002 file - promoters60/1387947
gaaaaa

SEQ ID NO: 109693 - DNA, 6 bp, Unknown
  misc_feature (1)..( 6): Result.002 file - promoters60/1387947
gaaaaa

SEQ ID NO: 109694 - DNA, 7 bp, Unknown
  misc_feature (1)..( 7): Result.002 file - promoters60/1387947
aaaagaa

SEQ ID NO: 109695 - DNA, 7 bp, Unknown
  misc_feature (1)..( 7): Result.002 file - promoters60/1387947
aaacgaa

SEQ ID NO: 109696 - DNA, 9 bp, Unknown
  misc_feature (1)..( 9): Result.002 file - promoters60/1387947
agaaagaaa

SEQ ID NO: 109697 - DNA, 9 bp, Unknown
  misc_feature (1)..( 9): Result.002 file - promoters60/1387947
agacagaaa

SEQ ID NO: 109698 - DNA, 9 bp, Unknown
  misc_feature (1)..( 9): Result.002 file - promoters60/1387947
taacaaaaa

SEQ ID NO: 109699 - DNA, 7 bp, Unknown
  misc_feature (1)..( 7): Result.002 file - promoters60/1387947
gaaggaa

SEQ ID NO: 109700 - DNA, 7 bp, Unknown
  misc_feature (1)..( 7): Result.002 file - promoters60/1387947
gaaagaa

SEQ ID NO: 109701 - DNA, 8 bp, Unknown
  misc_feature (1)..( 8): Result.002 file - promoters60/1387947
gttagtta

SEQ ID NO: 109702 - DNA, 8 bp, Unknown
  misc_feature (1)..( 8): Result.002 file - promoters60/1387947
gttactta

SEQ ID NO: 109703 - DNA, 8 bp, Unknown
  misc_feature (1)..( 8): Result.002 file - promoters60/1387947
aatactta

SEQ ID NO: 109704 - DNA, 6 bp, Unknown
  misc_feature (1)..( 6): Result.002 file - promoters60/1387947
accatt

SEQ ID NO: 109705 - DNA, 6 bp, Unknown
  misc_feature (1)..( 6): Result.002 file - promoters60/1387947
accatt

SEQ ID NO: 109706 - DNA, 7 bp, Unknown
  misc_feature (1)..( 7): Result.002 file - promoters60/1387947
agaagtt

SEQ ID NO: 109707 - DNA, 7 bp, Unknown
  misc_feature (1)..( 7): Result.002 file - promoters60/1387947
agacgtt

SEQ ID NO: 109708 - DNA, 7 bp, Unknown
  misc_feature (1)..( 7): Result.002 file - promoters60/1387947
aatttta

SEQ ID NO: 109709 - DNA, 7 bp, Unknown
  misc_feature (1)..( 7): Result.002 file - promoters60/1387947
aatatta

SEQ ID NO: 109710 - DNA, 7 bp, Unknown
  misc_feature (1)..( 7): Result.002 file - promoters60/1387947
aaataaa

SEQ ID NO: 109711 - DNA, 7 bp, Unknown
  misc_feature (1)..( 7): Result.002 file - promoters60/1387947
aaaaaaa

SEQ ID NO: 109712 - DNA, 8 bp, Unknown
  misc_feature (1)..( 8): Result.002 file - promoters60/1387947
aaacttta

SEQ ID NO: 109713 - DNA, 8 bp, Unknown
  misc_feature (1)..( 8): Result.002 file - promoters60/1387947
aaacgtta

SEQ ID NO: 109714 - DNA, 6 bp, Unknown
  misc_feature (1)..( 6): Result.002 file - promoters60/1387947
taaacg

SEQ ID NO: 109715 - DNA, 6 bp, Unknown
  misc_feature (1)..( 6): Result.002 file - promoters60/1387947
taaacg

SEQ ID NO: 109716 - DNA, 11 bp, Unknown
  misc_feature (1)..( 11): Result.002 file - promoters60/1388009
tatgaaaatat

SEQ ID NO: 109717 - DNA, 11 bp, Unknown
  misc_feature (1)..( 11): Result.002 file - promoters60/1388009
tattaaagtat

SEQ ID NO: 109718 - DNA, 11 bp, Unknown
  misc_feature (1)..( 11): Result.002 file - promoters60/1388009
tattaaattat

SEQ ID NO: 109719 - DNA, 7 bp, Unknown
  misc_feature (1)..( 7): Result.002 file - promoters60/1388009
atatttt

SEQ ID NO: 109720 - DNA, 7 bp, Unknown
  misc_feature (1)..( 7): Result.002 file - promoters60/1388009
atatttt

SEQ ID NO: 109721 - DNA, 7 bp, Unknown
  misc_feature (1)..( 7): Result.002 file - promoters60/1388009
atatttt

SEQ ID NO: 109722 - DNA, 7 bp, Unknown
  misc_feature (1)..( 7): Result.002 file - promoters60/1388009
tttttac

SEQ ID NO: 109723 - DNA, 7 bp, Unknown
  misc_feature (1)..( 7): Result.002 file - promoters60/1388009
attttac

SEQ ID NO: 109724 - DNA, 7 bp, Unknown
  misc_feature (1)..( 7): Result.002 file - promoters60/1388009
attttag

SEQ ID NO: 109725 - DNA, 8 bp, Unknown
  misc_feature (1)..( 8): Result.002 file - promoters60/1388009
cttctgtt

SEQ ID NO: 109726 - DNA, 8 bp, Unknown
  misc_feature (1)..( 8): Result.002 file - promoters60/1388009
cttttgtt

SEQ ID NO: 109727 - DNA, 10 bp, Unknown
  misc_feature (1)..( 10): Result.002 file - promoters60/1388009
cgaaatcata

SEQ ID NO: 109728 - DNA, 10 bp, Unknown
  misc_feature (1)..( 10): Result.002 file - promoters60/1388009
acaaataata

SEQ ID NO: 109729 - DNA, 10 bp, Unknown
  misc_feature (1)..( 10): Result.002 file - promoters60/1388009
cgaattcaaa

SEQ ID NO: 109730 - DNA, 6 bp, Unknown
  misc_feature (1)..( 6): Result.002 file - promoters60/1388009
gtaaca

SEQ ID NO: 109731 - DNA, 6 bp, Unknown
  misc_feature (1)..( 6): Result.002 file - promoters60/1388009
gtaaca

SEQ ID NO: 109732 - DNA, 7 bp, Unknown
  misc_feature (1)..( 7): Result.002 file - promoters60/1388009
ctatatg

SEQ ID NO: 109733 - DNA, 7 bp, Unknown
  misc_feature (1)..( 7): Result.002 file - promoters60/1388009
ctatata

SEQ ID NO: 109734 - DNA, 7 bp, Unknown
  misc_feature (1)..( 7): Result.002 file - promoters60/1388009
ttatatg

SEQ ID NO: 109735 - DNA, 9 bp, Unknown
  misc_feature (1)..( 9): Result.002 file - promoters60/1388009
acattataa

SEQ ID NO: 109736 - DNA, 9 bp, Unknown
  misc_feature (1)..( 9): Result.002 file - promoters60/1388009
aaattataa

SEQ ID NO: 109737 - DNA, 9 bp, Unknown
  misc_feature (1)..( 9): Result.002 file - promoters60/1388009
aaattatta

SEQ ID NO: 109738 - DNA, 6 bp, Unknown
  misc_feature (1)..( 6): Result.002 file - promoters60/1388009
gtatat

SEQ ID NO: 109739 - DNA, 6 bp, Unknown
  misc_feature (1)..( 6): Result.002 file - promoters60/1388009
gtatat

SEQ ID NO: 109740 - DNA, 8 bp, Unknown
  misc_feature (1)..( 8): Result.002 file - promoters60/1388009
attttact

SEQ ID NO: 109741 - DNA, 8 bp, Unknown
  misc_feature (1)..( 8): Result.002 file - promoters60/1388009
attttact

SEQ ID NO: 109742 - DNA, 8 bp, Unknown
  misc_feature (1)..( 8): Result.002 file - promoters60/1388009
tgctaacc

SEQ ID NO: 109743 - DNA, 8 bp, Unknown
  misc_feature (1)..( 8): Result.002 file - promoters60/1388009
tgcttacc

SEQ ID NO: 109744 - DNA, 7 bp, Unknown
  misc_feature (1)..( 7): Result.002 file - promoters60/1388009
ttactaa

SEQ ID NO: 109745 - DNA, 7 bp, Unknown
  misc_feature (1)..( 7): Result.002 file - promoters60/1388009
ttattaa

SEQ ID NO: 109746 - DNA, 8 bp, Unknown
  misc_feature (1)..( 8): Result.002 file - promoters60/1388009
taatttta

SEQ ID NO: 109747 - DNA, 8 bp, Unknown
  misc_feature (1)..( 8): Result.002 file - promoters60/1388009
taatttta

SEQ ID NO: 109748 - DNA, 8 bp, Unknown
  misc_feature (1)..( 8): Result.002 file - promoters60/1388009
agtcggtc

SEQ ID NO: 109749 - DNA, 8 bp, Unknown
  misc_feature (1)..( 8): Result.002 file - promoters60/1388009
agtctgtc

SEQ ID NO: 109750 - DNA, 6 bp, Unknown
  misc_feature (1)..( 6): Result.002 file - promoters60/1388009
gaattc

SEQ ID NO: 109751 - DNA, 6 bp, Unknown
  misc_feature (1)..( 6): Result.002 file - promoters60/1388009
gaattc

SEQ ID NO: 109752 - DNA, 6 bp, Unknown
  misc_feature (1)..( 6): Result.002 file - promoters60/1388009
atattt

SEQ ID NO: 109753 - DNA, 6 bp, Unknown
  misc_feature (1)..( 6): Result.002 file - promoters60/1388009
atattt

SEQ ID NO: 109754 - DNA, 6 bp, Unknown
  misc_feature (1)..( 6): Result.002 file - promoters60/1388009
taatat

SEQ ID NO: 109755 - DNA, 6 bp, Unknown
  misc_feature (1)..( 6): Result.002 file - promoters60/1388009
taatat

SEQ ID NO: 109756 - DNA, 6 bp, Unknown
  misc_feature (1)..( 6): Result.002 file - promoters60/1388069
tattgt

SEQ ID NO: 109757 - DNA, 6 bp, Unknown
  misc_feature (1)..( 6): Result.002 file - promoters60/1388069
tattgt

SEQ ID NO: 109758 - DNA, 7 bp, Unknown
  misc_feature (1)..( 7): Result.002 file - promoters60/1388069
aaattta

SEQ ID NO: 109759 - DNA, 7 bp, Unknown
  misc_feature (1)..( 7): Result.002 file - promoters60/1388069
aaactta

SEQ ID NO: 109760 - DNA, 6 bp, Unknown
  misc_feature (1)..( 6): Result.002 file - promoters60/1388069
tagaaa

SEQ ID NO: 109761 - DNA, 6 bp, Unknown
  misc_feature (1)..( 6): Result.002 file - promoters60/1388069
tagaaa

SEQ ID NO: 109762 - DNA, 10 bp, Unknown
  misc_feature (1)..( 10): Result.002 file - promoters60/1388069
caattgaaaa

SEQ ID NO: 109763 - DNA, 10 bp, Unknown
  misc_feature (1)..( 10): Result.002 file - promoters60/1388069
caattaaaaa

SEQ ID NO: 109764 - DNA, 10 bp, Unknown
  misc_feature (1)..( 10): Result.002 file - promoters60/1388069
taaataaacc

SEQ ID NO: 109765 - DNA, 8 bp, Unknown
  misc_feature (1)..( 8): Result.002 file - promoters60/1388069
tttataat

SEQ ID NO: 109766 - DNA, 8 bp, Unknown
  misc_feature (1)..( 8): Result.002 file - promoters60/1388069
tttctaat

SEQ ID NO: 109767 - DNA, 6 bp, Unknown
  misc_feature (1)..( 6): Result.002 file - promoters60/1388069
agatat

SEQ ID NO: 109768 - DNA, 6 bp, Unknown
  misc_feature (1)..( 6): Result.002 file - promoters60/1388069
agatat

SEQ ID NO: 109769 - DNA, 6 bp, Unknown
  misc_feature (1)..( 6): Result.002 file - promoters60/1388069
aaagat

SEQ ID NO: 109770 - DNA, 6 bp, Unknown
  misc_feature (1)..( 6): Result.002 file - promoters60/1388069
aaagat

SEQ ID NO: 109771 - DNA, 6 bp, Unknown
  misc_feature (1)..( 6): Result.002 file - promoters60/1388069
tctaag

SEQ ID NO: 109772 - DNA, 6 bp, Unknown
  misc_feature (1)..( 6): Result.002 file - promoters60/1388069
tctaag

SEQ ID NO: 109773 - DNA, 6 bp, Unknown
  misc_feature (1)..( 6): Result.002 file - promoters60/1388069
aaaaat

SEQ ID NO: 109774 - DNA, 6 bp, Unknown
  misc_feature (1)..( 6): Result.002 file - promoters60/1388069
aaaaat

SEQ ID NO: 109775 - DNA, 7 bp, Unknown
  misc_feature (1)..( 7): Result.002 file - promoters60/1388069
tttgaag

SEQ ID NO: 109776 - DNA, 7 bp, Unknown
  misc_feature (1)..( 7): Result.002 file - promoters60/1388069
ttttaag

SEQ ID NO: 109777 - DNA, 8 bp, Unknown
  misc_feature (1)..( 8): Result.002 file - promoters60/1388069
aaactaac

SEQ ID NO: 109778 - DNA, 8 bp, Unknown
  misc_feature (1)..( 8): Result.002 file - promoters60/1388069
aaaccaac

SEQ ID NO: 109779 - DNA, 7 bp, Unknown
  misc_feature (1)..( 7): Result.002 file - promoters60/1388069
cttcaag

SEQ ID NO: 109780 - DNA, 7 bp, Unknown
  misc_feature (1)..( 7): Result.002 file - promoters60/1388069
cttcaag

SEQ ID NO: 109781 - DNA, 8 bp, Unknown
  misc_feature (1)..( 8): Result.002 file - promoters60/1388069
atcttcct

SEQ ID NO: 109782 - DNA, 8 bp, Unknown
  misc_feature (1)..( 8): Result.002 file - promoters60/1388069
atcttcct

SEQ ID NO: 109783 - DNA, 8 bp, Unknown
  misc_feature (1)..( 8): Result.002 file - promoters60/1388545
aaataaat

SEQ ID NO: 109784 - DNA, 8 bp, Unknown
  misc_feature (1)..( 8): Result.002 file - promoters60/1388545
aaagaaaa

SEQ ID NO: 109785 - DNA, 9 bp, Unknown
  misc_feature (1)..( 9): Result.002 file - promoters60/1388545
aagagaaaa

SEQ ID NO: 109786 - DNA, 19 bp, Unknown
  misc_feature (1)..( 19): Result.002 file - promoters60/1388793
aacaaactacaaaagttta

SEQ ID NO: 109787 - DNA, 13 bp, Unknown
  misc_feature (1)..( 13): Result.002 file - promoters60/1388793
cagaaaatgtttt

SEQ ID NO: 109788 - DNA, 19 bp, Unknown
  misc_feature (1)..( 19): Result.002 file - promoters60/1388793
agtttagggaaaatggatc

SEQ ID NO: 109789 - DNA, 19 bp, Unknown
  misc_feature (1)..( 19): Result.002 file - promoters60/1388793
ccaacacattcaatatttt

SEQ ID NO: 109790 - DNA, 15 bp, Unknown
  misc_feature (1)..( 15): Result.002 file - promoters60/1388793
atcactgatccaaca

SEQ ID NO: 109791 - DNA, 15 bp, Unknown
  misc_feature (1)..( 15): Result.002 file - promoters60/1388793
atcactgatccaaca

SEQ ID NO: 109792 - DNA, 15 bp, Unknown
  misc_feature (1)..( 15): Result.002 file - promoters60/1388793
atcactgatccaaca

SEQ ID NO: 109793 - DNA, 7 bp, Unknown
  misc_feature (1)..( 7): Result.002 file - promoters60/1388793
aattatc

SEQ ID NO: 109794 - DNA, 7 bp, Unknown
  misc_feature (1)..( 7): Result.002 file - promoters60/1388793
cattatc

SEQ ID NO: 109795 - DNA, 7 bp, Unknown
  misc_feature (1)..( 7): Result.002 file - promoters60/1388793
cattata

SEQ ID NO: 109796 - DNA, 7 bp, Unknown
  misc_feature (1)..( 7): Result.002 file - promoters60/1388793
aattatc

SEQ ID NO: 109797 - DNA, 7 bp, Unknown
  misc_feature (1)..( 7): Result.002 file - promoters60/1388808
attttaa

SEQ ID NO: 109798 - DNA, 7 bp, Unknown
  misc_feature (1)..( 7): Result.002 file - promoters60/1388808
attttaa

SEQ ID NO: 109799 - DNA, 7 bp, Unknown
  misc_feature (1)..( 7): Result.002 file - promoters60/1388808
aatattg

SEQ ID NO: 109800 - DNA, 7 bp, Unknown
  misc_feature (1)..( 7): Result.002 file - promoters60/1388808
aatgttg

SEQ ID NO: 109801 - DNA, 7 bp, Unknown
  misc_feature (1)..( 7): Result.002 file - promoters60/1388808
atcctac

SEQ ID NO: 109802 - DNA, 7 bp, Unknown
  misc_feature (1)..( 7): Result.002 file - promoters60/1388808
atcttac

SEQ ID NO: 109803 - DNA, 6 bp, Unknown
  misc_feature (1)..( 6): Result.002 file - promoters60/1388808
tttttt

SEQ ID NO: 109804 - DNA, 6 bp, Unknown
  misc_feature (1)..( 6): Result.002 file - promoters60/1388808
tttttt

SEQ ID NO: 109805 - DNA, 6 bp, Unknown
  misc_feature (1)..( 6): Result.002 file - promoters60/1388808
attttg

SEQ ID NO: 109806 - DNA, 6 bp, Unknown
  misc_feature (1)..( 6): Result.002 file - promoters60/1388808
attttg

SEQ ID NO: 109807 - DNA, 6 bp, Unknown
  misc_feature (1)..( 6): Result.002 file - promoters60/1388808
atttgt

SEQ ID NO: 109808 - DNA, 6 bp, Unknown
  misc_feature (1)..( 6): Result.002 file - promoters60/1388808
atttgt

SEQ ID NO: 109809 - DNA, 7 bp, Unknown
  misc_feature (1)..( 7): Result.002 file - promoters60/1388808
atgtttt

SEQ ID NO: 109810 - DNA, 7 bp, Unknown
  misc_feature (1)..( 7): Result.002 file - promoters60/1388808
atgattt

SEQ ID NO: 109811 - DNA, 7 bp, Unknown
  misc_feature (1)..( 7): Result.002 file - promoters60/1388808
tgttttg

SEQ ID NO: 109812 - DNA, 7 bp, Unknown
  misc_feature (1)..( 7): Result.002 file - promoters60/1388808
tgttttg

SEQ ID NO: 109813 - DNA, 6 bp, Unknown
  misc_feature (1)..( 6): Result.002 file - promoters60/1388808
aaaatt

SEQ ID NO: 109814 - DNA, 6 bp, Unknown
  misc_feature (1)..( 6): Result.002 file - promoters60/1388808
aaaatt

SEQ ID NO: 109815 - DNA, 6 bp, Unknown
  misc_feature (1)..( 6): Result.002 file - promoters60/1388808
tctcaa

SEQ ID NO: 109816 - DNA, 6 bp, Unknown
  misc_feature (1)..( 6): Result.002 file - promoters60/1388808
tctcaa

SEQ ID NO: 109817 - DNA, 6 bp, Unknown
  misc_feature (1)..( 6): Result.002 file - promoters60/1388808
tagttt

SEQ ID NO: 109818 - DNA, 6 bp, Unknown
  misc_feature (1)..( 6): Result.002 file - promoters60/1388808
tagttt

SEQ ID NO: 109819 - DNA, 6 bp, Unknown
  misc_feature (1)..( 6): Result.002 file - promoters60/1388808
gtggat

SEQ ID NO: 109820 - DNA, 6 bp, Unknown
  misc_feature (1)..( 6): Result.002 file - promoters60/1388808
gtggat

SEQ ID NO: 109821 - DNA, 6 bp, Unknown
  misc_feature (1)..( 6): Result.002 file - promoters60/1388808
tttgca

SEQ ID NO: 109822 - DNA, 6 bp, Unknown
  misc_feature (1)..( 6): Result.002 file - promoters60/1388808
tttgca

SEQ ID NO: 109823 - DNA, 7 bp, Unknown
  misc_feature (1)..( 7): Result.002 file - promoters60/1388808
aaaagag

SEQ ID NO: 109824 - DNA, 7 bp, Unknown
  misc_feature (1)..( 7): Result.002 file - promoters60/1388808
aaaagag

SEQ ID NO: 109825 - DNA, 6 bp, Unknown
  misc_feature (1)..( 6): Result.002 file - promoters60/1388808
aaaata

SEQ ID NO: 109826 - DNA, 6 bp, Unknown
  misc_feature (1)..( 6): Result.002 file - promoters60/1388808
aaaata

SEQ ID NO: 109827 - DNA, 8 bp, Unknown
  misc_feature (1)..( 8): Result.002 file - promoters60/1388808
ttagagat

SEQ ID NO: 109828 - DNA, 8 bp, Unknown
  misc_feature (1)..( 8): Result.002 file - promoters60/1388808
ttatagat

SEQ ID NO: 109829 - DNA, 7 bp, Unknown
  misc_feature (1)..( 7): Result.002 file - promoters60/1388808
tttgtaa

SEQ ID NO: 109830 - DNA, 7 bp, Unknown
  misc_feature (1)..( 7): Result.002 file - promoters60/1388808
tttataa

SEQ ID NO: 109831 - DNA, 7 bp, Unknown
  misc_feature (1)..( 7): Result.002 file - promoters60/1388808
aaccgtc

SEQ ID NO: 109832 - DNA, 7 bp, Unknown
  misc_feature (1)..( 7): Result.002 file - promoters60/1388808
aacagtc

SEQ ID NO: 109833 - DNA, 7 bp, Unknown
  misc_feature (1)..( 7): Result.002 file - promoters60/1388808
ttaaaaa

SEQ ID NO: 109834 - DNA, 7 bp, Unknown
  misc_feature (1)..( 7): Result.002 file - promoters60/1388808
ttaaaaa

SEQ ID NO: 109835 - DNA, 8 bp, Unknown
  misc_feature (1)..( 8): Result.002 file - promoters60/1388808
tcaaaaaa

SEQ ID NO: 109836 - DNA, 8 bp, Unknown
  misc_feature (1)..( 8): Result.002 file - promoters60/1388808
tcaaaaaa

SEQ ID NO: 109837 - DNA, 7 bp, Unknown
  misc_feature (1)..( 7): Result.002 file - promoters60/1388808
agtgcgg

SEQ ID NO: 109838 - DNA, 7 bp, Unknown
  misc_feature (1)..( 7): Result.002 file - promoters60/1388808
agttcgg

SEQ ID NO: 109839 - DNA, 7 bp, Unknown
  misc_feature (1)..( 7): Result.002 file - promoters60/1388864
gttagaa

SEQ ID NO: 109840 - DNA, 7 bp, Unknown
  misc_feature (1)..( 7): Result.002 file - promoters60/1388864
gttagaa

SEQ ID NO: 109841 - DNA, 7 bp, Unknown
  misc_feature (1)..( 7): Result.002 file - promoters60/1388864
aaattaa

SEQ ID NO: 109842 - DNA, 7 bp, Unknown
  misc_feature (1)..( 7): Result.002 file - promoters60/1388864
aaattaa

SEQ ID NO: 109843 - DNA, 7 bp, Unknown
  misc_feature (1)..( 7): Result.002 file - promoters60/1388864
ctcagag

SEQ ID NO: 109844 - DNA, 7 bp, Unknown
  misc_feature (1)..( 7): Result.002 file - promoters60/1388864
ctcagaa

SEQ ID NO: 109845 - DNA, 7 bp, Unknown
  misc_feature (1)..( 7): Result.002 file - promoters60/1388864
ctcggaa

SEQ ID NO: 109846 - DNA, 8 bp, Unknown
  misc_feature (1)..( 8): Result.002 file - promoters60/1388864
ttgaaaga

SEQ ID NO: 109847 - DNA, 8 bp, Unknown
  misc_feature (1)..( 8): Result.002 file - promoters60/1388864
ttggaaga

SEQ ID NO: 109848 - DNA, 8 bp, Unknown
  misc_feature (1)..( 8): Result.002 file - promoters60/1388864
agaaaaga

SEQ ID NO: 109849 - DNA, 8 bp, Unknown
  misc_feature (1)..( 8): Result.002 file - promoters60/1388864
agaataga

SEQ ID NO: 109850 - DNA, 7 bp, Unknown
  misc_feature (1)..( 7): Result.002 file - promoters60/1388864
aagaaac

SEQ ID NO: 109851 - DNA, 7 bp, Unknown
  misc_feature (1)..( 7): Result.002 file - promoters60/1388864
aagaaac

SEQ ID NO: 109852 - DNA, 8 bp, Unknown
  misc_feature (1)..( 8): Result.002 file - promoters60/1388864
gaataagt

SEQ ID NO: 109853 - DNA, 8 bp, Unknown
  misc_feature (1)..( 8): Result.002 file - promoters60/1388864
gaaaaagt

SEQ ID NO: 109854 - DNA, 6 bp, Unknown
  misc_feature (1)..( 6): Result.002 file - promoters60/1388864
gttgtg

SEQ ID NO: 109855 - DNA, 6 bp, Unknown
  misc_feature (1)..( 6): Result.002 file - promoters60/1388864
gttgtg

SEQ ID NO: 109856 - DNA, 9 bp, Unknown
  misc_feature (1)..( 9): Result.002 file - promoters60/1388864
gatcaggaa

SEQ ID NO: 109857 - DNA, 9 bp, Unknown
  misc_feature (1)..( 9): Result.002 file - promoters60/1388864
gatctggaa

SEQ ID NO: 109858 - DNA, 8 bp, Unknown
  misc_feature (1)..( 8): Result.002 file - promoters60/1388864
atttggac

SEQ ID NO: 109859 - DNA, 8 bp, Unknown
  misc_feature (1)..( 8): Result.002 file - promoters60/1388864
attttgac

SEQ ID NO: 109860 - DNA, 11 bp, Unknown
  misc_feature (1)..( 11): Result.002 file - promoters60/1388872
atatcatccaa

SEQ ID NO: 109861 - DNA, 11 bp, Unknown
  misc_feature (1)..( 11): Result.002 file - promoters60/1388872
ataacattttt

SEQ ID NO: 109862 - DNA, 11 bp, Unknown
  misc_feature (1)..( 11): Result.002 file - promoters60/1388872
ttaagattttt

SEQ ID NO: 109863 - DNA, 11 bp, Unknown
  misc_feature (1)..( 11): Result.002 file - promoters60/1388872
ttagaattttt

SEQ ID NO: 109864 - DNA, 7 bp, Unknown
  misc_feature (1)..( 7): Result.002 file - promoters60/1388872
aaatatt

SEQ ID NO: 109865 - DNA, 7 bp, Unknown
  misc_feature (1)..( 7): Result.002 file - promoters60/1388872
caatatt

SEQ ID NO: 109866 - DNA, 8 bp, Unknown
  misc_feature (1)..( 8): Result.002 file - promoters60/1388872
aaattatg

SEQ ID NO: 109867 - DNA, 9 bp, Unknown
  misc_feature (1)..( 9): Result.002 file - promoters60/1388872
ataagatta

SEQ ID NO: 109868 - DNA, 9 bp, Unknown
  misc_feature (1)..( 9): Result.002 file - promoters60/1388872
ttaacattc

SEQ ID NO: 109869 - DNA, 9 bp, Unknown
  misc_feature (1)..( 9): Result.002 file - promoters60/1388872
ataatatta

SEQ ID NO: 109870 - DNA, 9 bp, Unknown
  misc_feature (1)..( 9): Result.002 file - promoters60/1388872
aatttggct

SEQ ID NO: 109871 - DNA, 9 bp, Unknown
  misc_feature (1)..( 9): Result.002 file - promoters60/1388872
aatgtggtg

SEQ ID NO: 109872 - DNA, 9 bp, Unknown
  misc_feature (1)..( 9): Result.002 file - promoters60/1388872
aattttgct

SEQ ID NO: 109873 - DNA, 9 bp, Unknown
  misc_feature (1)..( 9): Result.002 file - promoters60/1388872
aattttttt

SEQ ID NO: 109874 - DNA, 7 bp, Unknown
  misc_feature (1)..( 7): Result.002 file - promoters60/1388872
aattttg

SEQ ID NO: 109875 - DNA, 7 bp, Unknown
  misc_feature (1)..( 7): Result.002 file - promoters60/1388872
aattttt

SEQ ID NO: 109876 - DNA, 7 bp, Unknown
  misc_feature (1)..( 7): Result.002 file - promoters60/1388872
aattttt

SEQ ID NO: 109877 - DNA, 7 bp, Unknown
  misc_feature (1)..( 7): Result.002 file - promoters60/1388872
gattttt

SEQ ID NO: 109878 - DNA, 8 bp, Unknown
  misc_feature (1)..( 8): Result.002 file - promoters60/1388872
gtttttgt

SEQ ID NO: 109879 - DNA, 8 bp, Unknown
  misc_feature (1)..( 8): Result.002 file - promoters60/1388872
gttattgt

SEQ ID NO: 109880 - DNA, 8 bp, Unknown
  misc_feature (1)..( 8): Result.002 file - promoters60/1388872
tttaatgt

SEQ ID NO: 109881 - DNA, 7 bp, Unknown
  misc_feature (1)..( 7): Result.002 file - promoters60/1388872
ataaaac

SEQ ID NO: 109882 - DNA, 7 bp, Unknown
  misc_feature (1)..( 7): Result.002 file - promoters60/1388872
ataaaat

SEQ ID NO: 109883 - DNA, 7 bp, Unknown
  misc_feature (1)..( 7): Result.002 file - promoters60/1388872
ttaaaat

SEQ ID NO: 109884 - DNA, 9 bp, Unknown
  misc_feature (1)..( 9): Result.002 file - promoters60/1388872
atcatcttc

SEQ ID NO: 109885 - DNA, 9 bp, Unknown
  misc_feature (1)..( 9): Result.002 file - promoters60/1388872
caaatcttc

SEQ ID NO: 109886 - DNA, 9 bp, Unknown
  misc_feature (1)..( 9): Result.002 file - promoters60/1388872
caaaacttt

SEQ ID NO: 109887 - DNA, 9 bp, Unknown
  misc_feature (1)..( 9): Result.002 file - promoters60/1388872
tttaatcag

SEQ ID NO: 109888 - DNA, 9 bp, Unknown
  misc_feature (1)..( 9): Result.002 file - promoters60/1388872
tttattcag

SEQ ID NO: 109889 - DNA, 9 bp, Unknown
  misc_feature (1)..( 9): Result.002 file - promoters60/1388872
gttattcga

SEQ ID NO: 109890 - DNA, 12 bp, Unknown
  misc_feature (1)..( 12): Result.002 file - promoters60/1388973
ttataaaaccct

SEQ ID NO: 109891 - DNA, 12 bp, Unknown
  misc_feature (1)..( 12): Result.002 file - promoters60/1388973
atataaatccct

SEQ ID NO: 109892 - DNA, 12 bp, Unknown
  misc_feature (1)..( 12): Result.002 file - promoters60/1388973
ttataaataatc

SEQ ID NO: 109893 - DNA, 12 bp, Unknown
  misc_feature (1)..( 12): Result.002 file - promoters60/1388973
ctataaaacttg

SEQ ID NO: 109894 - DNA, 13 bp, Unknown
  misc_feature (1)..( 13): Result.002 file - promoters60/1388973
ttatttaaggccc

SEQ ID NO: 109895 - DNA, 13 bp, Unknown
  misc_feature (1)..( 13): Result.002 file - promoters60/1388973
tatataaagttcc

SEQ ID NO: 109896 - DNA, 12 bp, Unknown
  misc_feature (1)..( 12): Result.002 file - promoters60/1389243
taatttaatatt

SEQ ID NO: 109897 - DNA, 12 bp, Unknown
  misc_feature (1)..( 12): Result.002 file - promoters60/1389243
tcagttaataaa

SEQ ID NO: 109898 - DNA, 12 bp, Unknown
  misc_feature (1)..( 12): Result.002 file - promoters60/1389243
tcttttgataca

SEQ ID NO: 109899 - DNA, 12 bp, Unknown
  misc_feature (1)..( 12): Result.002 file - promoters60/1389243
taatttaatgca

SEQ ID NO: 109900 - DNA, 12 bp, Unknown
  misc_feature (1)..( 12): Result.002 file - promoters60/1389243
ggattaaatata

SEQ ID NO: 109901 - DNA, 12 bp, Unknown
  misc_feature (1)..( 12): Result.002 file - promoters60/1389243
gcacacaatata

SEQ ID NO: 109902 - DNA, 6 bp, Unknown
  misc_feature (1)..( 6): Result.002 file - promoters60/1389279
tctttt

SEQ ID NO: 109903 - DNA, 6 bp, Unknown
  misc_feature (1)..( 6): Result.002 file - promoters60/1389279
tctttt

SEQ ID NO: 109904 - DNA, 12 bp, Unknown
  misc_feature (1)..( 12): Result.002 file - promoters60/1389279
ttttcttatttt

SEQ ID NO: 109905 - DNA, 12 bp, Unknown
  misc_feature (1)..( 12): Result.002 file - promoters60/1389279
ttttcttacttt

SEQ ID NO: 109906 - DNA, 7 bp, Unknown
  misc_feature (1)..( 7): Result.002 file - promoters60/1389279
tggcata

SEQ ID NO: 109907 - DNA, 7 bp, Unknown
  misc_feature (1)..( 7): Result.002 file - promoters60/1389279
tggtata

SEQ ID NO: 109908 - DNA, 7 bp, Unknown
  misc_feature (1)..( 7): Result.002 file - promoters60/1389279
aattttg

SEQ ID NO: 109909 - DNA, 7 bp, Unknown
  misc_feature (1)..( 7): Result.002 file - promoters60/1389279
aattttg

SEQ ID NO: 109910 - DNA, 7 bp, Unknown
  misc_feature (1)..( 7): Result.002 file - promoters60/1389279
caatgta

SEQ ID NO: 109911 - DNA, 7 bp, Unknown
  misc_feature (1)..( 7): Result.002 file - promoters60/1389279
caatgtt

SEQ ID NO: 109912 - DNA, 7 bp, Unknown
  misc_feature (1)..( 7): Result.002 file - promoters60/1389279
gaatgtt

SEQ ID NO: 109913 - DNA, 7 bp, Unknown
  misc_feature (1)..( 7): Result.002 file - promoters60/1389279
ggaaaaa

SEQ ID NO: 109914 - DNA, 7 bp, Unknown
  misc_feature (1)..( 7): Result.002 file - promoters60/1389279
agaaaaa

SEQ ID NO: 109915 - DNA, 8 bp, Unknown
  misc_feature (1)..( 8): Result.002 file - promoters60/1389279
agacaaaa

SEQ ID NO: 109916 - DNA, 7 bp, Unknown
  misc_feature (1)..( 7): Result.002 file - promoters60/1389279
acaaaaa

SEQ ID NO: 109917 - DNA, 7 bp, Unknown
  misc_feature (1)..( 7): Result.002 file - promoters60/1389279
acaaaaa

SEQ ID NO: 109918 - DNA, 7 bp, Unknown
  misc_feature (1)..( 7): Result.002 file - promoters60/1389279
gcaaaaa

SEQ ID NO: 109919 - DNA, 8 bp, Unknown
  misc_feature (1)..( 8): Result.002 file - promoters60/1389279
tatatata

SEQ ID NO: 109920 - DNA, 8 bp, Unknown
  misc_feature (1)..( 8): Result.002 file - promoters60/1389279
tatatata

SEQ ID NO: 109921 - DNA, 8 bp, Unknown
  misc_feature (1)..( 8): Result.002 file - promoters60/1389279
tatatata

SEQ ID NO: 109922 - DNA, 6 bp, Unknown
  misc_feature (1)..( 6): Result.002 file - promoters60/1389279
aaagaa

SEQ ID NO: 109923 - DNA, 6 bp, Unknown
  misc_feature (1)..( 6): Result.002 file - promoters60/1389279
aaagaa

SEQ ID NO: 109924 - DNA, 9 bp, Unknown
  misc_feature (1)..( 9): Result.002 file - promoters60/1389279
atgttccag

SEQ ID NO: 109925 - DNA, 9 bp, Unknown
  misc_feature (1)..( 9): Result.002 file - promoters60/1389279
atgtttcag

SEQ ID NO: 109926 - DNA, 6 bp, Unknown
  misc_feature (1)..( 6): Result.002 file - promoters60/1389279
acaaga

SEQ ID NO: 109927 - DNA, 6 bp, Unknown
  misc_feature (1)..( 6): Result.002 file - promoters60/1389279
acaaga

SEQ ID NO: 109928 - DNA, 9 bp, Unknown
  misc_feature (1)..( 9): Result.002 file - promoters60/1389279
aatacaagt

SEQ ID NO: 109929 - DNA, 9 bp, Unknown
  misc_feature (1)..( 9): Result.002 file - promoters60/1389279
aaaacaagt

SEQ ID NO: 109930 - DNA, 9 bp, Unknown
  misc_feature (1)..( 9): Result.002 file - promoters60/1389279
aaaataagc

SEQ ID NO: 109931 - DNA, 6 bp, Unknown
  misc_feature (1)..( 6): Result.002 file - promoters60/1389279
aaaaaa

SEQ ID NO: 109932 - DNA, 6 bp, Unknown
  misc_feature (1)..( 6): Result.002 file - promoters60/1389279
aaaaaa

SEQ ID NO: 109933 - DNA, 6 bp, Unknown
  misc_feature (1)..( 6): Result.002 file - promoters60/1389279
aacaat

SEQ ID NO: 109934 - DNA, 6 bp, Unknown
  misc_feature (1)..( 6): Result.002 file - promoters60/1389279
aacaat

SEQ ID NO: 109935 - DNA, 8 bp, Unknown
  misc_feature (1)..( 8): Result.002 file - promoters60/1389330
taaataaa

SEQ ID NO: 109936 - DNA, 8 bp, Unknown
  misc_feature (1)..( 8): Result.002 file - promoters60/1389330
taaaaaaa

SEQ ID NO: 109937 - DNA, 7 bp, Unknown
  misc_feature (1)..( 7): Result.002 file - promoters60/1389330
atagtct

SEQ ID NO: 109938 - DNA, 7 bp, Unknown
  misc_feature (1)..( 7): Result.002 file - promoters60/1389330
ataatct

SEQ ID NO: 109939 - DNA, 8 bp, Unknown
  misc_feature (1)..( 8): Result.002 file - promoters60/1389330
aaatattt

SEQ ID NO: 109940 - DNA, 8 bp, Unknown
  misc_feature (1)..( 8): Result.002 file - promoters60/1389330
aaatgttt

SEQ ID NO: 109941 - DNA, 6 bp, Unknown
  misc_feature (1)..( 6): Result.002 file - promoters60/1389330
tttaaa

SEQ ID NO: 109942 - DNA, 6 bp, Unknown
  misc_feature (1)..( 6): Result.002 file - promoters60/1389330
tttaaa

SEQ ID NO: 109943 - DNA, 6 bp, Unknown
  misc_feature (1)..( 6): Result.002 file - promoters60/1389330
tttaaa

SEQ ID NO: 109944 - DNA, 7 bp, Unknown
  misc_feature (1)..( 7): Result.002 file - promoters60/1389330
tgtaatg

SEQ ID NO: 109945 - DNA, 7 bp, Unknown
  misc_feature (1)..( 7): Result.002 file - promoters60/1389330
tgtgatg

SEQ ID NO: 109946 - DNA, 6 bp, Unknown
  misc_feature (1)..( 6): Result.002 file - promoters60/1389330
ccaaaa

SEQ ID NO: 109947 - DNA, 6 bp, Unknown
  misc_feature (1)..( 6): Result.002 file - promoters60/1389330
ccaaaa

SEQ ID NO: 109948 - DNA, 8 bp, Unknown
  misc_feature (1)..( 8): Result.002 file - promoters60/1389330
aaaatgaa

SEQ ID NO: 109949 - DNA, 8 bp, Unknown
  misc_feature (1)..( 8): Result.002 file - promoters60/1389330
aaattgaa

SEQ ID NO: 109950 - DNA, 10 bp, Unknown
  misc_feature (1)..( 10): Result.002 file - promoters60/1389330
acatatctca

SEQ ID NO: 109951 - DNA, 10 bp, Unknown
  misc_feature (1)..( 10): Result.002 file - promoters60/1389330
acatatttca

SEQ ID NO: 109952 - DNA, 7 bp, Unknown
  misc_feature (1)..( 7): Result.002 file - promoters60/1389330
gaaaaat

SEQ ID NO: 109953 - DNA, 7 bp, Unknown
  misc_feature (1)..( 7): Result.002 file - promoters60/1389330
gaataat

SEQ ID NO: 109954 - DNA, 7 bp, Unknown
  misc_feature (1)..( 7): Result.002 file - promoters60/1389330
ttgtcaa

SEQ ID NO: 109955 - DNA, 7 bp, Unknown
  misc_feature (1)..( 7): Result.002 file - promoters60/1389330
ttgacaa

SEQ ID NO: 109956 - DNA, 8 bp, Unknown
  misc_feature (1)..( 8): Result.002 file - promoters60/1389330
aacaataa

SEQ ID NO: 109957 - DNA, 8 bp, Unknown
  misc_feature (1)..( 8): Result.002 file - promoters60/1389330
aactataa

SEQ ID NO: 109958 - DNA, 10 bp, Unknown
  misc_feature (1)..( 10): Result.002 file - promoters60/1389330
gtaacaataa

SEQ ID NO: 109959 - DNA, 10 bp, Unknown
  misc_feature (1)..( 10): Result.002 file - promoters60/1389330
ttaacaataa

SEQ ID NO: 109960 - DNA, 10 bp, Unknown
  misc_feature (1)..( 10): Result.002 file - promoters60/1389330
gtaataatta

SEQ ID NO: 109961 - DNA, 7 bp, Unknown
  misc_feature (1)..( 7): Result.002 file - promoters60/1389330
aaactca

SEQ ID NO: 109962 - DNA, 7 bp, Unknown
  misc_feature (1)..( 7): Result.002 file - promoters60/1389330
aaaatca

SEQ ID NO: 109963 - DNA, 7 bp, Unknown
  misc_feature (1)..( 7): Result.002 file - promoters60/1389330
ctcaaaa

SEQ ID NO: 109964 - DNA, 7 bp, Unknown
  misc_feature (1)..( 7): Result.002 file - promoters60/1389330
ctcaaaa

SEQ ID NO: 109965 - DNA, 7 bp, Unknown
  misc_feature (1)..( 7): Result.002 file - promoters60/1389330
gacaaga

SEQ ID NO: 109966 - DNA, 7 bp, Unknown
  misc_feature (1)..( 7): Result.002 file - promoters60/1389330
gacgaga

SEQ ID NO: 109967 - DNA, 8 bp, Unknown
  misc_feature (1)..( 8): Result.002 file - promoters60/1389330
tttattag

SEQ ID NO: 109968 - DNA, 8 bp, Unknown
  misc_feature (1)..( 8): Result.002 file - promoters60/1389330
tttattag

SEQ ID NO: 109969 - DNA, 10 bp, Unknown
  misc_feature (1)..( 10): Result.002 file - promoters60/1389330
tttttttatt

SEQ ID NO: 109970 - DNA, 10 bp, Unknown
  misc_feature (1)..( 10): Result.002 file - promoters60/1389330
ttttcttatt

SEQ ID NO: 109971 - DNA, 7 bp, Unknown
  misc_feature (1)..( 7): Result.002 file - promoters60/1389330
attaaat

SEQ ID NO: 109972 - DNA, 7 bp, Unknown
  misc_feature (1)..( 7): Result.002 file - promoters60/1389330
atttaat

SEQ ID NO: 109973 - DNA, 7 bp, Unknown
  misc_feature (1)..( 7): Result.002 file - promoters60/1389330
aaatata

SEQ ID NO: 109974 - DNA, 7 bp, Unknown
  misc_feature (1)..( 7): Result.002 file - promoters60/1389330
aaaaata

SEQ ID NO: 109975 - DNA, 6 bp, Unknown
  misc_feature (1)..( 6): Result.002 file - promoters60/1389330
caaaaa

SEQ ID NO: 109976 - DNA, 6 bp, Unknown
  misc_feature (1)..( 6): Result.002 file - promoters60/1389330
caaaaa

SEQ ID NO: 109977 - DNA, 6 bp, Unknown
  misc_feature (1)..( 6): Result.002 file - promoters60/1389330
tagata

SEQ ID NO: 109978 - DNA, 6 bp, Unknown
  misc_feature (1)..( 6): Result.002 file - promoters60/1389330
tagata

SEQ ID NO: 109979 - DNA, 7 bp, Unknown
  misc_feature (1)..( 7): Result.002 file - promoters60/1389330
aattaga

SEQ ID NO: 109980 - DNA, 7 bp, Unknown
  misc_feature (1)..( 7): Result.002 file - promoters60/1389330
aataaga

SEQ ID NO: 109981 - DNA, 10 bp, Unknown
  misc_feature (1)..( 10): Result.002 file - promoters60/1389330
ttaggcccat

SEQ ID NO: 109982 - DNA, 10 bp, Unknown
  misc_feature (1)..( 10): Result.002 file - promoters60/1389330
ttaggcccat

SEQ ID NO: 109983 - DNA, 6 bp, Unknown
  misc_feature (1)..( 6): Result.002 file - promoters60/1389330
ggccca

SEQ ID NO: 109984 - DNA, 6 bp, Unknown
  misc_feature (1)..( 6): Result.002 file - promoters60/1389330
ggccca

SEQ ID NO: 109985 - DNA, 6 bp, Unknown
  misc_feature (1)..( 6): Result.002 file - promoters60/1389330
tctcat

SEQ ID NO: 109986 - DNA, 6 bp, Unknown
  misc_feature (1)..( 6): Result.002 file - promoters60/1389330
tctcat

SEQ ID NO: 109987 - DNA, 8 bp, Unknown
  misc_feature (1)..( 8): Result.002 file - promoters60/1389330
ttgtaacc

SEQ ID NO: 109988 - DNA, 8 bp, Unknown
  misc_feature (1)..( 8): Result.002 file - promoters60/1389330
ttgttacc

SEQ ID NO: 109989 - DNA, 9 bp, Unknown
  misc_feature (1)..( 9): Result.002 file - promoters60/1389330
tgtaacaaa

SEQ ID NO: 109990 - DNA, 9 bp, Unknown
  misc_feature (1)..( 9): Result.002 file - promoters60/1389330
tgtaccaaa

SEQ ID NO: 109991 - DNA, 6 bp, Unknown
  misc_feature (1)..( 6): Result.002 file - promoters60/1389330
tatttt

SEQ ID NO: 109992 - DNA, 6 bp, Unknown
  misc_feature (1)..( 6): Result.002 file - promoters60/1389330
tatttt

SEQ ID NO: 109993 - DNA, 7 bp, Unknown
  misc_feature (1)..( 7): Result.002 file - promoters60/1389330
aagatat

SEQ ID NO: 109994 - DNA, 7 bp, Unknown
  misc_feature (1)..( 7): Result.002 file - promoters60/1389330
aagatat

SEQ ID NO: 109995 - DNA, 6 bp, Unknown
  misc_feature (1)..( 6): Result.002 file - promoters60/1389330
catcat

SEQ ID NO: 109996 - DNA, 6 bp, Unknown
  misc_feature (1)..( 6): Result.002 file - promoters60/1389330
catcat

SEQ ID NO: 109997 - DNA, 11 bp, Unknown
  misc_feature (1)..( 11): Result.002 file - promoters60/1390240
gaaaaaaagtt

SEQ ID NO: 109998 - DNA, 11 bp, Unknown
  misc_feature (1)..( 11): Result.002 file - promoters60/1390240
gaaaaaagttt

SEQ ID NO: 109999 - DNA, 12 bp, Unknown
  misc_feature (1)..( 12): Result.002 file - promoters60/1390240
caaacaaatcaa

SEQ ID NO: 110000 - DNA, 12 bp, Unknown
  misc_feature (1)..( 12): Result.002 file - promoters60/1390240
caaagaaaggtc

SEQ ID NO: 110001 - DNA, 12 bp, Unknown
  misc_feature (1)..( 12): Result.002 file - promoters60/1390240
caaaaaattact

SEQ ID NO: 110002 - DNA, 12 bp, Unknown
  misc_feature (1)..( 12): Result.002 file - promoters60/1390240
ccggaaaattta

SEQ ID NO: 110003 - DNA, 12 bp, Unknown
  misc_feature (1)..( 12): Result.002 file - promoters60/1390240
tcattaatcctt

SEQ ID NO: 110004 - DNA, 7 bp, Unknown
  misc_feature (1)..( 7): Result.002 file - promoters60/1390376
ttccctt

SEQ ID NO: 110005 - DNA, 7 bp, Unknown
  misc_feature (1)..( 7): Result.002 file - promoters60/1390376
ttcgctt

SEQ ID NO: 110006 - DNA, 6 bp, Unknown
  misc_feature (1)..( 6): Result.002 file - promoters60/1390376
ctttct

SEQ ID NO: 110007 - DNA, 6 bp, Unknown
  misc_feature (1)..( 6): Result.002 file - promoters60/1390376
ctttct

SEQ ID NO: 110008 - DNA, 6 bp, Unknown
  misc_feature (1)..( 6): Result.002 file - promoters60/1390376
ttctct

SEQ ID NO: 110009 - DNA, 6 bp, Unknown
  misc_feature (1)..( 6): Result.002 file - promoters60/1390376
ttctct

SEQ ID NO: 110010 - DNA, 6 bp, Unknown
  misc_feature (1)..( 6): Result.002 file - promoters60/1390376
ttctat

SEQ ID NO: 110011 - DNA, 6 bp, Unknown
  misc_feature (1)..( 6): Result.002 file - promoters60/1390376
ttctat

SEQ ID NO: 110012 - DNA, 7 bp, Unknown
  misc_feature (1)..( 7): Result.002 file - promoters60/1390376
tatctat

SEQ ID NO: 110013 - DNA, 7 bp, Unknown
  misc_feature (1)..( 7): Result.002 file - promoters60/1390376
tatctat

SEQ ID NO: 110014 - DNA, 7 bp, Unknown
  misc_feature (1)..( 7): Result.002 file - promoters60/1390376
atagtgt

SEQ ID NO: 110015 - DNA, 7 bp, Unknown
  misc_feature (1)..( 7): Result.002 file - promoters60/1390376
atattgt

SEQ ID NO: 110016 - DNA, 6 bp, Unknown
  misc_feature (1)..( 6): Result.002 file - promoters60/1390376
aacttg

SEQ ID NO: 110017 - DNA, 6 bp, Unknown
  misc_feature (1)..( 6): Result.002 file - promoters60/1390376
aacttg

SEQ ID NO: 110018 - DNA, 6 bp, Unknown
  misc_feature (1)..( 6): Result.002 file - promoters60/1390376
tcatat

SEQ ID NO: 110019 - DNA, 6 bp, Unknown
  misc_feature (1)..( 6): Result.002 file - promoters60/1390376
tcatat

SEQ ID NO: 110020 - DNA, 7 bp, Unknown
  misc_feature (1)..( 7): Result.002 file - promoters60/1390376
ttatgta

SEQ ID NO: 110021 - DNA, 7 bp, Unknown
  misc_feature (1)..( 7): Result.002 file - promoters60/1390376
ttacgta

SEQ ID NO: 110022 - DNA, 7 bp, Unknown
  misc_feature (1)..( 7): Result.002 file - promoters60/1390376
ctggtta

SEQ ID NO: 110023 - DNA, 7 bp, Unknown
  misc_feature (1)..( 7): Result.002 file - promoters60/1390376
ctgatta

SEQ ID NO: 110024 - DNA, 6 bp, Unknown
  misc_feature (1)..( 6): Result.002 file - promoters60/1390376
atcatt

SEQ ID NO: 110025 - DNA, 6 bp, Unknown
  misc_feature (1)..( 6): Result.002 file - promoters60/1390376
atcatt

SEQ ID NO: 110026 - DNA, 11 bp, Unknown
  misc_feature (1)..( 11): Result.002 file - promoters60/1390376
ttactgaagtt

SEQ ID NO: 110027 - DNA, 11 bp, Unknown
  misc_feature (1)..( 11): Result.002 file - promoters60/1390376
ttagtgatgtt

SEQ ID NO: 110028 - DNA, 7 bp, Unknown
  misc_feature (1)..( 7): Result.002 file - promoters60/1390376
ttttcat

SEQ ID NO: 110029 - DNA, 7 bp, Unknown
  misc_feature (1)..( 7): Result.002 file - promoters60/1390376
tttccat

SEQ ID NO: 110030 - DNA, 8 bp, Unknown
  misc_feature (1)..( 8): Result.002 file - promoters60/1390376
atcttgtg

SEQ ID NO: 110031 - DNA, 8 bp, Unknown
  misc_feature (1)..( 8): Result.002 file - promoters60/1390376
atctcgtg

SEQ ID NO: 110032 - DNA, 10 bp, Unknown
  misc_feature (1)..( 10): Result.002 file - promoters60/1391420
tgagaagatt

SEQ ID NO: 110033 - DNA, 10 bp, Unknown
  misc_feature (1)..( 10): Result.002 file - promoters60/1391420
aagaaagatt

SEQ ID NO: 110034 - DNA, 10 bp, Unknown
  misc_feature (1)..( 10): Result.002 file - promoters60/1391420
aagaaagatt

SEQ ID NO: 110035 - DNA, 10 bp, Unknown
  misc_feature (1)..( 10): Result.002 file - promoters60/1391420
ctagaagatt

SEQ ID NO: 110036 - DNA, 10 bp, Unknown
  misc_feature (1)..( 10): Result.002 file - promoters60/1391420
gagaaaaaaa

SEQ ID NO: 110037 - DNA, 10 bp, Unknown
  misc_feature (1)..( 10): Result.002 file - promoters60/1391420
gaataagaaa

SEQ ID NO: 110038 - DNA, 12 bp, Unknown
  misc_feature (1)..( 12): Result.002 file - promoters60/1391420
tgattagatttt

SEQ ID NO: 110039 - DNA, 12 bp, Unknown
  misc_feature (1)..( 12): Result.002 file - promoters60/1391420
aagaaagatttg

SEQ ID NO: 110040 - DNA, 12 bp, Unknown
  misc_feature (1)..( 12): Result.002 file - promoters60/1391420
ctagaagatttt

SEQ ID NO: 110041 - DNA, 12 bp, Unknown
  misc_feature (1)..( 12): Result.002 file - promoters60/1391420
ggatatgatttt

SEQ ID NO: 110042 - DNA, 12 bp, Unknown
  misc_feature (1)..( 12): Result.002 file - promoters60/1391420
aagaaagattct

SEQ ID NO: 110043 - DNA, 13 bp, Unknown
  misc_feature (1)..( 13): Result.002 file - promoters60/1391420
attaggctttaat

SEQ ID NO: 110044 - DNA, 13 bp, Unknown
  misc_feature (1)..( 13): Result.002 file - promoters60/1391420
aatgggctttagt

SEQ ID NO: 110045 - DNA, 13 bp, Unknown
  misc_feature (1)..( 13): Result.002 file - promoters60/1391420
attgggcttggcc

SEQ ID NO: 110046 - DNA, 13 bp, Unknown
  misc_feature (1)..( 13): Result.002 file - promoters60/1391420
tttgggccaactt

SEQ ID NO: 110047 - DNA, 13 bp, Unknown
  misc_feature (1)..( 13): Result.002 file - promoters60/1391420
aatgggctgggcc

SEQ ID NO: 110048 - DNA, 8 bp, Unknown
  misc_feature (1)..( 8): Result.002 file - promoters60/1391420
aatgggcc

SEQ ID NO: 110049 - DNA, 8 bp, Unknown
  misc_feature (1)..( 8): Result.002 file - promoters60/1391420
tttgggcc

SEQ ID NO: 110050 - DNA, 8 bp, Unknown
  misc_feature (1)..( 8): Result.002 file - promoters60/1391420
aatgggct

SEQ ID NO: 110051 - DNA, 8 bp, Unknown
  misc_feature (1)..( 8): Result.002 file - promoters60/1391420
aatgggct

SEQ ID NO: 110052 - DNA, 8 bp, Unknown
  misc_feature (1)..( 8): Result.002 file - promoters60/1391420
attgggct

SEQ ID NO: 110053 - DNA, 9 bp, Unknown
  misc_feature (1)..( 9): Result.002 file - promoters60/1391420
cgaaaaaag

SEQ ID NO: 110054 - DNA, 9 bp, Unknown
  misc_feature (1)..( 9): Result.002 file - promoters60/1391420
agaagaaag

SEQ ID NO: 110055 - DNA, 9 bp, Unknown
  misc_feature (1)..( 9): Result.002 file - promoters60/1391420
agaaaaaaa

SEQ ID NO: 110056 - DNA, 9 bp, Unknown
  misc_feature (1)..( 9): Result.002 file - promoters60/1391420
agaagattt

SEQ ID NO: 110057 - DNA, 9 bp, Unknown
  misc_feature (1)..( 9): Result.002 file - promoters60/1391420
ataagaaac

SEQ ID NO: 110058 - DNA, 9 bp, Unknown
  misc_feature (1)..( 9): Result.002 file - promoters60/1391420
ttaacaaaa

SEQ ID NO: 110059 - DNA, 9 bp, Unknown
  misc_feature (1)..( 9): Result.002 file - promoters60/1391420
gtaaaaaaa

SEQ ID NO: 110060 - DNA, 9 bp, Unknown
  misc_feature (1)..( 9): Result.002 file - promoters60/1391420
gtaaaaggt

SEQ ID NO: 110061 - DNA, 9 bp, Unknown
  misc_feature (1)..( 9): Result.002 file - promoters60/1391420
ccaaataaa

SEQ ID NO: 110062 - DNA, 9 bp, Unknown
  misc_feature (1)..( 9): Result.002 file - promoters60/1391420
tcaattaat

SEQ ID NO: 110063 - DNA, 7 bp, Unknown
  misc_feature (1)..( 7): Result.002 file - promoters60/1393104
ttagcct

SEQ ID NO: 110064 - DNA, 7 bp, Unknown
  misc_feature (1)..( 7): Result.002 file - promoters60/1393104
ttaccct

SEQ ID NO: 110065 - DNA, 6 bp, Unknown
  misc_feature (1)..( 6): Result.002 file - promoters60/1393104
taaccg

SEQ ID NO: 110066 - DNA, 6 bp, Unknown
  misc_feature (1)..( 6): Result.002 file - promoters60/1393104
taaccg

SEQ ID NO: 110067 - DNA, 6 bp, Unknown
  misc_feature (1)..( 6): Result.002 file - promoters60/1393104
gttaaa

SEQ ID NO: 110068 - DNA, 6 bp, Unknown
  misc_feature (1)..( 6): Result.002 file - promoters60/1393104
gttaaa

SEQ ID NO: 110069 - DNA, 7 bp, Unknown
  misc_feature (1)..( 7): Result.002 file - promoters60/1393104
caaagtc

SEQ ID NO: 110070 - DNA, 7 bp, Unknown
  misc_feature (1)..( 7): Result.002 file - promoters60/1393104
caatgtc

SEQ ID NO: 110071 - DNA, 8 bp, Unknown
  misc_feature (1)..( 8): Result.002 file - promoters60/1393104
atattttc

SEQ ID NO: 110072 - DNA, 8 bp, Unknown
  misc_feature (1)..( 8): Result.002 file - promoters60/1393104
atatcttc

SEQ ID NO: 110073 - DNA, 6 bp, Unknown
  misc_feature (1)..( 6): Result.002 file - promoters60/1393104
gagata

SEQ ID NO: 110074 - DNA, 6 bp, Unknown
  misc_feature (1)..( 6): Result.002 file - promoters60/1393104
gagata

SEQ ID NO: 110075 - DNA, 7 bp, Unknown
  misc_feature (1)..( 7): Result.002 file - promoters60/1393104
atgtggt

SEQ ID NO: 110076 - DNA, 7 bp, Unknown
  misc_feature (1)..( 7): Result.002 file - promoters60/1393104
atgtgga

SEQ ID NO: 110077 - DNA, 7 bp, Unknown
  misc_feature (1)..( 7): Result.002 file - promoters60/1393104
atgagga

SEQ ID NO: 110078 - DNA, 7 bp, Unknown
  misc_feature (1)..( 7): Result.002 file - promoters60/1393104
agctaat

SEQ ID NO: 110079 - DNA, 7 bp, Unknown
  misc_feature (1)..( 7): Result.002 file - promoters60/1393104
agcaaat

SEQ ID NO: 110080 - DNA, 6 bp, Unknown
  misc_feature (1)..( 6): Result.002 file - promoters60/1393104
aatgct

SEQ ID NO: 110081 - DNA, 6 bp, Unknown
  misc_feature (1)..( 6): Result.002 file - promoters60/1393104
aatgct

SEQ ID NO: 110082 - DNA, 7 bp, Unknown
  misc_feature (1)..( 7): Result.002 file - promoters60/1393104
caatcta

SEQ ID NO: 110083 - DNA, 7 bp, Unknown
  misc_feature (1)..( 7): Result.002 file - promoters60/1393104
caatcta

SEQ ID NO: 110084 - DNA, 8 bp, Unknown
  misc_feature (1)..( 8): Result.002 file - promoters60/1393104
atttcaaa

SEQ ID NO: 110085 - DNA, 8 bp, Unknown
  misc_feature (1)..( 8): Result.002 file - promoters60/1393104
atttcaaa

SEQ ID NO: 110086 - DNA, 8 bp, Unknown
  misc_feature (1)..( 8): Result.002 file - promoters60/1393104
tttgggaa

SEQ ID NO: 110087 - DNA, 8 bp, Unknown
  misc_feature (1)..( 8): Result.002 file - promoters60/1393104
tttgcgaa

SEQ ID NO: 110088 - DNA, 10 bp, Unknown
  misc_feature (1)..( 10): Result.002 file - promoters60/1393104
ttcaagaaga

SEQ ID NO: 110089 - DNA, 10 bp, Unknown
  misc_feature (1)..( 10): Result.002 file - promoters60/1393104
ttcaagaaga

SEQ ID NO: 110090 - DNA, 6 bp, Unknown
  misc_feature (1)..( 6): Result.002 file - promoters60/1393104
cgttga

SEQ ID NO: 110091 - DNA, 6 bp, Unknown
  misc_feature (1)..( 6): Result.002 file - promoters60/1393104
cgttga

SEQ ID NO: 110092 - DNA, 9 bp, Unknown
  misc_feature (1)..( 9): Result.002 file - promoters60/1393104
aatcaagat

SEQ ID NO: 110093 - DNA, 9 bp, Unknown
  misc_feature (1)..( 9): Result.002 file - promoters60/1393104
aataaagat

SEQ ID NO: 110094 - DNA, 9 bp, Unknown
  misc_feature (1)..( 9): Result.002 file - promoters60/1393139
tagattacc

SEQ ID NO: 110095 - DNA, 9 bp, Unknown
  misc_feature (1)..( 9): Result.002 file - promoters60/1393139
tagatttgg

SEQ ID NO: 110096 - DNA, 9 bp, Unknown
  misc_feature (1)..( 9): Result.002 file - promoters60/1393139
aagatttga

SEQ ID NO: 110097 - DNA, 9 bp, Unknown
  misc_feature (1)..( 9): Result.002 file - promoters60/1393139
acaatttga

SEQ ID NO: 110098 - DNA, 7 bp, Unknown
  misc_feature (1)..( 7): Result.002 file - promoters60/1393139
cttcatt

SEQ ID NO: 110099 - DNA, 7 bp, Unknown
  misc_feature (1)..( 7): Result.002 file - promoters60/1393139
cttcatc

SEQ ID NO: 110100 - DNA, 7 bp, Unknown
  misc_feature (1)..( 7): Result.002 file - promoters60/1393139
ctttatt

SEQ ID NO: 110101 - DNA, 7 bp, Unknown
  misc_feature (1)..( 7): Result.002 file - promoters60/1393139
atttatt

SEQ ID NO: 110102 - DNA, 13 bp, Unknown
  misc_feature (1)..( 13): Result.002 file - promoters60/1393139
tctacttttggta

SEQ ID NO: 110103 - DNA, 13 bp, Unknown
  misc_feature (1)..( 13): Result.002 file - promoters60/1393139
tcttcttttgtca

SEQ ID NO: 110104 - DNA, 13 bp, Unknown
  misc_feature (1)..( 13): Result.002 file - promoters60/1393139
ttaactttttagt

SEQ ID NO: 110105 - DNA, 13 bp, Unknown
  misc_feature (1)..( 13): Result.002 file - promoters60/1393139
ataacttttgagt

SEQ ID NO: 110106 - DNA, 11 bp, Unknown
  misc_feature (1)..( 11): Result.002 file - promoters60/1393139
gatacaatacc

SEQ ID NO: 110107 - DNA, 11 bp, Unknown
  misc_feature (1)..( 11): Result.002 file - promoters60/1393139
aataaaatacg

SEQ ID NO: 110108 - DNA, 11 bp, Unknown
  misc_feature (1)..( 11): Result.002 file - promoters60/1393139
aataaaagcca

SEQ ID NO: 110109 - DNA, 11 bp, Unknown
  misc_feature (1)..( 11): Result.002 file - promoters60/1393139
tttcaaagacg

SEQ ID NO: 110110 - DNA, 11 bp, Unknown
  misc_feature (1)..( 11): Result.002 file - promoters60/1393139
aatacaagttg

SEQ ID NO: 110111 - DNA, 12 bp, Unknown
  misc_feature (1)..( 12): Result.002 file - promoters60/1393139
tttatagaaaga

SEQ ID NO: 110112 - DNA, 12 bp, Unknown
  misc_feature (1)..( 12): Result.002 file - promoters60/1393139
tttatagaaaaa

SEQ ID NO: 110113 - DNA, 12 bp, Unknown
  misc_feature (1)..( 12): Result.002 file - promoters60/1393139
tttatatattag

SEQ ID NO: 110114 - DNA, 12 bp, Unknown
  misc_feature (1)..( 12): Result.002 file - promoters60/1393139
cgcaaagaaaat

SEQ ID NO: 110115 - DNA, 12 bp, Unknown
  misc_feature (1)..( 12): Result.002 file - promoters60/1393139
ataaaagaaaat

SEQ ID NO: 110116 - DNA, 10 bp, Unknown
  misc_feature (1)..( 10): Result.002 file - promoters60/1393139
agaataataa

SEQ ID NO: 110117 - DNA, 10 bp, Unknown
  misc_feature (1)..( 10): Result.002 file - promoters60/1393139
aagttaataa

SEQ ID NO: 110118 - DNA, 10 bp, Unknown
  misc_feature (1)..( 10): Result.002 file - promoters60/1393139
tgaataataa

SEQ ID NO: 110119 - DNA, 10 bp, Unknown
  misc_feature (1)..( 10): Result.002 file - promoters60/1393139
tgagtaatga

SEQ ID NO: 110120 - DNA, 8 bp, Unknown
  misc_feature (1)..( 8): Result.002 file - promoters60/1393181
tcactaat

SEQ ID NO: 110121 - DNA, 8 bp, Unknown
  misc_feature (1)..( 8): Result.002 file - promoters60/1393181
taactaat

SEQ ID NO: 110122 - DNA, 8 bp, Unknown
  misc_feature (1)..( 8): Result.002 file - promoters60/1393181
ctactata

SEQ ID NO: 110123 - DNA, 16 bp, Unknown
  misc_feature (1)..( 16): Result.002 file - promoters60/1393181
attaaaaaaaaaatct

SEQ ID NO: 110124 - DNA, 16 bp, Unknown
  misc_feature (1)..( 16): Result.002 file - promoters60/1393181
attataaaaaaagtct

SEQ ID NO: 110125 - DNA, 16 bp, Unknown
  misc_feature (1)..( 16): Result.002 file - promoters60/1393181
taaaaaaaaaaaaaaa

SEQ ID NO: 110126 - DNA, 8 bp, Unknown
  misc_feature (1)..( 8): Result.002 file - promoters60/1393181
aaattttt

SEQ ID NO: 110127 - DNA, 8 bp, Unknown
  misc_feature (1)..( 8): Result.002 file - promoters60/1393181
aaatcttt

SEQ ID NO: 110128 - DNA, 8 bp, Unknown
  misc_feature (1)..( 8): Result.002 file - promoters60/1393181
ttttaaat

SEQ ID NO: 110129 - DNA, 8 bp, Unknown
  misc_feature (1)..( 8): Result.002 file - promoters60/1393181
tttaaaat

SEQ ID NO: 110130 - DNA, 9 bp, Unknown
  misc_feature (1)..( 9): Result.002 file - promoters60/1393181
tttgtaatg

SEQ ID NO: 110131 - DNA, 7 bp, Unknown
  misc_feature (1)..( 7): Result.002 file - promoters60/1393181
tattatt

SEQ ID NO: 110132 - DNA, 7 bp, Unknown
  misc_feature (1)..( 7): Result.002 file - promoters60/1393181
tataatt

SEQ ID NO: 110133 - DNA, 9 bp, Unknown
  misc_feature (1)..( 9): Result.002 file - promoters60/1393181
ttacctaaa

SEQ ID NO: 110134 - DNA, 9 bp, Unknown
  misc_feature (1)..( 9): Result.002 file - promoters60/1393181
ttacccaaa

SEQ ID NO: 110135 - DNA, 7 bp, Unknown
  misc_feature (1)..( 7): Result.002 file - promoters60/1393181
ctatctt

SEQ ID NO: 110136 - DNA, 7 bp, Unknown
  misc_feature (1)..( 7): Result.002 file - promoters60/1393181
ctatctt

SEQ ID NO: 110137 - DNA, 9 bp, Unknown
  misc_feature (1)..( 9): Result.002 file - promoters60/1393181
ttcttttta

SEQ ID NO: 110138 - DNA, 9 bp, Unknown
  misc_feature (1)..( 9): Result.002 file - promoters60/1393181
ttcttttta

SEQ ID NO: 110139 - DNA, 8 bp, Unknown
  misc_feature (1)..( 8): Result.002 file - promoters60/1393181
aaagatgt

SEQ ID NO: 110140 - DNA, 8 bp, Unknown
  misc_feature (1)..( 8): Result.002 file - promoters60/1393181
aaatatgt

SEQ ID NO: 110141 - DNA, 7 bp, Unknown
  misc_feature (1)..( 7): Result.002 file - promoters60/1393181
accagct

SEQ ID NO: 110142 - DNA, 7 bp, Unknown
  misc_feature (1)..( 7): Result.002 file - promoters60/1393181
accagct

SEQ ID NO: 110143 - DNA, 11 bp, Unknown
  misc_feature (1)..( 11): Result.002 file - promoters60/1393181
tcaacctctct

SEQ ID NO: 110144 - DNA, 11 bp, Unknown
  misc_feature (1)..( 11): Result.002 file - promoters60/1393181
tcaccctctct

SEQ ID NO: 110145 - DNA, 6 bp, Unknown
  misc_feature (1)..( 6): Result.002 file - promoters60/1393181
caatta

SEQ ID NO: 110146 - DNA, 6 bp, Unknown
  misc_feature (1)..( 6): Result.002 file - promoters60/1393181
caatta

SEQ ID NO: 110147 - DNA, 6 bp, Unknown
  misc_feature (1)..( 6): Result.002 file - promoters60/1393181
ggtttt

SEQ ID NO: 110148 - DNA, 6 bp, Unknown
  misc_feature (1)..( 6): Result.002 file - promoters60/1393181
ggtttt

SEQ ID NO: 110149 - DNA, 7 bp, Unknown
  misc_feature (1)..( 7): Result.002 file - promoters60/1393181
ttttgtc

SEQ ID NO: 110150 - DNA, 7 bp, Unknown
  misc_feature (1)..( 7): Result.002 file - promoters60/1393181
ttttgtc

SEQ ID NO: 110151 - DNA, 7 bp, Unknown
  misc_feature (1)..( 7): Result.002 file - promoters60/1393181
agatgat

SEQ ID NO: 110152 - DNA, 7 bp, Unknown
  misc_feature (1)..( 7): Result.002 file - promoters60/1393181
agaggat

SEQ ID NO: 110153 - DNA, 7 bp, Unknown
  misc_feature (1)..( 7): Result.002 file - promoters60/1393181
ttacaag

SEQ ID NO: 110154 - DNA, 7 bp, Unknown
  misc_feature (1)..( 7): Result.002 file - promoters60/1393181
ttataag

SEQ ID NO: 110155 - DNA, 8 bp, Unknown
  misc_feature (1)..( 8): Result.002 file - promoters60/1393181
caagatta

SEQ ID NO: 110156 - DNA, 8 bp, Unknown
  misc_feature (1)..( 8): Result.002 file - promoters60/1393181
caaaatta

SEQ ID NO: 110157 - DNA, 9 bp, Unknown
  misc_feature (1)..( 9): Result.002 file - promoters60/1393181
taaataaat

SEQ ID NO: 110158 - DNA, 9 bp, Unknown
  misc_feature (1)..( 9): Result.002 file - promoters60/1393181
taaataaat

SEQ ID NO: 110159 - DNA, 15 bp, Unknown
  misc_feature (1)..( 15): Result.002 file - promoters60/1393187
taatgcatgtgatgc

SEQ ID NO: 110160 - DNA, 15 bp, Unknown
  misc_feature (1)..( 15): Result.002 file - promoters60/1393187
taatgcatgtgatgc

SEQ ID NO: 110161 - DNA, 7 bp, Unknown
  misc_feature (1)..( 7): Result.002 file - promoters60/1393187
caatttt

SEQ ID NO: 110162 - DNA, 7 bp, Unknown
  misc_feature (1)..( 7): Result.002 file - promoters60/1393187
caacttt

SEQ ID NO: 110163 - DNA, 7 bp, Unknown
  misc_feature (1)..( 7): Result.002 file - promoters60/1393187
aattttg

SEQ ID NO: 110164 - DNA, 7 bp, Unknown
  misc_feature (1)..( 7): Result.002 file - promoters60/1393187
aattttg

SEQ ID NO: 110165 - DNA, 6 bp, Unknown
  misc_feature (1)..( 6): Result.002 file - promoters60/1393187
atcaac

SEQ ID NO: 110166 - DNA, 6 bp, Unknown
  misc_feature (1)..( 6): Result.002 file - promoters60/1393187
atcaac

SEQ ID NO: 110167 - DNA, 8 bp, Unknown
  misc_feature (1)..( 8): Result.002 file - promoters60/1393187
actaaatc

SEQ ID NO: 110168 - DNA, 8 bp, Unknown
  misc_feature (1)..( 8): Result.002 file - promoters60/1393187
aataaatc

SEQ ID NO: 110169 - DNA, 8 bp, Unknown
  misc_feature (1)..( 8): Result.002 file - promoters60/1393187
aataaata

SEQ ID NO: 110170 - DNA, 7 bp, Unknown
  misc_feature (1)..( 7): Result.002 file - promoters60/1393187
aactaag

SEQ ID NO: 110171 - DNA, 7 bp, Unknown
  misc_feature (1)..( 7): Result.002 file - promoters60/1393187
aactaaa

SEQ ID NO: 110172 - DNA, 7 bp, Unknown
  misc_feature (1)..( 7): Result.002 file - promoters60/1393187
gactaaa

SEQ ID NO: 110173 - DNA, 6 bp, Unknown
  misc_feature (1)..( 6): Result.002 file - promoters60/1393187
tttttt

SEQ ID NO: 110174 - DNA, 6 bp, Unknown
  misc_feature (1)..( 6): Result.002 file - promoters60/1393187
tttttt

SEQ ID NO: 110175 - DNA, 7 bp, Unknown
  misc_feature (1)..( 7): Result.002 file - promoters60/1393187
aattatt

SEQ ID NO: 110176 - DNA, 7 bp, Unknown
  misc_feature (1)..( 7): Result.002 file - promoters60/1393187
aattatt

SEQ ID NO: 110177 - DNA, 6 bp, Unknown
  misc_feature (1)..( 6): Result.002 file - promoters60/1393187
attatt

SEQ ID NO: 110178 - DNA, 6 bp, Unknown
  misc_feature (1)..( 6): Result.002 file - promoters60/1393187
attatt

SEQ ID NO: 110179 - DNA, 9 bp, Unknown
  misc_feature (1)..( 9): Result.002 file - promoters60/1393187
attagtcga

SEQ ID NO: 110180 - DNA, 9 bp, Unknown
  misc_feature (1)..( 9): Result.002 file - promoters60/1393187
attattcga

SEQ ID NO: 110181 - DNA, 7 bp, Unknown
  misc_feature (1)..( 7): Result.002 file - promoters60/1393187
taaaaga

SEQ ID NO: 110182 - DNA, 7 bp, Unknown
  misc_feature (1)..( 7): Result.002 file - promoters60/1393187
taaaagg

SEQ ID NO: 110183 - DNA, 7 bp, Unknown
  misc_feature (1)..( 7): Result.002 file - promoters60/1393187
aaaaaga

SEQ ID NO: 110184 - DNA, 9 bp, Unknown
  misc_feature (1)..( 9): Result.002 file - promoters60/1393187
aaaaaagaa

SEQ ID NO: 110185 - DNA, 9 bp, Unknown
  misc_feature (1)..( 9): Result.002 file - promoters60/1393187
aaaaaaaga

SEQ ID NO: 110186 - DNA, 10 bp, Unknown
  misc_feature (1)..( 10): Result.002 file - promoters60/1393187
aaagaaagaa

SEQ ID NO: 110187 - DNA, 6 bp, Unknown
  misc_feature (1)..( 6): Result.002 file - promoters60/1393187
tggatt

SEQ ID NO: 110188 - DNA, 6 bp, Unknown
  misc_feature (1)..( 6): Result.002 file - promoters60/1393187
tggatt

SEQ ID NO: 110189 - DNA, 6 bp, Unknown
  misc_feature (1)..( 6): Result.002 file - promoters60/1393187
gatttt

SEQ ID NO: 110190 - DNA, 6 bp, Unknown
  misc_feature (1)..( 6): Result.002 file - promoters60/1393187
gatttt

SEQ ID NO: 110191 - DNA, 6 bp, Unknown
  misc_feature (1)..( 6): Result.002 file - promoters60/1393187
cacgtg

SEQ ID NO: 110192 - DNA, 6 bp, Unknown
  misc_feature (1)..( 6): Result.002 file - promoters60/1393187
cacgtg

SEQ ID NO: 110193 - DNA, 7 bp, Unknown
  misc_feature (1)..( 7): Result.002 file - promoters60/1393187
aataaat

SEQ ID NO: 110194 - DNA, 7 bp, Unknown
  misc_feature (1)..( 7): Result.002 file - promoters60/1393187
aatcaat

SEQ ID NO: 110195 - DNA, 8 bp, Unknown
  misc_feature (1)..( 8): Result.002 file - promoters60/1393187
atttgaat

SEQ ID NO: 110196 - DNA, 8 bp, Unknown
  misc_feature (1)..( 8): Result.002 file - promoters60/1393187
atttaaat

SEQ ID NO: 110197 - DNA, 8 bp, Unknown
  misc_feature (1)..( 8): Result.002 file - promoters60/1393187
atttgaat

SEQ ID NO: 110198 - DNA, 6 bp, Unknown
  misc_feature (1)..( 6): Result.002 file - promoters60/1393187
aaattt

SEQ ID NO: 110199 - DNA, 6 bp, Unknown
  misc_feature (1)..( 6): Result.002 file - promoters60/1393187
aaattt

SEQ ID NO: 110200 - DNA, 6 bp, Unknown
  misc_feature (1)..( 6): Result.002 file - promoters60/1393187
aaattt

SEQ ID NO: 110201 - DNA, 8 bp, Unknown
  misc_feature (1)..( 8): Result.002 file - promoters60/1393187
ggactaat

SEQ ID NO: 110202 - DNA, 8 bp, Unknown
  misc_feature (1)..( 8): Result.002 file - promoters60/1393187
ggactaaa

SEQ ID NO: 110203 - DNA, 8 bp, Unknown
  misc_feature (1)..( 8): Result.002 file - promoters60/1393187
caactaaa

SEQ ID NO: 110204 - DNA, 7 bp, Unknown
  misc_feature (1)..( 7): Result.002 file - promoters60/1393187
aaatttt

SEQ ID NO: 110205 - DNA, 7 bp, Unknown
  misc_feature (1)..( 7): Result.002 file - promoters60/1393187
aaatttt

SEQ ID NO: 110206 - DNA, 7 bp, Unknown
  misc_feature (1)..( 7): Result.002 file - promoters60/1393187
ataaaag

SEQ ID NO: 110207 - DNA, 7 bp, Unknown
  misc_feature (1)..( 7): Result.002 file - promoters60/1393187
atataag

SEQ ID NO: 110208 - DNA, 7 bp, Unknown
  misc_feature (1)..( 7): Result.002 file - promoters60/1393187
ataaaag

SEQ ID NO: 110209 - DNA, 6 bp, Unknown
  misc_feature (1)..( 6): Result.002 file - promoters60/1393187
ctatta

SEQ ID NO: 110210 - DNA, 6 bp, Unknown
  misc_feature (1)..( 6): Result.002 file - promoters60/1393187
ctatta

SEQ ID NO: 110211 - DNA, 7 bp, Unknown
  misc_feature (1)..( 7): Result.002 file - promoters60/1393187
gactaat

SEQ ID NO: 110212 - DNA, 7 bp, Unknown
  misc_feature (1)..( 7): Result.002 file - promoters60/1393187
gacaaat

SEQ ID NO: 110213 - DNA, 9 bp, Unknown
  misc_feature (1)..( 9): Result.002 file - promoters60/1393187
gagaaaatt

SEQ ID NO: 110214 - DNA, 9 bp, Unknown
  misc_feature (1)..( 9): Result.002 file - promoters60/1393187
gagataatt

SEQ ID NO: 110215 - DNA, 8 bp, Unknown
  misc_feature (1)..( 8): Result.002 file - promoters60/1393187
tctaacat

SEQ ID NO: 110216 - DNA, 8 bp, Unknown
  misc_feature (1)..( 8): Result.002 file - promoters60/1393187
tctaacat

SEQ ID NO: 110217 - DNA, 9 bp, Unknown
  misc_feature (1)..( 9): Result.002 file - promoters60/1393290
agacaactc

SEQ ID NO: 110218 - DNA, 9 bp, Unknown
  misc_feature (1)..( 9): Result.002 file - promoters60/1393290
gaacaactc

SEQ ID NO: 110219 - DNA, 9 bp, Unknown
  misc_feature (1)..( 9): Result.002 file - promoters60/1393290
gaataacat

SEQ ID NO: 110220 - DNA, 10 bp, Unknown
  misc_feature (1)..( 10): Result.002 file - promoters60/1393290
aaggcccaat

SEQ ID NO: 110221 - DNA, 10 bp, Unknown
  misc_feature (1)..( 10): Result.002 file - promoters60/1393290
aaggcccaat

SEQ ID NO: 110222 - DNA, 10 bp, Unknown
  misc_feature (1)..( 10): Result.002 file - promoters60/1393290
aaagcccaaa

SEQ ID NO: 110223 - DNA, 12 bp, Unknown
  misc_feature (1)..( 12): Result.002 file - promoters60/1393326
aattttcatcaa

SEQ ID NO: 110224 - DNA, 12 bp, Unknown
  misc_feature (1)..( 12): Result.002 file - promoters60/1393326
aattttagttat

SEQ ID NO: 110225 - DNA, 12 bp, Unknown
  misc_feature (1)..( 12): Result.002 file - promoters60/1393326
tattttcttttt

SEQ ID NO: 110226 - DNA, 12 bp, Unknown
  misc_feature (1)..( 12): Result.002 file - promoters60/1393326
cgtttttttttt

SEQ ID NO: 110227 - DNA, 9 bp, Unknown
  misc_feature (1)..( 9): Result.002 file - promoters60/1393326
cttttaata

SEQ ID NO: 110228 - DNA, 9 bp, Unknown
  misc_feature (1)..( 9): Result.002 file - promoters60/1393326
gttttaatc

SEQ ID NO: 110229 - DNA, 9 bp, Unknown
  misc_feature (1)..( 9): Result.002 file - promoters60/1393326
ctttttata

SEQ ID NO: 110230 - DNA, 9 bp, Unknown
  misc_feature (1)..( 9): Result.002 file - promoters60/1393326
tttttaatt

SEQ ID NO: 110231 - DNA, 11 bp, Unknown
  misc_feature (1)..( 11): Result.002 file - promoters60/1393326
atctttatttg

SEQ ID NO: 110232 - DNA, 11 bp, Unknown
  misc_feature (1)..( 11): Result.002 file - promoters60/1393326
taatttgtttg

SEQ ID NO: 110233 - DNA, 11 bp, Unknown
  misc_feature (1)..( 11): Result.002 file - promoters60/1393326
agatttgttag

SEQ ID NO: 110234 - DNA, 11 bp, Unknown
  misc_feature (1)..( 11): Result.002 file - promoters60/1393326
agattttttac

SEQ ID NO: 110235 - DNA, 7 bp, Unknown
  misc_feature (1)..( 7): Result.002 file - promoters60/1393326
aacaaat

SEQ ID NO: 110236 - DNA, 7 bp, Unknown
  misc_feature (1)..( 7): Result.002 file - promoters60/1393326
cacaaat

SEQ ID NO: 110237 - DNA, 7 bp, Unknown
  misc_feature (1)..( 7): Result.002 file - promoters60/1393326
gaaaaaa

SEQ ID NO: 110238 - DNA, 7 bp, Unknown
  misc_feature (1)..( 7): Result.002 file - promoters60/1393326
gaaaaag

SEQ ID NO: 110239 - DNA, 10 bp, Unknown
  misc_feature (1)..( 10): Result.002 file - promoters60/1393326
aaataaagtt

SEQ ID NO: 110240 - DNA, 10 bp, Unknown
  misc_feature (1)..( 10): Result.002 file - promoters60/1393326
gcttaaagtg

SEQ ID NO: 110241 - DNA, 10 bp, Unknown
  misc_feature (1)..( 10): Result.002 file - promoters60/1393326
aaataaggtt

SEQ ID NO: 110242 - DNA, 10 bp, Unknown
  misc_feature (1)..( 10): Result.002 file - promoters60/1393326
caacaaagtt

SEQ ID NO: 110243 - DNA, 8 bp, Unknown
  misc_feature (1)..( 8): Result.002 file - promoters60/1393326
cagaaaat

SEQ ID NO: 110244 - DNA, 8 bp, Unknown
  misc_feature (1)..( 8): Result.002 file - promoters60/1393326
aagaaaac

SEQ ID NO: 110245 - DNA, 8 bp, Unknown
  misc_feature (1)..( 8): Result.002 file - promoters60/1393326
atgaaaat

SEQ ID NO: 110246 - DNA, 8 bp, Unknown
  misc_feature (1)..( 8): Result.002 file - promoters60/1393326
aagaaacg

SEQ ID NO: 110247 - DNA, 10 bp, Unknown
  misc_feature (1)..( 10): Result.002 file - promoters60/1393383
gtcgaaatta

SEQ ID NO: 110248 - DNA, 10 bp, Unknown
  misc_feature (1)..( 10): Result.002 file - promoters60/1393383
atcgtaatca

SEQ ID NO: 110249 - DNA, 10 bp, Unknown
  misc_feature (1)..( 10): Result.002 file - promoters60/1393383
gtccaaaggc

SEQ ID NO: 110250 - DNA, 10 bp, Unknown
  misc_feature (1)..( 10): Result.002 file - promoters60/1393383
ttcgagattg

SEQ ID NO: 110251 - DNA, 10 bp, Unknown
  misc_feature (1)..( 10): Result.002 file - promoters60/1393383
caccaaagca

SEQ ID NO: 110252 - DNA, 10 bp, Unknown
  misc_feature (1)..( 10): Result.002 file - promoters60/1393383
aaccaaagaa

SEQ ID NO: 110253 - DNA, 10 bp, Unknown
  misc_feature (1)..( 10): Result.002 file - promoters60/1393383
tttgagtttg

SEQ ID NO: 110254 - DNA, 10 bp, Unknown
  misc_feature (1)..( 10): Result.002 file - promoters60/1393383
tgaatcaaat

SEQ ID NO: 110255 - DNA, 10 bp, Unknown
  misc_feature (1)..( 10): Result.002 file - promoters60/1393383
tacatctaat

SEQ ID NO: 110256 - DNA, 10 bp, Unknown
  misc_feature (1)..( 10): Result.002 file - promoters60/1393383
ctaatcaatt

SEQ ID NO: 110257 - DNA, 10 bp, Unknown
  misc_feature (1)..( 10): Result.002 file - promoters60/1393383
taaataaaag

SEQ ID NO: 110258 - DNA, 10 bp, Unknown
  misc_feature (1)..( 10): Result.002 file - promoters60/1393383
taaataatta

SEQ ID NO: 110259 - DNA, 10 bp, Unknown
  misc_feature (1)..( 10): Result.002 file - promoters60/1393383
aaaataaact

SEQ ID NO: 110260 - DNA, 9 bp, Unknown
  misc_feature (1)..( 9): Result.002 file - promoters60/1393478
gttgataat

SEQ ID NO: 110261 - DNA, 9 bp, Unknown
  misc_feature (1)..( 9): Result.002 file - promoters60/1393478
gttaatata

SEQ ID NO: 110262 - DNA, 9 bp, Unknown
  misc_feature (1)..( 9): Result.002 file - promoters60/1393478
tataagata

SEQ ID NO: 110263 - DNA, 9 bp, Unknown
  misc_feature (1)..( 9): Result.002 file - promoters60/1393478
attaataat

SEQ ID NO: 110264 - DNA, 10 bp, Unknown
  misc_feature (1)..( 10): Result.002 file - promoters60/1393478
tgataaatat

SEQ ID NO: 110265 - DNA, 10 bp, Unknown
  misc_feature (1)..( 10): Result.002 file - promoters60/1393478
aattaaatat

SEQ ID NO: 110266 - DNA, 10 bp, Unknown
  misc_feature (1)..( 10): Result.002 file - promoters60/1393478
tgatgaattc

SEQ ID NO: 110267 - DNA, 10 bp, Unknown
  misc_feature (1)..( 10): Result.002 file - promoters60/1393478
tactatttat

SEQ ID NO: 110268 - DNA, 10 bp, Unknown
  misc_feature (1)..( 10): Result.002 file - promoters60/1393478
tacaattttt

SEQ ID NO: 110269 - DNA, 10 bp, Unknown
  misc_feature (1)..( 10): Result.002 file - promoters60/1393478
ctttatatat

SEQ ID NO: 110270 - DNA, 7 bp, Unknown
  misc_feature (1)..( 7): Result.002 file - promoters60/1393478
atttttt

SEQ ID NO: 110271 - DNA, 7 bp, Unknown
  misc_feature (1)..( 7): Result.002 file - promoters60/1393478
atttttc

SEQ ID NO: 110272 - DNA, 7 bp, Unknown
  misc_feature (1)..( 7): Result.002 file - promoters60/1393478
gtttttt

SEQ ID NO: 110273 - DNA, 11 bp, Unknown
  misc_feature (1)..( 11): Result.002 file - promoters60/1393478
ttttttaatac

SEQ ID NO: 110274 - DNA, 11 bp, Unknown
  misc_feature (1)..( 11): Result.002 file - promoters60/1393478
ccttttaaaaa

SEQ ID NO: 110275 - DNA, 11 bp, Unknown
  misc_feature (1)..( 11): Result.002 file - promoters60/1393478
gattttaaata

SEQ ID NO: 110276 - DNA, 11 bp, Unknown
  misc_feature (1)..( 11): Result.002 file - promoters60/1393478
ttttttactaa

SEQ ID NO: 110277 - DNA, 7 bp, Unknown
  misc_feature (1)..( 7): Result.002 file - promoters60/1393478
taaatgc

SEQ ID NO: 110278 - DNA, 7 bp, Unknown
  misc_feature (1)..( 7): Result.002 file - promoters60/1393478
taaatgt

SEQ ID NO: 110279 - DNA, 7 bp, Unknown
  misc_feature (1)..( 7): Result.002 file - promoters60/1393478
gaaatgc

SEQ ID NO: 110280 - DNA, 8 bp, Unknown
  misc_feature (1)..( 8): Result.002 file - promoters60/1393478
aagacttt

SEQ ID NO: 110281 - DNA, 8 bp, Unknown
  misc_feature (1)..( 8): Result.002 file - promoters60/1393478
ttgacttt

SEQ ID NO: 110282 - DNA, 8 bp, Unknown
  misc_feature (1)..( 8): Result.002 file - promoters60/1393478
ttgatttt

SEQ ID NO: 110283 - DNA, 8 bp, Unknown
  misc_feature (1)..( 8): Result.002 file - promoters60/1393478
attgtttt

SEQ ID NO: 110284 - DNA, 8 bp, Unknown
  misc_feature (1)..( 8): Result.002 file - promoters60/1393478
tttgtttg

SEQ ID NO: 110285 - DNA, 8 bp, Unknown
  misc_feature (1)..( 8): Result.002 file - promoters60/1393478
attttttt

SEQ ID NO: 110286 - DNA, 9 bp, Unknown
  misc_feature (1)..( 9): Result.002 file - promoters60/1393478
tgttttgat

SEQ ID NO: 110287 - DNA, 9 bp, Unknown
  misc_feature (1)..( 9): Result.002 file - promoters60/1393478
ttgtttgat

SEQ ID NO: 110288 - DNA, 9 bp, Unknown
  misc_feature (1)..( 9): Result.002 file - promoters60/1393478
ttgcttgat

SEQ ID NO: 110289 - DNA, 8 bp, Unknown
  misc_feature (1)..( 8): Result.002 file - promoters60/1393478
ataacaca

SEQ ID NO: 110290 - DNA, 8 bp, Unknown
  misc_feature (1)..( 8): Result.002 file - promoters60/1393478
ctaacaca

SEQ ID NO: 110291 - DNA, 9 bp, Unknown
  misc_feature (1)..( 9): Result.002 file - promoters60/1393478
ataatcaca

SEQ ID NO: 110292 - DNA, 8 bp, Unknown
  misc_feature (1)..( 8): Result.002 file - promoters60/1393478
atattatg

SEQ ID NO: 110293 - DNA, 8 bp, Unknown
  misc_feature (1)..( 8): Result.002 file - promoters60/1393478
atatgatg

SEQ ID NO: 110294 - DNA, 8 bp, Unknown
  misc_feature (1)..( 8): Result.002 file - promoters60/1393478
atagtatt

SEQ ID NO: 110295 - DNA, 8 bp, Unknown
  misc_feature (1)..( 8): Result.002 file - promoters60/1393478
aatcttat

SEQ ID NO: 110296 - DNA, 8 bp, Unknown
  misc_feature (1)..( 8): Result.002 file - promoters60/1393478
catcttat

SEQ ID NO: 110297 - DNA, 8 bp, Unknown
  misc_feature (1)..( 8): Result.002 file - promoters60/1393478
aatcttca

SEQ ID NO: 110298 - DNA, 7 bp, Unknown
  misc_feature (1)..( 7): Result.002 file - promoters60/1393478
ataataa

SEQ ID NO: 110299 - DNA, 7 bp, Unknown
  misc_feature (1)..( 7): Result.002 file - promoters60/1393478
ttaataa

SEQ ID NO: 110300 - DNA, 7 bp, Unknown
  misc_feature (1)..( 7): Result.002 file - promoters60/1393478
ttaatat

SEQ ID NO: 110301 - DNA, 7 bp, Unknown
  misc_feature (1)..( 7): Result.002 file - promoters60/1393478
taataat

SEQ ID NO: 110302 - DNA, 7 bp, Unknown
  misc_feature (1)..( 7): Result.002 file - promoters60/1393478
taataac

SEQ ID NO: 110303 - DNA, 7 bp, Unknown
  misc_feature (1)..( 7): Result.002 file - promoters60/1393478
taacaac

SEQ ID NO: 110304 - DNA, 9 bp, Unknown
  misc_feature (1)..( 9): Result.002 file - promoters60/1393478
agccacaca

SEQ ID NO: 110305 - DNA, 9 bp, Unknown
  misc_feature (1)..( 9): Result.002 file - promoters60/1393478
aaacacaca

SEQ ID NO: 110306 - DNA, 9 bp, Unknown
  misc_feature (1)..( 9): Result.002 file - promoters60/1393478
aaaaacacg

SEQ ID NO: 110307 - DNA, 9 bp, Unknown
  misc_feature (1)..( 9): Result.002 file - promoters60/1393478
ttttaatac

SEQ ID NO: 110308 - DNA, 9 bp, Unknown
  misc_feature (1)..( 9): Result.002 file - promoters60/1393478
tttttatat

SEQ ID NO: 110309 - DNA, 9 bp, Unknown
  misc_feature (1)..( 9): Result.002 file - promoters60/1393478
tagttatat

SEQ ID NO: 110310 - DNA, 13 bp, Unknown
  misc_feature (1)..( 13): Result.002 file - promoters60/1393492
acagctcagaata

SEQ ID NO: 110311 - DNA, 13 bp, Unknown
  misc_feature (1)..( 13): Result.002 file - promoters60/1393492
ccttttcataatt

SEQ ID NO: 110312 - DNA, 13 bp, Unknown
  misc_feature (1)..( 13): Result.002 file - promoters60/1393492
cctttttataatc

SEQ ID NO: 110313 - DNA, 13 bp, Unknown
  misc_feature (1)..( 13): Result.002 file - promoters60/1393492
tttttttgtatcc

SEQ ID NO: 110314 - DNA, 13 bp, Unknown
  misc_feature (1)..( 13): Result.002 file - promoters60/1393492
gctttttcttctt

SEQ ID NO: 110315 - DNA, 13 bp, Unknown
  misc_feature (1)..( 13): Result.002 file - promoters60/1393492
ctgttatgtctcc

SEQ ID NO: 110316 - DNA, 10 bp, Unknown
  misc_feature (1)..( 10): Result.002 file - promoters60/1393492
caatattttt

SEQ ID NO: 110317 - DNA, 10 bp, Unknown
  misc_feature (1)..( 10): Result.002 file - promoters60/1393492
taatatttaa

SEQ ID NO: 110318 - DNA, 10 bp, Unknown
  misc_feature (1)..( 10): Result.002 file - promoters60/1393492
caaaattact

SEQ ID NO: 110319 - DNA, 10 bp, Unknown
  misc_feature (1)..( 10): Result.002 file - promoters60/1393492
caatatacac

SEQ ID NO: 110320 - DNA, 10 bp, Unknown
  misc_feature (1)..( 10): Result.002 file - promoters60/1393492
tgctatctaa

SEQ ID NO: 110321 - DNA, 10 bp, Unknown
  misc_feature (1)..( 10): Result.002 file - promoters60/1393492
tggtatttac

SEQ ID NO: 110322 - DNA, 15 bp, Unknown
  misc_feature (1)..( 15): Result.002 file - promoters60/1393492
attttattttttgat

SEQ ID NO: 110323 - DNA, 15 bp, Unknown
  misc_feature (1)..( 15): Result.002 file - promoters60/1393492
gtagcattgtttatg

SEQ ID NO: 110324 - DNA, 15 bp, Unknown
  misc_feature (1)..( 15): Result.002 file - promoters60/1393492
tctatattgtttaaa

SEQ ID NO: 110325 - DNA, 15 bp, Unknown
  misc_feature (1)..( 15): Result.002 file - promoters60/1393492
caaacattttttgac

SEQ ID NO: 110326 - DNA, 15 bp, Unknown
  misc_feature (1)..( 15): Result.002 file - promoters60/1393492
tttcttttgttttcg

SEQ ID NO: 110327 - DNA, 15 bp, Unknown
  misc_feature (1)..( 15): Result.002 file - promoters60/1393492
acatttatttatgat

SEQ ID NO: 110328 - DNA, 9 bp, Unknown
  misc_feature (1)..( 9): Result.002 file - promoters60/1393498
atgtcaaaa

SEQ ID NO: 110329 - DNA, 9 bp, Unknown
  misc_feature (1)..( 9): Result.002 file - promoters60/1393498
atgtccaaa

SEQ ID NO: 110330 - DNA, 7 bp, Unknown
  misc_feature (1)..( 7): Result.002 file - promoters60/1393498
aaataat

SEQ ID NO: 110331 - DNA, 7 bp, Unknown
  misc_feature (1)..( 7): Result.002 file - promoters60/1393498
aaataat

SEQ ID NO: 110332 - DNA, 8 bp, Unknown
  misc_feature (1)..( 8): Result.002 file - promoters60/1393498
acattttt

SEQ ID NO: 110333 - DNA, 8 bp, Unknown
  misc_feature (1)..( 8): Result.002 file - promoters60/1393498
acaatttt

SEQ ID NO: 110334 - DNA, 10 bp, Unknown
  misc_feature (1)..( 10): Result.002 file - promoters60/1393498
atattattat

SEQ ID NO: 110335 - DNA, 10 bp, Unknown
  misc_feature (1)..( 10): Result.002 file - promoters60/1393498
atattaaatg

SEQ ID NO: 110336 - DNA, 10 bp, Unknown
  misc_feature (1)..( 10): Result.002 file - promoters60/1393498
ttattaaatg

SEQ ID NO: 110337 - DNA, 6 bp, Unknown
  misc_feature (1)..( 6): Result.002 file - promoters60/1393498
aaattt

SEQ ID NO: 110338 - DNA, 6 bp, Unknown
  misc_feature (1)..( 6): Result.002 file - promoters60/1393498
aaattt

SEQ ID NO: 110339 - DNA, 7 bp, Unknown
  misc_feature (1)..( 7): Result.002 file - promoters60/1393498
gaatatt

SEQ ID NO: 110340 - DNA, 7 bp, Unknown
  misc_feature (1)..( 7): Result.002 file - promoters60/1393498
gaaaatt

SEQ ID NO: 110341 - DNA, 7 bp, Unknown
  misc_feature (1)..( 7): Result.002 file - promoters60/1393498
aaactgt

SEQ ID NO: 110342 - DNA, 7 bp, Unknown
  misc_feature (1)..( 7): Result.002 file - promoters60/1393498
aaattgt

SEQ ID NO: 110343 - DNA, 6 bp, Unknown
  misc_feature (1)..( 6): Result.002 file - promoters60/1393498
tttaga

SEQ ID NO: 110344 - DNA, 6 bp, Unknown
  misc_feature (1)..( 6): Result.002 file - promoters60/1393498
tttaga

SEQ ID NO: 110345 - DNA, 12 bp, Unknown
  misc_feature (1)..( 12): Result.002 file - promoters60/1393498
tttatacaacaa

SEQ ID NO: 110346 - DNA, 12 bp, Unknown
  misc_feature (1)..( 12): Result.002 file - promoters60/1393498
tttctacagcaa

SEQ ID NO: 110347 - DNA, 8 bp, Unknown
  misc_feature (1)..( 8): Result.002 file - promoters60/1393498
tctaaggc

SEQ ID NO: 110348 - DNA, 8 bp, Unknown
  misc_feature (1)..( 8): Result.002 file - promoters60/1393498
tctacggc

SEQ ID NO: 110349 - DNA, 6 bp, Unknown
  misc_feature (1)..( 6): Result.002 file - promoters60/1393498
tttttt

SEQ ID NO: 110350 - DNA, 6 bp, Unknown
  misc_feature (1)..( 6): Result.002 file - promoters60/1393498
tttttt

SEQ ID NO: 110351 - DNA, 6 bp, Unknown
  misc_feature (1)..( 6): Result.002 file - promoters60/1393498
taagga

SEQ ID NO: 110352 - DNA, 6 bp, Unknown
  misc_feature (1)..( 6): Result.002 file - promoters60/1393498
taagga

SEQ ID NO: 110353 - DNA, 8 bp, Unknown
  misc_feature (1)..( 8): Result.002 file - promoters60/1393498
ttaatatt

SEQ ID NO: 110354 - DNA, 8 bp, Unknown
  misc_feature (1)..( 8): Result.002 file - promoters60/1393498
ttaaaatt

SEQ ID NO: 110355 - DNA, 10 bp, Unknown
  misc_feature (1)..( 10): Result.002 file - promoters60/1393498
ttattattct

SEQ ID NO: 110356 - DNA, 10 bp, Unknown
  misc_feature (1)..( 10): Result.002 file - promoters60/1393498
ttattaaatg

SEQ ID NO: 110357 - DNA, 10 bp, Unknown
  misc_feature (1)..( 10): Result.002 file - promoters60/1393498
atattaaatg

SEQ ID NO: 110358 - DNA, 7 bp, Unknown
  misc_feature (1)..( 7): Result.002 file - promoters60/1393498
actgtag

SEQ ID NO: 110359 - DNA, 7 bp, Unknown
  misc_feature (1)..( 7): Result.002 file - promoters60/1393498
actgtag

SEQ ID NO: 110360 - DNA, 7 bp, Unknown
  misc_feature (1)..( 7): Result.002 file - promoters60/1393498
gtgtatg

SEQ ID NO: 110361 - DNA, 7 bp, Unknown
  misc_feature (1)..( 7): Result.002 file - promoters60/1393498
gtgcatg

SEQ ID NO: 110362 - DNA, 14 bp, Unknown
  misc_feature (1)..( 14): Result.002 file - promoters60/1393498
taaaaacatgattt

SEQ ID NO: 110363 - DNA, 14 bp, Unknown
  misc_feature (1)..( 14): Result.002 file - promoters60/1393498
taataacaggattt

SEQ ID NO: 110364 - DNA, 8 bp, Unknown
  misc_feature (1)..( 8): Result.002 file - promoters60/1393498
ttcagaga

SEQ ID NO: 110365 - DNA, 8 bp, Unknown
  misc_feature (1)..( 8): Result.002 file - promoters60/1393498
ttcataga

SEQ ID NO: 110366 - DNA, 7 bp, Unknown
  misc_feature (1)..( 7): Result.002 file - promoters60/1393498
tcaaaat

SEQ ID NO: 110367 - DNA, 7 bp, Unknown
  misc_feature (1)..( 7): Result.002 file - promoters60/1393498
tcaaaat

SEQ ID NO: 110368 - DNA, 7 bp, Unknown
  misc_feature (1)..( 7): Result.002 file - promoters60/1393545
atcgaca

SEQ ID NO: 110369 - DNA, 7 bp, Unknown
  misc_feature (1)..( 7): Result.002 file - promoters60/1393545
atcaaca

SEQ ID NO: 110370 - DNA, 6 bp, Unknown
  misc_feature (1)..( 6): Result.002 file - promoters60/1393545
aatcta

SEQ ID NO: 110371 - DNA, 6 bp, Unknown
  misc_feature (1)..( 6): Result.002 file - promoters60/1393545
aatcta

SEQ ID NO: 110372 - DNA, 6 bp, Unknown
  misc_feature (1)..( 6): Result.002 file - promoters60/1393545
tagctc

SEQ ID NO: 110373 - DNA, 6 bp, Unknown
  misc_feature (1)..( 6): Result.002 file - promoters60/1393545
tagctc

SEQ ID NO: 110374 - DNA, 6 bp, Unknown
  misc_feature (1)..( 6): Result.002 file - promoters60/1393545
tagctc

SEQ ID NO: 110375 - DNA, 8 bp, Unknown
  misc_feature (1)..( 8): Result.002 file - promoters60/1393545
atttgcta

SEQ ID NO: 110376 - DNA, 8 bp, Unknown
  misc_feature (1)..( 8): Result.002 file - promoters60/1393545
attcgcta

SEQ ID NO: 110377 - DNA, 7 bp, Unknown
  misc_feature (1)..( 7): Result.002 file - promoters60/1393545
gcagaag

SEQ ID NO: 110378 - DNA, 7 bp, Unknown
  misc_feature (1)..( 7): Result.002 file - promoters60/1393545
gcaaaag

SEQ ID NO: 110379 - DNA, 6 bp, Unknown
  misc_feature (1)..( 6): Result.002 file - promoters60/1393545
cattag

SEQ ID NO: 110380 - DNA, 6 bp, Unknown
  misc_feature (1)..( 6): Result.002 file - promoters60/1393545
cattag

SEQ ID NO: 110381 - DNA, 8 bp, Unknown
  misc_feature (1)..( 8): Result.002 file - promoters60/1393545
tggctctg

SEQ ID NO: 110382 - DNA, 8 bp, Unknown
  misc_feature (1)..( 8): Result.002 file - promoters60/1393545
tggctctg

SEQ ID NO: 110383 - DNA, 7 bp, Unknown
  misc_feature (1)..( 7): Result.002 file - promoters60/1393545
ctgtgat

SEQ ID NO: 110384 - DNA, 7 bp, Unknown
  misc_feature (1)..( 7): Result.002 file - promoters60/1393545
ctgagat

SEQ ID NO: 110385 - DNA, 8 bp, Unknown
  misc_feature (1)..( 8): Result.002 file - promoters60/1393545
tttttttt

SEQ ID NO: 110386 - DNA, 8 bp, Unknown
  misc_feature (1)..( 8): Result.002 file - promoters60/1393545
ttttgttt

SEQ ID NO: 110387 - DNA, 8 bp, Unknown
  misc_feature (1)..( 8): Result.002 file - promoters60/1393545
ttgtctat

SEQ ID NO: 110388 - DNA, 8 bp, Unknown
  misc_feature (1)..( 8): Result.002 file - promoters60/1393545
ttgtatat

SEQ ID NO: 110389 - DNA, 6 bp, Unknown
  misc_feature (1)..( 6): Result.002 file - promoters60/1393545
tatatt

SEQ ID NO: 110390 - DNA, 6 bp, Unknown
  misc_feature (1)..( 6): Result.002 file - promoters60/1393545
tatatt

SEQ ID NO: 110391 - DNA, 6 bp, Unknown
  misc_feature (1)..( 6): Result.002 file - promoters60/1393545
tattat

SEQ ID NO: 110392 - DNA, 6 bp, Unknown
  misc_feature (1)..( 6): Result.002 file - promoters60/1393545
tattat

SEQ ID NO: 110393 - DNA, 8 bp, Unknown
  misc_feature (1)..( 8): Result.002 file - promoters60/1393545
atttttca

SEQ ID NO: 110394 - DNA, 8 bp, Unknown
  misc_feature (1)..( 8): Result.002 file - promoters60/1393545
atttttca

SEQ ID NO: 110395 - DNA, 6 bp, Unknown
  misc_feature (1)..( 6): Result.002 file - promoters60/1393545
agctac

SEQ ID NO: 110396 - DNA, 6 bp, Unknown
  misc_feature (1)..( 6): Result.002 file - promoters60/1393545
agctac

SEQ ID NO: 110397 - DNA, 9 bp, Unknown
  misc_feature (1)..( 9): Result.002 file - promoters60/1393596
ttttttttg

SEQ ID NO: 110398 - DNA, 9 bp, Unknown
  misc_feature (1)..( 9): Result.002 file - promoters60/1393596
attttattg

SEQ ID NO: 110399 - DNA, 9 bp, Unknown
  misc_feature (1)..( 9): Result.002 file - promoters60/1393596
attttacca

SEQ ID NO: 110400 - DNA, 6 bp, Unknown
  misc_feature (1)..( 6): Result.002 file - promoters60/1393596
ttcttg

SEQ ID NO: 110401 - DNA, 6 bp, Unknown
  misc_feature (1)..( 6): Result.002 file - promoters60/1393596
ttcttg

SEQ ID NO: 110402 - DNA, 11 bp, Unknown
  misc_feature (1)..( 11): Result.002 file - promoters60/1393596
tgtattctctt

SEQ ID NO: 110403 - DNA, 11 bp, Unknown
  misc_feature (1)..( 11): Result.002 file - promoters60/1393596
tgttttctctt

SEQ ID NO: 110404 - DNA, 11 bp, Unknown
  misc_feature (1)..( 11): Result.002 file - promoters60/1393596
acgtttatata

SEQ ID NO: 110405 - DNA, 14 bp, Unknown
  misc_feature (1)..( 14): Result.002 file - promoters60/1393596
ataatcttttgttg

SEQ ID NO: 110406 - DNA, 14 bp, Unknown
  misc_feature (1)..( 14): Result.002 file - promoters60/1393596
tttctcttttcttg

SEQ ID NO: 110407 - DNA, 14 bp, Unknown
  misc_feature (1)..( 14): Result.002 file - promoters60/1393596
ataatattttttag

SEQ ID NO: 110408 - DNA, 7 bp, Unknown
  misc_feature (1)..( 7): Result.002 file - promoters60/1393596
aatgtgt

SEQ ID NO: 110409 - DNA, 7 bp, Unknown
  misc_feature (1)..( 7): Result.002 file - promoters60/1393596
aatatgt

SEQ ID NO: 110410 - DNA, 9 bp, Unknown
  misc_feature (1)..( 9): Result.002 file - promoters60/1393596
attttattg

SEQ ID NO: 110411 - DNA, 9 bp, Unknown
  misc_feature (1)..( 9): Result.002 file - promoters60/1393596
attatattg

SEQ ID NO: 110412 - DNA, 6 bp, Unknown
  misc_feature (1)..( 6): Result.002 file - promoters60/1393596
ccctct

SEQ ID NO: 110413 - DNA, 6 bp, Unknown
  misc_feature (1)..( 6): Result.002 file - promoters60/1393596
ccctct

SEQ ID NO: 110414 - DNA, 10 bp, Unknown
  misc_feature (1)..( 10): Result.002 file - promoters60/1393596
tttttttttt

SEQ ID NO: 110415 - DNA, 10 bp, Unknown
  misc_feature (1)..( 10): Result.002 file - promoters60/1393596
tttttttttt

SEQ ID NO: 110416 - DNA, 8 bp, Unknown
  misc_feature (1)..( 8): Result.002 file - promoters60/1393596
agataatc

SEQ ID NO: 110417 - DNA, 8 bp, Unknown
  misc_feature (1)..( 8): Result.002 file - promoters60/1393596
agaaaatc

SEQ ID NO: 110418 - DNA, 7 bp, Unknown
  misc_feature (1)..( 7): Result.002 file - promoters60/1393596
ttcagaa

SEQ ID NO: 110419 - DNA, 7 bp, Unknown
  misc_feature (1)..( 7): Result.002 file - promoters60/1393596
ttcggaa

SEQ ID NO: 110420 - DNA, 11 bp, Unknown
  misc_feature (1)..( 11): Result.002 file - promoters60/1393596
tttcttaaaaa

SEQ ID NO: 110421 - DNA, 11 bp, Unknown
  misc_feature (1)..( 11): Result.002 file - promoters60/1393596
tttcataaaaa

SEQ ID NO: 110422 - DNA, 6 bp, Unknown
  misc_feature (1)..( 6): Result.002 file - promoters60/1393596
agtctc

SEQ ID NO: 110423 - DNA, 6 bp, Unknown
  misc_feature (1)..( 6): Result.002 file - promoters60/1393596
agtctc

SEQ ID NO: 110424 - DNA, 9 bp, Unknown
  misc_feature (1)..( 9): Result.002 file - promoters60/1393596
tattagaca

SEQ ID NO: 110425 - DNA, 9 bp, Unknown
  misc_feature (1)..( 9): Result.002 file - promoters60/1393596
tattacaca

SEQ ID NO: 110426 - DNA, 13 bp, Unknown
  misc_feature (1)..( 13): Result.002 file - promoters60/1393596
actgtaaattacg

SEQ ID NO: 110427 - DNA, 13 bp, Unknown
  misc_feature (1)..( 13): Result.002 file - promoters60/1393596
actttaaattacg

SEQ ID NO: 110428 - DNA, 6 bp, Unknown
  misc_feature (1)..( 6): Result.002 file - promoters60/1393596
gaaaat

SEQ ID NO: 110429 - DNA, 6 bp, Unknown
  misc_feature (1)..( 6): Result.002 file - promoters60/1393596
gaaaat

SEQ ID NO: 110430 - DNA, 7 bp, Unknown
  misc_feature (1)..( 7): Result.002 file - promoters60/1393596
actgatt

SEQ ID NO: 110431 - DNA, 7 bp, Unknown
  misc_feature (1)..( 7): Result.002 file - promoters60/1393596
acttatt

SEQ ID NO: 110432 - DNA, 7 bp, Unknown
  misc_feature (1)..( 7): Result.002 file - promoters60/1393596
ttcttct

SEQ ID NO: 110433 - DNA, 7 bp, Unknown
  misc_feature (1)..( 7): Result.002 file - promoters60/1393596
ttcttct

SEQ ID NO: 110434 - DNA, 6 bp, Unknown
  misc_feature (1)..( 6): Result.002 file - promoters60/1393596
aatctc

SEQ ID NO: 110435 - DNA, 6 bp, Unknown
  misc_feature (1)..( 6): Result.002 file - promoters60/1393596
aatctc

SEQ ID NO: 110436 - DNA, 6 bp, Unknown
  misc_feature (1)..( 6): Result.002 file - promoters60/1393651
tatatg

SEQ ID NO: 110437 - DNA, 6 bp, Unknown
  misc_feature (1)..( 6): Result.002 file - promoters60/1393651
tatatg

SEQ ID NO: 110438 - DNA, 6 bp, Unknown
  misc_feature (1)..( 6): Result.002 file - promoters60/1393651
gtttgg

SEQ ID NO: 110439 - DNA, 6 bp, Unknown
  misc_feature (1)..( 6): Result.002 file - promoters60/1393651
gtttgg

SEQ ID NO: 110440 - DNA, 6 bp, Unknown
  misc_feature (1)..( 6): Result.002 file - promoters60/1393651
gccttt

SEQ ID NO: 110441 - DNA, 6 bp, Unknown
  misc_feature (1)..( 6): Result.002 file - promoters60/1393651
gccttt

SEQ ID NO: 110442 - DNA, 7 bp, Unknown
  misc_feature (1)..( 7): Result.002 file - promoters60/1393651
attgttt

SEQ ID NO: 110443 - DNA, 7 bp, Unknown
  misc_feature (1)..( 7): Result.002 file - promoters60/1393651
attattt

SEQ ID NO: 110444 - DNA, 7 bp, Unknown
  misc_feature (1)..( 7): Result.002 file - promoters60/1393651
aacgaaa

SEQ ID NO: 110445 - DNA, 7 bp, Unknown
  misc_feature (1)..( 7): Result.002 file - promoters60/1393651
aaccaaa

SEQ ID NO: 110446 - DNA, 8 bp, Unknown
  misc_feature (1)..( 8): Result.002 file - promoters60/1393651
aaatcaaa

SEQ ID NO: 110447 - DNA, 8 bp, Unknown
  misc_feature (1)..( 8): Result.002 file - promoters60/1393651
aaatgaaa

SEQ ID NO: 110448 - DNA, 8 bp, Unknown
  misc_feature (1)..( 8): Result.002 file - promoters60/1393651
caataaaa

SEQ ID NO: 110449 - DNA, 6 bp, Unknown
  misc_feature (1)..( 6): Result.002 file - promoters60/1393651
aaataa

SEQ ID NO: 110450 - DNA, 6 bp, Unknown
  misc_feature (1)..( 6): Result.002 file - promoters60/1393651
aaataa

SEQ ID NO: 110451 - DNA, 8 bp, Unknown
  misc_feature (1)..( 8): Result.002 file - promoters60/1393651
aaattgga

SEQ ID NO: 110452 - DNA, 8 bp, Unknown
  misc_feature (1)..( 8): Result.002 file - promoters60/1393651
aaattgga

SEQ ID NO: 110453 - DNA, 6 bp, Unknown
  misc_feature (1)..( 6): Result.002 file - promoters60/1393651
ggaaga

SEQ ID NO: 110454 - DNA, 6 bp, Unknown
  misc_feature (1)..( 6): Result.002 file - promoters60/1393651
ggaaga

SEQ ID NO: 110455 - DNA, 6 bp, Unknown
  misc_feature (1)..( 6): Result.002 file - promoters60/1393651
catcac

SEQ ID NO: 110456 - DNA, 6 bp, Unknown
  misc_feature (1)..( 6): Result.002 file - promoters60/1393651
catcac

SEQ ID NO: 110457 - DNA, 6 bp, Unknown
  misc_feature (1)..( 6): Result.002 file - promoters60/1393651
ttccat

SEQ ID NO: 110458 - DNA, 6 bp, Unknown
  misc_feature (1)..( 6): Result.002 file - promoters60/1393651
ttccat

SEQ ID NO: 110459 - DNA, 7 bp, Unknown
  misc_feature (1)..( 7): Result.002 file - promoters60/1393651
tatttta

SEQ ID NO: 110460 - DNA, 7 bp, Unknown
  misc_feature (1)..( 7): Result.002 file - promoters60/1393651
tatatta

SEQ ID NO: 110461 - DNA, 6 bp, Unknown
  misc_feature (1)..( 6): Result.002 file - promoters60/1393651
ataaaa

SEQ ID NO: 110462 - DNA, 6 bp, Unknown
  misc_feature (1)..( 6): Result.002 file - promoters60/1393651
ataaaa

SEQ ID NO: 110463 - DNA, 9 bp, Unknown
  misc_feature (1)..( 9): Result.002 file - promoters60/1393651
atataacat

SEQ ID NO: 110464 - DNA, 9 bp, Unknown
  misc_feature (1)..( 9): Result.002 file - promoters60/1393651
atatgacat

SEQ ID NO: 110465 - DNA, 6 bp, Unknown
  misc_feature (1)..( 6): Result.002 file - promoters60/1393651
aatctt

SEQ ID NO: 110466 - DNA, 6 bp, Unknown
  misc_feature (1)..( 6): Result.002 file - promoters60/1393651
aatctt

SEQ ID NO: 110467 - DNA, 8 bp, Unknown
  misc_feature (1)..( 8): Result.002 file - promoters60/1393651
attaaata

SEQ ID NO: 110468 - DNA, 8 bp, Unknown
  misc_feature (1)..( 8): Result.002 file - promoters60/1393651
attatata

SEQ ID NO: 110469 - DNA, 12 bp, Unknown
  misc_feature (1)..( 12): Result.002 file - promoters60/1393684
ataatttgagtt

SEQ ID NO: 110470 - DNA, 12 bp, Unknown
  misc_feature (1)..( 12): Result.002 file - promoters60/1393684
atatttttagta

SEQ ID NO: 110471 - DNA, 12 bp, Unknown
  misc_feature (1)..( 12): Result.002 file - promoters60/1393684
agcctttaagtt

SEQ ID NO: 110472 - DNA, 8 bp, Unknown
  misc_feature (1)..( 8): Result.002 file - promoters60/1393684
aggaggaa

SEQ ID NO: 110473 - DNA, 8 bp, Unknown
  misc_feature (1)..( 8): Result.002 file - promoters60/1393684
aggaggaa

SEQ ID NO: 110474 - DNA, 6 bp, Unknown
  misc_feature (1)..( 6): Result.002 file - promoters60/1393684
gaaaat

SEQ ID NO: 110475 - DNA, 6 bp, Unknown
  misc_feature (1)..( 6): Result.002 file - promoters60/1393684
gaaaat

SEQ ID NO: 110476 - DNA, 6 bp, Unknown
  misc_feature (1)..( 6): Result.002 file - promoters60/1393684
aggtct

SEQ ID NO: 110477 - DNA, 6 bp, Unknown
  misc_feature (1)..( 6): Result.002 file - promoters60/1393684
aggtct

SEQ ID NO: 110478 - DNA, 7 bp, Unknown
  misc_feature (1)..( 7): Result.002 file - promoters60/1393684
gttacaa

SEQ ID NO: 110479 - DNA, 7 bp, Unknown
  misc_feature (1)..( 7): Result.002 file - promoters60/1393684
gttacaa

SEQ ID NO: 110480 - DNA, 7 bp, Unknown
  misc_feature (1)..( 7): Result.002 file - promoters60/1393684
taattaa

SEQ ID NO: 110481 - DNA, 7 bp, Unknown
  misc_feature (1)..( 7): Result.002 file - promoters60/1393684
taattaa

SEQ ID NO: 110482 - DNA, 12 bp, Unknown
  misc_feature (1)..( 12): Result.002 file - promoters60/1393684
taaaaagaaaaa

SEQ ID NO: 110483 - DNA, 12 bp, Unknown
  misc_feature (1)..( 12): Result.002 file - promoters60/1393684
taaaaagaaaaa

SEQ ID NO: 110484 - DNA, 12 bp, Unknown
  misc_feature (1)..( 12): Result.002 file - promoters60/1393684
aaaaaaaaaaag

SEQ ID NO: 110485 - DNA, 9 bp, Unknown
  misc_feature (1)..( 9): Result.002 file - promoters60/1393684
acatggttt

SEQ ID NO: 110486 - DNA, 9 bp, Unknown
  misc_feature (1)..( 9): Result.002 file - promoters60/1393684
acatgtttt

SEQ ID NO: 110487 - DNA, 7 bp, Unknown
  misc_feature (1)..( 7): Result.002 file - promoters60/1393684
aaacata

SEQ ID NO: 110488 - DNA, 7 bp, Unknown
  misc_feature (1)..( 7): Result.002 file - promoters60/1393684
aaatata

SEQ ID NO: 110489 - DNA, 7 bp, Unknown
  misc_feature (1)..( 7): Result.002 file - promoters60/1393684
atataca

SEQ ID NO: 110490 - DNA, 7 bp, Unknown
  misc_feature (1)..( 7): Result.002 file - promoters60/1393684
atataca

SEQ ID NO: 110491 - DNA, 7 bp, Unknown
  misc_feature (1)..( 7): Result.002 file - promoters60/1393684
ttaagtt

SEQ ID NO: 110492 - DNA, 7 bp, Unknown
  misc_feature (1)..( 7): Result.002 file - promoters60/1393684
ttaagtt

SEQ ID NO: 110493 - DNA, 7 bp, Unknown
  misc_feature (1)..( 7): Result.002 file - promoters60/1393684
taaaact

SEQ ID NO: 110494 - DNA, 7 bp, Unknown
  misc_feature (1)..( 7): Result.002 file - promoters60/1393684
taacact

SEQ ID NO: 110495 - DNA, 12 bp, Unknown
  misc_feature (1)..( 12): Result.002 file - promoters60/1393684
atatctataaag

SEQ ID NO: 110496 - DNA, 12 bp, Unknown
  misc_feature (1)..( 12): Result.002 file - promoters60/1393684
atatatataaag

SEQ ID NO: 110497 - DNA, 10 bp, Unknown
  misc_feature (1)..( 10): Result.002 file - promoters60/1393684
acatatgatt

SEQ ID NO: 110498 - DNA, 10 bp, Unknown
  misc_feature (1)..( 10): Result.002 file - promoters60/1393684
acataagatt

SEQ ID NO: 110499 - DNA, 8 bp, Unknown
  misc_feature (1)..( 8): Result.002 file - promoters60/1393684
atttacat

SEQ ID NO: 110500 - DNA, 8 bp, Unknown
  misc_feature (1)..( 8): Result.002 file - promoters60/1393684
attcacat

SEQ ID NO: 110501 - DNA, 6 bp, Unknown
  misc_feature (1)..( 6): Result.002 file - promoters60/1393684
tttcaa

SEQ ID NO: 110502 - DNA, 6 bp, Unknown
  misc_feature (1)..( 6): Result.002 file - promoters60/1393684
tttcaa

SEQ ID NO: 110503 - DNA, 7 bp, Unknown
  misc_feature (1)..( 7): Result.002 file - promoters60/1393684
attttag

SEQ ID NO: 110504 - DNA, 7 bp, Unknown
  misc_feature (1)..( 7): Result.002 file - promoters60/1393684
attttag

SEQ ID NO: 110505 - DNA, 8 bp, Unknown
  misc_feature (1)..( 8): Result.002 file - promoters60/1393684
aagtgttt

SEQ ID NO: 110506 - DNA, 8 bp, Unknown
  misc_feature (1)..( 8): Result.002 file - promoters60/1393684
aagttttt

SEQ ID NO: 110507 - DNA, 8 bp, Unknown
  misc_feature (1)..( 8): Result.002 file - promoters60/1393684
tttattta

SEQ ID NO: 110508 - DNA, 8 bp, Unknown
  misc_feature (1)..( 8): Result.002 file - promoters60/1393684
ttttttta

SEQ ID NO: 110509 - DNA, 6 bp, Unknown
  misc_feature (1)..( 6): Result.002 file - promoters60/1393684
taaacg

SEQ ID NO: 110510 - DNA, 6 bp, Unknown
  misc_feature (1)..( 6): Result.002 file - promoters60/1393684
taaacg

SEQ ID NO: 110511 - DNA, 9 bp, Unknown
  misc_feature (1)..( 9): Result.002 file - promoters60/1393684
atattacca

SEQ ID NO: 110512 - DNA, 9 bp, Unknown
  misc_feature (1)..( 9): Result.002 file - promoters60/1393684
atatttcca

SEQ ID NO: 110513 - DNA, 11 bp, Unknown
  misc_feature (1)..( 11): Result.002 file - promoters60/1393684
caaaatttcaa

SEQ ID NO: 110514 - DNA, 11 bp, Unknown
  misc_feature (1)..( 11): Result.002 file - promoters60/1393684
caaaatgtcaa

SEQ ID NO: 110515 - DNA, 6 bp, Unknown
  misc_feature (1)..( 6): Result.002 file - promoters60/1393684
aaacat

SEQ ID NO: 110516 - DNA, 6 bp, Unknown
  misc_feature (1)..( 6): Result.002 file - promoters60/1393684
aaacat

SEQ ID NO: 110517 - DNA, 9 bp, Unknown
  misc_feature (1)..( 9): Result.002 file - promoters60/1393684
caaaatcta

SEQ ID NO: 110518 - DNA, 9 bp, Unknown
  misc_feature (1)..( 9): Result.002 file - promoters60/1393684
caaaaccta

SEQ ID NO: 110519 - DNA, 12 bp, Unknown
  misc_feature (1)..( 12): Result.002 file - promoters60/1393751
tactcacatatg

SEQ ID NO: 110520 - DNA, 12 bp, Unknown
  misc_feature (1)..( 12): Result.002 file - promoters60/1393751
tactaacatatg

SEQ ID NO: 110521 - DNA, 12 bp, Unknown
  misc_feature (1)..( 12): Result.002 file - promoters60/1393751
aactcaccggag

SEQ ID NO: 110522 - DNA, 12 bp, Unknown
  misc_feature (1)..( 12): Result.002 file - promoters60/1393751
tcaaaacataat

SEQ ID NO: 110523 - DNA, 6 bp, Unknown
  misc_feature (1)..( 6): Result.002 file - promoters60/1393761
tttttt

SEQ ID NO: 110524 - DNA, 6 bp, Unknown
  misc_feature (1)..( 6): Result.002 file - promoters60/1393761
tttttt

SEQ ID NO: 110525 - DNA, 6 bp, Unknown
  misc_feature (1)..( 6): Result.002 file - promoters60/1393761
tttttt

SEQ ID NO: 110526 - DNA, 9 bp, Unknown
  misc_feature (1)..( 9): Result.002 file - promoters60/1393761
aaatgaaat

SEQ ID NO: 110527 - DNA, 9 bp, Unknown
  misc_feature (1)..( 9): Result.002 file - promoters60/1393761
aaataaaat

SEQ ID NO: 110528 - DNA, 9 bp, Unknown
  misc_feature (1)..( 9): Result.002 file - promoters60/1393761
aaacgaaaa

SEQ ID NO: 110529 - DNA, 9 bp, Unknown
  misc_feature (1)..( 9): Result.002 file - promoters60/1393761
ttcggttag

SEQ ID NO: 110530 - DNA, 9 bp, Unknown
  misc_feature (1)..( 9): Result.002 file - promoters60/1393761
ttctgtttt

SEQ ID NO: 110531 - DNA, 9 bp, Unknown
  misc_feature (1)..( 9): Result.002 file - promoters60/1393761
ttctatttt

SEQ ID NO: 110532 - DNA, 9 bp, Unknown
  misc_feature (1)..( 9): Result.002 file - promoters60/1393761
aagctaaat

SEQ ID NO: 110533 - DNA, 9 bp, Unknown
  misc_feature (1)..( 9): Result.002 file - promoters60/1393761
aagttaata

SEQ ID NO: 110534 - DNA, 9 bp, Unknown
  misc_feature (1)..( 9): Result.002 file - promoters60/1393761
cagttaata

SEQ ID NO: 110535 - DNA, 11 bp, Unknown
  misc_feature (1)..( 11): Result.002 file - promoters60/1393761
attttcttaat

SEQ ID NO: 110536 - DNA, 11 bp, Unknown
  misc_feature (1)..( 11): Result.002 file - promoters60/1393761
attttcaatct

SEQ ID NO: 110537 - DNA, 11 bp, Unknown
  misc_feature (1)..( 11): Result.002 file - promoters60/1393761
tttttcataat

SEQ ID NO: 110538 - DNA, 10 bp, Unknown
  misc_feature (1)..( 10): Result.002 file - promoters60/1393761
ttttcttaat

SEQ ID NO: 110539 - DNA, 10 bp, Unknown
  misc_feature (1)..( 10): Result.002 file - promoters60/1393761
caatcttaaa

SEQ ID NO: 110540 - DNA, 10 bp, Unknown
  misc_feature (1)..( 10): Result.002 file - promoters60/1393761
ttttcataat

SEQ ID NO: 110541 - DNA, 7 bp, Unknown
  misc_feature (1)..( 7): Result.002 file - promoters60/1393761
ttaattt

SEQ ID NO: 110542 - DNA, 7 bp, Unknown
  misc_feature (1)..( 7): Result.002 file - promoters60/1393761
ttatttt

SEQ ID NO: 110543 - DNA, 7 bp, Unknown
  misc_feature (1)..( 7): Result.002 file - promoters60/1393761
ctatttt

SEQ ID NO: 110544 - DNA, 11 bp, Unknown
  misc_feature (1)..( 11): Result.002 file - promoters60/1393777
ttattttatat

SEQ ID NO: 110545 - DNA, 11 bp, Unknown
  misc_feature (1)..( 11): Result.002 file - promoters60/1393777
atatttttagc

SEQ ID NO: 110546 - DNA, 11 bp, Unknown
  misc_feature (1)..( 11): Result.002 file - promoters60/1393777
ttattttatat

SEQ ID NO: 110547 - DNA, 12 bp, Unknown
  misc_feature (1)..( 12): Result.002 file - promoters60/1393777
aaattgttaatg

SEQ ID NO: 110548 - DNA, 8 bp, Unknown
  misc_feature (1)..( 8): Result.002 file - promoters60/1393777
gtttttaa

SEQ ID NO: 110549 - DNA, 8 bp, Unknown
  misc_feature (1)..( 8): Result.002 file - promoters60/1393777
atttttag

SEQ ID NO: 110550 - DNA, 8 bp, Unknown
  misc_feature (1)..( 8): Result.002 file - promoters60/1393777
gtttataa

SEQ ID NO: 110551 - DNA, 8 bp, Unknown
  misc_feature (1)..( 8): Result.002 file - promoters60/1393777
attgttaa

SEQ ID NO: 110552 - DNA, 7 bp, Unknown
  misc_feature (1)..( 7): Result.002 file - promoters60/1393777
attatat

SEQ ID NO: 110553 - DNA, 7 bp, Unknown
  misc_feature (1)..( 7): Result.002 file - promoters60/1393777
tttatat

SEQ ID NO: 110554 - DNA, 7 bp, Unknown
  misc_feature (1)..( 7): Result.002 file - promoters60/1393777
tttttat

SEQ ID NO: 110555 - DNA, 9 bp, Unknown
  misc_feature (1)..( 9): Result.002 file - promoters60/1393777
agttttatt

SEQ ID NO: 110556 - DNA, 9 bp, Unknown
  misc_feature (1)..( 9): Result.002 file - promoters60/1393777
gcttttatt

SEQ ID NO: 110557 - DNA, 9 bp, Unknown
  misc_feature (1)..( 9): Result.002 file - promoters60/1393777
agttttaac

SEQ ID NO: 110558 - DNA, 8 bp, Unknown
  misc_feature (1)..( 8): Result.002 file - promoters60/1393777
ttttattt

SEQ ID NO: 110559 - DNA, 8 bp, Unknown
  misc_feature (1)..( 8): Result.002 file - promoters60/1393777
atttattt

SEQ ID NO: 110560 - DNA, 8 bp, Unknown
  misc_feature (1)..( 8): Result.002 file - promoters60/1393777
ctttattt

SEQ ID NO: 110561 - DNA, 8 bp, Unknown
  misc_feature (1)..( 8): Result.002 file - promoters60/1393777
attttttt

SEQ ID NO: 110562 - DNA, 8 bp, Unknown
  misc_feature (1)..( 8): Result.002 file - promoters60/1393777
tttttgat

SEQ ID NO: 110563 - DNA, 8 bp, Unknown
  misc_feature (1)..( 8): Result.002 file - promoters60/1393777
tttatgat

SEQ ID NO: 110564 - DNA, 9 bp, Unknown
  misc_feature (1)..( 9): Result.002 file - promoters60/1393777
tttcttgta

SEQ ID NO: 110565 - DNA, 10 bp, Unknown
  misc_feature (1)..( 10): Result.002 file - promoters60/1393777
ttgttatttt

SEQ ID NO: 110566 - DNA, 7 bp, Unknown
  misc_feature (1)..( 7): Result.002 file - promoters60/1393777
atttaaa

SEQ ID NO: 110567 - DNA, 7 bp, Unknown
  misc_feature (1)..( 7): Result.002 file - promoters60/1393777
attaaaa

SEQ ID NO: 110568 - DNA, 7 bp, Unknown
  misc_feature (1)..( 7): Result.002 file - promoters60/1393777
attaaac

SEQ ID NO: 110569 - DNA, 7 bp, Unknown
  misc_feature (1)..( 7): Result.002 file - promoters60/1393777
aataaaa

SEQ ID NO: 110570 - DNA, 10 bp, Unknown
  misc_feature (1)..( 10): Result.002 file - promoters60/1393777
aattttattt

SEQ ID NO: 110571 - DNA, 10 bp, Unknown
  misc_feature (1)..( 10): Result.002 file - promoters60/1393777
ctctttattt

SEQ ID NO: 110572 - DNA, 10 bp, Unknown
  misc_feature (1)..( 10): Result.002 file - promoters60/1393777
tattttatct

SEQ ID NO: 110573 - DNA, 10 bp, Unknown
  misc_feature (1)..( 10): Result.002 file - promoters60/1393777
tattttaatc

SEQ ID NO: 110574 - DNA, 10 bp, Unknown
  misc_feature (1)..( 10): Result.002 file - promoters60/1393777
aaaaatgttt

SEQ ID NO: 110575 - DNA, 10 bp, Unknown
  misc_feature (1)..( 10): Result.002 file - promoters60/1393777
aaaattgtta

SEQ ID NO: 110576 - DNA, 10 bp, Unknown
  misc_feature (1)..( 10): Result.002 file - promoters60/1393777
catattttta

SEQ ID NO: 110577 - DNA, 11 bp, Unknown
  misc_feature (1)..( 11): Result.002 file - promoters60/1393777
ttaagtattat

SEQ ID NO: 110578 - DNA, 11 bp, Unknown
  misc_feature (1)..( 11): Result.002 file - promoters60/1393777
ttaaggattaa

SEQ ID NO: 110579 - DNA, 11 bp, Unknown
  misc_feature (1)..( 11): Result.002 file - promoters60/1393777
ttctagattaa

SEQ ID NO: 110580 - DNA, 9 bp, Unknown
  misc_feature (1)..( 9): Result.002 file - promoters60/1393777
ccaatcagt

SEQ ID NO: 110581 - DNA, 9 bp, Unknown
  misc_feature (1)..( 9): Result.002 file - promoters60/1393777
ataataagt

SEQ ID NO: 110582 - DNA, 9 bp, Unknown
  misc_feature (1)..( 9): Result.002 file - promoters60/1393777
ccactcatt

SEQ ID NO: 110583 - DNA, 9 bp, Unknown
  misc_feature (1)..( 9): Result.002 file - promoters60/1393777
attaaaaac

SEQ ID NO: 110584 - DNA, 9 bp, Unknown
  misc_feature (1)..( 9): Result.002 file - promoters60/1393777
gaaaaaaac

SEQ ID NO: 110585 - DNA, 9 bp, Unknown
  misc_feature (1)..( 9): Result.002 file - promoters60/1393777
attaaaaat

SEQ ID NO: 110586 - DNA, 7 bp, Unknown
  misc_feature (1)..( 7): Result.002 file - promoters60/1393777
aacaaat

SEQ ID NO: 110587 - DNA, 7 bp, Unknown
  misc_feature (1)..( 7): Result.002 file - promoters60/1393777
aacaaat

SEQ ID NO: 110588 - DNA, 7 bp, Unknown
  misc_feature (1)..( 7): Result.002 file - promoters60/1393777
aacaaag

SEQ ID NO: 110589 - DNA, 9 bp, Unknown
  misc_feature (1)..( 9): Result.002 file - promoters60/1393777
aattaataa

SEQ ID NO: 110590 - DNA, 9 bp, Unknown
  misc_feature (1)..( 9): Result.002 file - promoters60/1393777
aatttataa

SEQ ID NO: 110591 - DNA, 9 bp, Unknown
  misc_feature (1)..( 9): Result.002 file - promoters60/1393777
tatttattt

SEQ ID NO: 110592 - DNA, 10 bp, Unknown
  misc_feature (1)..( 10): Result.002 file - promoters60/1393787
aaaagttatg

SEQ ID NO: 110593 - DNA, 10 bp, Unknown
  misc_feature (1)..( 10): Result.002 file - promoters60/1393787
cttagttata

SEQ ID NO: 110594 - DNA, 10 bp, Unknown
  misc_feature (1)..( 10): Result.002 file - promoters60/1393787
aaaagttatg

SEQ ID NO: 110595 - DNA, 10 bp, Unknown
  misc_feature (1)..( 10): Result.002 file - promoters60/1393787
taaaattagc

SEQ ID NO: 110596 - DNA, 9 bp, Unknown
  misc_feature (1)..( 9): Result.002 file - promoters60/1393787
taaattata

SEQ ID NO: 110597 - DNA, 10 bp, Unknown
  misc_feature (1)..( 10): Result.002 file - promoters60/1393787
ataatttact

SEQ ID NO: 110598 - DNA, 7 bp, Unknown
  misc_feature (1)..( 7): Result.002 file - promoters60/1393787
aatgatt

SEQ ID NO: 110599 - DNA, 7 bp, Unknown
  misc_feature (1)..( 7): Result.002 file - promoters60/1393802
gtcctca

SEQ ID NO: 110600 - DNA, 7 bp, Unknown
  misc_feature (1)..( 7): Result.002 file - promoters60/1393802
gtcgtca

SEQ ID NO: 110601 - DNA, 7 bp, Unknown
  misc_feature (1)..( 7): Result.002 file - promoters60/1393802
agagata

SEQ ID NO: 110602 - DNA, 7 bp, Unknown
  misc_feature (1)..( 7): Result.002 file - promoters60/1393802
agatata

SEQ ID NO: 110603 - DNA, 9 bp, Unknown
  misc_feature (1)..( 9): Result.002 file - promoters60/1393802
ttttaattt

SEQ ID NO: 110604 - DNA, 9 bp, Unknown
  misc_feature (1)..( 9): Result.002 file - promoters60/1393802
ttttcattt

SEQ ID NO: 110605 - DNA, 9 bp, Unknown
  misc_feature (1)..( 9): Result.002 file - promoters60/1393802
aacagtttt

SEQ ID NO: 110606 - DNA, 9 bp, Unknown
  misc_feature (1)..( 9): Result.002 file - promoters60/1393802
aacattttt

SEQ ID NO: 110607 - DNA, 6 bp, Unknown
  misc_feature (1)..( 6): Result.002 file - promoters60/1393802
ttttac

SEQ ID NO: 110608 - DNA, 6 bp, Unknown
  misc_feature (1)..( 6): Result.002 file - promoters60/1393802
ttttac

SEQ ID NO: 110609 - DNA, 6 bp, Unknown
  misc_feature (1)..( 6): Result.002 file - promoters60/1393802
caaaaa

SEQ ID NO: 110610 - DNA, 6 bp, Unknown
  misc_feature (1)..( 6): Result.002 file - promoters60/1393802
caaaaa

SEQ ID NO: 110611 - DNA, 6 bp, Unknown
  misc_feature (1)..( 6): Result.002 file - promoters60/1393802
attttt

SEQ ID NO: 110612 - DNA, 6 bp, Unknown
  misc_feature (1)..( 6): Result.002 file - promoters60/1393802
attttt

SEQ ID NO: 110613 - DNA, 11 bp, Unknown
  misc_feature (1)..( 11): Result.002 file - promoters60/1393802
taaccaaaaaa

SEQ ID NO: 110614 - DNA, 11 bp, Unknown
  misc_feature (1)..( 11): Result.002 file - promoters60/1393802
taacctaaaaa

SEQ ID NO: 110615 - DNA, 6 bp, Unknown
  misc_feature (1)..( 6): Result.002 file - promoters60/1393802
atgcac

SEQ ID NO: 110616 - DNA, 6 bp, Unknown
  misc_feature (1)..( 6): Result.002 file - promoters60/1393802
atgcac

SEQ ID NO: 110617 - DNA, 7 bp, Unknown
  misc_feature (1)..( 7): Result.002 file - promoters60/1393802
ctttgaa

SEQ ID NO: 110618 - DNA, 7 bp, Unknown
  misc_feature (1)..( 7): Result.002 file - promoters60/1393802
cttagaa

SEQ ID NO: 110619 - DNA, 8 bp, Unknown
  misc_feature (1)..( 8): Result.002 file - promoters60/1393802
gaaatctt

SEQ ID NO: 110620 - DNA, 8 bp, Unknown
  misc_feature (1)..( 8): Result.002 file - promoters60/1393802
gaaacctt

SEQ ID NO: 110621 - DNA, 9 bp, Unknown
  misc_feature (1)..( 9): Result.002 file - promoters60/1393802
aaacataaa

SEQ ID NO: 110622 - DNA, 9 bp, Unknown
  misc_feature (1)..( 9): Result.002 file - promoters60/1393802
aaacacaaa

SEQ ID NO: 110623 - DNA, 11 bp, Unknown
  misc_feature (1)..( 11): Result.002 file - promoters60/1393802
aaagttagaga

SEQ ID NO: 110624 - DNA, 11 bp, Unknown
  misc_feature (1)..( 11): Result.002 file - promoters60/1393802
aaagttcatct

SEQ ID NO: 110625 - DNA, 11 bp, Unknown
  misc_feature (1)..( 11): Result.002 file - promoters60/1393802
aaacttcatct

SEQ ID NO: 110626 - DNA, 6 bp, Unknown
  misc_feature (1)..( 6): Result.002 file - promoters60/1393802
atattt

SEQ ID NO: 110627 - DNA, 6 bp, Unknown
  misc_feature (1)..( 6): Result.002 file - promoters60/1393802
atattt

SEQ ID NO: 110628 - DNA, 7 bp, Unknown
  misc_feature (1)..( 7): Result.002 file - promoters60/1393802
agaaaaa

SEQ ID NO: 110629 - DNA, 7 bp, Unknown
  misc_feature (1)..( 7): Result.002 file - promoters60/1393802
agaaaaa

SEQ ID NO: 110630 - DNA, 7 bp, Unknown
  misc_feature (1)..( 7): Result.002 file - promoters60/1393802
gttaaaa

SEQ ID NO: 110631 - DNA, 7 bp, Unknown
  misc_feature (1)..( 7): Result.002 file - promoters60/1393802
gttcaaa

SEQ ID NO: 110632 - DNA, 8 bp, Unknown
  misc_feature (1)..( 8): Result.002 file - promoters60/1393802
tgattatt

SEQ ID NO: 110633 - DNA, 8 bp, Unknown
  misc_feature (1)..( 8): Result.002 file - promoters60/1393802
tgaatatt

SEQ ID NO: 110634 - DNA, 7 bp, Unknown
  misc_feature (1)..( 7): Result.002 file - promoters60/1393802
tattgtt

SEQ ID NO: 110635 - DNA, 7 bp, Unknown
  misc_feature (1)..( 7): Result.002 file - promoters60/1393802
tatagtt

SEQ ID NO: 110636 - DNA, 7 bp, Unknown
  misc_feature (1)..( 7): Result.002 file - promoters60/1393802
tatatgt

SEQ ID NO: 110637 - DNA, 7 bp, Unknown
  misc_feature (1)..( 7): Result.002 file - promoters60/1393802
tatgtgt

SEQ ID NO: 110638 - DNA, 7 bp, Unknown
  misc_feature (1)..( 7): Result.002 file - promoters60/1393802
taagatt

SEQ ID NO: 110639 - DNA, 7 bp, Unknown
  misc_feature (1)..( 7): Result.002 file - promoters60/1393802
taagatt

SEQ ID NO: 110640 - DNA, 7 bp, Unknown
  misc_feature (1)..( 7): Result.002 file - promoters60/1393802
tggttat

SEQ ID NO: 110641 - DNA, 7 bp, Unknown
  misc_feature (1)..( 7): Result.002 file - promoters60/1393802
tggatat

SEQ ID NO: 110642 - DNA, 8 bp, Unknown
  misc_feature (1)..( 8): Result.002 file - promoters60/1393802
attgtttt

SEQ ID NO: 110643 - DNA, 8 bp, Unknown
  misc_feature (1)..( 8): Result.002 file - promoters60/1393802
attttttt

SEQ ID NO: 110644 - DNA, 11 bp, Unknown
  misc_feature (1)..( 11): Result.002 file - promoters60/1393805
attttaatctc

SEQ ID NO: 110645 - DNA, 11 bp, Unknown
  misc_feature (1)..( 11): Result.002 file - promoters60/1393805
tttttattcta

SEQ ID NO: 110646 - DNA, 11 bp, Unknown
  misc_feature (1)..( 11): Result.002 file - promoters60/1393805
gttgtattcta

SEQ ID NO: 110647 - DNA, 11 bp, Unknown
  misc_feature (1)..( 11): Result.002 file - promoters60/1393805
caattaatctc

SEQ ID NO: 110648 - DNA, 11 bp, Unknown
  misc_feature (1)..( 11): Result.002 file - promoters60/1393805
tttttacggcg

SEQ ID NO: 110649 - DNA, 11 bp, Unknown
  misc_feature (1)..( 11): Result.002 file - promoters60/1393805
acattgatcca

SEQ ID NO: 110650 - DNA, 9 bp, Unknown
  misc_feature (1)..( 9): Result.002 file - promoters60/1393845
gttataatt

SEQ ID NO: 110651 - DNA, 9 bp, Unknown
  misc_feature (1)..( 9): Result.002 file - promoters60/1393845
attaaaata

SEQ ID NO: 110652 - DNA, 9 bp, Unknown
  misc_feature (1)..( 9): Result.002 file - promoters60/1393845
attataatt

SEQ ID NO: 110653 - DNA, 9 bp, Unknown
  misc_feature (1)..( 9): Result.002 file - promoters60/1393845
cttaatata

SEQ ID NO: 110654 - DNA, 11 bp, Unknown
  misc_feature (1)..( 11): Result.002 file - promoters60/1393845
attcaaaatga

SEQ ID NO: 110655 - DNA, 11 bp, Unknown
  misc_feature (1)..( 11): Result.002 file - promoters60/1393845
attcgaaatgg

SEQ ID NO: 110656 - DNA, 11 bp, Unknown
  misc_feature (1)..( 11): Result.002 file - promoters60/1393845
cttcaaagaaa

SEQ ID NO: 110657 - DNA, 11 bp, Unknown
  misc_feature (1)..( 11): Result.002 file - promoters60/1393845
tacagaaatgg

SEQ ID NO: 110658 - DNA, 12 bp, Unknown
  misc_feature (1)..( 12): Result.002 file - promoters60/1393845
aaaattaaaata

SEQ ID NO: 110659 - DNA, 12 bp, Unknown
  misc_feature (1)..( 12): Result.002 file - promoters60/1393845
aattctaaaatc

SEQ ID NO: 110660 - DNA, 12 bp, Unknown
  misc_feature (1)..( 12): Result.002 file - promoters60/1393845
aattcttaaatt

SEQ ID NO: 110661 - DNA, 12 bp, Unknown
  misc_feature (1)..( 12): Result.002 file - promoters60/1393845
ctttattaaatt

SEQ ID NO: 110662 - DNA, 11 bp, Unknown
  misc_feature (1)..( 11): Result.002 file - promoters60/1393845
tattattacaa

SEQ ID NO: 110663 - DNA, 11 bp, Unknown
  misc_feature (1)..( 11): Result.002 file - promoters60/1393845
aattcttaaat

SEQ ID NO: 110664 - DNA, 11 bp, Unknown
  misc_feature (1)..( 11): Result.002 file - promoters60/1393845
ctttattaaat

SEQ ID NO: 110665 - DNA, 11 bp, Unknown
  misc_feature (1)..( 11): Result.002 file - promoters60/1393845
aattctaaaat

SEQ ID NO: 110666 - DNA, 6 bp, Unknown
  misc_feature (1)..( 6): Result.002 file - promoters60/1394110
tttaaa

SEQ ID NO: 110667 - DNA, 6 bp, Unknown
  misc_feature (1)..( 6): Result.002 file - promoters60/1394110
tttaaa

SEQ ID NO: 110668 - DNA, 7 bp, Unknown
  misc_feature (1)..( 7): Result.002 file - promoters60/1394110
cacatat

SEQ ID NO: 110669 - DNA, 7 bp, Unknown
  misc_feature (1)..( 7): Result.002 file - promoters60/1394110
cacttat

SEQ ID NO: 110670 - DNA, 8 bp, Unknown
  misc_feature (1)..( 8): Result.002 file - promoters60/1394110
attaataa

SEQ ID NO: 110671 - DNA, 8 bp, Unknown
  misc_feature (1)..( 8): Result.002 file - promoters60/1394110
atttataa

SEQ ID NO: 110672 - DNA, 8 bp, Unknown
  misc_feature (1)..( 8): Result.002 file - promoters60/1394110
aaattaaa

SEQ ID NO: 110673 - DNA, 8 bp, Unknown
  misc_feature (1)..( 8): Result.002 file - promoters60/1394110
aaactaaa

SEQ ID NO: 110674 - DNA, 10 bp, Unknown
  misc_feature (1)..( 10): Result.002 file - promoters60/1394110
ttttcaaaaa

SEQ ID NO: 110675 - DNA, 10 bp, Unknown
  misc_feature (1)..( 10): Result.002 file - promoters60/1394110
ttttccaaat

SEQ ID NO: 110676 - DNA, 10 bp, Unknown
  misc_feature (1)..( 10): Result.002 file - promoters60/1394110
acgtcaaaaa

SEQ ID NO: 110677 - DNA, 8 bp, Unknown
  misc_feature (1)..( 8): Result.002 file - promoters60/1394110
taatttaa

SEQ ID NO: 110678 - DNA, 8 bp, Unknown
  misc_feature (1)..( 8): Result.002 file - promoters60/1394110
taatgtaa

SEQ ID NO: 110679 - DNA, 6 bp, Unknown
  misc_feature (1)..( 6): Result.002 file - promoters60/1394110
aaacat

SEQ ID NO: 110680 - DNA, 6 bp, Unknown
  misc_feature (1)..( 6): Result.002 file - promoters60/1394110
aaacat

SEQ ID NO: 110681 - DNA, 7 bp, Unknown
  misc_feature (1)..( 7): Result.002 file - promoters60/1394110
taatata

SEQ ID NO: 110682 - DNA, 7 bp, Unknown
  misc_feature (1)..( 7): Result.002 file - promoters60/1394110
taatata

SEQ ID NO: 110683 - DNA, 7 bp, Unknown
  misc_feature (1)..( 7): Result.002 file - promoters60/1394110
aagactc

SEQ ID NO: 110684 - DNA, 7 bp, Unknown
  misc_feature (1)..( 7): Result.002 file - promoters60/1394110
aagactc

SEQ ID NO: 110685 - DNA, 7 bp, Unknown
  misc_feature (1)..( 7): Result.002 file - promoters60/1394110
atactaa

SEQ ID NO: 110686 - DNA, 7 bp, Unknown
  misc_feature (1)..( 7): Result.002 file - promoters60/1394110
atattaa

SEQ ID NO: 110687 - DNA, 13 bp, Unknown
  misc_feature (1)..( 13): Result.002 file - promoters60/1394110
aaaagactaaaac

SEQ ID NO: 110688 - DNA, 13 bp, Unknown
  misc_feature (1)..( 13): Result.002 file - promoters60/1394110
attaaggtaaaac

SEQ ID NO: 110689 - DNA, 13 bp, Unknown
  misc_feature (1)..( 13): Result.002 file - promoters60/1394110
aaaagagtaaaaa

SEQ ID NO: 110690 - DNA, 8 bp, Unknown
  misc_feature (1)..( 8): Result.002 file - promoters60/1394110
aaaaagac

SEQ ID NO: 110691 - DNA, 8 bp, Unknown
  misc_feature (1)..( 8): Result.002 file - promoters60/1394110
taaaagac

SEQ ID NO: 110692 - DNA, 8 bp, Unknown
  misc_feature (1)..( 8): Result.002 file - promoters60/1394110
aaaaagaa

SEQ ID NO: 110693 - DNA, 6 bp, Unknown
  misc_feature (1)..( 6): Result.002 file - promoters60/1394110
tcttgg

SEQ ID NO: 110694 - DNA, 6 bp, Unknown
  misc_feature (1)..( 6): Result.002 file - promoters60/1394110
tcttgg

SEQ ID NO: 110695 - DNA, 7 bp, Unknown
  misc_feature (1)..( 7): Result.002 file - promoters60/1394110
cacttgt

SEQ ID NO: 110696 - DNA, 7 bp, Unknown
  misc_feature (1)..( 7): Result.002 file - promoters60/1394110
cacttgt

SEQ ID NO: 110697 - DNA, 6 bp, Unknown
  misc_feature (1)..( 6): Result.002 file - promoters60/1394110
acattt

SEQ ID NO: 110698 - DNA, 6 bp, Unknown
  misc_feature (1)..( 6): Result.002 file - promoters60/1394110
acattt

SEQ ID NO: 110699 - DNA, 7 bp, Unknown
  misc_feature (1)..( 7): Result.002 file - promoters60/1394110
tatgtgt

SEQ ID NO: 110700 - DNA, 7 bp, Unknown
  misc_feature (1)..( 7): Result.002 file - promoters60/1394110
tatttgt

SEQ ID NO: 110701 - DNA, 8 bp, Unknown
  misc_feature (1)..( 8): Result.002 file - promoters60/1394110
gtttcttt

SEQ ID NO: 110702 - DNA, 8 bp, Unknown
  misc_feature (1)..( 8): Result.002 file - promoters60/1394110
gtttattt

SEQ ID NO: 110703 - DNA, 9 bp, Unknown
  misc_feature (1)..( 9): Result.002 file - promoters60/1394110
aaaatcaag

SEQ ID NO: 110704 - DNA, 9 bp, Unknown
  misc_feature (1)..( 9): Result.002 file - promoters60/1394110
aaaatcaag

SEQ ID NO: 110705 - DNA, 8 bp, Unknown
  misc_feature (1)..( 8): Result.002 file - promoters60/1394110
cttaatat

SEQ ID NO: 110706 - DNA, 8 bp, Unknown
  misc_feature (1)..( 8): Result.002 file - promoters60/1394110
cttcatat

SEQ ID NO: 110707 - DNA, 7 bp, Unknown
  misc_feature (1)..( 7): Result.002 file - promoters60/1394110
caaatac

SEQ ID NO: 110708 - DNA, 7 bp, Unknown
  misc_feature (1)..( 7): Result.002 file - promoters60/1394110
caattac

SEQ ID NO: 110709 - DNA, 7 bp, Unknown
  misc_feature (1)..( 7): Result.002 file - promoters60/1394110
attatca

SEQ ID NO: 110710 - DNA, 7 bp, Unknown
  misc_feature (1)..( 7): Result.002 file - promoters60/1394110
attttca

SEQ ID NO: 110711 - DNA, 6 bp, Unknown
  misc_feature (1)..( 6): Result.002 file - promoters60/1394110
aataaa

SEQ ID NO: 110712 - DNA, 6 bp, Unknown
  misc_feature (1)..( 6): Result.002 file - promoters60/1394110
aataaa

SEQ ID NO: 110713 - DNA, 7 bp, Unknown
  misc_feature (1)..( 7): Result.002 file - promoters60/1394110
aaacaaa

SEQ ID NO: 110714 - DNA, 7 bp, Unknown
  misc_feature (1)..( 7): Result.002 file - promoters60/1394110
aaagaaa

SEQ ID NO: 110715 - DNA, 6 bp, Unknown
  misc_feature (1)..( 6): Result.002 file - promoters60/1394110
aataaa

SEQ ID NO: 110716 - DNA, 6 bp, Unknown
  misc_feature (1)..( 6): Result.002 file - promoters60/1394110
aataaa

SEQ ID NO: 110717 - DNA, 6 bp, Unknown
  misc_feature (1)..( 6): Result.002 file - promoters60/1394110
agacaa

SEQ ID NO: 110718 - DNA, 6 bp, Unknown
  misc_feature (1)..( 6): Result.002 file - promoters60/1394110
agacaa

SEQ ID NO: 110719 - DNA, 9 bp, Unknown
  misc_feature (1)..( 9): Result.002 file - promoters60/1394110
gagacaacc

SEQ ID NO: 110720 - DNA, 9 bp, Unknown
  misc_feature (1)..( 9): Result.002 file - promoters60/1394110
gagaaaacc

SEQ ID NO: 110721 - DNA, 6 bp, Unknown
  misc_feature (1)..( 6): Result.002 file - promoters60/1394178
ttcaca

SEQ ID NO: 110722 - DNA, 6 bp, Unknown
  misc_feature (1)..( 6): Result.002 file - promoters60/1394178
ttcaca

SEQ ID NO: 110723 - DNA, 8 bp, Unknown
  misc_feature (1)..( 8): Result.002 file - promoters60/1394178
tgaatgaa

SEQ ID NO: 110724 - DNA, 8 bp, Unknown
  misc_feature (1)..( 8): Result.002 file - promoters60/1394178
tgattgaa

SEQ ID NO: 110725 - DNA, 6 bp, Unknown
  misc_feature (1)..( 6): Result.002 file - promoters60/1394178
gccaag

SEQ ID NO: 110726 - DNA, 6 bp, Unknown
  misc_feature (1)..( 6): Result.002 file - promoters60/1394178
gccaag

SEQ ID NO: 110727 - DNA, 8 bp, Unknown
  misc_feature (1)..( 8): Result.002 file - promoters60/1394178
tggagagg

SEQ ID NO: 110728 - DNA, 8 bp, Unknown
  misc_feature (1)..( 8): Result.002 file - promoters60/1394178
tggaaagg

SEQ ID NO: 110729 - DNA, 12 bp, Unknown
  misc_feature (1)..( 12): Result.002 file - promoters60/1394178
aaatctctcatt

SEQ ID NO: 110730 - DNA, 12 bp, Unknown
  misc_feature (1)..( 12): Result.002 file - promoters60/1394178
aaatttctgatt

SEQ ID NO: 110731 - DNA, 8 bp, Unknown
  misc_feature (1)..( 8): Result.002 file - promoters60/1394178
tttcttaa

SEQ ID NO: 110732 - DNA, 8 bp, Unknown
  misc_feature (1)..( 8): Result.002 file - promoters60/1394178
tttattaa

SEQ ID NO: 110733 - DNA, 9 bp, Unknown
  misc_feature (1)..( 9): Result.002 file - promoters60/1394178
tttttttct

SEQ ID NO: 110734 - DNA, 9 bp, Unknown
  misc_feature (1)..( 9): Result.002 file - promoters60/1394178
ttttattct

SEQ ID NO: 110735 - DNA, 9 bp, Unknown
  misc_feature (1)..( 9): Result.002 file - promoters60/1394178
tttttctta

SEQ ID NO: 110736 - DNA, 9 bp, Unknown
  misc_feature (1)..( 9): Result.002 file - promoters60/1394178
tttttttta

SEQ ID NO: 110737 - DNA, 7 bp, Unknown
  misc_feature (1)..( 7): Result.002 file - promoters60/1394178
aatgtaa

SEQ ID NO: 110738 - DNA, 7 bp, Unknown
  misc_feature (1)..( 7): Result.002 file - promoters60/1394178
aatataa

SEQ ID NO: 110739 - DNA, 7 bp, Unknown
  misc_feature (1)..( 7): Result.002 file - promoters60/1394178
gtatcaa

SEQ ID NO: 110740 - DNA, 7 bp, Unknown
  misc_feature (1)..( 7): Result.002 file - promoters60/1394178
gtatcaa

SEQ ID NO: 110741 - DNA, 9 bp, Unknown
  misc_feature (1)..( 9): Result.002 file - promoters60/1394178
aattaccaa

SEQ ID NO: 110742 - DNA, 9 bp, Unknown
  misc_feature (1)..( 9): Result.002 file - promoters60/1394178
aataaccaa

SEQ ID NO: 110743 - DNA, 8 bp, Unknown
  misc_feature (1)..( 8): Result.002 file - promoters60/1394178
cagctatt

SEQ ID NO: 110744 - DNA, 8 bp, Unknown
  misc_feature (1)..( 8): Result.002 file - promoters60/1394178
cagttatt

SEQ ID NO: 110745 - DNA, 7 bp, Unknown
  misc_feature (1)..( 7): Result.002 file - promoters60/1394178
attgttg

SEQ ID NO: 110746 - DNA, 7 bp, Unknown
  misc_feature (1)..( 7): Result.002 file - promoters60/1394178
atttttg

SEQ ID NO: 110747 - DNA, 8 bp, Unknown
  misc_feature (1)..( 8): Result.002 file - promoters60/1394178
catataaa

SEQ ID NO: 110748 - DNA, 8 bp, Unknown
  misc_feature (1)..( 8): Result.002 file - promoters60/1394178
cataaaaa

SEQ ID NO: 110749 - DNA, 7 bp, Unknown
  misc_feature (1)..( 7): Result.002 file - promoters60/1394178
acagatt

SEQ ID NO: 110750 - DNA, 7 bp, Unknown
  misc_feature (1)..( 7): Result.002 file - promoters60/1394178
acatatt

SEQ ID NO: 110751 - DNA, 7 bp, Unknown
  misc_feature (1)..( 7): Result.002 file - promoters60/1394178
tttagtt

SEQ ID NO: 110752 - DNA, 7 bp, Unknown
  misc_feature (1)..( 7): Result.002 file - promoters60/1394178
ttttgtt

SEQ ID NO: 110753 - DNA, 8 bp, Unknown
  misc_feature (1)..( 8): Result.002 file - promoters60/1394178
ttcacaaa

SEQ ID NO: 110754 - DNA, 8 bp, Unknown
  misc_feature (1)..( 8): Result.002 file - promoters60/1394178
ttcaaaaa

SEQ ID NO: 110755 - DNA, 8 bp, Unknown
  misc_feature (1)..( 8): Result.002 file - promoters60/1394302
ttgttaaa

SEQ ID NO: 110756 - DNA, 8 bp, Unknown
  misc_feature (1)..( 8): Result.002 file - promoters60/1394302
ttgttaat

SEQ ID NO: 110757 - DNA, 8 bp, Unknown
  misc_feature (1)..( 8): Result.002 file - promoters60/1394302
acgttaat

SEQ ID NO: 110758 - DNA, 17 bp, Unknown
  misc_feature (1)..( 17): Result.002 file - promoters60/1394302
actgtttaaaaagaaaa

SEQ ID NO: 110759 - DNA, 17 bp, Unknown
  misc_feature (1)..( 17): Result.002 file - promoters60/1394302
tatgttaaaaaataaaa

SEQ ID NO: 110760 - DNA, 17 bp, Unknown
  misc_feature (1)..( 17): Result.002 file - promoters60/1394302
actttttctatcaaggt

SEQ ID NO: 110761 - DNA, 9 bp, Unknown
  misc_feature (1)..( 9): Result.002 file - promoters60/1394327
caaaacttt

SEQ ID NO: 110762 - DNA, 9 bp, Unknown
  misc_feature (1)..( 9): Result.002 file - promoters60/1394327
caagactta

SEQ ID NO: 110763 - DNA, 9 bp, Unknown
  misc_feature (1)..( 9): Result.002 file - promoters60/1394327
gaaaatttt

SEQ ID NO: 110764 - DNA, 6 bp, Unknown
  misc_feature (1)..( 6): Result.002 file - promoters60/1394327
ataatt

SEQ ID NO: 110765 - DNA, 6 bp, Unknown
  misc_feature (1)..( 6): Result.002 file - promoters60/1394327
ataatt

SEQ ID NO: 110766 - DNA, 6 bp, Unknown
  misc_feature (1)..( 6): Result.002 file - promoters60/1394327
tttctt

SEQ ID NO: 110767 - DNA, 6 bp, Unknown
  misc_feature (1)..( 6): Result.002 file - promoters60/1394327
tttctt

SEQ ID NO: 110768 - DNA, 7 bp, Unknown
  misc_feature (1)..( 7): Result.002 file - promoters60/1394327
ccaagct

SEQ ID NO: 110769 - DNA, 7 bp, Unknown
  misc_feature (1)..( 7): Result.002 file - promoters60/1394327
ccaagct

SEQ ID NO: 110770 - DNA, 7 bp, Unknown
  misc_feature (1)..( 7): Result.002 file - promoters60/1394327
gctttta

SEQ ID NO: 110771 - DNA, 7 bp, Unknown
  misc_feature (1)..( 7): Result.002 file - promoters60/1394327
gctttta

SEQ ID NO: 110772 - DNA, 8 bp, Unknown
  misc_feature (1)..( 8): Result.002 file - promoters60/1394327
tgttatct

SEQ ID NO: 110773 - DNA, 8 bp, Unknown
  misc_feature (1)..( 8): Result.002 file - promoters60/1394327
tgttctct

SEQ ID NO: 110774 - DNA, 7 bp, Unknown
  misc_feature (1)..( 7): Result.002 file - promoters60/1394327
tcatata

SEQ ID NO: 110775 - DNA, 7 bp, Unknown
  misc_feature (1)..( 7): Result.002 file - promoters60/1394327
tcacata

SEQ ID NO: 110776 - DNA, 7 bp, Unknown
  misc_feature (1)..( 7): Result.002 file - promoters60/1394327
ttttcaa

SEQ ID NO: 110777 - DNA, 7 bp, Unknown
  misc_feature (1)..( 7): Result.002 file - promoters60/1394327
ttttcaa

SEQ ID NO: 110778 - DNA, 6 bp, Unknown
  misc_feature (1)..( 6): Result.002 file - promoters60/1394327
ccatat

SEQ ID NO: 110779 - DNA, 6 bp, Unknown
  misc_feature (1)..( 6): Result.002 file - promoters60/1394327
ccatat

SEQ ID NO: 110780 - DNA, 6 bp, Unknown
  misc_feature (1)..( 6): Result.002 file - promoters60/1394327
aagtct

SEQ ID NO: 110781 - DNA, 6 bp, Unknown
  misc_feature (1)..( 6): Result.002 file - promoters60/1394327
aagtct

SEQ ID NO: 110782 - DNA, 6 bp, Unknown
  misc_feature (1)..( 6): Result.002 file - promoters60/1394327
tcttct

SEQ ID NO: 110783 - DNA, 6 bp, Unknown
  misc_feature (1)..( 6): Result.002 file - promoters60/1394327
tcttct

SEQ ID NO: 110784 - DNA, 7 bp, Unknown
  misc_feature (1)..( 7): Result.002 file - promoters60/1394327
agatttt

SEQ ID NO: 110785 - DNA, 7 bp, Unknown
  misc_feature (1)..( 7): Result.002 file - promoters60/1394327
agaattt

SEQ ID NO: 110786 - DNA, 7 bp, Unknown
  misc_feature (1)..( 7): Result.002 file - promoters60/1394327
caaccat

SEQ ID NO: 110787 - DNA, 7 bp, Unknown
  misc_feature (1)..( 7): Result.002 file - promoters60/1394327
caaacat

SEQ ID NO: 110788 - DNA, 7 bp, Unknown
  misc_feature (1)..( 7): Result.002 file - promoters60/1394327
tcctaat

SEQ ID NO: 110789 - DNA, 7 bp, Unknown
  misc_feature (1)..( 7): Result.002 file - promoters60/1394327
tccaaat

SEQ ID NO: 110790 - DNA, 7 bp, Unknown
  misc_feature (1)..( 7): Result.002 file - promoters60/1394327
aaagatg

SEQ ID NO: 110791 - DNA, 7 bp, Unknown
  misc_feature (1)..( 7): Result.002 file - promoters60/1394327
aaagatg

SEQ ID NO: 110792 - DNA, 6 bp, Unknown
  misc_feature (1)..( 6): Result.002 file - promoters60/1394327
gcaaaa

SEQ ID NO: 110793 - DNA, 6 bp, Unknown
  misc_feature (1)..( 6): Result.002 file - promoters60/1394327
gcaaaa

SEQ ID NO: 110794 - DNA, 7 bp, Unknown
  misc_feature (1)..( 7): Result.002 file - promoters60/1394327
ataggga

SEQ ID NO: 110795 - DNA, 7 bp, Unknown
  misc_feature (1)..( 7): Result.002 file - promoters60/1394327
atatgga

SEQ ID NO: 110796 - DNA, 9 bp, Unknown
  misc_feature (1)..( 9): Result.002 file - promoters60/1394465
agttgtttt

SEQ ID NO: 110797 - DNA, 9 bp, Unknown
  misc_feature (1)..( 9): Result.002 file - promoters60/1394465
atttgattt

SEQ ID NO: 110798 - DNA, 9 bp, Unknown
  misc_feature (1)..( 9): Result.002 file - promoters60/1394465
atttaattt

SEQ ID NO: 110799 - DNA, 8 bp, Unknown
  misc_feature (1)..( 8): Result.002 file - promoters60/1394465
tttttata

SEQ ID NO: 110800 - DNA, 8 bp, Unknown
  misc_feature (1)..( 8): Result.002 file - promoters60/1394465
atttgata

SEQ ID NO: 110801 - DNA, 8 bp, Unknown
  misc_feature (1)..( 8): Result.002 file - promoters60/1394465
atttgatt

SEQ ID NO: 110802 - DNA, 9 bp, Unknown
  misc_feature (1)..( 9): Result.002 file - promoters60/1394465
catcgtctt

SEQ ID NO: 110803 - DNA, 9 bp, Unknown
  misc_feature (1)..( 9): Result.002 file - promoters60/1394465
catcttcta

SEQ ID NO: 110804 - DNA, 9 bp, Unknown
  misc_feature (1)..( 9): Result.002 file - promoters60/1394465
tgccgtctt

SEQ ID NO: 110805 - DNA, 9 bp, Unknown
  misc_feature (1)..( 9): Result.002 file - promoters60/1394480
aaactttaa

SEQ ID NO: 110806 - DNA, 9 bp, Unknown
  misc_feature (1)..( 9): Result.002 file - promoters60/1394480
aaaatttct

SEQ ID NO: 110807 - DNA, 9 bp, Unknown
  misc_feature (1)..( 9): Result.002 file - promoters60/1394480
aaaatctct

SEQ ID NO: 110808 - DNA, 8 bp, Unknown
  misc_feature (1)..( 8): Result.002 file - promoters60/1394480
tttgaaac

SEQ ID NO: 110809 - DNA, 8 bp, Unknown
  misc_feature (1)..( 8): Result.002 file - promoters60/1394480
tgtgaaac

SEQ ID NO: 110810 - DNA, 8 bp, Unknown
  misc_feature (1)..( 8): Result.002 file - promoters60/1394480
tgtgaaaa

SEQ ID NO: 110811 - DNA, 9 bp, Unknown
  misc_feature (1)..( 9): Result.002 file - promoters60/1394480
gatatttct

SEQ ID NO: 110812 - DNA, 9 bp, Unknown
  misc_feature (1)..( 9): Result.002 file - promoters60/1394480
aaaatttct

SEQ ID NO: 110813 - DNA, 9 bp, Unknown
  misc_feature (1)..( 9): Result.002 file - promoters60/1394480
aaaatctct

SEQ ID NO: 110814 - DNA, 9 bp, Unknown
  misc_feature (1)..( 9): Result.002 file - promoters60/1394480
tttcaaaat

SEQ ID NO: 110815 - DNA, 9 bp, Unknown
  misc_feature (1)..( 9): Result.002 file - promoters60/1394480
tatcaaaat

SEQ ID NO: 110816 - DNA, 9 bp, Unknown
  misc_feature (1)..( 9): Result.002 file - promoters60/1394480
ttttaaaat

SEQ ID NO: 110817 - DNA, 6 bp, Unknown
  misc_feature (1)..( 6): Result.002 file - promoters60/1394480
taacat

SEQ ID NO: 110818 - DNA, 6 bp, Unknown
  misc_feature (1)..( 6): Result.002 file - promoters60/1394480
taacat

SEQ ID NO: 110819 - DNA, 7 bp, Unknown
  misc_feature (1)..( 7): Result.002 file - promoters60/1394480
aaaatat

SEQ ID NO: 110820 - DNA, 7 bp, Unknown
  misc_feature (1)..( 7): Result.002 file - promoters60/1394480
aaattat

SEQ ID NO: 110821 - DNA, 8 bp, Unknown
  misc_feature (1)..( 8): Result.002 file - promoters60/1394480
taattaaa

SEQ ID NO: 110822 - DNA, 8 bp, Unknown
  misc_feature (1)..( 8): Result.002 file - promoters60/1394480
taactaaa

SEQ ID NO: 110823 - DNA, 6 bp, Unknown
  misc_feature (1)..( 6): Result.002 file - promoters60/1394480
aatcaa

SEQ ID NO: 110824 - DNA, 6 bp, Unknown
  misc_feature (1)..( 6): Result.002 file - promoters60/1394480
aatcaa

SEQ ID NO: 110825 - DNA, 14 bp, Unknown
  misc_feature (1)..( 14): Result.002 file - promoters60/1394480
tcaataaatacaca

SEQ ID NO: 110826 - DNA, 14 bp, Unknown
  misc_feature (1)..( 14): Result.002 file - promoters60/1394480
tcaataaatagaca

SEQ ID NO: 110827 - DNA, 7 bp, Unknown
  misc_feature (1)..( 7): Result.002 file - promoters60/1394480
aaataaa

SEQ ID NO: 110828 - DNA, 7 bp, Unknown
  misc_feature (1)..( 7): Result.002 file - promoters60/1394480
aaaaaaa

SEQ ID NO: 110829 - DNA, 9 bp, Unknown
  misc_feature (1)..( 9): Result.002 file - promoters60/1394480
ctgttttca

SEQ ID NO: 110830 - DNA, 9 bp, Unknown
  misc_feature (1)..( 9): Result.002 file - promoters60/1394480
ctgctttca

SEQ ID NO: 110831 - DNA, 7 bp, Unknown
  misc_feature (1)..( 7): Result.002 file - promoters60/1394480
attttgg

SEQ ID NO: 110832 - DNA, 7 bp, Unknown
  misc_feature (1)..( 7): Result.002 file - promoters60/1394480
attttgg

SEQ ID NO: 110833 - DNA, 8 bp, Unknown
  misc_feature (1)..( 8): Result.002 file - promoters60/1394480
tcaaattt

SEQ ID NO: 110834 - DNA, 8 bp, Unknown
  misc_feature (1)..( 8): Result.002 file - promoters60/1394480
tcaatttt

SEQ ID NO: 110835 - DNA, 7 bp, Unknown
  misc_feature (1)..( 7): Result.002 file - promoters60/1394480
gtaatgg

SEQ ID NO: 110836 - DNA, 7 bp, Unknown
  misc_feature (1)..( 7): Result.002 file - promoters60/1394480
gtattgg

SEQ ID NO: 110837 - DNA, 6 bp, Unknown
  misc_feature (1)..( 6): Result.002 file - promoters60/1394480
aaaatg

SEQ ID NO: 110838 - DNA, 6 bp, Unknown
  misc_feature (1)..( 6): Result.002 file - promoters60/1394480
aaaatg

SEQ ID NO: 110839 - DNA, 6 bp, Unknown
  misc_feature (1)..( 6): Result.002 file - promoters60/1394480
aagatt

SEQ ID NO: 110840 - DNA, 6 bp, Unknown
  misc_feature (1)..( 6): Result.002 file - promoters60/1394480
aagatt

SEQ ID NO: 110841 - DNA, 8 bp, Unknown
  misc_feature (1)..( 8): Result.002 file - promoters60/1394480
atgtaaac

SEQ ID NO: 110842 - DNA, 8 bp, Unknown
  misc_feature (1)..( 8): Result.002 file - promoters60/1394480
atgtcaac

SEQ ID NO: 110843 - DNA, 7 bp, Unknown
  misc_feature (1)..( 7): Result.002 file - promoters60/1394480
gaaaaat

SEQ ID NO: 110844 - DNA, 7 bp, Unknown
  misc_feature (1)..( 7): Result.002 file - promoters60/1394480
gaagaat

SEQ ID NO: 110845 - DNA, 7 bp, Unknown
  misc_feature (1)..( 7): Result.002 file - promoters60/1394480
caaaatt

SEQ ID NO: 110846 - DNA, 7 bp, Unknown
  misc_feature (1)..( 7): Result.002 file - promoters60/1394480
caatatt

SEQ ID NO: 110847 - DNA, 7 bp, Unknown
  misc_feature (1)..( 7): Result.002 file - promoters60/1394480
acaactt

SEQ ID NO: 110848 - DNA, 7 bp, Unknown
  misc_feature (1)..( 7): Result.002 file - promoters60/1394480
acatctt

SEQ ID NO: 110849 - DNA, 7 bp, Unknown
  misc_feature (1)..( 7): Result.002 file - promoters60/1394480
tttattt

SEQ ID NO: 110850 - DNA, 7 bp, Unknown
  misc_feature (1)..( 7): Result.002 file - promoters60/1394480
ttttttt

SEQ ID NO: 110851 - DNA, 6 bp, Unknown
  misc_feature (1)..( 6): Result.002 file - promoters60/1394480
ttggtt

SEQ ID NO: 110852 - DNA, 6 bp, Unknown
  misc_feature (1)..( 6): Result.002 file - promoters60/1394480
ttggtt

SEQ ID NO: 110853 - DNA, 6 bp, Unknown
  misc_feature (1)..( 6): Result.002 file - promoters60/1394480
aaaagt

SEQ ID NO: 110854 - DNA, 6 bp, Unknown
  misc_feature (1)..( 6): Result.002 file - promoters60/1394480
aaaagt

SEQ ID NO: 110855 - DNA, 12 bp, Unknown
  misc_feature (1)..( 12): Result.002 file - promoters60/1394510
ttaagagttaag

SEQ ID NO: 110856 - DNA, 12 bp, Unknown
  misc_feature (1)..( 12): Result.002 file - promoters60/1394510
ttaatagttttt

SEQ ID NO: 110857 - DNA, 12 bp, Unknown
  misc_feature (1)..( 12): Result.002 file - promoters60/1394510
ttaagatttttg

SEQ ID NO: 110858 - DNA, 12 bp, Unknown
  misc_feature (1)..( 12): Result.002 file - promoters60/1394510
ataacatttttt

SEQ ID NO: 110859 - DNA, 12 bp, Unknown
  misc_feature (1)..( 12): Result.002 file - promoters60/1394510
ttagaatttttt

SEQ ID NO: 110860 - DNA, 14 bp, Unknown
  misc_feature (1)..( 14): Result.002 file - promoters60/1394510
acatttaactttat

SEQ ID NO: 110861 - DNA, 14 bp, Unknown
  misc_feature (1)..( 14): Result.002 file - promoters60/1394510
acacaaaactatat

SEQ ID NO: 110862 - DNA, 14 bp, Unknown
  misc_feature (1)..( 14): Result.002 file - promoters60/1394510
acatgtaatttttc

SEQ ID NO: 110863 - DNA, 14 bp, Unknown
  misc_feature (1)..( 14): Result.002 file - promoters60/1394510
agaataaactaatt

SEQ ID NO: 110864 - DNA, 11 bp, Unknown
  misc_feature (1)..( 11): Result.002 file - promoters60/1394510
atatcatccaa

SEQ ID NO: 110865 - DNA, 11 bp, Unknown
  misc_feature (1)..( 11): Result.002 file - promoters60/1394510
ataacattttt

SEQ ID NO: 110866 - DNA, 11 bp, Unknown
  misc_feature (1)..( 11): Result.002 file - promoters60/1394510
ttaagattttt

SEQ ID NO: 110867 - DNA, 11 bp, Unknown
  misc_feature (1)..( 11): Result.002 file - promoters60/1394510
ttagaattttt

SEQ ID NO: 110868 - DNA, 11 bp, Unknown
  misc_feature (1)..( 11): Result.002 file - promoters60/1394510
tggagactttg

SEQ ID NO: 110869 - DNA, 9 bp, Unknown
  misc_feature (1)..( 9): Result.002 file - promoters60/1394510
aatttggct

SEQ ID NO: 110870 - DNA, 9 bp, Unknown
  misc_feature (1)..( 9): Result.002 file - promoters60/1394510
aatgtggtg

SEQ ID NO: 110871 - DNA, 9 bp, Unknown
  misc_feature (1)..( 9): Result.002 file - promoters60/1394510
aattttgct

SEQ ID NO: 110872 - DNA, 9 bp, Unknown
  misc_feature (1)..( 9): Result.002 file - promoters60/1394510
aattttttt

SEQ ID NO: 110873 - DNA, 9 bp, Unknown
  misc_feature (1)..( 9): Result.002 file - promoters60/1394510
tctttactg

SEQ ID NO: 110874 - DNA, 9 bp, Unknown
  misc_feature (1)..( 9): Result.002 file - promoters60/1394510
ccaattttg

SEQ ID NO: 110875 - DNA, 9 bp, Unknown
  misc_feature (1)..( 9): Result.002 file - promoters60/1394510
agaattttt

SEQ ID NO: 110876 - DNA, 8 bp, Unknown
  misc_feature (1)..( 8): Result.002 file - promoters60/1394510
aaattttt

SEQ ID NO: 110877 - DNA, 9 bp, Unknown
  misc_feature (1)..( 9): Result.002 file - promoters60/1394510
aagattttt

SEQ ID NO: 110878 - DNA, 9 bp, Unknown
  misc_feature (1)..( 9): Result.002 file - promoters60/1394510
agactttgg

SEQ ID NO: 110879 - DNA, 15 bp, Unknown
  misc_feature (1)..( 15): Result.002 file - promoters60/1394592
tgtcatattcgtcgc

SEQ ID NO: 110880 - DNA, 15 bp, Unknown
  misc_feature (1)..( 15): Result.002 file - promoters60/1394592
gttcaaattcaaaat

SEQ ID NO: 110881 - DNA, 15 bp, Unknown
  misc_feature (1)..( 15): Result.002 file - promoters60/1394592
tgtcacattccatct

SEQ ID NO: 110882 - DNA, 15 bp, Unknown
  misc_feature (1)..( 15): Result.002 file - promoters60/1394592
tgaaaaattcaacaa

SEQ ID NO: 110883 - DNA, 15 bp, Unknown
  misc_feature (1)..( 15): Result.002 file - promoters60/1394592
gtacgacttcgacaa

SEQ ID NO: 110884 - DNA, 15 bp, Unknown
  misc_feature (1)..( 15): Result.002 file - promoters60/1394592
ataaaaatttgaaaa

SEQ ID NO: 110885 - DNA, 20 bp, Unknown
  misc_feature (1)..( 20): Result.002 file - promoters60/1394592
gagacgtttttaagattttt

SEQ ID NO: 110886 - DNA, 20 bp, Unknown
  misc_feature (1)..( 20): Result.002 file - promoters60/1394592
tgaatttttttataacaaat

SEQ ID NO: 110887 - DNA, 20 bp, Unknown
  misc_feature (1)..( 20): Result.002 file - promoters60/1394592
aaggaaattttaatcaacaa

SEQ ID NO: 110888 - DNA, 20 bp, Unknown
  misc_feature (1)..( 20): Result.002 file - promoters60/1394592
atgatatttttttgttttct

SEQ ID NO: 110889 - DNA, 20 bp, Unknown
  misc_feature (1)..( 20): Result.002 file - promoters60/1394592
gaaatattattcaataataa

SEQ ID NO: 110890 - DNA, 20 bp, Unknown
  misc_feature (1)..( 20): Result.002 file - promoters60/1394592
tctctgctttgaattttgac

SEQ ID NO: 110891 - DNA, 10 bp, Unknown
  misc_feature (1)..( 10): Result.002 file - promoters60/1394625
caaattcaaa

SEQ ID NO: 110892 - DNA, 10 bp, Unknown
  misc_feature (1)..( 10): Result.002 file - promoters60/1394625
caaattaaaa

SEQ ID NO: 110893 - DNA, 10 bp, Unknown
  misc_feature (1)..( 10): Result.002 file - promoters60/1394625
ataatttaaa

SEQ ID NO: 110894 - DNA, 8 bp, Unknown
  misc_feature (1)..( 8): Result.002 file - promoters60/1394625
ttttaatt

SEQ ID NO: 110895 - DNA, 8 bp, Unknown
  misc_feature (1)..( 8): Result.002 file - promoters60/1394625
ttttaaat

SEQ ID NO: 110896 - DNA, 8 bp, Unknown
  misc_feature (1)..( 8): Result.002 file - promoters60/1394625
tttcattt

SEQ ID NO: 110897 - DNA, 7 bp, Unknown
  misc_feature (1)..( 7): Result.002 file - promoters60/1394625
taatttt

SEQ ID NO: 110898 - DNA, 7 bp, Unknown
  misc_feature (1)..( 7): Result.002 file - promoters60/1394625
aaatttt

SEQ ID NO: 110899 - DNA, 7 bp, Unknown
  misc_feature (1)..( 7): Result.002 file - promoters60/1394625
taattta

SEQ ID NO: 110900 - DNA, 6 bp, Unknown
  misc_feature (1)..( 6): Result.002 file - promoters60/1394625
ttggta

SEQ ID NO: 110901 - DNA, 6 bp, Unknown
  misc_feature (1)..( 6): Result.002 file - promoters60/1394625
ttggta

SEQ ID NO: 110902 - DNA, 11 bp, Unknown
  misc_feature (1)..( 11): Result.002 file - promoters60/1394625
atttaataaaa

SEQ ID NO: 110903 - DNA, 11 bp, Unknown
  misc_feature (1)..( 11): Result.002 file - promoters60/1394625
atttaatcaaa

SEQ ID NO: 110904 - DNA, 11 bp, Unknown
  misc_feature (1)..( 11): Result.002 file - promoters60/1394625
gaagcataaaa

SEQ ID NO: 110905 - DNA, 6 bp, Unknown
  misc_feature (1)..( 6): Result.002 file - promoters60/1394625
aaaacg

SEQ ID NO: 110906 - DNA, 6 bp, Unknown
  misc_feature (1)..( 6): Result.002 file - promoters60/1394625
aaaacg

SEQ ID NO: 110907 - DNA, 6 bp, Unknown
  misc_feature (1)..( 6): Result.002 file - promoters60/1394625
tgggaa

SEQ ID NO: 110908 - DNA, 6 bp, Unknown
  misc_feature (1)..( 6): Result.002 file - promoters60/1394625
tgggaa

SEQ ID NO: 110909 - DNA, 9 bp, Unknown
  misc_feature (1)..( 9): Result.002 file - promoters60/1394625
taaaccatt

SEQ ID NO: 110910 - DNA, 9 bp, Unknown
  misc_feature (1)..( 9): Result.002 file - promoters60/1394625
taatccatt

SEQ ID NO: 110911 - DNA, 6 bp, Unknown
  misc_feature (1)..( 6): Result.002 file - promoters60/1394625
gaataa

SEQ ID NO: 110912 - DNA, 6 bp, Unknown
  misc_feature (1)..( 6): Result.002 file - promoters60/1394625
gaataa

SEQ ID NO: 110913 - DNA, 17 bp, Unknown
  misc_feature (1)..( 17): Result.002 file - promoters60/1394625
gatcataatttgcattc

SEQ ID NO: 110914 - DNA, 17 bp, Unknown
  misc_feature (1)..( 17): Result.002 file - promoters60/1394625
gattataaaaaaagtct

SEQ ID NO: 110915 - DNA, 17 bp, Unknown
  misc_feature (1)..( 17): Result.002 file - promoters60/1394625
aattaaaaaaaaaatct

SEQ ID NO: 110916 - DNA, 9 bp, Unknown
  misc_feature (1)..( 9): Result.002 file - promoters60/1394625
ttttttata

SEQ ID NO: 110917 - DNA, 9 bp, Unknown
  misc_feature (1)..( 9): Result.002 file - promoters60/1394625
tttcttata

SEQ ID NO: 110918 - DNA, 8 bp, Unknown
  misc_feature (1)..( 8): Result.002 file - promoters60/1394625
tatatatt

SEQ ID NO: 110919 - DNA, 8 bp, Unknown
  misc_feature (1)..( 8): Result.002 file - promoters60/1394625
tataaatt

SEQ ID NO: 110920 - DNA, 7 bp, Unknown
  misc_feature (1)..( 7): Result.002 file - promoters60/1394625
attcctt

SEQ ID NO: 110921 - DNA, 7 bp, Unknown
  misc_feature (1)..( 7): Result.002 file - promoters60/1394625
attactt

SEQ ID NO: 110922 - DNA, 9 bp, Unknown
  misc_feature (1)..( 9): Result.002 file - promoters60/1394625
aaaatttat

SEQ ID NO: 110923 - DNA, 9 bp, Unknown
  misc_feature (1)..( 9): Result.002 file - promoters60/1394625
aaaatatat

SEQ ID NO: 110924 - DNA, 6 bp, Unknown
  misc_feature (1)..( 6): Result.002 file - promoters60/1394625
tatata

SEQ ID NO: 110925 - DNA, 6 bp, Unknown
  misc_feature (1)..( 6): Result.002 file - promoters60/1394625
tatata

SEQ ID NO: 110926 - DNA, 6 bp, Unknown
  misc_feature (1)..( 6): Result.002 file - promoters60/1394625
aaattt

SEQ ID NO: 110927 - DNA, 6 bp, Unknown
  misc_feature (1)..( 6): Result.002 file - promoters60/1394625
aaattt

SEQ ID NO: 110928 - DNA, 7 bp, Unknown
  misc_feature (1)..( 7): Result.002 file - promoters60/1394625
aaaataa

SEQ ID NO: 110929 - DNA, 7 bp, Unknown
  misc_feature (1)..( 7): Result.002 file - promoters60/1394625
aaaatat

SEQ ID NO: 110930 - DNA, 8 bp, Unknown
  misc_feature (1)..( 8): Result.002 file - promoters60/1394625
aaagatgt

SEQ ID NO: 110931 - DNA, 7 bp, Unknown
  misc_feature (1)..( 7): Result.002 file - promoters60/1394625
taaataa

SEQ ID NO: 110932 - DNA, 7 bp, Unknown
  misc_feature (1)..( 7): Result.002 file - promoters60/1394625
taattaa

SEQ ID NO: 110933 - DNA, 11 bp, Unknown
  misc_feature (1)..( 11): Result.002 file - promoters60/1394625
ctcattctctt

SEQ ID NO: 110934 - DNA, 11 bp, Unknown
  misc_feature (1)..( 11): Result.002 file - promoters60/1394625
ctctttccctt

SEQ ID NO: 110935 - DNA, 6 bp, Unknown
  misc_feature (1)..( 6): Result.002 file - promoters60/1394625
actaat

SEQ ID NO: 110936 - DNA, 6 bp, Unknown
  misc_feature (1)..( 6): Result.002 file - promoters60/1394625
actaat

SEQ ID NO: 110937 - DNA, 7 bp, Unknown
  misc_feature (1)..( 7): Result.002 file - promoters60/1394625
tattatt

SEQ ID NO: 110938 - DNA, 7 bp, Unknown
  misc_feature (1)..( 7): Result.002 file - promoters60/1394625
tataatt

SEQ ID NO: 110939 - DNA, 9 bp, Unknown
  misc_feature (1)..( 9): Result.002 file - promoters60/1394625
ttacctaaa

SEQ ID NO: 110940 - DNA, 9 bp, Unknown
  misc_feature (1)..( 9): Result.002 file - promoters60/1394625
ttacccaaa

SEQ ID NO: 110941 - DNA, 7 bp, Unknown
  misc_feature (1)..( 7): Result.002 file - promoters60/1394625
ctatctt

SEQ ID NO: 110942 - DNA, 7 bp, Unknown
  misc_feature (1)..( 7): Result.002 file - promoters60/1394625
ctatctt

SEQ ID NO: 110943 - DNA, 9 bp, Unknown
  misc_feature (1)..( 9): Result.002 file - promoters60/1394625
ttcttttta

SEQ ID NO: 110944 - DNA, 9 bp, Unknown
  misc_feature (1)..( 9): Result.002 file - promoters60/1394625
ttcttttta

SEQ ID NO: 110945 - DNA, 7 bp, Unknown
  misc_feature (1)..( 7): Result.002 file - promoters60/1394625
accagct

SEQ ID NO: 110946 - DNA, 7 bp, Unknown
  misc_feature (1)..( 7): Result.002 file - promoters60/1394625
accagct

SEQ ID NO: 110947 - DNA, 11 bp, Unknown
  misc_feature (1)..( 11): Result.002 file - promoters60/1394625
tcaacctctct

SEQ ID NO: 110948 - DNA, 11 bp, Unknown
  misc_feature (1)..( 11): Result.002 file - promoters60/1394625
tcaccctctct

SEQ ID NO: 110949 - DNA, 12 bp, Unknown
  misc_feature (1)..( 12): Result.002 file - promoters60/1394643
gttttatatatt

SEQ ID NO: 110950 - DNA, 12 bp, Unknown
  misc_feature (1)..( 12): Result.002 file - promoters60/1394643
gttatatgtatt

SEQ ID NO: 110951 - DNA, 12 bp, Unknown
  misc_feature (1)..( 12): Result.002 file - promoters60/1394643
cttctatataac

SEQ ID NO: 110952 - DNA, 6 bp, Unknown
  misc_feature (1)..( 6): Result.002 file - promoters60/1394643
ttaata

SEQ ID NO: 110953 - DNA, 6 bp, Unknown
  misc_feature (1)..( 6): Result.002 file - promoters60/1394643
ttaata

SEQ ID NO: 110954 - DNA, 7 bp, Unknown
  misc_feature (1)..( 7): Result.002 file - promoters60/1394643
tttggtt

SEQ ID NO: 110955 - DNA, 7 bp, Unknown
  misc_feature (1)..( 7): Result.002 file - promoters60/1394643
tttagtt

SEQ ID NO: 110956 - DNA, 8 bp, Unknown
  misc_feature (1)..( 8): Result.002 file - promoters60/1394643
tttgccgt

SEQ ID NO: 110957 - DNA, 8 bp, Unknown
  misc_feature (1)..( 8): Result.002 file - promoters60/1394643
tttgtcgt

SEQ ID NO: 110958 - DNA, 9 bp, Unknown
  misc_feature (1)..( 9): Result.002 file - promoters60/1394643
tatttagga

SEQ ID NO: 110959 - DNA, 9 bp, Unknown
  misc_feature (1)..( 9): Result.002 file - promoters60/1394643
tatttggga

SEQ ID NO: 110960 - DNA, 9 bp, Unknown
  misc_feature (1)..( 9): Result.002 file - promoters60/1394643
tgattttct

SEQ ID NO: 110961 - DNA, 9 bp, Unknown
  misc_feature (1)..( 9): Result.002 file - promoters60/1394643
tgagtttct

SEQ ID NO: 110962 - DNA, 6 bp, Unknown
  misc_feature (1)..( 6): Result.002 file - promoters60/1394643
tttttc

SEQ ID NO: 110963 - DNA, 6 bp, Unknown
  misc_feature (1)..( 6): Result.002 file - promoters60/1394643
tttttc

SEQ ID NO: 110964 - DNA, 6 bp, Unknown
  misc_feature (1)..( 6): Result.002 file - promoters60/1394643
gggaaa

SEQ ID NO: 110965 - DNA, 6 bp, Unknown
  misc_feature (1)..( 6): Result.002 file - promoters60/1394643
gggaaa

SEQ ID NO: 110966 - DNA, 6 bp, Unknown
  misc_feature (1)..( 6): Result.002 file - promoters60/1394643
tccatg

SEQ ID NO: 110967 - DNA, 6 bp, Unknown
  misc_feature (1)..( 6): Result.002 file - promoters60/1394643
tccatg

SEQ ID NO: 110968 - DNA, 8 bp, Unknown
  misc_feature (1)..( 8): Result.002 file - promoters60/1394643
ttttttct

SEQ ID NO: 110969 - DNA, 8 bp, Unknown
  misc_feature (1)..( 8): Result.002 file - promoters60/1394643
tttcttct

SEQ ID NO: 110970 - DNA, 12 bp, Unknown
  misc_feature (1)..( 12): Result.002 file - promoters60/1394643
atgctattaaat

SEQ ID NO: 110971 - DNA, 12 bp, Unknown
  misc_feature (1)..( 12): Result.002 file - promoters60/1394643
atgctcttaaat

SEQ ID NO: 110972 - DNA, 6 bp, Unknown
  misc_feature (1)..( 6): Result.002 file - promoters60/1394643
aatatt

SEQ ID NO: 110973 - DNA, 6 bp, Unknown
  misc_feature (1)..( 6): Result.002 file - promoters60/1394643
aatatt

SEQ ID NO: 110974 - DNA, 6 bp, Unknown
  misc_feature (1)..( 6): Result.002 file - promoters60/1394643
acttat

SEQ ID NO: 110975 - DNA, 6 bp, Unknown
  misc_feature (1)..( 6): Result.002 file - promoters60/1394643
acttat

SEQ ID NO: 110976 - DNA, 7 bp, Unknown
  misc_feature (1)..( 7): Result.002 file - promoters60/1394643
tactaaa

SEQ ID NO: 110977 - DNA, 7 bp, Unknown
  misc_feature (1)..( 7): Result.002 file - promoters60/1394643
tacaaaa

SEQ ID NO: 110978 - DNA, 6 bp, Unknown
  misc_feature (1)..( 6): Result.002 file - promoters60/1394643
catcgt

SEQ ID NO: 110979 - DNA, 6 bp, Unknown
  misc_feature (1)..( 6): Result.002 file - promoters60/1394643
catcgt

SEQ ID NO: 110980 - DNA, 7 bp, Unknown
  misc_feature (1)..( 7): Result.002 file - promoters60/1394643
tcttatt

SEQ ID NO: 110981 - DNA, 7 bp, Unknown
  misc_feature (1)..( 7): Result.002 file - promoters60/1394643
tcttatt

SEQ ID NO: 110982 - DNA, 7 bp, Unknown
  misc_feature (1)..( 7): Result.002 file - promoters60/1394676
tttgtag

SEQ ID NO: 110983 - DNA, 7 bp, Unknown
  misc_feature (1)..( 7): Result.002 file - promoters60/1394676
tttctag

SEQ ID NO: 110984 - DNA, 6 bp, Unknown
  misc_feature (1)..( 6): Result.002 file - promoters60/1394676
attaag

SEQ ID NO: 110985 - DNA, 6 bp, Unknown
  misc_feature (1)..( 6): Result.002 file - promoters60/1394676
attaag

SEQ ID NO: 110986 - DNA, 9 bp, Unknown
  misc_feature (1)..( 9): Result.002 file - promoters60/1394676
tttggttga

SEQ ID NO: 110987 - DNA, 9 bp, Unknown
  misc_feature (1)..( 9): Result.002 file - promoters60/1394676
tttgtttga

SEQ ID NO: 110988 - DNA, 9 bp, Unknown
  misc_feature (1)..( 9): Result.002 file - promoters60/1394676
tttgatttt

SEQ ID NO: 110989 - DNA, 7 bp, Unknown
  misc_feature (1)..( 7): Result.002 file - promoters60/1394676
ggctgaa

SEQ ID NO: 110990 - DNA, 7 bp, Unknown
  misc_feature (1)..( 7): Result.002 file - promoters60/1394676
ggctgaa

SEQ ID NO: 110991 - DNA, 7 bp, Unknown
  misc_feature (1)..( 7): Result.002 file - promoters60/1394676
aaagtta

SEQ ID NO: 110992 - DNA, 7 bp, Unknown
  misc_feature (1)..( 7): Result.002 file - promoters60/1394676
aaaatta

SEQ ID NO: 110993 - DNA, 7 bp, Unknown
  misc_feature (1)..( 7): Result.002 file - promoters60/1394676
attgaaa

SEQ ID NO: 110994 - DNA, 7 bp, Unknown
  misc_feature (1)..( 7): Result.002 file - promoters60/1394676
attaaaa

SEQ ID NO: 110995 - DNA, 7 bp, Unknown
  misc_feature (1)..( 7): Result.002 file - promoters60/1394676
attactg

SEQ ID NO: 110996 - DNA, 7 bp, Unknown
  misc_feature (1)..( 7): Result.002 file - promoters60/1394676
attactg

SEQ ID NO: 110997 - DNA, 10 bp, Unknown
  misc_feature (1)..( 10): Result.002 file - promoters60/1394676
accaaactta

SEQ ID NO: 110998 - DNA, 10 bp, Unknown
  misc_feature (1)..( 10): Result.002 file - promoters60/1394676
accaaattta

SEQ ID NO: 110999 - DNA, 8 bp, Unknown
  misc_feature (1)..( 8): Result.002 file - promoters60/1394676
ctgatttg

SEQ ID NO: 111000 - DNA, 8 bp, Unknown
  misc_feature (1)..( 8): Result.002 file - promoters60/1394676
ctggtttg

SEQ ID NO: 111001 - DNA, 7 bp, Unknown
  misc_feature (1)..( 7): Result.002 file - promoters60/1394676
tatcatt

SEQ ID NO: 111002 - DNA, 7 bp, Unknown
  misc_feature (1)..( 7): Result.002 file - promoters60/1394676
tatgatt

SEQ ID NO: 111003 - DNA, 7 bp, Unknown
  misc_feature (1)..( 7): Result.002 file - promoters60/1394676
gaatttg

SEQ ID NO: 111004 - DNA, 7 bp, Unknown
  misc_feature (1)..( 7): Result.002 file - promoters60/1394676
gaatttg

SEQ ID NO: 111005 - DNA, 7 bp, Unknown
  misc_feature (1)..( 7): Result.002 file - promoters60/1394676
ttagatc

SEQ ID NO: 111006 - DNA, 7 bp, Unknown
  misc_feature (1)..( 7): Result.002 file - promoters60/1394676
ttatatc

SEQ ID NO: 111007 - DNA, 6 bp, Unknown
  misc_feature (1)..( 6): Result.002 file - promoters60/1394676
catttg

SEQ ID NO: 111008 - DNA, 6 bp, Unknown
  misc_feature (1)..( 6): Result.002 file - promoters60/1394676
catttg

SEQ ID NO: 111009 - DNA, 16 bp, Unknown
  misc_feature (1)..( 16): Result.002 file - promoters60/1394697
taaactaatttctatc

SEQ ID NO: 111010 - DNA, 16 bp, Unknown
  misc_feature (1)..( 16): Result.002 file - promoters60/1394697
ggtcttaaattcttct

SEQ ID NO: 111011 - DNA, 16 bp, Unknown
  misc_feature (1)..( 16): Result.002 file - promoters60/1394697
gaaaacaatttatatt

SEQ ID NO: 111012 - DNA, 16 bp, Unknown
  misc_feature (1)..( 16): Result.002 file - promoters60/1394697
caatttaatttcttca

SEQ ID NO: 111013 - DNA, 16 bp, Unknown
  misc_feature (1)..( 16): Result.002 file - promoters60/1394697
gcaactaatttgtcag

SEQ ID NO: 111014 - DNA, 16 bp, Unknown
  misc_feature (1)..( 16): Result.002 file - promoters60/1394697
agcacttttttttatt

SEQ ID NO: 111015 - DNA, 16 bp, Unknown
  misc_feature (1)..( 16): Result.002 file - promoters60/1394697
gcaaataattcgttat

SEQ ID NO: 111016 - DNA, 20 bp, Unknown
  misc_feature (1)..( 20): Result.002 file - promoters60/1394697
accgacctaataattaggta

SEQ ID NO: 111017 - DNA, 20 bp, Unknown
  misc_feature (1)..( 20): Result.002 file - promoters60/1394697
aagggtctaaaaatctatat

SEQ ID NO: 111018 - DNA, 20 bp, Unknown
  misc_feature (1)..( 20): Result.002 file - promoters60/1394697
tattattcaataataaaaca

SEQ ID NO: 111019 - DNA, 20 bp, Unknown
  misc_feature (1)..( 20): Result.002 file - promoters60/1394697
aatttttttataacaaatca

SEQ ID NO: 111020 - DNA, 21 bp, Unknown
  misc_feature (1)..( 21): Result.002 file - promoters60/1394697
gaaattttaatcaacaataat

SEQ ID NO: 111021 - DNA, 21 bp, Unknown
  misc_feature (1)..( 21): Result.002 file - promoters60/1394697
ctgctttgaattttgacttaa

SEQ ID NO: 111022 - DNA, 21 bp, Unknown
  misc_feature (1)..( 21): Result.002 file - promoters60/1394697
gagatagaataaaacaagaat

SEQ ID NO: 111023 - DNA, 12 bp, Unknown
  misc_feature (1)..( 12): Result.002 file - promoters60/1394697
taaggaaagtct

SEQ ID NO: 111024 - DNA, 12 bp, Unknown
  misc_feature (1)..( 12): Result.002 file - promoters60/1394697
cccgaaaaatct

SEQ ID NO: 111025 - DNA, 12 bp, Unknown
  misc_feature (1)..( 12): Result.002 file - promoters60/1394697
agtttaaacagt

SEQ ID NO: 111026 - DNA, 12 bp, Unknown
  misc_feature (1)..( 12): Result.002 file - promoters60/1394697
atccaaaaataa

SEQ ID NO: 111027 - DNA, 12 bp, Unknown
  misc_feature (1)..( 12): Result.002 file - promoters60/1394697
aaataaaaatca

SEQ ID NO: 111028 - DNA, 12 bp, Unknown
  misc_feature (1)..( 12): Result.002 file - promoters60/1394697
aattaaaaacta

SEQ ID NO: 111029 - DNA, 8 bp, Unknown
  misc_feature (1)..( 8): Result.002 file - promoters60/1394697
gaaacttg

SEQ ID NO: 111030 - DNA, 8 bp, Unknown
  misc_feature (1)..( 8): Result.002 file - promoters60/1394697
aaaaattg

SEQ ID NO: 111031 - DNA, 8 bp, Unknown
  misc_feature (1)..( 8): Result.002 file - promoters60/1394697
aaaacttt

SEQ ID NO: 111032 - DNA, 8 bp, Unknown
  misc_feature (1)..( 8): Result.002 file - promoters60/1394697
gaatctta

SEQ ID NO: 111033 - DNA, 8 bp, Unknown
  misc_feature (1)..( 8): Result.002 file - promoters60/1394697
caaaattt

SEQ ID NO: 111034 - DNA, 8 bp, Unknown
  misc_feature (1)..( 8): Result.002 file - promoters60/1394697
caaattta

SEQ ID NO: 111035 - DNA, 12 bp, Unknown
  misc_feature (1)..( 12): Result.002 file - promoters60/1394697
atactcaaatat

SEQ ID NO: 111036 - DNA, 12 bp, Unknown
  misc_feature (1)..( 12): Result.002 file - promoters60/1394697
ataatcattatc

SEQ ID NO: 111037 - DNA, 12 bp, Unknown
  misc_feature (1)..( 12): Result.002 file - promoters60/1394697
ataattattcat

SEQ ID NO: 111038 - DNA, 12 bp, Unknown
  misc_feature (1)..( 12): Result.002 file - promoters60/1394697
aaaattatttta

SEQ ID NO: 111039 - DNA, 12 bp, Unknown
  misc_feature (1)..( 12): Result.002 file - promoters60/1394697
caacttatttta

SEQ ID NO: 111040 - DNA, 12 bp, Unknown
  misc_feature (1)..( 12): Result.002 file - promoters60/1394697
ataaatatatct

SEQ ID NO: 111041 - DNA, 11 bp, Unknown
  misc_feature (1)..( 11): Result.002 file - promoters60/1394697
tattttattca

SEQ ID NO: 111042 - DNA, 11 bp, Unknown
  misc_feature (1)..( 11): Result.002 file - promoters60/1394697
tattttatgaa

SEQ ID NO: 111043 - DNA, 11 bp, Unknown
  misc_feature (1)..( 11): Result.002 file - promoters60/1394697
tattttaattt

SEQ ID NO: 111044 - DNA, 11 bp, Unknown
  misc_feature (1)..( 11): Result.002 file - promoters60/1394697
ctttttgtgac

SEQ ID NO: 111045 - DNA, 11 bp, Unknown
  misc_feature (1)..( 11): Result.002 file - promoters60/1394697
atttttgtgac

SEQ ID NO: 111046 - DNA, 11 bp, Unknown
  misc_feature (1)..( 11): Result.002 file - promoters60/1394697
agttttgaatt

SEQ ID NO: 111047 - DNA, 13 bp, Unknown
  misc_feature (1)..( 13): Result.002 file - promoters60/1394697
atattttattcaa

SEQ ID NO: 111048 - DNA, 13 bp, Unknown
  misc_feature (1)..( 13): Result.002 file - promoters60/1394697
cataattattcat

SEQ ID NO: 111049 - DNA, 13 bp, Unknown
  misc_feature (1)..( 13): Result.002 file - promoters60/1394697
tattttaattttg

SEQ ID NO: 111050 - DNA, 14 bp, Unknown
  misc_feature (1)..( 14): Result.002 file - promoters60/1394697
tcattattattatt

SEQ ID NO: 111051 - DNA, 14 bp, Unknown
  misc_feature (1)..( 14): Result.002 file - promoters60/1394697
tcttcactattaga

SEQ ID NO: 111052 - DNA, 14 bp, Unknown
  misc_feature (1)..( 14): Result.002 file - promoters60/1394697
agttttgaattcat

SEQ ID NO: 111053 - DNA, 7 bp, Unknown
  misc_feature (1)..( 7): Result.002 file - promoters60/1394795
attaact

SEQ ID NO: 111054 - DNA, 7 bp, Unknown
  misc_feature (1)..( 7): Result.002 file - promoters60/1394795
attgact

SEQ ID NO: 111055 - DNA, 9 bp, Unknown
  misc_feature (1)..( 9): Result.002 file - promoters60/1394795
aaacttttt

SEQ ID NO: 111056 - DNA, 9 bp, Unknown
  misc_feature (1)..( 9): Result.002 file - promoters60/1394795
aaacttttt

SEQ ID NO: 111057 - DNA, 9 bp, Unknown
  misc_feature (1)..( 9): Result.002 file - promoters60/1394795
aaacttttg

SEQ ID NO: 111058 - DNA, 6 bp, Unknown
  misc_feature (1)..( 6): Result.002 file - promoters60/1394795
tttcta

SEQ ID NO: 111059 - DNA, 6 bp, Unknown
  misc_feature (1)..( 6): Result.002 file - promoters60/1394795
tttcta

SEQ ID NO: 111060 - DNA, 7 bp, Unknown
  misc_feature (1)..( 7): Result.002 file - promoters60/1394795
taaaaaa

SEQ ID NO: 111061 - DNA, 7 bp, Unknown
  misc_feature (1)..( 7): Result.002 file - promoters60/1394795
taacaaa

SEQ ID NO: 111062 - DNA, 6 bp, Unknown
  misc_feature (1)..( 6): Result.002 file - promoters60/1394795
gcataa

SEQ ID NO: 111063 - DNA, 6 bp, Unknown
  misc_feature (1)..( 6): Result.002 file - promoters60/1394795
gcataa

SEQ ID NO: 111064 - DNA, 9 bp, Unknown
  misc_feature (1)..( 9): Result.002 file - promoters60/1394795
gaatctctt

SEQ ID NO: 111065 - DNA, 9 bp, Unknown
  misc_feature (1)..( 9): Result.002 file - promoters60/1394795
gaatctctt

SEQ ID NO: 111066 - DNA, 8 bp, Unknown
  misc_feature (1)..( 8): Result.002 file - promoters60/1394795
attttttt

SEQ ID NO: 111067 - DNA, 8 bp, Unknown
  misc_feature (1)..( 8): Result.002 file - promoters60/1394795
attttttt

SEQ ID NO: 111068 - DNA, 6 bp, Unknown
  misc_feature (1)..( 6): Result.002 file - promoters60/1394795
ttttct

SEQ ID NO: 111069 - DNA, 6 bp, Unknown
  misc_feature (1)..( 6): Result.002 file - promoters60/1394795
ttttct

SEQ ID NO: 111070 - DNA, 7 bp, Unknown
  misc_feature (1)..( 7): Result.002 file - promoters60/1394795
gatgaaa

SEQ ID NO: 111071 - DNA, 7 bp, Unknown
  misc_feature (1)..( 7): Result.002 file - promoters60/1394795
gataaaa

SEQ ID NO: 111072 - DNA, 8 bp, Unknown
  misc_feature (1)..( 8): Result.002 file - promoters60/1394795
tatgtatt

SEQ ID NO: 111073 - DNA, 8 bp, Unknown
  misc_feature (1)..( 8): Result.002 file - promoters60/1394795
tatatatt

SEQ ID NO: 111074 - DNA, 7 bp, Unknown
  misc_feature (1)..( 7): Result.002 file - promoters60/1394795
actatta

SEQ ID NO: 111075 - DNA, 7 bp, Unknown
  misc_feature (1)..( 7): Result.002 file - promoters60/1394795
actttta

SEQ ID NO: 111076 - DNA, 9 bp, Unknown
  misc_feature (1)..( 9): Result.002 file - promoters60/1394795
ttatttaaa

SEQ ID NO: 111077 - DNA, 9 bp, Unknown
  misc_feature (1)..( 9): Result.002 file - promoters60/1394795
acttttaaa

SEQ ID NO: 111078 - DNA, 9 bp, Unknown
  misc_feature (1)..( 9): Result.002 file - promoters60/1394795
tattttaaa

SEQ ID NO: 111079 - DNA, 6 bp, Unknown
  misc_feature (1)..( 6): Result.002 file - promoters60/1394795
ttttat

SEQ ID NO: 111080 - DNA, 6 bp, Unknown
  misc_feature (1)..( 6): Result.002 file - promoters60/1394795
ttttat

SEQ ID NO: 111081 - DNA, 6 bp, Unknown
  misc_feature (1)..( 6): Result.002 file - promoters60/1394795
attttt

SEQ ID NO: 111082 - DNA, 6 bp, Unknown
  misc_feature (1)..( 6): Result.002 file - promoters60/1394795
attttt

SEQ ID NO: 111083 - DNA, 6 bp, Unknown
  misc_feature (1)..( 6): Result.002 file - promoters60/1394795
ttctgc

SEQ ID NO: 111084 - DNA, 6 bp, Unknown
  misc_feature (1)..( 6): Result.002 file - promoters60/1394795
ttctgc

SEQ ID NO: 111085 - DNA, 8 bp, Unknown
  misc_feature (1)..( 8): Result.002 file - promoters60/1394795
catataaa

SEQ ID NO: 111086 - DNA, 8 bp, Unknown
  misc_feature (1)..( 8): Result.002 file - promoters60/1394795
tatataaa

SEQ ID NO: 111087 - DNA, 8 bp, Unknown
  misc_feature (1)..( 8): Result.002 file - promoters60/1394795
tatatagc

SEQ ID NO: 111088 - DNA, 6 bp, Unknown
  misc_feature (1)..( 6): Result.002 file - promoters60/1394795
aacttt

SEQ ID NO: 111089 - DNA, 6 bp, Unknown
  misc_feature (1)..( 6): Result.002 file - promoters60/1394795
aacttt

SEQ ID NO: 111090 - DNA, 6 bp, Unknown
  misc_feature (1)..( 6): Result.002 file - promoters60/1394795
tataaa

SEQ ID NO: 111091 - DNA, 6 bp, Unknown
  misc_feature (1)..( 6): Result.002 file - promoters60/1394795
tataaa

SEQ ID NO: 111092 - DNA, 7 bp, Unknown
  misc_feature (1)..( 7): Result.002 file - promoters60/1394795
tcttttt

SEQ ID NO: 111093 - DNA, 7 bp, Unknown
  misc_feature (1)..( 7): Result.002 file - promoters60/1394795
tcttttt

SEQ ID NO: 111094 - DNA, 8 bp, Unknown
  misc_feature (1)..( 8): Result.002 file - promoters60/1394795
tatttttt

SEQ ID NO: 111095 - DNA, 8 bp, Unknown
  misc_feature (1)..( 8): Result.002 file - promoters60/1394795
tatgtttt

SEQ ID NO: 111096 - DNA, 7 bp, Unknown
  misc_feature (1)..( 7): Result.002 file - promoters60/1394795
tctagtt

SEQ ID NO: 111097 - DNA, 7 bp, Unknown
  misc_feature (1)..( 7): Result.002 file - promoters60/1394795
tctagtt

SEQ ID NO: 111098 - DNA, 6 bp, Unknown
  misc_feature (1)..( 6): Result.002 file - promoters60/1394795
taaaat

SEQ ID NO: 111099 - DNA, 6 bp, Unknown
  misc_feature (1)..( 6): Result.002 file - promoters60/1394795
taaaat

SEQ ID NO: 111100 - DNA, 7 bp, Unknown
  misc_feature (1)..( 7): Result.002 file - promoters60/1394795
aaaatat

SEQ ID NO: 111101 - DNA, 7 bp, Unknown
  misc_feature (1)..( 7): Result.002 file - promoters60/1394795
aaaatat

SEQ ID NO: 111102 - DNA, 6 bp, Unknown
  misc_feature (1)..( 6): Result.002 file - promoters60/1394795
ttttga

SEQ ID NO: 111103 - DNA, 6 bp, Unknown
  misc_feature (1)..( 6): Result.002 file - promoters60/1394795
ttttga

SEQ ID NO: 111104 - DNA, 6 bp, Unknown
  misc_feature (1)..( 6): Result.002 file - promoters60/1394795
ttttaa

SEQ ID NO: 111105 - DNA, 6 bp, Unknown
  misc_feature (1)..( 6): Result.002 file - promoters60/1394795
ttttaa

SEQ ID NO: 111106 - DNA, 8 bp, Unknown
  misc_feature (1)..( 8): Result.002 file - promoters60/1394795
aacattag

SEQ ID NO: 111107 - DNA, 8 bp, Unknown
  misc_feature (1)..( 8): Result.002 file - promoters60/1394795
aacactag

SEQ ID NO: 111108 - DNA, 6 bp, Unknown
  misc_feature (1)..( 6): Result.002 file - promoters60/1394795
caaatg

SEQ ID NO: 111109 - DNA, 6 bp, Unknown
  misc_feature (1)..( 6): Result.002 file - promoters60/1394795
caaatg

SEQ ID NO: 111110 - DNA, 7 bp, Unknown
  misc_feature (1)..( 7): Result.002 file - promoters60/1394795
aagctca

SEQ ID NO: 111111 - DNA, 7 bp, Unknown
  misc_feature (1)..( 7): Result.002 file - promoters60/1394795
aagatca

SEQ ID NO: 111112 - DNA, 6 bp, Unknown
  misc_feature (1)..( 6): Result.002 file - promoters60/1394795
ctgaca

SEQ ID NO: 111113 - DNA, 6 bp, Unknown
  misc_feature (1)..( 6): Result.002 file - promoters60/1394795
ctgaca

SEQ ID NO: 111114 - DNA, 17 bp, Unknown
  misc_feature (1)..( 17): Result.002 file - promoters60/1394836
acacattaatagtgcag

SEQ ID NO: 111115 - DNA, 17 bp, Unknown
  misc_feature (1)..( 17): Result.002 file - promoters60/1394836
gcctattaatgatttca

SEQ ID NO: 111116 - DNA, 17 bp, Unknown
  misc_feature (1)..( 17): Result.002 file - promoters60/1394836
gcccattattgatttca

SEQ ID NO: 111117 - DNA, 17 bp, Unknown
  misc_feature (1)..( 17): Result.002 file - promoters60/1394836
ccgaattattgacgttc

SEQ ID NO: 111118 - DNA, 9 bp, Unknown
  misc_feature (1)..( 9): Result.002 file - promoters60/1394884
aattttttt

SEQ ID NO: 111119 - DNA, 9 bp, Unknown
  misc_feature (1)..( 9): Result.002 file - promoters60/1394884
cattttttt

SEQ ID NO: 111120 - DNA, 9 bp, Unknown
  misc_feature (1)..( 9): Result.002 file - promoters60/1394884
aattttaat

SEQ ID NO: 111121 - DNA, 8 bp, Unknown
  misc_feature (1)..( 8): Result.002 file - promoters60/1394884
gtttattt

SEQ ID NO: 111122 - DNA, 8 bp, Unknown
  misc_feature (1)..( 8): Result.002 file - promoters60/1394884
atttgttt

SEQ ID NO: 111123 - DNA, 8 bp, Unknown
  misc_feature (1)..( 8): Result.002 file - promoters60/1394884
atttgtat

SEQ ID NO: 111124 - DNA, 9 bp, Unknown
  misc_feature (1)..( 9): Result.002 file - promoters60/1394884
ttctcttag

SEQ ID NO: 111125 - DNA, 9 bp, Unknown
  misc_feature (1)..( 9): Result.002 file - promoters60/1394884
taatcttag

SEQ ID NO: 111126 - DNA, 9 bp, Unknown
  misc_feature (1)..( 9): Result.002 file - promoters60/1394884
taatattaa

SEQ ID NO: 111127 - DNA, 6 bp, Unknown
  misc_feature (1)..( 6): Result.002 file - promoters60/1394884
tataat

SEQ ID NO: 111128 - DNA, 6 bp, Unknown
  misc_feature (1)..( 6): Result.002 file - promoters60/1394884
tataat

SEQ ID NO: 111129 - DNA, 6 bp, Unknown
  misc_feature (1)..( 6): Result.002 file - promoters60/1394884
tataat

SEQ ID NO: 111130 - DNA, 11 bp, Unknown
  misc_feature (1)..( 11): Result.002 file - promoters60/1394884
aagtttatata

SEQ ID NO: 111131 - DNA, 11 bp, Unknown
  misc_feature (1)..( 11): Result.002 file - promoters60/1394884
aagtatatata

SEQ ID NO: 111132 - DNA, 11 bp, Unknown
  misc_feature (1)..( 11): Result.002 file - promoters60/1394884
tcatttgtata

SEQ ID NO: 111133 - DNA, 11 bp, Unknown
  misc_feature (1)..( 11): Result.002 file - promoters60/1394884
gaatttgtttg

SEQ ID NO: 111134 - DNA, 6 bp, Unknown
  misc_feature (1)..( 6): Result.002 file - promoters60/1394884
atttaa

SEQ ID NO: 111135 - DNA, 6 bp, Unknown
  misc_feature (1)..( 6): Result.002 file - promoters60/1394884
atttaa

SEQ ID NO: 111136 - DNA, 6 bp, Unknown
  misc_feature (1)..( 6): Result.002 file - promoters60/1394884
atttaa

SEQ ID NO: 111137 - DNA, 10 bp, Unknown
  misc_feature (1)..( 10): Result.002 file - promoters60/1394884
gaattatatt

SEQ ID NO: 111138 - DNA, 10 bp, Unknown
  misc_feature (1)..( 10): Result.002 file - promoters60/1394884
gaaatatata

SEQ ID NO: 111139 - DNA, 10 bp, Unknown
  misc_feature (1)..( 10): Result.002 file - promoters60/1394884
ttcttatatc

SEQ ID NO: 111140 - DNA, 10 bp, Unknown
  misc_feature (1)..( 10): Result.002 file - promoters60/1394884
aaattagatc

SEQ ID NO: 111141 - DNA, 9 bp, Unknown
  misc_feature (1)..( 9): Result.002 file - promoters60/1394884
atttctata

SEQ ID NO: 111142 - DNA, 9 bp, Unknown
  misc_feature (1)..( 9): Result.002 file - promoters60/1394884
atttgtata

SEQ ID NO: 111143 - DNA, 9 bp, Unknown
  misc_feature (1)..( 9): Result.002 file - promoters60/1394884
atttgtttg

SEQ ID NO: 111144 - DNA, 7 bp, Unknown
  misc_feature (1)..( 7): Result.002 file - promoters60/1394884
aatttat

SEQ ID NO: 111145 - DNA, 7 bp, Unknown
  misc_feature (1)..( 7): Result.002 file - promoters60/1394884
aatttaa

SEQ ID NO: 111146 - DNA, 7 bp, Unknown
  misc_feature (1)..( 7): Result.002 file - promoters60/1394884
tatttaa

SEQ ID NO: 111147 - DNA, 8 bp, Unknown
  misc_feature (1)..( 8): Result.002 file - promoters60/1395001
ttgtattc

SEQ ID NO: 111148 - DNA, 8 bp, Unknown
  misc_feature (1)..( 8): Result.002 file - promoters60/1395001
ttggatta

SEQ ID NO: 111149 - DNA, 8 bp, Unknown
  misc_feature (1)..( 8): Result.002 file - promoters60/1395001
ttgttttc

SEQ ID NO: 111150 - DNA, 7 bp, Unknown
  misc_feature (1)..( 7): Result.002 file - promoters60/1395027
ttatata

SEQ ID NO: 111151 - DNA, 7 bp, Unknown
  misc_feature (1)..( 7): Result.002 file - promoters60/1395027
ttaaata

SEQ ID NO: 111152 - DNA, 7 bp, Unknown
  misc_feature (1)..( 7): Result.002 file - promoters60/1395027
ccaattt

SEQ ID NO: 111153 - DNA, 7 bp, Unknown
  misc_feature (1)..( 7): Result.002 file - promoters60/1395027
ccatttt

SEQ ID NO: 111154 - DNA, 7 bp, Unknown
  misc_feature (1)..( 7): Result.002 file - promoters60/1395027
tttgtat

SEQ ID NO: 111155 - DNA, 7 bp, Unknown
  misc_feature (1)..( 7): Result.002 file - promoters60/1395027
tttctat

SEQ ID NO: 111156 - DNA, 8 bp, Unknown
  misc_feature (1)..( 8): Result.002 file - promoters60/1395027
aaaaaaaa

SEQ ID NO: 111157 - DNA, 8 bp, Unknown
  misc_feature (1)..( 8): Result.002 file - promoters60/1395027
aaaacaaa

SEQ ID NO: 111158 - DNA, 8 bp, Unknown
  misc_feature (1)..( 8): Result.002 file - promoters60/1395027
aaagcaaa

SEQ ID NO: 111159 - DNA, 6 bp, Unknown
  misc_feature (1)..( 6): Result.002 file - promoters60/1395027
gatttt

SEQ ID NO: 111160 - DNA, 6 bp, Unknown
  misc_feature (1)..( 6): Result.002 file - promoters60/1395027
gatttt

SEQ ID NO: 111161 - DNA, 7 bp, Unknown
  misc_feature (1)..( 7): Result.002 file - promoters60/1395027
cattttt

SEQ ID NO: 111162 - DNA, 7 bp, Unknown
  misc_feature (1)..( 7): Result.002 file - promoters60/1395027
cattttt

SEQ ID NO: 111163 - DNA, 13 bp, Unknown
  misc_feature (1)..( 13): Result.002 file - promoters60/1395027
agtttgaaatata

SEQ ID NO: 111164 - DNA, 13 bp, Unknown
  misc_feature (1)..( 13): Result.002 file - promoters60/1395027
ctaccaaaaaata

SEQ ID NO: 111165 - DNA, 13 bp, Unknown
  misc_feature (1)..( 13): Result.002 file - promoters60/1395027
aatacaaaatatg

SEQ ID NO: 111166 - DNA, 7 bp, Unknown
  misc_feature (1)..( 7): Result.002 file - promoters60/1395027
agaaaat

SEQ ID NO: 111167 - DNA, 7 bp, Unknown
  misc_feature (1)..( 7): Result.002 file - promoters60/1395027
agaaaat

SEQ ID NO: 111168 - DNA, 7 bp, Unknown
  misc_feature (1)..( 7): Result.002 file - promoters60/1395027
agccaat

SEQ ID NO: 111169 - DNA, 7 bp, Unknown
  misc_feature (1)..( 7): Result.002 file - promoters60/1395027
agcaaat

SEQ ID NO: 111170 - DNA, 7 bp, Unknown
  misc_feature (1)..( 7): Result.002 file - promoters60/1395027
ttaaagt

SEQ ID NO: 111171 - DNA, 7 bp, Unknown
  misc_feature (1)..( 7): Result.002 file - promoters60/1395027
ttatagt

SEQ ID NO: 111172 - DNA, 9 bp, Unknown
  misc_feature (1)..( 9): Result.002 file - promoters60/1395027
aaaactaat

SEQ ID NO: 111173 - DNA, 9 bp, Unknown
  misc_feature (1)..( 9): Result.002 file - promoters60/1395027
taaactaat

SEQ ID NO: 111174 - DNA, 9 bp, Unknown
  misc_feature (1)..( 9): Result.002 file - promoters60/1395027
taatctatg

SEQ ID NO: 111175 - DNA, 10 bp, Unknown
  misc_feature (1)..( 10): Result.002 file - promoters60/1395027
ataaattata

SEQ ID NO: 111176 - DNA, 10 bp, Unknown
  misc_feature (1)..( 10): Result.002 file - promoters60/1395027
ataaataata

SEQ ID NO: 111177 - DNA, 10 bp, Unknown
  misc_feature (1)..( 10): Result.002 file - promoters60/1395027
ggaaataatc

SEQ ID NO: 111178 - DNA, 7 bp, Unknown
  misc_feature (1)..( 7): Result.002 file - promoters60/1395027
ttggtct

SEQ ID NO: 111179 - DNA, 7 bp, Unknown
  misc_feature (1)..( 7): Result.002 file - promoters60/1395027
ttggtct

SEQ ID NO: 111180 - DNA, 6 bp, Unknown
  misc_feature (1)..( 6): Result.002 file - promoters60/1395027
aaataa

SEQ ID NO: 111181 - DNA, 6 bp, Unknown
  misc_feature (1)..( 6): Result.002 file - promoters60/1395027
aaataa

SEQ ID NO: 111182 - DNA, 7 bp, Unknown
  misc_feature (1)..( 7): Result.002 file - promoters60/1395027
atacaaa

SEQ ID NO: 111183 - DNA, 7 bp, Unknown
  misc_feature (1)..( 7): Result.002 file - promoters60/1395027
atacaaa

SEQ ID NO: 111184 - DNA, 7 bp, Unknown
  misc_feature (1)..( 7): Result.002 file - promoters60/1395027
tattatt

SEQ ID NO: 111185 - DNA, 7 bp, Unknown
  misc_feature (1)..( 7): Result.002 file - promoters60/1395027
tataatt

SEQ ID NO: 111186 - DNA, 8 bp, Unknown
  misc_feature (1)..( 8): Result.002 file - promoters60/1395027
acaatttg

SEQ ID NO: 111187 - DNA, 8 bp, Unknown
  misc_feature (1)..( 8): Result.002 file - promoters60/1395027
acaaattg

SEQ ID NO: 111188 - DNA, 7 bp, Unknown
  misc_feature (1)..( 7): Result.002 file - promoters60/1395066
gcaatag

SEQ ID NO: 111189 - DNA, 7 bp, Unknown
  misc_feature (1)..( 7): Result.002 file - promoters60/1395066
gcaatat

SEQ ID NO: 111190 - DNA, 7 bp, Unknown
  misc_feature (1)..( 7): Result.002 file - promoters60/1395066
tcaatag

SEQ ID NO: 111191 - DNA, 7 bp, Unknown
  misc_feature (1)..( 7): Result.002 file - promoters60/1395066
aaactat

SEQ ID NO: 111192 - DNA, 7 bp, Unknown
  misc_feature (1)..( 7): Result.002 file - promoters60/1395066
aaactat

SEQ ID NO: 111193 - DNA, 7 bp, Unknown
  misc_feature (1)..( 7): Result.002 file - promoters60/1395066
aaactac

SEQ ID NO: 111194 - DNA, 6 bp, Unknown
  misc_feature (1)..( 6): Result.002 file - promoters60/1395066
aaaata

SEQ ID NO: 111195 - DNA, 6 bp, Unknown
  misc_feature (1)..( 6): Result.002 file - promoters60/1395066
aaaata

SEQ ID NO: 111196 - DNA, 11 bp, Unknown
  misc_feature (1)..( 11): Result.002 file - promoters60/1395066
aaaaagtaact

SEQ ID NO: 111197 - DNA, 11 bp, Unknown
  misc_feature (1)..( 11): Result.002 file - promoters60/1395066
aaaaagagacc

SEQ ID NO: 111198 - DNA, 11 bp, Unknown
  misc_feature (1)..( 11): Result.002 file - promoters60/1395066
taaaagagacc

SEQ ID NO: 111199 - DNA, 6 bp, Unknown
  misc_feature (1)..( 6): Result.002 file - promoters60/1395066
gaattt

SEQ ID NO: 111200 - DNA, 6 bp, Unknown
  misc_feature (1)..( 6): Result.002 file - promoters60/1395066
gaattt

SEQ ID NO: 111201 - DNA, 8 bp, Unknown
  misc_feature (1)..( 8): Result.002 file - promoters60/1395066
atagttga

SEQ ID NO: 111202 - DNA, 8 bp, Unknown
  misc_feature (1)..( 8): Result.002 file - promoters60/1395066
aaagttga

SEQ ID NO: 111203 - DNA, 8 bp, Unknown
  misc_feature (1)..( 8): Result.002 file - promoters60/1395066
aaagttgt

SEQ ID NO: 111204 - DNA, 9 bp, Unknown
  misc_feature (1)..( 9): Result.002 file - promoters60/1395066
atttattta

SEQ ID NO: 111205 - DNA, 9 bp, Unknown
  misc_feature (1)..( 9): Result.002 file - promoters60/1395066
atttaatta

SEQ ID NO: 111206 - DNA, 7 bp, Unknown
  misc_feature (1)..( 7): Result.002 file - promoters60/1395066
actatag

SEQ ID NO: 111207 - DNA, 7 bp, Unknown
  misc_feature (1)..( 7): Result.002 file - promoters60/1395066
actatag

SEQ ID NO: 111208 - DNA, 7 bp, Unknown
  misc_feature (1)..( 7): Result.002 file - promoters60/1395066
tattctt

SEQ ID NO: 111209 - DNA, 7 bp, Unknown
  misc_feature (1)..( 7): Result.002 file - promoters60/1395066
tattctt

SEQ ID NO: 111210 - DNA, 7 bp, Unknown
  misc_feature (1)..( 7): Result.002 file - promoters60/1395066
tgtgaaa

SEQ ID NO: 111211 - DNA, 7 bp, Unknown
  misc_feature (1)..( 7): Result.002 file - promoters60/1395066
tgtgaaa

SEQ ID NO: 111212 - DNA, 9 bp, Unknown
  misc_feature (1)..( 9): Result.002 file - promoters60/1395066
tttattcaa

SEQ ID NO: 111213 - DNA, 9 bp, Unknown
  misc_feature (1)..( 9): Result.002 file - promoters60/1395066
tttattcaa

SEQ ID NO: 111214 - DNA, 6 bp, Unknown
  misc_feature (1)..( 6): Result.002 file - promoters60/1395066
ttatct

SEQ ID NO: 111215 - DNA, 6 bp, Unknown
  misc_feature (1)..( 6): Result.002 file - promoters60/1395066
ttatct

SEQ ID NO: 111216 - DNA, 9 bp, Unknown
  misc_feature (1)..( 9): Result.002 file - promoters60/1395066
gaaaactat

SEQ ID NO: 111217 - DNA, 9 bp, Unknown
  misc_feature (1)..( 9): Result.002 file - promoters60/1395066
gaaagctat

SEQ ID NO: 111218 - DNA, 10 bp, Unknown
  misc_feature (1)..( 10): Result.002 file - promoters60/1395066
ctagacatcc

SEQ ID NO: 111219 - DNA, 10 bp, Unknown
  misc_feature (1)..( 10): Result.002 file - promoters60/1395066
ctagacatcc

SEQ ID NO: 111220 - DNA, 15 bp, Unknown
  misc_feature (1)..( 15): Result.002 file - promoters60/1395066
ttagcttattgacgt

SEQ ID NO: 111221 - DNA, 15 bp, Unknown
  misc_feature (1)..( 15): Result.002 file - promoters60/1395066
ttagcttattgacgt

SEQ ID NO: 111222 - DNA, 7 bp, Unknown
  misc_feature (1)..( 7): Result.002 file - promoters60/1395066
tagtttg

SEQ ID NO: 111223 - DNA, 7 bp, Unknown
  misc_feature (1)..( 7): Result.002 file - promoters60/1395066
tagtttg

SEQ ID NO: 111224 - DNA, 15 bp, Unknown
  misc_feature (1)..( 15): Result.002 file - promoters60/1395066
tttgaaagatgcatc

SEQ ID NO: 111225 - DNA, 15 bp, Unknown
  misc_feature (1)..( 15): Result.002 file - promoters60/1395066
tttgaaagatgcatc

SEQ ID NO: 111226 - DNA, 28 bp, Unknown
  misc_feature (1)..( 28): Result.002 file - promoters60/1395066
agacctactcagataggtaaaagtagaa

SEQ ID NO: 111227 - DNA, 28 bp, Unknown
  misc_feature (1)..( 28): Result.002 file - promoters60/1395066
agaactactcagacaggtaaaagtagaa

SEQ ID NO: 111228 - DNA, 6 bp, Unknown
  misc_feature (1)..( 6): Result.002 file - promoters60/1395066
gtgtga

SEQ ID NO: 111229 - DNA, 6 bp, Unknown
  misc_feature (1)..( 6): Result.002 file - promoters60/1395066
gtgtga

SEQ ID NO: 111230 - DNA, 11 bp, Unknown
  misc_feature (1)..( 11): Result.002 file - promoters60/1395066
attatatttta

SEQ ID NO: 111231 - DNA, 11 bp, Unknown
  misc_feature (1)..( 11): Result.002 file - promoters60/1395066
attgtatgtta

SEQ ID NO: 111232 - DNA, 6 bp, Unknown
  misc_feature (1)..( 6): Result.002 file - promoters60/1395066
taaact

SEQ ID NO: 111233 - DNA, 6 bp, Unknown
  misc_feature (1)..( 6): Result.002 file - promoters60/1395066
taaact

SEQ ID NO: 111234 - DNA, 10 bp, Unknown
  misc_feature (1)..( 10): Result.002 file - promoters60/1395066
aagatatata

SEQ ID NO: 111235 - DNA, 10 bp, Unknown
  misc_feature (1)..( 10): Result.002 file - promoters60/1395066
aagatatata

SEQ ID NO: 111236 - DNA, 16 bp, Unknown
  misc_feature (1)..( 16): Result.002 file - promoters60/1395066
aatggaagataaaaac

SEQ ID NO: 111237 - DNA, 16 bp, Unknown
  misc_feature (1)..( 16): Result.002 file - promoters60/1395066
aatggtagataaaaac

SEQ ID NO: 111238 - DNA, 8 bp, Unknown
  misc_feature (1)..( 8): Result.002 file - promoters60/1395066
ttagtctg

SEQ ID NO: 111239 - DNA, 8 bp, Unknown
  misc_feature (1)..( 8): Result.002 file - promoters60/1395066
ttagtctg

SEQ ID NO: 111240 - DNA, 14 bp, Unknown
  misc_feature (1)..( 14): Result.002 file - promoters60/1395066
tttggaactgagta

SEQ ID NO: 111241 - DNA, 14 bp, Unknown
  misc_feature (1)..( 14): Result.002 file - promoters60/1395066
tttggaaatgagta

SEQ ID NO: 111242 - DNA, 22 bp, Unknown
  misc_feature (1)..( 22): Result.002 file - promoters60/1395066
agatatttgcatcttgagttac

SEQ ID NO: 111243 - DNA, 22 bp, Unknown
  misc_feature (1)..( 22): Result.002 file - promoters60/1395066
agatattggcatctagagttac

SEQ ID NO: 111244 - DNA, 9 bp, Unknown
  misc_feature (1)..( 9): Result.002 file - promoters60/1395066
taccatgga

SEQ ID NO: 111245 - DNA, 9 bp, Unknown
  misc_feature (1)..( 9): Result.002 file - promoters60/1395066
tactatgga

SEQ ID NO: 111246 - DNA, 8 bp, Unknown
  misc_feature (1)..( 8): Result.002 file - promoters60/1395066
caaaagtc

SEQ ID NO: 111247 - DNA, 8 bp, Unknown
  misc_feature (1)..( 8): Result.002 file - promoters60/1395066
caaaagtc

SEQ ID NO: 111248 - DNA, 13 bp, Unknown
  misc_feature (1)..( 13): Result.002 file - promoters60/1395066
gtgaaaatgctac

SEQ ID NO: 111249 - DNA, 13 bp, Unknown
  misc_feature (1)..( 13): Result.002 file - promoters60/1395066
gtgaaaatgttac

SEQ ID NO: 111250 - DNA, 11 bp, Unknown
  misc_feature (1)..( 11): Result.002 file - promoters60/1395066
aagcatttaca

SEQ ID NO: 111251 - DNA, 11 bp, Unknown
  misc_feature (1)..( 11): Result.002 file - promoters60/1395066
aagcatttaca

SEQ ID NO: 111252 - DNA, 10 bp, Unknown
  misc_feature (1)..( 10): Result.002 file - promoters60/1395066
cggtcaaaaa

SEQ ID NO: 111253 - DNA, 10 bp, Unknown
  misc_feature (1)..( 10): Result.002 file - promoters60/1395066
cggtaaaaaa

SEQ ID NO: 111254 - DNA, 12 bp, Unknown
  misc_feature (1)..( 12): Result.002 file - promoters60/1395095
actcccaaaaat

SEQ ID NO: 111255 - DNA, 12 bp, Unknown
  misc_feature (1)..( 12): Result.002 file - promoters60/1395095
actcctaaaata

SEQ ID NO: 111256 - DNA, 12 bp, Unknown
  misc_feature (1)..( 12): Result.002 file - promoters60/1395095
cagagtaaaatg

SEQ ID NO: 111257 - DNA, 12 bp, Unknown
  misc_feature (1)..( 12): Result.002 file - promoters60/1395095
taggagaaaatg

SEQ ID NO: 111258 - DNA, 10 bp, Unknown
  misc_feature (1)..( 10): Result.002 file - promoters60/1395095
aaaaataaga

SEQ ID NO: 111259 - DNA, 10 bp, Unknown
  misc_feature (1)..( 10): Result.002 file - promoters60/1395095
taaaataatc

SEQ ID NO: 111260 - DNA, 10 bp, Unknown
  misc_feature (1)..( 10): Result.002 file - promoters60/1395095
gaaaatgatc

SEQ ID NO: 111261 - DNA, 10 bp, Unknown
  misc_feature (1)..( 10): Result.002 file - promoters60/1395095
taaaatgcga

SEQ ID NO: 111262 - DNA, 7 bp, Unknown
  misc_feature (1)..( 7): Result.002 file - promoters60/1395095
catagat

SEQ ID NO: 111263 - DNA, 7 bp, Unknown
  misc_feature (1)..( 7): Result.002 file - promoters60/1395095
aatagat

SEQ ID NO: 111264 - DNA, 7 bp, Unknown
  misc_feature (1)..( 7): Result.002 file - promoters60/1395095
aatcgat

SEQ ID NO: 111265 - DNA, 9 bp, Unknown
  misc_feature (1)..( 9): Result.002 file - promoters60/1395095
atttatttc

SEQ ID NO: 111266 - DNA, 9 bp, Unknown
  misc_feature (1)..( 9): Result.002 file - promoters60/1395095
ttttctttc

SEQ ID NO: 111267 - DNA, 9 bp, Unknown
  misc_feature (1)..( 9): Result.002 file - promoters60/1395095
ctttgtttt

SEQ ID NO: 111268 - DNA, 9 bp, Unknown
  misc_feature (1)..( 9): Result.002 file - promoters60/1395095
ctttgtcct

SEQ ID NO: 111269 - DNA, 8 bp, Unknown
  misc_feature (1)..( 8): Result.002 file - promoters60/1395095
aaaaaaag

SEQ ID NO: 111270 - DNA, 8 bp, Unknown
  misc_feature (1)..( 8): Result.002 file - promoters60/1395095
caaagaag

SEQ ID NO: 111271 - DNA, 8 bp, Unknown
  misc_feature (1)..( 8): Result.002 file - promoters60/1395095
gaaaaaaa

SEQ ID NO: 111272 - DNA, 11 bp, Unknown
  misc_feature (1)..( 11): Result.002 file - promoters60/1395095
caacttttttt

SEQ ID NO: 111273 - DNA, 11 bp, Unknown
  misc_feature (1)..( 11): Result.002 file - promoters60/1395095
caaattttttt

SEQ ID NO: 111274 - DNA, 11 bp, Unknown
  misc_feature (1)..( 11): Result.002 file - promoters60/1395095
tacatttttta

SEQ ID NO: 111275 - DNA, 8 bp, Unknown
  misc_feature (1)..( 8): Result.002 file - promoters60/1395095
caagtctt

SEQ ID NO: 111276 - DNA, 8 bp, Unknown
  misc_feature (1)..( 8): Result.002 file - promoters60/1395095
aaagtctt

SEQ ID NO: 111277 - DNA, 8 bp, Unknown
  misc_feature (1)..( 8): Result.002 file - promoters60/1395095
aaattctg

SEQ ID NO: 111278 - DNA, 8 bp, Unknown
  misc_feature (1)..( 8): Result.002 file - promoters60/1395095
aaaatctc

SEQ ID NO: 111279 - DNA, 8 bp, Unknown
  misc_feature (1)..( 8): Result.002 file - promoters60/1395095
catatttt

SEQ ID NO: 111280 - DNA, 8 bp, Unknown
  misc_feature (1)..( 8): Result.002 file - promoters60/1395095
catttttt

SEQ ID NO: 111281 - DNA, 8 bp, Unknown
  misc_feature (1)..( 8): Result.002 file - promoters60/1395095
aatttttt

SEQ ID NO: 111282 - DNA, 8 bp, Unknown
  misc_feature (1)..( 8): Result.002 file - promoters60/1395095
aaaattca

SEQ ID NO: 111283 - DNA, 8 bp, Unknown
  misc_feature (1)..( 8): Result.002 file - promoters60/1395095
aaaattct

SEQ ID NO: 111284 - DNA, 8 bp, Unknown
  misc_feature (1)..( 8): Result.002 file - promoters60/1395095
taaagtct

SEQ ID NO: 111285 - DNA, 8 bp, Unknown
  misc_feature (1)..( 8): Result.002 file - promoters60/1395095
aaaaatct

SEQ ID NO: 111286 - DNA, 8 bp, Unknown
  misc_feature (1)..( 8): Result.002 file - promoters60/1395095
tataaatt

SEQ ID NO: 111287 - DNA, 8 bp, Unknown
  misc_feature (1)..( 8): Result.002 file - promoters60/1395095
tataaacc

SEQ ID NO: 111288 - DNA, 8 bp, Unknown
  misc_feature (1)..( 8): Result.002 file - promoters60/1395095
cataaatg

SEQ ID NO: 111289 - DNA, 8 bp, Unknown
  misc_feature (1)..( 8): Result.002 file - promoters60/1395095
aataaaaa

SEQ ID NO: 111290 - DNA, 7 bp, Unknown
  misc_feature (1)..( 7): Result.002 file - promoters60/1395215
aatgaca

SEQ ID NO: 111291 - DNA, 7 bp, Unknown
  misc_feature (1)..( 7): Result.002 file - promoters60/1395215
aattaca

SEQ ID NO: 111292 - DNA, 6 bp, Unknown
  misc_feature (1)..( 6): Result.002 file - promoters60/1395215
attcaa

SEQ ID NO: 111293 - DNA, 6 bp, Unknown
  misc_feature (1)..( 6): Result.002 file - promoters60/1395215
attcaa

SEQ ID NO: 111294 - DNA, 7 bp, Unknown
  misc_feature (1)..( 7): Result.002 file - promoters60/1395215
aaaattg

SEQ ID NO: 111295 - DNA, 7 bp, Unknown
  misc_feature (1)..( 7): Result.002 file - promoters60/1395215
aaagttg

SEQ ID NO: 111296 - DNA, 8 bp, Unknown
  misc_feature (1)..( 8): Result.002 file - promoters60/1395215
ttgttagt

SEQ ID NO: 111297 - DNA, 8 bp, Unknown
  misc_feature (1)..( 8): Result.002 file - promoters60/1395215
ttgctagt

SEQ ID NO: 111298 - DNA, 8 bp, Unknown
  misc_feature (1)..( 8): Result.002 file - promoters60/1395215
ttgttatc

SEQ ID NO: 111299 - DNA, 8 bp, Unknown
  misc_feature (1)..( 8): Result.002 file - promoters60/1395215
taatctcc

SEQ ID NO: 111300 - DNA, 8 bp, Unknown
  misc_feature (1)..( 8): Result.002 file - promoters60/1395215
taatttcc

SEQ ID NO: 111301 - DNA, 8 bp, Unknown
  misc_feature (1)..( 8): Result.002 file - promoters60/1395215
taaacaga

SEQ ID NO: 111302 - DNA, 8 bp, Unknown
  misc_feature (1)..( 8): Result.002 file - promoters60/1395215
taaaaaga

SEQ ID NO: 111303 - DNA, 6 bp, Unknown
  misc_feature (1)..( 6): Result.002 file - promoters60/1395215
gagaac

SEQ ID NO: 111304 - DNA, 6 bp, Unknown
  misc_feature (1)..( 6): Result.002 file - promoters60/1395215
gagaac

SEQ ID NO: 111305 - DNA, 8 bp, Unknown
  misc_feature (1)..( 8): Result.002 file - promoters60/1395215
aaaacaac

SEQ ID NO: 111306 - DNA, 8 bp, Unknown
  misc_feature (1)..( 8): Result.002 file - promoters60/1395215
gaaacaaa

SEQ ID NO: 111307 - DNA, 8 bp, Unknown
  misc_feature (1)..( 8): Result.002 file - promoters60/1395215
gaaagaaa

SEQ ID NO: 111308 - DNA, 6 bp, Unknown
  misc_feature (1)..( 6): Result.002 file - promoters60/1395215
tattaa

SEQ ID NO: 111309 - DNA, 6 bp, Unknown
  misc_feature (1)..( 6): Result.002 file - promoters60/1395215
tattaa

SEQ ID NO: 111310 - DNA, 6 bp, Unknown
  misc_feature (1)..( 6): Result.002 file - promoters60/1395215
ttatct

SEQ ID NO: 111311 - DNA, 6 bp, Unknown
  misc_feature (1)..( 6): Result.002 file - promoters60/1395215
ttatct

SEQ ID NO: 111312 - DNA, 6 bp, Unknown
  misc_feature (1)..( 6): Result.002 file - promoters60/1395215
attgtg

SEQ ID NO: 111313 - DNA, 6 bp, Unknown
  misc_feature (1)..( 6): Result.002 file - promoters60/1395215
attgtg

SEQ ID NO: 111314 - DNA, 6 bp, Unknown
  misc_feature (1)..( 6): Result.002 file - promoters60/1395215
taataa

SEQ ID NO: 111315 - DNA, 6 bp, Unknown
  misc_feature (1)..( 6): Result.002 file - promoters60/1395215
taataa

SEQ ID NO: 111316 - DNA, 6 bp, Unknown
  misc_feature (1)..( 6): Result.002 file - promoters60/1395215
agtaaa

SEQ ID NO: 111317 - DNA, 6 bp, Unknown
  misc_feature (1)..( 6): Result.002 file - promoters60/1395215
agtaaa

SEQ ID NO: 111318 - DNA, 7 bp, Unknown
  misc_feature (1)..( 7): Result.002 file - promoters60/1395215
aatcggg

SEQ ID NO: 111319 - DNA, 7 bp, Unknown
  misc_feature (1)..( 7): Result.002 file - promoters60/1395215
aattggg

SEQ ID NO: 111320 - DNA, 10 bp, Unknown
  misc_feature (1)..( 10): Result.002 file - promoters60/1395215
ggaaaagaaa

SEQ ID NO: 111321 - DNA, 10 bp, Unknown
  misc_feature (1)..( 10): Result.002 file - promoters60/1395215
ggaaatgaaa

SEQ ID NO: 111322 - DNA, 7 bp, Unknown
  misc_feature (1)..( 7): Result.002 file - promoters60/1395215
cccacta

SEQ ID NO: 111323 - DNA, 7 bp, Unknown
  misc_feature (1)..( 7): Result.002 file - promoters60/1395215
cccacta

SEQ ID NO: 111324 - DNA, 9 bp, Unknown
  misc_feature (1)..( 9): Result.002 file - promoters60/1395215
aaagaaaag

SEQ ID NO: 111325 - DNA, 9 bp, Unknown
  misc_feature (1)..( 9): Result.002 file - promoters60/1395215
aaagtaaag

SEQ ID NO: 111326 - DNA, 7 bp, Unknown
  misc_feature (1)..( 7): Result.002 file - promoters60/1395215
gtatata

SEQ ID NO: 111327 - DNA, 7 bp, Unknown
  misc_feature (1)..( 7): Result.002 file - promoters60/1395215
gtatata

SEQ ID NO: 111328 - DNA, 7 bp, Unknown
  misc_feature (1)..( 7): Result.002 file - promoters60/1395254
ttaggaa

SEQ ID NO: 111329 - DNA, 7 bp, Unknown
  misc_feature (1)..( 7): Result.002 file - promoters60/1395254
ttaagaa

SEQ ID NO: 111330 - DNA, 7 bp, Unknown
  misc_feature (1)..( 7): Result.002 file - promoters60/1395254
tttgctt

SEQ ID NO: 111331 - DNA, 7 bp, Unknown
  misc_feature (1)..( 7): Result.002 file - promoters60/1395254
tttgctt

SEQ ID NO: 111332 - DNA, 10 bp, Unknown
  misc_feature (1)..( 10): Result.002 file - promoters60/1395254
actttttaaa

SEQ ID NO: 111333 - DNA, 10 bp, Unknown
  misc_feature (1)..( 10): Result.002 file - promoters60/1395254
acttttgaaa

SEQ ID NO: 111334 - DNA, 8 bp, Unknown
  misc_feature (1)..( 8): Result.002 file - promoters60/1395254
atttttat

SEQ ID NO: 111335 - DNA, 8 bp, Unknown
  misc_feature (1)..( 8): Result.002 file - promoters60/1395254
attcttat

SEQ ID NO: 111336 - DNA, 9 bp, Unknown
  misc_feature (1)..( 9): Result.002 file - promoters60/1395254
ttttctatt

SEQ ID NO: 111337 - DNA, 9 bp, Unknown
  misc_feature (1)..( 9): Result.002 file - promoters60/1395254
ttttttatt

SEQ ID NO: 111338 - DNA, 9 bp, Unknown
  misc_feature (1)..( 9): Result.002 file - promoters60/1395254
cgtttaatt

SEQ ID NO: 111339 - DNA, 8 bp, Unknown
  misc_feature (1)..( 8): Result.002 file - promoters60/1395254
tctcgtta

SEQ ID NO: 111340 - DNA, 8 bp, Unknown
  misc_feature (1)..( 8): Result.002 file - promoters60/1395254
tctcttta

SEQ ID NO: 111341 - DNA, 6 bp, Unknown
  misc_feature (1)..( 6): Result.002 file - promoters60/1395254
atcttg

SEQ ID NO: 111342 - DNA, 6 bp, Unknown
  misc_feature (1)..( 6): Result.002 file - promoters60/1395254
atcttg

SEQ ID NO: 111343 - DNA, 7 bp, Unknown
  misc_feature (1)..( 7): Result.002 file - promoters60/1395254
ttgtttg

SEQ ID NO: 111344 - DNA, 7 bp, Unknown
  misc_feature (1)..( 7): Result.002 file - promoters60/1395254
ttgtttg

SEQ ID NO: 111345 - DNA, 8 bp, Unknown
  misc_feature (1)..( 8): Result.002 file - promoters60/1395254
gagctctc

SEQ ID NO: 111346 - DNA, 8 bp, Unknown
  misc_feature (1)..( 8): Result.002 file - promoters60/1395254
gagatctc

SEQ ID NO: 111347 - DNA, 6 bp, Unknown
  misc_feature (1)..( 6): Result.002 file - promoters60/1395254
tttata

SEQ ID NO: 111348 - DNA, 6 bp, Unknown
  misc_feature (1)..( 6): Result.002 file - promoters60/1395254
tttata

SEQ ID NO: 111349 - DNA, 7 bp, Unknown
  misc_feature (1)..( 7): Result.002 file - promoters60/1395254
taattta

SEQ ID NO: 111350 - DNA, 7 bp, Unknown
  misc_feature (1)..( 7): Result.002 file - promoters60/1395254
taagtta

SEQ ID NO: 111351 - DNA, 7 bp, Unknown
  misc_feature (1)..( 7): Result.002 file - promoters60/1395254
gaaatga

SEQ ID NO: 111352 - DNA, 7 bp, Unknown
  misc_feature (1)..( 7): Result.002 file - promoters60/1395254
gaagtga

SEQ ID NO: 111353 - DNA, 9 bp, Unknown
  misc_feature (1)..( 9): Result.002 file - promoters60/1395254
tctatttaa

SEQ ID NO: 111354 - DNA, 9 bp, Unknown
  misc_feature (1)..( 9): Result.002 file - promoters60/1395254
tctaattaa

SEQ ID NO: 111355 - DNA, 6 bp, Unknown
  misc_feature (1)..( 6): Result.002 file - promoters60/1395254
aaacag

SEQ ID NO: 111356 - DNA, 6 bp, Unknown
  misc_feature (1)..( 6): Result.002 file - promoters60/1395254
aaacag

SEQ ID NO: 111357 - DNA, 6 bp, Unknown
  misc_feature (1)..( 6): Result.002 file - promoters60/1395254
tccact

SEQ ID NO: 111358 - DNA, 6 bp, Unknown
  misc_feature (1)..( 6): Result.002 file - promoters60/1395254
tccact

SEQ ID NO: 111359 - DNA, 8 bp, Unknown
  misc_feature (1)..( 8): Result.002 file - promoters60/1395254
attaatga

SEQ ID NO: 111360 - DNA, 8 bp, Unknown
  misc_feature (1)..( 8): Result.002 file - promoters60/1395254
attgatga

SEQ ID NO: 111361 - DNA, 7 bp, Unknown
  misc_feature (1)..( 7): Result.002 file - promoters60/1395254
taacaga

SEQ ID NO: 111362 - DNA, 7 bp, Unknown
  misc_feature (1)..( 7): Result.002 file - promoters60/1395254
taacaga

SEQ ID NO: 111363 - DNA, 6 bp, Unknown
  misc_feature (1)..( 6): Result.002 file - promoters60/1395254
cgggtc

SEQ ID NO: 111364 - DNA, 6 bp, Unknown
  misc_feature (1)..( 6): Result.002 file - promoters60/1395254
cgggtc

SEQ ID NO: 111365 - DNA, 10 bp, Unknown
  misc_feature (1)..( 10): Result.002 file - promoters60/1395485
ataataattt

SEQ ID NO: 111366 - DNA, 10 bp, Unknown
  misc_feature (1)..( 10): Result.002 file - promoters60/1395485
atagtaattt

SEQ ID NO: 111367 - DNA, 12 bp, Unknown
  misc_feature (1)..( 12): Result.002 file - promoters60/1395485
taatctttttgt

SEQ ID NO: 111368 - DNA, 12 bp, Unknown
  misc_feature (1)..( 12): Result.002 file - promoters60/1395485
atgacttcttgg

SEQ ID NO: 111369 - DNA, 12 bp, Unknown
  misc_feature (1)..( 12): Result.002 file - promoters60/1395485
taagctttctgt

SEQ ID NO: 111370 - DNA, 7 bp, Unknown
  misc_feature (1)..( 7): Result.002 file - promoters60/1395485
catagat

SEQ ID NO: 111371 - DNA, 7 bp, Unknown
  misc_feature (1)..( 7): Result.002 file - promoters60/1395485
catcgat

SEQ ID NO: 111372 - DNA, 7 bp, Unknown
  misc_feature (1)..( 7): Result.002 file - promoters60/1395485
atcattt

SEQ ID NO: 111373 - DNA, 7 bp, Unknown
  misc_feature (1)..( 7): Result.002 file - promoters60/1395485
atcgttt

SEQ ID NO: 111374 - DNA, 8 bp, Unknown
  misc_feature (1)..( 8): Result.002 file - promoters60/1395485
actaaatt

SEQ ID NO: 111375 - DNA, 8 bp, Unknown
  misc_feature (1)..( 8): Result.002 file - promoters60/1395485
actacatt

SEQ ID NO: 111376 - DNA, 8 bp, Unknown
  misc_feature (1)..( 8): Result.002 file - promoters60/1395485
aggccctt

SEQ ID NO: 111377 - DNA, 8 bp, Unknown
  misc_feature (1)..( 8): Result.002 file - promoters60/1395485
aggcactt

SEQ ID NO: 111378 - DNA, 7 bp, Unknown
  misc_feature (1)..( 7): Result.002 file - promoters60/1395485
gaaaaat

SEQ ID NO: 111379 - DNA, 7 bp, Unknown
  misc_feature (1)..( 7): Result.002 file - promoters60/1395485
gaacaat

SEQ ID NO: 111380 - DNA, 8 bp, Unknown
  misc_feature (1)..( 8): Result.002 file - promoters60/1395485
tgtttact

SEQ ID NO: 111381 - DNA, 8 bp, Unknown
  misc_feature (1)..( 8): Result.002 file - promoters60/1395485
tgtttact

SEQ ID NO: 111382 - DNA, 8 bp, Unknown
  misc_feature (1)..( 8): Result.002 file - promoters60/1395485
tgttaatc

SEQ ID NO: 111383 - DNA, 8 bp, Unknown
  misc_feature (1)..( 8): Result.002 file - promoters60/1395485
tgtttatc

SEQ ID NO: 111384 - DNA, 8 bp, Unknown
  misc_feature (1)..( 8): Result.002 file - promoters60/1395485
aaagtctc

SEQ ID NO: 111385 - DNA, 8 bp, Unknown
  misc_feature (1)..( 8): Result.002 file - promoters60/1395485
aaaatctc

SEQ ID NO: 111386 - DNA, 6 bp, Unknown
  misc_feature (1)..( 6): Result.002 file - promoters60/1395485
cttctt

SEQ ID NO: 111387 - DNA, 6 bp, Unknown
  misc_feature (1)..( 6): Result.002 file - promoters60/1395485
cttctt

SEQ ID NO: 111388 - DNA, 6 bp, Unknown
  misc_feature (1)..( 6): Result.002 file - promoters60/1395485
catctc

SEQ ID NO: 111389 - DNA, 6 bp, Unknown
  misc_feature (1)..( 6): Result.002 file - promoters60/1395485
catctc

SEQ ID NO: 111390 - DNA, 6 bp, Unknown
  misc_feature (1)..( 6): Result.002 file - promoters60/1395485
agtttt

SEQ ID NO: 111391 - DNA, 6 bp, Unknown
  misc_feature (1)..( 6): Result.002 file - promoters60/1395485
agtttt

SEQ ID NO: 111392 - DNA, 7 bp, Unknown
  misc_feature (1)..( 7): Result.002 file - promoters60/1395485
acataaa

SEQ ID NO: 111393 - DNA, 7 bp, Unknown
  misc_feature (1)..( 7): Result.002 file - promoters60/1395485
acaaaaa

SEQ ID NO: 111394 - DNA, 7 bp, Unknown
  misc_feature (1)..( 7): Result.002 file - promoters60/1395568
gagaaat

SEQ ID NO: 111395 - DNA, 7 bp, Unknown
  misc_feature (1)..( 7): Result.002 file - promoters60/1395568
gagaaat

SEQ ID NO: 111396 - DNA, 7 bp, Unknown
  misc_feature (1)..( 7): Result.002 file - promoters60/1395568
aaaagga

SEQ ID NO: 111397 - DNA, 7 bp, Unknown
  misc_feature (1)..( 7): Result.002 file - promoters60/1395568
aaaagga

SEQ ID NO: 111398 - DNA, 9 bp, Unknown
  misc_feature (1)..( 9): Result.002 file - promoters60/1395568
tgtatataa

SEQ ID NO: 111399 - DNA, 9 bp, Unknown
  misc_feature (1)..( 9): Result.002 file - promoters60/1395568
tgtaaataa

SEQ ID NO: 111400 - DNA, 8 bp, Unknown
  misc_feature (1)..( 8): Result.002 file - promoters60/1395568
cagtctaa

SEQ ID NO: 111401 - DNA, 8 bp, Unknown
  misc_feature (1)..( 8): Result.002 file - promoters60/1395568
cagtataa

SEQ ID NO: 111402 - DNA, 6 bp, Unknown
  misc_feature (1)..( 6): Result.002 file - promoters60/1395568
aaatgt

SEQ ID NO: 111403 - DNA, 6 bp, Unknown
  misc_feature (1)..( 6): Result.002 file - promoters60/1395568
aaatgt

SEQ ID NO: 111404 - DNA, 8 bp, Unknown
  misc_feature (1)..( 8): Result.002 file - promoters60/1395568
ggcggcga

SEQ ID NO: 111405 - DNA, 8 bp, Unknown
  misc_feature (1)..( 8): Result.002 file - promoters60/1395568
ggcggcga

SEQ ID NO: 111406 - DNA, 7 bp, Unknown
  misc_feature (1)..( 7): Result.002 file - promoters60/1395568
gagccaa

SEQ ID NO: 111407 - DNA, 7 bp, Unknown
  misc_feature (1)..( 7): Result.002 file - promoters60/1395568
gagtcaa

SEQ ID NO: 111408 - DNA, 8 bp, Unknown
  misc_feature (1)..( 8): Result.002 file - promoters60/1395568
atctatat

SEQ ID NO: 111409 - DNA, 8 bp, Unknown
  misc_feature (1)..( 8): Result.002 file - promoters60/1395568
atctctat

SEQ ID NO: 111410 - DNA, 6 bp, Unknown
  misc_feature (1)..( 6): Result.002 file - promoters60/1395568
gataat

SEQ ID NO: 111411 - DNA, 6 bp, Unknown
  misc_feature (1)..( 6): Result.002 file - promoters60/1395568
gataat

SEQ ID NO: 111412 - DNA, 7 bp, Unknown
  misc_feature (1)..( 7): Result.002 file - promoters60/1395636
tttttac

SEQ ID NO: 111413 - DNA, 7 bp, Unknown
  misc_feature (1)..( 7): Result.002 file - promoters60/1395636
gttttac

SEQ ID NO: 111414 - DNA, 7 bp, Unknown
  misc_feature (1)..( 7): Result.002 file - promoters60/1395636
tttttat

SEQ ID NO: 111415 - DNA, 7 bp, Unknown
  misc_feature (1)..( 7): Result.002 file - promoters60/1395636
tttttat

SEQ ID NO: 111416 - DNA, 13 bp, Unknown
  misc_feature (1)..( 13): Result.002 file - promoters60/1395636
ctcctataaattg

SEQ ID NO: 111417 - DNA, 13 bp, Unknown
  misc_feature (1)..( 13): Result.002 file - promoters60/1395636
ggtgtataaattg

SEQ ID NO: 111418 - DNA, 13 bp, Unknown
  misc_feature (1)..( 13): Result.002 file - promoters60/1395636
ttagtataaataa

SEQ ID NO: 111419 - DNA, 13 bp, Unknown
  misc_feature (1)..( 13): Result.002 file - promoters60/1395636
ctcttatatattc

SEQ ID NO: 111420 - DNA, 11 bp, Unknown
  misc_feature (1)..( 11): Result.002 file - promoters60/1395636
aaatatgaaat

SEQ ID NO: 111421 - DNA, 11 bp, Unknown
  misc_feature (1)..( 11): Result.002 file - promoters60/1395636
aaatttgacct

SEQ ID NO: 111422 - DNA, 11 bp, Unknown
  misc_feature (1)..( 11): Result.002 file - promoters60/1395636
atataggaata

SEQ ID NO: 111423 - DNA, 11 bp, Unknown
  misc_feature (1)..( 11): Result.002 file - promoters60/1395636
agatagtaata

SEQ ID NO: 111424 - DNA, 8 bp, Unknown
  misc_feature (1)..( 8): Result.002 file - promoters60/1395781
taaaaaat

SEQ ID NO: 111425 - DNA, 8 bp, Unknown
  misc_feature (1)..( 8): Result.002 file - promoters60/1395781
taaaaaaa

SEQ ID NO: 111426 - DNA, 8 bp, Unknown
  misc_feature (1)..( 8): Result.002 file - promoters60/1395781
aaaagaat

SEQ ID NO: 111427 - DNA, 8 bp, Unknown
  misc_feature (1)..( 8): Result.002 file - promoters60/1395781
tgaaaaat

SEQ ID NO: 111428 - DNA, 10 bp, Unknown
  misc_feature (1)..( 10): Result.002 file - promoters60/1395781
tcaaaaatta

SEQ ID NO: 111429 - DNA, 10 bp, Unknown
  misc_feature (1)..( 10): Result.002 file - promoters60/1395781
tcaaaaatct

SEQ ID NO: 111430 - DNA, 10 bp, Unknown
  misc_feature (1)..( 10): Result.002 file - promoters60/1395781
aagaaaattg

SEQ ID NO: 111431 - DNA, 10 bp, Unknown
  misc_feature (1)..( 10): Result.002 file - promoters60/1395781
gacaaagtga

SEQ ID NO: 111432 - DNA, 10 bp, Unknown
  misc_feature (1)..( 10): Result.002 file - promoters60/1395781
tattattgtc

SEQ ID NO: 111433 - DNA, 10 bp, Unknown
  misc_feature (1)..( 10): Result.002 file - promoters60/1395781
catttttgtc

SEQ ID NO: 111434 - DNA, 10 bp, Unknown
  misc_feature (1)..( 10): Result.002 file - promoters60/1395781
ttaatttgtc

SEQ ID NO: 111435 - DNA, 10 bp, Unknown
  misc_feature (1)..( 10): Result.002 file - promoters60/1395781
catttttgtg

SEQ ID NO: 111436 - DNA, 10 bp, Unknown
  misc_feature (1)..( 10): Result.002 file - promoters60/1395781
aaaatgtcgc

SEQ ID NO: 111437 - DNA, 10 bp, Unknown
  misc_feature (1)..( 10): Result.002 file - promoters60/1395781
taaatgttag

SEQ ID NO: 111438 - DNA, 10 bp, Unknown
  misc_feature (1)..( 10): Result.002 file - promoters60/1395781
taaatgatgc

SEQ ID NO: 111439 - DNA, 10 bp, Unknown
  misc_feature (1)..( 10): Result.002 file - promoters60/1395781
agaattttag

SEQ ID NO: 111440 - DNA, 11 bp, Unknown
  misc_feature (1)..( 11): Result.002 file - promoters60/1395781
tctatataaac

SEQ ID NO: 111441 - DNA, 11 bp, Unknown
  misc_feature (1)..( 11): Result.002 file - promoters60/1395781
tctatataaac

SEQ ID NO: 111442 - DNA, 11 bp, Unknown
  misc_feature (1)..( 11): Result.002 file - promoters60/1395781
tagctataaaa

SEQ ID NO: 111443 - DNA, 11 bp, Unknown
  misc_feature (1)..( 11): Result.002 file - promoters60/1395781
cctacaaaatc

SEQ ID NO: 111444 - DNA, 12 bp, Unknown
  misc_feature (1)..( 12): Result.002 file - promoters60/1395781
atggatctacac

SEQ ID NO: 111445 - DNA, 12 bp, Unknown
  misc_feature (1)..( 12): Result.002 file - promoters60/1395781
cttgatgtacat

SEQ ID NO: 111446 - DNA, 12 bp, Unknown
  misc_feature (1)..( 12): Result.002 file - promoters60/1395781
cttgatgtcttt

SEQ ID NO: 111447 - DNA, 12 bp, Unknown
  misc_feature (1)..( 12): Result.002 file - promoters60/1395781
gtggtcgtacat

SEQ ID NO: 111448 - DNA, 15 bp, Unknown
  misc_feature (1)..( 15): Result.002 file - promoters60/1395824
aatattttcaaaatc

SEQ ID NO: 111449 - DNA, 15 bp, Unknown
  misc_feature (1)..( 15): Result.002 file - promoters60/1395824
aataattttaaaaaa

SEQ ID NO: 111450 - DNA, 15 bp, Unknown
  misc_feature (1)..( 15): Result.002 file - promoters60/1395824
aggttaatcacaatg

SEQ ID NO: 111451 - DNA, 16 bp, Unknown
  misc_feature (1)..( 16): Result.002 file - promoters60/1395824
tacatgattaaacatt

SEQ ID NO: 111452 - DNA, 16 bp, Unknown
  misc_feature (1)..( 16): Result.002 file - promoters60/1395824
caaataagcaaaaatg

SEQ ID NO: 111453 - DNA, 10 bp, Unknown
  misc_feature (1)..( 10): Result.002 file - promoters60/1395824
aacaatcatc

SEQ ID NO: 111454 - DNA, 10 bp, Unknown
  misc_feature (1)..( 10): Result.002 file - promoters60/1395824
cacaaacata

SEQ ID NO: 111455 - DNA, 10 bp, Unknown
  misc_feature (1)..( 10): Result.002 file - promoters60/1395824
ttcaaatata

SEQ ID NO: 111456 - DNA, 10 bp, Unknown
  misc_feature (1)..( 10): Result.002 file - promoters60/1395824
ttcagataaa

SEQ ID NO: 111457 - DNA, 10 bp, Unknown
  misc_feature (1)..( 10): Result.002 file - promoters60/1395824
gacagacaga

SEQ ID NO: 111458 - DNA, 12 bp, Unknown
  misc_feature (1)..( 12): Result.002 file - promoters60/1395824
tagcagtaatca

SEQ ID NO: 111459 - DNA, 12 bp, Unknown
  misc_feature (1)..( 12): Result.002 file - promoters60/1395824
atgcaataaacg

SEQ ID NO: 111460 - DNA, 12 bp, Unknown
  misc_feature (1)..( 12): Result.002 file - promoters60/1395824
aagcaataaaag

SEQ ID NO: 111461 - DNA, 12 bp, Unknown
  misc_feature (1)..( 12): Result.002 file - promoters60/1395824
atgcgataaacg

SEQ ID NO: 111462 - DNA, 13 bp, Unknown
  misc_feature (1)..( 13): Result.002 file - promoters60/1395824
ttagttacataat

SEQ ID NO: 111463 - DNA, 13 bp, Unknown
  misc_feature (1)..( 13): Result.002 file - promoters60/1395824
aaacatacttaaa

SEQ ID NO: 111464 - DNA, 13 bp, Unknown
  misc_feature (1)..( 13): Result.002 file - promoters60/1395824
ctagtcacaaaat

SEQ ID NO: 111465 - DNA, 13 bp, Unknown
  misc_feature (1)..( 13): Result.002 file - promoters60/1395824
ctaatcacctcgt

SEQ ID NO: 111466 - DNA, 10 bp, Unknown
  misc_feature (1)..( 10): Result.002 file - promoters60/1395824
ttcaaatata

SEQ ID NO: 111467 - DNA, 10 bp, Unknown
  misc_feature (1)..( 10): Result.002 file - promoters60/1395824
gagaaagata

SEQ ID NO: 111468 - DNA, 10 bp, Unknown
  misc_feature (1)..( 10): Result.002 file - promoters60/1395824
cacaaacata

SEQ ID NO: 111469 - DNA, 10 bp, Unknown
  misc_feature (1)..( 10): Result.002 file - promoters60/1395824
ttcagataaa

SEQ ID NO: 111470 - DNA, 8 bp, Unknown
  misc_feature (1)..( 8): Result.002 file - promoters60/1395832
ttatataa

SEQ ID NO: 111471 - DNA, 8 bp, Unknown
  misc_feature (1)..( 8): Result.002 file - promoters60/1395832
ttagataa

SEQ ID NO: 111472 - DNA, 8 bp, Unknown
  misc_feature (1)..( 8): Result.002 file - promoters60/1395832
gtatataa

SEQ ID NO: 111473 - DNA, 12 bp, Unknown
  misc_feature (1)..( 12): Result.002 file - promoters60/1395832
tgaaaaagtaat

SEQ ID NO: 111474 - DNA, 12 bp, Unknown
  misc_feature (1)..( 12): Result.002 file - promoters60/1395832
tcaaaaggtatc

SEQ ID NO: 111475 - DNA, 12 bp, Unknown
  misc_feature (1)..( 12): Result.002 file - promoters60/1395832
tgataaactaat

SEQ ID NO: 111476 - DNA, 7 bp, Unknown
  misc_feature (1)..( 7): Result.002 file - promoters60/1395832
tatgtaa

SEQ ID NO: 111477 - DNA, 7 bp, Unknown
  misc_feature (1)..( 7): Result.002 file - promoters60/1395832
tatttaa

SEQ ID NO: 111478 - DNA, 7 bp, Unknown
  misc_feature (1)..( 7): Result.002 file - promoters60/1395832
gatttaa

SEQ ID NO: 111479 - DNA, 8 bp, Unknown
  misc_feature (1)..( 8): Result.002 file - promoters60/1395839
ggacaaaa

SEQ ID NO: 111480 - DNA, 8 bp, Unknown
  misc_feature (1)..( 8): Result.002 file - promoters60/1395839
ggataaaa

SEQ ID NO: 111481 - DNA, 8 bp, Unknown
  misc_feature (1)..( 8): Result.002 file - promoters60/1395839
ggataact

SEQ ID NO: 111482 - DNA, 7 bp, Unknown
  misc_feature (1)..( 7): Result.002 file - promoters60/1395839
aaaatga

SEQ ID NO: 111483 - DNA, 7 bp, Unknown
  misc_feature (1)..( 7): Result.002 file - promoters60/1395839
caaatga

SEQ ID NO: 111484 - DNA, 8 bp, Unknown
  misc_feature (1)..( 8): Result.002 file - promoters60/1395839
taaattga

SEQ ID NO: 111485 - DNA, 9 bp, Unknown
  misc_feature (1)..( 9): Result.002 file - promoters60/1395839
taactaaaa

SEQ ID NO: 111486 - DNA, 9 bp, Unknown
  misc_feature (1)..( 9): Result.002 file - promoters60/1395839
taaataaat

SEQ ID NO: 111487 - DNA, 9 bp, Unknown
  misc_feature (1)..( 9): Result.002 file - promoters60/1395839
aaacaaaaa

SEQ ID NO: 111488 - DNA, 11 bp, Unknown
  misc_feature (1)..( 11): Result.002 file - promoters60/1395839
atttttgtttg

SEQ ID NO: 111489 - DNA, 11 bp, Unknown
  misc_feature (1)..( 11): Result.002 file - promoters60/1395839
atttctgtttg

SEQ ID NO: 111490 - DNA, 11 bp, Unknown
  misc_feature (1)..( 11): Result.002 file - promoters60/1395839
ggttttgtttt

SEQ ID NO: 111491 - DNA, 9 bp, Unknown
  misc_feature (1)..( 9): Result.002 file - promoters60/1395839
aaagaacaa

SEQ ID NO: 111492 - DNA, 9 bp, Unknown
  misc_feature (1)..( 9): Result.002 file - promoters60/1395839
aaataactt

SEQ ID NO: 111493 - DNA, 9 bp, Unknown
  misc_feature (1)..( 9): Result.002 file - promoters60/1395839
aaatatctt

SEQ ID NO: 111494 - DNA, 6 bp, Unknown
  misc_feature (1)..( 6): Result.002 file - promoters60/1395958
accaaa

SEQ ID NO: 111495 - DNA, 6 bp, Unknown
  misc_feature (1)..( 6): Result.002 file - promoters60/1395958
accaaa

SEQ ID NO: 111496 - DNA, 7 bp, Unknown
  misc_feature (1)..( 7): Result.002 file - promoters60/1395958
taaaaat

SEQ ID NO: 111497 - DNA, 7 bp, Unknown
  misc_feature (1)..( 7): Result.002 file - promoters60/1395958
taaaaat

SEQ ID NO: 111498 - DNA, 6 bp, Unknown
  misc_feature (1)..( 6): Result.002 file - promoters60/1395958
aaaaat

SEQ ID NO: 111499 - DNA, 6 bp, Unknown
  misc_feature (1)..( 6): Result.002 file - promoters60/1395958
aaaaat

SEQ ID NO: 111500 - DNA, 7 bp, Unknown
  misc_feature (1)..( 7): Result.002 file - promoters60/1395958
attttaa

SEQ ID NO: 111501 - DNA, 7 bp, Unknown
  misc_feature (1)..( 7): Result.002 file - promoters60/1395958
attttaa

SEQ ID NO: 111502 - DNA, 6 bp, Unknown
  misc_feature (1)..( 6): Result.002 file - promoters60/1395958
gtaaaa

SEQ ID NO: 111503 - DNA, 6 bp, Unknown
  misc_feature (1)..( 6): Result.002 file - promoters60/1395958
gtaaaa

SEQ ID NO: 111504 - DNA, 6 bp, Unknown
  misc_feature (1)..( 6): Result.002 file - promoters60/1395958
cgaata

SEQ ID NO: 111505 - DNA, 6 bp, Unknown
  misc_feature (1)..( 6): Result.002 file - promoters60/1395958
cgaata

SEQ ID NO: 111506 - DNA, 6 bp, Unknown
  misc_feature (1)..( 6): Result.002 file - promoters60/1395958
ctgaaa

SEQ ID NO: 111507 - DNA, 6 bp, Unknown
  misc_feature (1)..( 6): Result.002 file - promoters60/1395958
ctgaaa

SEQ ID NO: 111508 - DNA, 6 bp, Unknown
  misc_feature (1)..( 6): Result.002 file - promoters60/1395958
tgttta

SEQ ID NO: 111509 - DNA, 6 bp, Unknown
  misc_feature (1)..( 6): Result.002 file - promoters60/1395958
tgttta

SEQ ID NO: 111510 - DNA, 11 bp, Unknown
  misc_feature (1)..( 11): Result.002 file - promoters60/1395958
gttaacaagtc

SEQ ID NO: 111511 - DNA, 11 bp, Unknown
  misc_feature (1)..( 11): Result.002 file - promoters60/1395958
gttgacatgtc

SEQ ID NO: 111512 - DNA, 6 bp, Unknown
  misc_feature (1)..( 6): Result.002 file - promoters60/1395958
agaaat

SEQ ID NO: 111513 - DNA, 6 bp, Unknown
  misc_feature (1)..( 6): Result.002 file - promoters60/1395958
agaaat

SEQ ID NO: 111514 - DNA, 9 bp, Unknown
  misc_feature (1)..( 9): Result.002 file - promoters60/1395958
taatcaaag

SEQ ID NO: 111515 - DNA, 9 bp, Unknown
  misc_feature (1)..( 9): Result.002 file - promoters60/1395958
taatcgaag

SEQ ID NO: 111516 - DNA, 7 bp, Unknown
  misc_feature (1)..( 7): Result.002 file - promoters60/1395958
ttaattt

SEQ ID NO: 111517 - DNA, 7 bp, Unknown
  misc_feature (1)..( 7): Result.002 file - promoters60/1395958
ttagttt

SEQ ID NO: 111518 - DNA, 7 bp, Unknown
  misc_feature (1)..( 7): Result.002 file - promoters60/1395958
tttgaaa

SEQ ID NO: 111519 - DNA, 7 bp, Unknown
  misc_feature (1)..( 7): Result.002 file - promoters60/1395958
tttcaaa

SEQ ID NO: 111520 - DNA, 8 bp, Unknown
  misc_feature (1)..( 8): Result.002 file - promoters60/1395958
aaaggtga

SEQ ID NO: 111521 - DNA, 8 bp, Unknown
  misc_feature (1)..( 8): Result.002 file - promoters60/1395958
aaaggtga

SEQ ID NO: 111522 - DNA, 6 bp, Unknown
  misc_feature (1)..( 6): Result.002 file - promoters60/1395958
tttcga

SEQ ID NO: 111523 - DNA, 6 bp, Unknown
  misc_feature (1)..( 6): Result.002 file - promoters60/1395958
tttcga

SEQ ID NO: 111524 - DNA, 8 bp, Unknown
  misc_feature (1)..( 8): Result.002 file - promoters60/1395958
tagcgaat

SEQ ID NO: 111525 - DNA, 8 bp, Unknown
  misc_feature (1)..( 8): Result.002 file - promoters60/1395958
tagagaat

SEQ ID NO: 111526 - DNA, 8 bp, Unknown
  misc_feature (1)..( 8): Result.002 file - promoters60/1395958
aactaaaa

SEQ ID NO: 111527 - DNA, 8 bp, Unknown
  misc_feature (1)..( 8): Result.002 file - promoters60/1395958
aacaaaaa

SEQ ID NO: 111528 - DNA, 6 bp, Unknown
  misc_feature (1)..( 6): Result.002 file - promoters60/1395958
aaaaca

SEQ ID NO: 111529 - DNA, 6 bp, Unknown
  misc_feature (1)..( 6): Result.002 file - promoters60/1395958
aaaaca

SEQ ID NO: 111530 - DNA, 7 bp, Unknown
  misc_feature (1)..( 7): Result.002 file - promoters60/1395958
gaaaaat

SEQ ID NO: 111531 - DNA, 7 bp, Unknown
  misc_feature (1)..( 7): Result.002 file - promoters60/1395958
gaagaat

SEQ ID NO: 111532 - DNA, 7 bp, Unknown
  misc_feature (1)..( 7): Result.002 file - promoters60/1395958
attacag

SEQ ID NO: 111533 - DNA, 7 bp, Unknown
  misc_feature (1)..( 7): Result.002 file - promoters60/1395958
atttcag

SEQ ID NO: 111534 - DNA, 7 bp, Unknown
  misc_feature (1)..( 7): Result.002 file - promoters60/1395958
cgctgtt

SEQ ID NO: 111535 - DNA, 7 bp, Unknown
  misc_feature (1)..( 7): Result.002 file - promoters60/1395958
cgctgtt

SEQ ID NO: 111536 - DNA, 8 bp, Unknown
  misc_feature (1)..( 8): Result.002 file - promoters60/1395972
aattggta

SEQ ID NO: 111537 - DNA, 8 bp, Unknown
  misc_feature (1)..( 8): Result.002 file - promoters60/1395972
aattagta

SEQ ID NO: 111538 - DNA, 7 bp, Unknown
  misc_feature (1)..( 7): Result.002 file - promoters60/1395972
taacata

SEQ ID NO: 111539 - DNA, 7 bp, Unknown
  misc_feature (1)..( 7): Result.002 file - promoters60/1395972
taaaata

SEQ ID NO: 111540 - DNA, 6 bp, Unknown
  misc_feature (1)..( 6): Result.002 file - promoters60/1395972
actaaa

SEQ ID NO: 111541 - DNA, 6 bp, Unknown
  misc_feature (1)..( 6): Result.002 file - promoters60/1395972
actaaa

SEQ ID NO: 111542 - DNA, 9 bp, Unknown
  misc_feature (1)..( 9): Result.002 file - promoters60/1395972
tcacttaca

SEQ ID NO: 111543 - DNA, 9 bp, Unknown
  misc_feature (1)..( 9): Result.002 file - promoters60/1395972
tcacgtaca

SEQ ID NO: 111544 - DNA, 11 bp, Unknown
  misc_feature (1)..( 11): Result.002 file - promoters60/1395972
tttaaataaaa

SEQ ID NO: 111545 - DNA, 11 bp, Unknown
  misc_feature (1)..( 11): Result.002 file - promoters60/1395972
ttcaaataaaa

SEQ ID NO: 111546 - DNA, 11 bp, Unknown
  misc_feature (1)..( 11): Result.002 file - promoters60/1395972
ttctaatatcc

SEQ ID NO: 111547 - DNA, 7 bp, Unknown
  misc_feature (1)..( 7): Result.002 file - promoters60/1395972
gcaaaac

SEQ ID NO: 111548 - DNA, 7 bp, Unknown
  misc_feature (1)..( 7): Result.002 file - promoters60/1395972
gcaaaac

SEQ ID NO: 111549 - DNA, 8 bp, Unknown
  misc_feature (1)..( 8): Result.002 file - promoters60/1395972
aaaatagt

SEQ ID NO: 111550 - DNA, 8 bp, Unknown
  misc_feature (1)..( 8): Result.002 file - promoters60/1395972
aaaatagc

SEQ ID NO: 111551 - DNA, 8 bp, Unknown
  misc_feature (1)..( 8): Result.002 file - promoters60/1395972
aaaaagca

SEQ ID NO: 111552 - DNA, 6 bp, Unknown
  misc_feature (1)..( 6): Result.002 file - promoters60/1395972
ttatat

SEQ ID NO: 111553 - DNA, 6 bp, Unknown
  misc_feature (1)..( 6): Result.002 file - promoters60/1395972
ttatat

SEQ ID NO: 111554 - DNA, 6 bp, Unknown
  misc_feature (1)..( 6): Result.002 file - promoters60/1395972
ataaaa

SEQ ID NO: 111555 - DNA, 6 bp, Unknown
  misc_feature (1)..( 6): Result.002 file - promoters60/1395972
ataaaa

SEQ ID NO: 111556 - DNA, 6 bp, Unknown
  misc_feature (1)..( 6): Result.002 file - promoters60/1395972
aagaaa

SEQ ID NO: 111557 - DNA, 6 bp, Unknown
  misc_feature (1)..( 6): Result.002 file - promoters60/1395972
aagaaa

SEQ ID NO: 111558 - DNA, 9 bp, Unknown
  misc_feature (1)..( 9): Result.002 file - promoters60/1395972
aaaactcaa

SEQ ID NO: 111559 - DNA, 9 bp, Unknown
  misc_feature (1)..( 9): Result.002 file - promoters60/1395972
aaacctcaa

SEQ ID NO: 111560 - DNA, 9 bp, Unknown
  misc_feature (1)..( 9): Result.002 file - promoters60/1395972
aaataaaaa

SEQ ID NO: 111561 - DNA, 9 bp, Unknown
  misc_feature (1)..( 9): Result.002 file - promoters60/1395972
aaaaaaaaa

SEQ ID NO: 111562 - DNA, 9 bp, Unknown
  misc_feature (1)..( 9): Result.002 file - promoters60/1395972
catataact

SEQ ID NO: 111563 - DNA, 9 bp, Unknown
  misc_feature (1)..( 9): Result.002 file - promoters60/1395972
catatcact

SEQ ID NO: 111564 - DNA, 8 bp, Unknown
  misc_feature (1)..( 8): Result.002 file - promoters60/1395972
taaagatt

SEQ ID NO: 111565 - DNA, 8 bp, Unknown
  misc_feature (1)..( 8): Result.002 file - promoters60/1395972
taaacatt

SEQ ID NO: 111566 - DNA, 6 bp, Unknown
  misc_feature (1)..( 6): Result.002 file - promoters60/1395972
attttc

SEQ ID NO: 111567 - DNA, 6 bp, Unknown
  misc_feature (1)..( 6): Result.002 file - promoters60/1395972
attttc

SEQ ID NO: 111568 - DNA, 6 bp, Unknown
  misc_feature (1)..( 6): Result.002 file - promoters60/1395972
caaaat

SEQ ID NO: 111569 - DNA, 6 bp, Unknown
  misc_feature (1)..( 6): Result.002 file - promoters60/1395972
caaaat

SEQ ID NO: 111570 - DNA, 7 bp, Unknown
  misc_feature (1)..( 7): Result.002 file - promoters60/1395972
tatcttc

SEQ ID NO: 111571 - DNA, 7 bp, Unknown
  misc_feature (1)..( 7): Result.002 file - promoters60/1395972
tatgttc

SEQ ID NO: 111572 - DNA, 8 bp, Unknown
  misc_feature (1)..( 8): Result.002 file - promoters60/1395972
ttggcaaa

SEQ ID NO: 111573 - DNA, 8 bp, Unknown
  misc_feature (1)..( 8): Result.002 file - promoters60/1395972
ttgccaaa

SEQ ID NO: 111574 - DNA, 6 bp, Unknown
  misc_feature (1)..( 6): Result.002 file - promoters60/1395972
caaaat

SEQ ID NO: 111575 - DNA, 6 bp, Unknown
  misc_feature (1)..( 6): Result.002 file - promoters60/1395972
caaaat

SEQ ID NO: 111576 - DNA, 6 bp, Unknown
  misc_feature (1)..( 6): Result.002 file - promoters60/1395972
agacaa

SEQ ID NO: 111577 - DNA, 6 bp, Unknown
  misc_feature (1)..( 6): Result.002 file - promoters60/1395972
agacaa

SEQ ID NO: 111578 - DNA, 6 bp, Unknown
  misc_feature (1)..( 6): Result.002 file - promoters60/1395972
agctaa

SEQ ID NO: 111579 - DNA, 6 bp, Unknown
  misc_feature (1)..( 6): Result.002 file - promoters60/1395972
agctaa

SEQ ID NO: 111580 - DNA, 12 bp, Unknown
  misc_feature (1)..( 12): Result.002 file - promoters60/1395972
aaataaatggaa

SEQ ID NO: 111581 - DNA, 12 bp, Unknown
  misc_feature (1)..( 12): Result.002 file - promoters60/1395972
aaagaaagggaa

SEQ ID NO: 111582 - DNA, 9 bp, Unknown
  misc_feature (1)..( 9): Result.002 file - promoters60/1395972
acattttca

SEQ ID NO: 111583 - DNA, 9 bp, Unknown
  misc_feature (1)..( 9): Result.002 file - promoters60/1395972
acattttca

SEQ ID NO: 111584 - DNA, 6 bp, Unknown
  misc_feature (1)..( 6): Result.002 file - promoters60/1395972
tcttct

SEQ ID NO: 111585 - DNA, 6 bp, Unknown
  misc_feature (1)..( 6): Result.002 file - promoters60/1395972
tcttct

SEQ ID NO: 111586 - DNA, 6 bp, Unknown
  misc_feature (1)..( 6): Result.002 file - promoters60/1395972
tcaaaa

SEQ ID NO: 111587 - DNA, 6 bp, Unknown
  misc_feature (1)..( 6): Result.002 file - promoters60/1395972
tcaaaa

SEQ ID NO: 111588 - DNA, 6 bp, Unknown
  misc_feature (1)..( 6): Result.002 file - promoters60/1395972
agaaag

SEQ ID NO: 111589 - DNA, 6 bp, Unknown
  misc_feature (1)..( 6): Result.002 file - promoters60/1395972
agaaag

SEQ ID NO: 111590 - DNA, 7 bp, Unknown
  misc_feature (1)..( 7): Result.002 file - promoters60/1395972
aagaaaa

SEQ ID NO: 111591 - DNA, 7 bp, Unknown
  misc_feature (1)..( 7): Result.002 file - promoters60/1395972
aagaaaa

SEQ ID NO: 111592 - DNA, 7 bp, Unknown
  misc_feature (1)..( 7): Result.002 file - promoters60/1395972
aaataaa

SEQ ID NO: 111593 - DNA, 7 bp, Unknown
  misc_feature (1)..( 7): Result.002 file - promoters60/1395972
aaataaa

SEQ ID NO: 111594 - DNA, 7 bp, Unknown
  misc_feature (1)..( 7): Result.002 file - promoters60/1395972
atatatg

SEQ ID NO: 111595 - DNA, 7 bp, Unknown
  misc_feature (1)..( 7): Result.002 file - promoters60/1395972
ataaatg

SEQ ID NO: 111596 - DNA, 9 bp, Unknown
  misc_feature (1)..( 9): Result.002 file - promoters60/1396038
cctctttcc

SEQ ID NO: 111597 - DNA, 9 bp, Unknown
  misc_feature (1)..( 9): Result.002 file - promoters60/1396038
cctttttat

SEQ ID NO: 111598 - DNA, 9 bp, Unknown
  misc_feature (1)..( 9): Result.002 file - promoters60/1396038
actctttca

SEQ ID NO: 111599 - DNA, 9 bp, Unknown
  misc_feature (1)..( 9): Result.002 file - promoters60/1396038
tcttttttt

SEQ ID NO: 111600 - DNA, 10 bp, Unknown
  misc_feature (1)..( 10): Result.002 file - promoters60/1396038
tatttatttc

SEQ ID NO: 111601 - DNA, 10 bp, Unknown
  misc_feature (1)..( 10): Result.002 file - promoters60/1396038
tttctttctg

SEQ ID NO: 111602 - DNA, 8 bp, Unknown
  misc_feature (1)..( 8): Result.002 file - promoters60/1396038
tatatata

SEQ ID NO: 111603 - DNA, 8 bp, Unknown
  misc_feature (1)..( 8): Result.002 file - promoters60/1396038
tatataaa

SEQ ID NO: 111604 - DNA, 8 bp, Unknown
  misc_feature (1)..( 8): Result.002 file - promoters60/1396038
tataaata

SEQ ID NO: 111605 - DNA, 8 bp, Unknown
  misc_feature (1)..( 8): Result.002 file - promoters60/1396038
tatatata

SEQ ID NO: 111606 - DNA, 8 bp, Unknown
  misc_feature (1)..( 8): Result.002 file - promoters60/1396038
tataaata

SEQ ID NO: 111607 - DNA, 8 bp, Unknown
  misc_feature (1)..( 8): Result.002 file - promoters60/1396038
gatataat

SEQ ID NO: 111608 - DNA, 18 bp, Unknown
  misc_feature (1)..( 18): Result.002 file - promoters60/1396038
tgcttcgtagattgcgtg

SEQ ID NO: 111609 - DNA, 18 bp, Unknown
  misc_feature (1)..( 18): Result.002 file - promoters60/1396038
ttttttttagtttgtgtg

SEQ ID NO: 111610 - DNA, 18 bp, Unknown
  misc_feature (1)..( 18): Result.002 file - promoters60/1396038
cagtttttattttttatt

SEQ ID NO: 111611 - DNA, 18 bp, Unknown
  misc_feature (1)..( 18): Result.002 file - promoters60/1396038
cagcttttattaaaaaaa

SEQ ID NO: 111612 - DNA, 18 bp, Unknown
  misc_feature (1)..( 18): Result.002 file - promoters60/1396038
ggtctttgattagcaaat

SEQ ID NO: 111613 - DNA, 18 bp, Unknown
  misc_feature (1)..( 18): Result.002 file - promoters60/1396038
caacatttatgaaatttg

SEQ ID NO: 111614 - DNA, 11 bp, Unknown
  misc_feature (1)..( 11): Result.002 file - promoters60/1396085
ttaaattttaa

SEQ ID NO: 111615 - DNA, 11 bp, Unknown
  misc_feature (1)..( 11): Result.002 file - promoters60/1396085
acaaatttgtt

SEQ ID NO: 111616 - DNA, 11 bp, Unknown
  misc_feature (1)..( 11): Result.002 file - promoters60/1396085
taaaattttca

SEQ ID NO: 111617 - DNA, 11 bp, Unknown
  misc_feature (1)..( 11): Result.002 file - promoters60/1396085
ttaaatatgtt

SEQ ID NO: 111618 - DNA, 11 bp, Unknown
  misc_feature (1)..( 11): Result.002 file - promoters60/1396085
acatattttcg

SEQ ID NO: 111619 - DNA, 11 bp, Unknown
  misc_feature (1)..( 11): Result.002 file - promoters60/1396085
ctctattttcc

SEQ ID NO: 111620 - DNA, 11 bp, Unknown
  misc_feature (1)..( 11): Result.002 file - promoters60/1396085
ataaataacat

SEQ ID NO: 111621 - DNA, 13 bp, Unknown
  misc_feature (1)..( 13): Result.002 file - promoters60/1396085
tcacatatttgaa

SEQ ID NO: 111622 - DNA, 13 bp, Unknown
  misc_feature (1)..( 13): Result.002 file - promoters60/1396085
atacatattagta

SEQ ID NO: 111623 - DNA, 13 bp, Unknown
  misc_feature (1)..( 13): Result.002 file - promoters60/1396085
aatcatcttaaat

SEQ ID NO: 111624 - DNA, 13 bp, Unknown
  misc_feature (1)..( 13): Result.002 file - promoters60/1396085
ataaataaacaaa

SEQ ID NO: 111625 - DNA, 13 bp, Unknown
  misc_feature (1)..( 13): Result.002 file - promoters60/1396085
tatcatattgttg

SEQ ID NO: 111626 - DNA, 14 bp, Unknown
  misc_feature (1)..( 14): Result.002 file - promoters60/1396085
gtgcataattaaac

SEQ ID NO: 111627 - DNA, 11 bp, Unknown
  misc_feature (1)..( 11): Result.002 file - promoters60/1396085
attgtacttat

SEQ ID NO: 111628 - DNA, 11 bp, Unknown
  misc_feature (1)..( 11): Result.002 file - promoters60/1396085
tttggactgtg

SEQ ID NO: 111629 - DNA, 11 bp, Unknown
  misc_feature (1)..( 11): Result.002 file - promoters60/1396085
cttgtacacgc

SEQ ID NO: 111630 - DNA, 11 bp, Unknown
  misc_feature (1)..( 11): Result.002 file - promoters60/1396085
tttgaacttat

SEQ ID NO: 111631 - DNA, 11 bp, Unknown
  misc_feature (1)..( 11): Result.002 file - promoters60/1396085
attttaccgac

SEQ ID NO: 111632 - DNA, 11 bp, Unknown
  misc_feature (1)..( 11): Result.002 file - promoters60/1396085
tttgaataatt

SEQ ID NO: 111633 - DNA, 12 bp, Unknown
  misc_feature (1)..( 12): Result.002 file - promoters60/1396085
attttaatctct

SEQ ID NO: 111634 - DNA, 12 bp, Unknown
  misc_feature (1)..( 12): Result.002 file - promoters60/1396085
tttttattctat

SEQ ID NO: 111635 - DNA, 12 bp, Unknown
  misc_feature (1)..( 12): Result.002 file - promoters60/1396085
accttaatcttt

SEQ ID NO: 111636 - DNA, 12 bp, Unknown
  misc_feature (1)..( 12): Result.002 file - promoters60/1396085
gttgtattctaa

SEQ ID NO: 111637 - DNA, 12 bp, Unknown
  misc_feature (1)..( 12): Result.002 file - promoters60/1396085
tctttgttcaac

SEQ ID NO: 111638 - DNA, 12 bp, Unknown
  misc_feature (1)..( 12): Result.002 file - promoters60/1396085
tttttacggcgt

SEQ ID NO: 111639 - DNA, 12 bp, Unknown
  misc_feature (1)..( 12): Result.002 file - promoters60/1396085
aaaaaaatcttt

SEQ ID NO: 111640 - DNA, 9 bp, Unknown
  misc_feature (1)..( 9): Result.002 file - promoters60/1396085
atatatctt

SEQ ID NO: 111641 - DNA, 9 bp, Unknown
  misc_feature (1)..( 9): Result.002 file - promoters60/1396085
ataaatctt

SEQ ID NO: 111642 - DNA, 10 bp, Unknown
  misc_feature (1)..( 10): Result.002 file - promoters60/1396085
ttatcatatt

SEQ ID NO: 111643 - DNA, 10 bp, Unknown
  misc_feature (1)..( 10): Result.002 file - promoters60/1396085
ataaattaat

SEQ ID NO: 111644 - DNA, 10 bp, Unknown
  misc_feature (1)..( 10): Result.002 file - promoters60/1396085
ttaatttata

SEQ ID NO: 111645 - DNA, 10 bp, Unknown
  misc_feature (1)..( 10): Result.002 file - promoters60/1396085
ataaaacttg

SEQ ID NO: 111646 - DNA, 10 bp, Unknown
  misc_feature (1)..( 10): Result.002 file - promoters60/1396085
atattacccc

SEQ ID NO: 111647 - DNA, 10 bp, Unknown
  misc_feature (1)..( 10): Result.002 file - promoters60/1396085
gcttcttatt

SEQ ID NO: 111648 - DNA, 10 bp, Unknown
  misc_feature (1)..( 10): Result.002 file - promoters60/1396085
atttcttaat

SEQ ID NO: 111649 - DNA, 10 bp, Unknown
  misc_feature (1)..( 10): Result.002 file - promoters60/1396085
aattctcaat

SEQ ID NO: 111650 - DNA, 10 bp, Unknown
  misc_feature (1)..( 10): Result.002 file - promoters60/1396085
tttttttagt

SEQ ID NO: 111651 - DNA, 10 bp, Unknown
  misc_feature (1)..( 10): Result.002 file - promoters60/1396085
atttcttctc

SEQ ID NO: 111652 - DNA, 10 bp, Unknown
  misc_feature (1)..( 10): Result.002 file - promoters60/1396085
atttctttgt

SEQ ID NO: 111653 - DNA, 12 bp, Unknown
  misc_feature (1)..( 12): Result.002 file - promoters60/1396085
aaatttgttgta

SEQ ID NO: 111654 - DNA, 12 bp, Unknown
  misc_feature (1)..( 12): Result.002 file - promoters60/1396085
ttctttgttcaa

SEQ ID NO: 111655 - DNA, 12 bp, Unknown
  misc_feature (1)..( 12): Result.002 file - promoters60/1396085
aaatatgttaac

SEQ ID NO: 111656 - DNA, 12 bp, Unknown
  misc_feature (1)..( 12): Result.002 file - promoters60/1396085
atctttgtagta

SEQ ID NO: 111657 - DNA, 12 bp, Unknown
  misc_feature (1)..( 12): Result.002 file - promoters60/1396085
atttttattcta

SEQ ID NO: 111658 - DNA, 12 bp, Unknown
  misc_feature (1)..( 12): Result.002 file - promoters60/1396085
aaataaataaca

SEQ ID NO: 111659 - DNA, 8 bp, Unknown
  misc_feature (1)..( 8): Result.002 file - promoters60/1396085
atatattc

SEQ ID NO: 111660 - DNA, 8 bp, Unknown
  misc_feature (1)..( 8): Result.002 file - promoters60/1396085
ctattttc

SEQ ID NO: 111661 - DNA, 8 bp, Unknown
  misc_feature (1)..( 8): Result.002 file - promoters60/1396085
atatatat

SEQ ID NO: 111662 - DNA, 8 bp, Unknown
  misc_feature (1)..( 8): Result.002 file - promoters60/1396085
atattttc

SEQ ID NO: 111663 - DNA, 8 bp, Unknown
  misc_feature (1)..( 8): Result.002 file - promoters60/1396085
ttatgcta

SEQ ID NO: 111664 - DNA, 8 bp, Unknown
  misc_feature (1)..( 8): Result.002 file - promoters60/1396085
ttctattt

SEQ ID NO: 111665 - DNA, 11 bp, Unknown
  misc_feature (1)..( 11): Result.002 file - promoters60/1396085
aatagttaagt

SEQ ID NO: 111666 - DNA, 11 bp, Unknown
  misc_feature (1)..( 11): Result.002 file - promoters60/1396085
gatatttagga

SEQ ID NO: 111667 - DNA, 11 bp, Unknown
  misc_feature (1)..( 11): Result.002 file - promoters60/1396085
cataattaaac

SEQ ID NO: 111668 - DNA, 11 bp, Unknown
  misc_feature (1)..( 11): Result.002 file - promoters60/1396085
actatttacat

SEQ ID NO: 111669 - DNA, 11 bp, Unknown
  misc_feature (1)..( 11): Result.002 file - promoters60/1396085
cctaattaacc

SEQ ID NO: 111670 - DNA, 11 bp, Unknown
  misc_feature (1)..( 11): Result.002 file - promoters60/1396085
caaaattaaat

SEQ ID NO: 111671 - DNA, 11 bp, Unknown
  misc_feature (1)..( 11): Result.002 file - promoters60/1396085
cataaataaac

SEQ ID NO: 111672 - DNA, 13 bp, Unknown
  misc_feature (1)..( 13): Result.002 file - promoters60/1396085
agaccaattctca

SEQ ID NO: 111673 - DNA, 13 bp, Unknown
  misc_feature (1)..( 13): Result.002 file - promoters60/1396085
ttaccatttcttt

SEQ ID NO: 111674 - DNA, 13 bp, Unknown
  misc_feature (1)..( 13): Result.002 file - promoters60/1396085
ccttacttttttt

SEQ ID NO: 111675 - DNA, 13 bp, Unknown
  misc_feature (1)..( 13): Result.002 file - promoters60/1396085
ttactctttctat

SEQ ID NO: 111676 - DNA, 13 bp, Unknown
  misc_feature (1)..( 13): Result.002 file - promoters60/1396085
ttgacattttttt

SEQ ID NO: 111677 - DNA, 13 bp, Unknown
  misc_feature (1)..( 13): Result.002 file - promoters60/1396085
atcccattttccc

SEQ ID NO: 111678 - DNA, 7 bp, Unknown
  misc_feature (1)..( 7): Result.002 file - promoters60/1396104
tatcaaa

SEQ ID NO: 111679 - DNA, 7 bp, Unknown
  misc_feature (1)..( 7): Result.002 file - promoters60/1396104
tatcaaa

SEQ ID NO: 111680 - DNA, 7 bp, Unknown
  misc_feature (1)..( 7): Result.002 file - promoters60/1396104
gatcaaa

SEQ ID NO: 111681 - DNA, 6 bp, Unknown
  misc_feature (1)..( 6): Result.002 file - promoters60/1396123
aatata

SEQ ID NO: 111682 - DNA, 6 bp, Unknown
  misc_feature (1)..( 6): Result.002 file - promoters60/1396123
aatata

SEQ ID NO: 111683 - DNA, 7 bp, Unknown
  misc_feature (1)..( 7): Result.002 file - promoters60/1396123
ttattat

SEQ ID NO: 111684 - DNA, 7 bp, Unknown
  misc_feature (1)..( 7): Result.002 file - promoters60/1396123
ttaatat

SEQ ID NO: 111685 - DNA, 6 bp, Unknown
  misc_feature (1)..( 6): Result.002 file - promoters60/1396123
tattaa

SEQ ID NO: 111686 - DNA, 6 bp, Unknown
  misc_feature (1)..( 6): Result.002 file - promoters60/1396123
tattaa

SEQ ID NO: 111687 - DNA, 6 bp, Unknown
  misc_feature (1)..( 6): Result.002 file - promoters60/1396123
tatatt

SEQ ID NO: 111688 - DNA, 6 bp, Unknown
  misc_feature (1)..( 6): Result.002 file - promoters60/1396123
tatatt

SEQ ID NO: 111689 - DNA, 7 bp, Unknown
  misc_feature (1)..( 7): Result.002 file - promoters60/1396123
attatca

SEQ ID NO: 111690 - DNA, 7 bp, Unknown
  misc_feature (1)..( 7): Result.002 file - promoters60/1396123
attatca

SEQ ID NO: 111691 - DNA, 6 bp, Unknown
  misc_feature (1)..( 6): Result.002 file - promoters60/1396123
aataaa

SEQ ID NO: 111692 - DNA, 6 bp, Unknown
  misc_feature (1)..( 6): Result.002 file - promoters60/1396123
aataaa

SEQ ID NO: 111693 - DNA, 11 bp, Unknown
  misc_feature (1)..( 11): Result.002 file - promoters60/1396123
ataaactcaaa

SEQ ID NO: 111694 - DNA, 11 bp, Unknown
  misc_feature (1)..( 11): Result.002 file - promoters60/1396123
ataaacgcaaa

SEQ ID NO: 111695 - DNA, 8 bp, Unknown
  misc_feature (1)..( 8): Result.002 file - promoters60/1396123
ctgaaata

SEQ ID NO: 111696 - DNA, 8 bp, Unknown
  misc_feature (1)..( 8): Result.002 file - promoters60/1396123
ctgaaata

SEQ ID NO: 111697 - DNA, 6 bp, Unknown
  misc_feature (1)..( 6): Result.002 file - promoters60/1396123
aaacct

SEQ ID NO: 111698 - DNA, 6 bp, Unknown
  misc_feature (1)..( 6): Result.002 file - promoters60/1396123
aaacct

SEQ ID NO: 111699 - DNA, 6 bp, Unknown
  misc_feature (1)..( 6): Result.002 file - promoters60/1396123
aaatag

SEQ ID NO: 111700 - DNA, 6 bp, Unknown
  misc_feature (1)..( 6): Result.002 file - promoters60/1396123
aaatag

SEQ ID NO: 111701 - DNA, 6 bp, Unknown
  misc_feature (1)..( 6): Result.002 file - promoters60/1396123
aacacg

SEQ ID NO: 111702 - DNA, 6 bp, Unknown
  misc_feature (1)..( 6): Result.002 file - promoters60/1396123
aacacg

SEQ ID NO: 111703 - DNA, 9 bp, Unknown
  misc_feature (1)..( 9): Result.002 file - promoters60/1396123
aatactttg

SEQ ID NO: 111704 - DNA, 9 bp, Unknown
  misc_feature (1)..( 9): Result.002 file - promoters60/1396123
aattctttg

SEQ ID NO: 111705 - DNA, 7 bp, Unknown
  misc_feature (1)..( 7): Result.002 file - promoters60/1396123
acagaaa

SEQ ID NO: 111706 - DNA, 7 bp, Unknown
  misc_feature (1)..( 7): Result.002 file - promoters60/1396123
acaaaaa

SEQ ID NO: 111707 - DNA, 8 bp, Unknown
  misc_feature (1)..( 8): Result.002 file - promoters60/1396123
aaaaaata

SEQ ID NO: 111708 - DNA, 8 bp, Unknown
  misc_feature (1)..( 8): Result.002 file - promoters60/1396123
aaaaaata

SEQ ID NO: 111709 - DNA, 7 bp, Unknown
  misc_feature (1)..( 7): Result.002 file - promoters60/1396123
atatagg

SEQ ID NO: 111710 - DNA, 7 bp, Unknown
  misc_feature (1)..( 7): Result.002 file - promoters60/1396123
atagagg

SEQ ID NO: 111711 - DNA, 6 bp, Unknown
  misc_feature (1)..( 6): Result.002 file - promoters60/1396123
tgaaga

SEQ ID NO: 111712 - DNA, 6 bp, Unknown
  misc_feature (1)..( 6): Result.002 file - promoters60/1396123
tgaaga

SEQ ID NO: 111713 - DNA, 7 bp, Unknown
  misc_feature (1)..( 7): Result.002 file - promoters60/1396123
atcaaag

SEQ ID NO: 111714 - DNA, 7 bp, Unknown
  misc_feature (1)..( 7): Result.002 file - promoters60/1396123
atcaaag

SEQ ID NO: 111715 - DNA, 7 bp, Unknown
  misc_feature (1)..( 7): Result.002 file - promoters60/1396123
acatatg

SEQ ID NO: 111716 - DNA, 7 bp, Unknown
  misc_feature (1)..( 7): Result.002 file - promoters60/1396123
acacatg

SEQ ID NO: 111717 - DNA, 7 bp, Unknown
  misc_feature (1)..( 7): Result.002 file - promoters60/1396123
ttagatc

SEQ ID NO: 111718 - DNA, 7 bp, Unknown
  misc_feature (1)..( 7): Result.002 file - promoters60/1396123
ttagatc

SEQ ID NO: 111719 - DNA, 6 bp, Unknown
  misc_feature (1)..( 6): Result.002 file - promoters60/1396123
tgtttc

SEQ ID NO: 111720 - DNA, 6 bp, Unknown
  misc_feature (1)..( 6): Result.002 file - promoters60/1396123
tgtttc

SEQ ID NO: 111721 - DNA, 6 bp, Unknown
  misc_feature (1)..( 6): Result.002 file - promoters60/1396123
ttcact

SEQ ID NO: 111722 - DNA, 6 bp, Unknown
  misc_feature (1)..( 6): Result.002 file - promoters60/1396123
ttcact

SEQ ID NO: 111723 - DNA, 9 bp, Unknown
  misc_feature (1)..( 9): Result.002 file - promoters60/1396123
ggaccactt

SEQ ID NO: 111724 - DNA, 9 bp, Unknown
  misc_feature (1)..( 9): Result.002 file - promoters60/1396123
ggaacactt

SEQ ID NO: 111725 - DNA, 14 bp, Unknown
  misc_feature (1)..( 14): Result.002 file - promoters60/1396127
ataaagtaatttaa

SEQ ID NO: 111726 - DNA, 14 bp, Unknown
  misc_feature (1)..( 14): Result.002 file - promoters60/1396127
aaacagtagtttcc

SEQ ID NO: 111727 - DNA, 14 bp, Unknown
  misc_feature (1)..( 14): Result.002 file - promoters60/1396127
ataaattaattaat

SEQ ID NO: 111728 - DNA, 14 bp, Unknown
  misc_feature (1)..( 14): Result.002 file - promoters60/1396127
tttgttgagtttcg

SEQ ID NO: 111729 - DNA, 14 bp, Unknown
  misc_feature (1)..( 14): Result.002 file - promoters60/1396127
tcaagataaataaa

SEQ ID NO: 111730 - DNA, 14 bp, Unknown
  misc_feature (1)..( 14): Result.002 file - promoters60/1396127
tacgaaaaaaaaaa

SEQ ID NO: 111731 - DNA, 9 bp, Unknown
  misc_feature (1)..( 9): Result.002 file - promoters60/1396127
aaattttaa

SEQ ID NO: 111732 - DNA, 9 bp, Unknown
  misc_feature (1)..( 9): Result.002 file - promoters60/1396127
aaatttgtt

SEQ ID NO: 111733 - DNA, 9 bp, Unknown
  misc_feature (1)..( 9): Result.002 file - promoters60/1396127
taattttgt

SEQ ID NO: 111734 - DNA, 9 bp, Unknown
  misc_feature (1)..( 9): Result.002 file - promoters60/1396127
aaatatgtt

SEQ ID NO: 111735 - DNA, 9 bp, Unknown
  misc_feature (1)..( 9): Result.002 file - promoters60/1396127
gaatgataa

SEQ ID NO: 111736 - DNA, 9 bp, Unknown
  misc_feature (1)..( 9): Result.002 file - promoters60/1396127
gtattttac

SEQ ID NO: 111737 - DNA, 12 bp, Unknown
  misc_feature (1)..( 12): Result.002 file - promoters60/1396147
aattaactatta

SEQ ID NO: 111738 - DNA, 12 bp, Unknown
  misc_feature (1)..( 12): Result.002 file - promoters60/1396147
atattactttta

SEQ ID NO: 111739 - DNA, 12 bp, Unknown
  misc_feature (1)..( 12): Result.002 file - promoters60/1396147
atcttaatttca

SEQ ID NO: 111740 - DNA, 12 bp, Unknown
  misc_feature (1)..( 12): Result.002 file - promoters60/1396147
atcctaatcaac

SEQ ID NO: 111741 - DNA, 13 bp, Unknown
  misc_feature (1)..( 13): Result.002 file - promoters60/1396151
aagaaacaagctt

SEQ ID NO: 111742 - DNA, 13 bp, Unknown
  misc_feature (1)..( 13): Result.002 file - promoters60/1396151
ttgaatcaatatt

SEQ ID NO: 111743 - DNA, 13 bp, Unknown
  misc_feature (1)..( 13): Result.002 file - promoters60/1396151
ttgattcaaaatt

SEQ ID NO: 111744 - DNA, 7 bp, Unknown
  misc_feature (1)..( 7): Result.002 file - promoters60/1396151
tatgcaa

SEQ ID NO: 111745 - DNA, 7 bp, Unknown
  misc_feature (1)..( 7): Result.002 file - promoters60/1396151
tatccaa

SEQ ID NO: 111746 - DNA, 7 bp, Unknown
  misc_feature (1)..( 7): Result.002 file - promoters60/1396151
tttcatt

SEQ ID NO: 111747 - DNA, 7 bp, Unknown
  misc_feature (1)..( 7): Result.002 file - promoters60/1396151
tttgatt

SEQ ID NO: 111748 - DNA, 8 bp, Unknown
  misc_feature (1)..( 8): Result.002 file - promoters60/1396151
aattaatg

SEQ ID NO: 111749 - DNA, 8 bp, Unknown
  misc_feature (1)..( 8): Result.002 file - promoters60/1396151
aattgatg

SEQ ID NO: 111750 - DNA, 6 bp, Unknown
  misc_feature (1)..( 6): Result.002 file - promoters60/1396151
ggttat

SEQ ID NO: 111751 - DNA, 6 bp, Unknown
  misc_feature (1)..( 6): Result.002 file - promoters60/1396151
ggttat

SEQ ID NO: 111752 - DNA, 7 bp, Unknown
  misc_feature (1)..( 7): Result.002 file - promoters60/1396151
gatttcc

SEQ ID NO: 111753 - DNA, 7 bp, Unknown
  misc_feature (1)..( 7): Result.002 file - promoters60/1396151
gatttcc

SEQ ID NO: 111754 - DNA, 13 bp, Unknown
  misc_feature (1)..( 13): Result.002 file - promoters60/1396151
ttcaaaccctccc

SEQ ID NO: 111755 - DNA, 13 bp, Unknown
  misc_feature (1)..( 13): Result.002 file - promoters60/1396151
ttcaaaattctct

SEQ ID NO: 111756 - DNA, 13 bp, Unknown
  misc_feature (1)..( 13): Result.002 file - promoters60/1396151
ttgaatcaatatt

SEQ ID NO: 111757 - DNA, 7 bp, Unknown
  misc_feature (1)..( 7): Result.002 file - promoters60/1396151
agaactc

SEQ ID NO: 111758 - DNA, 7 bp, Unknown
  misc_feature (1)..( 7): Result.002 file - promoters60/1396151
agagctc

SEQ ID NO: 111759 - DNA, 7 bp, Unknown
  misc_feature (1)..( 7): Result.002 file - promoters60/1396151
tatttca

SEQ ID NO: 111760 - DNA, 7 bp, Unknown
  misc_feature (1)..( 7): Result.002 file - promoters60/1396151
tatttct

SEQ ID NO: 111761 - DNA, 7 bp, Unknown
  misc_feature (1)..( 7): Result.002 file - promoters60/1396151
aatttct

SEQ ID NO: 111762 - DNA, 6 bp, Unknown
  misc_feature (1)..( 6): Result.002 file - promoters60/1396151
ttaatt

SEQ ID NO: 111763 - DNA, 6 bp, Unknown
  misc_feature (1)..( 6): Result.002 file - promoters60/1396151
ttaatt

SEQ ID NO: 111764 - DNA, 7 bp, Unknown
  misc_feature (1)..( 7): Result.002 file - promoters60/1396151
tggattt

SEQ ID NO: 111765 - DNA, 7 bp, Unknown
  misc_feature (1)..( 7): Result.002 file - promoters60/1396151
tggattt

SEQ ID NO: 111766 - DNA, 6 bp, Unknown
  misc_feature (1)..( 6): Result.002 file - promoters60/1396151
aagatt

SEQ ID NO: 111767 - DNA, 6 bp, Unknown
  misc_feature (1)..( 6): Result.002 file - promoters60/1396151
aagatt

SEQ ID NO: 111768 - DNA, 6 bp, Unknown
  misc_feature (1)..( 6): Result.002 file - promoters60/1396151
ttggtt

SEQ ID NO: 111769 - DNA, 6 bp, Unknown
  misc_feature (1)..( 6): Result.002 file - promoters60/1396151
ttggtt

SEQ ID NO: 111770 - DNA, 6 bp, Unknown
  misc_feature (1)..( 6): Result.002 file - promoters60/1396151
ttaacc

SEQ ID NO: 111771 - DNA, 6 bp, Unknown
  misc_feature (1)..( 6): Result.002 file - promoters60/1396151
ttaacc

SEQ ID NO: 111772 - DNA, 7 bp, Unknown
  misc_feature (1)..( 7): Result.002 file - promoters60/1396151
ctcactc

SEQ ID NO: 111773 - DNA, 7 bp, Unknown
  misc_feature (1)..( 7): Result.002 file - promoters60/1396151
ctcgctc

SEQ ID NO: 111774 - DNA, 7 bp, Unknown
  misc_feature (1)..( 7): Result.002 file - promoters60/1396182
ttttgct

SEQ ID NO: 111775 - DNA, 7 bp, Unknown
  misc_feature (1)..( 7): Result.002 file - promoters60/1396182
ttttgct

SEQ ID NO: 111776 - DNA, 6 bp, Unknown
  misc_feature (1)..( 6): Result.002 file - promoters60/1396182
cttgtg

SEQ ID NO: 111777 - DNA, 6 bp, Unknown
  misc_feature (1)..( 6): Result.002 file - promoters60/1396182
cttgtg

SEQ ID NO: 111778 - DNA, 9 bp, Unknown
  misc_feature (1)..( 9): Result.002 file - promoters60/1396182
aagaataag

SEQ ID NO: 111779 - DNA, 9 bp, Unknown
  misc_feature (1)..( 9): Result.002 file - promoters60/1396182
gttaataag

SEQ ID NO: 111780 - DNA, 9 bp, Unknown
  misc_feature (1)..( 9): Result.002 file - promoters60/1396182
aagagtaaa

SEQ ID NO: 111781 - DNA, 8 bp, Unknown
  misc_feature (1)..( 8): Result.002 file - promoters60/1396182
ttttttct

SEQ ID NO: 111782 - DNA, 8 bp, Unknown
  misc_feature (1)..( 8): Result.002 file - promoters60/1396182
tttattct

SEQ ID NO: 111783 - DNA, 7 bp, Unknown
  misc_feature (1)..( 7): Result.002 file - promoters60/1396182
ttctaat

SEQ ID NO: 111784 - DNA, 7 bp, Unknown
  misc_feature (1)..( 7): Result.002 file - promoters60/1396182
ttctaat

SEQ ID NO: 111785 - DNA, 7 bp, Unknown
  misc_feature (1)..( 7): Result.002 file - promoters60/1396182
aaaacaa

SEQ ID NO: 111786 - DNA, 7 bp, Unknown
  misc_feature (1)..( 7): Result.002 file - promoters60/1396182
aaagcaa

SEQ ID NO: 111787 - DNA, 7 bp, Unknown
  misc_feature (1)..( 7): Result.002 file - promoters60/1396182
gaaacaa

SEQ ID NO: 111788 - DNA, 7 bp, Unknown
  misc_feature (1)..( 7): Result.002 file - promoters60/1396182
acttgat

SEQ ID NO: 111789 - DNA, 7 bp, Unknown
  misc_feature (1)..( 7): Result.002 file - promoters60/1396182
actagat

SEQ ID NO: 111790 - DNA, 6 bp, Unknown
  misc_feature (1)..( 6): Result.002 file - promoters60/1396182
atattt

SEQ ID NO: 111791 - DNA, 6 bp, Unknown
  misc_feature (1)..( 6): Result.002 file - promoters60/1396182
atattt

SEQ ID NO: 111792 - DNA, 7 bp, Unknown
  misc_feature (1)..( 7): Result.002 file - promoters60/1396182
atagctt

SEQ ID NO: 111793 - DNA, 7 bp, Unknown
  misc_feature (1)..( 7): Result.002 file - promoters60/1396182
ataactt

SEQ ID NO: 111794 - DNA, 6 bp, Unknown
  misc_feature (1)..( 6): Result.002 file - promoters60/1396182
tccaaa

SEQ ID NO: 111795 - DNA, 6 bp, Unknown
  misc_feature (1)..( 6): Result.002 file - promoters60/1396182
tccaaa

SEQ ID NO: 111796 - DNA, 7 bp, Unknown
  misc_feature (1)..( 7): Result.002 file - promoters60/1396182
cttgaaa

SEQ ID NO: 111797 - DNA, 7 bp, Unknown
  misc_feature (1)..( 7): Result.002 file - promoters60/1396182
cttgaaa

SEQ ID NO: 111798 - DNA, 9 bp, Unknown
  misc_feature (1)..( 9): Result.002 file - promoters60/1396182
attgtgatt

SEQ ID NO: 111799 - DNA, 9 bp, Unknown
  misc_feature (1)..( 9): Result.002 file - promoters60/1396182
attgttatt

SEQ ID NO: 111800 - DNA, 11 bp, Unknown
  misc_feature (1)..( 11): Result.002 file - promoters60/1396182
tagtatgcaat

SEQ ID NO: 111801 - DNA, 11 bp, Unknown
  misc_feature (1)..( 11): Result.002 file - promoters60/1396182
ggaaatgaaat

SEQ ID NO: 111802 - DNA, 11 bp, Unknown
  misc_feature (1)..( 11): Result.002 file - promoters60/1396182
ggaaaagaaaa

SEQ ID NO: 111803 - DNA, 7 bp, Unknown
  misc_feature (1)..( 7): Result.002 file - promoters60/1396182
tcttttg

SEQ ID NO: 111804 - DNA, 7 bp, Unknown
  misc_feature (1)..( 7): Result.002 file - promoters60/1396182
tctattg

SEQ ID NO: 111805 - DNA, 8 bp, Unknown
  misc_feature (1)..( 8): Result.002 file - promoters60/1396182
aaaaggaa

SEQ ID NO: 111806 - DNA, 8 bp, Unknown
  misc_feature (1)..( 8): Result.002 file - promoters60/1396182
aaaaagaa

SEQ ID NO: 111807 - DNA, 7 bp, Unknown
  misc_feature (1)..( 7): Result.002 file - promoters60/1396182
ctatata

SEQ ID NO: 111808 - DNA, 7 bp, Unknown
  misc_feature (1)..( 7): Result.002 file - promoters60/1396182
gtatata

SEQ ID NO: 111809 - DNA, 7 bp, Unknown
  misc_feature (1)..( 7): Result.002 file - promoters60/1396182
gtatata

SEQ ID NO: 111810 - DNA, 7 bp, Unknown
  misc_feature (1)..( 7): Result.002 file - promoters60/1396182
aatcggg

SEQ ID NO: 111811 - DNA, 7 bp, Unknown
  misc_feature (1)..( 7): Result.002 file - promoters60/1396182
aattggg

SEQ ID NO: 111812 - DNA, 7 bp, Unknown
  misc_feature (1)..( 7): Result.002 file - promoters60/1396182
cccacta

SEQ ID NO: 111813 - DNA, 7 bp, Unknown
  misc_feature (1)..( 7): Result.002 file - promoters60/1396182
cccacta

SEQ ID NO: 111814 - DNA, 9 bp, Unknown
  misc_feature (1)..( 9): Result.002 file - promoters60/1396182
aaagaaaag

SEQ ID NO: 111815 - DNA, 9 bp, Unknown
  misc_feature (1)..( 9): Result.002 file - promoters60/1396182
aaagtaaag

SEQ ID NO: 111816 - DNA, 10 bp, Unknown
  misc_feature (1)..( 10): Result.002 file - promoters60/1396238
aaaaatgaag

SEQ ID NO: 111817 - DNA, 10 bp, Unknown
  misc_feature (1)..( 10): Result.002 file - promoters60/1396238
ccaaatgaca

SEQ ID NO: 111818 - DNA, 11 bp, Unknown
  misc_feature (1)..( 11): Result.002 file - promoters60/1396238
caaatatgaca

SEQ ID NO: 111819 - DNA, 11 bp, Unknown
  misc_feature (1)..( 11): Result.002 file - promoters60/1396238
gaacaattaca

SEQ ID NO: 111820 - DNA, 11 bp, Unknown
  misc_feature (1)..( 11): Result.002 file - promoters60/1396238
acagacagaaa

SEQ ID NO: 111821 - DNA, 11 bp, Unknown
  misc_feature (1)..( 11): Result.002 file - promoters60/1396238
acaaacataac

SEQ ID NO: 111822 - DNA, 11 bp, Unknown
  misc_feature (1)..( 11): Result.002 file - promoters60/1396238
agagagataga

SEQ ID NO: 111823 - DNA, 8 bp, Unknown
  misc_feature (1)..( 8): Result.002 file - promoters60/1396238
ataatatg

SEQ ID NO: 111824 - DNA, 8 bp, Unknown
  misc_feature (1)..( 8): Result.002 file - promoters60/1396238
ataataag

SEQ ID NO: 111825 - DNA, 8 bp, Unknown
  misc_feature (1)..( 8): Result.002 file - promoters60/1396238
ctaataag

SEQ ID NO: 111826 - DNA, 7 bp, Unknown
  misc_feature (1)..( 7): Result.002 file - promoters60/1396238
taatggg

SEQ ID NO: 111827 - DNA, 7 bp, Unknown
  misc_feature (1)..( 7): Result.002 file - promoters60/1396238
taaaggg

SEQ ID NO: 111828 - DNA, 7 bp, Unknown
  misc_feature (1)..( 7): Result.002 file - promoters60/1396238
taaaggc

SEQ ID NO: 111829 - DNA, 9 bp, Unknown
  misc_feature (1)..( 9): Result.002 file - promoters60/1396238
aatgacaac

SEQ ID NO: 111830 - DNA, 9 bp, Unknown
  misc_feature (1)..( 9): Result.002 file - promoters60/1396238
tatgacaac

SEQ ID NO: 111831 - DNA, 9 bp, Unknown
  misc_feature (1)..( 9): Result.002 file - promoters60/1396238
aattacatg

SEQ ID NO: 111832 - DNA, 9 bp, Unknown
  misc_feature (1)..( 9): Result.002 file - promoters60/1396238
tatgtgtgc

SEQ ID NO: 111833 - DNA, 9 bp, Unknown
  misc_feature (1)..( 9): Result.002 file - promoters60/1396238
tatttgtaa

SEQ ID NO: 111834 - DNA, 9 bp, Unknown
  misc_feature (1)..( 9): Result.002 file - promoters60/1396238
gctttgtaa

SEQ ID NO: 111835 - DNA, 9 bp, Unknown
  misc_feature (1)..( 9): Result.002 file - promoters60/1396238
tatatacga

SEQ ID NO: 111836 - DNA, 9 bp, Unknown
  misc_feature (1)..( 9): Result.002 file - promoters60/1396238
aatatacga

SEQ ID NO: 111837 - DNA, 9 bp, Unknown
  misc_feature (1)..( 9): Result.002 file - promoters60/1396238
tatataaac

SEQ ID NO: 111838 - DNA, 11 bp, Unknown
  misc_feature (1)..( 11): Result.002 file - promoters60/1396256
acgtttcattt

SEQ ID NO: 111839 - DNA, 11 bp, Unknown
  misc_feature (1)..( 11): Result.002 file - promoters60/1396256
aaatttaattt

SEQ ID NO: 111840 - DNA, 11 bp, Unknown
  misc_feature (1)..( 11): Result.002 file - promoters60/1396256
ccagttcgttt

SEQ ID NO: 111841 - DNA, 11 bp, Unknown
  misc_feature (1)..( 11): Result.002 file - promoters60/1396256
aaaattaaatc

SEQ ID NO: 111842 - DNA, 9 bp, Unknown
  misc_feature (1)..( 9): Result.002 file - promoters60/1396256
ttgttgttt

SEQ ID NO: 111843 - DNA, 9 bp, Unknown
  misc_feature (1)..( 9): Result.002 file - promoters60/1396256
ttgttgtta

SEQ ID NO: 111844 - DNA, 9 bp, Unknown
  misc_feature (1)..( 9): Result.002 file - promoters60/1396256
acgttcttt

SEQ ID NO: 111845 - DNA, 9 bp, Unknown
  misc_feature (1)..( 9): Result.002 file - promoters60/1396256
ttatagttt

SEQ ID NO: 111846 - DNA, 12 bp, Unknown
  misc_feature (1)..( 12): Result.002 file - promoters60/1396256
tcctataataaa

SEQ ID NO: 111847 - DNA, 12 bp, Unknown
  misc_feature (1)..( 12): Result.002 file - promoters60/1396256
gcctttaaaaaa

SEQ ID NO: 111848 - DNA, 12 bp, Unknown
  misc_feature (1)..( 12): Result.002 file - promoters60/1396256
tcctataaatat

SEQ ID NO: 111849 - DNA, 12 bp, Unknown
  misc_feature (1)..( 12): Result.002 file - promoters60/1396256
ttcaacaaaaag

SEQ ID NO: 111850 - DNA, 10 bp, Unknown
  misc_feature (1)..( 10): Result.002 file - promoters60/1396256
gaattttttt

SEQ ID NO: 111851 - DNA, 10 bp, Unknown
  misc_feature (1)..( 10): Result.002 file - promoters60/1396256
tcttttattt

SEQ ID NO: 111852 - DNA, 10 bp, Unknown
  misc_feature (1)..( 10): Result.002 file - promoters60/1396256
aattttataa

SEQ ID NO: 111853 - DNA, 10 bp, Unknown
  misc_feature (1)..( 10): Result.002 file - promoters60/1396256
aatcttactc

SEQ ID NO: 111854 - DNA, 10 bp, Unknown
  misc_feature (1)..( 10): Result.002 file - promoters60/1396256
catcttactc

SEQ ID NO: 111855 - DNA, 10 bp, Unknown
  misc_feature (1)..( 10): Result.002 file - promoters60/1396256
gaatctcttc

SEQ ID NO: 111856 - DNA, 10 bp, Unknown
  misc_feature (1)..( 10): Result.002 file - promoters60/1396256
taatatctca

SEQ ID NO: 111857 - DNA, 10 bp, Unknown
  misc_feature (1)..( 10): Result.002 file - promoters60/1396256
taatgtctcg

SEQ ID NO: 111858 - DNA, 10 bp, Unknown
  misc_feature (1)..( 10): Result.002 file - promoters60/1396256
tgatggctcg

SEQ ID NO: 111859 - DNA, 10 bp, Unknown
  misc_feature (1)..( 10): Result.002 file - promoters60/1396256
aatttttttc

SEQ ID NO: 111860 - DNA, 10 bp, Unknown
  misc_feature (1)..( 10): Result.002 file - promoters60/1396256
aattttataa

SEQ ID NO: 111861 - DNA, 10 bp, Unknown
  misc_feature (1)..( 10): Result.002 file - promoters60/1396256
aatcttactc

SEQ ID NO: 111862 - DNA, 10 bp, Unknown
  misc_feature (1)..( 10): Result.002 file - promoters60/1396256
catcttactc

SEQ ID NO: 111863 - DNA, 8 bp, Unknown
  misc_feature (1)..( 8): Result.002 file - promoters60/1396256
gacaaagt

SEQ ID NO: 111864 - DNA, 8 bp, Unknown
  misc_feature (1)..( 8): Result.002 file - promoters60/1396256
gacaaaaa

SEQ ID NO: 111865 - DNA, 8 bp, Unknown
  misc_feature (1)..( 8): Result.002 file - promoters60/1396256
cacaaaaa

SEQ ID NO: 111866 - DNA, 8 bp, Unknown
  misc_feature (1)..( 8): Result.002 file - promoters60/1396256
cacaaata

SEQ ID NO: 111867 - DNA, 8 bp, Unknown
  misc_feature (1)..( 8): Result.002 file - promoters60/1396256
taaataaa

SEQ ID NO: 111868 - DNA, 8 bp, Unknown
  misc_feature (1)..( 8): Result.002 file - promoters60/1396256
caaaaaaa

SEQ ID NO: 111869 - DNA, 8 bp, Unknown
  misc_feature (1)..( 8): Result.002 file - promoters60/1396256
cacaaaaa

SEQ ID NO: 111870 - DNA, 8 bp, Unknown
  misc_feature (1)..( 8): Result.002 file - promoters60/1396256
cacaaata

SEQ ID NO: 111871 - DNA, 7 bp, Unknown
  misc_feature (1)..( 7): Result.002 file - promoters60/1396296
tatttaa

SEQ ID NO: 111872 - DNA, 7 bp, Unknown
  misc_feature (1)..( 7): Result.002 file - promoters60/1396296
tatctaa

SEQ ID NO: 111873 - DNA, 7 bp, Unknown
  misc_feature (1)..( 7): Result.002 file - promoters60/1396296
atatttg

SEQ ID NO: 111874 - DNA, 7 bp, Unknown
  misc_feature (1)..( 7): Result.002 file - promoters60/1396296
atatttg

SEQ ID NO: 111875 - DNA, 7 bp, Unknown
  misc_feature (1)..( 7): Result.002 file - promoters60/1396296
tttgaag

SEQ ID NO: 111876 - DNA, 7 bp, Unknown
  misc_feature (1)..( 7): Result.002 file - promoters60/1396296
tttgaat

SEQ ID NO: 111877 - DNA, 7 bp, Unknown
  misc_feature (1)..( 7): Result.002 file - promoters60/1396296
tttcaag

SEQ ID NO: 111878 - DNA, 6 bp, Unknown
  misc_feature (1)..( 6): Result.002 file - promoters60/1396296
tttttt

SEQ ID NO: 111879 - DNA, 6 bp, Unknown
  misc_feature (1)..( 6): Result.002 file - promoters60/1396296
tttttt

SEQ ID NO: 111880 - DNA, 7 bp, Unknown
  misc_feature (1)..( 7): Result.002 file - promoters60/1396296
tttgttt

SEQ ID NO: 111881 - DNA, 11 bp, Unknown
  misc_feature (1)..( 11): Result.002 file - promoters60/1396296
agacagaaaga

SEQ ID NO: 111882 - DNA, 11 bp, Unknown
  misc_feature (1)..( 11): Result.002 file - promoters60/1396296
agagagataga

SEQ ID NO: 111883 - DNA, 6 bp, Unknown
  misc_feature (1)..( 6): Result.002 file - promoters60/1396296
taataa

SEQ ID NO: 111884 - DNA, 6 bp, Unknown
  misc_feature (1)..( 6): Result.002 file - promoters60/1396296
taataa

SEQ ID NO: 111885 - DNA, 9 bp, Unknown
  misc_feature (1)..( 9): Result.002 file - promoters60/1396296
ataaacgaa

SEQ ID NO: 111886 - DNA, 9 bp, Unknown
  misc_feature (1)..( 9): Result.002 file - promoters60/1396296
ataaatgaa

SEQ ID NO: 111887 - DNA, 8 bp, Unknown
  misc_feature (1)..( 8): Result.002 file - promoters60/1396296
ctaatcac

SEQ ID NO: 111888 - DNA, 8 bp, Unknown
  misc_feature (1)..( 8): Result.002 file - promoters60/1396296
ctagtcac

SEQ ID NO: 111889 - DNA, 7 bp, Unknown
  misc_feature (1)..( 7): Result.002 file - promoters60/1396296
taatggg

SEQ ID NO: 111890 - DNA, 7 bp, Unknown
  misc_feature (1)..( 7): Result.002 file - promoters60/1396296
taaaggg

SEQ ID NO: 111891 - DNA, 6 bp, Unknown
  misc_feature (1)..( 6): Result.002 file - promoters60/1396296
tctctc

SEQ ID NO: 111892 - DNA, 6 bp, Unknown
  misc_feature (1)..( 6): Result.002 file - promoters60/1396296
tctctc

SEQ ID NO: 111893 - DNA, 6 bp, Unknown
  misc_feature (1)..( 6): Result.002 file - promoters60/1396296
tcatat

SEQ ID NO: 111894 - DNA, 6 bp, Unknown
  misc_feature (1)..( 6): Result.002 file - promoters60/1396296
tcatat

SEQ ID NO: 111895 - DNA, 6 bp, Unknown
  misc_feature (1)..( 6): Result.002 file - promoters60/1396296
acaatt

SEQ ID NO: 111896 - DNA, 6 bp, Unknown
  misc_feature (1)..( 6): Result.002 file - promoters60/1396296
acaatt

SEQ ID NO: 111897 - DNA, 6 bp, Unknown
  misc_feature (1)..( 6): Result.002 file - promoters60/1396296
atgatt

SEQ ID NO: 111898 - DNA, 6 bp, Unknown
  misc_feature (1)..( 6): Result.002 file - promoters60/1396296
atgatt

SEQ ID NO: 111899 - DNA, 8 bp, Unknown
  misc_feature (1)..( 8): Result.002 file - promoters60/1396296
atacaagt

SEQ ID NO: 111900 - DNA, 8 bp, Unknown
  misc_feature (1)..( 8): Result.002 file - promoters60/1396296
ataaaagt

SEQ ID NO: 111901 - DNA, 8 bp, Unknown
  misc_feature (1)..( 8): Result.002 file - promoters60/1396296
ttttcttt

SEQ ID NO: 111902 - DNA, 8 bp, Unknown
  misc_feature (1)..( 8): Result.002 file - promoters60/1396296
ttttcttt

SEQ ID NO: 111903 - DNA, 6 bp, Unknown
  misc_feature (1)..( 6): Result.002 file - promoters60/1396296
aaataa

SEQ ID NO: 111904 - DNA, 6 bp, Unknown
  misc_feature (1)..( 6): Result.002 file - promoters60/1396296
aaataa

SEQ ID NO: 111905 - DNA, 6 bp, Unknown
  misc_feature (1)..( 6): Result.002 file - promoters60/1396296
aattta

SEQ ID NO: 111906 - DNA, 6 bp, Unknown
  misc_feature (1)..( 6): Result.002 file - promoters60/1396296
aattta

SEQ ID NO: 111907 - DNA, 6 bp, Unknown
  misc_feature (1)..( 6): Result.002 file - promoters60/1396296
ttttct

SEQ ID NO: 111908 - DNA, 6 bp, Unknown
  misc_feature (1)..( 6): Result.002 file - promoters60/1396296
ttttct

SEQ ID NO: 111909 - DNA, 10 bp, Unknown
  misc_feature (1)..( 10): Result.002 file - promoters60/1396308
taaaaatgaa

SEQ ID NO: 111910 - DNA, 10 bp, Unknown
  misc_feature (1)..( 10): Result.002 file - promoters60/1396308
taaaaagtct

SEQ ID NO: 111911 - DNA, 10 bp, Unknown
  misc_feature (1)..( 10): Result.002 file - promoters60/1396308
aaaaaaagaa

SEQ ID NO: 111912 - DNA, 10 bp, Unknown
  misc_feature (1)..( 10): Result.002 file - promoters60/1396308
caaaaatctt

SEQ ID NO: 111913 - DNA, 10 bp, Unknown
  misc_feature (1)..( 10): Result.002 file - promoters60/1396308
gaaaaagggt

SEQ ID NO: 111914 - DNA, 14 bp, Unknown
  misc_feature (1)..( 14): Result.002 file - promoters60/1396308
actcataataaata

SEQ ID NO: 111915 - DNA, 14 bp, Unknown
  misc_feature (1)..( 14): Result.002 file - promoters60/1396308
tcatataatagtaa

SEQ ID NO: 111916 - DNA, 14 bp, Unknown
  misc_feature (1)..( 14): Result.002 file - promoters60/1396308
atttataatataat

SEQ ID NO: 111917 - DNA, 14 bp, Unknown
  misc_feature (1)..( 14): Result.002 file - promoters60/1396308
acttataatgaatt

SEQ ID NO: 111918 - DNA, 14 bp, Unknown
  misc_feature (1)..( 14): Result.002 file - promoters60/1396308
taaaataaggaatt

SEQ ID NO: 111919 - DNA, 14 bp, Unknown
  misc_feature (1)..( 14): Result.002 file - promoters60/1396308
atatataataaata

SEQ ID NO: 111920 - DNA, 14 bp, Unknown
  misc_feature (1)..( 14): Result.002 file - promoters60/1396308
aagcataaaaaata

SEQ ID NO: 111921 - DNA, 14 bp, Unknown
  misc_feature (1)..( 14): Result.002 file - promoters60/1396308
aattattatacttc

SEQ ID NO: 111922 - DNA, 14 bp, Unknown
  misc_feature (1)..( 14): Result.002 file - promoters60/1396308
tcatataattatct

SEQ ID NO: 111923 - DNA, 14 bp, Unknown
  misc_feature (1)..( 14): Result.002 file - promoters60/1396308
cagtttaataacaa

SEQ ID NO: 111924 - DNA, 14 bp, Unknown
  misc_feature (1)..( 14): Result.002 file - promoters60/1396308
gcctaaaatataat

SEQ ID NO: 111925 - DNA, 14 bp, Unknown
  misc_feature (1)..( 14): Result.002 file - promoters60/1396308
tcatataacaattt

SEQ ID NO: 111926 - DNA, 11 bp, Unknown
  misc_feature (1)..( 11): Result.002 file - promoters60/1396308
tgtatatatat

SEQ ID NO: 111927 - DNA, 11 bp, Unknown
  misc_feature (1)..( 11): Result.002 file - promoters60/1396308
aaaataaatag

SEQ ID NO: 111928 - DNA, 11 bp, Unknown
  misc_feature (1)..( 11): Result.002 file - promoters60/1396308
aaaatatataa

SEQ ID NO: 111929 - DNA, 11 bp, Unknown
  misc_feature (1)..( 11): Result.002 file - promoters60/1396308
agaataaaaat

SEQ ID NO: 111930 - DNA, 11 bp, Unknown
  misc_feature (1)..( 11): Result.002 file - promoters60/1396308
aaaatataata

SEQ ID NO: 111931 - DNA, 12 bp, Unknown
  misc_feature (1)..( 12): Result.002 file - promoters60/1396308
tagaaattaata

SEQ ID NO: 111932 - DNA, 12 bp, Unknown
  misc_feature (1)..( 12): Result.002 file - promoters60/1396308
agataattaagt

SEQ ID NO: 111933 - DNA, 11 bp, Unknown
  misc_feature (1)..( 11): Result.002 file - promoters60/1396308
taaaatcaata

SEQ ID NO: 111934 - DNA, 11 bp, Unknown
  misc_feature (1)..( 11): Result.002 file - promoters60/1396308
tttaattatta

SEQ ID NO: 111935 - DNA, 12 bp, Unknown
  misc_feature (1)..( 12): Result.002 file - promoters60/1396308
ataacatcactt

SEQ ID NO: 111936 - DNA, 12 bp, Unknown
  misc_feature (1)..( 12): Result.002 file - promoters60/1396308
ggtacatcactg

SEQ ID NO: 111937 - DNA, 13 bp, Unknown
  misc_feature (1)..( 13): Result.002 file - promoters60/1396308
tttgttatataag

SEQ ID NO: 111938 - DNA, 13 bp, Unknown
  misc_feature (1)..( 13): Result.002 file - promoters60/1396308
tcctttatatatt

SEQ ID NO: 111939 - DNA, 13 bp, Unknown
  misc_feature (1)..( 13): Result.002 file - promoters60/1396308
cttattatataga

SEQ ID NO: 111940 - DNA, 13 bp, Unknown
  misc_feature (1)..( 13): Result.002 file - promoters60/1396308
cgtcccataaaga

SEQ ID NO: 111941 - DNA, 13 bp, Unknown
  misc_feature (1)..( 13): Result.002 file - promoters60/1396308
cgtcctataaata

SEQ ID NO: 111942 - DNA, 10 bp, Unknown
  misc_feature (1)..( 10): Result.002 file - promoters60/1396308
ttttatcaca

SEQ ID NO: 111943 - DNA, 10 bp, Unknown
  misc_feature (1)..( 10): Result.002 file - promoters60/1396308
ttttgtcaac

SEQ ID NO: 111944 - DNA, 10 bp, Unknown
  misc_feature (1)..( 10): Result.002 file - promoters60/1396308
ctttatccta

SEQ ID NO: 111945 - DNA, 10 bp, Unknown
  misc_feature (1)..( 10): Result.002 file - promoters60/1396308
gtataacaat

SEQ ID NO: 111946 - DNA, 10 bp, Unknown
  misc_feature (1)..( 10): Result.002 file - promoters60/1396308
gtgtaaacga

SEQ ID NO: 111947 - DNA, 10 bp, Unknown
  misc_feature (1)..( 10): Result.002 file - promoters60/1396308
ttttgtatct

SEQ ID NO: 111948 - DNA, 10 bp, Unknown
  misc_feature (1)..( 10): Result.002 file - promoters60/1396308
tcaatcaaaa

SEQ ID NO: 111949 - DNA, 10 bp, Unknown
  misc_feature (1)..( 10): Result.002 file - promoters60/1396308
caaatcaaat

SEQ ID NO: 111950 - DNA, 11 bp, Unknown
  misc_feature (1)..( 11): Result.002 file - promoters60/1396308
ttgatccaaac

SEQ ID NO: 111951 - DNA, 11 bp, Unknown
  misc_feature (1)..( 11): Result.002 file - promoters60/1396308
tcaattaaaag

SEQ ID NO: 111952 - DNA, 11 bp, Unknown
  misc_feature (1)..( 11): Result.002 file - promoters60/1396308
acctttcaaat

SEQ ID NO: 111953 - DNA, 11 bp, Unknown
  misc_feature (1)..( 11): Result.002 file - promoters60/1396308
attatcctaac

SEQ ID NO: 111954 - DNA, 8 bp, Unknown
  misc_feature (1)..( 8): Result.002 file - promoters60/1396308
ttttgttt

SEQ ID NO: 111955 - DNA, 8 bp, Unknown
  misc_feature (1)..( 8): Result.002 file - promoters60/1396308
ttttgtat

SEQ ID NO: 111956 - DNA, 8 bp, Unknown
  misc_feature (1)..( 8): Result.002 file - promoters60/1396308
atttgttt

SEQ ID NO: 111957 - DNA, 8 bp, Unknown
  misc_feature (1)..( 8): Result.002 file - promoters60/1396308
ctttgttg

SEQ ID NO: 111958 - DNA, 8 bp, Unknown
  misc_feature (1)..( 8): Result.002 file - promoters60/1396308
atttattt

SEQ ID NO: 111959 - DNA, 9 bp, Unknown
  misc_feature (1)..( 9): Result.002 file - promoters60/1396312
aaaaataaa

SEQ ID NO: 111960 - DNA, 9 bp, Unknown
  misc_feature (1)..( 9): Result.002 file - promoters60/1396312
attaataaa

SEQ ID NO: 111961 - DNA, 9 bp, Unknown
  misc_feature (1)..( 9): Result.002 file - promoters60/1396312
ttaaataaa

SEQ ID NO: 111962 - DNA, 9 bp, Unknown
  misc_feature (1)..( 9): Result.002 file - promoters60/1396312
gaaaattaa

SEQ ID NO: 111963 - DNA, 9 bp, Unknown
  misc_feature (1)..( 9): Result.002 file - promoters60/1396312
gaaaattcc

SEQ ID NO: 111964 - DNA, 11 bp, Unknown
  misc_feature (1)..( 11): Result.002 file - promoters60/1396312
atattaacctt

SEQ ID NO: 111965 - DNA, 11 bp, Unknown
  misc_feature (1)..( 11): Result.002 file - promoters60/1396312
tttttaacctt

SEQ ID NO: 111966 - DNA, 11 bp, Unknown
  misc_feature (1)..( 11): Result.002 file - promoters60/1396312
ttattaacatt

SEQ ID NO: 111967 - DNA, 11 bp, Unknown
  misc_feature (1)..( 11): Result.002 file - promoters60/1396312
tttttaacaaa

SEQ ID NO: 111968 - DNA, 10 bp, Unknown
  misc_feature (1)..( 10): Result.002 file - promoters60/1396312
ccttgagttt

SEQ ID NO: 111969 - DNA, 10 bp, Unknown
  misc_feature (1)..( 10): Result.002 file - promoters60/1396312
gattgtgtta

SEQ ID NO: 111970 - DNA, 10 bp, Unknown
  misc_feature (1)..( 10): Result.002 file - promoters60/1396312
gattgatttt

SEQ ID NO: 111971 - DNA, 10 bp, Unknown
  misc_feature (1)..( 10): Result.002 file - promoters60/1396312
gatggattat

SEQ ID NO: 111972 - DNA, 10 bp, Unknown
  misc_feature (1)..( 10): Result.002 file - promoters60/1396312
agaggattac

SEQ ID NO: 111973 - DNA, 10 bp, Unknown
  misc_feature (1)..( 10): Result.002 file - promoters60/1396312
taacgaaaaa

SEQ ID NO: 111974 - DNA, 10 bp, Unknown
  misc_feature (1)..( 10): Result.002 file - promoters60/1396312
aaacaaaaaa

SEQ ID NO: 111975 - DNA, 10 bp, Unknown
  misc_feature (1)..( 10): Result.002 file - promoters60/1396312
aaacatataa

SEQ ID NO: 111976 - DNA, 10 bp, Unknown
  misc_feature (1)..( 10): Result.002 file - promoters60/1396312
tcccaaaaac

SEQ ID NO: 111977 - DNA, 10 bp, Unknown
  misc_feature (1)..( 10): Result.002 file - promoters60/1396312
cgtcaaaaaa

SEQ ID NO: 111978 - DNA, 10 bp, Unknown
  misc_feature (1)..( 10): Result.002 file - promoters60/1396312
aaagcaacta

SEQ ID NO: 111979 - DNA, 10 bp, Unknown
  misc_feature (1)..( 10): Result.002 file - promoters60/1396312
aaagcaaaca

SEQ ID NO: 111980 - DNA, 10 bp, Unknown
  misc_feature (1)..( 10): Result.002 file - promoters60/1396312
aaagaaaatt

SEQ ID NO: 111981 - DNA, 10 bp, Unknown
  misc_feature (1)..( 10): Result.002 file - promoters60/1396312
gatgaaaatt

SEQ ID NO: 111982 - DNA, 9 bp, Unknown
  misc_feature (1)..( 9): Result.002 file - promoters60/1396312
caaaatgaa

SEQ ID NO: 111983 - DNA, 9 bp, Unknown
  misc_feature (1)..( 9): Result.002 file - promoters60/1396312
aaaagtgaa

SEQ ID NO: 111984 - DNA, 9 bp, Unknown
  misc_feature (1)..( 9): Result.002 file - promoters60/1396312
aaaaatgca

SEQ ID NO: 111985 - DNA, 9 bp, Unknown
  misc_feature (1)..( 9): Result.002 file - promoters60/1396312
aaaaatatg

SEQ ID NO: 111986 - DNA, 11 bp, Unknown
  misc_feature (1)..( 11): Result.002 file - promoters60/1396312
taaagaacaaa

SEQ ID NO: 111987 - DNA, 11 bp, Unknown
  misc_feature (1)..( 11): Result.002 file - promoters60/1396312
tatagaaaaaa

SEQ ID NO: 111988 - DNA, 11 bp, Unknown
  misc_feature (1)..( 11): Result.002 file - promoters60/1396312
tattgaaatat

SEQ ID NO: 111989 - DNA, 11 bp, Unknown
  misc_feature (1)..( 11): Result.002 file - promoters60/1396312
aggagaaaaga

SEQ ID NO: 111990 - DNA, 8 bp, Unknown
  misc_feature (1)..( 8): Result.002 file - promoters60/1396312
ggaaaaag

SEQ ID NO: 111991 - DNA, 8 bp, Unknown
  misc_feature (1)..( 8): Result.002 file - promoters60/1396312
tgaaaaag

SEQ ID NO: 111992 - DNA, 8 bp, Unknown
  misc_feature (1)..( 8): Result.002 file - promoters60/1396312
ctaaaaag

SEQ ID NO: 111993 - DNA, 8 bp, Unknown
  misc_feature (1)..( 8): Result.002 file - promoters60/1396312
ggaaaata

SEQ ID NO: 111994 - DNA, 10 bp, Unknown
  misc_feature (1)..( 10): Result.002 file - promoters60/1396354
gctttgttat

SEQ ID NO: 111995 - DNA, 10 bp, Unknown
  misc_feature (1)..( 10): Result.002 file - promoters60/1396354
gctgtgtctt

SEQ ID NO: 111996 - DNA, 10 bp, Unknown
  misc_feature (1)..( 10): Result.002 file - promoters60/1396354
gctctgtaac

SEQ ID NO: 111997 - DNA, 10 bp, Unknown
  misc_feature (1)..( 10): Result.002 file - promoters60/1396354
tgtgtgtctt

SEQ ID NO: 111998 - DNA, 10 bp, Unknown
  misc_feature (1)..( 10): Result.002 file - promoters60/1396354
attgtgtcct

SEQ ID NO: 111999 - DNA, 9 bp, Unknown
  misc_feature (1)..( 9): Result.002 file - promoters60/1396354
aatatatac

SEQ ID NO: 112000 - DNA, 9 bp, Unknown
  misc_feature (1)..( 9): Result.002 file - promoters60/1396354
tctatataa

SEQ ID NO: 112001 - DNA, 9 bp, Unknown
  misc_feature (1)..( 9): Result.002 file - promoters60/1396354
aatatatat

SEQ ID NO: 112002 - DNA, 9 bp, Unknown
  misc_feature (1)..( 9): Result.002 file - promoters60/1396354
actatttaa

SEQ ID NO: 112003 - DNA, 9 bp, Unknown
  misc_feature (1)..( 9): Result.002 file - promoters60/1396354
cctagttac

SEQ ID NO: 112004 - DNA, 13 bp, Unknown
  misc_feature (1)..( 13): Result.002 file - promoters60/1396364
tagttgattcgtt

SEQ ID NO: 112005 - DNA, 13 bp, Unknown
  misc_feature (1)..( 13): Result.002 file - promoters60/1396364
atttttatttgtt

SEQ ID NO: 112006 - DNA, 13 bp, Unknown
  misc_feature (1)..( 13): Result.002 file - promoters60/1396364
tagtttattcgag

SEQ ID NO: 112007 - DNA, 14 bp, Unknown
  misc_feature (1)..( 14): Result.002 file - promoters60/1396364
tgaaatgtttagtt

SEQ ID NO: 112008 - DNA, 8 bp, Unknown
  misc_feature (1)..( 8): Result.002 file - promoters60/1396364
tattaatg

SEQ ID NO: 112009 - DNA, 8 bp, Unknown
  misc_feature (1)..( 8): Result.002 file - promoters60/1396364
tattaata

SEQ ID NO: 112010 - DNA, 8 bp, Unknown
  misc_feature (1)..( 8): Result.002 file - promoters60/1396364
agttaatg

SEQ ID NO: 112011 - DNA, 8 bp, Unknown
  misc_feature (1)..( 8): Result.002 file - promoters60/1396364
ggttaatt

SEQ ID NO: 112012 - DNA, 7 bp, Unknown
  misc_feature (1)..( 7): Result.002 file - promoters60/1396364
aatatta

SEQ ID NO: 112013 - DNA, 7 bp, Unknown
  misc_feature (1)..( 7): Result.002 file - promoters60/1396364
aatattt

SEQ ID NO: 112014 - DNA, 7 bp, Unknown
  misc_feature (1)..( 7): Result.002 file - promoters60/1396364
aatgttt

SEQ ID NO: 112015 - DNA, 7 bp, Unknown
  misc_feature (1)..( 7): Result.002 file - promoters60/1396364
aatgttt

SEQ ID NO: 112016 - DNA, 8 bp, Unknown
  misc_feature (1)..( 8): Result.002 file - promoters60/1396364
tttagtgg

SEQ ID NO: 112017 - DNA, 8 bp, Unknown
  misc_feature (1)..( 8): Result.002 file - promoters60/1396364
tttagtta

SEQ ID NO: 112018 - DNA, 8 bp, Unknown
  misc_feature (1)..( 8): Result.002 file - promoters60/1396364
tttagttt

SEQ ID NO: 112019 - DNA, 8 bp, Unknown
  misc_feature (1)..( 8): Result.002 file - promoters60/1396364
cttatttt

SEQ ID NO: 112020 - DNA, 10 bp, Unknown
  misc_feature (1)..( 10): Result.002 file - promoters60/1396364
tgaagccaaa

SEQ ID NO: 112021 - DNA, 10 bp, Unknown
  misc_feature (1)..( 10): Result.002 file - promoters60/1396364
tgaaaccaac

SEQ ID NO: 112022 - DNA, 10 bp, Unknown
  misc_feature (1)..( 10): Result.002 file - promoters60/1396364
aagaacaaac

SEQ ID NO: 112023 - DNA, 7 bp, Unknown
  misc_feature (1)..( 7): Result.002 file - promoters60/1396364
tttcgat

SEQ ID NO: 112024 - DNA, 7 bp, Unknown
  misc_feature (1)..( 7): Result.002 file - promoters60/1396364
ttttgat

SEQ ID NO: 112025 - DNA, 7 bp, Unknown
  misc_feature (1)..( 7): Result.002 file - promoters60/1396364
ttttgat

SEQ ID NO: 112026 - DNA, 9 bp, Unknown
  misc_feature (1)..( 9): Result.002 file - promoters60/1396364
aatttattt

SEQ ID NO: 112027 - DNA, 9 bp, Unknown
  misc_feature (1)..( 9): Result.002 file - promoters60/1396364
agtttattc

SEQ ID NO: 112028 - DNA, 9 bp, Unknown
  misc_feature (1)..( 9): Result.002 file - promoters60/1396364
aatatattt

SEQ ID NO: 112029 - DNA, 11 bp, Unknown
  misc_feature (1)..( 11): Result.002 file - promoters60/1396364
tacgtaacatg

SEQ ID NO: 112030 - DNA, 11 bp, Unknown
  misc_feature (1)..( 11): Result.002 file - promoters60/1396364
gtattaatatg

SEQ ID NO: 112031 - DNA, 11 bp, Unknown
  misc_feature (1)..( 11): Result.002 file - promoters60/1396364
tacgttacaat

SEQ ID NO: 112032 - DNA, 11 bp, Unknown
  misc_feature (1)..( 11): Result.002 file - promoters60/1396462
gaagaataaca

SEQ ID NO: 112033 - DNA, 11 bp, Unknown
  misc_feature (1)..( 11): Result.002 file - promoters60/1396462
gaacaattaca

SEQ ID NO: 112034 - DNA, 10 bp, Unknown
  misc_feature (1)..( 10): Result.002 file - promoters60/1396462
taaaaagtaa

SEQ ID NO: 112035 - DNA, 10 bp, Unknown
  misc_feature (1)..( 10): Result.002 file - promoters60/1396462
taataagtaa

SEQ ID NO: 112036 - DNA, 10 bp, Unknown
  misc_feature (1)..( 10): Result.002 file - promoters60/1396462
taaaaatatc

SEQ ID NO: 112037 - DNA, 7 bp, Unknown
  misc_feature (1)..( 7): Result.002 file - promoters60/1396462
ataaaac

SEQ ID NO: 112038 - DNA, 7 bp, Unknown
  misc_feature (1)..( 7): Result.002 file - promoters60/1396462
ataaaac

SEQ ID NO: 112039 - DNA, 7 bp, Unknown
  misc_feature (1)..( 7): Result.002 file - promoters60/1396462
ttgtaac

SEQ ID NO: 112040 - DNA, 7 bp, Unknown
  misc_feature (1)..( 7): Result.002 file - promoters60/1396462
ttgtaac

SEQ ID NO: 112041 - DNA, 7 bp, Unknown
  misc_feature (1)..( 7): Result.002 file - promoters60/1396462
aaaacaa

SEQ ID NO: 112042 - DNA, 7 bp, Unknown
  misc_feature (1)..( 7): Result.002 file - promoters60/1396462
aaagcaa

SEQ ID NO: 112043 - DNA, 10 bp, Unknown
  misc_feature (1)..( 10): Result.002 file - promoters60/1396462
aaacaaattt

SEQ ID NO: 112044 - DNA, 10 bp, Unknown
  misc_feature (1)..( 10): Result.002 file - promoters60/1396462
aaagaaagct

SEQ ID NO: 112045 - DNA, 10 bp, Unknown
  misc_feature (1)..( 10): Result.002 file - promoters60/1396462
ctacaatttt

SEQ ID NO: 112046 - DNA, 9 bp, Unknown
  misc_feature (1)..( 9): Result.002 file - promoters60/1396462
ttttgaaaa

SEQ ID NO: 112047 - DNA, 9 bp, Unknown
  misc_feature (1)..( 9): Result.002 file - promoters60/1396462
tttggaaaa

SEQ ID NO: 112048 - DNA, 9 bp, Unknown
  misc_feature (1)..( 9): Result.002 file - promoters60/1396462
ccttgaaac

SEQ ID NO: 112049 - DNA, 9 bp, Unknown
  misc_feature (1)..( 9): Result.002 file - promoters60/1396462
tgaaaaaaa

SEQ ID NO: 112050 - DNA, 9 bp, Unknown
  misc_feature (1)..( 9): Result.002 file - promoters60/1396462
gaaaagaaa

SEQ ID NO: 112051 - DNA, 10 bp, Unknown
  misc_feature (1)..( 10): Result.002 file - promoters60/1396462
ggaaatgaaa

SEQ ID NO: 112052 - DNA, 11 bp, Unknown
  misc_feature (1)..( 11): Result.002 file - promoters60/1396462
aaaaaaaaagt

SEQ ID NO: 112053 - DNA, 11 bp, Unknown
  misc_feature (1)..( 11): Result.002 file - promoters60/1396462
aaaataaaata

SEQ ID NO: 112054 - DNA, 11 bp, Unknown
  misc_feature (1)..( 11): Result.002 file - promoters60/1396462
gaaatgaaata

SEQ ID NO: 112055 - DNA, 13 bp, Unknown
  misc_feature (1)..( 13): Result.002 file - promoters60/1396462
aatcttttttttg

SEQ ID NO: 112056 - DNA, 13 bp, Unknown
  misc_feature (1)..( 13): Result.002 file - promoters60/1396462
aatattttctttg

SEQ ID NO: 112057 - DNA, 8 bp, Unknown
  misc_feature (1)..( 8): Result.002 file - promoters60/1396462
caatataa

SEQ ID NO: 112058 - DNA, 8 bp, Unknown
  misc_feature (1)..( 8): Result.002 file - promoters60/1396462
caaaataa

SEQ ID NO: 112059 - DNA, 6 bp, Unknown
  misc_feature (1)..( 6): Result.002 file - promoters60/1396462
gaaaaa

SEQ ID NO: 112060 - DNA, 6 bp, Unknown
  misc_feature (1)..( 6): Result.002 file - promoters60/1396462
gaaaaa

SEQ ID NO: 112061 - DNA, 9 bp, Unknown
  misc_feature (1)..( 9): Result.002 file - promoters60/1396462
aaaaggaaa

SEQ ID NO: 112062 - DNA, 9 bp, Unknown
  misc_feature (1)..( 9): Result.002 file - promoters60/1396462
aaaaggaga

SEQ ID NO: 112063 - DNA, 9 bp, Unknown
  misc_feature (1)..( 9): Result.002 file - promoters60/1396462
taaagtaaa

SEQ ID NO: 112064 - DNA, 7 bp, Unknown
  misc_feature (1)..( 7): Result.002 file - promoters60/1396462
ttgtgaa

SEQ ID NO: 112065 - DNA, 7 bp, Unknown
  misc_feature (1)..( 7): Result.002 file - promoters60/1396462
ttgagaa

SEQ ID NO: 112066 - DNA, 8 bp, Unknown
  misc_feature (1)..( 8): Result.002 file - promoters60/1396462
tatgtgag

SEQ ID NO: 112067 - DNA, 8 bp, Unknown
  misc_feature (1)..( 8): Result.002 file - promoters60/1396462
tatctgag

SEQ ID NO: 112068 - DNA, 7 bp, Unknown
  misc_feature (1)..( 7): Result.002 file - promoters60/1396462
tttattt

SEQ ID NO: 112069 - DNA, 7 bp, Unknown
  misc_feature (1)..( 7): Result.002 file - promoters60/1396462
tttgttt

SEQ ID NO: 112070 - DNA, 10 bp, Unknown
  misc_feature (1)..( 10): Result.002 file - promoters60/1396462
tttacttaat

SEQ ID NO: 112071 - DNA, 10 bp, Unknown
  misc_feature (1)..( 10): Result.002 file - promoters60/1396462
tttaattaat

SEQ ID NO: 112072 - DNA, 8 bp, Unknown
  misc_feature (1)..( 8): Result.002 file - promoters60/1396462
aatattgt

SEQ ID NO: 112073 - DNA, 8 bp, Unknown
  misc_feature (1)..( 8): Result.002 file - promoters60/1396462
aattttgt

SEQ ID NO: 112074 - DNA, 7 bp, Unknown
  misc_feature (1)..( 7): Result.002 file - promoters60/1396462
aaaaaaa

SEQ ID NO: 112075 - DNA, 7 bp, Unknown
  misc_feature (1)..( 7): Result.002 file - promoters60/1396462
aaaaaaa

SEQ ID NO: 112076 - DNA, 6 bp, Unknown
  misc_feature (1)..( 6): Result.002 file - promoters60/1396462
taataa

SEQ ID NO: 112077 - DNA, 6 bp, Unknown
  misc_feature (1)..( 6): Result.002 file - promoters60/1396462
taataa

SEQ ID NO: 112078 - DNA, 7 bp, Unknown
  misc_feature (1)..( 7): Result.002 file - promoters60/1396462
aatcggg

SEQ ID NO: 112079 - DNA, 7 bp, Unknown
  misc_feature (1)..( 7): Result.002 file - promoters60/1396462
aattggg

SEQ ID NO: 112080 - DNA, 7 bp, Unknown
  misc_feature (1)..( 7): Result.002 file - promoters60/1396462
cccacta

SEQ ID NO: 112081 - DNA, 7 bp, Unknown
  misc_feature (1)..( 7): Result.002 file - promoters60/1396462
cccacta

SEQ ID NO: 112082 - DNA, 7 bp, Unknown
  misc_feature (1)..( 7): Result.002 file - promoters60/1396462
gtatata

SEQ ID NO: 112083 - DNA, 7 bp, Unknown
  misc_feature (1)..( 7): Result.002 file - promoters60/1396462
gtatata

SEQ ID NO: 112084 - DNA, 11 bp, Unknown
  misc_feature (1)..( 11): Result.002 file - promoters60/1396469
ttttcttataa

SEQ ID NO: 112085 - DNA, 11 bp, Unknown
  misc_feature (1)..( 11): Result.002 file - promoters60/1396469
cattcttattt

SEQ ID NO: 112086 - DNA, 11 bp, Unknown
  misc_feature (1)..( 11): Result.002 file - promoters60/1396469
catgctttcaa

SEQ ID NO: 112087 - DNA, 11 bp, Unknown
  misc_feature (1)..( 11): Result.002 file - promoters60/1396469
acaacttattt

SEQ ID NO: 112088 - DNA, 11 bp, Unknown
  misc_feature (1)..( 11): Result.002 file - promoters60/1396469
cgtttttattt

SEQ ID NO: 112089 - DNA, 11 bp, Unknown
  misc_feature (1)..( 11): Result.002 file - promoters60/1396469
taacttacaaa

SEQ ID NO: 112090 - DNA, 11 bp, Unknown
  misc_feature (1)..( 11): Result.002 file - promoters60/1396469
atacttactta

SEQ ID NO: 112091 - DNA, 11 bp, Unknown
  misc_feature (1)..( 11): Result.002 file - promoters60/1396469
ggccttccaaa

SEQ ID NO: 112092 - DNA, 11 bp, Unknown
  misc_feature (1)..( 11): Result.002 file - promoters60/1396469
atacgtacgta

SEQ ID NO: 112093 - DNA, 13 bp, Unknown
  misc_feature (1)..( 13): Result.002 file - promoters60/1396469
tacaatataaaca

SEQ ID NO: 112094 - DNA, 13 bp, Unknown
  misc_feature (1)..( 13): Result.002 file - promoters60/1396469
tcacatattaaca

SEQ ID NO: 112095 - DNA, 13 bp, Unknown
  misc_feature (1)..( 13): Result.002 file - promoters60/1396469
tcatatatataca

SEQ ID NO: 112096 - DNA, 13 bp, Unknown
  misc_feature (1)..( 13): Result.002 file - promoters60/1396469
gtatatataaaga

SEQ ID NO: 112097 - DNA, 13 bp, Unknown
  misc_feature (1)..( 13): Result.002 file - promoters60/1396469
actcatatatatc

SEQ ID NO: 112098 - DNA, 12 bp, Unknown
  misc_feature (1)..( 12): Result.002 file - promoters60/1396469
acttttctttct

SEQ ID NO: 112099 - DNA, 12 bp, Unknown
  misc_feature (1)..( 12): Result.002 file - promoters60/1396469
aattttttttct

SEQ ID NO: 112100 - DNA, 12 bp, Unknown
  misc_feature (1)..( 12): Result.002 file - promoters60/1396469
actttttttaca

SEQ ID NO: 112101 - DNA, 12 bp, Unknown
  misc_feature (1)..( 12): Result.002 file - promoters60/1396469
aatttttagtca

SEQ ID NO: 112102 - DNA, 14 bp, Unknown
  misc_feature (1)..( 14): Result.002 file - promoters60/1396469
tcagatatacattg

SEQ ID NO: 112103 - DNA, 14 bp, Unknown
  misc_feature (1)..( 14): Result.002 file - promoters60/1396469
ttttctataaatta

SEQ ID NO: 112104 - DNA, 14 bp, Unknown
  misc_feature (1)..( 14): Result.002 file - promoters60/1396469
ttttttatagatta

SEQ ID NO: 112105 - DNA, 14 bp, Unknown
  misc_feature (1)..( 14): Result.002 file - promoters60/1396469
agagctaaaaacgg

SEQ ID NO: 112106 - DNA, 7 bp, Unknown
  misc_feature (1)..( 7): Result.002 file - promoters60/1396469
tacgaaa

SEQ ID NO: 112107 - DNA, 7 bp, Unknown
  misc_feature (1)..( 7): Result.002 file - promoters60/1396469
tactaaa

SEQ ID NO: 112108 - DNA, 7 bp, Unknown
  misc_feature (1)..( 7): Result.002 file - promoters60/1396469
aactaaa

SEQ ID NO: 112109 - DNA, 7 bp, Unknown
  misc_feature (1)..( 7): Result.002 file - promoters60/1396469
aactaaa

SEQ ID NO: 112110 - DNA, 14 bp, Unknown
  misc_feature (1)..( 14): Result.002 file - promoters60/1396469
ttttttatagatta

SEQ ID NO: 112111 - DNA, 14 bp, Unknown
  misc_feature (1)..( 14): Result.002 file - promoters60/1396469
ctttatatagagac

SEQ ID NO: 112112 - DNA, 14 bp, Unknown
  misc_feature (1)..( 14): Result.002 file - promoters60/1396469
ttttctataaatta

SEQ ID NO: 112113 - DNA, 14 bp, Unknown
  misc_feature (1)..( 14): Result.002 file - promoters60/1396469
agagctaaaaacgg

SEQ ID NO: 112114 - DNA, 9 bp, Unknown
  misc_feature (1)..( 9): Result.002 file - promoters60/1396469
aactaaacc

SEQ ID NO: 112115 - DNA, 9 bp, Unknown
  misc_feature (1)..( 9): Result.002 file - promoters60/1396469
aactaaacc

SEQ ID NO: 112116 - DNA, 9 bp, Unknown
  misc_feature (1)..( 9): Result.002 file - promoters60/1396469
aactaatca

SEQ ID NO: 112117 - DNA, 9 bp, Unknown
  misc_feature (1)..( 9): Result.002 file - promoters60/1396469
tactaaaga

SEQ ID NO: 112118 - DNA, 13 bp, Unknown
  misc_feature (1)..( 13): Result.002 file - promoters60/1396482
aaaacaaaacata

SEQ ID NO: 112119 - DNA, 13 bp, Unknown
  misc_feature (1)..( 13): Result.002 file - promoters60/1396482
agtttaaaaaata

SEQ ID NO: 112120 - DNA, 13 bp, Unknown
  misc_feature (1)..( 13): Result.002 file - promoters60/1396482
tttagaaacaatg

SEQ ID NO: 112121 - DNA, 13 bp, Unknown
  misc_feature (1)..( 13): Result.002 file - promoters60/1396482
ttaataaattttg

SEQ ID NO: 112122 - DNA, 13 bp, Unknown
  misc_feature (1)..( 13): Result.002 file - promoters60/1396482
tcaattaatcttt

SEQ ID NO: 112123 - DNA, 7 bp, Unknown
  misc_feature (1)..( 7): Result.002 file - promoters60/1396519
gttacaa

SEQ ID NO: 112124 - DNA, 7 bp, Unknown
  misc_feature (1)..( 7): Result.002 file - promoters60/1396519
gttacaa

SEQ ID NO: 112125 - DNA, 7 bp, Unknown
  misc_feature (1)..( 7): Result.002 file - promoters60/1396519
aaaattt

SEQ ID NO: 112126 - DNA, 7 bp, Unknown
  misc_feature (1)..( 7): Result.002 file - promoters60/1396519
aaacttt

SEQ ID NO: 112127 - DNA, 6 bp, Unknown
  misc_feature (1)..( 6): Result.002 file - promoters60/1396519
accaaa

SEQ ID NO: 112128 - DNA, 6 bp, Unknown
  misc_feature (1)..( 6): Result.002 file - promoters60/1396519
accaaa

SEQ ID NO: 112129 - DNA, 6 bp, Unknown
  misc_feature (1)..( 6): Result.002 file - promoters60/1396519
gaaaaa

SEQ ID NO: 112130 - DNA, 6 bp, Unknown
  misc_feature (1)..( 6): Result.002 file - promoters60/1396519
gaaaaa

SEQ ID NO: 112131 - DNA, 7 bp, Unknown
  misc_feature (1)..( 7): Result.002 file - promoters60/1396519
aaataaa

SEQ ID NO: 112132 - DNA, 7 bp, Unknown
  misc_feature (1)..( 7): Result.002 file - promoters60/1396519
aaacaaa

SEQ ID NO: 112133 - DNA, 6 bp, Unknown
  misc_feature (1)..( 6): Result.002 file - promoters60/1396519
caaaaa

SEQ ID NO: 112134 - DNA, 6 bp, Unknown
  misc_feature (1)..( 6): Result.002 file - promoters60/1396519
caaaaa

SEQ ID NO: 112135 - DNA, 8 bp, Unknown
  misc_feature (1)..( 8): Result.002 file - promoters60/1396519
agaataaa

SEQ ID NO: 112136 - DNA, 8 bp, Unknown
  misc_feature (1)..( 8): Result.002 file - promoters60/1396519
agaataaa

SEQ ID NO: 112137 - DNA, 7 bp, Unknown
  misc_feature (1)..( 7): Result.002 file - promoters60/1396519
atataaa

SEQ ID NO: 112138 - DNA, 7 bp, Unknown
  misc_feature (1)..( 7): Result.002 file - promoters60/1396519
atataat

SEQ ID NO: 112139 - DNA, 7 bp, Unknown
  misc_feature (1)..( 7): Result.002 file - promoters60/1396519
atataaa

SEQ ID NO: 112140 - DNA, 6 bp, Unknown
  misc_feature (1)..( 6): Result.002 file - promoters60/1396519
aaaaag

SEQ ID NO: 112141 - DNA, 6 bp, Unknown
  misc_feature (1)..( 6): Result.002 file - promoters60/1396519
aaaaag

SEQ ID NO: 112142 - DNA, 7 bp, Unknown
  misc_feature (1)..( 7): Result.002 file - promoters60/1396519
aagaaat

SEQ ID NO: 112143 - DNA, 7 bp, Unknown
  misc_feature (1)..( 7): Result.002 file - promoters60/1396519
aagcaat

SEQ ID NO: 112144 - DNA, 10 bp, Unknown
  misc_feature (1)..( 10): Result.002 file - promoters60/1396519
gaacataaaa

SEQ ID NO: 112145 - DNA, 10 bp, Unknown
  misc_feature (1)..( 10): Result.002 file - promoters60/1396519
gaaaataaaa

SEQ ID NO: 112146 - DNA, 7 bp, Unknown
  misc_feature (1)..( 7): Result.002 file - promoters60/1396519
aaaataa

SEQ ID NO: 112147 - DNA, 7 bp, Unknown
  misc_feature (1)..( 7): Result.002 file - promoters60/1396519
aaaataa

SEQ ID NO: 112148 - DNA, 8 bp, Unknown
  misc_feature (1)..( 8): Result.002 file - promoters60/1396519
ttttttta

SEQ ID NO: 112149 - DNA, 8 bp, Unknown
  misc_feature (1)..( 8): Result.002 file - promoters60/1396519
tttgttta

SEQ ID NO: 112150 - DNA, 6 bp, Unknown
  misc_feature (1)..( 6): Result.002 file - promoters60/1396519
aagtta

SEQ ID NO: 112151 - DNA, 6 bp, Unknown
  misc_feature (1)..( 6): Result.002 file - promoters60/1396519
aagtta

SEQ ID NO: 112152 - DNA, 9 bp, Unknown
  misc_feature (1)..( 9): Result.002 file - promoters60/1396519
aagtgtaaa

SEQ ID NO: 112153 - DNA, 9 bp, Unknown
  misc_feature (1)..( 9): Result.002 file - promoters60/1396519
aagagtaaa

SEQ ID NO: 112154 - DNA, 11 bp, Unknown
  misc_feature (1)..( 11): Result.002 file - promoters60/1396519
aaacaagctaa

SEQ ID NO: 112155 - DNA, 11 bp, Unknown
  misc_feature (1)..( 11): Result.002 file - promoters60/1396519
aaacaaggtaa

SEQ ID NO: 112156 - DNA, 8 bp, Unknown
  misc_feature (1)..( 8): Result.002 file - promoters60/1396519
agatatag

SEQ ID NO: 112157 - DNA, 8 bp, Unknown
  misc_feature (1)..( 8): Result.002 file - promoters60/1396519
agagatag

SEQ ID NO: 112158 - DNA, 13 bp, Unknown
  misc_feature (1)..( 13): Result.002 file - promoters60/1396519
acatttttagata

SEQ ID NO: 112159 - DNA, 13 bp, Unknown
  misc_feature (1)..( 13): Result.002 file - promoters60/1396519
acattttcagata

SEQ ID NO: 112160 - DNA, 8 bp, Unknown
  misc_feature (1)..( 8): Result.002 file - promoters60/1396519
tgcaggag

SEQ ID NO: 112161 - DNA, 8 bp, Unknown
  misc_feature (1)..( 8): Result.002 file - promoters60/1396519
tgcaggag

SEQ ID NO: 112162 - DNA, 7 bp, Unknown
  misc_feature (1)..( 7): Result.002 file - promoters60/1396519
attcatg

SEQ ID NO: 112163 - DNA, 7 bp, Unknown
  misc_feature (1)..( 7): Result.002 file - promoters60/1396519
atttatg

SEQ ID NO: 112164 - DNA, 7 bp, Unknown
  misc_feature (1)..( 7): Result.002 file - promoters60/1396519
cacgaga

SEQ ID NO: 112165 - DNA, 7 bp, Unknown
  misc_feature (1)..( 7): Result.002 file - promoters60/1396519
cactaga

SEQ ID NO: 112166 - DNA, 6 bp, Unknown
  misc_feature (1)..( 6): Result.002 file - promoters60/1396519
gctaag

SEQ ID NO: 112167 - DNA, 6 bp, Unknown
  misc_feature (1)..( 6): Result.002 file - promoters60/1396519
gctaag

SEQ ID NO: 112168 - DNA, 7 bp, Unknown
  misc_feature (1)..( 7): Result.002 file - promoters60/1396519
aaataaa

SEQ ID NO: 112169 - DNA, 7 bp, Unknown
  misc_feature (1)..( 7): Result.002 file - promoters60/1396519
aaagaaa

SEQ ID NO: 112170 - DNA, 6 bp, Unknown
  misc_feature (1)..( 6): Result.002 file - promoters60/1396519
taaaaa

SEQ ID NO: 112171 - DNA, 6 bp, Unknown
  misc_feature (1)..( 6): Result.002 file - promoters60/1396519
taaaaa

SEQ ID NO: 112172 - DNA, 7 bp, Unknown
  misc_feature (1)..( 7): Result.002 file - promoters60/1396519
agatttc

SEQ ID NO: 112173 - DNA, 7 bp, Unknown
  misc_feature (1)..( 7): Result.002 file - promoters60/1396519
agatttc

SEQ ID NO: 112174 - DNA, 7 bp, Unknown
  misc_feature (1)..( 7): Result.002 file - promoters60/1396767
atgtata

SEQ ID NO: 112175 - DNA, 7 bp, Unknown
  misc_feature (1)..( 7): Result.002 file - promoters60/1396767
atgtata

SEQ ID NO: 112176 - DNA, 7 bp, Unknown
  misc_feature (1)..( 7): Result.002 file - promoters60/1396767
ttttcag

SEQ ID NO: 112177 - DNA, 7 bp, Unknown
  misc_feature (1)..( 7): Result.002 file - promoters60/1396767
tttacag

SEQ ID NO: 112178 - DNA, 7 bp, Unknown
  misc_feature (1)..( 7): Result.002 file - promoters60/1396767
tactatt

SEQ ID NO: 112179 - DNA, 7 bp, Unknown
  misc_feature (1)..( 7): Result.002 file - promoters60/1396767
tacgatt

SEQ ID NO: 112180 - DNA, 8 bp, Unknown
  misc_feature (1)..( 8): Result.002 file - promoters60/1396767
tttgattt

SEQ ID NO: 112181 - DNA, 8 bp, Unknown
  misc_feature (1)..( 8): Result.002 file - promoters60/1396767
tttgtttt

SEQ ID NO: 112182 - DNA, 7 bp, Unknown
  misc_feature (1)..( 7): Result.002 file - promoters60/1396767
aaaatac

SEQ ID NO: 112183 - DNA, 7 bp, Unknown
  misc_feature (1)..( 7): Result.002 file - promoters60/1396767
aaattac

SEQ ID NO: 112184 - DNA, 9 bp, Unknown
  misc_feature (1)..( 9): Result.002 file - promoters60/1396767
taaacaaaa

SEQ ID NO: 112185 - DNA, 9 bp, Unknown
  misc_feature (1)..( 9): Result.002 file - promoters60/1396767
caaactaaa

SEQ ID NO: 112186 - DNA, 9 bp, Unknown
  misc_feature (1)..( 9): Result.002 file - promoters60/1396767
caagctaga

SEQ ID NO: 112187 - DNA, 8 bp, Unknown
  misc_feature (1)..( 8): Result.002 file - promoters60/1396767
tgttttaa

SEQ ID NO: 112188 - DNA, 8 bp, Unknown
  misc_feature (1)..( 8): Result.002 file - promoters60/1396767
tgttgtaa

SEQ ID NO: 112189 - DNA, 7 bp, Unknown
  misc_feature (1)..( 7): Result.002 file - promoters60/1396767
aaaaaaa

SEQ ID NO: 112190 - DNA, 7 bp, Unknown
  misc_feature (1)..( 7): Result.002 file - promoters60/1396767
aaagaaa

SEQ ID NO: 112191 - DNA, 8 bp, Unknown
  misc_feature (1)..( 8): Result.002 file - promoters60/1396767
gttagaaa

SEQ ID NO: 112192 - DNA, 8 bp, Unknown
  misc_feature (1)..( 8): Result.002 file - promoters60/1396767
cttacaaa

SEQ ID NO: 112193 - DNA, 8 bp, Unknown
  misc_feature (1)..( 8): Result.002 file - promoters60/1396767
cttacatt

SEQ ID NO: 112194 - DNA, 7 bp, Unknown
  misc_feature (1)..( 7): Result.002 file - promoters60/1396767
aagaaaa

SEQ ID NO: 112195 - DNA, 7 bp, Unknown
  misc_feature (1)..( 7): Result.002 file - promoters60/1396767
aagaaaa

SEQ ID NO: 112196 - DNA, 6 bp, Unknown
  misc_feature (1)..( 6): Result.002 file - promoters60/1396767
gccttg

SEQ ID NO: 112197 - DNA, 6 bp, Unknown
  misc_feature (1)..( 6): Result.002 file - promoters60/1396767
gccttg

SEQ ID NO: 112198 - DNA, 8 bp, Unknown
  misc_feature (1)..( 8): Result.002 file - promoters60/1396767
aaacttaa

SEQ ID NO: 112199 - DNA, 8 bp, Unknown
  misc_feature (1)..( 8): Result.002 file - promoters60/1396767
aaagttaa

SEQ ID NO: 112200 - DNA, 8 bp, Unknown
  misc_feature (1)..( 8): Result.002 file - promoters60/1396767
ttggtgaa

SEQ ID NO: 112201 - DNA, 8 bp, Unknown
  misc_feature (1)..( 8): Result.002 file - promoters60/1396767
ttgatgaa

SEQ ID NO: 112202 - DNA, 8 bp, Unknown
  misc_feature (1)..( 8): Result.002 file - promoters60/1396767
agctttac

SEQ ID NO: 112203 - DNA, 8 bp, Unknown
  misc_feature (1)..( 8): Result.002 file - promoters60/1396767
agccttac

SEQ ID NO: 112204 - DNA, 6 bp, Unknown
  misc_feature (1)..( 6): Result.002 file - promoters60/1396767
ttgcaa

SEQ ID NO: 112205 - DNA, 6 bp, Unknown
  misc_feature (1)..( 6): Result.002 file - promoters60/1396767
ttgcaa

SEQ ID NO: 112206 - DNA, 6 bp, Unknown
  misc_feature (1)..( 6): Result.002 file - promoters60/1396767
ttttga

SEQ ID NO: 112207 - DNA, 6 bp, Unknown
  misc_feature (1)..( 6): Result.002 file - promoters60/1396767
ttttga

SEQ ID NO: 112208 - DNA, 8 bp, Unknown
  misc_feature (1)..( 8): Result.002 file - promoters60/1396767
agaaaaga

SEQ ID NO: 112209 - DNA, 8 bp, Unknown
  misc_feature (1)..( 8): Result.002 file - promoters60/1396767
agaacaga

SEQ ID NO: 112210 - DNA, 9 bp, Unknown
  misc_feature (1)..( 9): Result.002 file - promoters60/1396816
agattagaa

SEQ ID NO: 112211 - DNA, 9 bp, Unknown
  misc_feature (1)..( 9): Result.002 file - promoters60/1396816
agatcagat

SEQ ID NO: 112212 - DNA, 9 bp, Unknown
  misc_feature (1)..( 9): Result.002 file - promoters60/1396816
taatttgaa

SEQ ID NO: 112213 - DNA, 9 bp, Unknown
  misc_feature (1)..( 9): Result.002 file - promoters60/1396816
tgatttgag

SEQ ID NO: 112214 - DNA, 10 bp, Unknown
  misc_feature (1)..( 10): Result.002 file - promoters60/1396816
gatgacaaac

SEQ ID NO: 112215 - DNA, 10 bp, Unknown
  misc_feature (1)..( 10): Result.002 file - promoters60/1396816
catgacaaga

SEQ ID NO: 112216 - DNA, 10 bp, Unknown
  misc_feature (1)..( 10): Result.002 file - promoters60/1396816
gacgagaaag

SEQ ID NO: 112217 - DNA, 11 bp, Unknown
  misc_feature (1)..( 11): Result.002 file - promoters60/1396816
agagagcaagg

SEQ ID NO: 112218 - DNA, 6 bp, Unknown
  misc_feature (1)..( 6): Result.002 file - promoters60/1396951
atttgc

SEQ ID NO: 112219 - DNA, 6 bp, Unknown
  misc_feature (1)..( 6): Result.002 file - promoters60/1396951
atttgc

SEQ ID NO: 112220 - DNA, 6 bp, Unknown
  misc_feature (1)..( 6): Result.002 file - promoters60/1396951
aaaaat

SEQ ID NO: 112221 - DNA, 6 bp, Unknown
  misc_feature (1)..( 6): Result.002 file - promoters60/1396951
aaaaat

SEQ ID NO: 112222 - DNA, 6 bp, Unknown
  misc_feature (1)..( 6): Result.002 file - promoters60/1396951
ttcaaa

SEQ ID NO: 112223 - DNA, 6 bp, Unknown
  misc_feature (1)..( 6): Result.002 file - promoters60/1396951
ttcaaa

SEQ ID NO: 112224 - DNA, 7 bp, Unknown
  misc_feature (1)..( 7): Result.002 file - promoters60/1396951
aaatttc

SEQ ID NO: 112225 - DNA, 7 bp, Unknown
  misc_feature (1)..( 7): Result.002 file - promoters60/1396951
aaacttc

SEQ ID NO: 112226 - DNA, 6 bp, Unknown
  misc_feature (1)..( 6): Result.002 file - promoters60/1396951
agaaga

SEQ ID NO: 112227 - DNA, 6 bp, Unknown
  misc_feature (1)..( 6): Result.002 file - promoters60/1396951
agaaga

SEQ ID NO: 112228 - DNA, 6 bp, Unknown
  misc_feature (1)..( 6): Result.002 file - promoters60/1396951
aaatgc

SEQ ID NO: 112229 - DNA, 6 bp, Unknown
  misc_feature (1)..( 6): Result.002 file - promoters60/1396951
aaatgc

SEQ ID NO: 112230 - DNA, 8 bp, Unknown
  misc_feature (1)..( 8): Result.002 file - promoters60/1396951
aaaatgta

SEQ ID NO: 112231 - DNA, 8 bp, Unknown
  misc_feature (1)..( 8): Result.002 file - promoters60/1396951
aaattgta

SEQ ID NO: 112232 - DNA, 7 bp, Unknown
  misc_feature (1)..( 7): Result.002 file - promoters60/1396951
acagtta

SEQ ID NO: 112233 - DNA, 7 bp, Unknown
  misc_feature (1)..( 7): Result.002 file - promoters60/1396951
acaatta

SEQ ID NO: 112234 - DNA, 8 bp, Unknown
  misc_feature (1)..( 8): Result.002 file - promoters60/1396951
tcttcttc

SEQ ID NO: 112235 - DNA, 8 bp, Unknown
  misc_feature (1)..( 8): Result.002 file - promoters60/1396951
tcttcttc

SEQ ID NO: 112236 - DNA, 6 bp, Unknown
  misc_feature (1)..( 6): Result.002 file - promoters60/1396951
aaaaat

SEQ ID NO: 112237 - DNA, 6 bp, Unknown
  misc_feature (1)..( 6): Result.002 file - promoters60/1396951
aaaaat

SEQ ID NO: 112238 - DNA, 8 bp, Unknown
  misc_feature (1)..( 8): Result.002 file - promoters60/1396951
attaattt

SEQ ID NO: 112239 - DNA, 8 bp, Unknown
  misc_feature (1)..( 8): Result.002 file - promoters60/1396951
atttattt

SEQ ID NO: 112240 - DNA, 8 bp, Unknown
  misc_feature (1)..( 8): Result.002 file - promoters60/1396951
gtttggtt

SEQ ID NO: 112241 - DNA, 8 bp, Unknown
  misc_feature (1)..( 8): Result.002 file - promoters60/1396951
gttaggtt

SEQ ID NO: 112242 - DNA, 6 bp, Unknown
  misc_feature (1)..( 6): Result.002 file - promoters60/1396951
ttatat

SEQ ID NO: 112243 - DNA, 6 bp, Unknown
  misc_feature (1)..( 6): Result.002 file - promoters60/1396951
ttatat

SEQ ID NO: 112244 - DNA, 7 bp, Unknown
  misc_feature (1)..( 7): Result.002 file - promoters60/1396951
aaaagta

SEQ ID NO: 112245 - DNA, 7 bp, Unknown
  misc_feature (1)..( 7): Result.002 file - promoters60/1396951
aaaagta

SEQ ID NO: 112246 - DNA, 7 bp, Unknown
  misc_feature (1)..( 7): Result.002 file - promoters60/1396951
gtagtat

SEQ ID NO: 112247 - DNA, 7 bp, Unknown
  misc_feature (1)..( 7): Result.002 file - promoters60/1396951
gtaatat

SEQ ID NO: 112248 - DNA, 10 bp, Unknown
  misc_feature (1)..( 10): Result.002 file - promoters60/1396951
aaaatacaac

SEQ ID NO: 112249 - DNA, 10 bp, Unknown
  misc_feature (1)..( 10): Result.002 file - promoters60/1396951
aaaatataac

SEQ ID NO: 112250 - DNA, 7 bp, Unknown
  misc_feature (1)..( 7): Result.002 file - promoters60/1396951
attaaat

SEQ ID NO: 112251 - DNA, 7 bp, Unknown
  misc_feature (1)..( 7): Result.002 file - promoters60/1396951
atttaat

SEQ ID NO: 112252 - DNA, 10 bp, Unknown
  misc_feature (1)..( 10): Result.002 file - promoters60/1396951
taagaaataa

SEQ ID NO: 112253 - DNA, 10 bp, Unknown
  misc_feature (1)..( 10): Result.002 file - promoters60/1396951
taataaataa

SEQ ID NO: 112254 - DNA, 6 bp, Unknown
  misc_feature (1)..( 6): Result.002 file - promoters60/1396951
aataat

SEQ ID NO: 112255 - DNA, 6 bp, Unknown
  misc_feature (1)..( 6): Result.002 file - promoters60/1396951
aataat

SEQ ID NO: 112256 - DNA, 7 bp, Unknown
  misc_feature (1)..( 7): Result.002 file - promoters60/1396951
tttaata

SEQ ID NO: 112257 - DNA, 7 bp, Unknown
  misc_feature (1)..( 7): Result.002 file - promoters60/1396951
tttgata

SEQ ID NO: 112258 - DNA, 8 bp, Unknown
  misc_feature (1)..( 8): Result.002 file - promoters60/1396951
acttgatt

SEQ ID NO: 112259 - DNA, 8 bp, Unknown
  misc_feature (1)..( 8): Result.002 file - promoters60/1396951
actttatt

SEQ ID NO: 112260 - DNA, 11 bp, Unknown
  misc_feature (1)..( 11): Result.002 file - promoters60/1396951
ccaaaatcaca

SEQ ID NO: 112261 - DNA, 11 bp, Unknown
  misc_feature (1)..( 11): Result.002 file - promoters60/1396951
ccaaaatcaca

SEQ ID NO: 112262 - DNA, 9 bp, Unknown
  misc_feature (1)..( 9): Result.002 file - promoters60/1397029
taatcgttt

SEQ ID NO: 112263 - DNA, 9 bp, Unknown
  misc_feature (1)..( 9): Result.002 file - promoters60/1397029
taagcgtag

SEQ ID NO: 112264 - DNA, 9 bp, Unknown
  misc_feature (1)..( 9): Result.002 file - promoters60/1397029
caatccttt

SEQ ID NO: 112265 - DNA, 7 bp, Unknown
  misc_feature (1)..( 7): Result.002 file - promoters60/1397029
ttttagt

SEQ ID NO: 112266 - DNA, 7 bp, Unknown
  misc_feature (1)..( 7): Result.002 file - promoters60/1397029
gtttagt

SEQ ID NO: 112267 - DNA, 7 bp, Unknown
  misc_feature (1)..( 7): Result.002 file - promoters60/1397029
ttttaga

SEQ ID NO: 112268 - DNA, 12 bp, Unknown
  misc_feature (1)..( 12): Result.002 file - promoters60/1397029
cgggtttatgtt

SEQ ID NO: 112269 - DNA, 12 bp, Unknown
  misc_feature (1)..( 12): Result.002 file - promoters60/1397029
aacctttatgta

SEQ ID NO: 112270 - DNA, 12 bp, Unknown
  misc_feature (1)..( 12): Result.002 file - promoters60/1397029
aacttttaagta

SEQ ID NO: 112271 - DNA, 10 bp, Unknown
  misc_feature (1)..( 10): Result.002 file - promoters60/1397029
tttcgatgta

SEQ ID NO: 112272 - DNA, 10 bp, Unknown
  misc_feature (1)..( 10): Result.002 file - promoters60/1397029
ttttgatttg

SEQ ID NO: 112273 - DNA, 10 bp, Unknown
  misc_feature (1)..( 10): Result.002 file - promoters60/1397029
ctttgctttg

SEQ ID NO: 112274 - DNA, 12 bp, Unknown
  misc_feature (1)..( 12): Result.002 file - promoters60/1397029
ttattttcagta

SEQ ID NO: 112275 - DNA, 12 bp, Unknown
  misc_feature (1)..( 12): Result.002 file - promoters60/1397029
aacttttaagta

SEQ ID NO: 112276 - DNA, 12 bp, Unknown
  misc_feature (1)..( 12): Result.002 file - promoters60/1397029
aacctttatgta

SEQ ID NO: 112277 - DNA, 7 bp, Unknown
  misc_feature (1)..( 7): Result.002 file - promoters60/1397033
aacggag

SEQ ID NO: 112278 - DNA, 7 bp, Unknown
  misc_feature (1)..( 7): Result.002 file - promoters60/1397033
aacagag

SEQ ID NO: 112279 - DNA, 6 bp, Unknown
  misc_feature (1)..( 6): Result.002 file - promoters60/1397033
tttctc

SEQ ID NO: 112280 - DNA, 6 bp, Unknown
  misc_feature (1)..( 6): Result.002 file - promoters60/1397033
tttctc

SEQ ID NO: 112281 - DNA, 6 bp, Unknown
  misc_feature (1)..( 6): Result.002 file - promoters60/1397033
tttgtc

SEQ ID NO: 112282 - DNA, 6 bp, Unknown
  misc_feature (1)..( 6): Result.002 file - promoters60/1397033
tttgtc

SEQ ID NO: 112283 - DNA, 7 bp, Unknown
  misc_feature (1)..( 7): Result.002 file - promoters60/1397033
agagtca

SEQ ID NO: 112284 - DNA, 7 bp, Unknown
  misc_feature (1)..( 7): Result.002 file - promoters60/1397033
agagtca

SEQ ID NO: 112285 - DNA, 7 bp, Unknown
  misc_feature (1)..( 7): Result.002 file - promoters60/1397033
aaggaaa

SEQ ID NO: 112286 - DNA, 7 bp, Unknown
  misc_feature (1)..( 7): Result.002 file - promoters60/1397033
aagcaaa

SEQ ID NO: 112287 - DNA, 7 bp, Unknown
  misc_feature (1)..( 7): Result.002 file - promoters60/1397033
aaaattc

SEQ ID NO: 112288 - DNA, 7 bp, Unknown
  misc_feature (1)..( 7): Result.002 file - promoters60/1397033
aaatttc

SEQ ID NO: 112289 - DNA, 11 bp, Unknown
  misc_feature (1)..( 11): Result.002 file - promoters60/1397033
atataaggaca

SEQ ID NO: 112290 - DNA, 11 bp, Unknown
  misc_feature (1)..( 11): Result.002 file - promoters60/1397033
atagaagtaca

SEQ ID NO: 112291 - DNA, 8 bp, Unknown
  misc_feature (1)..( 8): Result.002 file - promoters60/1397033
atcttgaa

SEQ ID NO: 112292 - DNA, 8 bp, Unknown
  misc_feature (1)..( 8): Result.002 file - promoters60/1397033
atctggaa

SEQ ID NO: 112293 - DNA, 13 bp, Unknown
  misc_feature (1)..( 13): Result.002 file - promoters60/1397033
attctcgcacgaa

SEQ ID NO: 112294 - DNA, 13 bp, Unknown
  misc_feature (1)..( 13): Result.002 file - promoters60/1397033
attttcgctcgaa

SEQ ID NO: 112295 - DNA, 6 bp, Unknown
  misc_feature (1)..( 6): Result.002 file - promoters60/1397033
ttctct

SEQ ID NO: 112296 - DNA, 6 bp, Unknown
  misc_feature (1)..( 6): Result.002 file - promoters60/1397033
ttctct

SEQ ID NO: 112297 - DNA, 6 bp, Unknown
  misc_feature (1)..( 6): Result.002 file - promoters60/1397033
aaataa

SEQ ID NO: 112298 - DNA, 6 bp, Unknown
  misc_feature (1)..( 6): Result.002 file - promoters60/1397033
aaataa

SEQ ID NO: 112299 - DNA, 7 bp, Unknown
  misc_feature (1)..( 7): Result.002 file - promoters60/1397033
attcttt

SEQ ID NO: 112300 - DNA, 7 bp, Unknown
  misc_feature (1)..( 7): Result.002 file - promoters60/1397033
atttttt

SEQ ID NO: 112301 - DNA, 7 bp, Unknown
  misc_feature (1)..( 7): Result.002 file - promoters60/1397033
atttttc

SEQ ID NO: 112302 - DNA, 6 bp, Unknown
  misc_feature (1)..( 6): Result.002 file - promoters60/1397033
ttcatt

SEQ ID NO: 112303 - DNA, 6 bp, Unknown
  misc_feature (1)..( 6): Result.002 file - promoters60/1397033
ttcatt

SEQ ID NO: 112304 - DNA, 11 bp, Unknown
  misc_feature (1)..( 11): Result.002 file - promoters60/1397080
ttccatcgaat

SEQ ID NO: 112305 - DNA, 11 bp, Unknown
  misc_feature (1)..( 11): Result.002 file - promoters60/1397080
acaaatcaaat

SEQ ID NO: 112306 - DNA, 11 bp, Unknown
  misc_feature (1)..( 11): Result.002 file - promoters60/1397080
ctccaacgaac

SEQ ID NO: 112307 - DNA, 11 bp, Unknown
  misc_feature (1)..( 11): Result.002 file - promoters60/1397080
gaaaaacaaaa

SEQ ID NO: 112308 - DNA, 11 bp, Unknown
  misc_feature (1)..( 11): Result.002 file - promoters60/1397080
taaaaacgggt

SEQ ID NO: 112309 - DNA, 11 bp, Unknown
  misc_feature (1)..( 11): Result.002 file - promoters60/1397080
gaataacgata

SEQ ID NO: 112310 - DNA, 11 bp, Unknown
  misc_feature (1)..( 11): Result.002 file - promoters60/1397080
ctccgacgtgt

SEQ ID NO: 112311 - DNA, 13 bp, Unknown
  misc_feature (1)..( 13): Result.002 file - promoters60/1397080
aactacacatagt

SEQ ID NO: 112312 - DNA, 13 bp, Unknown
  misc_feature (1)..( 13): Result.002 file - promoters60/1397080
agctaaacaaaaa

SEQ ID NO: 112313 - DNA, 13 bp, Unknown
  misc_feature (1)..( 13): Result.002 file - promoters60/1397080
tgaaaaacaaaat

SEQ ID NO: 112314 - DNA, 13 bp, Unknown
  misc_feature (1)..( 13): Result.002 file - promoters60/1397080
ggaaaaagaaaaa

SEQ ID NO: 112315 - DNA, 13 bp, Unknown
  misc_feature (1)..( 13): Result.002 file - promoters60/1397080
ggataaacatgca

SEQ ID NO: 112316 - DNA, 13 bp, Unknown
  misc_feature (1)..( 13): Result.002 file - promoters60/1397080
aagtaaaaaagat

SEQ ID NO: 112317 - DNA, 13 bp, Unknown
  misc_feature (1)..( 13): Result.002 file - promoters60/1397080
cagaatttttgcg

SEQ ID NO: 112318 - DNA, 13 bp, Unknown
  misc_feature (1)..( 13): Result.002 file - promoters60/1397080
aaaaatatttgat

SEQ ID NO: 112319 - DNA, 13 bp, Unknown
  misc_feature (1)..( 13): Result.002 file - promoters60/1397080
ctaccttttacga

SEQ ID NO: 112320 - DNA, 13 bp, Unknown
  misc_feature (1)..( 13): Result.002 file - promoters60/1397080
aaaagtataaaaa

SEQ ID NO: 112321 - DNA, 13 bp, Unknown
  misc_feature (1)..( 13): Result.002 file - promoters60/1397080
aaaaacaaggaat

SEQ ID NO: 112322 - DNA, 13 bp, Unknown
  misc_feature (1)..( 13): Result.002 file - promoters60/1397080
aaaaagaaaaaga

SEQ ID NO: 112323 - DNA, 10 bp, Unknown
  misc_feature (1)..( 10): Result.002 file - promoters60/1397111
tttttctttt

SEQ ID NO: 112324 - DNA, 10 bp, Unknown
  misc_feature (1)..( 10): Result.002 file - promoters60/1397111
tttttttttt

SEQ ID NO: 112325 - DNA, 10 bp, Unknown
  misc_feature (1)..( 10): Result.002 file - promoters60/1397111
tttgtcttat

SEQ ID NO: 112326 - DNA, 10 bp, Unknown
  misc_feature (1)..( 10): Result.002 file - promoters60/1397111
cttttgttgt

SEQ ID NO: 112327 - DNA, 8 bp, Unknown
  misc_feature (1)..( 8): Result.002 file - promoters60/1397111
aaaattgc

SEQ ID NO: 112328 - DNA, 8 bp, Unknown
  misc_feature (1)..( 8): Result.002 file - promoters60/1397111
aaaatttc

SEQ ID NO: 112329 - DNA, 8 bp, Unknown
  misc_feature (1)..( 8): Result.002 file - promoters60/1397111
aaaatttt

SEQ ID NO: 112330 - DNA, 8 bp, Unknown
  misc_feature (1)..( 8): Result.002 file - promoters60/1397111
aaagttct

SEQ ID NO: 112331 - DNA, 8 bp, Unknown
  misc_feature (1)..( 8): Result.002 file - promoters60/1397111
cataaaat

SEQ ID NO: 112332 - DNA, 8 bp, Unknown
  misc_feature (1)..( 8): Result.002 file - promoters60/1397111
aataaaaa

SEQ ID NO: 112333 - DNA, 8 bp, Unknown
  misc_feature (1)..( 8): Result.002 file - promoters60/1397111
catgaaag

SEQ ID NO: 112334 - DNA, 8 bp, Unknown
  misc_feature (1)..( 8): Result.002 file - promoters60/1397111
aattaaaa

SEQ ID NO: 112335 - DNA, 11 bp, Unknown
  misc_feature (1)..( 11): Result.002 file - promoters60/1397111
ataaatttatt

SEQ ID NO: 112336 - DNA, 11 bp, Unknown
  misc_feature (1)..( 11): Result.002 file - promoters60/1397111
atcaatttata

SEQ ID NO: 112337 - DNA, 11 bp, Unknown
  misc_feature (1)..( 11): Result.002 file - promoters60/1397111
tgagttttatt

SEQ ID NO: 112338 - DNA, 12 bp, Unknown
  misc_feature (1)..( 12): Result.002 file - promoters60/1397111
ttgtgtttgatt

SEQ ID NO: 112339 - DNA, 12 bp, Unknown
  misc_feature (1)..( 12): Result.002 file - promoters60/1397111
tttgatggttaa

SEQ ID NO: 112340 - DNA, 12 bp, Unknown
  misc_feature (1)..( 12): Result.002 file - promoters60/1397111
atatatgtttat

SEQ ID NO: 112341 - DNA, 12 bp, Unknown
  misc_feature (1)..( 12): Result.002 file - promoters60/1397111
tttgagggtaca

SEQ ID NO: 112342 - DNA, 12 bp, Unknown
  misc_feature (1)..( 12): Result.002 file - promoters60/1397111
tttattgtttat

SEQ ID NO: 112343 - DNA, 8 bp, Unknown
  misc_feature (1)..( 8): Result.002 file - promoters60/1397111
ttgtttcc

SEQ ID NO: 112344 - DNA, 8 bp, Unknown
  misc_feature (1)..( 8): Result.002 file - promoters60/1397111
ttgtttat

SEQ ID NO: 112345 - DNA, 8 bp, Unknown
  misc_feature (1)..( 8): Result.002 file - promoters60/1397111
ttgattag

SEQ ID NO: 112346 - DNA, 8 bp, Unknown
  misc_feature (1)..( 8): Result.002 file - promoters60/1397111
atgtttat

SEQ ID NO: 112347 - DNA, 9 bp, Unknown
  misc_feature (1)..( 9): Result.002 file - promoters60/1397125
aaaaacaaa

SEQ ID NO: 112348 - DNA, 9 bp, Unknown
  misc_feature (1)..( 9): Result.002 file - promoters60/1397125
gaaaaaaaa

SEQ ID NO: 112349 - DNA, 9 bp, Unknown
  misc_feature (1)..( 9): Result.002 file - promoters60/1397125
tcaaacaaa

SEQ ID NO: 112350 - DNA, 9 bp, Unknown
  misc_feature (1)..( 9): Result.002 file - promoters60/1397125
ttaaaaaaa

SEQ ID NO: 112351 - DNA, 9 bp, Unknown
  misc_feature (1)..( 9): Result.002 file - promoters60/1397125
taaaaaata

SEQ ID NO: 112352 - DNA, 9 bp, Unknown
  misc_feature (1)..( 9): Result.002 file - promoters60/1397125
taaaaagtt

SEQ ID NO: 112353 - DNA, 12 bp, Unknown
  misc_feature (1)..( 12): Result.002 file - promoters60/1397125
aaactacatatt

SEQ ID NO: 112354 - DNA, 12 bp, Unknown
  misc_feature (1)..( 12): Result.002 file - promoters60/1397125
aataaacatatt

SEQ ID NO: 112355 - DNA, 12 bp, Unknown
  misc_feature (1)..( 12): Result.002 file - promoters60/1397125
cccaaaaataag

SEQ ID NO: 112356 - DNA, 12 bp, Unknown
  misc_feature (1)..( 12): Result.002 file - promoters60/1397125
cccacaaacagt

SEQ ID NO: 112357 - DNA, 12 bp, Unknown
  misc_feature (1)..( 12): Result.002 file - promoters60/1397125
aagaaaaatcta

SEQ ID NO: 112358 - DNA, 12 bp, Unknown
  misc_feature (1)..( 12): Result.002 file - promoters60/1397125
tcctaaaatcaa

SEQ ID NO: 112359 - DNA, 6 bp, Unknown
  misc_feature (1)..( 6): Result.002 file - promoters60/1397130
gagatt

SEQ ID NO: 112360 - DNA, 6 bp, Unknown
  misc_feature (1)..( 6): Result.002 file - promoters60/1397130
gagatt

SEQ ID NO: 112361 - DNA, 7 bp, Unknown
  misc_feature (1)..( 7): Result.002 file - promoters60/1397130
gagagaa

SEQ ID NO: 112362 - DNA, 7 bp, Unknown
  misc_feature (1)..( 7): Result.002 file - promoters60/1397130
gagagaa

SEQ ID NO: 112363 - DNA, 6 bp, Unknown
  misc_feature (1)..( 6): Result.002 file - promoters60/1397130
tgatct

SEQ ID NO: 112364 - DNA, 6 bp, Unknown
  misc_feature (1)..( 6): Result.002 file - promoters60/1397130
tgatct

SEQ ID NO: 112365 - DNA, 10 bp, Unknown
  misc_feature (1)..( 10): Result.002 file - promoters60/1397130
aattaagggc

SEQ ID NO: 112366 - DNA, 10 bp, Unknown
  misc_feature (1)..( 10): Result.002 file - promoters60/1397130
aattatgggc

SEQ ID NO: 112367 - DNA, 7 bp, Unknown
  misc_feature (1)..( 7): Result.002 file - promoters60/1397130
agcacaa

SEQ ID NO: 112368 - DNA, 7 bp, Unknown
  misc_feature (1)..( 7): Result.002 file - promoters60/1397130
agcccaa

SEQ ID NO: 112369 - DNA, 6 bp, Unknown
  misc_feature (1)..( 6): Result.002 file - promoters60/1397130
ttattt

SEQ ID NO: 112370 - DNA, 6 bp, Unknown
  misc_feature (1)..( 6): Result.002 file - promoters60/1397130
ttattt

SEQ ID NO: 112371 - DNA, 7 bp, Unknown
  misc_feature (1)..( 7): Result.002 file - promoters60/1397130
aatctaa

SEQ ID NO: 112372 - DNA, 7 bp, Unknown
  misc_feature (1)..( 7): Result.002 file - promoters60/1397130
aatttaa

SEQ ID NO: 112373 - DNA, 8 bp, Unknown
  misc_feature (1)..( 8): Result.002 file - promoters60/1397130
cttctggt

SEQ ID NO: 112374 - DNA, 8 bp, Unknown
  misc_feature (1)..( 8): Result.002 file - promoters60/1397130
tttccggt

SEQ ID NO: 112375 - DNA, 8 bp, Unknown
  misc_feature (1)..( 8): Result.002 file - promoters60/1397130
tttccggg

SEQ ID NO: 112376 - DNA, 9 bp, Unknown
  misc_feature (1)..( 9): Result.002 file - promoters60/1397130
tatttgggg

SEQ ID NO: 112377 - DNA, 9 bp, Unknown
  misc_feature (1)..( 9): Result.002 file - promoters60/1397130
tatgtggtc

SEQ ID NO: 112378 - DNA, 9 bp, Unknown
  misc_feature (1)..( 9): Result.002 file - promoters60/1397130
attgtagtc

SEQ ID NO: 112379 - DNA, 7 bp, Unknown
  misc_feature (1)..( 7): Result.002 file - promoters60/1397130
tatgaat

SEQ ID NO: 112380 - DNA, 7 bp, Unknown
  misc_feature (1)..( 7): Result.002 file - promoters60/1397130
tataaat

SEQ ID NO: 112381 - DNA, 6 bp, Unknown
  misc_feature (1)..( 6): Result.002 file - promoters60/1397130
gaagag

SEQ ID NO: 112382 - DNA, 6 bp, Unknown
  misc_feature (1)..( 6): Result.002 file - promoters60/1397130
gaagag

SEQ ID NO: 112383 - DNA, 8 bp, Unknown
  misc_feature (1)..( 8): Result.002 file - promoters60/1397130
tccgttgc

SEQ ID NO: 112384 - DNA, 8 bp, Unknown
  misc_feature (1)..( 8): Result.002 file - promoters60/1397130
tccggtgc

SEQ ID NO: 112385 - DNA, 7 bp, Unknown
  misc_feature (1)..( 7): Result.002 file - promoters60/1397130
acgaaaa

SEQ ID NO: 112386 - DNA, 7 bp, Unknown
  misc_feature (1)..( 7): Result.002 file - promoters60/1397130
acgcaaa

SEQ ID NO: 112387 - DNA, 6 bp, Unknown
  misc_feature (1)..( 6): Result.002 file - promoters60/1397130
agattt

SEQ ID NO: 112388 - DNA, 6 bp, Unknown
  misc_feature (1)..( 6): Result.002 file - promoters60/1397130
agattt

SEQ ID NO: 112389 - DNA, 8 bp, Unknown
  misc_feature (1)..( 8): Result.002 file - promoters60/1397130
aaacagaa

SEQ ID NO: 112390 - DNA, 8 bp, Unknown
  misc_feature (1)..( 8): Result.002 file - promoters60/1397130
aaagagaa

SEQ ID NO: 112391 - DNA, 8 bp, Unknown
  misc_feature (1)..( 8): Result.002 file - promoters60/1397130
atattttc

SEQ ID NO: 112392 - DNA, 8 bp, Unknown
  misc_feature (1)..( 8): Result.002 file - promoters60/1397130
ataatttc

SEQ ID NO: 112393 - DNA, 7 bp, Unknown
  misc_feature (1)..( 7): Result.002 file - promoters60/1397178
tttttta

SEQ ID NO: 112394 - DNA, 7 bp, Unknown
  misc_feature (1)..( 7): Result.002 file - promoters60/1397178
tttatta

SEQ ID NO: 112395 - DNA, 8 bp, Unknown
  misc_feature (1)..( 8): Result.002 file - promoters60/1397178
tttatcta

SEQ ID NO: 112396 - DNA, 8 bp, Unknown
  misc_feature (1)..( 8): Result.002 file - promoters60/1397178
tttttcta

SEQ ID NO: 112397 - DNA, 6 bp, Unknown
  misc_feature (1)..( 6): Result.002 file - promoters60/1397178
attttt

SEQ ID NO: 112398 - DNA, 6 bp, Unknown
  misc_feature (1)..( 6): Result.002 file - promoters60/1397178
attttt

SEQ ID NO: 112399 - DNA, 8 bp, Unknown
  misc_feature (1)..( 8): Result.002 file - promoters60/1397178
aaagattt

SEQ ID NO: 112400 - DNA, 8 bp, Unknown
  misc_feature (1)..( 8): Result.002 file - promoters60/1397178
aaagattt

SEQ ID NO: 112401 - DNA, 8 bp, Unknown
  misc_feature (1)..( 8): Result.002 file - promoters60/1397178
taagattg

SEQ ID NO: 112402 - DNA, 8 bp, Unknown
  misc_feature (1)..( 8): Result.002 file - promoters60/1397178
ggtatttg

SEQ ID NO: 112403 - DNA, 8 bp, Unknown
  misc_feature (1)..( 8): Result.002 file - promoters60/1397178
ggtgtttg

SEQ ID NO: 112404 - DNA, 6 bp, Unknown
  misc_feature (1)..( 6): Result.002 file - promoters60/1397178
atgaat

SEQ ID NO: 112405 - DNA, 6 bp, Unknown
  misc_feature (1)..( 6): Result.002 file - promoters60/1397178
atgaat

SEQ ID NO: 112406 - DNA, 7 bp, Unknown
  misc_feature (1)..( 7): Result.002 file - promoters60/1397178
ttacaat

SEQ ID NO: 112407 - DNA, 7 bp, Unknown
  misc_feature (1)..( 7): Result.002 file - promoters60/1397178
ttataat

SEQ ID NO: 112408 - DNA, 9 bp, Unknown
  misc_feature (1)..( 9): Result.002 file - promoters60/1397178
aattataaa

SEQ ID NO: 112409 - DNA, 9 bp, Unknown
  misc_feature (1)..( 9): Result.002 file - promoters60/1397178
aattttaac

SEQ ID NO: 112410 - DNA, 9 bp, Unknown
  misc_feature (1)..( 9): Result.002 file - promoters60/1397178
cctttgacc

SEQ ID NO: 112411 - DNA, 14 bp, Unknown
  misc_feature (1)..( 14): Result.002 file - promoters60/1397178
aatttctcccaaaa

SEQ ID NO: 112412 - DNA, 14 bp, Unknown
  misc_feature (1)..( 14): Result.002 file - promoters60/1397178
aatttctgccaaaa

SEQ ID NO: 112413 - DNA, 14 bp, Unknown
  misc_feature (1)..( 14): Result.002 file - promoters60/1397178
tatttctcttatcc

SEQ ID NO: 112414 - DNA, 8 bp, Unknown
  misc_feature (1)..( 8): Result.002 file - promoters60/1397178
ataaactt

SEQ ID NO: 112415 - DNA, 8 bp, Unknown
  misc_feature (1)..( 8): Result.002 file - promoters60/1397178
ttaacctt

SEQ ID NO: 112416 - DNA, 8 bp, Unknown
  misc_feature (1)..( 8): Result.002 file - promoters60/1397178
ttaaccct

SEQ ID NO: 112417 - DNA, 13 bp, Unknown
  misc_feature (1)..( 13): Result.002 file - promoters60/1397178
ttgaatcaatatt

SEQ ID NO: 112418 - DNA, 13 bp, Unknown
  misc_feature (1)..( 13): Result.002 file - promoters60/1397178
ttgattcaaaatt

SEQ ID NO: 112419 - DNA, 7 bp, Unknown
  misc_feature (1)..( 7): Result.002 file - promoters60/1397178
tggattt

SEQ ID NO: 112420 - DNA, 7 bp, Unknown
  misc_feature (1)..( 7): Result.002 file - promoters60/1397178
tggattt

SEQ ID NO: 112421 - DNA, 6 bp, Unknown
  misc_feature (1)..( 6): Result.002 file - promoters60/1397178
ttggtt

SEQ ID NO: 112422 - DNA, 6 bp, Unknown
  misc_feature (1)..( 6): Result.002 file - promoters60/1397178
ttggtt

SEQ ID NO: 112423 - DNA, 7 bp, Unknown
  misc_feature (1)..( 7): Result.002 file - promoters60/1397178
ctcactc

SEQ ID NO: 112424 - DNA, 7 bp, Unknown
  misc_feature (1)..( 7): Result.002 file - promoters60/1397178
ctcgctc

SEQ ID NO: 112425 - DNA, 15 bp, Unknown
  misc_feature (1)..( 15): Result.002 file - promoters60/1397203
tttaacattgatata

SEQ ID NO: 112426 - DNA, 15 bp, Unknown
  misc_feature (1)..( 15): Result.002 file - promoters60/1397203
ttttacacaaatttg

SEQ ID NO: 112427 - DNA, 15 bp, Unknown
  misc_feature (1)..( 15): Result.002 file - promoters60/1397203
gttaacaaaaacttt

SEQ ID NO: 112428 - DNA, 15 bp, Unknown
  misc_feature (1)..( 15): Result.002 file - promoters60/1397203
aataacattaaaaaa

SEQ ID NO: 112429 - DNA, 15 bp, Unknown
  misc_feature (1)..( 15): Result.002 file - promoters60/1397203
gtcgacattataaaa

SEQ ID NO: 112430 - DNA, 15 bp, Unknown
  misc_feature (1)..( 15): Result.002 file - promoters60/1397203
gttatcaattaatct

SEQ ID NO: 112431 - DNA, 9 bp, Unknown
  misc_feature (1)..( 9): Result.002 file - promoters60/1397203
tataaaaaa

SEQ ID NO: 112432 - DNA, 9 bp, Unknown
  misc_feature (1)..( 9): Result.002 file - promoters60/1397203
tctaaaaag

SEQ ID NO: 112433 - DNA, 9 bp, Unknown
  misc_feature (1)..( 9): Result.002 file - promoters60/1397203
tatcaaaca

SEQ ID NO: 112434 - DNA, 9 bp, Unknown
  misc_feature (1)..( 9): Result.002 file - promoters60/1397203
taacaaaaa

SEQ ID NO: 112435 - DNA, 9 bp, Unknown
  misc_feature (1)..( 9): Result.002 file - promoters60/1397203
taaaaaaat

SEQ ID NO: 112436 - DNA, 9 bp, Unknown
  misc_feature (1)..( 9): Result.002 file - promoters60/1397203
tataaaata

SEQ ID NO: 112437 - DNA, 12 bp, Unknown
  misc_feature (1)..( 12): Result.002 file - promoters60/1397203
aaaacaacccaa

SEQ ID NO: 112438 - DNA, 12 bp, Unknown
  misc_feature (1)..( 12): Result.002 file - promoters60/1397203
gcaacaacaatc

SEQ ID NO: 112439 - DNA, 12 bp, Unknown
  misc_feature (1)..( 12): Result.002 file - promoters60/1397203
taaaaaactcaa

SEQ ID NO: 112440 - DNA, 12 bp, Unknown
  misc_feature (1)..( 12): Result.002 file - promoters60/1397203
caaaaaagaaat

SEQ ID NO: 112441 - DNA, 12 bp, Unknown
  misc_feature (1)..( 12): Result.002 file - promoters60/1397203
gaaacacttatc

SEQ ID NO: 112442 - DNA, 12 bp, Unknown
  misc_feature (1)..( 12): Result.002 file - promoters60/1397203
taaaaattcgtg

SEQ ID NO: 112443 - DNA, 12 bp, Unknown
  misc_feature (1)..( 12): Result.002 file - promoters60/1397203
taaactctatca

SEQ ID NO: 112444 - DNA, 15 bp, Unknown
  misc_feature (1)..( 15): Result.002 file - promoters60/1397203
gtcattaaattcaaa

SEQ ID NO: 112445 - DNA, 15 bp, Unknown
  misc_feature (1)..( 15): Result.002 file - promoters60/1397203
ttcataaaatctata

SEQ ID NO: 112446 - DNA, 16 bp, Unknown
  misc_feature (1)..( 16): Result.002 file - promoters60/1397203
cgacatttaatcaaat

SEQ ID NO: 112447 - DNA, 16 bp, Unknown
  misc_feature (1)..( 16): Result.002 file - promoters60/1397203
ggagatttaacaaatt

SEQ ID NO: 112448 - DNA, 15 bp, Unknown
  misc_feature (1)..( 15): Result.002 file - promoters60/1397203
ttcataaactctata

SEQ ID NO: 112449 - DNA, 16 bp, Unknown
  misc_feature (1)..( 16): Result.002 file - promoters60/1397203
ttctataacgtagtga

SEQ ID NO: 112450 - DNA, 7 bp, Unknown
  misc_feature (1)..( 7): Result.002 file - promoters60/1397332
aactcag

SEQ ID NO: 112451 - DNA, 7 bp, Unknown
  misc_feature (1)..( 7): Result.002 file - promoters60/1397332
aactcag

SEQ ID NO: 112452 - DNA, 6 bp, Unknown
  misc_feature (1)..( 6): Result.002 file - promoters60/1397332
tttcga

SEQ ID NO: 112453 - DNA, 6 bp, Unknown
  misc_feature (1)..( 6): Result.002 file - promoters60/1397332
tttcga

SEQ ID NO: 112454 - DNA, 7 bp, Unknown
  misc_feature (1)..( 7): Result.002 file - promoters60/1397332
caataac

SEQ ID NO: 112455 - DNA, 7 bp, Unknown
  misc_feature (1)..( 7): Result.002 file - promoters60/1397332
caaaaac

SEQ ID NO: 112456 - DNA, 7 bp, Unknown
  misc_feature (1)..( 7): Result.002 file - promoters60/1397332
acattgt

SEQ ID NO: 112457 - DNA, 7 bp, Unknown
  misc_feature (1)..( 7): Result.002 file - promoters60/1397332
acattgt

SEQ ID NO: 112458 - DNA, 7 bp, Unknown
  misc_feature (1)..( 7): Result.002 file - promoters60/1397332
aaatcaa

SEQ ID NO: 112459 - DNA, 7 bp, Unknown
  misc_feature (1)..( 7): Result.002 file - promoters60/1397332
aaaccaa

SEQ ID NO: 112460 - DNA, 11 bp, Unknown
  misc_feature (1)..( 11): Result.002 file - promoters60/1397332
ccctctaaacc

SEQ ID NO: 112461 - DNA, 11 bp, Unknown
  misc_feature (1)..( 11): Result.002 file - promoters60/1397332
cccactaaacc

SEQ ID NO: 112462 - DNA, 11 bp, Unknown
  misc_feature (1)..( 11): Result.002 file - promoters60/1397332
atgtttaaacc

SEQ ID NO: 112463 - DNA, 7 bp, Unknown
  misc_feature (1)..( 7): Result.002 file - promoters60/1397332
agaagag

SEQ ID NO: 112464 - DNA, 7 bp, Unknown
  misc_feature (1)..( 7): Result.002 file - promoters60/1397332
agacgag

SEQ ID NO: 112465 - DNA, 10 bp, Unknown
  misc_feature (1)..( 10): Result.002 file - promoters60/1397332
aaataaaaaa

SEQ ID NO: 112466 - DNA, 10 bp, Unknown
  misc_feature (1)..( 10): Result.002 file - promoters60/1397332
aaagaaaaaa

SEQ ID NO: 112467 - DNA, 6 bp, Unknown
  misc_feature (1)..( 6): Result.002 file - promoters60/1397332
gatgtt

SEQ ID NO: 112468 - DNA, 6 bp, Unknown
  misc_feature (1)..( 6): Result.002 file - promoters60/1397332
gatgtt

SEQ ID NO: 112469 - DNA, 7 bp, Unknown
  misc_feature (1)..( 7): Result.002 file - promoters60/1397332
catcact

SEQ ID NO: 112470 - DNA, 7 bp, Unknown
  misc_feature (1)..( 7): Result.002 file - promoters60/1397332
cattact

SEQ ID NO: 112471 - DNA, 9 bp, Unknown
  misc_feature (1)..( 9): Result.002 file - promoters60/1397332
tagctttgt

SEQ ID NO: 112472 - DNA, 9 bp, Unknown
  misc_feature (1)..( 9): Result.002 file - promoters60/1397332
tagcattgt

SEQ ID NO: 112473 - DNA, 7 bp, Unknown
  misc_feature (1)..( 7): Result.002 file - promoters60/1397332
tagggtt

SEQ ID NO: 112474 - DNA, 7 bp, Unknown
  misc_feature (1)..( 7): Result.002 file - promoters60/1397332
tagggtt

SEQ ID NO: 112475 - DNA, 9 bp, Unknown
  misc_feature (1)..( 9): Result.002 file - promoters60/1397332
tttaattaa

SEQ ID NO: 112476 - DNA, 9 bp, Unknown
  misc_feature (1)..( 9): Result.002 file - promoters60/1397332
tttacttaa

SEQ ID NO: 112477 - DNA, 8 bp, Unknown
  misc_feature (1)..( 8): Result.002 file - promoters60/1397332
atttgtta

SEQ ID NO: 112478 - DNA, 8 bp, Unknown
  misc_feature (1)..( 8): Result.002 file - promoters60/1397332
atttttta

SEQ ID NO: 112479 - DNA, 6 bp, Unknown
  misc_feature (1)..( 6): Result.002 file - promoters60/1397332
gaaccc

SEQ ID NO: 112480 - DNA, 6 bp, Unknown
  misc_feature (1)..( 6): Result.002 file - promoters60/1397332
gaaccc

SEQ ID NO: 112481 - DNA, 7 bp, Unknown
  misc_feature (1)..( 7): Result.002 file - promoters60/1397332
attaata

SEQ ID NO: 112482 - DNA, 7 bp, Unknown
  misc_feature (1)..( 7): Result.002 file - promoters60/1397332
atttata

SEQ ID NO: 112483 - DNA, 13 bp, Unknown
  misc_feature (1)..( 13): Result.002 file - promoters60/1397350
gtctcatggattc

SEQ ID NO: 112484 - DNA, 13 bp, Unknown
  misc_feature (1)..( 13): Result.002 file - promoters60/1397350
gtttcaaggattc

SEQ ID NO: 112485 - DNA, 13 bp, Unknown
  misc_feature (1)..( 13): Result.002 file - promoters60/1397350
gtctgatggataa

SEQ ID NO: 112486 - DNA, 7 bp, Unknown
  misc_feature (1)..( 7): Result.002 file - promoters60/1397350
aataaca

SEQ ID NO: 112487 - DNA, 7 bp, Unknown
  misc_feature (1)..( 7): Result.002 file - promoters60/1397350
aattaca

SEQ ID NO: 112488 - DNA, 7 bp, Unknown
  misc_feature (1)..( 7): Result.002 file - promoters60/1397350
aacaatt

SEQ ID NO: 112489 - DNA, 7 bp, Unknown
  misc_feature (1)..( 7): Result.002 file - promoters60/1397350
aacaatt

SEQ ID NO: 112490 - DNA, 6 bp, Unknown
  misc_feature (1)..( 6): Result.002 file - promoters60/1397350
ttaaac

SEQ ID NO: 112491 - DNA, 6 bp, Unknown
  misc_feature (1)..( 6): Result.002 file - promoters60/1397350
ttaaac

SEQ ID NO: 112492 - DNA, 7 bp, Unknown
  misc_feature (1)..( 7): Result.002 file - promoters60/1397350
aaatatt

SEQ ID NO: 112493 - DNA, 7 bp, Unknown
  misc_feature (1)..( 7): Result.002 file - promoters60/1397350
aaacatt

SEQ ID NO: 112494 - DNA, 6 bp, Unknown
  misc_feature (1)..( 6): Result.002 file - promoters60/1397350
ttaata

SEQ ID NO: 112495 - DNA, 6 bp, Unknown
  misc_feature (1)..( 6): Result.002 file - promoters60/1397350
ttaata

SEQ ID NO: 112496 - DNA, 7 bp, Unknown
  misc_feature (1)..( 7): Result.002 file - promoters60/1397350
aaatcgt

SEQ ID NO: 112497 - DNA, 7 bp, Unknown
  misc_feature (1)..( 7): Result.002 file - promoters60/1397350
aaaacgt

SEQ ID NO: 112498 - DNA, 7 bp, Unknown
  misc_feature (1)..( 7): Result.002 file - promoters60/1397350
taaaatc

SEQ ID NO: 112499 - DNA, 7 bp, Unknown
  misc_feature (1)..( 7): Result.002 file - promoters60/1397350
taatatc

SEQ ID NO: 112500 - DNA, 7 bp, Unknown
  misc_feature (1)..( 7): Result.002 file - promoters60/1397350
aaaccaa

SEQ ID NO: 112501 - DNA, 7 bp, Unknown
  misc_feature (1)..( 7): Result.002 file - promoters60/1397350
aaagcaa

SEQ ID NO: 112502 - DNA, 6 bp, Unknown
  misc_feature (1)..( 6): Result.002 file - promoters60/1397350
aatgaa

SEQ ID NO: 112503 - DNA, 6 bp, Unknown
  misc_feature (1)..( 6): Result.002 file - promoters60/1397350
aatgaa

SEQ ID NO: 112504 - DNA, 7 bp, Unknown
  misc_feature (1)..( 7): Result.002 file - promoters60/1397350
gttcaga

SEQ ID NO: 112505 - DNA, 7 bp, Unknown
  misc_feature (1)..( 7): Result.002 file - promoters60/1397350
gttaaga

SEQ ID NO: 112506 - DNA, 6 bp, Unknown
  misc_feature (1)..( 6): Result.002 file - promoters60/1397350
aaaacc

SEQ ID NO: 112507 - DNA, 6 bp, Unknown
  misc_feature (1)..( 6): Result.002 file - promoters60/1397350
aaaacc

SEQ ID NO: 112508 - DNA, 7 bp, Unknown
  misc_feature (1)..( 7): Result.002 file - promoters60/1397350
ttgcaag

SEQ ID NO: 112509 - DNA, 7 bp, Unknown
  misc_feature (1)..( 7): Result.002 file - promoters60/1397350
ttgcaag

SEQ ID NO: 112510 - DNA, 6 bp, Unknown
  misc_feature (1)..( 6): Result.002 file - promoters60/1397350
taaaaa

SEQ ID NO: 112511 - DNA, 6 bp, Unknown
  misc_feature (1)..( 6): Result.002 file - promoters60/1397350
taaaaa

SEQ ID NO: 112512 - DNA, 7 bp, Unknown
  misc_feature (1)..( 7): Result.002 file - promoters60/1397350
aaataca

SEQ ID NO: 112513 - DNA, 7 bp, Unknown
  misc_feature (1)..( 7): Result.002 file - promoters60/1397350
aaaaaca

SEQ ID NO: 112514 - DNA, 7 bp, Unknown
  misc_feature (1)..( 7): Result.002 file - promoters60/1397350
gaataaa

SEQ ID NO: 112515 - DNA, 7 bp, Unknown
  misc_feature (1)..( 7): Result.002 file - promoters60/1397350
gaaaaaa

SEQ ID NO: 112516 - DNA, 6 bp, Unknown
  misc_feature (1)..( 6): Result.002 file - promoters60/1397350
agtaaa

SEQ ID NO: 112517 - DNA, 6 bp, Unknown
  misc_feature (1)..( 6): Result.002 file - promoters60/1397350
agtaaa

SEQ ID NO: 112518 - DNA, 7 bp, Unknown
  misc_feature (1)..( 7): Result.002 file - promoters60/1397350
aatcggg

SEQ ID NO: 112519 - DNA, 7 bp, Unknown
  misc_feature (1)..( 7): Result.002 file - promoters60/1397350
aattggg

SEQ ID NO: 112520 - DNA, 8 bp, Unknown
  misc_feature (1)..( 8): Result.002 file - promoters60/1397350
gaaagaaa

SEQ ID NO: 112521 - DNA, 8 bp, Unknown
  misc_feature (1)..( 8): Result.002 file - promoters60/1397350
gaaacaaa

SEQ ID NO: 112522 - DNA, 10 bp, Unknown
  misc_feature (1)..( 10): Result.002 file - promoters60/1397350
ggaaaagaaa

SEQ ID NO: 112523 - DNA, 10 bp, Unknown
  misc_feature (1)..( 10): Result.002 file - promoters60/1397350
ggaaatgaaa

SEQ ID NO: 112524 - DNA, 7 bp, Unknown
  misc_feature (1)..( 7): Result.002 file - promoters60/1397350
cccacta

SEQ ID NO: 112525 - DNA, 7 bp, Unknown
  misc_feature (1)..( 7): Result.002 file - promoters60/1397350
cccacta

SEQ ID NO: 112526 - DNA, 9 bp, Unknown
  misc_feature (1)..( 9): Result.002 file - promoters60/1397350
aaagaaaag

SEQ ID NO: 112527 - DNA, 9 bp, Unknown
  misc_feature (1)..( 9): Result.002 file - promoters60/1397350
aaagtaaag

SEQ ID NO: 112528 - DNA, 7 bp, Unknown
  misc_feature (1)..( 7): Result.002 file - promoters60/1397350
gtatata

SEQ ID NO: 112529 - DNA, 7 bp, Unknown
  misc_feature (1)..( 7): Result.002 file - promoters60/1397350
gtatata

SEQ ID NO: 112530 - DNA, 8 bp, Unknown
  misc_feature (1)..( 8): Result.002 file - promoters60/1397425
tactaagg

SEQ ID NO: 112531 - DNA, 8 bp, Unknown
  misc_feature (1)..( 8): Result.002 file - promoters60/1397425
tactgagg

SEQ ID NO: 112532 - DNA, 6 bp, Unknown
  misc_feature (1)..( 6): Result.002 file - promoters60/1397425
taattt

SEQ ID NO: 112533 - DNA, 6 bp, Unknown
  misc_feature (1)..( 6): Result.002 file - promoters60/1397425
taattt

SEQ ID NO: 112534 - DNA, 8 bp, Unknown
  misc_feature (1)..( 8): Result.002 file - promoters60/1397425
atatgtaa

SEQ ID NO: 112535 - DNA, 8 bp, Unknown
  misc_feature (1)..( 8): Result.002 file - promoters60/1397425
gtatataa

SEQ ID NO: 112536 - DNA, 8 bp, Unknown
  misc_feature (1)..( 8): Result.002 file - promoters60/1397425
ataagtat

SEQ ID NO: 112537 - DNA, 7 bp, Unknown
  misc_feature (1)..( 7): Result.002 file - promoters60/1397425
ttaaaat

SEQ ID NO: 112538 - DNA, 7 bp, Unknown
  misc_feature (1)..( 7): Result.002 file - promoters60/1397425
ttagaat

SEQ ID NO: 112539 - DNA, 8 bp, Unknown
  misc_feature (1)..( 8): Result.002 file - promoters60/1397425
tcatgatt

SEQ ID NO: 112540 - DNA, 8 bp, Unknown
  misc_feature (1)..( 8): Result.002 file - promoters60/1397425
tcataatt

SEQ ID NO: 112541 - DNA, 8 bp, Unknown
  misc_feature (1)..( 8): Result.002 file - promoters60/1397425
tcataata

SEQ ID NO: 112542 - DNA, 6 bp, Unknown
  misc_feature (1)..( 6): Result.002 file - promoters60/1397425
ttttct

SEQ ID NO: 112543 - DNA, 6 bp, Unknown
  misc_feature (1)..( 6): Result.002 file - promoters60/1397425
ttttct

SEQ ID NO: 112544 - DNA, 6 bp, Unknown
  misc_feature (1)..( 6): Result.002 file - promoters60/1397425
ttacct

SEQ ID NO: 112545 - DNA, 6 bp, Unknown
  misc_feature (1)..( 6): Result.002 file - promoters60/1397425
ttacct

SEQ ID NO: 112546 - DNA, 6 bp, Unknown
  misc_feature (1)..( 6): Result.002 file - promoters60/1397425
attgtt

SEQ ID NO: 112547 - DNA, 6 bp, Unknown
  misc_feature (1)..( 6): Result.002 file - promoters60/1397425
attgtt

SEQ ID NO: 112548 - DNA, 9 bp, Unknown
  misc_feature (1)..( 9): Result.002 file - promoters60/1397500
aatgctaaa

SEQ ID NO: 112549 - DNA, 9 bp, Unknown
  misc_feature (1)..( 9): Result.002 file - promoters60/1397500
gctgctaat

SEQ ID NO: 112550 - DNA, 9 bp, Unknown
  misc_feature (1)..( 9): Result.002 file - promoters60/1397500
agtgccaat

SEQ ID NO: 112551 - DNA, 9 bp, Unknown
  misc_feature (1)..( 9): Result.002 file - promoters60/1397500
agttccaac

SEQ ID NO: 112552 - DNA, 10 bp, Unknown
  misc_feature (1)..( 10): Result.002 file - promoters60/1397500
aattttttaa

SEQ ID NO: 112553 - DNA, 10 bp, Unknown
  misc_feature (1)..( 10): Result.002 file - promoters60/1397500
aatttttggc

SEQ ID NO: 112554 - DNA, 10 bp, Unknown
  misc_feature (1)..( 10): Result.002 file - promoters60/1397500
gattttataa

SEQ ID NO: 112555 - DNA, 10 bp, Unknown
  misc_feature (1)..( 10): Result.002 file - promoters60/1397500
tattttttgg

SEQ ID NO: 112556 - DNA, 10 bp, Unknown
  misc_feature (1)..( 10): Result.002 file - promoters60/1397500
acaaacatgg

SEQ ID NO: 112557 - DNA, 10 bp, Unknown
  misc_feature (1)..( 10): Result.002 file - promoters60/1397500
ccaatcataa

SEQ ID NO: 112558 - DNA, 10 bp, Unknown
  misc_feature (1)..( 10): Result.002 file - promoters60/1397500
ataattatat

SEQ ID NO: 112559 - DNA, 10 bp, Unknown
  misc_feature (1)..( 10): Result.002 file - promoters60/1397500
taaatgatat

SEQ ID NO: 112560 - DNA, 10 bp, Unknown
  misc_feature (1)..( 10): Result.002 file - promoters60/1397500
ccaatcgcaa

SEQ ID NO: 112561 - DNA, 12 bp, Unknown
  misc_feature (1)..( 12): Result.002 file - promoters60/1397500
tcttaaaagttt

SEQ ID NO: 112562 - DNA, 12 bp, Unknown
  misc_feature (1)..( 12): Result.002 file - promoters60/1397500
acataaaaattt

SEQ ID NO: 112563 - DNA, 12 bp, Unknown
  misc_feature (1)..( 12): Result.002 file - promoters60/1397500
atataaaggata

SEQ ID NO: 112564 - DNA, 12 bp, Unknown
  misc_feature (1)..( 12): Result.002 file - promoters60/1397500
ggtgaaaaattc

SEQ ID NO: 112565 - DNA, 10 bp, Unknown
  misc_feature (1)..( 10): Result.002 file - promoters60/1397500
ttttttataa

SEQ ID NO: 112566 - DNA, 10 bp, Unknown
  misc_feature (1)..( 10): Result.002 file - promoters60/1397500
ggaattataa

SEQ ID NO: 112567 - DNA, 10 bp, Unknown
  misc_feature (1)..( 10): Result.002 file - promoters60/1397500
taaatcatat

SEQ ID NO: 112568 - DNA, 10 bp, Unknown
  misc_feature (1)..( 10): Result.002 file - promoters60/1397500
taaatcaaat

SEQ ID NO: 112569 - DNA, 6 bp, Unknown
  misc_feature (1)..( 6): Result.002 file - promoters60/1397556
attcac

SEQ ID NO: 112570 - DNA, 6 bp, Unknown
  misc_feature (1)..( 6): Result.002 file - promoters60/1397556
attcac

SEQ ID NO: 112571 - DNA, 6 bp, Unknown
  misc_feature (1)..( 6): Result.002 file - promoters60/1397556
caaata

SEQ ID NO: 112572 - DNA, 6 bp, Unknown
  misc_feature (1)..( 6): Result.002 file - promoters60/1397556
caaata

SEQ ID NO: 112573 - DNA, 8 bp, Unknown
  misc_feature (1)..( 8): Result.002 file - promoters60/1397556
ataataat

SEQ ID NO: 112574 - DNA, 8 bp, Unknown
  misc_feature (1)..( 8): Result.002 file - promoters60/1397556
ataacaat

SEQ ID NO: 112575 - DNA, 6 bp, Unknown
  misc_feature (1)..( 6): Result.002 file - promoters60/1397556
ctttca

SEQ ID NO: 112576 - DNA, 6 bp, Unknown
  misc_feature (1)..( 6): Result.002 file - promoters60/1397556
ctttca

SEQ ID NO: 112577 - DNA, 6 bp, Unknown
  misc_feature (1)..( 6): Result.002 file - promoters60/1397556
aataac

SEQ ID NO: 112578 - DNA, 6 bp, Unknown
  misc_feature (1)..( 6): Result.002 file - promoters60/1397556
aataac

SEQ ID NO: 112579 - DNA, 7 bp, Unknown
  misc_feature (1)..( 7): Result.002 file - promoters60/1397556
aaagaat

SEQ ID NO: 112580 - DNA, 7 bp, Unknown
  misc_feature (1)..( 7): Result.002 file - promoters60/1397556
aaacaat

SEQ ID NO: 112581 - DNA, 11 bp, Unknown
  misc_feature (1)..( 11): Result.002 file - promoters60/1397556
agtttttttgc

SEQ ID NO: 112582 - DNA, 11 bp, Unknown
  misc_feature (1)..( 11): Result.002 file - promoters60/1397556
agttattttgc

SEQ ID NO: 112583 - DNA, 7 bp, Unknown
  misc_feature (1)..( 7): Result.002 file - promoters60/1397556
tctgtga

SEQ ID NO: 112584 - DNA, 7 bp, Unknown
  misc_feature (1)..( 7): Result.002 file - promoters60/1397556
tctgtga

SEQ ID NO: 112585 - DNA, 7 bp, Unknown
  misc_feature (1)..( 7): Result.002 file - promoters60/1397556
acgatta

SEQ ID NO: 112586 - DNA, 7 bp, Unknown
  misc_feature (1)..( 7): Result.002 file - promoters60/1397556
acggtta

SEQ ID NO: 112587 - DNA, 8 bp, Unknown
  misc_feature (1)..( 8): Result.002 file - promoters60/1397556
ataatttt

SEQ ID NO: 112588 - DNA, 8 bp, Unknown
  misc_feature (1)..( 8): Result.002 file - promoters60/1397556
atagtttt

SEQ ID NO: 112589 - DNA, 8 bp, Unknown
  misc_feature (1)..( 8): Result.002 file - promoters60/1397556
ttttctgc

SEQ ID NO: 112590 - DNA, 8 bp, Unknown
  misc_feature (1)..( 8): Result.002 file - promoters60/1397556
ttttttgc

SEQ ID NO: 112591 - DNA, 6 bp, Unknown
  misc_feature (1)..( 6): Result.002 file - promoters60/1397556
ctcttc

SEQ ID NO: 112592 - DNA, 6 bp, Unknown
  misc_feature (1)..( 6): Result.002 file - promoters60/1397556
ctcttc

SEQ ID NO: 112593 - DNA, 8 bp, Unknown
  misc_feature (1)..( 8): Result.002 file - promoters60/1397568
caatctaa

SEQ ID NO: 112594 - DNA, 8 bp, Unknown
  misc_feature (1)..( 8): Result.002 file - promoters60/1397568
caatttaa

SEQ ID NO: 112595 - DNA, 6 bp, Unknown
  misc_feature (1)..( 6): Result.002 file - promoters60/1397568
taagtt

SEQ ID NO: 112596 - DNA, 6 bp, Unknown
  misc_feature (1)..( 6): Result.002 file - promoters60/1397568
taagtt

SEQ ID NO: 112597 - DNA, 9 bp, Unknown
  misc_feature (1)..( 9): Result.002 file - promoters60/1397568
aacaacaat

SEQ ID NO: 112598 - DNA, 9 bp, Unknown
  misc_feature (1)..( 9): Result.002 file - promoters60/1397568
aacaagaat

SEQ ID NO: 112599 - DNA, 6 bp, Unknown
  misc_feature (1)..( 6): Result.002 file - promoters60/1397568
caaatt

SEQ ID NO: 112600 - DNA, 6 bp, Unknown
  misc_feature (1)..( 6): Result.002 file - promoters60/1397568
caaatt

SEQ ID NO: 112601 - DNA, 7 bp, Unknown
  misc_feature (1)..( 7): Result.002 file - promoters60/1397568
atttgaa

SEQ ID NO: 112602 - DNA, 7 bp, Unknown
  misc_feature (1)..( 7): Result.002 file - promoters60/1397568
atttgaa

SEQ ID NO: 112603 - DNA, 7 bp, Unknown
  misc_feature (1)..( 7): Result.002 file - promoters60/1397568
ttcaaat

SEQ ID NO: 112604 - DNA, 7 bp, Unknown
  misc_feature (1)..( 7): Result.002 file - promoters60/1397568
ttccaat

SEQ ID NO: 112605 - DNA, 7 bp, Unknown
  misc_feature (1)..( 7): Result.002 file - promoters60/1397568
ttgagct

SEQ ID NO: 112606 - DNA, 7 bp, Unknown
  misc_feature (1)..( 7): Result.002 file - promoters60/1397568
ttgggct

SEQ ID NO: 112607 - DNA, 8 bp, Unknown
  misc_feature (1)..( 8): Result.002 file - promoters60/1397568
aaaacata

SEQ ID NO: 112608 - DNA, 8 bp, Unknown
  misc_feature (1)..( 8): Result.002 file - promoters60/1397568
aaaacata

SEQ ID NO: 112609 - DNA, 6 bp, Unknown
  misc_feature (1)..( 6): Result.002 file - promoters60/1397568
ataaat

SEQ ID NO: 112610 - DNA, 6 bp, Unknown
  misc_feature (1)..( 6): Result.002 file - promoters60/1397568
ataaat

SEQ ID NO: 112611 - DNA, 6 bp, Unknown
  misc_feature (1)..( 6): Result.002 file - promoters60/1397568
gatgac

SEQ ID NO: 112612 - DNA, 6 bp, Unknown
  misc_feature (1)..( 6): Result.002 file - promoters60/1397568
gatgac

SEQ ID NO: 112613 - DNA, 7 bp, Unknown
  misc_feature (1)..( 7): Result.002 file - promoters60/1397568
catttga

SEQ ID NO: 112614 - DNA, 7 bp, Unknown
  misc_feature (1)..( 7): Result.002 file - promoters60/1397568
catttga

SEQ ID NO: 112615 - DNA, 6 bp, Unknown
  misc_feature (1)..( 6): Result.002 file - promoters60/1397568
tgacac

SEQ ID NO: 112616 - DNA, 6 bp, Unknown
  misc_feature (1)..( 6): Result.002 file - promoters60/1397568
tgacac

SEQ ID NO: 112617 - DNA, 9 bp, Unknown
  misc_feature (1)..( 9): Result.002 file - promoters60/1397568
actagattc

SEQ ID NO: 112618 - DNA, 9 bp, Unknown
  misc_feature (1)..( 9): Result.002 file - promoters60/1397568
actagcttc

SEQ ID NO: 112619 - DNA, 7 bp, Unknown
  misc_feature (1)..( 7): Result.002 file - promoters60/1397568
aaggcaa

SEQ ID NO: 112620 - DNA, 7 bp, Unknown
  misc_feature (1)..( 7): Result.002 file - promoters60/1397568
aagccaa

SEQ ID NO: 112621 - DNA, 9 bp, Unknown
  misc_feature (1)..( 9): Result.002 file - promoters60/1397568
caatatcaa

SEQ ID NO: 112622 - DNA, 9 bp, Unknown
  misc_feature (1)..( 9): Result.002 file - promoters60/1397568
caagatcaa

SEQ ID NO: 112623 - DNA, 10 bp, Unknown
  misc_feature (1)..( 10): Result.002 file - promoters60/1397568
tttgaatttt

SEQ ID NO: 112624 - DNA, 10 bp, Unknown
  misc_feature (1)..( 10): Result.002 file - promoters60/1397568
tttcaatttt

SEQ ID NO: 112625 - DNA, 10 bp, Unknown
  misc_feature (1)..( 10): Result.002 file - promoters60/1397568
aacttttgat

SEQ ID NO: 112626 - DNA, 10 bp, Unknown
  misc_feature (1)..( 10): Result.002 file - promoters60/1397568
aacttttgat

SEQ ID NO: 112627 - DNA, 6 bp, Unknown
  misc_feature (1)..( 6): Result.002 file - promoters60/1397568
tttata

SEQ ID NO: 112628 - DNA, 6 bp, Unknown
  misc_feature (1)..( 6): Result.002 file - promoters60/1397568
tttata

SEQ ID NO: 112629 - DNA, 7 bp, Unknown
  misc_feature (1)..( 7): Result.002 file - promoters60/1397568
tttaaaa

SEQ ID NO: 112630 - DNA, 7 bp, Unknown
  misc_feature (1)..( 7): Result.002 file - promoters60/1397568
tttcaaa

SEQ ID NO: 112631 - DNA, 8 bp, Unknown
  misc_feature (1)..( 8): Result.002 file - promoters60/1397568
gatttaag

SEQ ID NO: 112632 - DNA, 8 bp, Unknown
  misc_feature (1)..( 8): Result.002 file - promoters60/1397568
gattcaag

SEQ ID NO: 112633 - DNA, 8 bp, Unknown
  misc_feature (1)..( 8): Result.002 file - promoters60/1397568
aatcttct

SEQ ID NO: 112634 - DNA, 8 bp, Unknown
  misc_feature (1)..( 8): Result.002 file - promoters60/1397568
aattttct

SEQ ID NO: 112635 - DNA, 7 bp, Unknown
  misc_feature (1)..( 7): Result.002 file - promoters60/1397568
tatgtaa

SEQ ID NO: 112636 - DNA, 7 bp, Unknown
  misc_feature (1)..( 7): Result.002 file - promoters60/1397568
tatataa

SEQ ID NO: 112637 - DNA, 10 bp, Unknown
  misc_feature (1)..( 10): Result.002 file - promoters60/1397568
atttaacttt

SEQ ID NO: 112638 - DNA, 10 bp, Unknown
  misc_feature (1)..( 10): Result.002 file - promoters60/1397568
atttcacttt

SEQ ID NO: 112639 - DNA, 7 bp, Unknown
  misc_feature (1)..( 7): Result.002 file - promoters60/1397568
caaaaat

SEQ ID NO: 112640 - DNA, 7 bp, Unknown
  misc_feature (1)..( 7): Result.002 file - promoters60/1397568
caataat

SEQ ID NO: 112641 - DNA, 9 bp, Unknown
  misc_feature (1)..( 9): Result.002 file - promoters60/1397568
tgacagttt

SEQ ID NO: 112642 - DNA, 9 bp, Unknown
  misc_feature (1)..( 9): Result.002 file - promoters60/1397568
tgacaattt

SEQ ID NO: 112643 - DNA, 8 bp, Unknown
  misc_feature (1)..( 8): Result.002 file - promoters60/1397568
taaactgt

SEQ ID NO: 112644 - DNA, 8 bp, Unknown
  misc_feature (1)..( 8): Result.002 file - promoters60/1397568
taacctgt

SEQ ID NO: 112645 - DNA, 9 bp, Unknown
  misc_feature (1)..( 9): Result.002 file - promoters60/1397568
gctttttaa

SEQ ID NO: 112646 - DNA, 9 bp, Unknown
  misc_feature (1)..( 9): Result.002 file - promoters60/1397568
gcttattaa

SEQ ID NO: 112647 - DNA, 7 bp, Unknown
  misc_feature (1)..( 7): Result.002 file - promoters60/1397590
ttatttt

SEQ ID NO: 112648 - DNA, 7 bp, Unknown
  misc_feature (1)..( 7): Result.002 file - promoters60/1397590
atatttt

SEQ ID NO: 112649 - DNA, 7 bp, Unknown
  misc_feature (1)..( 7): Result.002 file - promoters60/1397590
ttatttc

SEQ ID NO: 112650 - DNA, 6 bp, Unknown
  misc_feature (1)..( 6): Result.002 file - promoters60/1397590
taacaa

SEQ ID NO: 112651 - DNA, 6 bp, Unknown
  misc_feature (1)..( 6): Result.002 file - promoters60/1397590
taacaa

SEQ ID NO: 112652 - DNA, 8 bp, Unknown
  misc_feature (1)..( 8): Result.002 file - promoters60/1397590
atttaaaa

SEQ ID NO: 112653 - DNA, 8 bp, Unknown
  misc_feature (1)..( 8): Result.002 file - promoters60/1397590
atttaata

SEQ ID NO: 112654 - DNA, 8 bp, Unknown
  misc_feature (1)..( 8): Result.002 file - promoters60/1397590
attaaaaa

SEQ ID NO: 112655 - DNA, 6 bp, Unknown
  misc_feature (1)..( 6): Result.002 file - promoters60/1397590
taatta

SEQ ID NO: 112656 - DNA, 6 bp, Unknown
  misc_feature (1)..( 6): Result.002 file - promoters60/1397590
taatta

SEQ ID NO: 112657 - DNA, 7 bp, Unknown
  misc_feature (1)..( 7): Result.002 file - promoters60/1397590
gatgata

SEQ ID NO: 112658 - DNA, 7 bp, Unknown
  misc_feature (1)..( 7): Result.002 file - promoters60/1397590
gataata

SEQ ID NO: 112659 - DNA, 7 bp, Unknown
  misc_feature (1)..( 7): Result.002 file - promoters60/1397590
ttaaaaa

SEQ ID NO: 112660 - DNA, 7 bp, Unknown
  misc_feature (1)..( 7): Result.002 file - promoters60/1397590
ttacaaa

SEQ ID NO: 112661 - DNA, 6 bp, Unknown
  misc_feature (1)..( 6): Result.002 file - promoters60/1397590
aataaa

SEQ ID NO: 112662 - DNA, 6 bp, Unknown
  misc_feature (1)..( 6): Result.002 file - promoters60/1397590
aataaa

SEQ ID NO: 112663 - DNA, 12 bp, Unknown
  misc_feature (1)..( 12): Result.002 file - promoters60/1397590
ttcctatatatc

SEQ ID NO: 112664 - DNA, 12 bp, Unknown
  misc_feature (1)..( 12): Result.002 file - promoters60/1397590
ctcctataaatt

SEQ ID NO: 112665 - DNA, 12 bp, Unknown
  misc_feature (1)..( 12): Result.002 file - promoters60/1397590
ctcttatatatt

SEQ ID NO: 112666 - DNA, 7 bp, Unknown
  misc_feature (1)..( 7): Result.002 file - promoters60/1397590
agcccat

SEQ ID NO: 112667 - DNA, 7 bp, Unknown
  misc_feature (1)..( 7): Result.002 file - promoters60/1397590
agcacat

SEQ ID NO: 112668 - DNA, 7 bp, Unknown
  misc_feature (1)..( 7): Result.002 file - promoters60/1397590
tatttct

SEQ ID NO: 112669 - DNA, 7 bp, Unknown
  misc_feature (1)..( 7): Result.002 file - promoters60/1397590
tatatct

SEQ ID NO: 112670 - DNA, 10 bp, Unknown
  misc_feature (1)..( 10): Result.002 file - promoters60/1397590
atattttaac

SEQ ID NO: 112671 - DNA, 10 bp, Unknown
  misc_feature (1)..( 10): Result.002 file - promoters60/1397590
atagtttaac

SEQ ID NO: 112672 - DNA, 7 bp, Unknown
  misc_feature (1)..( 7): Result.002 file - promoters60/1397590
aaggaaa

SEQ ID NO: 112673 - DNA, 7 bp, Unknown
  misc_feature (1)..( 7): Result.002 file - promoters60/1397590
aagtaaa

SEQ ID NO: 112674 - DNA, 8 bp, Unknown
  misc_feature (1)..( 8): Result.002 file - promoters60/1397590
aactattt

SEQ ID NO: 112675 - DNA, 8 bp, Unknown
  misc_feature (1)..( 8): Result.002 file - promoters60/1397590
aacttttt

SEQ ID NO: 112676 - DNA, 6 bp, Unknown
  misc_feature (1)..( 6): Result.002 file - promoters60/1397590
ttaggc

SEQ ID NO: 112677 - DNA, 6 bp, Unknown
  misc_feature (1)..( 6): Result.002 file - promoters60/1397590
ttaggc

SEQ ID NO: 112678 - DNA, 12 bp, Unknown
  misc_feature (1)..( 12): Result.002 file - promoters60/1397590
ttcctatatatc

SEQ ID NO: 112679 - DNA, 12 bp, Unknown
  misc_feature (1)..( 12): Result.002 file - promoters60/1397590
ctcttatatatt

SEQ ID NO: 112680 - DNA, 12 bp, Unknown
  misc_feature (1)..( 12): Result.002 file - promoters60/1397590
ctcctataaatt

SEQ ID NO: 112681 - DNA, 6 bp, Unknown
  misc_feature (1)..( 6): Result.002 file - promoters60/1397590
ttttta

SEQ ID NO: 112682 - DNA, 6 bp, Unknown
  misc_feature (1)..( 6): Result.002 file - promoters60/1397590
ttttta

SEQ ID NO: 112683 - DNA, 7 bp, Unknown
  misc_feature (1)..( 7): Result.002 file - promoters60/1397590
atatatt

SEQ ID NO: 112684 - DNA, 7 bp, Unknown
  misc_feature (1)..( 7): Result.002 file - promoters60/1397590
atagatt

SEQ ID NO: 112685 - DNA, 7 bp, Unknown
  misc_feature (1)..( 7): Result.002 file - promoters60/1397590
atttcca

SEQ ID NO: 112686 - DNA, 7 bp, Unknown
  misc_feature (1)..( 7): Result.002 file - promoters60/1397590
attacca

SEQ ID NO: 112687 - DNA, 10 bp, Unknown
  misc_feature (1)..( 10): Result.002 file - promoters60/1397590
aagatatatg

SEQ ID NO: 112688 - DNA, 10 bp, Unknown
  misc_feature (1)..( 10): Result.002 file - promoters60/1397590
aagaaatatg

SEQ ID NO: 112689 - DNA, 7 bp, Unknown
  misc_feature (1)..( 7): Result.002 file - promoters60/1397590
atatgaa

SEQ ID NO: 112690 - DNA, 7 bp, Unknown
  misc_feature (1)..( 7): Result.002 file - promoters60/1397590
ataggaa

SEQ ID NO: 112691 - DNA, 7 bp, Unknown
  misc_feature (1)..( 7): Result.002 file - promoters60/1397590
aaaacaa

SEQ ID NO: 112692 - DNA, 7 bp, Unknown
  misc_feature (1)..( 7): Result.002 file - promoters60/1397590
aaagcaa

SEQ ID NO: 112693 - DNA, 12 bp, Unknown
  misc_feature (1)..( 12): Result.002 file - promoters60/1397590
aaaagaagaaag

SEQ ID NO: 112694 - DNA, 12 bp, Unknown
  misc_feature (1)..( 12): Result.002 file - promoters60/1397590
aaacgaagaaag

SEQ ID NO: 112695 - DNA, 8 bp, Unknown
  misc_feature (1)..( 8): Result.002 file - promoters60/1397594
gaataatt

SEQ ID NO: 112696 - DNA, 8 bp, Unknown
  misc_feature (1)..( 8): Result.002 file - promoters60/1397594
gaacaatt

SEQ ID NO: 112697 - DNA, 8 bp, Unknown
  misc_feature (1)..( 8): Result.002 file - promoters60/1397594
ttgttgaa

SEQ ID NO: 112698 - DNA, 8 bp, Unknown
  misc_feature (1)..( 8): Result.002 file - promoters60/1397594
ttgtggaa

SEQ ID NO: 112699 - DNA, 6 bp, Unknown
  misc_feature (1)..( 6): Result.002 file - promoters60/1397594
gttctt

SEQ ID NO: 112700 - DNA, 6 bp, Unknown
  misc_feature (1)..( 6): Result.002 file - promoters60/1397594
gttctt

SEQ ID NO: 112701 - DNA, 9 bp, Unknown
  misc_feature (1)..( 9): Result.002 file - promoters60/1397594
ccttgtttt

SEQ ID NO: 112702 - DNA, 9 bp, Unknown
  misc_feature (1)..( 9): Result.002 file - promoters60/1397594
cctcgttgt

SEQ ID NO: 112703 - DNA, 9 bp, Unknown
  misc_feature (1)..( 9): Result.002 file - promoters60/1397594
cttcggtgt

SEQ ID NO: 112704 - DNA, 7 bp, Unknown
  misc_feature (1)..( 7): Result.002 file - promoters60/1397594
tttgttt

SEQ ID NO: 112705 - DNA, 7 bp, Unknown
  misc_feature (1)..( 7): Result.002 file - promoters60/1397594
tttcttt

SEQ ID NO: 112706 - DNA, 6 bp, Unknown
  misc_feature (1)..( 6): Result.002 file - promoters60/1397594
tcacaa

SEQ ID NO: 112707 - DNA, 6 bp, Unknown
  misc_feature (1)..( 6): Result.002 file - promoters60/1397594
tcacaa

SEQ ID NO: 112708 - DNA, 6 bp, Unknown
  misc_feature (1)..( 6): Result.002 file - promoters60/1397594
ttgcca

SEQ ID NO: 112709 - DNA, 6 bp, Unknown
  misc_feature (1)..( 6): Result.002 file - promoters60/1397594
ttgcca

SEQ ID NO: 112710 - DNA, 8 bp, Unknown
  misc_feature (1)..( 8): Result.002 file - promoters60/1397594
ccacaatc

SEQ ID NO: 112711 - DNA, 8 bp, Unknown
  misc_feature (1)..( 8): Result.002 file - promoters60/1397594
ccaaaatc

SEQ ID NO: 112712 - DNA, 6 bp, Unknown
  misc_feature (1)..( 6): Result.002 file - promoters60/1397594
tctttg

SEQ ID NO: 112713 - DNA, 6 bp, Unknown
  misc_feature (1)..( 6): Result.002 file - promoters60/1397594
tctttg

SEQ ID NO: 112714 - DNA, 9 bp, Unknown
  misc_feature (1)..( 9): Result.002 file - promoters60/1397594
tgggttttg

SEQ ID NO: 112715 - DNA, 9 bp, Unknown
  misc_feature (1)..( 9): Result.002 file - promoters60/1397594
tggattttg

SEQ ID NO: 112716 - DNA, 6 bp, Unknown
  misc_feature (1)..( 6): Result.002 file - promoters60/1397594
attctt

SEQ ID NO: 112717 - DNA, 6 bp, Unknown
  misc_feature (1)..( 6): Result.002 file - promoters60/1397594
attctt

SEQ ID NO: 112718 - DNA, 8 bp, Unknown
  misc_feature (1)..( 8): Result.002 file - promoters60/1397594
tgtaatcg

SEQ ID NO: 112719 - DNA, 8 bp, Unknown
  misc_feature (1)..( 8): Result.002 file - promoters60/1397594
tgtgatcg

SEQ ID NO: 112720 - DNA, 6 bp, Unknown
  misc_feature (1)..( 6): Result.002 file - promoters60/1397594
caggag

SEQ ID NO: 112721 - DNA, 6 bp, Unknown
  misc_feature (1)..( 6): Result.002 file - promoters60/1397594
caggag

SEQ ID NO: 112722 - DNA, 6 bp, Unknown
  misc_feature (1)..( 6): Result.002 file - promoters60/1397594
tatgtt

SEQ ID NO: 112723 - DNA, 6 bp, Unknown
  misc_feature (1)..( 6): Result.002 file - promoters60/1397594
tatgtt

SEQ ID NO: 112724 - DNA, 6 bp, Unknown
  misc_feature (1)..( 6): Result.002 file - promoters60/1397594
agggaa

SEQ ID NO: 112725 - DNA, 6 bp, Unknown
  misc_feature (1)..( 6): Result.002 file - promoters60/1397594
agggaa

SEQ ID NO: 112726 - DNA, 9 bp, Unknown
  misc_feature (1)..( 9): Result.002 file - promoters60/1397700
tcttgtaat

SEQ ID NO: 112727 - DNA, 9 bp, Unknown
  misc_feature (1)..( 9): Result.002 file - promoters60/1397700
aattgtaat

SEQ ID NO: 112728 - DNA, 9 bp, Unknown
  misc_feature (1)..( 9): Result.002 file - promoters60/1397700
aatagtact

SEQ ID NO: 112729 - DNA, 10 bp, Unknown
  misc_feature (1)..( 10): Result.002 file - promoters60/1397700
aactttgaaa

SEQ ID NO: 112730 - DNA, 10 bp, Unknown
  misc_feature (1)..( 10): Result.002 file - promoters60/1397700
ttatttcaaa

SEQ ID NO: 112731 - DNA, 10 bp, Unknown
  misc_feature (1)..( 10): Result.002 file - promoters60/1397700
aactttaaaa

SEQ ID NO: 112732 - DNA, 10 bp, Unknown
  misc_feature (1)..( 10): Result.002 file - promoters60/1397700
aaattacaaa

SEQ ID NO: 112733 - DNA, 8 bp, Unknown
  misc_feature (1)..( 8): Result.002 file - promoters60/1397700
attaaagc

SEQ ID NO: 112734 - DNA, 8 bp, Unknown
  misc_feature (1)..( 8): Result.002 file - promoters60/1397700
attcaaga

SEQ ID NO: 112735 - DNA, 8 bp, Unknown
  misc_feature (1)..( 8): Result.002 file - promoters60/1397700
tttctaga

SEQ ID NO: 112736 - DNA, 8 bp, Unknown
  misc_feature (1)..( 8): Result.002 file - promoters60/1397700
gaaccaat

SEQ ID NO: 112737 - DNA, 8 bp, Unknown
  misc_feature (1)..( 8): Result.002 file - promoters60/1397700
gaaacaaa

SEQ ID NO: 112738 - DNA, 8 bp, Unknown
  misc_feature (1)..( 8): Result.002 file - promoters60/1397700
taaacaaa

SEQ ID NO: 112739 - DNA, 7 bp, Unknown
  misc_feature (1)..( 7): Result.002 file - promoters60/1397700
tttcttg

SEQ ID NO: 112740 - DNA, 7 bp, Unknown
  misc_feature (1)..( 7): Result.002 file - promoters60/1397700
tttctta

SEQ ID NO: 112741 - DNA, 7 bp, Unknown
  misc_feature (1)..( 7): Result.002 file - promoters60/1397700
tttcttg

SEQ ID NO: 112742 - DNA, 8 bp, Unknown
  misc_feature (1)..( 8): Result.002 file - promoters60/1397700
attgaaat

SEQ ID NO: 112743 - DNA, 8 bp, Unknown
  misc_feature (1)..( 8): Result.002 file - promoters60/1397700
tttgcaat

SEQ ID NO: 112744 - DNA, 8 bp, Unknown
  misc_feature (1)..( 8): Result.002 file - promoters60/1397700
attaaaag

SEQ ID NO: 112745 - DNA, 9 bp, Unknown
  misc_feature (1)..( 9): Result.002 file - promoters60/1397700
taagatagc

SEQ ID NO: 112746 - DNA, 9 bp, Unknown
  misc_feature (1)..( 9): Result.002 file - promoters60/1397700
taatatata

SEQ ID NO: 112747 - DNA, 9 bp, Unknown
  misc_feature (1)..( 9): Result.002 file - promoters60/1397700
ttatatata

SEQ ID NO: 112748 - DNA, 7 bp, Unknown
  misc_feature (1)..( 7): Result.002 file - promoters60/1397700
ctctctg

SEQ ID NO: 112749 - DNA, 7 bp, Unknown
  misc_feature (1)..( 7): Result.002 file - promoters60/1397700
ttctctg

SEQ ID NO: 112750 - DNA, 7 bp, Unknown
  misc_feature (1)..( 7): Result.002 file - promoters60/1397700
ttctctt

SEQ ID NO: 112751 - DNA, 9 bp, Unknown
  misc_feature (1)..( 9): Result.002 file - promoters60/1397700
caatcaaaa

SEQ ID NO: 112752 - DNA, 9 bp, Unknown
  misc_feature (1)..( 9): Result.002 file - promoters60/1397700
caattaaat

SEQ ID NO: 112753 - DNA, 9 bp, Unknown
  misc_feature (1)..( 9): Result.002 file - promoters60/1397700
tccttaaat

SEQ ID NO: 112754 - DNA, 7 bp, Unknown
  misc_feature (1)..( 7): Result.002 file - promoters60/1397700
atgtttg

SEQ ID NO: 112755 - DNA, 7 bp, Unknown
  misc_feature (1)..( 7): Result.002 file - promoters60/1397700
gtgtttg

SEQ ID NO: 112756 - DNA, 7 bp, Unknown
  misc_feature (1)..( 7): Result.002 file - promoters60/1397700
gtgattg

SEQ ID NO: 112757 - DNA, 11 bp, Unknown
  misc_feature (1)..( 11): Result.002 file - promoters60/1397700
taaagtgaagt

SEQ ID NO: 112758 - DNA, 11 bp, Unknown
  misc_feature (1)..( 11): Result.002 file - promoters60/1397700
taaagtcaaaa

SEQ ID NO: 112759 - DNA, 11 bp, Unknown
  misc_feature (1)..( 11): Result.002 file - promoters60/1397700
aaaaatcaaaa

SEQ ID NO: 112760 - DNA, 10 bp, Unknown
  misc_feature (1)..( 10): Result.002 file - promoters60/1397700
gaagtcatat

SEQ ID NO: 112761 - DNA, 10 bp, Unknown
  misc_feature (1)..( 10): Result.002 file - promoters60/1397700
aaagtcaaaa

SEQ ID NO: 112762 - DNA, 10 bp, Unknown
  misc_feature (1)..( 10): Result.002 file - promoters60/1397700
aaaatcaaaa

SEQ ID NO: 112763 - DNA, 9 bp, Unknown
  misc_feature (1)..( 9): Result.002 file - promoters60/1397753
aatattttg

SEQ ID NO: 112764 - DNA, 9 bp, Unknown
  misc_feature (1)..( 9): Result.002 file - promoters60/1397753
gttattttt

SEQ ID NO: 112765 - DNA, 9 bp, Unknown
  misc_feature (1)..( 9): Result.002 file - promoters60/1397753
aataatttg

SEQ ID NO: 112766 - DNA, 9 bp, Unknown
  misc_feature (1)..( 9): Result.002 file - promoters60/1397753
aataattta

SEQ ID NO: 112767 - DNA, 10 bp, Unknown
  misc_feature (1)..( 10): Result.002 file - promoters60/1397753
aatattttgg

SEQ ID NO: 112768 - DNA, 10 bp, Unknown
  misc_feature (1)..( 10): Result.002 file - promoters60/1397753
tattttttgg

SEQ ID NO: 112769 - DNA, 10 bp, Unknown
  misc_feature (1)..( 10): Result.002 file - promoters60/1397753
aataatttga

SEQ ID NO: 112770 - DNA, 10 bp, Unknown
  misc_feature (1)..( 10): Result.002 file - promoters60/1397753
aatattttta

SEQ ID NO: 112771 - DNA, 15 bp, Unknown
  misc_feature (1)..( 15): Result.002 file - promoters60/1397753
tttggggtttgattc

SEQ ID NO: 112772 - DNA, 15 bp, Unknown
  misc_feature (1)..( 15): Result.002 file - promoters60/1397753
tttgggattttctta

SEQ ID NO: 112773 - DNA, 15 bp, Unknown
  misc_feature (1)..( 15): Result.002 file - promoters60/1397753
tgtatgatttcctta

SEQ ID NO: 112774 - DNA, 15 bp, Unknown
  misc_feature (1)..( 15): Result.002 file - promoters60/1397753
ataatgttttagtgg

SEQ ID NO: 112775 - DNA, 13 bp, Unknown
  misc_feature (1)..( 13): Result.002 file - promoters60/1397753
gtaccaaactaaa

SEQ ID NO: 112776 - DNA, 13 bp, Unknown
  misc_feature (1)..( 13): Result.002 file - promoters60/1397753
tttctaaaataat

SEQ ID NO: 112777 - DNA, 13 bp, Unknown
  misc_feature (1)..( 13): Result.002 file - promoters60/1397753
ttctcaaattgtt

SEQ ID NO: 112778 - DNA, 13 bp, Unknown
  misc_feature (1)..( 13): Result.002 file - promoters60/1397753
agaagaaaaaaat

SEQ ID NO: 112779 - DNA, 10 bp, Unknown
  misc_feature (1)..( 10): Result.002 file - promoters60/1397821
gaattgatgt

SEQ ID NO: 112780 - DNA, 10 bp, Unknown
  misc_feature (1)..( 10): Result.002 file - promoters60/1397821
gaattgatta

SEQ ID NO: 112781 - DNA, 10 bp, Unknown
  misc_feature (1)..( 10): Result.002 file - promoters60/1397821
gaaatgaaat

SEQ ID NO: 112782 - DNA, 10 bp, Unknown
  misc_feature (1)..( 10): Result.002 file - promoters60/1397821
tctttggtta

SEQ ID NO: 112783 - DNA, 10 bp, Unknown
  misc_feature (1)..( 10): Result.002 file - promoters60/1397821
taattcattg

SEQ ID NO: 112784 - DNA, 11 bp, Unknown
  misc_feature (1)..( 11): Result.002 file - promoters60/1397821
gtcttttcaaa

SEQ ID NO: 112785 - DNA, 11 bp, Unknown
  misc_feature (1)..( 11): Result.002 file - promoters60/1397821
gtccttttacc

SEQ ID NO: 112786 - DNA, 11 bp, Unknown
  misc_feature (1)..( 11): Result.002 file - promoters60/1397821
atcttttcaat

SEQ ID NO: 112787 - DNA, 11 bp, Unknown
  misc_feature (1)..( 11): Result.002 file - promoters60/1397821
ctattttaata

SEQ ID NO: 112788 - DNA, 11 bp, Unknown
  misc_feature (1)..( 11): Result.002 file - promoters60/1397821
ttctgttcgta

SEQ ID NO: 112789 - DNA, 11 bp, Unknown
  misc_feature (1)..( 11): Result.002 file - promoters60/1397821
tcaagtttgag

SEQ ID NO: 112790 - DNA, 11 bp, Unknown
  misc_feature (1)..( 11): Result.002 file - promoters60/1397821
tcaattttgct

SEQ ID NO: 112791 - DNA, 11 bp, Unknown
  misc_feature (1)..( 11): Result.002 file - promoters60/1397821
aagagtctgat

SEQ ID NO: 112792 - DNA, 11 bp, Unknown
  misc_feature (1)..( 11): Result.002 file - promoters60/1397821
ctaattttaat

SEQ ID NO: 112793 - DNA, 11 bp, Unknown
  misc_feature (1)..( 11): Result.002 file - promoters60/1397821
acgagcctgat

SEQ ID NO: 112794 - DNA, 9 bp, Unknown
  misc_feature (1)..( 9): Result.002 file - promoters60/1397821
aaaacattg

SEQ ID NO: 112795 - DNA, 9 bp, Unknown
  misc_feature (1)..( 9): Result.002 file - promoters60/1397821
aaaacagtg

SEQ ID NO: 112796 - DNA, 9 bp, Unknown
  misc_feature (1)..( 9): Result.002 file - promoters60/1397821
aaaaaattc

SEQ ID NO: 112797 - DNA, 9 bp, Unknown
  misc_feature (1)..( 9): Result.002 file - promoters60/1397821
aaaacattg

SEQ ID NO: 112798 - DNA, 9 bp, Unknown
  misc_feature (1)..( 9): Result.002 file - promoters60/1397821
aaaataata

SEQ ID NO: 112799 - DNA, 10 bp, Unknown
  misc_feature (1)..( 10): Result.002 file - promoters60/1397867
tttggtttct

SEQ ID NO: 112800 - DNA, 10 bp, Unknown
  misc_feature (1)..( 10): Result.002 file - promoters60/1397867
tttggattct

SEQ ID NO: 112801 - DNA, 10 bp, Unknown
  misc_feature (1)..( 10): Result.002 file - promoters60/1397867
tttgatttta

SEQ ID NO: 112802 - DNA, 10 bp, Unknown
  misc_feature (1)..( 10): Result.002 file - promoters60/1397867
aatggtttta

SEQ ID NO: 112803 - DNA, 10 bp, Unknown
  misc_feature (1)..( 10): Result.002 file - promoters60/1397867
aatgatttca

SEQ ID NO: 112804 - DNA, 10 bp, Unknown
  misc_feature (1)..( 10): Result.002 file - promoters60/1397867
tatgaattct

SEQ ID NO: 112805 - DNA, 10 bp, Unknown
  misc_feature (1)..( 10): Result.002 file - promoters60/1397867
aatggttaat

SEQ ID NO: 112806 - DNA, 10 bp, Unknown
  misc_feature (1)..( 10): Result.002 file - promoters60/1397867
acttcatatg

SEQ ID NO: 112807 - DNA, 10 bp, Unknown
  misc_feature (1)..( 10): Result.002 file - promoters60/1397867
gattcatata

SEQ ID NO: 112808 - DNA, 10 bp, Unknown
  misc_feature (1)..( 10): Result.002 file - promoters60/1397867
tcatcagatg

SEQ ID NO: 112809 - DNA, 10 bp, Unknown
  misc_feature (1)..( 10): Result.002 file - promoters60/1397867
agagcatata

SEQ ID NO: 112810 - DNA, 10 bp, Unknown
  misc_feature (1)..( 10): Result.002 file - promoters60/1397867
cattcatcct

SEQ ID NO: 112811 - DNA, 10 bp, Unknown
  misc_feature (1)..( 10): Result.002 file - promoters60/1397867
cattcaatga

SEQ ID NO: 112812 - DNA, 8 bp, Unknown
  misc_feature (1)..( 8): Result.002 file - promoters60/1397898
ttgtttat

SEQ ID NO: 112813 - DNA, 8 bp, Unknown
  misc_feature (1)..( 8): Result.002 file - promoters60/1397898
ttgtgtat

SEQ ID NO: 112814 - DNA, 7 bp, Unknown
  misc_feature (1)..( 7): Result.002 file - promoters60/1397898
tgtagtt

SEQ ID NO: 112815 - DNA, 7 bp, Unknown
  misc_feature (1)..( 7): Result.002 file - promoters60/1397898
tgtagtt

SEQ ID NO: 112816 - DNA, 6 bp, Unknown
  misc_feature (1)..( 6): Result.002 file - promoters60/1397898
aattct

SEQ ID NO: 112817 - DNA, 6 bp, Unknown
  misc_feature (1)..( 6): Result.002 file - promoters60/1397898
aattct

SEQ ID NO: 112818 - DNA, 6 bp, Unknown
  misc_feature (1)..( 6): Result.002 file - promoters60/1397898
tacata

SEQ ID NO: 112819 - DNA, 6 bp, Unknown
  misc_feature (1)..( 6): Result.002 file - promoters60/1397898
tacata

SEQ ID NO: 112820 - DNA, 8 bp, Unknown
  misc_feature (1)..( 8): Result.002 file - promoters60/1397898
gaattatt

SEQ ID NO: 112821 - DNA, 8 bp, Unknown
  misc_feature (1)..( 8): Result.002 file - promoters60/1397898
gaatgatt

SEQ ID NO: 112822 - DNA, 8 bp, Unknown
  misc_feature (1)..( 8): Result.002 file - promoters60/1397898
taatgata

SEQ ID NO: 112823 - DNA, 7 bp, Unknown
  misc_feature (1)..( 7): Result.002 file - promoters60/1397898
caaggag

SEQ ID NO: 112824 - DNA, 7 bp, Unknown
  misc_feature (1)..( 7): Result.002 file - promoters60/1397898
caacgag

SEQ ID NO: 112825 - DNA, 7 bp, Unknown
  misc_feature (1)..( 7): Result.002 file - promoters60/1397898
atggttg

SEQ ID NO: 112826 - DNA, 7 bp, Unknown
  misc_feature (1)..( 7): Result.002 file - promoters60/1397898
atggttg

SEQ ID NO: 112827 - DNA, 6 bp, Unknown
  misc_feature (1)..( 6): Result.002 file - promoters60/1397898
ttgctg

SEQ ID NO: 112828 - DNA, 6 bp, Unknown
  misc_feature (1)..( 6): Result.002 file - promoters60/1397898
ttgctg

SEQ ID NO: 112829 - DNA, 7 bp, Unknown
  misc_feature (1)..( 7): Result.002 file - promoters60/1397898
tttaaca

SEQ ID NO: 112830 - DNA, 7 bp, Unknown
  misc_feature (1)..( 7): Result.002 file - promoters60/1397898
tttaaca

SEQ ID NO: 112831 - DNA, 11 bp, Unknown
  misc_feature (1)..( 11): Result.002 file - promoters60/1397898
tccttttgtgc

SEQ ID NO: 112832 - DNA, 11 bp, Unknown
  misc_feature (1)..( 11): Result.002 file - promoters60/1397898
tccctttctgc

SEQ ID NO: 112833 - DNA, 10 bp, Unknown
  misc_feature (1)..( 10): Result.002 file - promoters60/1397919
tgtaacaatt

SEQ ID NO: 112834 - DNA, 10 bp, Unknown
  misc_feature (1)..( 10): Result.002 file - promoters60/1397919
aataacaaca

SEQ ID NO: 112835 - DNA, 10 bp, Unknown
  misc_feature (1)..( 10): Result.002 file - promoters60/1397919
tgtgacatgg

SEQ ID NO: 112836 - DNA, 10 bp, Unknown
  misc_feature (1)..( 10): Result.002 file - promoters60/1397919
agtgacaaga

SEQ ID NO: 112837 - DNA, 10 bp, Unknown
  misc_feature (1)..( 10): Result.002 file - promoters60/1397919
gataagaaca

SEQ ID NO: 112838 - DNA, 10 bp, Unknown
  misc_feature (1)..( 10): Result.002 file - promoters60/1397919
atagagaagc

SEQ ID NO: 112839 - DNA, 8 bp, Unknown
  misc_feature (1)..( 8): Result.002 file - promoters60/1397923
cttttttt

SEQ ID NO: 112840 - DNA, 8 bp, Unknown
  misc_feature (1)..( 8): Result.002 file - promoters60/1397923
attttttt

SEQ ID NO: 112841 - DNA, 8 bp, Unknown
  misc_feature (1)..( 8): Result.002 file - promoters60/1397923
ctttttta

SEQ ID NO: 112842 - DNA, 8 bp, Unknown
  misc_feature (1)..( 8): Result.002 file - promoters60/1397923
tttataaa

SEQ ID NO: 112843 - DNA, 8 bp, Unknown
  misc_feature (1)..( 8): Result.002 file - promoters60/1397923
tttgtaaa

SEQ ID NO: 112844 - DNA, 8 bp, Unknown
  misc_feature (1)..( 8): Result.002 file - promoters60/1397923
tttatatt

SEQ ID NO: 112845 - DNA, 8 bp, Unknown
  misc_feature (1)..( 8): Result.002 file - promoters60/1397923
aaaagttt

SEQ ID NO: 112846 - DNA, 8 bp, Unknown
  misc_feature (1)..( 8): Result.002 file - promoters60/1397923
taaatttt

SEQ ID NO: 112847 - DNA, 8 bp, Unknown
  misc_feature (1)..( 8): Result.002 file - promoters60/1397923
aaaatttg

SEQ ID NO: 112848 - DNA, 16 bp, Unknown
  misc_feature (1)..( 16): Result.002 file - promoters60/1397923
taacgaaagtgacatt

SEQ ID NO: 112849 - DNA, 16 bp, Unknown
  misc_feature (1)..( 16): Result.002 file - promoters60/1397923
taacaaaactgacaac

SEQ ID NO: 112850 - DNA, 16 bp, Unknown
  misc_feature (1)..( 16): Result.002 file - promoters60/1397923
taaatcatatgatatt

SEQ ID NO: 112851 - DNA, 7 bp, Unknown
  misc_feature (1)..( 7): Result.002 file - promoters60/1397923
aaacaaa

SEQ ID NO: 112852 - DNA, 7 bp, Unknown
  misc_feature (1)..( 7): Result.002 file - promoters60/1397923
aaaaaaa

SEQ ID NO: 112853 - DNA, 7 bp, Unknown
  misc_feature (1)..( 7): Result.002 file - promoters60/1397923
aaaaaaa

SEQ ID NO: 112854 - DNA, 9 bp, Unknown
  misc_feature (1)..( 9): Result.002 file - promoters60/1397923
attttgttt

SEQ ID NO: 112855 - DNA, 9 bp, Unknown
  misc_feature (1)..( 9): Result.002 file - promoters60/1397923
ctttttttt

SEQ ID NO: 112856 - DNA, 9 bp, Unknown
  misc_feature (1)..( 9): Result.002 file - promoters60/1397923
attttgttg

SEQ ID NO: 112857 - DNA, 9 bp, Unknown
  misc_feature (1)..( 9): Result.002 file - promoters60/1397923
aaataaaaa

SEQ ID NO: 112858 - DNA, 9 bp, Unknown
  misc_feature (1)..( 9): Result.002 file - promoters60/1397923
aaacaaaaa

SEQ ID NO: 112859 - DNA, 9 bp, Unknown
  misc_feature (1)..( 9): Result.002 file - promoters60/1397923
aaagaacag

SEQ ID NO: 112860 - DNA, 10 bp, Unknown
  misc_feature (1)..( 10): Result.002 file - promoters60/1397923
tttaaatata

SEQ ID NO: 112861 - DNA, 10 bp, Unknown
  misc_feature (1)..( 10): Result.002 file - promoters60/1397923
aataattata

SEQ ID NO: 112862 - DNA, 10 bp, Unknown
  misc_feature (1)..( 10): Result.002 file - promoters60/1397923
tttcaattct

SEQ ID NO: 112863 - DNA, 13 bp, Unknown
  misc_feature (1)..( 13): Result.002 file - promoters60/1397923
aaaactttatcct

SEQ ID NO: 112864 - DNA, 13 bp, Unknown
  misc_feature (1)..( 13): Result.002 file - promoters60/1397923
aaaaatttgaaaa

SEQ ID NO: 112865 - DNA, 13 bp, Unknown
  misc_feature (1)..( 13): Result.002 file - promoters60/1397923
gtaaatttgtaaa

SEQ ID NO: 112866 - DNA, 10 bp, Unknown
  misc_feature (1)..( 10): Result.002 file - promoters60/1397923
tcctttgaac

SEQ ID NO: 112867 - DNA, 10 bp, Unknown
  misc_feature (1)..( 10): Result.002 file - promoters60/1397923
aaatttgaaa

SEQ ID NO: 112868 - DNA, 11 bp, Unknown
  misc_feature (1)..( 11): Result.002 file - promoters60/1397923
aaatttgtaaa

SEQ ID NO: 112869 - DNA, 7 bp, Unknown
  misc_feature (1)..( 7): Result.002 file - promoters60/1397923
attttac

SEQ ID NO: 112870 - DNA, 7 bp, Unknown
  misc_feature (1)..( 7): Result.002 file - promoters60/1397923
attttat

SEQ ID NO: 112871 - DNA, 7 bp, Unknown
  misc_feature (1)..( 7): Result.002 file - promoters60/1397923
cttttac

SEQ ID NO: 112872 - DNA, 8 bp, Unknown
  misc_feature (1)..( 8): Result.002 file - promoters60/1398081
ttatatca

SEQ ID NO: 112873 - DNA, 8 bp, Unknown
  misc_feature (1)..( 8): Result.002 file - promoters60/1398081
tcatatca

SEQ ID NO: 112874 - DNA, 8 bp, Unknown
  misc_feature (1)..( 8): Result.002 file - promoters60/1398081
ttagatcg

SEQ ID NO: 112875 - DNA, 8 bp, Unknown
  misc_feature (1)..( 8): Result.002 file - promoters60/1398081
agataagt

SEQ ID NO: 112876 - DNA, 8 bp, Unknown
  misc_feature (1)..( 8): Result.002 file - promoters60/1398081
taataagt

SEQ ID NO: 112877 - DNA, 8 bp, Unknown
  misc_feature (1)..( 8): Result.002 file - promoters60/1398081
agagaaga

SEQ ID NO: 112878 - DNA, 6 bp, Unknown
  misc_feature (1)..( 6): Result.002 file - promoters60/1398081
agtaaa

SEQ ID NO: 112879 - DNA, 6 bp, Unknown
  misc_feature (1)..( 6): Result.002 file - promoters60/1398081
agtaaa

SEQ ID NO: 112880 - DNA, 6 bp, Unknown
  misc_feature (1)..( 6): Result.002 file - promoters60/1398081
agtaaa

SEQ ID NO: 112881 - DNA, 14 bp, Unknown
  misc_feature (1)..( 14): Result.002 file - promoters60/1398081
caacaaaatttggt

SEQ ID NO: 112882 - DNA, 14 bp, Unknown
  misc_feature (1)..( 14): Result.002 file - promoters60/1398081
caataaaagttgca

SEQ ID NO: 112883 - DNA, 14 bp, Unknown
  misc_feature (1)..( 14): Result.002 file - promoters60/1398081
cctacaattttgtt

SEQ ID NO: 112884 - DNA, 14 bp, Unknown
  misc_feature (1)..( 14): Result.002 file - promoters60/1398081
atacataattcata

SEQ ID NO: 112885 - DNA, 15 bp, Unknown
  misc_feature (1)..( 15): Result.002 file - promoters60/1398081
attggttatcttttg

SEQ ID NO: 112886 - DNA, 15 bp, Unknown
  misc_feature (1)..( 15): Result.002 file - promoters60/1398081
atttgttatctattg

SEQ ID NO: 112887 - DNA, 15 bp, Unknown
  misc_feature (1)..( 15): Result.002 file - promoters60/1398081
ctaggatatttttta

SEQ ID NO: 112888 - DNA, 15 bp, Unknown
  misc_feature (1)..( 15): Result.002 file - promoters60/1398081
atgaagaatattttc

SEQ ID NO: 112889 - DNA, 9 bp, Unknown
  misc_feature (1)..( 9): Result.002 file - promoters60/1398081
ttagatatg

SEQ ID NO: 112890 - DNA, 9 bp, Unknown
  misc_feature (1)..( 9): Result.002 file - promoters60/1398081
ttaaataaa

SEQ ID NO: 112891 - DNA, 9 bp, Unknown
  misc_feature (1)..( 9): Result.002 file - promoters60/1398081
caaaataaa

SEQ ID NO: 112892 - DNA, 11 bp, Unknown
  misc_feature (1)..( 11): Result.002 file - promoters60/1398114
aggagagatga

SEQ ID NO: 112893 - DNA, 11 bp, Unknown
  misc_feature (1)..( 11): Result.002 file - promoters60/1398114
cctagagattg

SEQ ID NO: 112894 - DNA, 11 bp, Unknown
  misc_feature (1)..( 11): Result.002 file - promoters60/1398114
gacagagttga

SEQ ID NO: 112895 - DNA, 11 bp, Unknown
  misc_feature (1)..( 11): Result.002 file - promoters60/1398114
caaagaaatga

SEQ ID NO: 112896 - DNA, 11 bp, Unknown
  misc_feature (1)..( 11): Result.002 file - promoters60/1398114
caaacaaatca

SEQ ID NO: 112897 - DNA, 11 bp, Unknown
  misc_feature (1)..( 11): Result.002 file - promoters60/1398114
caaagaaaggt

SEQ ID NO: 112898 - DNA, 11 bp, Unknown
  misc_feature (1)..( 11): Result.002 file - promoters60/1398114
tatagagttgg

SEQ ID NO: 112899 - DNA, 9 bp, Unknown
  misc_feature (1)..( 9): Result.002 file - promoters60/1398114
aaagaacct

SEQ ID NO: 112900 - DNA, 9 bp, Unknown
  misc_feature (1)..( 9): Result.002 file - promoters60/1398114
ctagatcct

SEQ ID NO: 112901 - DNA, 9 bp, Unknown
  misc_feature (1)..( 9): Result.002 file - promoters60/1398114
aaataactg

SEQ ID NO: 112902 - DNA, 9 bp, Unknown
  misc_feature (1)..( 9): Result.002 file - promoters60/1398114
tcataactt

SEQ ID NO: 112903 - DNA, 9 bp, Unknown
  misc_feature (1)..( 9): Result.002 file - promoters60/1398114
taataactc

SEQ ID NO: 112904 - DNA, 9 bp, Unknown
  misc_feature (1)..( 9): Result.002 file - promoters60/1398114
aaataaaat

SEQ ID NO: 112905 - DNA, 14 bp, Unknown
  misc_feature (1)..( 14): Result.002 file - promoters60/1398114
agagttgaatttag

SEQ ID NO: 112906 - DNA, 14 bp, Unknown
  misc_feature (1)..( 14): Result.002 file - promoters60/1398114
ttagtggaaattat

SEQ ID NO: 112907 - DNA, 14 bp, Unknown
  misc_feature (1)..( 14): Result.002 file - promoters60/1398114
tcactggcaatgtt

SEQ ID NO: 112908 - DNA, 14 bp, Unknown
  misc_feature (1)..( 14): Result.002 file - promoters60/1398114
ttactgggttagat

SEQ ID NO: 112909 - DNA, 14 bp, Unknown
  misc_feature (1)..( 14): Result.002 file - promoters60/1398114
aaagcccaaattaa

SEQ ID NO: 112910 - DNA, 14 bp, Unknown
  misc_feature (1)..( 14): Result.002 file - promoters60/1398114
tcagacaaaaataa

SEQ ID NO: 112911 - DNA, 14 bp, Unknown
  misc_feature (1)..( 14): Result.002 file - promoters60/1398114
acaatccaaaggga

SEQ ID NO: 112912 - DNA, 14 bp, Unknown
  misc_feature (1)..( 14): Result.002 file - promoters60/1398114
caaatcgaaatcga

SEQ ID NO: 112913 - DNA, 14 bp, Unknown
  misc_feature (1)..( 14): Result.002 file - promoters60/1398114
caaaaccaaagaaa

SEQ ID NO: 112914 - DNA, 14 bp, Unknown
  misc_feature (1)..( 14): Result.002 file - promoters60/1398114
gcataacaaaaaat

SEQ ID NO: 112915 - DNA, 14 bp, Unknown
  misc_feature (1)..( 14): Result.002 file - promoters60/1398114
gagttggatagctt

SEQ ID NO: 112916 - DNA, 14 bp, Unknown
  misc_feature (1)..( 14): Result.002 file - promoters60/1398114
gtcttacaaagaaa

SEQ ID NO: 112917 - DNA, 9 bp, Unknown
  misc_feature (1)..( 9): Result.002 file - promoters60/1398124
caattattt

SEQ ID NO: 112918 - DNA, 9 bp, Unknown
  misc_feature (1)..( 9): Result.002 file - promoters60/1398124
gcattgttt

SEQ ID NO: 112919 - DNA, 9 bp, Unknown
  misc_feature (1)..( 9): Result.002 file - promoters60/1398124
caaatataa

SEQ ID NO: 112920 - DNA, 9 bp, Unknown
  misc_feature (1)..( 9): Result.002 file - promoters60/1398124
aaaatattt

SEQ ID NO: 112921 - DNA, 11 bp, Unknown
  misc_feature (1)..( 11): Result.002 file - promoters60/1398124
tgttatattaa

SEQ ID NO: 112922 - DNA, 11 bp, Unknown
  misc_feature (1)..( 11): Result.002 file - promoters60/1398124
acttattttat

SEQ ID NO: 112923 - DNA, 11 bp, Unknown
  misc_feature (1)..( 11): Result.002 file - promoters60/1398124
aattattttaa

SEQ ID NO: 112924 - DNA, 11 bp, Unknown
  misc_feature (1)..( 11): Result.002 file - promoters60/1398124
acttgtttcaa

SEQ ID NO: 112925 - DNA, 11 bp, Unknown
  misc_feature (1)..( 11): Result.002 file - promoters60/1398124
ttttgaattca

SEQ ID NO: 112926 - DNA, 11 bp, Unknown
  misc_feature (1)..( 11): Result.002 file - promoters60/1398124
ttatgtattca

SEQ ID NO: 112927 - DNA, 11 bp, Unknown
  misc_feature (1)..( 11): Result.002 file - promoters60/1398124
ttaagtagatt

SEQ ID NO: 112928 - DNA, 11 bp, Unknown
  misc_feature (1)..( 11): Result.002 file - promoters60/1398124
ataattagttt

SEQ ID NO: 112929 - DNA, 11 bp, Unknown
  misc_feature (1)..( 11): Result.002 file - promoters60/1398124
cgaagaagatt

SEQ ID NO: 112930 - DNA, 7 bp, Unknown
  misc_feature (1)..( 7): Result.002 file - promoters60/1398270
cgatttt

SEQ ID NO: 112931 - DNA, 7 bp, Unknown
  misc_feature (1)..( 7): Result.002 file - promoters60/1398270
cgaattt

SEQ ID NO: 112932 - DNA, 7 bp, Unknown
  misc_feature (1)..( 7): Result.002 file - promoters60/1398270
tgcaaac

SEQ ID NO: 112933 - DNA, 7 bp, Unknown
  misc_feature (1)..( 7): Result.002 file - promoters60/1398270
tgcaaac

SEQ ID NO: 112934 - DNA, 9 bp, Unknown
  misc_feature (1)..( 9): Result.002 file - promoters60/1398270
tagaatgga

SEQ ID NO: 112935 - DNA, 9 bp, Unknown
  misc_feature (1)..( 9): Result.002 file - promoters60/1398270
tagaacgga

SEQ ID NO: 112936 - DNA, 7 bp, Unknown
  misc_feature (1)..( 7): Result.002 file - promoters60/1398270
aaacgat

SEQ ID NO: 112937 - DNA, 7 bp, Unknown
  misc_feature (1)..( 7): Result.002 file - promoters60/1398270
aaacgat

SEQ ID NO: 112938 - DNA, 6 bp, Unknown
  misc_feature (1)..( 6): Result.002 file - promoters60/1398270
aaagag

SEQ ID NO: 112939 - DNA, 6 bp, Unknown
  misc_feature (1)..( 6): Result.002 file - promoters60/1398270
aaagag

SEQ ID NO: 112940 - DNA, 6 bp, Unknown
  misc_feature (1)..( 6): Result.002 file - promoters60/1398270
ctcagt

SEQ ID NO: 112941 - DNA, 6 bp, Unknown
  misc_feature (1)..( 6): Result.002 file - promoters60/1398270
ctcagt

SEQ ID NO: 112942 - DNA, 6 bp, Unknown
  misc_feature (1)..( 6): Result.002 file - promoters60/1398270
ttttgt

SEQ ID NO: 112943 - DNA, 6 bp, Unknown
  misc_feature (1)..( 6): Result.002 file - promoters60/1398270
ttttgt

SEQ ID NO: 112944 - DNA, 6 bp, Unknown
  misc_feature (1)..( 6): Result.002 file - promoters60/1398270
taacta

SEQ ID NO: 112945 - DNA, 6 bp, Unknown
  misc_feature (1)..( 6): Result.002 file - promoters60/1398270
taacta

SEQ ID NO: 112946 - DNA, 6 bp, Unknown
  misc_feature (1)..( 6): Result.002 file - promoters60/1398270
tgactc

SEQ ID NO: 112947 - DNA, 6 bp, Unknown
  misc_feature (1)..( 6): Result.002 file - promoters60/1398270
tgactc

SEQ ID NO: 112948 - DNA, 7 bp, Unknown
  misc_feature (1)..( 7): Result.002 file - promoters60/1398270
aaaccaa

SEQ ID NO: 112949 - DNA, 7 bp, Unknown
  misc_feature (1)..( 7): Result.002 file - promoters60/1398270
aaaccaa

SEQ ID NO: 112950 - DNA, 6 bp, Unknown
  misc_feature (1)..( 6): Result.002 file - promoters60/1398270
gaaaaa

SEQ ID NO: 112951 - DNA, 6 bp, Unknown
  misc_feature (1)..( 6): Result.002 file - promoters60/1398270
gaaaaa

SEQ ID NO: 112952 - DNA, 9 bp, Unknown
  misc_feature (1)..( 9): Result.002 file - promoters60/1398270
agattataa

SEQ ID NO: 112953 - DNA, 9 bp, Unknown
  misc_feature (1)..( 9): Result.002 file - promoters60/1398270
agataataa

SEQ ID NO: 112954 - DNA, 7 bp, Unknown
  misc_feature (1)..( 7): Result.002 file - promoters60/1398270
ttaataa

SEQ ID NO: 112955 - DNA, 7 bp, Unknown
  misc_feature (1)..( 7): Result.002 file - promoters60/1398270
ttaataa

SEQ ID NO: 112956 - DNA, 7 bp, Unknown
  misc_feature (1)..( 7): Result.002 file - promoters60/1398270
ttctaaa

SEQ ID NO: 112957 - DNA, 7 bp, Unknown
  misc_feature (1)..( 7): Result.002 file - promoters60/1398270
ttccaaa

SEQ ID NO: 112958 - DNA, 6 bp, Unknown
  misc_feature (1)..( 6): Result.002 file - promoters60/1398270
ccaaac

SEQ ID NO: 112959 - DNA, 6 bp, Unknown
  misc_feature (1)..( 6): Result.002 file - promoters60/1398270
ccaaac

SEQ ID NO: 112960 - DNA, 6 bp, Unknown
  misc_feature (1)..( 6): Result.002 file - promoters60/1398270
ggtttt

SEQ ID NO: 112961 - DNA, 6 bp, Unknown
  misc_feature (1)..( 6): Result.002 file - promoters60/1398270
ggtttt

SEQ ID NO: 112962 - DNA, 6 bp, Unknown
  misc_feature (1)..( 6): Result.002 file - promoters60/1398270
ttaatt

SEQ ID NO: 112963 - DNA, 6 bp, Unknown
  misc_feature (1)..( 6): Result.002 file - promoters60/1398270
ttaatt

SEQ ID NO: 112964 - DNA, 8 bp, Unknown
  misc_feature (1)..( 8): Result.002 file - promoters60/1398270
gttagtat

SEQ ID NO: 112965 - DNA, 8 bp, Unknown
  misc_feature (1)..( 8): Result.002 file - promoters60/1398270
gttcgtat

SEQ ID NO: 112966 - DNA, 6 bp, Unknown
  misc_feature (1)..( 6): Result.002 file - promoters60/1398270
ttggcg

SEQ ID NO: 112967 - DNA, 6 bp, Unknown
  misc_feature (1)..( 6): Result.002 file - promoters60/1398270
ttggcg

SEQ ID NO: 112968 - DNA, 7 bp, Unknown
  misc_feature (1)..( 7): Result.002 file - promoters60/1398270
atattta

SEQ ID NO: 112969 - DNA, 7 bp, Unknown
  misc_feature (1)..( 7): Result.002 file - promoters60/1398270
atattta

SEQ ID NO: 112970 - DNA, 7 bp, Unknown
  misc_feature (1)..( 7): Result.002 file - promoters60/1398328
acgcagc

SEQ ID NO: 112971 - DNA, 7 bp, Unknown
  misc_feature (1)..( 7): Result.002 file - promoters60/1398328
acgaagc

SEQ ID NO: 112972 - DNA, 7 bp, Unknown
  misc_feature (1)..( 7): Result.002 file - promoters60/1398328
caatttt

SEQ ID NO: 112973 - DNA, 7 bp, Unknown
  misc_feature (1)..( 7): Result.002 file - promoters60/1398328
caatttt

SEQ ID NO: 112974 - DNA, 6 bp, Unknown
  misc_feature (1)..( 6): Result.002 file - promoters60/1398328
gaaaaa

SEQ ID NO: 112975 - DNA, 6 bp, Unknown
  misc_feature (1)..( 6): Result.002 file - promoters60/1398328
gaaaaa

SEQ ID NO: 112976 - DNA, 6 bp, Unknown
  misc_feature (1)..( 6): Result.002 file - promoters60/1398328
taataa

SEQ ID NO: 112977 - DNA, 6 bp, Unknown
  misc_feature (1)..( 6): Result.002 file - promoters60/1398328
taataa

SEQ ID NO: 112978 - DNA, 9 bp, Unknown
  misc_feature (1)..( 9): Result.002 file - promoters60/1398328
agaacccta

SEQ ID NO: 112979 - DNA, 9 bp, Unknown
  misc_feature (1)..( 9): Result.002 file - promoters60/1398328
agaacgcta

SEQ ID NO: 112980 - DNA, 6 bp, Unknown
  misc_feature (1)..( 6): Result.002 file - promoters60/1398328
attgag

SEQ ID NO: 112981 - DNA, 6 bp, Unknown
  misc_feature (1)..( 6): Result.002 file - promoters60/1398328
attgag

SEQ ID NO: 112982 - DNA, 7 bp, Unknown
  misc_feature (1)..( 7): Result.002 file - promoters60/1398328
gataatt

SEQ ID NO: 112983 - DNA, 7 bp, Unknown
  misc_feature (1)..( 7): Result.002 file - promoters60/1398328
gataatt

SEQ ID NO: 112984 - DNA, 6 bp, Unknown
  misc_feature (1)..( 6): Result.002 file - promoters60/1398328
tccttg

SEQ ID NO: 112985 - DNA, 6 bp, Unknown
  misc_feature (1)..( 6): Result.002 file - promoters60/1398328
tccttg

SEQ ID NO: 112986 - DNA, 6 bp, Unknown
  misc_feature (1)..( 6): Result.002 file - promoters60/1398328
aattaa

SEQ ID NO: 112987 - DNA, 6 bp, Unknown
  misc_feature (1)..( 6): Result.002 file - promoters60/1398328
aattaa

SEQ ID NO: 112988 - DNA, 7 bp, Unknown
  misc_feature (1)..( 7): Result.002 file - promoters60/1398328
gatgaca

SEQ ID NO: 112989 - DNA, 7 bp, Unknown
  misc_feature (1)..( 7): Result.002 file - promoters60/1398328
gataaca

SEQ ID NO: 112990 - DNA, 7 bp, Unknown
  misc_feature (1)..( 7): Result.002 file - promoters60/1398328
ttatttc

SEQ ID NO: 112991 - DNA, 7 bp, Unknown
  misc_feature (1)..( 7): Result.002 file - promoters60/1398328
ttagttc

SEQ ID NO: 112992 - DNA, 6 bp, Unknown
  misc_feature (1)..( 6): Result.002 file - promoters60/1398328
ttatat

SEQ ID NO: 112993 - DNA, 6 bp, Unknown
  misc_feature (1)..( 6): Result.002 file - promoters60/1398328
ttatat

SEQ ID NO: 112994 - DNA, 7 bp, Unknown
  misc_feature (1)..( 7): Result.002 file - promoters60/1398328
aaacatt

SEQ ID NO: 112995 - DNA, 7 bp, Unknown
  misc_feature (1)..( 7): Result.002 file - promoters60/1398328
aaaaatt

SEQ ID NO: 112996 - DNA, 9 bp, Unknown
  misc_feature (1)..( 9): Result.002 file - promoters60/1398328
ttgtataaa

SEQ ID NO: 112997 - DNA, 9 bp, Unknown
  misc_feature (1)..( 9): Result.002 file - promoters60/1398328
ttgtataaa

SEQ ID NO: 112998 - DNA, 7 bp, Unknown
  misc_feature (1)..( 7): Result.002 file - promoters60/1398328
aatcgag

SEQ ID NO: 112999 - DNA, 7 bp, Unknown
  misc_feature (1)..( 7): Result.002 file - promoters60/1398328
aatggag

SEQ ID NO: 113000 - DNA, 6 bp, Unknown
  misc_feature (1)..( 6): Result.002 file - promoters60/1398337
taaaga

SEQ ID NO: 113001 - DNA, 6 bp, Unknown
  misc_feature (1)..( 6): Result.002 file - promoters60/1398337
taaaga

SEQ ID NO: 113002 - DNA, 7 bp, Unknown
  misc_feature (1)..( 7): Result.002 file - promoters60/1398337
attgttg

SEQ ID NO: 113003 - DNA, 7 bp, Unknown
  misc_feature (1)..( 7): Result.002 file - promoters60/1398337
atttttg

SEQ ID NO: 113004 - DNA, 6 bp, Unknown
  misc_feature (1)..( 6): Result.002 file - promoters60/1398337
agagag

SEQ ID NO: 113005 - DNA, 6 bp, Unknown
  misc_feature (1)..( 6): Result.002 file - promoters60/1398337
agagag

SEQ ID NO: 113006 - DNA, 8 bp, Unknown
  misc_feature (1)..( 8): Result.002 file - promoters60/1398337
ttttcatt

SEQ ID NO: 113007 - DNA, 8 bp, Unknown
  misc_feature (1)..( 8): Result.002 file - promoters60/1398337
ttttaatt

SEQ ID NO: 113008 - DNA, 11 bp, Unknown
  misc_feature (1)..( 11): Result.002 file - promoters60/1398337
taaacacaaac

SEQ ID NO: 113009 - DNA, 11 bp, Unknown
  misc_feature (1)..( 11): Result.002 file - promoters60/1398337
gaaacaaaaac

SEQ ID NO: 113010 - DNA, 11 bp, Unknown
  misc_feature (1)..( 11): Result.002 file - promoters60/1398337
gaaagaaagct

SEQ ID NO: 113011 - DNA, 6 bp, Unknown
  misc_feature (1)..( 6): Result.002 file - promoters60/1398337
aaccaa

SEQ ID NO: 113012 - DNA, 6 bp, Unknown
  misc_feature (1)..( 6): Result.002 file - promoters60/1398337
aaccaa

SEQ ID NO: 113013 - DNA, 7 bp, Unknown
  misc_feature (1)..( 7): Result.002 file - promoters60/1398337
ttgcctc

SEQ ID NO: 113014 - DNA, 7 bp, Unknown
  misc_feature (1)..( 7): Result.002 file - promoters60/1398337
ttgactc

SEQ ID NO: 113015 - DNA, 6 bp, Unknown
  misc_feature (1)..( 6): Result.002 file - promoters60/1398337
aaagaa

SEQ ID NO: 113016 - DNA, 6 bp, Unknown
  misc_feature (1)..( 6): Result.002 file - promoters60/1398337
aaagaa

SEQ ID NO: 113017 - DNA, 6 bp, Unknown
  misc_feature (1)..( 6): Result.002 file - promoters60/1398337
taattg

SEQ ID NO: 113018 - DNA, 6 bp, Unknown
  misc_feature (1)..( 6): Result.002 file - promoters60/1398337
taattg

SEQ ID NO: 113019 - DNA, 6 bp, Unknown
  misc_feature (1)..( 6): Result.002 file - promoters60/1398337
aataaa

SEQ ID NO: 113020 - DNA, 6 bp, Unknown
  misc_feature (1)..( 6): Result.002 file - promoters60/1398337
aataaa

SEQ ID NO: 113021 - DNA, 6 bp, Unknown
  misc_feature (1)..( 6): Result.002 file - promoters60/1398337
agtaaa

SEQ ID NO: 113022 - DNA, 6 bp, Unknown
  misc_feature (1)..( 6): Result.002 file - promoters60/1398337
agtaaa

SEQ ID NO: 113023 - DNA, 7 bp, Unknown
  misc_feature (1)..( 7): Result.002 file - promoters60/1398337
aatcggg

SEQ ID NO: 113024 - DNA, 7 bp, Unknown
  misc_feature (1)..( 7): Result.002 file - promoters60/1398337
aattggg

SEQ ID NO: 113025 - DNA, 10 bp, Unknown
  misc_feature (1)..( 10): Result.002 file - promoters60/1398337
ggaaaagaaa

SEQ ID NO: 113026 - DNA, 10 bp, Unknown
  misc_feature (1)..( 10): Result.002 file - promoters60/1398337
ggaaatgaaa

SEQ ID NO: 113027 - DNA, 7 bp, Unknown
  misc_feature (1)..( 7): Result.002 file - promoters60/1398337
cccacta

SEQ ID NO: 113028 - DNA, 7 bp, Unknown
  misc_feature (1)..( 7): Result.002 file - promoters60/1398337
cccacta

SEQ ID NO: 113029 - DNA, 9 bp, Unknown
  misc_feature (1)..( 9): Result.002 file - promoters60/1398337
aaagaaaag

SEQ ID NO: 113030 - DNA, 9 bp, Unknown
  misc_feature (1)..( 9): Result.002 file - promoters60/1398337
aaagtaaag

SEQ ID NO: 113031 - DNA, 7 bp, Unknown
  misc_feature (1)..( 7): Result.002 file - promoters60/1398337
gtatata

SEQ ID NO: 113032 - DNA, 7 bp, Unknown
  misc_feature (1)..( 7): Result.002 file - promoters60/1398337
gtatata

SEQ ID NO: 113033 - DNA, 8 bp, Unknown
  misc_feature (1)..( 8): Result.002 file - promoters60/1398345
gatttgta

SEQ ID NO: 113034 - DNA, 8 bp, Unknown
  misc_feature (1)..( 8): Result.002 file - promoters60/1398345
gattggta

SEQ ID NO: 113035 - DNA, 8 bp, Unknown
  misc_feature (1)..( 8): Result.002 file - promoters60/1398345
aaaaatat

SEQ ID NO: 113036 - DNA, 8 bp, Unknown
  misc_feature (1)..( 8): Result.002 file - promoters60/1398345
aaaaatat

SEQ ID NO: 113037 - DNA, 8 bp, Unknown
  misc_feature (1)..( 8): Result.002 file - promoters60/1398345
aaacatat

SEQ ID NO: 113038 - DNA, 6 bp, Unknown
  misc_feature (1)..( 6): Result.002 file - promoters60/1398345
tcatca

SEQ ID NO: 113039 - DNA, 6 bp, Unknown
  misc_feature (1)..( 6): Result.002 file - promoters60/1398345
tcatca

SEQ ID NO: 113040 - DNA, 7 bp, Unknown
  misc_feature (1)..( 7): Result.002 file - promoters60/1398345
cacccct

SEQ ID NO: 113041 - DNA, 7 bp, Unknown
  misc_feature (1)..( 7): Result.002 file - promoters60/1398345
cactcct

SEQ ID NO: 113042 - DNA, 7 bp, Unknown
  misc_feature (1)..( 7): Result.002 file - promoters60/1398345
ctataaa

SEQ ID NO: 113043 - DNA, 7 bp, Unknown
  misc_feature (1)..( 7): Result.002 file - promoters60/1398345
ctataaa

SEQ ID NO: 113044 - DNA, 6 bp, Unknown
  misc_feature (1)..( 6): Result.002 file - promoters60/1398345
cggttt

SEQ ID NO: 113045 - DNA, 6 bp, Unknown
  misc_feature (1)..( 6): Result.002 file - promoters60/1398345
cggttt

SEQ ID NO: 113046 - DNA, 7 bp, Unknown
  misc_feature (1)..( 7): Result.002 file - promoters60/1398345
tttgagc

SEQ ID NO: 113047 - DNA, 7 bp, Unknown
  misc_feature (1)..( 7): Result.002 file - promoters60/1398345
tttaagc

SEQ ID NO: 113048 - DNA, 6 bp, Unknown
  misc_feature (1)..( 6): Result.002 file - promoters60/1398345
gtttgg

SEQ ID NO: 113049 - DNA, 6 bp, Unknown
  misc_feature (1)..( 6): Result.002 file - promoters60/1398345
gtttgg

SEQ ID NO: 113050 - DNA, 6 bp, Unknown
  misc_feature (1)..( 6): Result.002 file - promoters60/1398345
aagaaa

SEQ ID NO: 113051 - DNA, 6 bp, Unknown
  misc_feature (1)..( 6): Result.002 file - promoters60/1398345
aagaaa

SEQ ID NO: 113052 - DNA, 10 bp, Unknown
  misc_feature (1)..( 10): Result.002 file - promoters60/1398401
tcatatgcat

SEQ ID NO: 113053 - DNA, 10 bp, Unknown
  misc_feature (1)..( 10): Result.002 file - promoters60/1398401
acatgtgcat

SEQ ID NO: 113054 - DNA, 10 bp, Unknown
  misc_feature (1)..( 10): Result.002 file - promoters60/1398401
tcagatgtac

SEQ ID NO: 113055 - DNA, 10 bp, Unknown
  misc_feature (1)..( 10): Result.002 file - promoters60/1398401
tcaaaaaacg

SEQ ID NO: 113056 - DNA, 10 bp, Unknown
  misc_feature (1)..( 10): Result.002 file - promoters60/1398401
gtaaaatacg

SEQ ID NO: 113057 - DNA, 10 bp, Unknown
  misc_feature (1)..( 10): Result.002 file - promoters60/1398401
gtagaatgta

SEQ ID NO: 113058 - DNA, 7 bp, Unknown
  misc_feature (1)..( 7): Result.002 file - promoters60/1398401
agaaaga

SEQ ID NO: 113059 - DNA, 7 bp, Unknown
  misc_feature (1)..( 7): Result.002 file - promoters60/1398401
agaaagt

SEQ ID NO: 113060 - DNA, 7 bp, Unknown
  misc_feature (1)..( 7): Result.002 file - promoters60/1398401
ggaaagt

SEQ ID NO: 113061 - DNA, 8 bp, Unknown
  misc_feature (1)..( 8): Result.002 file - promoters60/1398401
atttgtaa

SEQ ID NO: 113062 - DNA, 8 bp, Unknown
  misc_feature (1)..( 8): Result.002 file - promoters60/1398401
atttgtat

SEQ ID NO: 113063 - DNA, 8 bp, Unknown
  misc_feature (1)..( 8): Result.002 file - promoters60/1398401
atttctat

SEQ ID NO: 113064 - DNA, 9 bp, Unknown
  misc_feature (1)..( 9): Result.002 file - promoters60/1398401
ttgtagttt

SEQ ID NO: 113065 - DNA, 9 bp, Unknown
  misc_feature (1)..( 9): Result.002 file - promoters60/1398401
aggtacttt

SEQ ID NO: 113066 - DNA, 9 bp, Unknown
  misc_feature (1)..( 9): Result.002 file - promoters60/1398401
aggaactaa

SEQ ID NO: 113067 - DNA, 9 bp, Unknown
  misc_feature (1)..( 9): Result.002 file - promoters60/1398401
gaaatagtt

SEQ ID NO: 113068 - DNA, 9 bp, Unknown
  misc_feature (1)..( 9): Result.002 file - promoters60/1398401
gaaattgtt

SEQ ID NO: 113069 - DNA, 9 bp, Unknown
  misc_feature (1)..( 9): Result.002 file - promoters60/1398401
gaaatatct

SEQ ID NO: 113070 - DNA, 9 bp, Unknown
  misc_feature (1)..( 9): Result.002 file - promoters60/1398401
ttacgaaat

SEQ ID NO: 113071 - DNA, 9 bp, Unknown
  misc_feature (1)..( 9): Result.002 file - promoters60/1398401
ttaagaaga

SEQ ID NO: 113072 - DNA, 9 bp, Unknown
  misc_feature (1)..( 9): Result.002 file - promoters60/1398401
ttaaaaaga

SEQ ID NO: 113073 - DNA, 13 bp, Unknown
  misc_feature (1)..( 13): Result.002 file - promoters60/1398444
aaaaaaaataact

SEQ ID NO: 113074 - DNA, 13 bp, Unknown
  misc_feature (1)..( 13): Result.002 file - promoters60/1398444
ggctaaactaact

SEQ ID NO: 113075 - DNA, 13 bp, Unknown
  misc_feature (1)..( 13): Result.002 file - promoters60/1398444
aaagaaaataaac

SEQ ID NO: 113076 - DNA, 9 bp, Unknown
  misc_feature (1)..( 9): Result.002 file - promoters60/1398444
attgaagct

SEQ ID NO: 113077 - DNA, 9 bp, Unknown
  misc_feature (1)..( 9): Result.002 file - promoters60/1398444
attcaaggt

SEQ ID NO: 113078 - DNA, 9 bp, Unknown
  misc_feature (1)..( 9): Result.002 file - promoters60/1398444
tatgatgct

SEQ ID NO: 113079 - DNA, 15 bp, Unknown
  misc_feature (1)..( 15): Result.002 file - promoters60/1398444
tccttaataaacaat

SEQ ID NO: 113080 - DNA, 15 bp, Unknown
  misc_feature (1)..( 15): Result.002 file - promoters60/1398444
aatttaaaaaataat

SEQ ID NO: 113081 - DNA, 15 bp, Unknown
  misc_feature (1)..( 15): Result.002 file - promoters60/1398444
aatctaaaattacaa

SEQ ID NO: 113082 - DNA, 7 bp, Unknown
  misc_feature (1)..( 7): Result.002 file - promoters60/1398444
ggaatga

SEQ ID NO: 113083 - DNA, 7 bp, Unknown
  misc_feature (1)..( 7): Result.002 file - promoters60/1398444
ggattga

SEQ ID NO: 113084 - DNA, 7 bp, Unknown
  misc_feature (1)..( 7): Result.002 file - promoters60/1398444
tgattga

SEQ ID NO: 113085 - DNA, 7 bp, Unknown
  misc_feature (1)..( 7): Result.002 file - promoters60/1398444
aatgatt

SEQ ID NO: 113086 - DNA, 7 bp, Unknown
  misc_feature (1)..( 7): Result.002 file - promoters60/1398444
tatgatt

SEQ ID NO: 113087 - DNA, 7 bp, Unknown
  misc_feature (1)..( 7): Result.002 file - promoters60/1398444
tataatt

SEQ ID NO: 113088 - DNA, 11 bp, Unknown
  misc_feature (1)..( 11): Result.002 file - promoters60/1398444
aaagtataaat

SEQ ID NO: 113089 - DNA, 11 bp, Unknown
  misc_feature (1)..( 11): Result.002 file - promoters60/1398444
aaattataaat

SEQ ID NO: 113090 - DNA, 11 bp, Unknown
  misc_feature (1)..( 11): Result.002 file - promoters60/1398444
aaactattata

SEQ ID NO: 113091 - DNA, 10 bp, Unknown
  misc_feature (1)..( 10): Result.002 file - promoters60/1398444
gattaaaatg

SEQ ID NO: 113092 - DNA, 10 bp, Unknown
  misc_feature (1)..( 10): Result.002 file - promoters60/1398444
gatgaaaaat

SEQ ID NO: 113093 - DNA, 10 bp, Unknown
  misc_feature (1)..( 10): Result.002 file - promoters60/1398444
ggttaatatg

SEQ ID NO: 113094 - DNA, 8 bp, Unknown
  misc_feature (1)..( 8): Result.002 file - promoters60/1398444
tctaattt

SEQ ID NO: 113095 - DNA, 8 bp, Unknown
  misc_feature (1)..( 8): Result.002 file - promoters60/1398444
tctagttt

SEQ ID NO: 113096 - DNA, 8 bp, Unknown
  misc_feature (1)..( 8): Result.002 file - promoters60/1398444
tataattt

SEQ ID NO: 113097 - DNA, 9 bp, Unknown
  misc_feature (1)..( 9): Result.002 file - promoters60/1398444
gaaacaaag

SEQ ID NO: 113098 - DNA, 9 bp, Unknown
  misc_feature (1)..( 9): Result.002 file - promoters60/1398444
ctgacaaag

SEQ ID NO: 113099 - DNA, 9 bp, Unknown
  misc_feature (1)..( 9): Result.002 file - promoters60/1398444
gaaataaac

SEQ ID NO: 113100 - DNA, 8 bp, Unknown
  misc_feature (1)..( 8): Result.002 file - promoters60/1398558
ttatataa

SEQ ID NO: 113101 - DNA, 8 bp, Unknown
  misc_feature (1)..( 8): Result.002 file - promoters60/1398558
ttagataa

SEQ ID NO: 113102 - DNA, 8 bp, Unknown
  misc_feature (1)..( 8): Result.002 file - promoters60/1398558
gtatataa

SEQ ID NO: 113103 - DNA, 12 bp, Unknown
  misc_feature (1)..( 12): Result.002 file - promoters60/1398558
tgaaaaagtaat

SEQ ID NO: 113104 - DNA, 12 bp, Unknown
  misc_feature (1)..( 12): Result.002 file - promoters60/1398558
tcaaaaggtatc

SEQ ID NO: 113105 - DNA, 12 bp, Unknown
  misc_feature (1)..( 12): Result.002 file - promoters60/1398558
tgataaactaat

SEQ ID NO: 113106 - DNA, 7 bp, Unknown
  misc_feature (1)..( 7): Result.002 file - promoters60/1398558
tatgtaa

SEQ ID NO: 113107 - DNA, 7 bp, Unknown
  misc_feature (1)..( 7): Result.002 file - promoters60/1398558
tatttaa

SEQ ID NO: 113108 - DNA, 7 bp, Unknown
  misc_feature (1)..( 7): Result.002 file - promoters60/1398558
gatttaa

SEQ ID NO: 113109 - DNA, 11 bp, Unknown
  misc_feature (1)..( 11): Result.002 file - promoters60/1398565
tttgtatttta

SEQ ID NO: 113110 - DNA, 11 bp, Unknown
  misc_feature (1)..( 11): Result.002 file - promoters60/1398565
tttctatacaa

SEQ ID NO: 113111 - DNA, 11 bp, Unknown
  misc_feature (1)..( 11): Result.002 file - promoters60/1398565
actgtagttta

SEQ ID NO: 113112 - DNA, 7 bp, Unknown
  misc_feature (1)..( 7): Result.002 file - promoters60/1398565
tatttaa

SEQ ID NO: 113113 - DNA, 7 bp, Unknown
  misc_feature (1)..( 7): Result.002 file - promoters60/1398565
tatgtaa

SEQ ID NO: 113114 - DNA, 7 bp, Unknown
  misc_feature (1)..( 7): Result.002 file - promoters60/1398565
ttacttg

SEQ ID NO: 113115 - DNA, 7 bp, Unknown
  misc_feature (1)..( 7): Result.002 file - promoters60/1398565
ttatttg

SEQ ID NO: 113116 - DNA, 7 bp, Unknown
  misc_feature (1)..( 7): Result.002 file - promoters60/1398565
tctaatt

SEQ ID NO: 113117 - DNA, 7 bp, Unknown
  misc_feature (1)..( 7): Result.002 file - promoters60/1398565
tctgatt

SEQ ID NO: 113118 - DNA, 8 bp, Unknown
  misc_feature (1)..( 8): Result.002 file - promoters60/1398565
acaaacca

SEQ ID NO: 113119 - DNA, 8 bp, Unknown
  misc_feature (1)..( 8): Result.002 file - promoters60/1398565
acacacca

SEQ ID NO: 113120 - DNA, 7 bp, Unknown
  misc_feature (1)..( 7): Result.002 file - promoters60/1398565
aagcata

SEQ ID NO: 113121 - DNA, 7 bp, Unknown
  misc_feature (1)..( 7): Result.002 file - promoters60/1398565
aagtata

SEQ ID NO: 113122 - DNA, 13 bp, Unknown
  misc_feature (1)..( 13): Result.002 file - promoters60/1398565
aatctaaaaacta

SEQ ID NO: 113123 - DNA, 13 bp, Unknown
  misc_feature (1)..( 13): Result.002 file - promoters60/1398565
aatataaaaatat

SEQ ID NO: 113124 - DNA, 13 bp, Unknown
  misc_feature (1)..( 13): Result.002 file - promoters60/1398565
tatatgaaaatat

SEQ ID NO: 113125 - DNA, 7 bp, Unknown
  misc_feature (1)..( 7): Result.002 file - promoters60/1398565
ttttaaa

SEQ ID NO: 113126 - DNA, 7 bp, Unknown
  misc_feature (1)..( 7): Result.002 file - promoters60/1398565
tttcaaa

SEQ ID NO: 113127 - DNA, 8 bp, Unknown
  misc_feature (1)..( 8): Result.002 file - promoters60/1398565
atatatat

SEQ ID NO: 113128 - DNA, 8 bp, Unknown
  misc_feature (1)..( 8): Result.002 file - promoters60/1398565
atatatat

SEQ ID NO: 113129 - DNA, 8 bp, Unknown
  misc_feature (1)..( 8): Result.002 file - promoters60/1398565
gtatataa

SEQ ID NO: 113130 - DNA, 7 bp, Unknown
  misc_feature (1)..( 7): Result.002 file - promoters60/1398565
aagaaaa

SEQ ID NO: 113131 - DNA, 7 bp, Unknown
  misc_feature (1)..( 7): Result.002 file - promoters60/1398565
aagcaaa

SEQ ID NO: 113132 - DNA, 6 bp, Unknown
  misc_feature (1)..( 6): Result.002 file - promoters60/1398565
caaaaa

SEQ ID NO: 113133 - DNA, 6 bp, Unknown
  misc_feature (1)..( 6): Result.002 file - promoters60/1398565
caaaaa

SEQ ID NO: 113134 - DNA, 7 bp, Unknown
  misc_feature (1)..( 7): Result.002 file - promoters60/1398565
aaacaaa

SEQ ID NO: 113135 - DNA, 7 bp, Unknown
  misc_feature (1)..( 7): Result.002 file - promoters60/1398565
aaacaaa

SEQ ID NO: 113136 - DNA, 6 bp, Unknown
  misc_feature (1)..( 6): Result.002 file - promoters60/1398565
aatata

SEQ ID NO: 113137 - DNA, 6 bp, Unknown
  misc_feature (1)..( 6): Result.002 file - promoters60/1398565
aatata

SEQ ID NO: 113138 - DNA, 7 bp, Unknown
  misc_feature (1)..( 7): Result.002 file - promoters60/1398565
aatgaat

SEQ ID NO: 113139 - DNA, 7 bp, Unknown
  misc_feature (1)..( 7): Result.002 file - promoters60/1398565
aataaat

SEQ ID NO: 113140 - DNA, 6 bp, Unknown
  misc_feature (1)..( 6): Result.002 file - promoters60/1398565
gataga

SEQ ID NO: 113141 - DNA, 6 bp, Unknown
  misc_feature (1)..( 6): Result.002 file - promoters60/1398565
gataga

SEQ ID NO: 113142 - DNA, 7 bp, Unknown
  misc_feature (1)..( 7): Result.002 file - promoters60/1398565
aaattca

SEQ ID NO: 113143 - DNA, 7 bp, Unknown
  misc_feature (1)..( 7): Result.002 file - promoters60/1398565
aaactca

SEQ ID NO: 113144 - DNA, 9 bp, Unknown
  misc_feature (1)..( 9): Result.002 file - promoters60/1398704
accgttcat

SEQ ID NO: 113145 - DNA, 9 bp, Unknown
  misc_feature (1)..( 9): Result.002 file - promoters60/1398704
tccgatcat

SEQ ID NO: 113146 - DNA, 9 bp, Unknown
  misc_feature (1)..( 9): Result.002 file - promoters60/1398704
accgttaaa

SEQ ID NO: 113147 - DNA, 6 bp, Unknown
  misc_feature (1)..( 6): Result.002 file - promoters60/1398704
tatatc

SEQ ID NO: 113148 - DNA, 6 bp, Unknown
  misc_feature (1)..( 6): Result.002 file - promoters60/1398704
tatatc

SEQ ID NO: 113149 - DNA, 7 bp, Unknown
  misc_feature (1)..( 7): Result.002 file - promoters60/1398704
ttagtgt

SEQ ID NO: 113150 - DNA, 7 bp, Unknown
  misc_feature (1)..( 7): Result.002 file - promoters60/1398704
ttattgt

SEQ ID NO: 113151 - DNA, 7 bp, Unknown
  misc_feature (1)..( 7): Result.002 file - promoters60/1398704
ttttcta

SEQ ID NO: 113152 - DNA, 7 bp, Unknown
  misc_feature (1)..( 7): Result.002 file - promoters60/1398704
tttccta

SEQ ID NO: 113153 - DNA, 6 bp, Unknown
  misc_feature (1)..( 6): Result.002 file - promoters60/1398704
gtcttc

SEQ ID NO: 113154 - DNA, 6 bp, Unknown
  misc_feature (1)..( 6): Result.002 file - promoters60/1398704
gtcttc

SEQ ID NO: 113155 - DNA, 7 bp, Unknown
  misc_feature (1)..( 7): Result.002 file - promoters60/1398704
catacaa

SEQ ID NO: 113156 - DNA, 7 bp, Unknown
  misc_feature (1)..( 7): Result.002 file - promoters60/1398704
cattcaa

SEQ ID NO: 113157 - DNA, 7 bp, Unknown
  misc_feature (1)..( 7): Result.002 file - promoters60/1398704
caataca

SEQ ID NO: 113158 - DNA, 7 bp, Unknown
  misc_feature (1)..( 7): Result.002 file - promoters60/1398704
caaaaca

SEQ ID NO: 113159 - DNA, 7 bp, Unknown
  misc_feature (1)..( 7): Result.002 file - promoters60/1398704
aacacga

SEQ ID NO: 113160 - DNA, 7 bp, Unknown
  misc_feature (1)..( 7): Result.002 file - promoters60/1398704
aactcga

SEQ ID NO: 113161 - DNA, 7 bp, Unknown
  misc_feature (1)..( 7): Result.002 file - promoters60/1398704
ttcttct

SEQ ID NO: 113162 - DNA, 7 bp, Unknown
  misc_feature (1)..( 7): Result.002 file - promoters60/1398704
ttcttct

SEQ ID NO: 113163 - DNA, 7 bp, Unknown
  misc_feature (1)..( 7): Result.002 file - promoters60/1398704
ccaatag

SEQ ID NO: 113164 - DNA, 7 bp, Unknown
  misc_feature (1)..( 7): Result.002 file - promoters60/1398704
ccattag

SEQ ID NO: 113165 - DNA, 6 bp, Unknown
  misc_feature (1)..( 6): Result.002 file - promoters60/1398704
tttttg

SEQ ID NO: 113166 - DNA, 6 bp, Unknown
  misc_feature (1)..( 6): Result.002 file - promoters60/1398704
tttttg

SEQ ID NO: 113167 - DNA, 11 bp, Unknown
  misc_feature (1)..( 11): Result.002 file - promoters60/1398704
attgttgtttt

SEQ ID NO: 113168 - DNA, 11 bp, Unknown
  misc_feature (1)..( 11): Result.002 file - promoters60/1398704
attgttttttt

SEQ ID NO: 113169 - DNA, 7 bp, Unknown
  misc_feature (1)..( 7): Result.002 file - promoters60/1398704
aaaaaag

SEQ ID NO: 113170 - DNA, 7 bp, Unknown
  misc_feature (1)..( 7): Result.002 file - promoters60/1398704
aaagaag

SEQ ID NO: 113171 - DNA, 7 bp, Unknown
  misc_feature (1)..( 7): Result.002 file - promoters60/1398704
acacaat

SEQ ID NO: 113172 - DNA, 7 bp, Unknown
  misc_feature (1)..( 7): Result.002 file - promoters60/1398704
acaaaat

SEQ ID NO: 113173 - DNA, 8 bp, Unknown
  misc_feature (1)..( 8): Result.002 file - promoters60/1398704
aattttgg

SEQ ID NO: 113174 - DNA, 8 bp, Unknown
  misc_feature (1)..( 8): Result.002 file - promoters60/1398704
aattttgg

SEQ ID NO: 113175 - DNA, 8 bp, Unknown
  misc_feature (1)..( 8): Result.002 file - promoters60/1398737
ttagcttt

SEQ ID NO: 113176 - DNA, 8 bp, Unknown
  misc_feature (1)..( 8): Result.002 file - promoters60/1398737
ttagattt

SEQ ID NO: 113177 - DNA, 8 bp, Unknown
  misc_feature (1)..( 8): Result.002 file - promoters60/1398737
ttagatca

SEQ ID NO: 113178 - DNA, 8 bp, Unknown
  misc_feature (1)..( 8): Result.002 file - promoters60/1398737
ttatattg

SEQ ID NO: 113179 - DNA, 10 bp, Unknown
  misc_feature (1)..( 10): Result.002 file - promoters60/1398737
ctataaaaat

SEQ ID NO: 113180 - DNA, 10 bp, Unknown
  misc_feature (1)..( 10): Result.002 file - promoters60/1398737
ctatcaaatg

SEQ ID NO: 113181 - DNA, 10 bp, Unknown
  misc_feature (1)..( 10): Result.002 file - promoters60/1398737
ctaaaaaaat

SEQ ID NO: 113182 - DNA, 10 bp, Unknown
  misc_feature (1)..( 10): Result.002 file - promoters60/1398737
ttatagaaag

SEQ ID NO: 113183 - DNA, 11 bp, Unknown
  misc_feature (1)..( 11): Result.002 file - promoters60/1398737
gtcaataaaag

SEQ ID NO: 113184 - DNA, 11 bp, Unknown
  misc_feature (1)..( 11): Result.002 file - promoters60/1398737
gtcaataaaaa

SEQ ID NO: 113185 - DNA, 11 bp, Unknown
  misc_feature (1)..( 11): Result.002 file - promoters60/1398737
gcttttaaaaa

SEQ ID NO: 113186 - DNA, 11 bp, Unknown
  misc_feature (1)..( 11): Result.002 file - promoters60/1398737
ccctttgaaat

SEQ ID NO: 113187 - DNA, 11 bp, Unknown
  misc_feature (1)..( 11): Result.002 file - promoters60/1398737
accaaatttaa

SEQ ID NO: 113188 - DNA, 11 bp, Unknown
  misc_feature (1)..( 11): Result.002 file - promoters60/1398737
gtcaattttga

SEQ ID NO: 113189 - DNA, 11 bp, Unknown
  misc_feature (1)..( 11): Result.002 file - promoters60/1398737
cttaatttata

SEQ ID NO: 113190 - DNA, 11 bp, Unknown
  misc_feature (1)..( 11): Result.002 file - promoters60/1398737
cttactttata

SEQ ID NO: 113191 - DNA, 11 bp, Unknown
  misc_feature (1)..( 11): Result.002 file - promoters60/1398737
tttatagaaag

SEQ ID NO: 113192 - DNA, 11 bp, Unknown
  misc_feature (1)..( 11): Result.002 file - promoters60/1398737
tttatagaaaa

SEQ ID NO: 113193 - DNA, 11 bp, Unknown
  misc_feature (1)..( 11): Result.002 file - promoters60/1398737
tttatatatta

SEQ ID NO: 113194 - DNA, 11 bp, Unknown
  misc_feature (1)..( 11): Result.002 file - promoters60/1398737
tgacaagaaaa

SEQ ID NO: 113195 - DNA, 9 bp, Unknown
  misc_feature (1)..( 9): Result.002 file - promoters60/1398737
cattggtta

SEQ ID NO: 113196 - DNA, 9 bp, Unknown
  misc_feature (1)..( 9): Result.002 file - promoters60/1398737
gattagttt

SEQ ID NO: 113197 - DNA, 9 bp, Unknown
  misc_feature (1)..( 9): Result.002 file - promoters60/1398737
gatcagtac

SEQ ID NO: 113198 - DNA, 9 bp, Unknown
  misc_feature (1)..( 9): Result.002 file - promoters60/1398737
atttatttt

SEQ ID NO: 113199 - DNA, 8 bp, Unknown
  misc_feature (1)..( 8): Result.002 file - promoters60/1398784
aattgagt

SEQ ID NO: 113200 - DNA, 8 bp, Unknown
  misc_feature (1)..( 8): Result.002 file - promoters60/1398784
aattaagt

SEQ ID NO: 113201 - DNA, 7 bp, Unknown
  misc_feature (1)..( 7): Result.002 file - promoters60/1398784
gaagcaa

SEQ ID NO: 113202 - DNA, 7 bp, Unknown
  misc_feature (1)..( 7): Result.002 file - promoters60/1398784
gaaacaa

SEQ ID NO: 113203 - DNA, 11 bp, Unknown
  misc_feature (1)..( 11): Result.002 file - promoters60/1398784
gaaaactaaag

SEQ ID NO: 113204 - DNA, 11 bp, Unknown
  misc_feature (1)..( 11): Result.002 file - promoters60/1398784
gaaaattaaag

SEQ ID NO: 113205 - DNA, 11 bp, Unknown
  misc_feature (1)..( 11): Result.002 file - promoters60/1398784
caaaacttaaa

SEQ ID NO: 113206 - DNA, 8 bp, Unknown
  misc_feature (1)..( 8): Result.002 file - promoters60/1398784
aaatcaat

SEQ ID NO: 113207 - DNA, 8 bp, Unknown
  misc_feature (1)..( 8): Result.002 file - promoters60/1398784
aaatgaat

SEQ ID NO: 113208 - DNA, 7 bp, Unknown
  misc_feature (1)..( 7): Result.002 file - promoters60/1398784
aaaattt

SEQ ID NO: 113209 - DNA, 7 bp, Unknown
  misc_feature (1)..( 7): Result.002 file - promoters60/1398784
aaagttt

SEQ ID NO: 113210 - DNA, 10 bp, Unknown
  misc_feature (1)..( 10): Result.002 file - promoters60/1398784
aaagaaaaat

SEQ ID NO: 113211 - DNA, 10 bp, Unknown
  misc_feature (1)..( 10): Result.002 file - promoters60/1398784
gaagaaagaa

SEQ ID NO: 113212 - DNA, 11 bp, Unknown
  misc_feature (1)..( 11): Result.002 file - promoters60/1398784
aaagtaaaatc

SEQ ID NO: 113213 - DNA, 6 bp, Unknown
  misc_feature (1)..( 6): Result.002 file - promoters60/1398784
tttttc

SEQ ID NO: 113214 - DNA, 6 bp, Unknown
  misc_feature (1)..( 6): Result.002 file - promoters60/1398784
tttttc

SEQ ID NO: 113215 - DNA, 6 bp, Unknown
  misc_feature (1)..( 6): Result.002 file - promoters60/1398784
ggaaat

SEQ ID NO: 113216 - DNA, 6 bp, Unknown
  misc_feature (1)..( 6): Result.002 file - promoters60/1398784
ggaaat

SEQ ID NO: 113217 - DNA, 7 bp, Unknown
  misc_feature (1)..( 7): Result.002 file - promoters60/1398784
ctaaaat

SEQ ID NO: 113218 - DNA, 7 bp, Unknown
  misc_feature (1)..( 7): Result.002 file - promoters60/1398784
ataaaat

SEQ ID NO: 113219 - DNA, 7 bp, Unknown
  misc_feature (1)..( 7): Result.002 file - promoters60/1398784
ataaaat

SEQ ID NO: 113220 - DNA, 6 bp, Unknown
  misc_feature (1)..( 6): Result.002 file - promoters60/1398784
ttaaga

SEQ ID NO: 113221 - DNA, 6 bp, Unknown
  misc_feature (1)..( 6): Result.002 file - promoters60/1398784
ttaaga

SEQ ID NO: 113222 - DNA, 7 bp, Unknown
  misc_feature (1)..( 7): Result.002 file - promoters60/1398784
aaatttg

SEQ ID NO: 113223 - DNA, 7 bp, Unknown
  misc_feature (1)..( 7): Result.002 file - promoters60/1398784
aaaattg

SEQ ID NO: 113224 - DNA, 6 bp, Unknown
  misc_feature (1)..( 6): Result.002 file - promoters60/1398784
ccaatt

SEQ ID NO: 113225 - DNA, 6 bp, Unknown
  misc_feature (1)..( 6): Result.002 file - promoters60/1398784
ccaatt

SEQ ID NO: 113226 - DNA, 7 bp, Unknown
  misc_feature (1)..( 7): Result.002 file - promoters60/1398784
ttggaat

SEQ ID NO: 113227 - DNA, 7 bp, Unknown
  misc_feature (1)..( 7): Result.002 file - promoters60/1398784
ttgaaat

SEQ ID NO: 113228 - DNA, 6 bp, Unknown
  misc_feature (1)..( 6): Result.002 file - promoters60/1398784
aatccg

SEQ ID NO: 113229 - DNA, 6 bp, Unknown
  misc_feature (1)..( 6): Result.002 file - promoters60/1398784
aatccg

SEQ ID NO: 113230 - DNA, 6 bp, Unknown
  misc_feature (1)..( 6): Result.002 file - promoters60/1398784
agaagt

SEQ ID NO: 113231 - DNA, 6 bp, Unknown
  misc_feature (1)..( 6): Result.002 file - promoters60/1398784
agaagt

SEQ ID NO: 113232 - DNA, 6 bp, Unknown
  misc_feature (1)..( 6): Result.002 file - promoters60/1398784
aaatga

SEQ ID NO: 113233 - DNA, 6 bp, Unknown
  misc_feature (1)..( 6): Result.002 file - promoters60/1398784
aaatga

SEQ ID NO: 113234 - DNA, 6 bp, Unknown
  misc_feature (1)..( 6): Result.002 file - promoters60/1398784
taaaaa

SEQ ID NO: 113235 - DNA, 6 bp, Unknown
  misc_feature (1)..( 6): Result.002 file - promoters60/1398784
taaaaa

SEQ ID NO: 113236 - DNA, 6 bp, Unknown
  misc_feature (1)..( 6): Result.002 file - promoters60/1398784
aaaatt

SEQ ID NO: 113237 - DNA, 6 bp, Unknown
  misc_feature (1)..( 6): Result.002 file - promoters60/1398784
aaaatt

SEQ ID NO: 113238 - DNA, 8 bp, Unknown
  misc_feature (1)..( 8): Result.002 file - promoters60/1398784
tttcaaat

SEQ ID NO: 113239 - DNA, 8 bp, Unknown
  misc_feature (1)..( 8): Result.002 file - promoters60/1398784
tttcaaat

SEQ ID NO: 113240 - DNA, 6 bp, Unknown
  misc_feature (1)..( 6): Result.002 file - promoters60/1398784
ttttcc

SEQ ID NO: 113241 - DNA, 6 bp, Unknown
  misc_feature (1)..( 6): Result.002 file - promoters60/1398784
ttttcc

SEQ ID NO: 113242 - DNA, 6 bp, Unknown
  misc_feature (1)..( 6): Result.002 file - promoters60/1398799
tgttct

SEQ ID NO: 113243 - DNA, 6 bp, Unknown
  misc_feature (1)..( 6): Result.002 file - promoters60/1398799
tgttct

SEQ ID NO: 113244 - DNA, 6 bp, Unknown
  misc_feature (1)..( 6): Result.002 file - promoters60/1398799
tgttct

SEQ ID NO: 113245 - DNA, 7 bp, Unknown
  misc_feature (1)..( 7): Result.002 file - promoters60/1398799
agatata

SEQ ID NO: 113246 - DNA, 7 bp, Unknown
  misc_feature (1)..( 7): Result.002 file - promoters60/1398799
agatata

SEQ ID NO: 113247 - DNA, 11 bp, Unknown
  misc_feature (1)..( 11): Result.002 file - promoters60/1398799
ataaacaagaa

SEQ ID NO: 113248 - DNA, 11 bp, Unknown
  misc_feature (1)..( 11): Result.002 file - promoters60/1398799
ataaccaagaa

SEQ ID NO: 113249 - DNA, 10 bp, Unknown
  misc_feature (1)..( 10): Result.002 file - promoters60/1398799
cattcatttg

SEQ ID NO: 113250 - DNA, 10 bp, Unknown
  misc_feature (1)..( 10): Result.002 file - promoters60/1398799
gagtcatttg

SEQ ID NO: 113251 - DNA, 10 bp, Unknown
  misc_feature (1)..( 10): Result.002 file - promoters60/1398799
gagtaattgt

SEQ ID NO: 113252 - DNA, 8 bp, Unknown
  misc_feature (1)..( 8): Result.002 file - promoters60/1398799
attattac

SEQ ID NO: 113253 - DNA, 8 bp, Unknown
  misc_feature (1)..( 8): Result.002 file - promoters60/1398799
attactac

SEQ ID NO: 113254 - DNA, 6 bp, Unknown
  misc_feature (1)..( 6): Result.002 file - promoters60/1398799
acataa

SEQ ID NO: 113255 - DNA, 6 bp, Unknown
  misc_feature (1)..( 6): Result.002 file - promoters60/1398799
acataa

SEQ ID NO: 113256 - DNA, 9 bp, Unknown
  misc_feature (1)..( 9): Result.002 file - promoters60/1398799
ttaaaaacc

SEQ ID NO: 113257 - DNA, 9 bp, Unknown
  misc_feature (1)..( 9): Result.002 file - promoters60/1398799
ataaatacc

SEQ ID NO: 113258 - DNA, 9 bp, Unknown
  misc_feature (1)..( 9): Result.002 file - promoters60/1398799
ataaatctt

SEQ ID NO: 113259 - DNA, 7 bp, Unknown
  misc_feature (1)..( 7): Result.002 file - promoters60/1398799
gctgctg

SEQ ID NO: 113260 - DNA, 7 bp, Unknown
  misc_feature (1)..( 7): Result.002 file - promoters60/1398799
gctgctg

SEQ ID NO: 113261 - DNA, 9 bp, Unknown
  misc_feature (1)..( 9): Result.002 file - promoters60/1398799
tttaagtct

SEQ ID NO: 113262 - DNA, 9 bp, Unknown
  misc_feature (1)..( 9): Result.002 file - promoters60/1398799
tttaactct

SEQ ID NO: 113263 - DNA, 8 bp, Unknown
  misc_feature (1)..( 8): Result.002 file - promoters60/1398799
gtctacga

SEQ ID NO: 113264 - DNA, 8 bp, Unknown
  misc_feature (1)..( 8): Result.002 file - promoters60/1398799
gtcttcga

SEQ ID NO: 113265 - DNA, 8 bp, Unknown
  misc_feature (1)..( 8): Result.002 file - promoters60/1398799
aatcaagt

SEQ ID NO: 113266 - DNA, 8 bp, Unknown
  misc_feature (1)..( 8): Result.002 file - promoters60/1398799
aattaagt

SEQ ID NO: 113267 - DNA, 9 bp, Unknown
  misc_feature (1)..( 9): Result.002 file - promoters60/1398799
tgggcccat

SEQ ID NO: 113268 - DNA, 9 bp, Unknown
  misc_feature (1)..( 9): Result.002 file - promoters60/1398799
tgggcccat

SEQ ID NO: 113269 - DNA, 7 bp, Unknown
  misc_feature (1)..( 7): Result.002 file - promoters60/1398799
cctttgt

SEQ ID NO: 113270 - DNA, 7 bp, Unknown
  misc_feature (1)..( 7): Result.002 file - promoters60/1398799
cctctgt

SEQ ID NO: 113271 - DNA, 8 bp, Unknown
  misc_feature (1)..( 8): Result.002 file - promoters60/1398799
accctttt

SEQ ID NO: 113272 - DNA, 8 bp, Unknown
  misc_feature (1)..( 8): Result.002 file - promoters60/1398799
accttttt

SEQ ID NO: 113273 - DNA, 7 bp, Unknown
  misc_feature (1)..( 7): Result.002 file - promoters60/1398799
gttatga

SEQ ID NO: 113274 - DNA, 7 bp, Unknown
  misc_feature (1)..( 7): Result.002 file - promoters60/1398799
gttttga

SEQ ID NO: 113275 - DNA, 8 bp, Unknown
  misc_feature (1)..( 8): Result.002 file - promoters60/1398799
cttcatta

SEQ ID NO: 113276 - DNA, 8 bp, Unknown
  misc_feature (1)..( 8): Result.002 file - promoters60/1398799
ctttatta

SEQ ID NO: 113277 - DNA, 6 bp, Unknown
  misc_feature (1)..( 6): Result.002 file - promoters60/1398846
tttact

SEQ ID NO: 113278 - DNA, 6 bp, Unknown
  misc_feature (1)..( 6): Result.002 file - promoters60/1398846
tttact

SEQ ID NO: 113279 - DNA, 6 bp, Unknown
  misc_feature (1)..( 6): Result.002 file - promoters60/1398846
gtttct

SEQ ID NO: 113280 - DNA, 6 bp, Unknown
  misc_feature (1)..( 6): Result.002 file - promoters60/1398846
gtttct

SEQ ID NO: 113281 - DNA, 7 bp, Unknown
  misc_feature (1)..( 7): Result.002 file - promoters60/1398846
tttgtta

SEQ ID NO: 113282 - DNA, 7 bp, Unknown
  misc_feature (1)..( 7): Result.002 file - promoters60/1398846
tttgtta

SEQ ID NO: 113283 - DNA, 7 bp, Unknown
  misc_feature (1)..( 7): Result.002 file - promoters60/1398846
attgtta

SEQ ID NO: 113284 - DNA, 7 bp, Unknown
  misc_feature (1)..( 7): Result.002 file - promoters60/1398846
tatacca

SEQ ID NO: 113285 - DNA, 7 bp, Unknown
  misc_feature (1)..( 7): Result.002 file - promoters60/1398846
tatacca

SEQ ID NO: 113286 - DNA, 6 bp, Unknown
  misc_feature (1)..( 6): Result.002 file - promoters60/1398846
tcctat

SEQ ID NO: 113287 - DNA, 6 bp, Unknown
  misc_feature (1)..( 6): Result.002 file - promoters60/1398846
tcctat

SEQ ID NO: 113288 - DNA, 6 bp, Unknown
  misc_feature (1)..( 6): Result.002 file - promoters60/1398846
aaaaat

SEQ ID NO: 113289 - DNA, 6 bp, Unknown
  misc_feature (1)..( 6): Result.002 file - promoters60/1398846
aaaaat

SEQ ID NO: 113290 - DNA, 6 bp, Unknown
  misc_feature (1)..( 6): Result.002 file - promoters60/1398846
taaact

SEQ ID NO: 113291 - DNA, 6 bp, Unknown
  misc_feature (1)..( 6): Result.002 file - promoters60/1398846
taaact

SEQ ID NO: 113292 - DNA, 6 bp, Unknown
  misc_feature (1)..( 6): Result.002 file - promoters60/1398846
attaat

SEQ ID NO: 113293 - DNA, 6 bp, Unknown
  misc_feature (1)..( 6): Result.002 file - promoters60/1398846
attaat

SEQ ID NO: 113294 - DNA, 9 bp, Unknown
  misc_feature (1)..( 9): Result.002 file - promoters60/1398846
ttaattaga

SEQ ID NO: 113295 - DNA, 9 bp, Unknown
  misc_feature (1)..( 9): Result.002 file - promoters60/1398846
ttaattaaa

SEQ ID NO: 113296 - DNA, 9 bp, Unknown
  misc_feature (1)..( 9): Result.002 file - promoters60/1398846
taaattaaa

SEQ ID NO: 113297 - DNA, 11 bp, Unknown
  misc_feature (1)..( 11): Result.002 file - promoters60/1398846
atatatataaa

SEQ ID NO: 113298 - DNA, 11 bp, Unknown
  misc_feature (1)..( 11): Result.002 file - promoters60/1398846
atatatataaa

SEQ ID NO: 113299 - DNA, 6 bp, Unknown
  misc_feature (1)..( 6): Result.002 file - promoters60/1398846
ttatta

SEQ ID NO: 113300 - DNA, 6 bp, Unknown
  misc_feature (1)..( 6): Result.002 file - promoters60/1398846
ttatta

SEQ ID NO: 113301 - DNA, 7 bp, Unknown
  misc_feature (1)..( 7): Result.002 file - promoters60/1398846
tctcatt

SEQ ID NO: 113302 - DNA, 7 bp, Unknown
  misc_feature (1)..( 7): Result.002 file - promoters60/1398846
tctaatt

SEQ ID NO: 113303 - DNA, 7 bp, Unknown
  misc_feature (1)..( 7): Result.002 file - promoters60/1398846
aaagaaa

SEQ ID NO: 113304 - DNA, 7 bp, Unknown
  misc_feature (1)..( 7): Result.002 file - promoters60/1398846
aaaaaaa

SEQ ID NO: 113305 - DNA, 7 bp, Unknown
  misc_feature (1)..( 7): Result.002 file - promoters60/1398846
ctacccc

SEQ ID NO: 113306 - DNA, 7 bp, Unknown
  misc_feature (1)..( 7): Result.002 file - promoters60/1398846
ctaaccc

SEQ ID NO: 113307 - DNA, 6 bp, Unknown
  misc_feature (1)..( 6): Result.002 file - promoters60/1398846
tcaccc

SEQ ID NO: 113308 - DNA, 6 bp, Unknown
  misc_feature (1)..( 6): Result.002 file - promoters60/1398846
tcaccc

SEQ ID NO: 113309 - DNA, 6 bp, Unknown
  misc_feature (1)..( 6): Result.002 file - promoters60/1398846
attaaa

SEQ ID NO: 113310 - DNA, 6 bp, Unknown
  misc_feature (1)..( 6): Result.002 file - promoters60/1398846
attaaa

SEQ ID NO: 113311 - DNA, 6 bp, Unknown
  misc_feature (1)..( 6): Result.002 file - promoters60/1398846
gaaaaa

SEQ ID NO: 113312 - DNA, 6 bp, Unknown
  misc_feature (1)..( 6): Result.002 file - promoters60/1398846
gaaaaa

SEQ ID NO: 113313 - DNA, 8 bp, Unknown
  misc_feature (1)..( 8): Result.002 file - promoters60/1398846
ttagctta

SEQ ID NO: 113314 - DNA, 8 bp, Unknown
  misc_feature (1)..( 8): Result.002 file - promoters60/1398846
ttagctta

SEQ ID NO: 113315 - DNA, 6 bp, Unknown
  misc_feature (1)..( 6): Result.002 file - promoters60/1398846
ttttca

SEQ ID NO: 113316 - DNA, 6 bp, Unknown
  misc_feature (1)..( 6): Result.002 file - promoters60/1398846
ttttca

SEQ ID NO: 113317 - DNA, 7 bp, Unknown
  misc_feature (1)..( 7): Result.002 file - promoters60/1398846
aagaaac

SEQ ID NO: 113318 - DNA, 7 bp, Unknown
  misc_feature (1)..( 7): Result.002 file - promoters60/1398846
aagaaac

SEQ ID NO: 113319 - DNA, 14 bp, Unknown
  misc_feature (1)..( 14): Result.002 file - promoters60/1399037
catatttgaaatag

SEQ ID NO: 113320 - DNA, 14 bp, Unknown
  misc_feature (1)..( 14): Result.002 file - promoters60/1399037
attctttgaactta

SEQ ID NO: 113321 - DNA, 14 bp, Unknown
  misc_feature (1)..( 14): Result.002 file - promoters60/1399037
aatattcgaaatgg

SEQ ID NO: 113322 - DNA, 14 bp, Unknown
  misc_feature (1)..( 14): Result.002 file - promoters60/1399037
acaatttgaactgt

SEQ ID NO: 113323 - DNA, 14 bp, Unknown
  misc_feature (1)..( 14): Result.002 file - promoters60/1399037
attattttaactta

SEQ ID NO: 113324 - DNA, 14 bp, Unknown
  misc_feature (1)..( 14): Result.002 file - promoters60/1399037
gatcttggaagcaa

SEQ ID NO: 113325 - DNA, 8 bp, Unknown
  misc_feature (1)..( 8): Result.002 file - promoters60/1399074
cgtataga

SEQ ID NO: 113326 - DNA, 8 bp, Unknown
  misc_feature (1)..( 8): Result.002 file - promoters60/1399074
agtaaaga

SEQ ID NO: 113327 - DNA, 8 bp, Unknown
  misc_feature (1)..( 8): Result.002 file - promoters60/1399074
agtaaaaa

SEQ ID NO: 113328 - DNA, 7 bp, Unknown
  misc_feature (1)..( 7): Result.002 file - promoters60/1399074
ttggaac

SEQ ID NO: 113329 - DNA, 7 bp, Unknown
  misc_feature (1)..( 7): Result.002 file - promoters60/1399074
ttgtaac

SEQ ID NO: 113330 - DNA, 10 bp, Unknown
  misc_feature (1)..( 10): Result.002 file - promoters60/1399074
ttaaggaagc

SEQ ID NO: 113331 - DNA, 10 bp, Unknown
  misc_feature (1)..( 10): Result.002 file - promoters60/1399074
gaaagaaagc

SEQ ID NO: 113332 - DNA, 10 bp, Unknown
  misc_feature (1)..( 10): Result.002 file - promoters60/1399074
gaaacaaaaa

SEQ ID NO: 113333 - DNA, 10 bp, Unknown
  misc_feature (1)..( 10): Result.002 file - promoters60/1399074
ggagaagcat

SEQ ID NO: 113334 - DNA, 10 bp, Unknown
  misc_feature (1)..( 10): Result.002 file - promoters60/1399074
ggaaaagaaa

SEQ ID NO: 113335 - DNA, 10 bp, Unknown
  misc_feature (1)..( 10): Result.002 file - promoters60/1399074
ggaaatgaaa

SEQ ID NO: 113336 - DNA, 6 bp, Unknown
  misc_feature (1)..( 6): Result.002 file - promoters60/1399074
agggaa

SEQ ID NO: 113337 - DNA, 6 bp, Unknown
  misc_feature (1)..( 6): Result.002 file - promoters60/1399074
agggaa

SEQ ID NO: 113338 - DNA, 6 bp, Unknown
  misc_feature (1)..( 6): Result.002 file - promoters60/1399074
taaagg

SEQ ID NO: 113339 - DNA, 6 bp, Unknown
  misc_feature (1)..( 6): Result.002 file - promoters60/1399074
taaagg

SEQ ID NO: 113340 - DNA, 7 bp, Unknown
  misc_feature (1)..( 7): Result.002 file - promoters60/1399074
gatctgg

SEQ ID NO: 113341 - DNA, 7 bp, Unknown
  misc_feature (1)..( 7): Result.002 file - promoters60/1399074
gatatgg

SEQ ID NO: 113342 - DNA, 7 bp, Unknown
  misc_feature (1)..( 7): Result.002 file - promoters60/1399074
ttgagtc

SEQ ID NO: 113343 - DNA, 7 bp, Unknown
  misc_feature (1)..( 7): Result.002 file - promoters60/1399074
ttgggtc

SEQ ID NO: 113344 - DNA, 6 bp, Unknown
  misc_feature (1)..( 6): Result.002 file - promoters60/1399074
ctgttc

SEQ ID NO: 113345 - DNA, 6 bp, Unknown
  misc_feature (1)..( 6): Result.002 file - promoters60/1399074
ctgttc

SEQ ID NO: 113346 - DNA, 7 bp, Unknown
  misc_feature (1)..( 7): Result.002 file - promoters60/1399074
aatcggg

SEQ ID NO: 113347 - DNA, 7 bp, Unknown
  misc_feature (1)..( 7): Result.002 file - promoters60/1399074
aattggg

SEQ ID NO: 113348 - DNA, 7 bp, Unknown
  misc_feature (1)..( 7): Result.002 file - promoters60/1399074
cccacta

SEQ ID NO: 113349 - DNA, 7 bp, Unknown
  misc_feature (1)..( 7): Result.002 file - promoters60/1399074
cccacta

SEQ ID NO: 113350 - DNA, 9 bp, Unknown
  misc_feature (1)..( 9): Result.002 file - promoters60/1399074
aaagaaaag

SEQ ID NO: 113351 - DNA, 9 bp, Unknown
  misc_feature (1)..( 9): Result.002 file - promoters60/1399074
aaagtaaag

SEQ ID NO: 113352 - DNA, 7 bp, Unknown
  misc_feature (1)..( 7): Result.002 file - promoters60/1399074
gtatata

SEQ ID NO: 113353 - DNA, 7 bp, Unknown
  misc_feature (1)..( 7): Result.002 file - promoters60/1399074
gtatata

SEQ ID NO: 113354 - DNA, 9 bp, Unknown
  misc_feature (1)..( 9): Result.002 file - promoters60/1399140
tttggtttg

SEQ ID NO: 113355 - DNA, 9 bp, Unknown
  misc_feature (1)..( 9): Result.002 file - promoters60/1399140
tttgttttc

SEQ ID NO: 113356 - DNA, 9 bp, Unknown
  misc_feature (1)..( 9): Result.002 file - promoters60/1399140
attgttttc

SEQ ID NO: 113357 - DNA, 9 bp, Unknown
  misc_feature (1)..( 9): Result.002 file - promoters60/1399140
tcagttttc

SEQ ID NO: 113358 - DNA, 8 bp, Unknown
  misc_feature (1)..( 8): Result.002 file - promoters60/1399265
aatttttt

SEQ ID NO: 113359 - DNA, 8 bp, Unknown
  misc_feature (1)..( 8): Result.002 file - promoters60/1399265
aatattta

SEQ ID NO: 113360 - DNA, 8 bp, Unknown
  misc_feature (1)..( 8): Result.002 file - promoters60/1399265
aattttga

SEQ ID NO: 113361 - DNA, 8 bp, Unknown
  misc_feature (1)..( 8): Result.002 file - promoters60/1399265
agtattta

SEQ ID NO: 113362 - DNA, 8 bp, Unknown
  misc_feature (1)..( 8): Result.002 file - promoters60/1399265
aatcttgt

SEQ ID NO: 113363 - DNA, 8 bp, Unknown
  misc_feature (1)..( 8): Result.002 file - promoters60/1399265
ttttttaa

SEQ ID NO: 113364 - DNA, 8 bp, Unknown
  misc_feature (1)..( 8): Result.002 file - promoters60/1399265
tttattaa

SEQ ID NO: 113365 - DNA, 9 bp, Unknown
  misc_feature (1)..( 9): Result.002 file - promoters60/1399265
gttatatat

SEQ ID NO: 113366 - DNA, 9 bp, Unknown
  misc_feature (1)..( 9): Result.002 file - promoters60/1399265
aatatataa

SEQ ID NO: 113367 - DNA, 9 bp, Unknown
  misc_feature (1)..( 9): Result.002 file - promoters60/1399265
ttaaaaaat

SEQ ID NO: 113368 - DNA, 9 bp, Unknown
  misc_feature (1)..( 9): Result.002 file - promoters60/1399265
ttataaact

SEQ ID NO: 113369 - DNA, 9 bp, Unknown
  misc_feature (1)..( 9): Result.002 file - promoters60/1399265
ataaaaatt

SEQ ID NO: 113370 - DNA, 9 bp, Unknown
  misc_feature (1)..( 9): Result.002 file - promoters60/1399265
tgaaaaatt

SEQ ID NO: 113371 - DNA, 14 bp, Unknown
  misc_feature (1)..( 14): Result.002 file - promoters60/1399265
tctatttttagtta

SEQ ID NO: 113372 - DNA, 14 bp, Unknown
  misc_feature (1)..( 14): Result.002 file - promoters60/1399265
aatatttttagttt

SEQ ID NO: 113373 - DNA, 14 bp, Unknown
  misc_feature (1)..( 14): Result.002 file - promoters60/1399265
cttattttatgaaa

SEQ ID NO: 113374 - DNA, 14 bp, Unknown
  misc_feature (1)..( 14): Result.002 file - promoters60/1399265
tttaatttcttcac

SEQ ID NO: 113375 - DNA, 14 bp, Unknown
  misc_feature (1)..( 14): Result.002 file - promoters60/1399265
tttatattataaaa

SEQ ID NO: 113376 - DNA, 11 bp, Unknown
  misc_feature (1)..( 11): Result.002 file - promoters60/1399265
aattgttttaa

SEQ ID NO: 113377 - DNA, 11 bp, Unknown
  misc_feature (1)..( 11): Result.002 file - promoters60/1399265
gattttttttt

SEQ ID NO: 113378 - DNA, 11 bp, Unknown
  misc_feature (1)..( 11): Result.002 file - promoters60/1399265
atgtgttgtaa

SEQ ID NO: 113379 - DNA, 11 bp, Unknown
  misc_feature (1)..( 11): Result.002 file - promoters60/1399265
aatggttcaat

SEQ ID NO: 113380 - DNA, 9 bp, Unknown
  misc_feature (1)..( 9): Result.002 file - promoters60/1399265
tattattgt

SEQ ID NO: 113381 - DNA, 9 bp, Unknown
  misc_feature (1)..( 9): Result.002 file - promoters60/1399265
tattattta

SEQ ID NO: 113382 - DNA, 9 bp, Unknown
  misc_feature (1)..( 9): Result.002 file - promoters60/1399265
acttatttt

SEQ ID NO: 113383 - DNA, 9 bp, Unknown
  misc_feature (1)..( 9): Result.002 file - promoters60/1399265
tatcatttt

SEQ ID NO: 113384 - DNA, 9 bp, Unknown
  misc_feature (1)..( 9): Result.002 file - promoters60/1399265
aaatatttt

SEQ ID NO: 113385 - DNA, 7 bp, Unknown
  misc_feature (1)..( 7): Result.002 file - promoters60/1399265
ttatttt

SEQ ID NO: 113386 - DNA, 7 bp, Unknown
  misc_feature (1)..( 7): Result.002 file - promoters60/1399265
ctatttt

SEQ ID NO: 113387 - DNA, 7 bp, Unknown
  misc_feature (1)..( 7): Result.002 file - promoters60/1399265
ttatttt

SEQ ID NO: 113388 - DNA, 7 bp, Unknown
  misc_feature (1)..( 7): Result.002 file - promoters60/1399265
atatttt

SEQ ID NO: 113389 - DNA, 8 bp, Unknown
  misc_feature (1)..( 8): Result.002 file - promoters60/1399265
atttcttt

SEQ ID NO: 113390 - DNA, 8 bp, Unknown
  misc_feature (1)..( 8): Result.002 file - promoters60/1399265
cttttttt

SEQ ID NO: 113391 - DNA, 8 bp, Unknown
  misc_feature (1)..( 8): Result.002 file - promoters60/1399265
attttttt

SEQ ID NO: 113392 - DNA, 8 bp, Unknown
  misc_feature (1)..( 8): Result.002 file - promoters60/1399265
atttttca

SEQ ID NO: 113393 - DNA, 9 bp, Unknown
  misc_feature (1)..( 9): Result.002 file - promoters60/1399265
tttataagc

SEQ ID NO: 113394 - DNA, 9 bp, Unknown
  misc_feature (1)..( 9): Result.002 file - promoters60/1399265
tatataagt

SEQ ID NO: 113395 - DNA, 9 bp, Unknown
  misc_feature (1)..( 9): Result.002 file - promoters60/1399265
tttttaaag

SEQ ID NO: 113396 - DNA, 9 bp, Unknown
  misc_feature (1)..( 9): Result.002 file - promoters60/1399265
gttttaaaa

SEQ ID NO: 113397 - DNA, 9 bp, Unknown
  misc_feature (1)..( 9): Result.002 file - promoters60/1399265
ttttttggg

SEQ ID NO: 113398 - DNA, 12 bp, Unknown
  misc_feature (1)..( 12): Result.002 file - promoters60/1399265
cttttattttgc

SEQ ID NO: 113399 - DNA, 12 bp, Unknown
  misc_feature (1)..( 12): Result.002 file - promoters60/1399265
agttatttttgc

SEQ ID NO: 113400 - DNA, 12 bp, Unknown
  misc_feature (1)..( 12): Result.002 file - promoters60/1399265
tttgaattttga

SEQ ID NO: 113401 - DNA, 13 bp, Unknown
  misc_feature (1)..( 13): Result.002 file - promoters60/1399265
ctattttttctgc

SEQ ID NO: 113402 - DNA, 13 bp, Unknown
  misc_feature (1)..( 13): Result.002 file - promoters60/1399265
tttttgttttctt

SEQ ID NO: 113403 - DNA, 7 bp, Unknown
  misc_feature (1)..( 7): Result.002 file - promoters60/1399265
atacaaa

SEQ ID NO: 113404 - DNA, 7 bp, Unknown
  misc_feature (1)..( 7): Result.002 file - promoters60/1399265
ataaaaa

SEQ ID NO: 113405 - DNA, 7 bp, Unknown
  misc_feature (1)..( 7): Result.002 file - promoters60/1399265
aaaaaaa

SEQ ID NO: 113406 - DNA, 7 bp, Unknown
  misc_feature (1)..( 7): Result.002 file - promoters60/1399265
tgaaaaa

SEQ ID NO: 113407 - DNA, 7 bp, Unknown
  misc_feature (1)..( 7): Result.002 file - promoters60/1399265
ataaaac

SEQ ID NO: 113408 - DNA, 13 bp, Unknown
  misc_feature (1)..( 13): Result.002 file - promoters60/1399265
aaatataggcgcc

SEQ ID NO: 113409 - DNA, 13 bp, Unknown
  misc_feature (1)..( 13): Result.002 file - promoters60/1399265
taatataaataat

SEQ ID NO: 113410 - DNA, 13 bp, Unknown
  misc_feature (1)..( 13): Result.002 file - promoters60/1399265
caataaaaataat

SEQ ID NO: 113411 - DNA, 14 bp, Unknown
  misc_feature (1)..( 14): Result.002 file - promoters60/1399265
aaatgatatgagaa

SEQ ID NO: 113412 - DNA, 8 bp, Unknown
  misc_feature (1)..( 8): Result.002 file - promoters60/1399265
tctgtttt

SEQ ID NO: 113413 - DNA, 8 bp, Unknown
  misc_feature (1)..( 8): Result.002 file - promoters60/1399265
tctttttt

SEQ ID NO: 113414 - DNA, 6 bp, Unknown
  misc_feature (1)..( 6): Result.002 file - promoters60/1399265
tgtttt

SEQ ID NO: 113415 - DNA, 8 bp, Unknown
  misc_feature (1)..( 8): Result.002 file - promoters60/1399265
actttttt

SEQ ID NO: 113416 - DNA, 9 bp, Unknown
  misc_feature (1)..( 9): Result.002 file - promoters60/1399265
ttagaaaaa

SEQ ID NO: 113417 - DNA, 9 bp, Unknown
  misc_feature (1)..( 9): Result.002 file - promoters60/1399265
ttataaaac

SEQ ID NO: 113418 - DNA, 9 bp, Unknown
  misc_feature (1)..( 9): Result.002 file - promoters60/1399265
tctgaaaaa

SEQ ID NO: 113419 - DNA, 9 bp, Unknown
  misc_feature (1)..( 9): Result.002 file - promoters60/1399265
tcataaaaa

SEQ ID NO: 113420 - DNA, 7 bp, Unknown
  misc_feature (1)..( 7): Result.002 file - promoters60/1399277
aaaacaa

SEQ ID NO: 113421 - DNA, 7 bp, Unknown
  misc_feature (1)..( 7): Result.002 file - promoters60/1399277
aaaacaa

SEQ ID NO: 113422 - DNA, 6 bp, Unknown
  misc_feature (1)..( 6): Result.002 file - promoters60/1399277
attatt

SEQ ID NO: 113423 - DNA, 6 bp, Unknown
  misc_feature (1)..( 6): Result.002 file - promoters60/1399277
attatt

SEQ ID NO: 113424 - DNA, 6 bp, Unknown
  misc_feature (1)..( 6): Result.002 file - promoters60/1399277
aataaa

SEQ ID NO: 113425 - DNA, 6 bp, Unknown
  misc_feature (1)..( 6): Result.002 file - promoters60/1399277
aataaa

SEQ ID NO: 113426 - DNA, 6 bp, Unknown
  misc_feature (1)..( 6): Result.002 file - promoters60/1399277
acaatt

SEQ ID NO: 113427 - DNA, 6 bp, Unknown
  misc_feature (1)..( 6): Result.002 file - promoters60/1399277
acaatt

SEQ ID NO: 113428 - DNA, 16 bp, Unknown
  misc_feature (1)..( 16): Result.002 file - promoters60/1399277
taaacacaaaaatttt

SEQ ID NO: 113429 - DNA, 16 bp, Unknown
  misc_feature (1)..( 16): Result.002 file - promoters60/1399277
taatcacaaaaacttt

SEQ ID NO: 113430 - DNA, 16 bp, Unknown
  misc_feature (1)..( 16): Result.002 file - promoters60/1399277
taaacacaaaagttca

SEQ ID NO: 113431 - DNA, 8 bp, Unknown
  misc_feature (1)..( 8): Result.002 file - promoters60/1399277
ttataaaa

SEQ ID NO: 113432 - DNA, 8 bp, Unknown
  misc_feature (1)..( 8): Result.002 file - promoters60/1399277
ttacaaaa

SEQ ID NO: 113433 - DNA, 8 bp, Unknown
  misc_feature (1)..( 8): Result.002 file - promoters60/1399277
acacaaaa

SEQ ID NO: 113434 - DNA, 6 bp, Unknown
  misc_feature (1)..( 6): Result.002 file - promoters60/1399277
ttttat

SEQ ID NO: 113435 - DNA, 6 bp, Unknown
  misc_feature (1)..( 6): Result.002 file - promoters60/1399277
ttttat

SEQ ID NO: 113436 - DNA, 8 bp, Unknown
  misc_feature (1)..( 8): Result.002 file - promoters60/1399277
atttttta

SEQ ID NO: 113437 - DNA, 8 bp, Unknown
  misc_feature (1)..( 8): Result.002 file - promoters60/1399277
ctttctta

SEQ ID NO: 113438 - DNA, 8 bp, Unknown
  misc_feature (1)..( 8): Result.002 file - promoters60/1399277
attttttt

SEQ ID NO: 113439 - DNA, 6 bp, Unknown
  misc_feature (1)..( 6): Result.002 file - promoters60/1399277
gataaa

SEQ ID NO: 113440 - DNA, 6 bp, Unknown
  misc_feature (1)..( 6): Result.002 file - promoters60/1399277
gataaa

SEQ ID NO: 113441 - DNA, 10 bp, Unknown
  misc_feature (1)..( 10): Result.002 file - promoters60/1399277
gaataaccac

SEQ ID NO: 113442 - DNA, 10 bp, Unknown
  misc_feature (1)..( 10): Result.002 file - promoters60/1399277
gaacaactcc

SEQ ID NO: 113443 - DNA, 10 bp, Unknown
  misc_feature (1)..( 10): Result.002 file - promoters60/1399277
acatacccac

SEQ ID NO: 113444 - DNA, 6 bp, Unknown
  misc_feature (1)..( 6): Result.002 file - promoters60/1399277
accaat

SEQ ID NO: 113445 - DNA, 6 bp, Unknown
  misc_feature (1)..( 6): Result.002 file - promoters60/1399277
accaat

SEQ ID NO: 113446 - DNA, 7 bp, Unknown
  misc_feature (1)..( 7): Result.002 file - promoters60/1399277
aaacttt

SEQ ID NO: 113447 - DNA, 7 bp, Unknown
  misc_feature (1)..( 7): Result.002 file - promoters60/1399277
aaacttt

SEQ ID NO: 113448 - DNA, 6 bp, Unknown
  misc_feature (1)..( 6): Result.002 file - promoters60/1399277
aaatca

SEQ ID NO: 113449 - DNA, 6 bp, Unknown
  misc_feature (1)..( 6): Result.002 file - promoters60/1399277
aaatca

SEQ ID NO: 113450 - DNA, 7 bp, Unknown
  misc_feature (1)..( 7): Result.002 file - promoters60/1399277
aagattt

SEQ ID NO: 113451 - DNA, 7 bp, Unknown
  misc_feature (1)..( 7): Result.002 file - promoters60/1399277
aagattt

SEQ ID NO: 113452 - DNA, 6 bp, Unknown
  misc_feature (1)..( 6): Result.002 file - promoters60/1399277
acatat

SEQ ID NO: 113453 - DNA, 6 bp, Unknown
  misc_feature (1)..( 6): Result.002 file - promoters60/1399277
acatat

SEQ ID NO: 113454 - DNA, 9 bp, Unknown
  misc_feature (1)..( 9): Result.002 file - promoters60/1399277
tcaacgtga

SEQ ID NO: 113455 - DNA, 9 bp, Unknown
  misc_feature (1)..( 9): Result.002 file - promoters60/1399277
tcaaagtga

SEQ ID NO: 113456 - DNA, 9 bp, Unknown
  misc_feature (1)..( 9): Result.002 file - promoters60/1399277
tttattaaa

SEQ ID NO: 113457 - DNA, 9 bp, Unknown
  misc_feature (1)..( 9): Result.002 file - promoters60/1399277
ttttttaaa

SEQ ID NO: 113458 - DNA, 7 bp, Unknown
  misc_feature (1)..( 7): Result.002 file - promoters60/1399277
aaaagtt

SEQ ID NO: 113459 - DNA, 7 bp, Unknown
  misc_feature (1)..( 7): Result.002 file - promoters60/1399277
aaaagtt

SEQ ID NO: 113460 - DNA, 14 bp, Unknown
  misc_feature (1)..( 14): Result.002 file - promoters60/1399325
atcacatatttgaa

SEQ ID NO: 113461 - DNA, 14 bp, Unknown
  misc_feature (1)..( 14): Result.002 file - promoters60/1399325
gatacatattagta

SEQ ID NO: 113462 - DNA, 14 bp, Unknown
  misc_feature (1)..( 14): Result.002 file - promoters60/1399325
aaatcatcttaaat

SEQ ID NO: 113463 - DNA, 14 bp, Unknown
  misc_feature (1)..( 14): Result.002 file - promoters60/1399325
gataaataaactta

SEQ ID NO: 113464 - DNA, 14 bp, Unknown
  misc_feature (1)..( 14): Result.002 file - promoters60/1399325
agagaatctgaaat

SEQ ID NO: 113465 - DNA, 14 bp, Unknown
  misc_feature (1)..( 14): Result.002 file - promoters60/1399325
gattaattcttttc

SEQ ID NO: 113466 - DNA, 7 bp, Unknown
  misc_feature (1)..( 7): Result.002 file - promoters60/1399417
cgattcc

SEQ ID NO: 113467 - DNA, 7 bp, Unknown
  misc_feature (1)..( 7): Result.002 file - promoters60/1399417
cgattcc

SEQ ID NO: 113468 - DNA, 7 bp, Unknown
  misc_feature (1)..( 7): Result.002 file - promoters60/1399417
agagaaa

SEQ ID NO: 113469 - DNA, 7 bp, Unknown
  misc_feature (1)..( 7): Result.002 file - promoters60/1399417
agaaaaa

SEQ ID NO: 113470 - DNA, 11 bp, Unknown
  misc_feature (1)..( 11): Result.002 file - promoters60/1399417
agctagtgaga

SEQ ID NO: 113471 - DNA, 11 bp, Unknown
  misc_feature (1)..( 11): Result.002 file - promoters60/1399417
agctagagaga

SEQ ID NO: 113472 - DNA, 6 bp, Unknown
  misc_feature (1)..( 6): Result.002 file - promoters60/1399417
gttttg

SEQ ID NO: 113473 - DNA, 6 bp, Unknown
  misc_feature (1)..( 6): Result.002 file - promoters60/1399417
gttttg

SEQ ID NO: 113474 - DNA, 6 bp, Unknown
  misc_feature (1)..( 6): Result.002 file - promoters60/1399417
tcgaaa

SEQ ID NO: 113475 - DNA, 6 bp, Unknown
  misc_feature (1)..( 6): Result.002 file - promoters60/1399417
tcgaaa

SEQ ID NO: 113476 - DNA, 7 bp, Unknown
  misc_feature (1)..( 7): Result.002 file - promoters60/1399417
atctgag

SEQ ID NO: 113477 - DNA, 7 bp, Unknown
  misc_feature (1)..( 7): Result.002 file - promoters60/1399417
atctgag

SEQ ID NO: 113478 - DNA, 8 bp, Unknown
  misc_feature (1)..( 8): Result.002 file - promoters60/1399417
gaatcaac

SEQ ID NO: 113479 - DNA, 8 bp, Unknown
  misc_feature (1)..( 8): Result.002 file - promoters60/1399417
gaaacaaa

SEQ ID NO: 113480 - DNA, 9 bp, Unknown
  misc_feature (1)..( 9): Result.002 file - promoters60/1399417
gaacacaaa

SEQ ID NO: 113481 - DNA, 6 bp, Unknown
  misc_feature (1)..( 6): Result.002 file - promoters60/1399417
attgtg

SEQ ID NO: 113482 - DNA, 6 bp, Unknown
  misc_feature (1)..( 6): Result.002 file - promoters60/1399417
attgtg

SEQ ID NO: 113483 - DNA, 6 bp, Unknown
  misc_feature (1)..( 6): Result.002 file - promoters60/1399417
tgttcg

SEQ ID NO: 113484 - DNA, 6 bp, Unknown
  misc_feature (1)..( 6): Result.002 file - promoters60/1399417
tgttcg

SEQ ID NO: 113485 - DNA, 6 bp, Unknown
  misc_feature (1)..( 6): Result.002 file - promoters60/1399417
tctgtt

SEQ ID NO: 113486 - DNA, 6 bp, Unknown
  misc_feature (1)..( 6): Result.002 file - promoters60/1399417
tctgtt

SEQ ID NO: 113487 - DNA, 7 bp, Unknown
  misc_feature (1)..( 7): Result.002 file - promoters60/1399417
ataaaaa

SEQ ID NO: 113488 - DNA, 7 bp, Unknown
  misc_feature (1)..( 7): Result.002 file - promoters60/1399417
ataaaaa

SEQ ID NO: 113489 - DNA, 6 bp, Unknown
  misc_feature (1)..( 6): Result.002 file - promoters60/1399417
atatat

SEQ ID NO: 113490 - DNA, 6 bp, Unknown
  misc_feature (1)..( 6): Result.002 file - promoters60/1399417
atatat

SEQ ID NO: 113491 - DNA, 9 bp, Unknown
  misc_feature (1)..( 9): Result.002 file - promoters60/1399417
gagcctgat

SEQ ID NO: 113492 - DNA, 9 bp, Unknown
  misc_feature (1)..( 9): Result.002 file - promoters60/1399417
gagtctgat

SEQ ID NO: 113493 - DNA, 6 bp, Unknown
  misc_feature (1)..( 6): Result.002 file - promoters60/1399417
aattgc

SEQ ID NO: 113494 - DNA, 6 bp, Unknown
  misc_feature (1)..( 6): Result.002 file - promoters60/1399417
aattgc

SEQ ID NO: 113495 - DNA, 6 bp, Unknown
  misc_feature (1)..( 6): Result.002 file - promoters60/1399417
tccaaa

SEQ ID NO: 113496 - DNA, 6 bp, Unknown
  misc_feature (1)..( 6): Result.002 file - promoters60/1399417
tccaaa

SEQ ID NO: 113497 - DNA, 6 bp, Unknown
  misc_feature (1)..( 6): Result.002 file - promoters60/1399417
aaacga

SEQ ID NO: 113498 - DNA, 6 bp, Unknown
  misc_feature (1)..( 6): Result.002 file - promoters60/1399417
aaacga

SEQ ID NO: 113499 - DNA, 6 bp, Unknown
  misc_feature (1)..( 6): Result.002 file - promoters60/1399417
tctaaa

SEQ ID NO: 113500 - DNA, 6 bp, Unknown
  misc_feature (1)..( 6): Result.002 file - promoters60/1399417
tctaaa

SEQ ID NO: 113501 - DNA, 6 bp, Unknown
  misc_feature (1)..( 6): Result.002 file - promoters60/1399417
ttgact

SEQ ID NO: 113502 - DNA, 6 bp, Unknown
  misc_feature (1)..( 6): Result.002 file - promoters60/1399417
ttgact

SEQ ID NO: 113503 - DNA, 8 bp, Unknown
  misc_feature (1)..( 8): Result.002 file - promoters60/1399417
ccaagacg

SEQ ID NO: 113504 - DNA, 8 bp, Unknown
  misc_feature (1)..( 8): Result.002 file - promoters60/1399417
ccaagacg

SEQ ID NO: 113505 - DNA, 7 bp, Unknown
  misc_feature (1)..( 7): Result.002 file - promoters60/1399417
aggccca

SEQ ID NO: 113506 - DNA, 7 bp, Unknown
  misc_feature (1)..( 7): Result.002 file - promoters60/1399417
aggccca

SEQ ID NO: 113507 - DNA, 8 bp, Unknown
  misc_feature (1)..( 8): Result.002 file - promoters60/1399541
atttcttc

SEQ ID NO: 113508 - DNA, 8 bp, Unknown
  misc_feature (1)..( 8): Result.002 file - promoters60/1399541
atttctcc

SEQ ID NO: 113509 - DNA, 8 bp, Unknown
  misc_feature (1)..( 8): Result.002 file - promoters60/1399541
gtttcttc

SEQ ID NO: 113510 - DNA, 7 bp, Unknown
  misc_feature (1)..( 7): Result.002 file - promoters60/1399541
tcatatt

SEQ ID NO: 113511 - DNA, 7 bp, Unknown
  misc_feature (1)..( 7): Result.002 file - promoters60/1399541
tcaaatt

SEQ ID NO: 113512 - DNA, 8 bp, Unknown
  misc_feature (1)..( 8): Result.002 file - promoters60/1399541
ccagtatt

SEQ ID NO: 113513 - DNA, 8 bp, Unknown
  misc_feature (1)..( 8): Result.002 file - promoters60/1399541
ccagtatt

SEQ ID NO: 113514 - DNA, 6 bp, Unknown
  misc_feature (1)..( 6): Result.002 file - promoters60/1399541
tttttt

SEQ ID NO: 113515 - DNA, 6 bp, Unknown
  misc_feature (1)..( 6): Result.002 file - promoters60/1399541
tttttt

SEQ ID NO: 113516 - DNA, 7 bp, Unknown
  misc_feature (1)..( 7): Result.002 file - promoters60/1399541
ttctttt

SEQ ID NO: 113517 - DNA, 7 bp, Unknown
  misc_feature (1)..( 7): Result.002 file - promoters60/1399541
ttctttt

SEQ ID NO: 113518 - DNA, 8 bp, Unknown
  misc_feature (1)..( 8): Result.002 file - promoters60/1399541
aggtaatt

SEQ ID NO: 113519 - DNA, 8 bp, Unknown
  misc_feature (1)..( 8): Result.002 file - promoters60/1399541
aggcaatt

SEQ ID NO: 113520 - DNA, 7 bp, Unknown
  misc_feature (1)..( 7): Result.002 file - promoters60/1399541
attagtt

SEQ ID NO: 113521 - DNA, 7 bp, Unknown
  misc_feature (1)..( 7): Result.002 file - promoters60/1399541
atttgtt

SEQ ID NO: 113522 - DNA, 6 bp, Unknown
  misc_feature (1)..( 6): Result.002 file - promoters60/1399541
tgttgg

SEQ ID NO: 113523 - DNA, 6 bp, Unknown
  misc_feature (1)..( 6): Result.002 file - promoters60/1399541
tgttgg

SEQ ID NO: 113524 - DNA, 6 bp, Unknown
  misc_feature (1)..( 6): Result.002 file - promoters60/1399541
actcct

SEQ ID NO: 113525 - DNA, 6 bp, Unknown
  misc_feature (1)..( 6): Result.002 file - promoters60/1399541
actcct

SEQ ID NO: 113526 - DNA, 7 bp, Unknown
  misc_feature (1)..( 7): Result.002 file - promoters60/1399541
ccttttc

SEQ ID NO: 113527 - DNA, 7 bp, Unknown
  misc_feature (1)..( 7): Result.002 file - promoters60/1399541
cctcttc

SEQ ID NO: 113528 - DNA, 7 bp, Unknown
  misc_feature (1)..( 7): Result.002 file - promoters60/1399541
cttttgt

SEQ ID NO: 113529 - DNA, 7 bp, Unknown
  misc_feature (1)..( 7): Result.002 file - promoters60/1399541
cttttgt

SEQ ID NO: 113530 - DNA, 6 bp, Unknown
  misc_feature (1)..( 6): Result.002 file - promoters60/1399541
gaaaaa

SEQ ID NO: 113531 - DNA, 6 bp, Unknown
  misc_feature (1)..( 6): Result.002 file - promoters60/1399541
gaaaaa

SEQ ID NO: 113532 - DNA, 8 bp, Unknown
  misc_feature (1)..( 8): Result.002 file - promoters60/1399541
aaaccact

SEQ ID NO: 113533 - DNA, 8 bp, Unknown
  misc_feature (1)..( 8): Result.002 file - promoters60/1399541
aaacgact

SEQ ID NO: 113534 - DNA, 8 bp, Unknown
  misc_feature (1)..( 8): Result.002 file - promoters60/1399634
tatacata

SEQ ID NO: 113535 - DNA, 8 bp, Unknown
  misc_feature (1)..( 8): Result.002 file - promoters60/1399634
tattcata

SEQ ID NO: 113536 - DNA, 9 bp, Unknown
  misc_feature (1)..( 9): Result.002 file - promoters60/1399634
tcgaagtag

SEQ ID NO: 113537 - DNA, 9 bp, Unknown
  misc_feature (1)..( 9): Result.002 file - promoters60/1399634
tcgaaatag

SEQ ID NO: 113538 - DNA, 9 bp, Unknown
  misc_feature (1)..( 9): Result.002 file - promoters60/1399634
gcgcaatta

SEQ ID NO: 113539 - DNA, 9 bp, Unknown
  misc_feature (1)..( 9): Result.002 file - promoters60/1399634
gcgcaatta

SEQ ID NO: 113540 - DNA, 6 bp, Unknown
  misc_feature (1)..( 6): Result.002 file - promoters60/1399634
taaaca

SEQ ID NO: 113541 - DNA, 6 bp, Unknown
  misc_feature (1)..( 6): Result.002 file - promoters60/1399634
taaaca

SEQ ID NO: 113542 - DNA, 8 bp, Unknown
  misc_feature (1)..( 8): Result.002 file - promoters60/1399634
attattta

SEQ ID NO: 113543 - DNA, 8 bp, Unknown
  misc_feature (1)..( 8): Result.002 file - promoters60/1399634
atttttta

SEQ ID NO: 113544 - DNA, 6 bp, Unknown
  misc_feature (1)..( 6): Result.002 file - promoters60/1399634
tttctc

SEQ ID NO: 113545 - DNA, 6 bp, Unknown
  misc_feature (1)..( 6): Result.002 file - promoters60/1399634
tttctc

SEQ ID NO: 113546 - DNA, 6 bp, Unknown
  misc_feature (1)..( 6): Result.002 file - promoters60/1399634
aatttt

SEQ ID NO: 113547 - DNA, 6 bp, Unknown
  misc_feature (1)..( 6): Result.002 file - promoters60/1399634
aatttt

SEQ ID NO: 113548 - DNA, 7 bp, Unknown
  misc_feature (1)..( 7): Result.002 file - promoters60/1399634
atatata

SEQ ID NO: 113549 - DNA, 7 bp, Unknown
  misc_feature (1)..( 7): Result.002 file - promoters60/1399634
atacata

SEQ ID NO: 113550 - DNA, 8 bp, Unknown
  misc_feature (1)..( 8): Result.002 file - promoters60/1399634
acatgcat

SEQ ID NO: 113551 - DNA, 8 bp, Unknown
  misc_feature (1)..( 8): Result.002 file - promoters60/1399634
acatacat

SEQ ID NO: 113552 - DNA, 7 bp, Unknown
  misc_feature (1)..( 7): Result.002 file - promoters60/1399634
atagtag

SEQ ID NO: 113553 - DNA, 7 bp, Unknown
  misc_feature (1)..( 7): Result.002 file - promoters60/1399634
atactag

SEQ ID NO: 113554 - DNA, 7 bp, Unknown
  misc_feature (1)..( 7): Result.002 file - promoters60/1399634
catttat

SEQ ID NO: 113555 - DNA, 7 bp, Unknown
  misc_feature (1)..( 7): Result.002 file - promoters60/1399634
catctat

SEQ ID NO: 113556 - DNA, 7 bp, Unknown
  misc_feature (1)..( 7): Result.002 file - promoters60/1399634
acatttc

SEQ ID NO: 113557 - DNA, 7 bp, Unknown
  misc_feature (1)..( 7): Result.002 file - promoters60/1399634
acatttc

SEQ ID NO: 113558 - DNA, 7 bp, Unknown
  misc_feature (1)..( 7): Result.002 file - promoters60/1399634
tcacata

SEQ ID NO: 113559 - DNA, 7 bp, Unknown
  misc_feature (1)..( 7): Result.002 file - promoters60/1399634
tcatata

SEQ ID NO: 113560 - DNA, 6 bp, Unknown
  misc_feature (1)..( 6): Result.002 file - promoters60/1399634
atttat

SEQ ID NO: 113561 - DNA, 6 bp, Unknown
  misc_feature (1)..( 6): Result.002 file - promoters60/1399634
atttat

SEQ ID NO: 113562 - DNA, 6 bp, Unknown
  misc_feature (1)..( 6): Result.002 file - promoters60/1399634
taataa

SEQ ID NO: 113563 - DNA, 6 bp, Unknown
  misc_feature (1)..( 6): Result.002 file - promoters60/1399634
taataa

SEQ ID NO: 113564 - DNA, 6 bp, Unknown
  misc_feature (1)..( 6): Result.002 file - promoters60/1399634
tcgatc

SEQ ID NO: 113565 - DNA, 6 bp, Unknown
  misc_feature (1)..( 6): Result.002 file - promoters60/1399634
tcgatc

SEQ ID NO: 113566 - DNA, 6 bp, Unknown
  misc_feature (1)..( 6): Result.002 file - promoters60/1399634
tagatt

SEQ ID NO: 113567 - DNA, 6 bp, Unknown
  misc_feature (1)..( 6): Result.002 file - promoters60/1399634
tagatt

SEQ ID NO: 113568 - DNA, 7 bp, Unknown
  misc_feature (1)..( 7): Result.002 file - promoters60/1399709
attgaga

SEQ ID NO: 113569 - DNA, 7 bp, Unknown
  misc_feature (1)..( 7): Result.002 file - promoters60/1399709
attaaga

SEQ ID NO: 113570 - DNA, 6 bp, Unknown
  misc_feature (1)..( 6): Result.002 file - promoters60/1399709
cttttt

SEQ ID NO: 113571 - DNA, 6 bp, Unknown
  misc_feature (1)..( 6): Result.002 file - promoters60/1399709
cttttt

SEQ ID NO: 113572 - DNA, 6 bp, Unknown
  misc_feature (1)..( 6): Result.002 file - promoters60/1399709
gacatc

SEQ ID NO: 113573 - DNA, 6 bp, Unknown
  misc_feature (1)..( 6): Result.002 file - promoters60/1399709
gacatc

SEQ ID NO: 113574 - DNA, 7 bp, Unknown
  misc_feature (1)..( 7): Result.002 file - promoters60/1399709
aaggaaa

SEQ ID NO: 113575 - DNA, 7 bp, Unknown
  misc_feature (1)..( 7): Result.002 file - promoters60/1399709
aagtaaa

SEQ ID NO: 113576 - DNA, 8 bp, Unknown
  misc_feature (1)..( 8): Result.002 file - promoters60/1399709
gaagatcg

SEQ ID NO: 113577 - DNA, 8 bp, Unknown
  misc_feature (1)..( 8): Result.002 file - promoters60/1399709
gaagttcg

SEQ ID NO: 113578 - DNA, 6 bp, Unknown
  misc_feature (1)..( 6): Result.002 file - promoters60/1399709
gtttcg

SEQ ID NO: 113579 - DNA, 6 bp, Unknown
  misc_feature (1)..( 6): Result.002 file - promoters60/1399709
gtttcg

SEQ ID NO: 113580 - DNA, 6 bp, Unknown
  misc_feature (1)..( 6): Result.002 file - promoters60/1399709
aggcct

SEQ ID NO: 113581 - DNA, 6 bp, Unknown
  misc_feature (1)..( 6): Result.002 file - promoters60/1399709
aggcct

SEQ ID NO: 113582 - DNA, 7 bp, Unknown
  misc_feature (1)..( 7): Result.002 file - promoters60/1399709
tatcatt

SEQ ID NO: 113583 - DNA, 7 bp, Unknown
  misc_feature (1)..( 7): Result.002 file - promoters60/1399709
tatgatt

SEQ ID NO: 113584 - DNA, 7 bp, Unknown
  misc_feature (1)..( 7): Result.002 file - promoters60/1399709
gaatttg

SEQ ID NO: 113585 - DNA, 7 bp, Unknown
  misc_feature (1)..( 7): Result.002 file - promoters60/1399709
gaatttg

SEQ ID NO: 113586 - DNA, 7 bp, Unknown
  misc_feature (1)..( 7): Result.002 file - promoters60/1399709
tttgatt

SEQ ID NO: 113587 - DNA, 7 bp, Unknown
  misc_feature (1)..( 7): Result.002 file - promoters60/1399709
tttgatt

SEQ ID NO: 113588 - DNA, 7 bp, Unknown
  misc_feature (1)..( 7): Result.002 file - promoters60/1399709
ttagatc

SEQ ID NO: 113589 - DNA, 7 bp, Unknown
  misc_feature (1)..( 7): Result.002 file - promoters60/1399709
ttatatc

SEQ ID NO: 113590 - DNA, 6 bp, Unknown
  misc_feature (1)..( 6): Result.002 file - promoters60/1399709
catttg

SEQ ID NO: 113591 - DNA, 6 bp, Unknown
  misc_feature (1)..( 6): Result.002 file - promoters60/1399709
catttg

SEQ ID NO: 113592 - DNA, 11 bp, Unknown
  misc_feature (1)..( 11): Result.002 file - promoters60/1399726
cagtccttgca

SEQ ID NO: 113593 - DNA, 11 bp, Unknown
  misc_feature (1)..( 11): Result.002 file - promoters60/1399726
cagttctttaa

SEQ ID NO: 113594 - DNA, 12 bp, Unknown
  misc_feature (1)..( 12): Result.002 file - promoters60/1399726
aaattcattaat

SEQ ID NO: 113595 - DNA, 12 bp, Unknown
  misc_feature (1)..( 12): Result.002 file - promoters60/1399726
agatttattcat

SEQ ID NO: 113596 - DNA, 12 bp, Unknown
  misc_feature (1)..( 12): Result.002 file - promoters60/1399726
aaatttattatt

SEQ ID NO: 113597 - DNA, 11 bp, Unknown
  misc_feature (1)..( 11): Result.002 file - promoters60/1399726
ccaattcattt

SEQ ID NO: 113598 - DNA, 11 bp, Unknown
  misc_feature (1)..( 11): Result.002 file - promoters60/1399726
ctaattcacaa

SEQ ID NO: 113599 - DNA, 11 bp, Unknown
  misc_feature (1)..( 11): Result.002 file - promoters60/1399726
ccaattaattt

SEQ ID NO: 113600 - DNA, 11 bp, Unknown
  misc_feature (1)..( 11): Result.002 file - promoters60/1399726
aaaattccttt

SEQ ID NO: 113601 - DNA, 11 bp, Unknown
  misc_feature (1)..( 11): Result.002 file - promoters60/1399726
tatattgacac

SEQ ID NO: 113602 - DNA, 11 bp, Unknown
  misc_feature (1)..( 11): Result.002 file - promoters60/1399726
gtaataaatga

SEQ ID NO: 113603 - DNA, 12 bp, Unknown
  misc_feature (1)..( 12): Result.002 file - promoters60/1399726
aacaaattcttt

SEQ ID NO: 113604 - DNA, 12 bp, Unknown
  misc_feature (1)..( 12): Result.002 file - promoters60/1399726
atcaaattaatg

SEQ ID NO: 113605 - DNA, 12 bp, Unknown
  misc_feature (1)..( 12): Result.002 file - promoters60/1399726
ggcaaactctga

SEQ ID NO: 113606 - DNA, 12 bp, Unknown
  misc_feature (1)..( 12): Result.002 file - promoters60/1399726
atccaatgataa

SEQ ID NO: 113607 - DNA, 12 bp, Unknown
  misc_feature (1)..( 12): Result.002 file - promoters60/1399726
cacacactatga

SEQ ID NO: 113608 - DNA, 12 bp, Unknown
  misc_feature (1)..( 12): Result.002 file - promoters60/1399726
catataaagtac

SEQ ID NO: 113609 - DNA, 12 bp, Unknown
  misc_feature (1)..( 12): Result.002 file - promoters60/1399726
tagataaattac

SEQ ID NO: 113610 - DNA, 12 bp, Unknown
  misc_feature (1)..( 12): Result.002 file - promoters60/1399726
agtacaaaatac

SEQ ID NO: 113611 - DNA, 12 bp, Unknown
  misc_feature (1)..( 12): Result.002 file - promoters60/1399726
ctgataaatttt

SEQ ID NO: 113612 - DNA, 12 bp, Unknown
  misc_feature (1)..( 12): Result.002 file - promoters60/1399726
tagaaaaagttg

SEQ ID NO: 113613 - DNA, 12 bp, Unknown
  misc_feature (1)..( 12): Result.002 file - promoters60/1399726
atttcaaaattt

SEQ ID NO: 113614 - DNA, 14 bp, Unknown
  misc_feature (1)..( 14): Result.002 file - promoters60/1399726
caaactaattcaca

SEQ ID NO: 113615 - DNA, 14 bp, Unknown
  misc_feature (1)..( 14): Result.002 file - promoters60/1399726
ccaactaagactga

SEQ ID NO: 113616 - DNA, 14 bp, Unknown
  misc_feature (1)..( 14): Result.002 file - promoters60/1399726
gaaagtaataaatg

SEQ ID NO: 113617 - DNA, 14 bp, Unknown
  misc_feature (1)..( 14): Result.002 file - promoters60/1399726
ccaattaattttct

SEQ ID NO: 113618 - DNA, 14 bp, Unknown
  misc_feature (1)..( 14): Result.002 file - promoters60/1399726
aacattaattttct

SEQ ID NO: 113619 - DNA, 12 bp, Unknown
  misc_feature (1)..( 12): Result.002 file - promoters60/1399726
ctgataaatttt

SEQ ID NO: 113620 - DNA, 12 bp, Unknown
  misc_feature (1)..( 12): Result.002 file - promoters60/1399726
tttcaaaattta

SEQ ID NO: 113621 - DNA, 12 bp, Unknown
  misc_feature (1)..( 12): Result.002 file - promoters60/1399726
tagataaattac

SEQ ID NO: 113622 - DNA, 12 bp, Unknown
  misc_feature (1)..( 12): Result.002 file - promoters60/1399726
tagaaaaagttg

SEQ ID NO: 113623 - DNA, 12 bp, Unknown
  misc_feature (1)..( 12): Result.002 file - promoters60/1399726
gtacaaaataca

SEQ ID NO: 113624 - DNA, 8 bp, Unknown
  misc_feature (1)..( 8): Result.002 file - promoters60/1403210
aaaaaagt

SEQ ID NO: 113625 - DNA, 8 bp, Unknown
  misc_feature (1)..( 8): Result.002 file - promoters60/1403210
aaataagt

SEQ ID NO: 113626 - DNA, 7 bp, Unknown
  misc_feature (1)..( 7): Result.002 file - promoters60/1403210
aagaaag

SEQ ID NO: 113627 - DNA, 7 bp, Unknown
  misc_feature (1)..( 7): Result.002 file - promoters60/1403210
aagtaag

SEQ ID NO: 113628 - DNA, 10 bp, Unknown
  misc_feature (1)..( 10): Result.002 file - promoters60/1403210
tgagtataat

SEQ ID NO: 113629 - DNA, 10 bp, Unknown
  misc_feature (1)..( 10): Result.002 file - promoters60/1403210
tgagtaaaat

SEQ ID NO: 113630 - DNA, 7 bp, Unknown
  misc_feature (1)..( 7): Result.002 file - promoters60/1403210
ttgaaaa

SEQ ID NO: 113631 - DNA, 7 bp, Unknown
  misc_feature (1)..( 7): Result.002 file - promoters60/1403210
ttgaaat

SEQ ID NO: 113632 - DNA, 7 bp, Unknown
  misc_feature (1)..( 7): Result.002 file - promoters60/1403210
tttaaaa

SEQ ID NO: 113633 - DNA, 9 bp, Unknown
  misc_feature (1)..( 9): Result.002 file - promoters60/1403210
tggttttct

SEQ ID NO: 113634 - DNA, 9 bp, Unknown
  misc_feature (1)..( 9): Result.002 file - promoters60/1403210
tggctttct

SEQ ID NO: 113635 - DNA, 7 bp, Unknown
  misc_feature (1)..( 7): Result.002 file - promoters60/1403210
aaagttt

SEQ ID NO: 113636 - DNA, 7 bp, Unknown
  misc_feature (1)..( 7): Result.002 file - promoters60/1403210
aaaattt

SEQ ID NO: 113637 - DNA, 6 bp, Unknown
  misc_feature (1)..( 6): Result.002 file - promoters60/1403210
ttgaga

SEQ ID NO: 113638 - DNA, 6 bp, Unknown
  misc_feature (1)..( 6): Result.002 file - promoters60/1403210
ttgaga

SEQ ID NO: 113639 - DNA, 7 bp, Unknown
  misc_feature (1)..( 7): Result.002 file - promoters60/1403210
tttaggg

SEQ ID NO: 113640 - DNA, 7 bp, Unknown
  misc_feature (1)..( 7): Result.002 file - promoters60/1403210
tttgggg

SEQ ID NO: 113641 - DNA, 8 bp, Unknown
  misc_feature (1)..( 8): Result.002 file - promoters60/1403210
ttttgatt

SEQ ID NO: 113642 - DNA, 8 bp, Unknown
  misc_feature (1)..( 8): Result.002 file - promoters60/1403210
ttttcatt

SEQ ID NO: 113643 - DNA, 7 bp, Unknown
  misc_feature (1)..( 7): Result.002 file - promoters60/1403210
tgatgaa

SEQ ID NO: 113644 - DNA, 7 bp, Unknown
  misc_feature (1)..( 7): Result.002 file - promoters60/1403210
tgatgaa

SEQ ID NO: 113645 - DNA, 8 bp, Unknown
  misc_feature (1)..( 8): Result.002 file - promoters60/1403210
atcaactt

SEQ ID NO: 113646 - DNA, 8 bp, Unknown
  misc_feature (1)..( 8): Result.002 file - promoters60/1403210
atcatctt

SEQ ID NO: 113647 - DNA, 10 bp, Unknown
  misc_feature (1)..( 10): Result.002 file - promoters60/1403210
tttttaattt

SEQ ID NO: 113648 - DNA, 10 bp, Unknown
  misc_feature (1)..( 10): Result.002 file - promoters60/1403210
tttttatttt

SEQ ID NO: 113649 - DNA, 9 bp, Unknown
  misc_feature (1)..( 9): Result.002 file - promoters60/1403210
atggatact

SEQ ID NO: 113650 - DNA, 9 bp, Unknown
  misc_feature (1)..( 9): Result.002 file - promoters60/1403210
atggttact

SEQ ID NO: 113651 - DNA, 7 bp, Unknown
  misc_feature (1)..( 7): Result.002 file - promoters60/1403210
tttactc

SEQ ID NO: 113652 - DNA, 7 bp, Unknown
  misc_feature (1)..( 7): Result.002 file - promoters60/1403210
tttactc

SEQ ID NO: 113653 - DNA, 8 bp, Unknown
  misc_feature (1)..( 8): Result.002 file - promoters60/1403210
ttctcttc

SEQ ID NO: 113654 - DNA, 8 bp, Unknown
  misc_feature (1)..( 8): Result.002 file - promoters60/1403210
ttctgttc

SEQ ID NO: 113655 - DNA, 6 bp, Unknown
  misc_feature (1)..( 6): Result.002 file - promoters60/1403210
tttctt

SEQ ID NO: 113656 - DNA, 6 bp, Unknown
  misc_feature (1)..( 6): Result.002 file - promoters60/1403210
tttctt

SEQ ID NO: 113657 - DNA, 10 bp, Unknown
  misc_feature (1)..( 10): Result.002 file - promoters60/1411578
atgagaatcc

SEQ ID NO: 113658 - DNA, 10 bp, Unknown
  misc_feature (1)..( 10): Result.002 file - promoters60/1411578
atgagaactc

SEQ ID NO: 113659 - DNA, 7 bp, Unknown
  misc_feature (1)..( 7): Result.002 file - promoters60/1411578
agaagag

SEQ ID NO: 113660 - DNA, 8 bp, Unknown
  misc_feature (1)..( 8): Result.002 file - promoters60/1411578
agaagatg

SEQ ID NO: 113661 - DNA, 8 bp, Unknown
  misc_feature (1)..( 8): Result.002 file - promoters60/1411578
cgaatatg

SEQ ID NO: 113662 - DNA, 8 bp, Unknown
  misc_feature (1)..( 8): Result.002 file - promoters60/1411578
agaagagt

SEQ ID NO: 113663 - DNA, 9 bp, Unknown
  misc_feature (1)..( 9): Result.002 file - promoters60/1411578
acattgttt

SEQ ID NO: 113664 - DNA, 9 bp, Unknown
  misc_feature (1)..( 9): Result.002 file - promoters60/1411578
cgatttttt

SEQ ID NO: 113665 - DNA, 9 bp, Unknown
  misc_feature (1)..( 9): Result.002 file - promoters60/1411578
acattgtta

SEQ ID NO: 113666 - DNA, 7 bp, Unknown
  misc_feature (1)..( 7): Result.002 file - promoters60/1411578
aaactta

SEQ ID NO: 113667 - DNA, 7 bp, Unknown
  misc_feature (1)..( 7): Result.002 file - promoters60/1411578
aaactta

SEQ ID NO: 113668 - DNA, 7 bp, Unknown
  misc_feature (1)..( 7): Result.002 file - promoters60/1411578
aaattta

SEQ ID NO: 113669 - DNA, 6 bp, Unknown
  misc_feature (1)..( 6): Result.002 file - promoters60/1411598
aaaaga

SEQ ID NO: 113670 - DNA, 6 bp, Unknown
  misc_feature (1)..( 6): Result.002 file - promoters60/1411598
aaaaga

SEQ ID NO: 113671 - DNA, 7 bp, Unknown
  misc_feature (1)..( 7): Result.002 file - promoters60/1411598
acaaaaa

SEQ ID NO: 113672 - DNA, 7 bp, Unknown
  misc_feature (1)..( 7): Result.002 file - promoters60/1411598
acaaaaa

SEQ ID NO: 113673 - DNA, 6 bp, Unknown
  misc_feature (1)..( 6): Result.002 file - promoters60/1411598
cttgaa

SEQ ID NO: 113674 - DNA, 6 bp, Unknown
  misc_feature (1)..( 6): Result.002 file - promoters60/1411598
cttgaa

SEQ ID NO: 113675 - DNA, 8 bp, Unknown
  misc_feature (1)..( 8): Result.002 file - promoters60/1411598
ttagaaaa

SEQ ID NO: 113676 - DNA, 8 bp, Unknown
  misc_feature (1)..( 8): Result.002 file - promoters60/1411598
ttaaaaaa

SEQ ID NO: 113677 - DNA, 6 bp, Unknown
  misc_feature (1)..( 6): Result.002 file - promoters60/1411598
tacttt

SEQ ID NO: 113678 - DNA, 6 bp, Unknown
  misc_feature (1)..( 6): Result.002 file - promoters60/1411598
tacttt

SEQ ID NO: 113679 - DNA, 7 bp, Unknown
  misc_feature (1)..( 7): Result.002 file - promoters60/1411598
acaaaaa

SEQ ID NO: 113680 - DNA, 7 bp, Unknown
  misc_feature (1)..( 7): Result.002 file - promoters60/1411598
acataaa

SEQ ID NO: 113681 - DNA, 7 bp, Unknown
  misc_feature (1)..( 7): Result.002 file - promoters60/1411598
ccataaa

SEQ ID NO: 113682 - DNA, 8 bp, Unknown
  misc_feature (1)..( 8): Result.002 file - promoters60/1411598
aggatgtt

SEQ ID NO: 113683 - DNA, 8 bp, Unknown
  misc_feature (1)..( 8): Result.002 file - promoters60/1411598
aggaagtt

SEQ ID NO: 113684 - DNA, 6 bp, Unknown
  misc_feature (1)..( 6): Result.002 file - promoters60/1411598
caaaat

SEQ ID NO: 113685 - DNA, 6 bp, Unknown
  misc_feature (1)..( 6): Result.002 file - promoters60/1411598
caaaat

SEQ ID NO: 113686 - DNA, 9 bp, Unknown
  misc_feature (1)..( 9): Result.002 file - promoters60/1411598
tacccaaat

SEQ ID NO: 113687 - DNA, 9 bp, Unknown
  misc_feature (1)..( 9): Result.002 file - promoters60/1411598
taccccaat

SEQ ID NO: 113688 - DNA, 9 bp, Unknown
  misc_feature (1)..( 9): Result.002 file - promoters60/1411598
atatgattt

SEQ ID NO: 113689 - DNA, 9 bp, Unknown
  misc_feature (1)..( 9): Result.002 file - promoters60/1411598
atatgattt

SEQ ID NO: 113690 - DNA, 8 bp, Unknown
  misc_feature (1)..( 8): Result.002 file - promoters60/1411598
ttctatct

SEQ ID NO: 113691 - DNA, 8 bp, Unknown
  misc_feature (1)..( 8): Result.002 file - promoters60/1411598
ttctttct

SEQ ID NO: 113692 - DNA, 7 bp, Unknown
  misc_feature (1)..( 7): Result.002 file - promoters60/1411598
cttagaa

SEQ ID NO: 113693 - DNA, 7 bp, Unknown
  misc_feature (1)..( 7): Result.002 file - promoters60/1411598
cttcgaa

SEQ ID NO: 113694 - DNA, 7 bp, Unknown
  misc_feature (1)..( 7): Result.002 file - promoters60/1411598
gaaaaat

SEQ ID NO: 113695 - DNA, 7 bp, Unknown
  misc_feature (1)..( 7): Result.002 file - promoters60/1411598
gaaaaat

SEQ ID NO: 113696 - DNA, 6 bp, Unknown
  misc_feature (1)..( 6): Result.002 file - promoters60/1411598
attgga

SEQ ID NO: 113697 - DNA, 6 bp, Unknown
  misc_feature (1)..( 6): Result.002 file - promoters60/1411598
attgga

SEQ ID NO: 113698 - DNA, 6 bp, Unknown
  misc_feature (1)..( 6): Result.002 file - promoters60/1411598
agttgg

SEQ ID NO: 113699 - DNA, 6 bp, Unknown
  misc_feature (1)..( 6): Result.002 file - promoters60/1411598
agttgg

SEQ ID NO: 113700 - DNA, 6 bp, Unknown
  misc_feature (1)..( 6): Result.002 file - promoters60/1411598
tttaat

SEQ ID NO: 113701 - DNA, 6 bp, Unknown
  misc_feature (1)..( 6): Result.002 file - promoters60/1411598
tttaat

SEQ ID NO: 113702 - DNA, 6 bp, Unknown
  misc_feature (1)..( 6): Result.002 file - promoters60/1411598
ttgatt

SEQ ID NO: 113703 - DNA, 6 bp, Unknown
  misc_feature (1)..( 6): Result.002 file - promoters60/1411598
ttgatt

SEQ ID NO: 113704 - DNA, 9 bp, Unknown
  misc_feature (1)..( 9): Result.002 file - promoters60/1411616
ttttgaaat

SEQ ID NO: 113705 - DNA, 9 bp, Unknown
  misc_feature (1)..( 9): Result.002 file - promoters60/1411616
tttagaaga

SEQ ID NO: 113706 - DNA, 9 bp, Unknown
  misc_feature (1)..( 9): Result.002 file - promoters60/1411616
tgtagaaga

SEQ ID NO: 113707 - DNA, 7 bp, Unknown
  misc_feature (1)..( 7): Result.002 file - promoters60/1411616
caaataa

SEQ ID NO: 113708 - DNA, 7 bp, Unknown
  misc_feature (1)..( 7): Result.002 file - promoters60/1411616
aaaataa

SEQ ID NO: 113709 - DNA, 8 bp, Unknown
  misc_feature (1)..( 8): Result.002 file - promoters60/1411616
aaacatat

SEQ ID NO: 113710 - DNA, 8 bp, Unknown
  misc_feature (1)..( 8): Result.002 file - promoters60/1411616
taaaacag

SEQ ID NO: 113711 - DNA, 8 bp, Unknown
  misc_feature (1)..( 8): Result.002 file - promoters60/1411616
aaaatcag

SEQ ID NO: 113712 - DNA, 8 bp, Unknown
  misc_feature (1)..( 8): Result.002 file - promoters60/1411616
aaaatcct

SEQ ID NO: 113713 - DNA, 14 bp, Unknown
  misc_feature (1)..( 14): Result.002 file - promoters60/1411616
aacaaatttgtttt

SEQ ID NO: 113714 - DNA, 14 bp, Unknown
  misc_feature (1)..( 14): Result.002 file - promoters60/1411616
tagtaacatgtttt

SEQ ID NO: 113715 - DNA, 14 bp, Unknown
  misc_feature (1)..( 14): Result.002 file - promoters60/1411616
aaaaaacttgtttt

SEQ ID NO: 113716 - DNA, 14 bp, Unknown
  misc_feature (1)..( 14): Result.002 file - promoters60/1411616
aaaaaactaaaata

SEQ ID NO: 113717 - DNA, 9 bp, Unknown
  misc_feature (1)..( 9): Result.002 file - promoters60/1411616
ttttcattt

SEQ ID NO: 113718 - DNA, 9 bp, Unknown
  misc_feature (1)..( 9): Result.002 file - promoters60/1411616
cttttattt

SEQ ID NO: 113719 - DNA, 9 bp, Unknown
  misc_feature (1)..( 9): Result.002 file - promoters60/1411616
attttaatt

SEQ ID NO: 113720 - DNA, 9 bp, Unknown
  misc_feature (1)..( 9): Result.002 file - promoters60/1411616
attttcatt

SEQ ID NO: 113721 - DNA, 9 bp, Unknown
  misc_feature (1)..( 9): Result.002 file - promoters60/1411616
attttcgta

SEQ ID NO: 113722 - DNA, 9 bp, Unknown
  misc_feature (1)..( 9): Result.002 file - promoters60/1411616
attttaatt

SEQ ID NO: 113723 - DNA, 8 bp, Unknown
  misc_feature (1)..( 8): Result.002 file - promoters60/1411616
agaacata

SEQ ID NO: 113724 - DNA, 8 bp, Unknown
  misc_feature (1)..( 8): Result.002 file - promoters60/1411616
cgaaaata

SEQ ID NO: 113725 - DNA, 8 bp, Unknown
  misc_feature (1)..( 8): Result.002 file - promoters60/1411616
agaagata

SEQ ID NO: 113726 - DNA, 7 bp, Unknown
  misc_feature (1)..( 7): Result.002 file - promoters60/1411616
aaacaaa

SEQ ID NO: 113727 - DNA, 7 bp, Unknown
  misc_feature (1)..( 7): Result.002 file - promoters60/1411616
aaaaaaa

SEQ ID NO: 113728 - DNA, 7 bp, Unknown
  misc_feature (1)..( 7): Result.002 file - promoters60/1411616
aaaaaac

SEQ ID NO: 113729 - DNA, 8 bp, Unknown
  misc_feature (1)..( 8): Result.002 file - promoters60/1411616
aattattt

SEQ ID NO: 113730 - DNA, 8 bp, Unknown
  misc_feature (1)..( 8): Result.002 file - promoters60/1411616
tattattt

SEQ ID NO: 113731 - DNA, 8 bp, Unknown
  misc_feature (1)..( 8): Result.002 file - promoters60/1411616
tattgttt

SEQ ID NO: 113732 - DNA, 8 bp, Unknown
  misc_feature (1)..( 8): Result.002 file - promoters60/1411616
actaaaga

SEQ ID NO: 113733 - DNA, 8 bp, Unknown
  misc_feature (1)..( 8): Result.002 file - promoters60/1411616
tataaaga

SEQ ID NO: 113734 - DNA, 8 bp, Unknown
  misc_feature (1)..( 8): Result.002 file - promoters60/1411616
tataaaga

SEQ ID NO: 113735 - DNA, 7 bp, Unknown
  misc_feature (1)..( 7): Result.002 file - promoters60/1413159
tttgggt

SEQ ID NO: 113736 - DNA, 7 bp, Unknown
  misc_feature (1)..( 7): Result.002 file - promoters60/1413159
tttaggt

SEQ ID NO: 113737 - DNA, 7 bp, Unknown
  misc_feature (1)..( 7): Result.002 file - promoters60/1413159
acaaagg

SEQ ID NO: 113738 - DNA, 7 bp, Unknown
  misc_feature (1)..( 7): Result.002 file - promoters60/1413159
acaaagg

SEQ ID NO: 113739 - DNA, 7 bp, Unknown
  misc_feature (1)..( 7): Result.002 file - promoters60/1413159
ttttgtt

SEQ ID NO: 113740 - DNA, 7 bp, Unknown
  misc_feature (1)..( 7): Result.002 file - promoters60/1413159
tttggtt

SEQ ID NO: 113741 - DNA, 7 bp, Unknown
  misc_feature (1)..( 7): Result.002 file - promoters60/1413159
ttgtgat

SEQ ID NO: 113742 - DNA, 7 bp, Unknown
  misc_feature (1)..( 7): Result.002 file - promoters60/1413159
ctgtgat

SEQ ID NO: 113743 - DNA, 7 bp, Unknown
  misc_feature (1)..( 7): Result.002 file - promoters60/1413159
ttgtgaa

SEQ ID NO: 113744 - DNA, 7 bp, Unknown
  misc_feature (1)..( 7): Result.002 file - promoters60/1413159
aaacgat

SEQ ID NO: 113745 - DNA, 7 bp, Unknown
  misc_feature (1)..( 7): Result.002 file - promoters60/1413159
aaaagat

SEQ ID NO: 113746 - DNA, 6 bp, Unknown
  misc_feature (1)..( 6): Result.002 file - promoters60/1413159
tggaga

SEQ ID NO: 113747 - DNA, 6 bp, Unknown
  misc_feature (1)..( 6): Result.002 file - promoters60/1413159
tggaga

SEQ ID NO: 113748 - DNA, 7 bp, Unknown
  misc_feature (1)..( 7): Result.002 file - promoters60/1413159
gaagcta

SEQ ID NO: 113749 - DNA, 7 bp, Unknown
  misc_feature (1)..( 7): Result.002 file - promoters60/1413159
gaagcta

SEQ ID NO: 113750 - DNA, 6 bp, Unknown
  misc_feature (1)..( 6): Result.002 file - promoters60/1413159
atgaaa

SEQ ID NO: 113751 - DNA, 6 bp, Unknown
  misc_feature (1)..( 6): Result.002 file - promoters60/1413159
atgaaa

SEQ ID NO: 113752 - DNA, 6 bp, Unknown
  misc_feature (1)..( 6): Result.002 file - promoters60/1413159
acactt

SEQ ID NO: 113753 - DNA, 6 bp, Unknown
  misc_feature (1)..( 6): Result.002 file - promoters60/1413159
acactt

SEQ ID NO: 113754 - DNA, 7 bp, Unknown
  misc_feature (1)..( 7): Result.002 file - promoters60/1413159
tgttttg

SEQ ID NO: 113755 - DNA, 7 bp, Unknown
  misc_feature (1)..( 7): Result.002 file - promoters60/1413159
tgtcttg

SEQ ID NO: 113756 - DNA, 8 bp, Unknown
  misc_feature (1)..( 8): Result.002 file - promoters60/1413159
ttactttt

SEQ ID NO: 113757 - DNA, 8 bp, Unknown
  misc_feature (1)..( 8): Result.002 file - promoters60/1413159
ttacattt

SEQ ID NO: 113758 - DNA, 6 bp, Unknown
  misc_feature (1)..( 6): Result.002 file - promoters60/1413159
ttataa

SEQ ID NO: 113759 - DNA, 6 bp, Unknown
  misc_feature (1)..( 6): Result.002 file - promoters60/1413159
ttataa

SEQ ID NO: 113760 - DNA, 10 bp, Unknown
  misc_feature (1)..( 10): Result.002 file - promoters60/1413159
atataacaaa

SEQ ID NO: 113761 - DNA, 10 bp, Unknown
  misc_feature (1)..( 10): Result.002 file - promoters60/1413159
atacaacaaa

SEQ ID NO: 113762 - DNA, 11 bp, Unknown
  misc_feature (1)..( 11): Result.002 file - promoters60/1413191
actattttgac

SEQ ID NO: 113763 - DNA, 11 bp, Unknown
  misc_feature (1)..( 11): Result.002 file - promoters60/1413191
tgtgttttgac

SEQ ID NO: 113764 - DNA, 11 bp, Unknown
  misc_feature (1)..( 11): Result.002 file - promoters60/1413191
acttttttgtt

SEQ ID NO: 113765 - DNA, 11 bp, Unknown
  misc_feature (1)..( 11): Result.002 file - promoters60/1413191
tttatgttgtt

SEQ ID NO: 113766 - DNA, 11 bp, Unknown
  misc_feature (1)..( 11): Result.002 file - promoters60/1413191
taaatgttgca

SEQ ID NO: 113767 - DNA, 11 bp, Unknown
  misc_feature (1)..( 11): Result.002 file - promoters60/1413191
tctttttttgg

SEQ ID NO: 113768 - DNA, 9 bp, Unknown
  misc_feature (1)..( 9): Result.002 file - promoters60/1413191
gatataaga

SEQ ID NO: 113769 - DNA, 9 bp, Unknown
  misc_feature (1)..( 9): Result.002 file - promoters60/1413191
gatttaaaa

SEQ ID NO: 113770 - DNA, 9 bp, Unknown
  misc_feature (1)..( 9): Result.002 file - promoters60/1413191
aattcaaaa

SEQ ID NO: 113771 - DNA, 9 bp, Unknown
  misc_feature (1)..( 9): Result.002 file - promoters60/1413191
aatttaatg

SEQ ID NO: 113772 - DNA, 9 bp, Unknown
  misc_feature (1)..( 9): Result.002 file - promoters60/1413191
tatttaaac

SEQ ID NO: 113773 - DNA, 9 bp, Unknown
  misc_feature (1)..( 9): Result.002 file - promoters60/1413191
gctttaatt

SEQ ID NO: 113774 - DNA, 9 bp, Unknown
  misc_feature (1)..( 9): Result.002 file - promoters60/1413211
gtcagatca

SEQ ID NO: 113775 - DNA, 9 bp, Unknown
  misc_feature (1)..( 9): Result.002 file - promoters60/1413211
gtcggatca

SEQ ID NO: 113776 - DNA, 9 bp, Unknown
  misc_feature (1)..( 9): Result.002 file - promoters60/1413211
atagtcaac

SEQ ID NO: 113777 - DNA, 9 bp, Unknown
  misc_feature (1)..( 9): Result.002 file - promoters60/1413211
ttagtcata

SEQ ID NO: 113778 - DNA, 9 bp, Unknown
  misc_feature (1)..( 9): Result.002 file - promoters60/1413211
ataatcaac

SEQ ID NO: 113779 - DNA, 6 bp, Unknown
  misc_feature (1)..( 6): Result.002 file - promoters60/1413211
aataat

SEQ ID NO: 113780 - DNA, 6 bp, Unknown
  misc_feature (1)..( 6): Result.002 file - promoters60/1413211
aataat

SEQ ID NO: 113781 - DNA, 7 bp, Unknown
  misc_feature (1)..( 7): Result.002 file - promoters60/1413211
tctaatt

SEQ ID NO: 113782 - DNA, 7 bp, Unknown
  misc_feature (1)..( 7): Result.002 file - promoters60/1413211
tctaatt

SEQ ID NO: 113783 - DNA, 9 bp, Unknown
  misc_feature (1)..( 9): Result.002 file - promoters60/1413211
aaaatagaa

SEQ ID NO: 113784 - DNA, 9 bp, Unknown
  misc_feature (1)..( 9): Result.002 file - promoters60/1413211
aaaaaagaa

SEQ ID NO: 113785 - DNA, 7 bp, Unknown
  misc_feature (1)..( 7): Result.002 file - promoters60/1413211
ccaacat

SEQ ID NO: 113786 - DNA, 7 bp, Unknown
  misc_feature (1)..( 7): Result.002 file - promoters60/1413211
ccaacat

SEQ ID NO: 113787 - DNA, 6 bp, Unknown
  misc_feature (1)..( 6): Result.002 file - promoters60/1413211
taattt

SEQ ID NO: 113788 - DNA, 6 bp, Unknown
  misc_feature (1)..( 6): Result.002 file - promoters60/1413211
taattt

SEQ ID NO: 113789 - DNA, 13 bp, Unknown
  misc_feature (1)..( 13): Result.002 file - promoters60/1413211
tgatgaaaaggat

SEQ ID NO: 113790 - DNA, 13 bp, Unknown
  misc_feature (1)..( 13): Result.002 file - promoters60/1413211
tgatgtaaatgat

SEQ ID NO: 113791 - DNA, 13 bp, Unknown
  misc_feature (1)..( 13): Result.002 file - promoters60/1413211
aatttaaaatgaa

SEQ ID NO: 113792 - DNA, 7 bp, Unknown
  misc_feature (1)..( 7): Result.002 file - promoters60/1413211
gacaaaa

SEQ ID NO: 113793 - DNA, 7 bp, Unknown
  misc_feature (1)..( 7): Result.002 file - promoters60/1413211
gacaaaa

SEQ ID NO: 113794 - DNA, 6 bp, Unknown
  misc_feature (1)..( 6): Result.002 file - promoters60/1413211
aaaagg

SEQ ID NO: 113795 - DNA, 6 bp, Unknown
  misc_feature (1)..( 6): Result.002 file - promoters60/1413211
aaaagg

SEQ ID NO: 113796 - DNA, 6 bp, Unknown
  misc_feature (1)..( 6): Result.002 file - promoters60/1413211
ctactt

SEQ ID NO: 113797 - DNA, 6 bp, Unknown
  misc_feature (1)..( 6): Result.002 file - promoters60/1413211
ctactt

SEQ ID NO: 113798 - DNA, 7 bp, Unknown
  misc_feature (1)..( 7): Result.002 file - promoters60/1413211
ctctact

SEQ ID NO: 113799 - DNA, 7 bp, Unknown
  misc_feature (1)..( 7): Result.002 file - promoters60/1413211
ctctact

SEQ ID NO: 113800 - DNA, 6 bp, Unknown
  misc_feature (1)..( 6): Result.002 file - promoters60/1413211
atttaa

SEQ ID NO: 113801 - DNA, 6 bp, Unknown
  misc_feature (1)..( 6): Result.002 file - promoters60/1413211
atttaa

SEQ ID NO: 113802 - DNA, 7 bp, Unknown
  misc_feature (1)..( 7): Result.002 file - promoters60/1413211
ccatatc

SEQ ID NO: 113803 - DNA, 7 bp, Unknown
  misc_feature (1)..( 7): Result.002 file - promoters60/1413211
ccaaatc

SEQ ID NO: 113804 - DNA, 8 bp, Unknown
  misc_feature (1)..( 8): Result.002 file - promoters60/1413211
tctgtttt

SEQ ID NO: 113805 - DNA, 8 bp, Unknown
  misc_feature (1)..( 8): Result.002 file - promoters60/1413211
tctggttt

SEQ ID NO: 113806 - DNA, 7 bp, Unknown
  misc_feature (1)..( 7): Result.002 file - promoters60/1413211
aaactat

SEQ ID NO: 113807 - DNA, 7 bp, Unknown
  misc_feature (1)..( 7): Result.002 file - promoters60/1413211
aaattat

SEQ ID NO: 113808 - DNA, 7 bp, Unknown
  misc_feature (1)..( 7): Result.002 file - promoters60/1413211
taaatta

SEQ ID NO: 113809 - DNA, 7 bp, Unknown
  misc_feature (1)..( 7): Result.002 file - promoters60/1413211
taattta

SEQ ID NO: 113810 - DNA, 6 bp, Unknown
  misc_feature (1)..( 6): Result.002 file - promoters60/1420853
tttagt

SEQ ID NO: 113811 - DNA, 6 bp, Unknown
  misc_feature (1)..( 6): Result.002 file - promoters60/1420853
tttagt

SEQ ID NO: 113812 - DNA, 7 bp, Unknown
  misc_feature (1)..( 7): Result.002 file - promoters60/1420853
gaaaata

SEQ ID NO: 113813 - DNA, 7 bp, Unknown
  misc_feature (1)..( 7): Result.002 file - promoters60/1420853
gaacata

SEQ ID NO: 113814 - DNA, 8 bp, Unknown
  misc_feature (1)..( 8): Result.002 file - promoters60/1420853
ttctacat

SEQ ID NO: 113815 - DNA, 8 bp, Unknown
  misc_feature (1)..( 8): Result.002 file - promoters60/1420853
ttcgacat

SEQ ID NO: 113816 - DNA, 8 bp, Unknown
  misc_feature (1)..( 8): Result.002 file - promoters60/1420853
tatggttt

SEQ ID NO: 113817 - DNA, 8 bp, Unknown
  misc_feature (1)..( 8): Result.002 file - promoters60/1420853
tatgtttt

SEQ ID NO: 113818 - DNA, 9 bp, Unknown
  misc_feature (1)..( 9): Result.002 file - promoters60/1420853
cgtatttaa

SEQ ID NO: 113819 - DNA, 9 bp, Unknown
  misc_feature (1)..( 9): Result.002 file - promoters60/1420853
cgtatgtaa

SEQ ID NO: 113820 - DNA, 8 bp, Unknown
  misc_feature (1)..( 8): Result.002 file - promoters60/1420853
aatataat

SEQ ID NO: 113821 - DNA, 8 bp, Unknown
  misc_feature (1)..( 8): Result.002 file - promoters60/1420853
aatttaat

SEQ ID NO: 113822 - DNA, 8 bp, Unknown
  misc_feature (1)..( 8): Result.002 file - promoters60/1420853
aggcttta

SEQ ID NO: 113823 - DNA, 8 bp, Unknown
  misc_feature (1)..( 8): Result.002 file - promoters60/1420853
aggattta

SEQ ID NO: 113824 - DNA, 6 bp, Unknown
  misc_feature (1)..( 6): Result.002 file - promoters60/1420853
aaatat

SEQ ID NO: 113825 - DNA, 6 bp, Unknown
  misc_feature (1)..( 6): Result.002 file - promoters60/1420853
aaatat

SEQ ID NO: 113826 - DNA, 7 bp, Unknown
  misc_feature (1)..( 7): Result.002 file - promoters60/1420853
cagcctt

SEQ ID NO: 113827 - DNA, 7 bp, Unknown
  misc_feature (1)..( 7): Result.002 file - promoters60/1420853
cagcctt

SEQ ID NO: 113828 - DNA, 6 bp, Unknown
  misc_feature (1)..( 6): Result.002 file - promoters60/1420853
tataca

SEQ ID NO: 113829 - DNA, 6 bp, Unknown
  misc_feature (1)..( 6): Result.002 file - promoters60/1420853
tataca

SEQ ID NO: 113830 - DNA, 7 bp, Unknown
  misc_feature (1)..( 7): Result.002 file - promoters60/1420853
ttagatc

SEQ ID NO: 113831 - DNA, 7 bp, Unknown
  misc_feature (1)..( 7): Result.002 file - promoters60/1420853
ttagatc

SEQ ID NO: 113832 - DNA, 8 bp, Unknown
  misc_feature (1)..( 8): Result.002 file - promoters60/1420853
taattgta

SEQ ID NO: 113833 - DNA, 8 bp, Unknown
  misc_feature (1)..( 8): Result.002 file - promoters60/1420853
taaatgta

SEQ ID NO: 113834 - DNA, 6 bp, Unknown
  misc_feature (1)..( 6): Result.002 file - promoters60/1420853
atgtct

SEQ ID NO: 113835 - DNA, 6 bp, Unknown
  misc_feature (1)..( 6): Result.002 file - promoters60/1420853
atgtct

SEQ ID NO: 113836 - DNA, 7 bp, Unknown
  misc_feature (1)..( 7): Result.002 file - promoters60/1420853
ttggaga

SEQ ID NO: 113837 - DNA, 7 bp, Unknown
  misc_feature (1)..( 7): Result.002 file - promoters60/1420853
ttggaga

SEQ ID NO: 113838 - DNA, 6 bp, Unknown
  misc_feature (1)..( 6): Result.002 file - promoters60/1420853
gaagat

SEQ ID NO: 113839 - DNA, 6 bp, Unknown
  misc_feature (1)..( 6): Result.002 file - promoters60/1420853
gaagat

SEQ ID NO: 113840 - DNA, 6 bp, Unknown
  misc_feature (1)..( 6): Result.002 file - promoters60/1420853
gatcga

SEQ ID NO: 113841 - DNA, 6 bp, Unknown
  misc_feature (1)..( 6): Result.002 file - promoters60/1420853
gatcga

SEQ ID NO: 113842 - DNA, 6 bp, Unknown
  misc_feature (1)..( 6): Result.002 file - promoters60/1420853
aaatgc

SEQ ID NO: 113843 - DNA, 6 bp, Unknown
  misc_feature (1)..( 6): Result.002 file - promoters60/1420853
aaatgc

SEQ ID NO: 113844 - DNA, 8 bp, Unknown
  misc_feature (1)..( 8): Result.002 file - promoters60/1420853
ggatttgt

SEQ ID NO: 113845 - DNA, 8 bp, Unknown
  misc_feature (1)..( 8): Result.002 file - promoters60/1420853
ggacttgt

SEQ ID NO: 113846 - DNA, 10 bp, Unknown
  misc_feature (1)..( 10): Result.002 file - promoters60/1440865
gaaaaaaaga

SEQ ID NO: 113847 - DNA, 10 bp, Unknown
  misc_feature (1)..( 10): Result.002 file - promoters60/1440865
taaaaataga

SEQ ID NO: 113848 - DNA, 10 bp, Unknown
  misc_feature (1)..( 10): Result.002 file - promoters60/1440865
gaaaaatgta

SEQ ID NO: 113849 - DNA, 6 bp, Unknown
  misc_feature (1)..( 6): Result.002 file - promoters60/1440865
agaaaa

SEQ ID NO: 113850 - DNA, 6 bp, Unknown
  misc_feature (1)..( 6): Result.002 file - promoters60/1440865
agaaaa

SEQ ID NO: 113851 - DNA, 6 bp, Unknown
  misc_feature (1)..( 6): Result.002 file - promoters60/1440865
aacaga

SEQ ID NO: 113852 - DNA, 6 bp, Unknown
  misc_feature (1)..( 6): Result.002 file - promoters60/1440865
aacaga

SEQ ID NO: 113853 - DNA, 7 bp, Unknown
  misc_feature (1)..( 7): Result.002 file - promoters60/1440865
aataaaa

SEQ ID NO: 113854 - DNA, 7 bp, Unknown
  misc_feature (1)..( 7): Result.002 file - promoters60/1440865
aataaaa

SEQ ID NO: 113855 - DNA, 7 bp, Unknown
  misc_feature (1)..( 7): Result.002 file - promoters60/1440865
accgaaa

SEQ ID NO: 113856 - DNA, 7 bp, Unknown
  misc_feature (1)..( 7): Result.002 file - promoters60/1440865
accaaaa

SEQ ID NO: 113857 - DNA, 6 bp, Unknown
  misc_feature (1)..( 6): Result.002 file - promoters60/1440865
aaaaag

SEQ ID NO: 113858 - DNA, 6 bp, Unknown
  misc_feature (1)..( 6): Result.002 file - promoters60/1440865
aaaaag

SEQ ID NO: 113859 - DNA, 7 bp, Unknown
  misc_feature (1)..( 7): Result.002 file - promoters60/1440865
attacgt

SEQ ID NO: 113860 - DNA, 7 bp, Unknown
  misc_feature (1)..( 7): Result.002 file - promoters60/1440865
attccgt

SEQ ID NO: 113861 - DNA, 9 bp, Unknown
  misc_feature (1)..( 9): Result.002 file - promoters60/1440865
aaattgaat

SEQ ID NO: 113862 - DNA, 9 bp, Unknown
  misc_feature (1)..( 9): Result.002 file - promoters60/1440865
aaaatgaat

SEQ ID NO: 113863 - DNA, 10 bp, Unknown
  misc_feature (1)..( 10): Result.002 file - promoters60/1440865
aatatgaaat

SEQ ID NO: 113864 - DNA, 10 bp, Unknown
  misc_feature (1)..( 10): Result.002 file - promoters60/1440865
aatttgaaat

SEQ ID NO: 113865 - DNA, 12 bp, Unknown
  misc_feature (1)..( 12): Result.002 file - promoters60/1440865
taccaaataaat

SEQ ID NO: 113866 - DNA, 12 bp, Unknown
  misc_feature (1)..( 12): Result.002 file - promoters60/1440865
tacaaaaaaaat

SEQ ID NO: 113867 - DNA, 6 bp, Unknown
  misc_feature (1)..( 6): Result.002 file - promoters60/1440865
aactaa

SEQ ID NO: 113868 - DNA, 6 bp, Unknown
  misc_feature (1)..( 6): Result.002 file - promoters60/1440865
aactaa

SEQ ID NO: 113869 - DNA, 7 bp, Unknown
  misc_feature (1)..( 7): Result.002 file - promoters60/1440865
agcaagt

SEQ ID NO: 113870 - DNA, 7 bp, Unknown
  misc_feature (1)..( 7): Result.002 file - promoters60/1440865
agcgagt

SEQ ID NO: 113871 - DNA, 7 bp, Unknown
  misc_feature (1)..( 7): Result.002 file - promoters60/1440865
taagatt

SEQ ID NO: 113872 - DNA, 7 bp, Unknown
  misc_feature (1)..( 7): Result.002 file - promoters60/1440865
taacatt

SEQ ID NO: 113873 - DNA, 6 bp, Unknown
  misc_feature (1)..( 6): Result.002 file - promoters60/1440865
aaaaaa

SEQ ID NO: 113874 - DNA, 6 bp, Unknown
  misc_feature (1)..( 6): Result.002 file - promoters60/1440865
aaaaaa

SEQ ID NO: 113875 - DNA, 7 bp, Unknown
  misc_feature (1)..( 7): Result.002 file - promoters60/1440865
tcataag

SEQ ID NO: 113876 - DNA, 7 bp, Unknown
  misc_feature (1)..( 7): Result.002 file - promoters60/1440865
tcaaaag

SEQ ID NO: 113877 - DNA, 7 bp, Unknown
  misc_feature (1)..( 7): Result.002 file - promoters60/1440865
caaaaag

SEQ ID NO: 113878 - DNA, 7 bp, Unknown
  misc_feature (1)..( 7): Result.002 file - promoters60/1440865
caataag

SEQ ID NO: 113879 - DNA, 6 bp, Unknown
  misc_feature (1)..( 6): Result.002 file - promoters60/1440865
aatata

SEQ ID NO: 113880 - DNA, 6 bp, Unknown
  misc_feature (1)..( 6): Result.002 file - promoters60/1440865
aatata

SEQ ID NO: 113881 - DNA, 7 bp, Unknown
  misc_feature (1)..( 7): Result.002 file - promoters60/1440865
gacattt

SEQ ID NO: 113882 - DNA, 7 bp, Unknown
  misc_feature (1)..( 7): Result.002 file - promoters60/1440865
gaccttt

SEQ ID NO: 113883 - DNA, 9 bp, Unknown
  misc_feature (1)..( 9): Result.002 file - promoters60/1440873
caaaaaaac

SEQ ID NO: 113884 - DNA, 9 bp, Unknown
  misc_feature (1)..( 9): Result.002 file - promoters60/1440873
caacaaaac

SEQ ID NO: 113885 - DNA, 10 bp, Unknown
  misc_feature (1)..( 10): Result.002 file - promoters60/1440873
aatcctaatc

SEQ ID NO: 113886 - DNA, 10 bp, Unknown
  misc_feature (1)..( 10): Result.002 file - promoters60/1440873
aatcataata

SEQ ID NO: 113887 - DNA, 10 bp, Unknown
  misc_feature (1)..( 10): Result.002 file - promoters60/1440873
ttccataata

SEQ ID NO: 113888 - DNA, 7 bp, Unknown
  misc_feature (1)..( 7): Result.002 file - promoters60/1440873
tgaacag

SEQ ID NO: 113889 - DNA, 7 bp, Unknown
  misc_feature (1)..( 7): Result.002 file - promoters60/1440873
tgaacag

SEQ ID NO: 113890 - DNA, 6 bp, Unknown
  misc_feature (1)..( 6): Result.002 file - promoters60/1440873
actcaa

SEQ ID NO: 113891 - DNA, 6 bp, Unknown
  misc_feature (1)..( 6): Result.002 file - promoters60/1440873
actcaa

SEQ ID NO: 113892 - DNA, 7 bp, Unknown
  misc_feature (1)..( 7): Result.002 file - promoters60/1440873
caacgta

SEQ ID NO: 113893 - DNA, 7 bp, Unknown
  misc_feature (1)..( 7): Result.002 file - promoters60/1440873
caaggta

SEQ ID NO: 113894 - DNA, 8 bp, Unknown
  misc_feature (1)..( 8): Result.002 file - promoters60/1440873
ttagacac

SEQ ID NO: 113895 - DNA, 8 bp, Unknown
  misc_feature (1)..( 8): Result.002 file - promoters60/1440873
ttagacac

SEQ ID NO: 113896 - DNA, 9 bp, Unknown
  misc_feature (1)..( 9): Result.002 file - promoters60/1440873
acagtttgt

SEQ ID NO: 113897 - DNA, 9 bp, Unknown
  misc_feature (1)..( 9): Result.002 file - promoters60/1440873
acattttgt

SEQ ID NO: 113898 - DNA, 7 bp, Unknown
  misc_feature (1)..( 7): Result.002 file - promoters60/1440873
tcaccaa

SEQ ID NO: 113899 - DNA, 7 bp, Unknown
  misc_feature (1)..( 7): Result.002 file - promoters60/1440873
tcaacaa

SEQ ID NO: 113900 - DNA, 7 bp, Unknown
  misc_feature (1)..( 7): Result.002 file - promoters60/1440873
aaatttt

SEQ ID NO: 113901 - DNA, 7 bp, Unknown
  misc_feature (1)..( 7): Result.002 file - promoters60/1440873
aaatttt

SEQ ID NO: 113902 - DNA, 6 bp, Unknown
  misc_feature (1)..( 6): Result.002 file - promoters60/1440873
tctttc

SEQ ID NO: 113903 - DNA, 6 bp, Unknown
  misc_feature (1)..( 6): Result.002 file - promoters60/1440873
tctttc

SEQ ID NO: 113904 - DNA, 7 bp, Unknown
  misc_feature (1)..( 7): Result.002 file - promoters60/1440873
taataat

SEQ ID NO: 113905 - DNA, 7 bp, Unknown
  misc_feature (1)..( 7): Result.002 file - promoters60/1440873
taagaat

SEQ ID NO: 113906 - DNA, 8 bp, Unknown
  misc_feature (1)..( 8): Result.002 file - promoters60/1440873
caaactta

SEQ ID NO: 113907 - DNA, 8 bp, Unknown
  misc_feature (1)..( 8): Result.002 file - promoters60/1440873
caatctta

SEQ ID NO: 113908 - DNA, 8 bp, Unknown
  misc_feature (1)..( 8): Result.002 file - promoters60/1440920
ttgagata

SEQ ID NO: 113909 - DNA, 8 bp, Unknown
  misc_feature (1)..( 8): Result.002 file - promoters60/1440920
ttgacata

SEQ ID NO: 113910 - DNA, 10 bp, Unknown
  misc_feature (1)..( 10): Result.002 file - promoters60/1440920
aaaattcttg

SEQ ID NO: 113911 - DNA, 10 bp, Unknown
  misc_feature (1)..( 10): Result.002 file - promoters60/1440920
aaacttcttg

SEQ ID NO: 113912 - DNA, 6 bp, Unknown
  misc_feature (1)..( 6): Result.002 file - promoters60/1440920
aaacaa

SEQ ID NO: 113913 - DNA, 6 bp, Unknown
  misc_feature (1)..( 6): Result.002 file - promoters60/1440920
aaacaa

SEQ ID NO: 113914 - DNA, 7 bp, Unknown
  misc_feature (1)..( 7): Result.002 file - promoters60/1440920
aaaaaat

SEQ ID NO: 113915 - DNA, 7 bp, Unknown
  misc_feature (1)..( 7): Result.002 file - promoters60/1440920
aaataat

SEQ ID NO: 113916 - DNA, 7 bp, Unknown
  misc_feature (1)..( 7): Result.002 file - promoters60/1440920
atagaat

SEQ ID NO: 113917 - DNA, 7 bp, Unknown
  misc_feature (1)..( 7): Result.002 file - promoters60/1440920
ataaaat

SEQ ID NO: 113918 - DNA, 8 bp, Unknown
  misc_feature (1)..( 8): Result.002 file - promoters60/1440920
aaacaaaa

SEQ ID NO: 113919 - DNA, 8 bp, Unknown
  misc_feature (1)..( 8): Result.002 file - promoters60/1440920
aaacgaaa

SEQ ID NO: 113920 - DNA, 7 bp, Unknown
  misc_feature (1)..( 7): Result.002 file - promoters60/1440920
aaaaaga

SEQ ID NO: 113921 - DNA, 7 bp, Unknown
  misc_feature (1)..( 7): Result.002 file - promoters60/1440920
aaagaga

SEQ ID NO: 113922 - DNA, 8 bp, Unknown
  misc_feature (1)..( 8): Result.002 file - promoters60/1440920
gtgtactt

SEQ ID NO: 113923 - DNA, 8 bp, Unknown
  misc_feature (1)..( 8): Result.002 file - promoters60/1440920
gtgaactt

SEQ ID NO: 113924 - DNA, 13 bp, Unknown
  misc_feature (1)..( 13): Result.002 file - promoters60/1440920
aaagtctccacat

SEQ ID NO: 113925 - DNA, 13 bp, Unknown
  misc_feature (1)..( 13): Result.002 file - promoters60/1440920
aaattctctacat

SEQ ID NO: 113926 - DNA, 6 bp, Unknown
  misc_feature (1)..( 6): Result.002 file - promoters60/1440920
aatgct

SEQ ID NO: 113927 - DNA, 6 bp, Unknown
  misc_feature (1)..( 6): Result.002 file - promoters60/1440920
aatgct

SEQ ID NO: 113928 - DNA, 6 bp, Unknown
  misc_feature (1)..( 6): Result.002 file - promoters60/1440920
atttga

SEQ ID NO: 113929 - DNA, 6 bp, Unknown
  misc_feature (1)..( 6): Result.002 file - promoters60/1440920
atttga

SEQ ID NO: 113930 - DNA, 11 bp, Unknown
  misc_feature (1)..( 11): Result.002 file - promoters60/1440967
attaaaaaaaa

SEQ ID NO: 113931 - DNA, 11 bp, Unknown
  misc_feature (1)..( 11): Result.002 file - promoters60/1440967
attcaaaacct

SEQ ID NO: 113932 - DNA, 12 bp, Unknown
  misc_feature (1)..( 12): Result.002 file - promoters60/1440967
attataaaaaag

SEQ ID NO: 113933 - DNA, 12 bp, Unknown
  misc_feature (1)..( 12): Result.002 file - promoters60/1440967
atccaaaaagaa

SEQ ID NO: 113934 - DNA, 9 bp, Unknown
  misc_feature (1)..( 9): Result.002 file - promoters60/1440967
aattaactt

SEQ ID NO: 113935 - DNA, 9 bp, Unknown
  misc_feature (1)..( 9): Result.002 file - promoters60/1440967
cattaacat

SEQ ID NO: 113936 - DNA, 9 bp, Unknown
  misc_feature (1)..( 9): Result.002 file - promoters60/1440967
aatcaactt

SEQ ID NO: 113937 - DNA, 9 bp, Unknown
  misc_feature (1)..( 9): Result.002 file - promoters60/1440967
tcttatcat

SEQ ID NO: 113938 - DNA, 11 bp, Unknown
  misc_feature (1)..( 11): Result.002 file - promoters60/1441000
aaattgctaag

SEQ ID NO: 113939 - DNA, 11 bp, Unknown
  misc_feature (1)..( 11): Result.002 file - promoters60/1441000
caatttctaca

SEQ ID NO: 113940 - DNA, 12 bp, Unknown
  misc_feature (1)..( 12): Result.002 file - promoters60/1441000
caagttgttaag

SEQ ID NO: 113941 - DNA, 12 bp, Unknown
  misc_feature (1)..( 12): Result.002 file - promoters60/1441000
caagttccgagg

SEQ ID NO: 113942 - DNA, 9 bp, Unknown
  misc_feature (1)..( 9): Result.002 file - promoters60/1441000
acaaaacat

SEQ ID NO: 113943 - DNA, 9 bp, Unknown
  misc_feature (1)..( 9): Result.002 file - promoters60/1441000
acaaagcat

SEQ ID NO: 113944 - DNA, 9 bp, Unknown
  misc_feature (1)..( 9): Result.002 file - promoters60/1441000
tcaaaaccg

SEQ ID NO: 113945 - DNA, 9 bp, Unknown
  misc_feature (1)..( 9): Result.002 file - promoters60/1441000
tcaaaattc

SEQ ID NO: 113946 - DNA, 7 bp, Unknown
  misc_feature (1)..( 7): Result.002 file - promoters60/1441020
tagaaag

SEQ ID NO: 113947 - DNA, 7 bp, Unknown
  misc_feature (1)..( 7): Result.002 file - promoters60/1441020
tagcaag

SEQ ID NO: 113948 - DNA, 6 bp, Unknown
  misc_feature (1)..( 6): Result.002 file - promoters60/1441020
atcaaa

SEQ ID NO: 113949 - DNA, 6 bp, Unknown
  misc_feature (1)..( 6): Result.002 file - promoters60/1441020
atcaaa

SEQ ID NO: 113950 - DNA, 6 bp, Unknown
  misc_feature (1)..( 6): Result.002 file - promoters60/1441020
atttgg

SEQ ID NO: 113951 - DNA, 6 bp, Unknown
  misc_feature (1)..( 6): Result.002 file - promoters60/1441020
atttgg

SEQ ID NO: 113952 - DNA, 6 bp, Unknown
  misc_feature (1)..( 6): Result.002 file - promoters60/1441020
atttga

SEQ ID NO: 113953 - DNA, 6 bp, Unknown
  misc_feature (1)..( 6): Result.002 file - promoters60/1441020
atttga

SEQ ID NO: 113954 - DNA, 7 bp, Unknown
  misc_feature (1)..( 7): Result.002 file - promoters60/1441020
agaatga

SEQ ID NO: 113955 - DNA, 7 bp, Unknown
  misc_feature (1)..( 7): Result.002 file - promoters60/1441020
agattga

SEQ ID NO: 113956 - DNA, 8 bp, Unknown
  misc_feature (1)..( 8): Result.002 file - promoters60/1441020
aattgaaa

SEQ ID NO: 113957 - DNA, 8 bp, Unknown
  misc_feature (1)..( 8): Result.002 file - promoters60/1441020
aatttaaa

SEQ ID NO: 113958 - DNA, 7 bp, Unknown
  misc_feature (1)..( 7): Result.002 file - promoters60/1441020
gcccaat

SEQ ID NO: 113959 - DNA, 7 bp, Unknown
  misc_feature (1)..( 7): Result.002 file - promoters60/1441020
gcctaat

SEQ ID NO: 113960 - DNA, 6 bp, Unknown
  misc_feature (1)..( 6): Result.002 file - promoters60/1441020
actttt

SEQ ID NO: 113961 - DNA, 6 bp, Unknown
  misc_feature (1)..( 6): Result.002 file - promoters60/1441020
actttt

SEQ ID NO: 113962 - DNA, 6 bp, Unknown
  misc_feature (1)..( 6): Result.002 file - promoters60/1441020
attctc

SEQ ID NO: 113963 - DNA, 6 bp, Unknown
  misc_feature (1)..( 6): Result.002 file - promoters60/1441020
attctc

SEQ ID NO: 113964 - DNA, 6 bp, Unknown
  misc_feature (1)..( 6): Result.002 file - promoters60/1441020
aatttg

SEQ ID NO: 113965 - DNA, 6 bp, Unknown
  misc_feature (1)..( 6): Result.002 file - promoters60/1441020
aatttg

SEQ ID NO: 113966 - DNA, 9 bp, Unknown
  misc_feature (1)..( 9): Result.002 file - promoters60/1441020
gattgcaaa

SEQ ID NO: 113967 - DNA, 9 bp, Unknown
  misc_feature (1)..( 9): Result.002 file - promoters60/1441020
gatggcaaa

SEQ ID NO: 113968 - DNA, 7 bp, Unknown
  misc_feature (1)..( 7): Result.002 file - promoters60/1441020
tgggctc

SEQ ID NO: 113969 - DNA, 7 bp, Unknown
  misc_feature (1)..( 7): Result.002 file - promoters60/1441020
tgggctc

SEQ ID NO: 113970 - DNA, 6 bp, Unknown
  misc_feature (1)..( 6): Result.002 file - promoters60/1441020
gattca

SEQ ID NO: 113971 - DNA, 6 bp, Unknown
  misc_feature (1)..( 6): Result.002 file - promoters60/1441020
gattca

SEQ ID NO: 113972 - DNA, 14 bp, Unknown
  misc_feature (1)..( 14): Result.002 file - promoters60/1441044
ttttttatagatta

SEQ ID NO: 113973 - DNA, 14 bp, Unknown
  misc_feature (1)..( 14): Result.002 file - promoters60/1441044
ctttatatagagac

SEQ ID NO: 113974 - DNA, 14 bp, Unknown
  misc_feature (1)..( 14): Result.002 file - promoters60/1441044
ttttctataaatta

SEQ ID NO: 113975 - DNA, 14 bp, Unknown
  misc_feature (1)..( 14): Result.002 file - promoters60/1441044
agagctaaaaacgg

SEQ ID NO: 113976 - DNA, 12 bp, Unknown
  misc_feature (1)..( 12): Result.002 file - promoters60/1441044
aatcacatatta

SEQ ID NO: 113977 - DNA, 12 bp, Unknown
  misc_feature (1)..( 12): Result.002 file - promoters60/1441044
actcatatatat

SEQ ID NO: 113978 - DNA, 12 bp, Unknown
  misc_feature (1)..( 12): Result.002 file - promoters60/1441044
actcatatatat

SEQ ID NO: 113979 - DNA, 12 bp, Unknown
  misc_feature (1)..( 12): Result.002 file - promoters60/1441044
acgtatatataa

SEQ ID NO: 113980 - DNA, 13 bp, Unknown
  misc_feature (1)..( 13): Result.002 file - promoters60/1441044
tcaaatttttttt

SEQ ID NO: 113981 - DNA, 13 bp, Unknown
  misc_feature (1)..( 13): Result.002 file - promoters60/1441044
acaaacttttttt

SEQ ID NO: 113982 - DNA, 13 bp, Unknown
  misc_feature (1)..( 13): Result.002 file - promoters60/1441044
accaatttttagt

SEQ ID NO: 113983 - DNA, 13 bp, Unknown
  misc_feature (1)..( 13): Result.002 file - promoters60/1441044
acaaacattaaga

SEQ ID NO: 113984 - DNA, 9 bp, Unknown
  misc_feature (1)..( 9): Result.002 file - promoters60/1441044
aactaaacc

SEQ ID NO: 113985 - DNA, 9 bp, Unknown
  misc_feature (1)..( 9): Result.002 file - promoters60/1441044
aactaaacc

SEQ ID NO: 113986 - DNA, 9 bp, Unknown
  misc_feature (1)..( 9): Result.002 file - promoters60/1441044
aactaatca

SEQ ID NO: 113987 - DNA, 9 bp, Unknown
  misc_feature (1)..( 9): Result.002 file - promoters60/1441044
tactaaaga

SEQ ID NO: 113988 - DNA, 9 bp, Unknown
  misc_feature (1)..( 9): Result.002 file - promoters60/1441134
ttttccttt

SEQ ID NO: 113989 - DNA, 9 bp, Unknown
  misc_feature (1)..( 9): Result.002 file - promoters60/1441134
tttttcttt

SEQ ID NO: 113990 - DNA, 6 bp, Unknown
  misc_feature (1)..( 6): Result.002 file - promoters60/1441134
ctttca

SEQ ID NO: 113991 - DNA, 6 bp, Unknown
  misc_feature (1)..( 6): Result.002 file - promoters60/1441134
ctttca

SEQ ID NO: 113992 - DNA, 7 bp, Unknown
  misc_feature (1)..( 7): Result.002 file - promoters60/1441134
tgatctt

SEQ ID NO: 113993 - DNA, 7 bp, Unknown
  misc_feature (1)..( 7): Result.002 file - promoters60/1441134
tgaactt

SEQ ID NO: 113994 - DNA, 8 bp, Unknown
  misc_feature (1)..( 8): Result.002 file - promoters60/1441134
tatttaca

SEQ ID NO: 113995 - DNA, 8 bp, Unknown
  misc_feature (1)..( 8): Result.002 file - promoters60/1441134
tatataca

SEQ ID NO: 113996 - DNA, 6 bp, Unknown
  misc_feature (1)..( 6): Result.002 file - promoters60/1441134
atatta

SEQ ID NO: 113997 - DNA, 6 bp, Unknown
  misc_feature (1)..( 6): Result.002 file - promoters60/1441134
atatta

SEQ ID NO: 113998 - DNA, 8 bp, Unknown
  misc_feature (1)..( 8): Result.002 file - promoters60/1441134
attaacaa

SEQ ID NO: 113999 - DNA, 8 bp, Unknown
  misc_feature (1)..( 8): Result.002 file - promoters60/1441134
attaacac

SEQ ID NO: 114000 - DNA, 8 bp, Unknown
  misc_feature (1)..( 8): Result.002 file - promoters60/1441134
tttaacaa

SEQ ID NO: 114001 - DNA, 6 bp, Unknown
  misc_feature (1)..( 6): Result.002 file - promoters60/1441134
aaattt

SEQ ID NO: 114002 - DNA, 6 bp, Unknown
  misc_feature (1)..( 6): Result.002 file - promoters60/1441134
aaattt

SEQ ID NO: 114003 - DNA, 6 bp, Unknown
  misc_feature (1)..( 6): Result.002 file - promoters60/1441134
ctttca

SEQ ID NO: 114004 - DNA, 6 bp, Unknown
  misc_feature (1)..( 6): Result.002 file - promoters60/1441134
ctttca

SEQ ID NO: 114005 - DNA, 9 bp, Unknown
  misc_feature (1)..( 9): Result.002 file - promoters60/1441134
aacacaatg

SEQ ID NO: 114006 - DNA, 9 bp, Unknown
  misc_feature (1)..( 9): Result.002 file - promoters60/1441134
aactcaatg

SEQ ID NO: 114007 - DNA, 6 bp, Unknown
  misc_feature (1)..( 6): Result.002 file - promoters60/1441134
caaaaa

SEQ ID NO: 114008 - DNA, 6 bp, Unknown
  misc_feature (1)..( 6): Result.002 file - promoters60/1441134
caaaaa

SEQ ID NO: 114009 - DNA, 7 bp, Unknown
  misc_feature (1)..( 7): Result.002 file - promoters60/1441134
tcttgtg

SEQ ID NO: 114010 - DNA, 7 bp, Unknown
  misc_feature (1)..( 7): Result.002 file - promoters60/1441134
tctagtg

SEQ ID NO: 114011 - DNA, 7 bp, Unknown
  misc_feature (1)..( 7): Result.002 file - promoters60/1441134
aaaaata

SEQ ID NO: 114012 - DNA, 7 bp, Unknown
  misc_feature (1)..( 7): Result.002 file - promoters60/1441134
aaaaata

SEQ ID NO: 114013 - DNA, 6 bp, Unknown
  misc_feature (1)..( 6): Result.002 file - promoters60/1441134
aacttt

SEQ ID NO: 114014 - DNA, 6 bp, Unknown
  misc_feature (1)..( 6): Result.002 file - promoters60/1441134
aacttt

SEQ ID NO: 114015 - DNA, 7 bp, Unknown
  misc_feature (1)..( 7): Result.002 file - promoters60/1441134
ttacaat

SEQ ID NO: 114016 - DNA, 7 bp, Unknown
  misc_feature (1)..( 7): Result.002 file - promoters60/1441134
ttataat

SEQ ID NO: 114017 - DNA, 9 bp, Unknown
  misc_feature (1)..( 9): Result.002 file - promoters60/1441170
atattaaat

SEQ ID NO: 114018 - DNA, 9 bp, Unknown
  misc_feature (1)..( 9): Result.002 file - promoters60/1441170
tttttaaat

SEQ ID NO: 114019 - DNA, 9 bp, Unknown
  misc_feature (1)..( 9): Result.002 file - promoters60/1441170
tttttcaat

SEQ ID NO: 114020 - DNA, 12 bp, Unknown
  misc_feature (1)..( 12): Result.002 file - promoters60/1441170
tataagtcaatt

SEQ ID NO: 114021 - DNA, 12 bp, Unknown
  misc_feature (1)..( 12): Result.002 file - promoters60/1441170
tattagtaaata

SEQ ID NO: 114022 - DNA, 12 bp, Unknown
  misc_feature (1)..( 12): Result.002 file - promoters60/1441170
cttttttcaatt

SEQ ID NO: 114023 - DNA, 6 bp, Unknown
  misc_feature (1)..( 6): Result.002 file - promoters60/1441170
aatttg

SEQ ID NO: 114024 - DNA, 6 bp, Unknown
  misc_feature (1)..( 6): Result.002 file - promoters60/1441170
aatttg

SEQ ID NO: 114025 - DNA, 6 bp, Unknown
  misc_feature (1)..( 6): Result.002 file - promoters60/1441170
tttaaa

SEQ ID NO: 114026 - DNA, 6 bp, Unknown
  misc_feature (1)..( 6): Result.002 file - promoters60/1441170
tttaaa

SEQ ID NO: 114027 - DNA, 8 bp, Unknown
  misc_feature (1)..( 8): Result.002 file - promoters60/1441170
aaaccaaa

SEQ ID NO: 114028 - DNA, 8 bp, Unknown
  misc_feature (1)..( 8): Result.002 file - promoters60/1441170
aaatcaaa

SEQ ID NO: 114029 - DNA, 9 bp, Unknown
  misc_feature (1)..( 9): Result.002 file - promoters60/1441170
aaagtcacg

SEQ ID NO: 114030 - DNA, 7 bp, Unknown
  misc_feature (1)..( 7): Result.002 file - promoters60/1441170
gaataaa

SEQ ID NO: 114031 - DNA, 7 bp, Unknown
  misc_feature (1)..( 7): Result.002 file - promoters60/1441170
gaacaaa

SEQ ID NO: 114032 - DNA, 8 bp, Unknown
  misc_feature (1)..( 8): Result.002 file - promoters60/1441170
aaacaata

SEQ ID NO: 114033 - DNA, 8 bp, Unknown
  misc_feature (1)..( 8): Result.002 file - promoters60/1441170
aaaccata

SEQ ID NO: 114034 - DNA, 8 bp, Unknown
  misc_feature (1)..( 8): Result.002 file - promoters60/1441170
agtcttac

SEQ ID NO: 114035 - DNA, 8 bp, Unknown
  misc_feature (1)..( 8): Result.002 file - promoters60/1441170
agttttac

SEQ ID NO: 114036 - DNA, 6 bp, Unknown
  misc_feature (1)..( 6): Result.002 file - promoters60/1441170
taagag

SEQ ID NO: 114037 - DNA, 6 bp, Unknown
  misc_feature (1)..( 6): Result.002 file - promoters60/1441170
taagag

SEQ ID NO: 114038 - DNA, 6 bp, Unknown
  misc_feature (1)..( 6): Result.002 file - promoters60/1441170
taaaag

SEQ ID NO: 114039 - DNA, 6 bp, Unknown
  misc_feature (1)..( 6): Result.002 file - promoters60/1441170
taaaag

SEQ ID NO: 114040 - DNA, 7 bp, Unknown
  misc_feature (1)..( 7): Result.002 file - promoters60/1441170
tttgttt

SEQ ID NO: 114041 - DNA, 7 bp, Unknown
  misc_feature (1)..( 7): Result.002 file - promoters60/1441170
tttattt

SEQ ID NO: 114042 - DNA, 6 bp, Unknown
  misc_feature (1)..( 6): Result.002 file - promoters60/1441170
actttc

SEQ ID NO: 114043 - DNA, 6 bp, Unknown
  misc_feature (1)..( 6): Result.002 file - promoters60/1441170
actttc

SEQ ID NO: 114044 - DNA, 9 bp, Unknown
  misc_feature (1)..( 9): Result.002 file - promoters60/1441170
ggataaaca

SEQ ID NO: 114045 - DNA, 9 bp, Unknown
  misc_feature (1)..( 9): Result.002 file - promoters60/1441170
ggataaaca

SEQ ID NO: 114046 - DNA, 10 bp, Unknown
  misc_feature (1)..( 10): Result.002 file - promoters60/1441184
gattgtgagt

SEQ ID NO: 114047 - DNA, 10 bp, Unknown
  misc_feature (1)..( 10): Result.002 file - promoters60/1441184
aattgtgtct

SEQ ID NO: 114048 - DNA, 10 bp, Unknown
  misc_feature (1)..( 10): Result.002 file - promoters60/1441184
cgttgagagc

SEQ ID NO: 114049 - DNA, 10 bp, Unknown
  misc_feature (1)..( 10): Result.002 file - promoters60/1441184
tattgtgttt

SEQ ID NO: 114050 - DNA, 10 bp, Unknown
  misc_feature (1)..( 10): Result.002 file - promoters60/1441184
tattgggttt

SEQ ID NO: 114051 - DNA, 10 bp, Unknown
  misc_feature (1)..( 10): Result.002 file - promoters60/1441184
aattatgtgg

SEQ ID NO: 114052 - DNA, 11 bp, Unknown
  misc_feature (1)..( 11): Result.002 file - promoters60/1441184
aactattttga

SEQ ID NO: 114053 - DNA, 11 bp, Unknown
  misc_feature (1)..( 11): Result.002 file - promoters60/1441184
gcatattttat

SEQ ID NO: 114054 - DNA, 11 bp, Unknown
  misc_feature (1)..( 11): Result.002 file - promoters60/1441184
gttgattttga

SEQ ID NO: 114055 - DNA, 12 bp, Unknown
  misc_feature (1)..( 12): Result.002 file - promoters60/1441184
acgcatctttgt

SEQ ID NO: 114056 - DNA, 12 bp, Unknown
  misc_feature (1)..( 12): Result.002 file - promoters60/1441184
cataattttaaa

SEQ ID NO: 114057 - DNA, 12 bp, Unknown
  misc_feature (1)..( 12): Result.002 file - promoters60/1441184
tcataatattag

SEQ ID NO: 114058 - DNA, 12 bp, Unknown
  misc_feature (1)..( 12): Result.002 file - promoters60/1441184
ctagaattttct

SEQ ID NO: 114059 - DNA, 13 bp, Unknown
  misc_feature (1)..( 13): Result.002 file - promoters60/1441184
tttgcttacaatt

SEQ ID NO: 114060 - DNA, 13 bp, Unknown
  misc_feature (1)..( 13): Result.002 file - promoters60/1441184
gttgtttatataa

SEQ ID NO: 114061 - DNA, 13 bp, Unknown
  misc_feature (1)..( 13): Result.002 file - promoters60/1441184
catgtttaatctg

SEQ ID NO: 114062 - DNA, 13 bp, Unknown
  misc_feature (1)..( 13): Result.002 file - promoters60/1441184
catctttttgaac

SEQ ID NO: 114063 - DNA, 13 bp, Unknown
  misc_feature (1)..( 13): Result.002 file - promoters60/1441184
aaagttaaataaa

SEQ ID NO: 114064 - DNA, 13 bp, Unknown
  misc_feature (1)..( 13): Result.002 file - promoters60/1441184
catatttagcagc

SEQ ID NO: 114065 - DNA, 13 bp, Unknown
  misc_feature (1)..( 13): Result.002 file - promoters60/1441184
tggatttaacagc

SEQ ID NO: 114066 - DNA, 10 bp, Unknown
  misc_feature (1)..( 10): Result.002 file - promoters60/1441184
atgtataaaa

SEQ ID NO: 114067 - DNA, 10 bp, Unknown
  misc_feature (1)..( 10): Result.002 file - promoters60/1441184
gtatataaat

SEQ ID NO: 114068 - DNA, 10 bp, Unknown
  misc_feature (1)..( 10): Result.002 file - promoters60/1441184
gtatataaat

SEQ ID NO: 114069 - DNA, 10 bp, Unknown
  misc_feature (1)..( 10): Result.002 file - promoters60/1441184
ctatataaaa

SEQ ID NO: 114070 - DNA, 10 bp, Unknown
  misc_feature (1)..( 10): Result.002 file - promoters60/1441184
atgtataaaa

SEQ ID NO: 114071 - DNA, 10 bp, Unknown
  misc_feature (1)..( 10): Result.002 file - promoters60/1441184
tcttataaat

SEQ ID NO: 114072 - DNA, 7 bp, Unknown
  misc_feature (1)..( 7): Result.002 file - promoters60/1441190
catgtat

SEQ ID NO: 114073 - DNA, 7 bp, Unknown
  misc_feature (1)..( 7): Result.002 file - promoters60/1441190
catatat

SEQ ID NO: 114074 - DNA, 7 bp, Unknown
  misc_feature (1)..( 7): Result.002 file - promoters60/1441190
aatatat

SEQ ID NO: 114075 - DNA, 7 bp, Unknown
  misc_feature (1)..( 7): Result.002 file - promoters60/1441190
tatatat

SEQ ID NO: 114076 - DNA, 10 bp, Unknown
  misc_feature (1)..( 10): Result.002 file - promoters60/1441237
caaaatttgt

SEQ ID NO: 114077 - DNA, 10 bp, Unknown
  misc_feature (1)..( 10): Result.002 file - promoters60/1441237
caatatttta

SEQ ID NO: 114078 - DNA, 10 bp, Unknown
  misc_feature (1)..( 10): Result.002 file - promoters60/1441237
gaatatgttt

SEQ ID NO: 114079 - DNA, 10 bp, Unknown
  misc_feature (1)..( 10): Result.002 file - promoters60/1441237
aattatttta

SEQ ID NO: 114080 - DNA, 11 bp, Unknown
  misc_feature (1)..( 11): Result.002 file - promoters60/1441237
atttagtttga

SEQ ID NO: 114081 - DNA, 11 bp, Unknown
  misc_feature (1)..( 11): Result.002 file - promoters60/1441237
aactattttta

SEQ ID NO: 114082 - DNA, 9 bp, Unknown
  misc_feature (1)..( 9): Result.002 file - promoters60/1441237
gttattttt

SEQ ID NO: 114083 - DNA, 9 bp, Unknown
  misc_feature (1)..( 9): Result.002 file - promoters60/1441237
actattttt

SEQ ID NO: 114084 - DNA, 9 bp, Unknown
  misc_feature (1)..( 9): Result.002 file - promoters60/1441237
tttagtttg

SEQ ID NO: 114085 - DNA, 9 bp, Unknown
  misc_feature (1)..( 9): Result.002 file - promoters60/1441237
gtttttttt

SEQ ID NO: 114086 - DNA, 9 bp, Unknown
  misc_feature (1)..( 9): Result.002 file - promoters60/1441237
attatttta

SEQ ID NO: 114087 - DNA, 9 bp, Unknown
  misc_feature (1)..( 9): Result.002 file - promoters60/1441237
attattagt

SEQ ID NO: 114088 - DNA, 9 bp, Unknown
  misc_feature (1)..( 9): Result.002 file - promoters60/1441237
aatatttta

SEQ ID NO: 114089 - DNA, 10 bp, Unknown
  misc_feature (1)..( 10): Result.002 file - promoters60/1441237
ttatataaac

SEQ ID NO: 114090 - DNA, 10 bp, Unknown
  misc_feature (1)..( 10): Result.002 file - promoters60/1441237
atatatacat

SEQ ID NO: 114091 - DNA, 10 bp, Unknown
  misc_feature (1)..( 10): Result.002 file - promoters60/1441237
gtatataaac

SEQ ID NO: 114092 - DNA, 10 bp, Unknown
  misc_feature (1)..( 10): Result.002 file - promoters60/1441237
ataaatatcc

SEQ ID NO: 114093 - DNA, 10 bp, Unknown
  misc_feature (1)..( 10): Result.002 file - promoters60/1441237
ataaataaaa

SEQ ID NO: 114094 - DNA, 10 bp, Unknown
  misc_feature (1)..( 10): Result.002 file - promoters60/1441237
ctataaaatc

SEQ ID NO: 114095 - DNA, 10 bp, Unknown
  misc_feature (1)..( 10): Result.002 file - promoters60/1441237
tataaacaaa

SEQ ID NO: 114096 - DNA, 10 bp, Unknown
  misc_feature (1)..( 10): Result.002 file - promoters60/1441237
tataaataaa

SEQ ID NO: 114097 - DNA, 10 bp, Unknown
  misc_feature (1)..( 10): Result.002 file - promoters60/1441237
tataaaatca

SEQ ID NO: 114098 - DNA, 10 bp, Unknown
  misc_feature (1)..( 10): Result.002 file - promoters60/1441237
cataaaagca

SEQ ID NO: 114099 - DNA, 10 bp, Unknown
  misc_feature (1)..( 10): Result.002 file - promoters60/1441237
gataaatatc

SEQ ID NO: 114100 - DNA, 10 bp, Unknown
  misc_feature (1)..( 10): Result.002 file - promoters60/1441237
tataaactct

SEQ ID NO: 114101 - DNA, 9 bp, Unknown
  misc_feature (1)..( 9): Result.002 file - promoters60/1441249
ttatacata

SEQ ID NO: 114102 - DNA, 9 bp, Unknown
  misc_feature (1)..( 9): Result.002 file - promoters60/1441249
ttatacata

SEQ ID NO: 114103 - DNA, 6 bp, Unknown
  misc_feature (1)..( 6): Result.002 file - promoters60/1441249
tgatat

SEQ ID NO: 114104 - DNA, 6 bp, Unknown
  misc_feature (1)..( 6): Result.002 file - promoters60/1441249
tgatat

SEQ ID NO: 114105 - DNA, 6 bp, Unknown
  misc_feature (1)..( 6): Result.002 file - promoters60/1441249
aaatat

SEQ ID NO: 114106 - DNA, 6 bp, Unknown
  misc_feature (1)..( 6): Result.002 file - promoters60/1441249
aaatat

SEQ ID NO: 114107 - DNA, 7 bp, Unknown
  misc_feature (1)..( 7): Result.002 file - promoters60/1441249
ttcgtaa

SEQ ID NO: 114108 - DNA, 7 bp, Unknown
  misc_feature (1)..( 7): Result.002 file - promoters60/1441249
ttcgtaa

SEQ ID NO: 114109 - DNA, 7 bp, Unknown
  misc_feature (1)..( 7): Result.002 file - promoters60/1441249
tgaccat

SEQ ID NO: 114110 - DNA, 7 bp, Unknown
  misc_feature (1)..( 7): Result.002 file - promoters60/1441249
tgatcat

SEQ ID NO: 114111 - DNA, 10 bp, Unknown
  misc_feature (1)..( 10): Result.002 file - promoters60/1441249
ttttattttt

SEQ ID NO: 114112 - DNA, 10 bp, Unknown
  misc_feature (1)..( 10): Result.002 file - promoters60/1441249
tttttttttt

SEQ ID NO: 114113 - DNA, 7 bp, Unknown
  misc_feature (1)..( 7): Result.002 file - promoters60/1441249
tttaaga

SEQ ID NO: 114114 - DNA, 7 bp, Unknown
  misc_feature (1)..( 7): Result.002 file - promoters60/1441249
ttttaga

SEQ ID NO: 114115 - DNA, 7 bp, Unknown
  misc_feature (1)..( 7): Result.002 file - promoters60/1441249
attcaag

SEQ ID NO: 114116 - DNA, 7 bp, Unknown
  misc_feature (1)..( 7): Result.002 file - promoters60/1441249
attgaag

SEQ ID NO: 114117 - DNA, 8 bp, Unknown
  misc_feature (1)..( 8): Result.002 file - promoters60/1441249
gtgtgttt

SEQ ID NO: 114118 - DNA, 8 bp, Unknown
  misc_feature (1)..( 8): Result.002 file - promoters60/1441249
gtgtcttt

SEQ ID NO: 114119 - DNA, 6 bp, Unknown
  misc_feature (1)..( 6): Result.002 file - promoters60/1441249
cttcaa

SEQ ID NO: 114120 - DNA, 6 bp, Unknown
  misc_feature (1)..( 6): Result.002 file - promoters60/1441249
cttcaa

SEQ ID NO: 114121 - DNA, 6 bp, Unknown
  misc_feature (1)..( 6): Result.002 file - promoters60/1441249
aatata

SEQ ID NO: 114122 - DNA, 6 bp, Unknown
  misc_feature (1)..( 6): Result.002 file - promoters60/1441249
aatata

SEQ ID NO: 114123 - DNA, 7 bp, Unknown
  misc_feature (1)..( 7): Result.002 file - promoters60/1441249
aaattac

SEQ ID NO: 114124 - DNA, 7 bp, Unknown
  misc_feature (1)..( 7): Result.002 file - promoters60/1441249
aaattat

SEQ ID NO: 114125 - DNA, 7 bp, Unknown
  misc_feature (1)..( 7): Result.002 file - promoters60/1441249
aaaatat

SEQ ID NO: 114126 - DNA, 8 bp, Unknown
  misc_feature (1)..( 8): Result.002 file - promoters60/1441249
actctaaa

SEQ ID NO: 114127 - DNA, 8 bp, Unknown
  misc_feature (1)..( 8): Result.002 file - promoters60/1441249
actttaaa

SEQ ID NO: 114128 - DNA, 8 bp, Unknown
  misc_feature (1)..( 8): Result.002 file - promoters60/1441249
tttttaaa

SEQ ID NO: 114129 - DNA, 9 bp, Unknown
  misc_feature (1)..( 9): Result.002 file - promoters60/1441249
caatcatcc

SEQ ID NO: 114130 - DNA, 9 bp, Unknown
  misc_feature (1)..( 9): Result.002 file - promoters60/1441249
caataatcc

SEQ ID NO: 114131 - DNA, 7 bp, Unknown
  misc_feature (1)..( 7): Result.002 file - promoters60/1441249
aatcatg

SEQ ID NO: 114132 - DNA, 7 bp, Unknown
  misc_feature (1)..( 7): Result.002 file - promoters60/1441249
aattatg

SEQ ID NO: 114133 - DNA, 6 bp, Unknown
  misc_feature (1)..( 6): Result.002 file - promoters60/1441249
acataa

SEQ ID NO: 114134 - DNA, 6 bp, Unknown
  misc_feature (1)..( 6): Result.002 file - promoters60/1441249
acataa

SEQ ID NO: 114135 - DNA, 6 bp, Unknown
  misc_feature (1)..( 6): Result.002 file - promoters60/1441249
caaaat

SEQ ID NO: 114136 - DNA, 6 bp, Unknown
  misc_feature (1)..( 6): Result.002 file - promoters60/1441249
caaaat

SEQ ID NO: 114137 - DNA, 8 bp, Unknown
  misc_feature (1)..( 8): Result.002 file - promoters60/1441249
aaagtaaa

SEQ ID NO: 114138 - DNA, 8 bp, Unknown
  misc_feature (1)..( 8): Result.002 file - promoters60/1441249
aaagcaaa

SEQ ID NO: 114139 - DNA, 8 bp, Unknown
  misc_feature (1)..( 8): Result.002 file - promoters60/1441291
tatgatgg

SEQ ID NO: 114140 - DNA, 8 bp, Unknown
  misc_feature (1)..( 8): Result.002 file - promoters60/1441291
tatgttgg

SEQ ID NO: 114141 - DNA, 9 bp, Unknown
  misc_feature (1)..( 9): Result.002 file - promoters60/1441291
ataatctta

SEQ ID NO: 114142 - DNA, 9 bp, Unknown
  misc_feature (1)..( 9): Result.002 file - promoters60/1441291
ataacctta

SEQ ID NO: 114143 - DNA, 8 bp, Unknown
  misc_feature (1)..( 8): Result.002 file - promoters60/1441291
agaaccaa

SEQ ID NO: 114144 - DNA, 8 bp, Unknown
  misc_feature (1)..( 8): Result.002 file - promoters60/1441291
agaaccaa

SEQ ID NO: 114145 - DNA, 6 bp, Unknown
  misc_feature (1)..( 6): Result.002 file - promoters60/1441291
ggctga

SEQ ID NO: 114146 - DNA, 6 bp, Unknown
  misc_feature (1)..( 6): Result.002 file - promoters60/1441291
ggctga

SEQ ID NO: 114147 - DNA, 11 bp, Unknown
  misc_feature (1)..( 11): Result.002 file - promoters60/1441291
aggttctcaga

SEQ ID NO: 114148 - DNA, 11 bp, Unknown
  misc_feature (1)..( 11): Result.002 file - promoters60/1441291
agggtctgaga

SEQ ID NO: 114149 - DNA, 6 bp, Unknown
  misc_feature (1)..( 6): Result.002 file - promoters60/1441291
agattt

SEQ ID NO: 114150 - DNA, 6 bp, Unknown
  misc_feature (1)..( 6): Result.002 file - promoters60/1441291
agattt

SEQ ID NO: 114151 - DNA, 8 bp, Unknown
  misc_feature (1)..( 8): Result.002 file - promoters60/1441395
atgataat

SEQ ID NO: 114152 - DNA, 8 bp, Unknown
  misc_feature (1)..( 8): Result.002 file - promoters60/1441395
atgttaaa

SEQ ID NO: 114153 - DNA, 9 bp, Unknown
  misc_feature (1)..( 9): Result.002 file - promoters60/1441395
ttgttcaaa

SEQ ID NO: 114154 - DNA, 11 bp, Unknown
  misc_feature (1)..( 11): Result.002 file - promoters60/1441395
acagaataaaa

SEQ ID NO: 114155 - DNA, 11 bp, Unknown
  misc_feature (1)..( 11): Result.002 file - promoters60/1441395
aaagaatcaaa

SEQ ID NO: 114156 - DNA, 11 bp, Unknown
  misc_feature (1)..( 11): Result.002 file - promoters60/1441395
aaaaaatcaaa

SEQ ID NO: 114157 - DNA, 11 bp, Unknown
  misc_feature (1)..( 11): Result.002 file - promoters60/1441395
ataaaaccaag

SEQ ID NO: 114158 - DNA, 8 bp, Unknown
  misc_feature (1)..( 8): Result.002 file - promoters60/1441395
tatttaaa

SEQ ID NO: 114159 - DNA, 8 bp, Unknown
  misc_feature (1)..( 8): Result.002 file - promoters60/1441395
aattaaaa

SEQ ID NO: 114160 - DNA, 8 bp, Unknown
  misc_feature (1)..( 8): Result.002 file - promoters60/1441395
tatataag

SEQ ID NO: 114161 - DNA, 8 bp, Unknown
  misc_feature (1)..( 8): Result.002 file - promoters60/1441395
tctataag

SEQ ID NO: 114162 - DNA, 7 bp, Unknown
  misc_feature (1)..( 7): Result.002 file - promoters60/1441395
aaatcaa

SEQ ID NO: 114163 - DNA, 7 bp, Unknown
  misc_feature (1)..( 7): Result.002 file - promoters60/1441395
aaaccaa

SEQ ID NO: 114164 - DNA, 7 bp, Unknown
  misc_feature (1)..( 7): Result.002 file - promoters60/1441395
aaatcaa

SEQ ID NO: 114165 - DNA, 6 bp, Unknown
  misc_feature (1)..( 6): Result.002 file - promoters60/1441460
agccag

SEQ ID NO: 114166 - DNA, 6 bp, Unknown
  misc_feature (1)..( 6): Result.002 file - promoters60/1441460
agccag

SEQ ID NO: 114167 - DNA, 7 bp, Unknown
  misc_feature (1)..( 7): Result.002 file - promoters60/1441460
gaagcca

SEQ ID NO: 114168 - DNA, 7 bp, Unknown
  misc_feature (1)..( 7): Result.002 file - promoters60/1441460
gaaacca

SEQ ID NO: 114169 - DNA, 7 bp, Unknown
  misc_feature (1)..( 7): Result.002 file - promoters60/1441460
ttaggat

SEQ ID NO: 114170 - DNA, 7 bp, Unknown
  misc_feature (1)..( 7): Result.002 file - promoters60/1441460
ttatgat

SEQ ID NO: 114171 - DNA, 12 bp, Unknown
  misc_feature (1)..( 12): Result.002 file - promoters60/1441460
atattcatgatc

SEQ ID NO: 114172 - DNA, 12 bp, Unknown
  misc_feature (1)..( 12): Result.002 file - promoters60/1441460
cctttcttgaaa

SEQ ID NO: 114173 - DNA, 12 bp, Unknown
  misc_feature (1)..( 12): Result.002 file - promoters60/1441460
atattaatgatc

SEQ ID NO: 114174 - DNA, 10 bp, Unknown
  misc_feature (1)..( 10): Result.002 file - promoters60/1441460
gaagaaatga

SEQ ID NO: 114175 - DNA, 10 bp, Unknown
  misc_feature (1)..( 10): Result.002 file - promoters60/1441460
gaaaaaatga

SEQ ID NO: 114176 - DNA, 6 bp, Unknown
  misc_feature (1)..( 6): Result.002 file - promoters60/1441460
aaacga

SEQ ID NO: 114177 - DNA, 6 bp, Unknown
  misc_feature (1)..( 6): Result.002 file - promoters60/1441460
aaacga

SEQ ID NO: 114178 - DNA, 9 bp, Unknown
  misc_feature (1)..( 9): Result.002 file - promoters60/1441460
tatgatttc

SEQ ID NO: 114179 - DNA, 9 bp, Unknown
  misc_feature (1)..( 9): Result.002 file - promoters60/1441460
aatgttttg

SEQ ID NO: 114180 - DNA, 9 bp, Unknown
  misc_feature (1)..( 9): Result.002 file - promoters60/1441460
aattttttg

SEQ ID NO: 114181 - DNA, 8 bp, Unknown
  misc_feature (1)..( 8): Result.002 file - promoters60/1441460
ctttggtt

SEQ ID NO: 114182 - DNA, 8 bp, Unknown
  misc_feature (1)..( 8): Result.002 file - promoters60/1441460
gttttgtt

SEQ ID NO: 114183 - DNA, 8 bp, Unknown
  misc_feature (1)..( 8): Result.002 file - promoters60/1441460
gttatgtt

SEQ ID NO: 114184 - DNA, 8 bp, Unknown
  misc_feature (1)..( 8): Result.002 file - promoters60/1441460
atatgaga

SEQ ID NO: 114185 - DNA, 8 bp, Unknown
  misc_feature (1)..( 8): Result.002 file - promoters60/1441460
atatcaga

SEQ ID NO: 114186 - DNA, 9 bp, Unknown
  misc_feature (1)..( 9): Result.002 file - promoters60/1441460
tttgtttta

SEQ ID NO: 114187 - DNA, 9 bp, Unknown
  misc_feature (1)..( 9): Result.002 file - promoters60/1441460
tttatttta

SEQ ID NO: 114188 - DNA, 8 bp, Unknown
  misc_feature (1)..( 8): Result.002 file - promoters60/1441460
accacatt

SEQ ID NO: 114189 - DNA, 8 bp, Unknown
  misc_feature (1)..( 8): Result.002 file - promoters60/1441460
accaaatt

SEQ ID NO: 114190 - DNA, 6 bp, Unknown
  misc_feature (1)..( 6): Result.002 file - promoters60/1441460
agagaa

SEQ ID NO: 114191 - DNA, 6 bp, Unknown
  misc_feature (1)..( 6): Result.002 file - promoters60/1441460
agagaa

SEQ ID NO: 114192 - DNA, 7 bp, Unknown
  misc_feature (1)..( 7): Result.002 file - promoters60/1441460
tttaagt

SEQ ID NO: 114193 - DNA, 7 bp, Unknown
  misc_feature (1)..( 7): Result.002 file - promoters60/1441460
tttgagt

SEQ ID NO: 114194 - DNA, 8 bp, Unknown
  misc_feature (1)..( 8): Result.002 file - promoters60/1441460
ttttttgt

SEQ ID NO: 114195 - DNA, 8 bp, Unknown
  misc_feature (1)..( 8): Result.002 file - promoters60/1441460
tttcttgt

SEQ ID NO: 114196 - DNA, 7 bp, Unknown
  misc_feature (1)..( 7): Result.002 file - promoters60/1441460
gagaatt

SEQ ID NO: 114197 - DNA, 7 bp, Unknown
  misc_feature (1)..( 7): Result.002 file - promoters60/1441460
gaggatt

SEQ ID NO: 114198 - DNA, 6 bp, Unknown
  misc_feature (1)..( 6): Result.002 file - promoters60/1441460
aagcaa

SEQ ID NO: 114199 - DNA, 6 bp, Unknown
  misc_feature (1)..( 6): Result.002 file - promoters60/1441460
aagcaa

SEQ ID NO: 114200 - DNA, 6 bp, Unknown
  misc_feature (1)..( 6): Result.002 file - promoters60/1441460
aagggt

SEQ ID NO: 114201 - DNA, 6 bp, Unknown
  misc_feature (1)..( 6): Result.002 file - promoters60/1441460
aagggt

SEQ ID NO: 114202 - DNA, 7 bp, Unknown
  misc_feature (1)..( 7): Result.002 file - promoters60/1441465
agaaaaa

SEQ ID NO: 114203 - DNA, 7 bp, Unknown
  misc_feature (1)..( 7): Result.002 file - promoters60/1441465
agacaaa

SEQ ID NO: 114204 - DNA, 6 bp, Unknown
  misc_feature (1)..( 6): Result.002 file - promoters60/1441465
tgcaaa

SEQ ID NO: 114205 - DNA, 6 bp, Unknown
  misc_feature (1)..( 6): Result.002 file - promoters60/1441465
tgcaaa

SEQ ID NO: 114206 - DNA, 6 bp, Unknown
  misc_feature (1)..( 6): Result.002 file - promoters60/1441465
ttatcg

SEQ ID NO: 114207 - DNA, 6 bp, Unknown
  misc_feature (1)..( 6): Result.002 file - promoters60/1441465
ttatcg

SEQ ID NO: 114208 - DNA, 7 bp, Unknown
  misc_feature (1)..( 7): Result.002 file - promoters60/1441465
tataaaa

SEQ ID NO: 114209 - DNA, 7 bp, Unknown
  misc_feature (1)..( 7): Result.002 file - promoters60/1441465
tataaaa

SEQ ID NO: 114210 - DNA, 12 bp, Unknown
  misc_feature (1)..( 12): Result.002 file - promoters60/1441465
aaacaattcgtc

SEQ ID NO: 114211 - DNA, 12 bp, Unknown
  misc_feature (1)..( 12): Result.002 file - promoters60/1441465
aaaaaattggtc

SEQ ID NO: 114212 - DNA, 6 bp, Unknown
  misc_feature (1)..( 6): Result.002 file - promoters60/1441465
agattt

SEQ ID NO: 114213 - DNA, 6 bp, Unknown
  misc_feature (1)..( 6): Result.002 file - promoters60/1441465
agattt

SEQ ID NO: 114214 - DNA, 7 bp, Unknown
  misc_feature (1)..( 7): Result.002 file - promoters60/1441465
taaccga

SEQ ID NO: 114215 - DNA, 7 bp, Unknown
  misc_feature (1)..( 7): Result.002 file - promoters60/1441465
taagcga

SEQ ID NO: 114216 - DNA, 6 bp, Unknown
  misc_feature (1)..( 6): Result.002 file - promoters60/1441465
aaattt

SEQ ID NO: 114217 - DNA, 6 bp, Unknown
  misc_feature (1)..( 6): Result.002 file - promoters60/1441465
aaattt

SEQ ID NO: 114218 - DNA, 7 bp, Unknown
  misc_feature (1)..( 7): Result.002 file - promoters60/1441465
attttct

SEQ ID NO: 114219 - DNA, 7 bp, Unknown
  misc_feature (1)..( 7): Result.002 file - promoters60/1441465
attttct

SEQ ID NO: 114220 - DNA, 8 bp, Unknown
  misc_feature (1)..( 8): Result.002 file - promoters60/1441465
aacacaaa

SEQ ID NO: 114221 - DNA, 8 bp, Unknown
  misc_feature (1)..( 8): Result.002 file - promoters60/1441465
aacagaaa

SEQ ID NO: 114222 - DNA, 7 bp, Unknown
  misc_feature (1)..( 7): Result.002 file - promoters60/1441465
caaacca

SEQ ID NO: 114223 - DNA, 7 bp, Unknown
  misc_feature (1)..( 7): Result.002 file - promoters60/1441465
caatcca

SEQ ID NO: 114224 - DNA, 6 bp, Unknown
  misc_feature (1)..( 6): Result.002 file - promoters60/1441465
catttt

SEQ ID NO: 114225 - DNA, 6 bp, Unknown
  misc_feature (1)..( 6): Result.002 file - promoters60/1441465
catttt

SEQ ID NO: 114226 - DNA, 7 bp, Unknown
  misc_feature (1)..( 7): Result.002 file - promoters60/1441465
ttttcat

SEQ ID NO: 114227 - DNA, 7 bp, Unknown
  misc_feature (1)..( 7): Result.002 file - promoters60/1441465
ttttcat

SEQ ID NO: 114228 - DNA, 8 bp, Unknown
  misc_feature (1)..( 8): Result.002 file - promoters60/1441465
tttcttta

SEQ ID NO: 114229 - DNA, 8 bp, Unknown
  misc_feature (1)..( 8): Result.002 file - promoters60/1441465
tttcttta

SEQ ID NO: 114230 - DNA, 6 bp, Unknown
  misc_feature (1)..( 6): Result.002 file - promoters60/1441465
ttatac

SEQ ID NO: 114231 - DNA, 6 bp, Unknown
  misc_feature (1)..( 6): Result.002 file - promoters60/1441465
ttatac

SEQ ID NO: 114232 - DNA, 6 bp, Unknown
  misc_feature (1)..( 6): Result.002 file - promoters60/1441465
gtgata

SEQ ID NO: 114233 - DNA, 6 bp, Unknown
  misc_feature (1)..( 6): Result.002 file - promoters60/1441465
gtgata

SEQ ID NO: 114234 - DNA, 8 bp, Unknown
  misc_feature (1)..( 8): Result.002 file - promoters60/1441533
ttacgtat

SEQ ID NO: 114235 - DNA, 8 bp, Unknown
  misc_feature (1)..( 8): Result.002 file - promoters60/1441533
ttacatat

SEQ ID NO: 114236 - DNA, 7 bp, Unknown
  misc_feature (1)..( 7): Result.002 file - promoters60/1441533
acaattt

SEQ ID NO: 114237 - DNA, 7 bp, Unknown
  misc_feature (1)..( 7): Result.002 file - promoters60/1441533
acatttt

SEQ ID NO: 114238 - DNA, 7 bp, Unknown
  misc_feature (1)..( 7): Result.002 file - promoters60/1441533
ccacaat

SEQ ID NO: 114239 - DNA, 7 bp, Unknown
  misc_feature (1)..( 7): Result.002 file - promoters60/1441533
ccaaaat

SEQ ID NO: 114240 - DNA, 6 bp, Unknown
  misc_feature (1)..( 6): Result.002 file - promoters60/1441533
ggtttt

SEQ ID NO: 114241 - DNA, 6 bp, Unknown
  misc_feature (1)..( 6): Result.002 file - promoters60/1441533
ggtttt

SEQ ID NO: 114242 - DNA, 6 bp, Unknown
  misc_feature (1)..( 6): Result.002 file - promoters60/1441533
ttttga

SEQ ID NO: 114243 - DNA, 6 bp, Unknown
  misc_feature (1)..( 6): Result.002 file - promoters60/1441533
ttttga

SEQ ID NO: 114244 - DNA, 9 bp, Unknown
  misc_feature (1)..( 9): Result.002 file - promoters60/1441533
atttttttt

SEQ ID NO: 114245 - DNA, 9 bp, Unknown
  misc_feature (1)..( 9): Result.002 file - promoters60/1441533
attattttt

SEQ ID NO: 114246 - DNA, 6 bp, Unknown
  misc_feature (1)..( 6): Result.002 file - promoters60/1441533
aaatga

SEQ ID NO: 114247 - DNA, 6 bp, Unknown
  misc_feature (1)..( 6): Result.002 file - promoters60/1441533
aaatga

SEQ ID NO: 114248 - DNA, 7 bp, Unknown
  misc_feature (1)..( 7): Result.002 file - promoters60/1441533
aagctgt

SEQ ID NO: 114249 - DNA, 7 bp, Unknown
  misc_feature (1)..( 7): Result.002 file - promoters60/1441533
aagatgt

SEQ ID NO: 114250 - DNA, 7 bp, Unknown
  misc_feature (1)..( 7): Result.002 file - promoters60/1441533
acgtgga

SEQ ID NO: 114251 - DNA, 7 bp, Unknown
  misc_feature (1)..( 7): Result.002 file - promoters60/1441533
acgagga

SEQ ID NO: 114252 - DNA, 9 bp, Unknown
  misc_feature (1)..( 9): Result.002 file - promoters60/1441533
atataaata

SEQ ID NO: 114253 - DNA, 9 bp, Unknown
  misc_feature (1)..( 9): Result.002 file - promoters60/1441533
atataaata

SEQ ID NO: 114254 - DNA, 8 bp, Unknown
  misc_feature (1)..( 8): Result.002 file - promoters60/1441533
ttttcctt

SEQ ID NO: 114255 - DNA, 8 bp, Unknown
  misc_feature (1)..( 8): Result.002 file - promoters60/1441533
ttttactt

SEQ ID NO: 114256 - DNA, 7 bp, Unknown
  misc_feature (1)..( 7): Result.002 file - promoters60/1441533
acgcact

SEQ ID NO: 114257 - DNA, 7 bp, Unknown
  misc_feature (1)..( 7): Result.002 file - promoters60/1441533
acgaact

SEQ ID NO: 114258 - DNA, 7 bp, Unknown
  misc_feature (1)..( 7): Result.002 file - promoters60/1441533
tatctcg

SEQ ID NO: 114259 - DNA, 7 bp, Unknown
  misc_feature (1)..( 7): Result.002 file - promoters60/1441533
tatgtcg

SEQ ID NO: 114260 - DNA, 8 bp, Unknown
  misc_feature (1)..( 8): Result.002 file - promoters60/1441533
attttcac

SEQ ID NO: 114261 - DNA, 8 bp, Unknown
  misc_feature (1)..( 8): Result.002 file - promoters60/1441533
atttgcac

SEQ ID NO: 114262 - DNA, 7 bp, Unknown
  misc_feature (1)..( 7): Result.002 file - promoters60/1441533
ttaatat

SEQ ID NO: 114263 - DNA, 7 bp, Unknown
  misc_feature (1)..( 7): Result.002 file - promoters60/1441533
ttaatat

SEQ ID NO: 114264 - DNA, 6 bp, Unknown
  misc_feature (1)..( 6): Result.002 file - promoters60/1441533
aatata

SEQ ID NO: 114265 - DNA, 6 bp, Unknown
  misc_feature (1)..( 6): Result.002 file - promoters60/1441533
aatata

SEQ ID NO: 114266 - DNA, 7 bp, Unknown
  misc_feature (1)..( 7): Result.002 file - promoters60/1441533
tgactaa

SEQ ID NO: 114267 - DNA, 7 bp, Unknown
  misc_feature (1)..( 7): Result.002 file - promoters60/1441533
tgattaa

SEQ ID NO: 114268 - DNA, 6 bp, Unknown
  misc_feature (1)..( 6): Result.002 file - promoters60/1441533
tactcg

SEQ ID NO: 114269 - DNA, 6 bp, Unknown
  misc_feature (1)..( 6): Result.002 file - promoters60/1441533
tactcg

SEQ ID NO: 114270 - DNA, 6 bp, Unknown
  misc_feature (1)..( 6): Result.002 file - promoters60/1441533
tatact

SEQ ID NO: 114271 - DNA, 6 bp, Unknown
  misc_feature (1)..( 6): Result.002 file - promoters60/1441533
tatact

SEQ ID NO: 114272 - DNA, 6 bp, Unknown
  misc_feature (1)..( 6): Result.002 file - promoters60/1441533
tttgtt

SEQ ID NO: 114273 - DNA, 6 bp, Unknown
  misc_feature (1)..( 6): Result.002 file - promoters60/1441533
tttgtt

SEQ ID NO: 114274 - DNA, 7 bp, Unknown
  misc_feature (1)..( 7): Result.002 file - promoters60/1441533
aaaaaaa

SEQ ID NO: 114275 - DNA, 7 bp, Unknown
  misc_feature (1)..( 7): Result.002 file - promoters60/1441533
aaaaaaa

SEQ ID NO: 114276 - DNA, 7 bp, Unknown
  misc_feature (1)..( 7): Result.002 file - promoters60/1441533
aacattt

SEQ ID NO: 114277 - DNA, 7 bp, Unknown
  misc_feature (1)..( 7): Result.002 file - promoters60/1441533
aacattt

SEQ ID NO: 114278 - DNA, 10 bp, Unknown
  misc_feature (1)..( 10): Result.002 file - promoters60/1441533
aaactagaaa

SEQ ID NO: 114279 - DNA, 10 bp, Unknown
  misc_feature (1)..( 10): Result.002 file - promoters60/1441533
aaactaaaaa

SEQ ID NO: 114280 - DNA, 9 bp, Unknown
  misc_feature (1)..( 9): Result.002 file - promoters60/1441533
agaaaaaaa

SEQ ID NO: 114281 - DNA, 9 bp, Unknown
  misc_feature (1)..( 9): Result.002 file - promoters60/1441533
agaataaaa

SEQ ID NO: 114282 - DNA, 7 bp, Unknown
  misc_feature (1)..( 7): Result.002 file - promoters60/1441533
tagtaaa

SEQ ID NO: 114283 - DNA, 7 bp, Unknown
  misc_feature (1)..( 7): Result.002 file - promoters60/1441533
taggaaa

SEQ ID NO: 114284 - DNA, 6 bp, Unknown
  misc_feature (1)..( 6): Result.002 file - promoters60/1441539
tatata

SEQ ID NO: 114285 - DNA, 6 bp, Unknown
  misc_feature (1)..( 6): Result.002 file - promoters60/1441539
tatata

SEQ ID NO: 114286 - DNA, 6 bp, Unknown
  misc_feature (1)..( 6): Result.002 file - promoters60/1441539
tttgac

SEQ ID NO: 114287 - DNA, 6 bp, Unknown
  misc_feature (1)..( 6): Result.002 file - promoters60/1441539
tttgac

SEQ ID NO: 114288 - DNA, 8 bp, Unknown
  misc_feature (1)..( 8): Result.002 file - promoters60/1441539
ttgggaaa

SEQ ID NO: 114289 - DNA, 8 bp, Unknown
  misc_feature (1)..( 8): Result.002 file - promoters60/1441539
ttgtgaaa

SEQ ID NO: 114290 - DNA, 7 bp, Unknown
  misc_feature (1)..( 7): Result.002 file - promoters60/1441539
tgatttg

SEQ ID NO: 114291 - DNA, 7 bp, Unknown
  misc_feature (1)..( 7): Result.002 file - promoters60/1441539
tgaattg

SEQ ID NO: 114292 - DNA, 8 bp, Unknown
  misc_feature (1)..( 8): Result.002 file - promoters60/1441539
ttttcttt

SEQ ID NO: 114293 - DNA, 8 bp, Unknown
  misc_feature (1)..( 8): Result.002 file - promoters60/1441539
ttttgttt

SEQ ID NO: 114294 - DNA, 6 bp, Unknown
  misc_feature (1)..( 6): Result.002 file - promoters60/1441539
aacaaa

SEQ ID NO: 114295 - DNA, 6 bp, Unknown
  misc_feature (1)..( 6): Result.002 file - promoters60/1441539
aacaaa

SEQ ID NO: 114296 - DNA, 7 bp, Unknown
  misc_feature (1)..( 7): Result.002 file - promoters60/1441539
aaacatt

SEQ ID NO: 114297 - DNA, 7 bp, Unknown
  misc_feature (1)..( 7): Result.002 file - promoters60/1441539
aaacatt

SEQ ID NO: 114298 - DNA, 6 bp, Unknown
  misc_feature (1)..( 6): Result.002 file - promoters60/1441539
aaaaag

SEQ ID NO: 114299 - DNA, 6 bp, Unknown
  misc_feature (1)..( 6): Result.002 file - promoters60/1441539
aaaaag

SEQ ID NO: 114300 - DNA, 7 bp, Unknown
  misc_feature (1)..( 7): Result.002 file - promoters60/1441539
aaagctt

SEQ ID NO: 114301 - DNA, 7 bp, Unknown
  misc_feature (1)..( 7): Result.002 file - promoters60/1441539
aaaactt

SEQ ID NO: 114302 - DNA, 6 bp, Unknown
  misc_feature (1)..( 6): Result.002 file - promoters60/1441539
aaccct

SEQ ID NO: 114303 - DNA, 6 bp, Unknown
  misc_feature (1)..( 6): Result.002 file - promoters60/1441539
aaccct

SEQ ID NO: 114304 - DNA, 9 bp, Unknown
  misc_feature (1)..( 9): Result.002 file - promoters60/1441539
atggctgaa

SEQ ID NO: 114305 - DNA, 9 bp, Unknown
  misc_feature (1)..( 9): Result.002 file - promoters60/1441539
atggttgaa

SEQ ID NO: 114306 - DNA, 7 bp, Unknown
  misc_feature (1)..( 7): Result.002 file - promoters60/1441539
aagtaaa

SEQ ID NO: 114307 - DNA, 7 bp, Unknown
  misc_feature (1)..( 7): Result.002 file - promoters60/1441539
aagaaaa

SEQ ID NO: 114308 - DNA, 8 bp, Unknown
  misc_feature (1)..( 8): Result.002 file - promoters60/1441569
ttacgtat

SEQ ID NO: 114309 - DNA, 8 bp, Unknown
  misc_feature (1)..( 8): Result.002 file - promoters60/1441569
ttacatat

SEQ ID NO: 114310 - DNA, 7 bp, Unknown
  misc_feature (1)..( 7): Result.002 file - promoters60/1441569
acaattt

SEQ ID NO: 114311 - DNA, 7 bp, Unknown
  misc_feature (1)..( 7): Result.002 file - promoters60/1441569
acatttt

SEQ ID NO: 114312 - DNA, 7 bp, Unknown
  misc_feature (1)..( 7): Result.002 file - promoters60/1441569
ccacaat

SEQ ID NO: 114313 - DNA, 7 bp, Unknown
  misc_feature (1)..( 7): Result.002 file - promoters60/1441569
ccaaaat

SEQ ID NO: 114314 - DNA, 6 bp, Unknown
  misc_feature (1)..( 6): Result.002 file - promoters60/1441569
ggtttt

SEQ ID NO: 114315 - DNA, 6 bp, Unknown
  misc_feature (1)..( 6): Result.002 file - promoters60/1441569
ggtttt

SEQ ID NO: 114316 - DNA, 6 bp, Unknown
  misc_feature (1)..( 6): Result.002 file - promoters60/1441569
ttttga

SEQ ID NO: 114317 - DNA, 6 bp, Unknown
  misc_feature (1)..( 6): Result.002 file - promoters60/1441569
ttttga

SEQ ID NO: 114318 - DNA, 9 bp, Unknown
  misc_feature (1)..( 9): Result.002 file - promoters60/1441569
atttttttt

SEQ ID NO: 114319 - DNA, 9 bp, Unknown
  misc_feature (1)..( 9): Result.002 file - promoters60/1441569
attattttt

SEQ ID NO: 114320 - DNA, 9 bp, Unknown
  misc_feature (1)..( 9): Result.002 file - promoters60/1441569
gtttttttt

SEQ ID NO: 114321 - DNA, 6 bp, Unknown
  misc_feature (1)..( 6): Result.002 file - promoters60/1441569
aaatga

SEQ ID NO: 114322 - DNA, 6 bp, Unknown
  misc_feature (1)..( 6): Result.002 file - promoters60/1441569
aaatga

SEQ ID NO: 114323 - DNA, 7 bp, Unknown
  misc_feature (1)..( 7): Result.002 file - promoters60/1441569
aagctgt

SEQ ID NO: 114324 - DNA, 7 bp, Unknown
  misc_feature (1)..( 7): Result.002 file - promoters60/1441569
aagatgt

SEQ ID NO: 114325 - DNA, 7 bp, Unknown
  misc_feature (1)..( 7): Result.002 file - promoters60/1441569
acgtgga

SEQ ID NO: 114326 - DNA, 7 bp, Unknown
  misc_feature (1)..( 7): Result.002 file - promoters60/1441569
acgagga

SEQ ID NO: 114327 - DNA, 9 bp, Unknown
  misc_feature (1)..( 9): Result.002 file - promoters60/1441569
atataaata

SEQ ID NO: 114328 - DNA, 9 bp, Unknown
  misc_feature (1)..( 9): Result.002 file - promoters60/1441569
atataaata

SEQ ID NO: 114329 - DNA, 8 bp, Unknown
  misc_feature (1)..( 8): Result.002 file - promoters60/1441569
gaaactac

SEQ ID NO: 114330 - DNA, 8 bp, Unknown
  misc_feature (1)..( 8): Result.002 file - promoters60/1441569
gaaattac

SEQ ID NO: 114331 - DNA, 8 bp, Unknown
  misc_feature (1)..( 8): Result.002 file - promoters60/1441569
aattttgt

SEQ ID NO: 114332 - DNA, 8 bp, Unknown
  misc_feature (1)..( 8): Result.002 file - promoters60/1441569
aattttgt

SEQ ID NO: 114333 - DNA, 6 bp, Unknown
  misc_feature (1)..( 6): Result.002 file - promoters60/1441569
gttatt

SEQ ID NO: 114334 - DNA, 6 bp, Unknown
  misc_feature (1)..( 6): Result.002 file - promoters60/1441569
gttatt

SEQ ID NO: 114335 - DNA, 7 bp, Unknown
  misc_feature (1)..( 7): Result.002 file - promoters60/1441569
gaatatt

SEQ ID NO: 114336 - DNA, 7 bp, Unknown
  misc_feature (1)..( 7): Result.002 file - promoters60/1441569
gaaaatt

SEQ ID NO: 114337 - DNA, 7 bp, Unknown
  misc_feature (1)..( 7): Result.002 file - promoters60/1441569
acgcata

SEQ ID NO: 114338 - DNA, 7 bp, Unknown
  misc_feature (1)..( 7): Result.002 file - promoters60/1441569
acgaata

SEQ ID NO: 114339 - DNA, 6 bp, Unknown
  misc_feature (1)..( 6): Result.002 file - promoters60/1441569
aaaaca

SEQ ID NO: 114340 - DNA, 6 bp, Unknown
  misc_feature (1)..( 6): Result.002 file - promoters60/1441569
aaaaca

SEQ ID NO: 114341 - DNA, 6 bp, Unknown
  misc_feature (1)..( 6): Result.002 file - promoters60/1441569
gtaacc

SEQ ID NO: 114342 - DNA, 6 bp, Unknown
  misc_feature (1)..( 6): Result.002 file - promoters60/1441569
gtaacc

SEQ ID NO: 114343 - DNA, 8 bp, Unknown
  misc_feature (1)..( 8): Result.002 file - promoters60/1441569
atagaaat

SEQ ID NO: 114344 - DNA, 8 bp, Unknown
  misc_feature (1)..( 8): Result.002 file - promoters60/1441569
atagaaat

SEQ ID NO: 114345 - DNA, 11 bp, Unknown
  misc_feature (1)..( 11): Result.002 file - promoters60/1441569
aattacaaaaa

SEQ ID NO: 114346 - DNA, 11 bp, Unknown
  misc_feature (1)..( 11): Result.002 file - promoters60/1441569
aatcacaaaaa

SEQ ID NO: 114347 - DNA, 6 bp, Unknown
  misc_feature (1)..( 6): Result.002 file - promoters60/1441569
ctcagt

SEQ ID NO: 114348 - DNA, 6 bp, Unknown
  misc_feature (1)..( 6): Result.002 file - promoters60/1441569
ctcagt

SEQ ID NO: 114349 - DNA, 7 bp, Unknown
  misc_feature (1)..( 7): Result.002 file - promoters60/1441569
tttctta

SEQ ID NO: 114350 - DNA, 7 bp, Unknown
  misc_feature (1)..( 7): Result.002 file - promoters60/1441569
tttctta

SEQ ID NO: 114351 - DNA, 6 bp, Unknown
  misc_feature (1)..( 6): Result.002 file - promoters60/1441569
tttcta

SEQ ID NO: 114352 - DNA, 6 bp, Unknown
  misc_feature (1)..( 6): Result.002 file - promoters60/1441569
tttcta

SEQ ID NO: 114353 - DNA, 7 bp, Unknown
  misc_feature (1)..( 7): Result.002 file - promoters60/1441569
caaataa

SEQ ID NO: 114354 - DNA, 7 bp, Unknown
  misc_feature (1)..( 7): Result.002 file - promoters60/1441569
caactaa

SEQ ID NO: 114355 - DNA, 9 bp, Unknown
  misc_feature (1)..( 9): Result.002 file - promoters60/1441569
cttgttcaa

SEQ ID NO: 114356 - DNA, 9 bp, Unknown
  misc_feature (1)..( 9): Result.002 file - promoters60/1441569
cttgtacaa

SEQ ID NO: 114357 - DNA, 6 bp, Unknown
  misc_feature (1)..( 6): Result.002 file - promoters60/1441569
ttggtt

SEQ ID NO: 114358 - DNA, 6 bp, Unknown
  misc_feature (1)..( 6): Result.002 file - promoters60/1441569
ttggtt

SEQ ID NO: 114359 - DNA, 6 bp, Unknown
  misc_feature (1)..( 6): Result.002 file - promoters60/1441569
cataaa

SEQ ID NO: 114360 - DNA, 6 bp, Unknown
  misc_feature (1)..( 6): Result.002 file - promoters60/1441569
cataaa

SEQ ID NO: 114361 - DNA, 6 bp, Unknown
  misc_feature (1)..( 6): Result.002 file - promoters60/1441569
ttttaa

SEQ ID NO: 114362 - DNA, 6 bp, Unknown
  misc_feature (1)..( 6): Result.002 file - promoters60/1441569
ttttaa

SEQ ID NO: 114363 - DNA, 11 bp, Unknown
  misc_feature (1)..( 11): Result.002 file - promoters60/1441657
atcttctgtct

SEQ ID NO: 114364 - DNA, 11 bp, Unknown
  misc_feature (1)..( 11): Result.002 file - promoters60/1441657
cacttgtgttt

SEQ ID NO: 114365 - DNA, 11 bp, Unknown
  misc_feature (1)..( 11): Result.002 file - promoters60/1441657
atcttctaaaa

SEQ ID NO: 114366 - DNA, 11 bp, Unknown
  misc_feature (1)..( 11): Result.002 file - promoters60/1441657
taattgtattt

SEQ ID NO: 114367 - DNA, 9 bp, Unknown
  misc_feature (1)..( 9): Result.002 file - promoters60/1441657
ccaaacaaa

SEQ ID NO: 114368 - DNA, 9 bp, Unknown
  misc_feature (1)..( 9): Result.002 file - promoters60/1441657
ccaaaccca

SEQ ID NO: 114369 - DNA, 9 bp, Unknown
  misc_feature (1)..( 9): Result.002 file - promoters60/1441657
tcaaacctg

SEQ ID NO: 114370 - DNA, 9 bp, Unknown
  misc_feature (1)..( 9): Result.002 file - promoters60/1441657
agaaagctg

SEQ ID NO: 114371 - DNA, 12 bp, Unknown
  misc_feature (1)..( 12): Result.002 file - promoters60/1441657
ataatttgcaag

SEQ ID NO: 114372 - DNA, 12 bp, Unknown
  misc_feature (1)..( 12): Result.002 file - promoters60/1441657
ataatttcgagg

SEQ ID NO: 114373 - DNA, 12 bp, Unknown
  misc_feature (1)..( 12): Result.002 file - promoters60/1441657
ttaatttgatag

SEQ ID NO: 114374 - DNA, 12 bp, Unknown
  misc_feature (1)..( 12): Result.002 file - promoters60/1441657
cccatttgattt

SEQ ID NO: 114375 - DNA, 8 bp, Unknown
  misc_feature (1)..( 8): Result.002 file - promoters60/1441665
gaaaaaaa

SEQ ID NO: 114376 - DNA, 8 bp, Unknown
  misc_feature (1)..( 8): Result.002 file - promoters60/1441665
gaaaaaag

SEQ ID NO: 114377 - DNA, 9 bp, Unknown
  misc_feature (1)..( 9): Result.002 file - promoters60/1441665
caaacaaat

SEQ ID NO: 114378 - DNA, 9 bp, Unknown
  misc_feature (1)..( 9): Result.002 file - promoters60/1441665
caaagaaag

SEQ ID NO: 114379 - DNA, 9 bp, Unknown
  misc_feature (1)..( 9): Result.002 file - promoters60/1441665
caaacacaa

SEQ ID NO: 114380 - DNA, 9 bp, Unknown
  misc_feature (1)..( 9): Result.002 file - promoters60/1441665
caaggaaag

SEQ ID NO: 114381 - DNA, 9 bp, Unknown
  misc_feature (1)..( 9): Result.002 file - promoters60/1441665
caacgaata

SEQ ID NO: 114382 - DNA, 15 bp, Unknown
  misc_feature (1)..( 15): Result.002 file - promoters60/1441665
acaatgggctgggcc

SEQ ID NO: 114383 - DNA, 15 bp, Unknown
  misc_feature (1)..( 15): Result.002 file - promoters60/1441665
caaatgggcctaatt

SEQ ID NO: 114384 - DNA, 15 bp, Unknown
  misc_feature (1)..( 15): Result.002 file - promoters60/1441665
gaaataggcccaaca

SEQ ID NO: 114385 - DNA, 15 bp, Unknown
  misc_feature (1)..( 15): Result.002 file - promoters60/1441665
ttaatgggccgaatt

SEQ ID NO: 114386 - DNA, 15 bp, Unknown
  misc_feature (1)..( 15): Result.002 file - promoters60/1441665
agtttgggccaactt

SEQ ID NO: 114387 - DNA, 15 bp, Unknown
  misc_feature (1)..( 15): Result.002 file - promoters60/1441665
taaaaaggcccatta

SEQ ID NO: 114388 - DNA, 15 bp, Unknown
  misc_feature (1)..( 15): Result.002 file - promoters60/1441665
taaaaaatatctgaa

SEQ ID NO: 114389 - DNA, 15 bp, Unknown
  misc_feature (1)..( 15): Result.002 file - promoters60/1441665
ccaaacggctaggat

SEQ ID NO: 114390 - DNA, 11 bp, Unknown
  misc_feature (1)..( 11): Result.002 file - promoters60/1441814
tctttgcttac

SEQ ID NO: 114391 - DNA, 11 bp, Unknown
  misc_feature (1)..( 11): Result.002 file - promoters60/1441814
gtttttctttt

SEQ ID NO: 114392 - DNA, 11 bp, Unknown
  misc_feature (1)..( 11): Result.002 file - promoters60/1441814
aagttgtttat

SEQ ID NO: 114393 - DNA, 11 bp, Unknown
  misc_feature (1)..( 11): Result.002 file - promoters60/1441814
aattttattta

SEQ ID NO: 114394 - DNA, 11 bp, Unknown
  misc_feature (1)..( 11): Result.002 file - promoters60/1441814
tattttatgta

SEQ ID NO: 114395 - DNA, 11 bp, Unknown
  misc_feature (1)..( 11): Result.002 file - promoters60/1441814
aatcttaatat

SEQ ID NO: 114396 - DNA, 11 bp, Unknown
  misc_feature (1)..( 11): Result.002 file - promoters60/1441814
ttcatgtttaa

SEQ ID NO: 114397 - DNA, 11 bp, Unknown
  misc_feature (1)..( 11): Result.002 file - promoters60/1441814
ccacatattta

SEQ ID NO: 114398 - DNA, 10 bp, Unknown
  misc_feature (1)..( 10): Result.002 file - promoters60/1441814
gcatatcctt

SEQ ID NO: 114399 - DNA, 10 bp, Unknown
  misc_feature (1)..( 10): Result.002 file - promoters60/1441814
atgtattctt

SEQ ID NO: 114400 - DNA, 10 bp, Unknown
  misc_feature (1)..( 10): Result.002 file - promoters60/1441814
aaatatccgg

SEQ ID NO: 114401 - DNA, 10 bp, Unknown
  misc_feature (1)..( 10): Result.002 file - promoters60/1441814
aattattctg

SEQ ID NO: 114402 - DNA, 10 bp, Unknown
  misc_feature (1)..( 10): Result.002 file - promoters60/1441814
gtttactcta

SEQ ID NO: 114403 - DNA, 10 bp, Unknown
  misc_feature (1)..( 10): Result.002 file - promoters60/1441814
aaatatctaa

SEQ ID NO: 114404 - DNA, 15 bp, Unknown
  misc_feature (1)..( 15): Result.002 file - promoters60/1441814
tagagattgtgagtc

SEQ ID NO: 114405 - DNA, 15 bp, Unknown
  misc_feature (1)..( 15): Result.002 file - promoters60/1441814
gcccctttgagagga

SEQ ID NO: 114406 - DNA, 15 bp, Unknown
  misc_feature (1)..( 15): Result.002 file - promoters60/1441814
cgtgtattgtgtttt

SEQ ID NO: 114407 - DNA, 15 bp, Unknown
  misc_feature (1)..( 15): Result.002 file - promoters60/1441814
taatgtttgagtgga

SEQ ID NO: 114408 - DNA, 15 bp, Unknown
  misc_feature (1)..( 15): Result.002 file - promoters60/1441814
taatgttagagtgga

SEQ ID NO: 114409 - DNA, 15 bp, Unknown
  misc_feature (1)..( 15): Result.002 file - promoters60/1441814
taattttatttttaa

SEQ ID NO: 114410 - DNA, 8 bp, Unknown
  misc_feature (1)..( 8): Result.002 file - promoters60/1441814
tattttga

SEQ ID NO: 114411 - DNA, 8 bp, Unknown
  misc_feature (1)..( 8): Result.002 file - promoters60/1441814
tattttat

SEQ ID NO: 114412 - DNA, 8 bp, Unknown
  misc_feature (1)..( 8): Result.002 file - promoters60/1441814
tattatat

SEQ ID NO: 114413 - DNA, 9 bp, Unknown
  misc_feature (1)..( 9): Result.002 file - promoters60/1441814
tatatatga

SEQ ID NO: 114414 - DNA, 9 bp, Unknown
  misc_feature (1)..( 9): Result.002 file - promoters60/1441814
aattttaaa

SEQ ID NO: 114415 - DNA, 9 bp, Unknown
  misc_feature (1)..( 9): Result.002 file - promoters60/1441814
ttcatatga

SEQ ID NO: 114416 - DNA, 9 bp, Unknown
  misc_feature (1)..( 9): Result.002 file - promoters60/1441814
gaattttct

SEQ ID NO: 114417 - DNA, 14 bp, Unknown
  misc_feature (1)..( 14): Result.002 file - promoters60/1441814
caacaatgtacaaa

SEQ ID NO: 114418 - DNA, 14 bp, Unknown
  misc_feature (1)..( 14): Result.002 file - promoters60/1441814
caataatttacatt

SEQ ID NO: 114419 - DNA, 14 bp, Unknown
  misc_feature (1)..( 14): Result.002 file - promoters60/1441814
ttacaatttacaat

SEQ ID NO: 114420 - DNA, 14 bp, Unknown
  misc_feature (1)..( 14): Result.002 file - promoters60/1441814
gaataataaaatgt

SEQ ID NO: 114421 - DNA, 14 bp, Unknown
  misc_feature (1)..( 14): Result.002 file - promoters60/1441814
atttaatttaatat

SEQ ID NO: 114422 - DNA, 14 bp, Unknown
  misc_feature (1)..( 14): Result.002 file - promoters60/1441814
attggattaaatat

SEQ ID NO: 114423 - DNA, 14 bp, Unknown
  misc_feature (1)..( 14): Result.002 file - promoters60/1441814
tgaaaatttatacg

SEQ ID NO: 114424 - DNA, 14 bp, Unknown
  misc_feature (1)..( 14): Result.002 file - promoters60/1441814
aaataaatagatac

SEQ ID NO: 114425 - DNA, 15 bp, Unknown
  misc_feature (1)..( 15): Result.002 file - promoters60/1441814
tgtaataattaaagt

SEQ ID NO: 114426 - DNA, 15 bp, Unknown
  misc_feature (1)..( 15): Result.002 file - promoters60/1441814
accaataatggcccc

SEQ ID NO: 114427 - DNA, 15 bp, Unknown
  misc_feature (1)..( 15): Result.002 file - promoters60/1441814
taaaataattcttag

SEQ ID NO: 114428 - DNA, 16 bp, Unknown
  misc_feature (1)..( 16): Result.002 file - promoters60/1441814
agtggatattgggttt

SEQ ID NO: 114429 - DNA, 16 bp, Unknown
  misc_feature (1)..( 16): Result.002 file - promoters60/1441814
ataaactaattatgtg

SEQ ID NO: 114430 - DNA, 16 bp, Unknown
  misc_feature (1)..( 16): Result.002 file - promoters60/1441814
aacaaaaaattactct

SEQ ID NO: 114431 - DNA, 16 bp, Unknown
  misc_feature (1)..( 16): Result.002 file - promoters60/1441814
gtcgtgtattgtgttt

SEQ ID NO: 114432 - DNA, 10 bp, Unknown
  misc_feature (1)..( 10): Result.002 file - promoters60/1441814
gcattttgag

SEQ ID NO: 114433 - DNA, 10 bp, Unknown
  misc_feature (1)..( 10): Result.002 file - promoters60/1441814
tcatttttat

SEQ ID NO: 114434 - DNA, 10 bp, Unknown
  misc_feature (1)..( 10): Result.002 file - promoters60/1441814
agattttgtt

SEQ ID NO: 114435 - DNA, 10 bp, Unknown
  misc_feature (1)..( 10): Result.002 file - promoters60/1441814
caattttgtt

SEQ ID NO: 114436 - DNA, 10 bp, Unknown
  misc_feature (1)..( 10): Result.002 file - promoters60/1441814
aaatttttat

SEQ ID NO: 114437 - DNA, 10 bp, Unknown
  misc_feature (1)..( 10): Result.002 file - promoters60/1441814
aaactttaga

SEQ ID NO: 114438 - DNA, 10 bp, Unknown
  misc_feature (1)..( 10): Result.002 file - promoters60/1441814
taatattagt

SEQ ID NO: 114439 - DNA, 10 bp, Unknown
  misc_feature (1)..( 10): Result.002 file - promoters60/1441814
taatattagt

SEQ ID NO: 114440 - DNA, 10 bp, Unknown
  misc_feature (1)..( 10): Result.002 file - promoters60/1441814
taattttaaa

SEQ ID NO: 114441 - DNA, 10 bp, Unknown
  misc_feature (1)..( 10): Result.002 file - promoters60/1441814
tcatatgagt

SEQ ID NO: 114442 - DNA, 10 bp, Unknown
  misc_feature (1)..( 10): Result.002 file - promoters60/1441814
atattttatc

SEQ ID NO: 114443 - DNA, 10 bp, Unknown
  misc_feature (1)..( 10): Result.002 file - promoters60/1441814
gaattttctg

SEQ ID NO: 114444 - DNA, 12 bp, Unknown
  misc_feature (1)..( 12): Result.002 file - promoters60/1441835
tgccattttctt

SEQ ID NO: 114445 - DNA, 12 bp, Unknown
  misc_feature (1)..( 12): Result.002 file - promoters60/1441835
tctcatttttgg

SEQ ID NO: 114446 - DNA, 12 bp, Unknown
  misc_feature (1)..( 12): Result.002 file - promoters60/1441835
aataatttactt

SEQ ID NO: 114447 - DNA, 11 bp, Unknown
  misc_feature (1)..( 11): Result.002 file - promoters60/1441835
taaattataat

SEQ ID NO: 114448 - DNA, 12 bp, Unknown
  misc_feature (1)..( 12): Result.002 file - promoters60/1441835
taaaattagcag

SEQ ID NO: 114449 - DNA, 12 bp, Unknown
  misc_feature (1)..( 12): Result.002 file - promoters60/1441835
ctcagtttctcg

SEQ ID NO: 114450 - DNA, 12 bp, Unknown
  misc_feature (1)..( 12): Result.002 file - promoters60/1441841
cttcacatgaaa

SEQ ID NO: 114451 - DNA, 12 bp, Unknown
  misc_feature (1)..( 12): Result.002 file - promoters60/1441841
tctcacacgaag

SEQ ID NO: 114452 - DNA, 12 bp, Unknown
  misc_feature (1)..( 12): Result.002 file - promoters60/1441841
gaactaatgaaa

SEQ ID NO: 114453 - DNA, 12 bp, Unknown
  misc_feature (1)..( 12): Result.002 file - promoters60/1441841
tcttacacgtta

SEQ ID NO: 114454 - DNA, 10 bp, Unknown
  misc_feature (1)..( 10): Result.002 file - promoters60/1441841
aaaaggtttt

SEQ ID NO: 114455 - DNA, 10 bp, Unknown
  misc_feature (1)..( 10): Result.002 file - promoters60/1441841
aaaatgtttt

SEQ ID NO: 114456 - DNA, 10 bp, Unknown
  misc_feature (1)..( 10): Result.002 file - promoters60/1441841
acaatatttg

SEQ ID NO: 114457 - DNA, 8 bp, Unknown
  misc_feature (1)..( 8): Result.002 file - promoters60/1441841
cttggttc

SEQ ID NO: 114458 - DNA, 8 bp, Unknown
  misc_feature (1)..( 8): Result.002 file - promoters60/1441841
gttgtttc

SEQ ID NO: 114459 - DNA, 8 bp, Unknown
  misc_feature (1)..( 8): Result.002 file - promoters60/1441841
tttgtttg

SEQ ID NO: 114460 - DNA, 8 bp, Unknown
  misc_feature (1)..( 8): Result.002 file - promoters60/1441841
tttattta

SEQ ID NO: 114461 - DNA, 14 bp, Unknown
  misc_feature (1)..( 14): Result.002 file - promoters60/1441841
acatagttactaat

SEQ ID NO: 114462 - DNA, 14 bp, Unknown
  misc_feature (1)..( 14): Result.002 file - promoters60/1441841
tcattgtttaattt

SEQ ID NO: 114463 - DNA, 14 bp, Unknown
  misc_feature (1)..( 14): Result.002 file - promoters60/1441841
tcattttttaattt

SEQ ID NO: 114464 - DNA, 14 bp, Unknown
  misc_feature (1)..( 14): Result.002 file - promoters60/1441841
aaatttgttataac

SEQ ID NO: 114465 - DNA, 7 bp, Unknown
  misc_feature (1)..( 7): Result.002 file - promoters60/1441841
cttttaa

SEQ ID NO: 114466 - DNA, 7 bp, Unknown
  misc_feature (1)..( 7): Result.002 file - promoters60/1441841
cttctaa

SEQ ID NO: 114467 - DNA, 7 bp, Unknown
  misc_feature (1)..( 7): Result.002 file - promoters60/1441841
tttctaa

SEQ ID NO: 114468 - DNA, 8 bp, Unknown
  misc_feature (1)..( 8): Result.002 file - promoters60/1441841
ttttgttg

SEQ ID NO: 114469 - DNA, 8 bp, Unknown
  misc_feature (1)..( 8): Result.002 file - promoters60/1441841
ttttgttt

SEQ ID NO: 114470 - DNA, 8 bp, Unknown
  misc_feature (1)..( 8): Result.002 file - promoters60/1441841
atttattt

SEQ ID NO: 114471 - DNA, 6 bp, Unknown
  misc_feature (1)..( 6): Result.002 file - promoters60/1441851
ttgaga

SEQ ID NO: 114472 - DNA, 6 bp, Unknown
  misc_feature (1)..( 6): Result.002 file - promoters60/1441851
ttgaga

SEQ ID NO: 114473 - DNA, 10 bp, Unknown
  misc_feature (1)..( 10): Result.002 file - promoters60/1441851
taacgtttaa

SEQ ID NO: 114474 - DNA, 10 bp, Unknown
  misc_feature (1)..( 10): Result.002 file - promoters60/1441851
taacgtttaa

SEQ ID NO: 114475 - DNA, 6 bp, Unknown
  misc_feature (1)..( 6): Result.002 file - promoters60/1441851
aacatt

SEQ ID NO: 114476 - DNA, 6 bp, Unknown
  misc_feature (1)..( 6): Result.002 file - promoters60/1441851
aacatt

SEQ ID NO: 114477 - DNA, 7 bp, Unknown
  misc_feature (1)..( 7): Result.002 file - promoters60/1441851
ttcaaag

SEQ ID NO: 114478 - DNA, 7 bp, Unknown
  misc_feature (1)..( 7): Result.002 file - promoters60/1441851
ttcaaag

SEQ ID NO: 114479 - DNA, 7 bp, Unknown
  misc_feature (1)..( 7): Result.002 file - promoters60/1441851
aagaact

SEQ ID NO: 114480 - DNA, 7 bp, Unknown
  misc_feature (1)..( 7): Result.002 file - promoters60/1441851
aagtact

SEQ ID NO: 114481 - DNA, 7 bp, Unknown
  misc_feature (1)..( 7): Result.002 file - promoters60/1441851
agtaaac

SEQ ID NO: 114482 - DNA, 7 bp, Unknown
  misc_feature (1)..( 7): Result.002 file - promoters60/1441851
agttaac

SEQ ID NO: 114483 - DNA, 7 bp, Unknown
  misc_feature (1)..( 7): Result.002 file - promoters60/1441851
attcata

SEQ ID NO: 114484 - DNA, 7 bp, Unknown
  misc_feature (1)..( 7): Result.002 file - promoters60/1441851
attcata

SEQ ID NO: 114485 - DNA, 6 bp, Unknown
  misc_feature (1)..( 6): Result.002 file - promoters60/1441851
taacat

SEQ ID NO: 114486 - DNA, 6 bp, Unknown
  misc_feature (1)..( 6): Result.002 file - promoters60/1441851
taacat

SEQ ID NO: 114487 - DNA, 10 bp, Unknown
  misc_feature (1)..( 10): Result.002 file - promoters60/1441851
agtctagaaa

SEQ ID NO: 114488 - DNA, 10 bp, Unknown
  misc_feature (1)..( 10): Result.002 file - promoters60/1441851
agtctaaaaa

SEQ ID NO: 114489 - DNA, 9 bp, Unknown
  misc_feature (1)..( 9): Result.002 file - promoters60/1441851
ataattttt

SEQ ID NO: 114490 - DNA, 9 bp, Unknown
  misc_feature (1)..( 9): Result.002 file - promoters60/1441851
ataatgttt

SEQ ID NO: 114491 - DNA, 7 bp, Unknown
  misc_feature (1)..( 7): Result.002 file - promoters60/1441851
atagata

SEQ ID NO: 114492 - DNA, 7 bp, Unknown
  misc_feature (1)..( 7): Result.002 file - promoters60/1441851
atatata

SEQ ID NO: 114493 - DNA, 7 bp, Unknown
  misc_feature (1)..( 7): Result.002 file - promoters60/1441851
atgtaat

SEQ ID NO: 114494 - DNA, 7 bp, Unknown
  misc_feature (1)..( 7): Result.002 file - promoters60/1441851
atggaat

SEQ ID NO: 114495 - DNA, 7 bp, Unknown
  misc_feature (1)..( 7): Result.002 file - promoters60/1441851
acctaat

SEQ ID NO: 114496 - DNA, 7 bp, Unknown
  misc_feature (1)..( 7): Result.002 file - promoters60/1441851
accaaat

SEQ ID NO: 114497 - DNA, 6 bp, Unknown
  misc_feature (1)..( 6): Result.002 file - promoters60/1441851
tattat

SEQ ID NO: 114498 - DNA, 6 bp, Unknown
  misc_feature (1)..( 6): Result.002 file - promoters60/1441851
tattat

SEQ ID NO: 114499 - DNA, 6 bp, Unknown
  misc_feature (1)..( 6): Result.002 file - promoters60/1441851
aaaaaa

SEQ ID NO: 114500 - DNA, 6 bp, Unknown
  misc_feature (1)..( 6): Result.002 file - promoters60/1441851
aaaaaa

SEQ ID NO: 114501 - DNA, 6 bp, Unknown
  misc_feature (1)..( 6): Result.002 file - promoters60/1441851
gtcaaa

SEQ ID NO: 114502 - DNA, 6 bp, Unknown
  misc_feature (1)..( 6): Result.002 file - promoters60/1441851
gtcaaa

SEQ ID NO: 114503 - DNA, 6 bp, Unknown
  misc_feature (1)..( 6): Result.002 file - promoters60/1441851
ggcgag

SEQ ID NO: 114504 - DNA, 6 bp, Unknown
  misc_feature (1)..( 6): Result.002 file - promoters60/1441851
ggcgag

SEQ ID NO: 114505 - DNA, 13 bp, Unknown
  misc_feature (1)..( 13): Result.002 file - promoters60/1441859
tttttttttcttc

SEQ ID NO: 114506 - DNA, 13 bp, Unknown
  misc_feature (1)..( 13): Result.002 file - promoters60/1441859
tatagttttctgt

SEQ ID NO: 114507 - DNA, 13 bp, Unknown
  misc_feature (1)..( 13): Result.002 file - promoters60/1441859
ttttgttttcctt

SEQ ID NO: 114508 - DNA, 13 bp, Unknown
  misc_feature (1)..( 13): Result.002 file - promoters60/1441859
acaatttttcaat

SEQ ID NO: 114509 - DNA, 13 bp, Unknown
  misc_feature (1)..( 13): Result.002 file - promoters60/1441859
cacaattttgttg

SEQ ID NO: 114510 - DNA, 13 bp, Unknown
  misc_feature (1)..( 13): Result.002 file - promoters60/1441859
atttattttgtaa

SEQ ID NO: 114511 - DNA, 16 bp, Unknown
  misc_feature (1)..( 16): Result.002 file - promoters60/1441859
aacaatgatttaatac

SEQ ID NO: 114512 - DNA, 16 bp, Unknown
  misc_feature (1)..( 16): Result.002 file - promoters60/1441859
taccaaaattaaatgc

SEQ ID NO: 114513 - DNA, 16 bp, Unknown
  misc_feature (1)..( 16): Result.002 file - promoters60/1441859
tactaaaatgaaatga

SEQ ID NO: 114514 - DNA, 16 bp, Unknown
  misc_feature (1)..( 16): Result.002 file - promoters60/1441859
acgaggggcaaaatgt

SEQ ID NO: 114515 - DNA, 16 bp, Unknown
  misc_feature (1)..( 16): Result.002 file - promoters60/1441859
aaagcaattgaaatgt

SEQ ID NO: 114516 - DNA, 16 bp, Unknown
  misc_feature (1)..( 16): Result.002 file - promoters60/1441859
aaaaaaaaaaaaagaa

SEQ ID NO: 114517 - DNA, 16 bp, Unknown
  misc_feature (1)..( 16): Result.002 file - promoters60/1441859
ttttaaaaaaaaagtt

SEQ ID NO: 114518 - DNA, 10 bp, Unknown
  misc_feature (1)..( 10): Result.002 file - promoters60/1441859
cttttttttt

SEQ ID NO: 114519 - DNA, 10 bp, Unknown
  misc_feature (1)..( 10): Result.002 file - promoters60/1441859
gttttgtttt

SEQ ID NO: 114520 - DNA, 10 bp, Unknown
  misc_feature (1)..( 10): Result.002 file - promoters60/1441859
gttttgaatt

SEQ ID NO: 114521 - DNA, 10 bp, Unknown
  misc_feature (1)..( 10): Result.002 file - promoters60/1441859
attttgttgt

SEQ ID NO: 114522 - DNA, 10 bp, Unknown
  misc_feature (1)..( 10): Result.002 file - promoters60/1441859
attttgtaat

SEQ ID NO: 114523 - DNA, 10 bp, Unknown
  misc_feature (1)..( 10): Result.002 file - promoters60/1441859
ttttagttga

SEQ ID NO: 114524 - DNA, 14 bp, Unknown
  misc_feature (1)..( 14): Result.002 file - promoters60/1441859
ttgtcacaagtttt

SEQ ID NO: 114525 - DNA, 14 bp, Unknown
  misc_feature (1)..( 14): Result.002 file - promoters60/1441859
aaaaaaaaagttta

SEQ ID NO: 114526 - DNA, 14 bp, Unknown
  misc_feature (1)..( 14): Result.002 file - promoters60/1441859
tgtgtcaaagtttt

SEQ ID NO: 114527 - DNA, 14 bp, Unknown
  misc_feature (1)..( 14): Result.002 file - promoters60/1441859
ttctaaatagttga

SEQ ID NO: 114528 - DNA, 14 bp, Unknown
  misc_feature (1)..( 14): Result.002 file - promoters60/1441859
aaaaagaaagttaa

SEQ ID NO: 114529 - DNA, 14 bp, Unknown
  misc_feature (1)..( 14): Result.002 file - promoters60/1441859
attacgaaagtgac

SEQ ID NO: 114530 - DNA, 12 bp, Unknown
  misc_feature (1)..( 12): Result.002 file - promoters60/1441912
gtatatatataa

SEQ ID NO: 114531 - DNA, 12 bp, Unknown
  misc_feature (1)..( 12): Result.002 file - promoters60/1441912
atatttatatag

SEQ ID NO: 114532 - DNA, 12 bp, Unknown
  misc_feature (1)..( 12): Result.002 file - promoters60/1441912
caataaaaagca

SEQ ID NO: 114533 - DNA, 12 bp, Unknown
  misc_feature (1)..( 12): Result.002 file - promoters60/1441912
acagttaaatag

SEQ ID NO: 114534 - DNA, 12 bp, Unknown
  misc_feature (1)..( 12): Result.002 file - promoters60/1441912
atatttgtatca

SEQ ID NO: 114535 - DNA, 12 bp, Unknown
  misc_feature (1)..( 12): Result.002 file - promoters60/1441912
tctgttaaaatc

SEQ ID NO: 114536 - DNA, 9 bp, Unknown
  misc_feature (1)..( 9): Result.002 file - promoters60/1441912
ataataaac

SEQ ID NO: 114537 - DNA, 9 bp, Unknown
  misc_feature (1)..( 9): Result.002 file - promoters60/1441912
ccaataaag

SEQ ID NO: 114538 - DNA, 9 bp, Unknown
  misc_feature (1)..( 9): Result.002 file - promoters60/1441912
gtaataata

SEQ ID NO: 114539 - DNA, 9 bp, Unknown
  misc_feature (1)..( 9): Result.002 file - promoters60/1441912
atactaaaa

SEQ ID NO: 114540 - DNA, 9 bp, Unknown
  misc_feature (1)..( 9): Result.002 file - promoters60/1441912
ttaataaaa

SEQ ID NO: 114541 - DNA, 9 bp, Unknown
  misc_feature (1)..( 9): Result.002 file - promoters60/1441912
catataaaa

SEQ ID NO: 114542 - DNA, 8 bp, Unknown
  misc_feature (1)..( 8): Result.002 file - promoters60/1441937
taaaaatc

SEQ ID NO: 114543 - DNA, 8 bp, Unknown
  misc_feature (1)..( 8): Result.002 file - promoters60/1441937
taacaata

SEQ ID NO: 114544 - DNA, 8 bp, Unknown
  misc_feature (1)..( 8): Result.002 file - promoters60/1441937
ttaaaatc

SEQ ID NO: 114545 - DNA, 8 bp, Unknown
  misc_feature (1)..( 8): Result.002 file - promoters60/1441937
ctgtgttg

SEQ ID NO: 114546 - DNA, 8 bp, Unknown
  misc_feature (1)..( 8): Result.002 file - promoters60/1441937
atgtcttg

SEQ ID NO: 114547 - DNA, 8 bp, Unknown
  misc_feature (1)..( 8): Result.002 file - promoters60/1441937
ctgtgtct

SEQ ID NO: 114548 - DNA, 8 bp, Unknown
  misc_feature (1)..( 8): Result.002 file - promoters60/1441937
tcttgttt

SEQ ID NO: 114549 - DNA, 8 bp, Unknown
  misc_feature (1)..( 8): Result.002 file - promoters60/1441937
tcttattt

SEQ ID NO: 114550 - DNA, 8 bp, Unknown
  misc_feature (1)..( 8): Result.002 file - promoters60/1441937
tctggttg

SEQ ID NO: 114551 - DNA, 8 bp, Unknown
  misc_feature (1)..( 8): Result.002 file - promoters60/1441937
caatttat

SEQ ID NO: 114552 - DNA, 8 bp, Unknown
  misc_feature (1)..( 8): Result.002 file - promoters60/1441937
caatttgc

SEQ ID NO: 114553 - DNA, 8 bp, Unknown
  misc_feature (1)..( 8): Result.002 file - promoters60/1441937
taatgtat

SEQ ID NO: 114554 - DNA, 8 bp, Unknown
  misc_feature (1)..( 8): Result.002 file - promoters60/1441985
ttacgtat

SEQ ID NO: 114555 - DNA, 8 bp, Unknown
  misc_feature (1)..( 8): Result.002 file - promoters60/1441985
ttacatat

SEQ ID NO: 114556 - DNA, 7 bp, Unknown
  misc_feature (1)..( 7): Result.002 file - promoters60/1441985
acaattt

SEQ ID NO: 114557 - DNA, 7 bp, Unknown
  misc_feature (1)..( 7): Result.002 file - promoters60/1441985
acatttt

SEQ ID NO: 114558 - DNA, 7 bp, Unknown
  misc_feature (1)..( 7): Result.002 file - promoters60/1441985
ccacaat

SEQ ID NO: 114559 - DNA, 7 bp, Unknown
  misc_feature (1)..( 7): Result.002 file - promoters60/1441985
ccaaaat

SEQ ID NO: 114560 - DNA, 6 bp, Unknown
  misc_feature (1)..( 6): Result.002 file - promoters60/1441985
ggtttt

SEQ ID NO: 114561 - DNA, 6 bp, Unknown
  misc_feature (1)..( 6): Result.002 file - promoters60/1441985
ggtttt

SEQ ID NO: 114562 - DNA, 6 bp, Unknown
  misc_feature (1)..( 6): Result.002 file - promoters60/1441985
ttttga

SEQ ID NO: 114563 - DNA, 6 bp, Unknown
  misc_feature (1)..( 6): Result.002 file - promoters60/1441985
ttttga

SEQ ID NO: 114564 - DNA, 9 bp, Unknown
  misc_feature (1)..( 9): Result.002 file - promoters60/1441985
atttttttt

SEQ ID NO: 114565 - DNA, 9 bp, Unknown
  misc_feature (1)..( 9): Result.002 file - promoters60/1441985
attattttt

SEQ ID NO: 114566 - DNA, 9 bp, Unknown
  misc_feature (1)..( 9): Result.002 file - promoters60/1441985
gtttttttt

SEQ ID NO: 114567 - DNA, 6 bp, Unknown
  misc_feature (1)..( 6): Result.002 file - promoters60/1441985
aaatga

SEQ ID NO: 114568 - DNA, 6 bp, Unknown
  misc_feature (1)..( 6): Result.002 file - promoters60/1441985
aaatga

SEQ ID NO: 114569 - DNA, 7 bp, Unknown
  misc_feature (1)..( 7): Result.002 file - promoters60/1441985
aagctgt

SEQ ID NO: 114570 - DNA, 7 bp, Unknown
  misc_feature (1)..( 7): Result.002 file - promoters60/1441985
aagatgt

SEQ ID NO: 114571 - DNA, 7 bp, Unknown
  misc_feature (1)..( 7): Result.002 file - promoters60/1441985
acgtgga

SEQ ID NO: 114572 - DNA, 7 bp, Unknown
  misc_feature (1)..( 7): Result.002 file - promoters60/1441985
acgagga

SEQ ID NO: 114573 - DNA, 9 bp, Unknown
  misc_feature (1)..( 9): Result.002 file - promoters60/1441985
atataaata

SEQ ID NO: 114574 - DNA, 9 bp, Unknown
  misc_feature (1)..( 9): Result.002 file - promoters60/1441985
atataaata

SEQ ID NO: 114575 - DNA, 8 bp, Unknown
  misc_feature (1)..( 8): Result.002 file - promoters60/1441985
gaaactac

SEQ ID NO: 114576 - DNA, 8 bp, Unknown
  misc_feature (1)..( 8): Result.002 file - promoters60/1441985
gaaattac

SEQ ID NO: 114577 - DNA, 8 bp, Unknown
  misc_feature (1)..( 8): Result.002 file - promoters60/1441985
aattttgt

SEQ ID NO: 114578 - DNA, 8 bp, Unknown
  misc_feature (1)..( 8): Result.002 file - promoters60/1441985
aattttgt

SEQ ID NO: 114579 - DNA, 6 bp, Unknown
  misc_feature (1)..( 6): Result.002 file - promoters60/1441985
gttatt

SEQ ID NO: 114580 - DNA, 6 bp, Unknown
  misc_feature (1)..( 6): Result.002 file - promoters60/1441985
gttatt

SEQ ID NO: 114581 - DNA, 7 bp, Unknown
  misc_feature (1)..( 7): Result.002 file - promoters60/1441985
gaatatt

SEQ ID NO: 114582 - DNA, 7 bp, Unknown
  misc_feature (1)..( 7): Result.002 file - promoters60/1441985
gaaaatt

SEQ ID NO: 114583 - DNA, 7 bp, Unknown
  misc_feature (1)..( 7): Result.002 file - promoters60/1441985
acgcata

SEQ ID NO: 114584 - DNA, 7 bp, Unknown
  misc_feature (1)..( 7): Result.002 file - promoters60/1441985
acgaata

SEQ ID NO: 114585 - DNA, 6 bp, Unknown
  misc_feature (1)..( 6): Result.002 file - promoters60/1441985
aaaaca

SEQ ID NO: 114586 - DNA, 6 bp, Unknown
  misc_feature (1)..( 6): Result.002 file - promoters60/1441985
aaaaca

SEQ ID NO: 114587 - DNA, 6 bp, Unknown
  misc_feature (1)..( 6): Result.002 file - promoters60/1441985
gtaacc

SEQ ID NO: 114588 - DNA, 6 bp, Unknown
  misc_feature (1)..( 6): Result.002 file - promoters60/1441985
gtaacc

SEQ ID NO: 114589 - DNA, 8 bp, Unknown
  misc_feature (1)..( 8): Result.002 file - promoters60/1441985
atagaaat

SEQ ID NO: 114590 - DNA, 8 bp, Unknown
  misc_feature (1)..( 8): Result.002 file - promoters60/1441985
atagaaat

SEQ ID NO: 114591 - DNA, 11 bp, Unknown
  misc_feature (1)..( 11): Result.002 file - promoters60/1441985
aattacaaaaa

SEQ ID NO: 114592 - DNA, 11 bp, Unknown
  misc_feature (1)..( 11): Result.002 file - promoters60/1441985
aatcacaaaaa

SEQ ID NO: 114593 - DNA, 6 bp, Unknown
  misc_feature (1)..( 6): Result.002 file - promoters60/1441985
ctcagt

SEQ ID NO: 114594 - DNA, 6 bp, Unknown
  misc_feature (1)..( 6): Result.002 file - promoters60/1441985
ctcagt

SEQ ID NO: 114595 - DNA, 7 bp, Unknown
  misc_feature (1)..( 7): Result.002 file - promoters60/1441985
tttctta

SEQ ID NO: 114596 - DNA, 7 bp, Unknown
  misc_feature (1)..( 7): Result.002 file - promoters60/1441985
tttctta

SEQ ID NO: 114597 - DNA, 6 bp, Unknown
  misc_feature (1)..( 6): Result.002 file - promoters60/1441985
tttcta

SEQ ID NO: 114598 - DNA, 6 bp, Unknown
  misc_feature (1)..( 6): Result.002 file - promoters60/1441985
tttcta

SEQ ID NO: 114599 - DNA, 7 bp, Unknown
  misc_feature (1)..( 7): Result.002 file - promoters60/1441985
caaataa

SEQ ID NO: 114600 - DNA, 7 bp, Unknown
  misc_feature (1)..( 7): Result.002 file - promoters60/1441985
caactaa

SEQ ID NO: 114601 - DNA, 9 bp, Unknown
  misc_feature (1)..( 9): Result.002 file - promoters60/1441985
cttgttcaa

SEQ ID NO: 114602 - DNA, 9 bp, Unknown
  misc_feature (1)..( 9): Result.002 file - promoters60/1441985
cttgtacaa

SEQ ID NO: 114603 - DNA, 6 bp, Unknown
  misc_feature (1)..( 6): Result.002 file - promoters60/1441985
ttggtt

SEQ ID NO: 114604 - DNA, 6 bp, Unknown
  misc_feature (1)..( 6): Result.002 file - promoters60/1441985
ttggtt

SEQ ID NO: 114605 - DNA, 6 bp, Unknown
  misc_feature (1)..( 6): Result.002 file - promoters60/1441985
cataaa

SEQ ID NO: 114606 - DNA, 6 bp, Unknown
  misc_feature (1)..( 6): Result.002 file - promoters60/1441985
cataaa

SEQ ID NO: 114607 - DNA, 6 bp, Unknown
  misc_feature (1)..( 6): Result.002 file - promoters60/1441985
ttttaa

SEQ ID NO: 114608 - DNA, 6 bp, Unknown
  misc_feature (1)..( 6): Result.002 file - promoters60/1441985
ttttaa

SEQ ID NO: 114609 - DNA, 11 bp, Unknown
  misc_feature (1)..( 11): Result.002 file - promoters60/1441990
catatatactt

SEQ ID NO: 114610 - DNA, 11 bp, Unknown
  misc_feature (1)..( 11): Result.002 file - promoters60/1441990
tatatatataa

SEQ ID NO: 114611 - DNA, 11 bp, Unknown
  misc_feature (1)..( 11): Result.002 file - promoters60/1441990
tttatatagat

SEQ ID NO: 114612 - DNA, 11 bp, Unknown
  misc_feature (1)..( 11): Result.002 file - promoters60/1441990
agtatataaat

SEQ ID NO: 114613 - DNA, 11 bp, Unknown
  misc_feature (1)..( 11): Result.002 file - promoters60/1441990
gttaaatagca

SEQ ID NO: 114614 - DNA, 11 bp, Unknown
  misc_feature (1)..( 11): Result.002 file - promoters60/1441990
aataaaaagca

SEQ ID NO: 114615 - DNA, 11 bp, Unknown
  misc_feature (1)..( 11): Result.002 file - promoters60/1441990
gttaaaatcgt

SEQ ID NO: 114616 - DNA, 15 bp, Unknown
  misc_feature (1)..( 15): Result.002 file - promoters60/1441990
ttaggatagatagac

SEQ ID NO: 114617 - DNA, 15 bp, Unknown
  misc_feature (1)..( 15): Result.002 file - promoters60/1441990
cgacaataaataata

SEQ ID NO: 114618 - DNA, 15 bp, Unknown
  misc_feature (1)..( 15): Result.002 file - promoters60/1441990
cgagaatacatacag

SEQ ID NO: 114619 - DNA, 15 bp, Unknown
  misc_feature (1)..( 15): Result.002 file - promoters60/1441990
tgagaatcattaatc

SEQ ID NO: 114620 - DNA, 15 bp, Unknown
  misc_feature (1)..( 15): Result.002 file - promoters60/1441990
agagcatataagtaa

SEQ ID NO: 114621 - DNA, 15 bp, Unknown
  misc_feature (1)..( 15): Result.002 file - promoters60/1441990
aaaacaaaaattata

SEQ ID NO: 114622 - DNA, 17 bp, Unknown
  misc_feature (1)..( 17): Result.002 file - promoters60/1441990
aatacatacagatccac

SEQ ID NO: 114623 - DNA, 17 bp, Unknown
  misc_feature (1)..( 17): Result.002 file - promoters60/1441990
agtacataaaacaaaaa

SEQ ID NO: 114624 - DNA, 17 bp, Unknown
  misc_feature (1)..( 17): Result.002 file - promoters60/1441990
aatccatcaacagtagc

SEQ ID NO: 114625 - DNA, 17 bp, Unknown
  misc_feature (1)..( 17): Result.002 file - promoters60/1441990
tttacaaaaaaaaaaaa

SEQ ID NO: 114626 - DNA, 17 bp, Unknown
  misc_feature (1)..( 17): Result.002 file - promoters60/1441990
catacaaacgacacaat

SEQ ID NO: 114627 - DNA, 17 bp, Unknown
  misc_feature (1)..( 17): Result.002 file - promoters60/1441990
actacaaatatcgaatc

SEQ ID NO: 114628 - DNA, 7 bp, Unknown
  misc_feature (1)..( 7): Result.002 file - promoters60/1442104
actagat

SEQ ID NO: 114629 - DNA, 7 bp, Unknown
  misc_feature (1)..( 7): Result.002 file - promoters60/1442104
acttgat

SEQ ID NO: 114630 - DNA, 6 bp, Unknown
  misc_feature (1)..( 6): Result.002 file - promoters60/1442104
aataat

SEQ ID NO: 114631 - DNA, 6 bp, Unknown
  misc_feature (1)..( 6): Result.002 file - promoters60/1442104
aataat

SEQ ID NO: 114632 - DNA, 6 bp, Unknown
  misc_feature (1)..( 6): Result.002 file - promoters60/1442104
ttgtgg

SEQ ID NO: 114633 - DNA, 6 bp, Unknown
  misc_feature (1)..( 6): Result.002 file - promoters60/1442104
ttgtgg

SEQ ID NO: 114634 - DNA, 7 bp, Unknown
  misc_feature (1)..( 7): Result.002 file - promoters60/1442104
tataaat

SEQ ID NO: 114635 - DNA, 7 bp, Unknown
  misc_feature (1)..( 7): Result.002 file - promoters60/1442104
tataaat

SEQ ID NO: 114636 - DNA, 13 bp, Unknown
  misc_feature (1)..( 13): Result.002 file - promoters60/1442104
attcttcgacctt

SEQ ID NO: 114637 - DNA, 13 bp, Unknown
  misc_feature (1)..( 13): Result.002 file - promoters60/1442104
attattcgatctt

SEQ ID NO: 114638 - DNA, 6 bp, Unknown
  misc_feature (1)..( 6): Result.002 file - promoters60/1442104
tttgaa

SEQ ID NO: 114639 - DNA, 6 bp, Unknown
  misc_feature (1)..( 6): Result.002 file - promoters60/1442104
tttgaa

SEQ ID NO: 114640 - DNA, 6 bp, Unknown
  misc_feature (1)..( 6): Result.002 file - promoters60/1442104
taattt

SEQ ID NO: 114641 - DNA, 6 bp, Unknown
  misc_feature (1)..( 6): Result.002 file - promoters60/1442104
taattt

SEQ ID NO: 114642 - DNA, 7 bp, Unknown
  misc_feature (1)..( 7): Result.002 file - promoters60/1442104
aaacaaa

SEQ ID NO: 114643 - DNA, 7 bp, Unknown
  misc_feature (1)..( 7): Result.002 file - promoters60/1442104
aaataaa

SEQ ID NO: 114644 - DNA, 6 bp, Unknown
  misc_feature (1)..( 6): Result.002 file - promoters60/1442104
tttatc

SEQ ID NO: 114645 - DNA, 6 bp, Unknown
  misc_feature (1)..( 6): Result.002 file - promoters60/1442104
tttatc

SEQ ID NO: 114646 - DNA, 7 bp, Unknown
  misc_feature (1)..( 7): Result.002 file - promoters60/1442104
tctccca

SEQ ID NO: 114647 - DNA, 7 bp, Unknown
  misc_feature (1)..( 7): Result.002 file - promoters60/1442104
tcttcca

SEQ ID NO: 114648 - DNA, 6 bp, Unknown
  misc_feature (1)..( 6): Result.002 file - promoters60/1442104
acaatt

SEQ ID NO: 114649 - DNA, 6 bp, Unknown
  misc_feature (1)..( 6): Result.002 file - promoters60/1442104
acaatt

SEQ ID NO: 114650 - DNA, 7 bp, Unknown
  misc_feature (1)..( 7): Result.002 file - promoters60/1442104
attactt

SEQ ID NO: 114651 - DNA, 7 bp, Unknown
  misc_feature (1)..( 7): Result.002 file - promoters60/1442104
atttctt

SEQ ID NO: 114652 - DNA, 6 bp, Unknown
  misc_feature (1)..( 6): Result.002 file - promoters60/1442104
ccgaca

SEQ ID NO: 114653 - DNA, 6 bp, Unknown
  misc_feature (1)..( 6): Result.002 file - promoters60/1442104
ccgaca

SEQ ID NO: 114654 - DNA, 8 bp, Unknown
  misc_feature (1)..( 8): Result.002 file - promoters60/1442104
attgtgat

SEQ ID NO: 114655 - DNA, 8 bp, Unknown
  misc_feature (1)..( 8): Result.002 file - promoters60/1442104
attttgat

SEQ ID NO: 114656 - DNA, 6 bp, Unknown
  misc_feature (1)..( 6): Result.002 file - promoters60/1442104
ttttaa

SEQ ID NO: 114657 - DNA, 6 bp, Unknown
  misc_feature (1)..( 6): Result.002 file - promoters60/1442104
ttttaa

SEQ ID NO: 114658 - DNA, 12 bp, Unknown
  misc_feature (1)..( 12): Result.002 file - promoters60/1442156
ttattgttttct

SEQ ID NO: 114659 - DNA, 12 bp, Unknown
  misc_feature (1)..( 12): Result.002 file - promoters60/1442156
atatagttataa

SEQ ID NO: 114660 - DNA, 12 bp, Unknown
  misc_feature (1)..( 12): Result.002 file - promoters60/1442156
aaataattaaac

SEQ ID NO: 114661 - DNA, 12 bp, Unknown
  misc_feature (1)..( 12): Result.002 file - promoters60/1442156
aaatagtttcaa

SEQ ID NO: 114662 - DNA, 12 bp, Unknown
  misc_feature (1)..( 12): Result.002 file - promoters60/1442156
agaaagaatcaa

SEQ ID NO: 114663 - DNA, 12 bp, Unknown
  misc_feature (1)..( 12): Result.002 file - promoters60/1442156
aaaaagttgcaa

SEQ ID NO: 114664 - DNA, 18 bp, Unknown
  misc_feature (1)..( 18): Result.002 file - promoters60/1442156
tggcattttcttgagtca

SEQ ID NO: 114665 - DNA, 18 bp, Unknown
  misc_feature (1)..( 18): Result.002 file - promoters60/1442156
cctttatttcttctactt

SEQ ID NO: 114666 - DNA, 18 bp, Unknown
  misc_feature (1)..( 18): Result.002 file - promoters60/1442156
attttatttctcctactt

SEQ ID NO: 114667 - DNA, 18 bp, Unknown
  misc_feature (1)..( 18): Result.002 file - promoters60/1442156
attttattacagacagat

SEQ ID NO: 114668 - DNA, 10 bp, Unknown
  misc_feature (1)..( 10): Result.002 file - promoters60/1442156
actttcttct

SEQ ID NO: 114669 - DNA, 10 bp, Unknown
  misc_feature (1)..( 10): Result.002 file - promoters60/1442156
ttcgtcttct

SEQ ID NO: 114670 - DNA, 10 bp, Unknown
  misc_feature (1)..( 10): Result.002 file - promoters60/1442156
aacttcttca

SEQ ID NO: 114671 - DNA, 10 bp, Unknown
  misc_feature (1)..( 10): Result.002 file - promoters60/1442156
ttcttcttct

SEQ ID NO: 114672 - DNA, 8 bp, Unknown
  misc_feature (1)..( 8): Result.002 file - promoters60/1442156
ttttgagt

SEQ ID NO: 114673 - DNA, 8 bp, Unknown
  misc_feature (1)..( 8): Result.002 file - promoters60/1442156
attttagt

SEQ ID NO: 114674 - DNA, 8 bp, Unknown
  misc_feature (1)..( 8): Result.002 file - promoters60/1442156
attttaaa

SEQ ID NO: 114675 - DNA, 8 bp, Unknown
  misc_feature (1)..( 8): Result.002 file - promoters60/1442156
attctaga

SEQ ID NO: 114676 - DNA, 9 bp, Unknown
  misc_feature (1)..( 9): Result.002 file - promoters60/1442156
cacaaatat

SEQ ID NO: 114677 - DNA, 9 bp, Unknown
  misc_feature (1)..( 9): Result.002 file - promoters60/1442156
aacaaataa

SEQ ID NO: 114678 - DNA, 9 bp, Unknown
  misc_feature (1)..( 9): Result.002 file - promoters60/1442156
aacgaatca

SEQ ID NO: 114679 - DNA, 9 bp, Unknown
  misc_feature (1)..( 9): Result.002 file - promoters60/1442156
ttcaagtaa

SEQ ID NO: 114680 - DNA, 9 bp, Unknown
  misc_feature (1)..( 9): Result.002 file - promoters60/1442156
aaagaatca

SEQ ID NO: 114681 - DNA, 10 bp, Unknown
  misc_feature (1)..( 10): Result.002 file - promoters60/1442156
ttttttccta

SEQ ID NO: 114682 - DNA, 10 bp, Unknown
  misc_feature (1)..( 10): Result.002 file - promoters60/1442156
cagtttgcta

SEQ ID NO: 114683 - DNA, 11 bp, Unknown
  misc_feature (1)..( 11): Result.002 file - promoters60/1442156
tttttatccac

SEQ ID NO: 114684 - DNA, 11 bp, Unknown
  misc_feature (1)..( 11): Result.002 file - promoters60/1442156
cgtttatctga

SEQ ID NO: 114685 - DNA, 11 bp, Unknown
  misc_feature (1)..( 11): Result.002 file - promoters60/1442156
gaaaaagtctt

SEQ ID NO: 114686 - DNA, 11 bp, Unknown
  misc_feature (1)..( 11): Result.002 file - promoters60/1442156
gaaaaaaaaaa

SEQ ID NO: 114687 - DNA, 11 bp, Unknown
  misc_feature (1)..( 11): Result.002 file - promoters60/1442156
aaaaaaggaat

SEQ ID NO: 114688 - DNA, 11 bp, Unknown
  misc_feature (1)..( 11): Result.002 file - promoters60/1442156
caaaaaataat

SEQ ID NO: 114689 - DNA, 11 bp, Unknown
  misc_feature (1)..( 11): Result.002 file - promoters60/1442156
ctaaaagataa

SEQ ID NO: 114690 - DNA, 12 bp, Unknown
  misc_feature (1)..( 12): Result.002 file - promoters60/1442156
taaacaaaatca

SEQ ID NO: 114691 - DNA, 11 bp, Unknown
  misc_feature (1)..( 11): Result.002 file - promoters60/1442156
taatctgaaat

SEQ ID NO: 114692 - DNA, 11 bp, Unknown
  misc_feature (1)..( 11): Result.002 file - promoters60/1442156
agatctaaaat

SEQ ID NO: 114693 - DNA, 11 bp, Unknown
  misc_feature (1)..( 11): Result.002 file - promoters60/1442156
ttatctgaaaa

SEQ ID NO: 114694 - DNA, 11 bp, Unknown
  misc_feature (1)..( 11): Result.002 file - promoters60/1442156
ttagctggctt

SEQ ID NO: 114695 - DNA, 8 bp, Unknown
  misc_feature (1)..( 8): Result.002 file - promoters60/1442156
aaaaataa

SEQ ID NO: 114696 - DNA, 8 bp, Unknown
  misc_feature (1)..( 8): Result.002 file - promoters60/1442156
caaaatag

SEQ ID NO: 114697 - DNA, 9 bp, Unknown
  misc_feature (1)..( 9): Result.002 file - promoters60/1442156
aaaagataa

SEQ ID NO: 114698 - DNA, 9 bp, Unknown
  misc_feature (1)..( 9): Result.002 file - promoters60/1442156
agaaaataa

SEQ ID NO: 114699 - DNA, 7 bp, Unknown
  misc_feature (1)..( 7): Result.002 file - promoters60/1442156
cacgtgt

SEQ ID NO: 114700 - DNA, 7 bp, Unknown
  misc_feature (1)..( 7): Result.002 file - promoters60/1442156
cacgtgc

SEQ ID NO: 114701 - DNA, 7 bp, Unknown
  misc_feature (1)..( 7): Result.002 file - promoters60/1442156
cacgtgg

SEQ ID NO: 114702 - DNA, 7 bp, Unknown
  misc_feature (1)..( 7): Result.002 file - promoters60/1442156
cacatgc

SEQ ID NO: 114703 - DNA, 7 bp, Unknown
  misc_feature (1)..( 7): Result.002 file - promoters60/1442179
tcaacaa

SEQ ID NO: 114704 - DNA, 7 bp, Unknown
  misc_feature (1)..( 7): Result.002 file - promoters60/1442179
tcatcaa

SEQ ID NO: 114705 - DNA, 7 bp, Unknown
  misc_feature (1)..( 7): Result.002 file - promoters60/1442179
gatcaag

SEQ ID NO: 114706 - DNA, 7 bp, Unknown
  misc_feature (1)..( 7): Result.002 file - promoters60/1442179
gattaag

SEQ ID NO: 114707 - DNA, 9 bp, Unknown
  misc_feature (1)..( 9): Result.002 file - promoters60/1442179
gagttcttg

SEQ ID NO: 114708 - DNA, 9 bp, Unknown
  misc_feature (1)..( 9): Result.002 file - promoters60/1442179
gagctcttg

SEQ ID NO: 114709 - DNA, 7 bp, Unknown
  misc_feature (1)..( 7): Result.002 file - promoters60/1442179
aattgta

SEQ ID NO: 114710 - DNA, 7 bp, Unknown
  misc_feature (1)..( 7): Result.002 file - promoters60/1442179
aatagta

SEQ ID NO: 114711 - DNA, 7 bp, Unknown
  misc_feature (1)..( 7): Result.002 file - promoters60/1442179
attattt

SEQ ID NO: 114712 - DNA, 7 bp, Unknown
  misc_feature (1)..( 7): Result.002 file - promoters60/1442179
atttttt

SEQ ID NO: 114713 - DNA, 6 bp, Unknown
  misc_feature (1)..( 6): Result.002 file - promoters60/1442179
ggatat

SEQ ID NO: 114714 - DNA, 6 bp, Unknown
  misc_feature (1)..( 6): Result.002 file - promoters60/1442179
ggatat

SEQ ID NO: 114715 - DNA, 7 bp, Unknown
  misc_feature (1)..( 7): Result.002 file - promoters60/1442179
tttttaa

SEQ ID NO: 114716 - DNA, 7 bp, Unknown
  misc_feature (1)..( 7): Result.002 file - promoters60/1442179
tttttaa

SEQ ID NO: 114717 - DNA, 7 bp, Unknown
  misc_feature (1)..( 7): Result.002 file - promoters60/1442179
taaaaat

SEQ ID NO: 114718 - DNA, 7 bp, Unknown
  misc_feature (1)..( 7): Result.002 file - promoters60/1442179
taagaat

SEQ ID NO: 114719 - DNA, 6 bp, Unknown
  misc_feature (1)..( 6): Result.002 file - promoters60/1442179
cgagcc

SEQ ID NO: 114720 - DNA, 6 bp, Unknown
  misc_feature (1)..( 6): Result.002 file - promoters60/1442179
cgagcc

SEQ ID NO: 114721 - DNA, 6 bp, Unknown
  misc_feature (1)..( 6): Result.002 file - promoters60/1442179
aaatcg

SEQ ID NO: 114722 - DNA, 6 bp, Unknown
  misc_feature (1)..( 6): Result.002 file - promoters60/1442179
aaatcg

SEQ ID NO: 114723 - DNA, 9 bp, Unknown
  misc_feature (1)..( 9): Result.002 file - promoters60/1442179
gtttgtgtt

SEQ ID NO: 114724 - DNA, 9 bp, Unknown
  misc_feature (1)..( 9): Result.002 file - promoters60/1442179
gttggtgtt

SEQ ID NO: 114725 - DNA, 8 bp, Unknown
  misc_feature (1)..( 8): Result.002 file - promoters60/1442179
gtttcaga

SEQ ID NO: 114726 - DNA, 8 bp, Unknown
  misc_feature (1)..( 8): Result.002 file - promoters60/1442179
gtttaaga

SEQ ID NO: 114727 - DNA, 7 bp, Unknown
  misc_feature (1)..( 7): Result.002 file - promoters60/1442189
cttttta

SEQ ID NO: 114728 - DNA, 7 bp, Unknown
  misc_feature (1)..( 7): Result.002 file - promoters60/1442189
cttatta

SEQ ID NO: 114729 - DNA, 12 bp, Unknown
  misc_feature (1)..( 12): Result.002 file - promoters60/1442189
ataagtatctca

SEQ ID NO: 114730 - DNA, 12 bp, Unknown
  misc_feature (1)..( 12): Result.002 file - promoters60/1442189
gaaaatatatca

SEQ ID NO: 114731 - DNA, 12 bp, Unknown
  misc_feature (1)..( 12): Result.002 file - promoters60/1442189
aaaaatataatt

SEQ ID NO: 114732 - DNA, 10 bp, Unknown
  misc_feature (1)..( 10): Result.002 file - promoters60/1442189
aaaaactaga

SEQ ID NO: 114733 - DNA, 10 bp, Unknown
  misc_feature (1)..( 10): Result.002 file - promoters60/1442189
aaaaattagt

SEQ ID NO: 114734 - DNA, 10 bp, Unknown
  misc_feature (1)..( 10): Result.002 file - promoters60/1442189
ggctactaga

SEQ ID NO: 114735 - DNA, 7 bp, Unknown
  misc_feature (1)..( 7): Result.002 file - promoters60/1442189
caataaa

SEQ ID NO: 114736 - DNA, 7 bp, Unknown
  misc_feature (1)..( 7): Result.002 file - promoters60/1442189
caataat

SEQ ID NO: 114737 - DNA, 7 bp, Unknown
  misc_feature (1)..( 7): Result.002 file - promoters60/1442189
caaaaaa

SEQ ID NO: 114738 - DNA, 6 bp, Unknown
  misc_feature (1)..( 6): Result.002 file - promoters60/1442189
aagata

SEQ ID NO: 114739 - DNA, 6 bp, Unknown
  misc_feature (1)..( 6): Result.002 file - promoters60/1442189
aagata

SEQ ID NO: 114740 - DNA, 6 bp, Unknown
  misc_feature (1)..( 6): Result.002 file - promoters60/1442189
aagata

SEQ ID NO: 114741 - DNA, 6 bp, Unknown
  misc_feature (1)..( 6): Result.002 file - promoters60/1442189
ttttcc

SEQ ID NO: 114742 - DNA, 6 bp, Unknown
  misc_feature (1)..( 6): Result.002 file - promoters60/1442189
ttttcc

SEQ ID NO: 114743 - DNA, 6 bp, Unknown
  misc_feature (1)..( 6): Result.002 file - promoters60/1442189
ttaaaa

SEQ ID NO: 114744 - DNA, 6 bp, Unknown
  misc_feature (1)..( 6): Result.002 file - promoters60/1442189
ttaaaa

SEQ ID NO: 114745 - DNA, 6 bp, Unknown
  misc_feature (1)..( 6): Result.002 file - promoters60/1442189
atataa

SEQ ID NO: 114746 - DNA, 6 bp, Unknown
  misc_feature (1)..( 6): Result.002 file - promoters60/1442189
atataa

SEQ ID NO: 114747 - DNA, 6 bp, Unknown
  misc_feature (1)..( 6): Result.002 file - promoters60/1442189
ataaac

SEQ ID NO: 114748 - DNA, 6 bp, Unknown
  misc_feature (1)..( 6): Result.002 file - promoters60/1442189
ataaac

SEQ ID NO: 114749 - DNA, 7 bp, Unknown
  misc_feature (1)..( 7): Result.002 file - promoters60/1442189
gtgtgat

SEQ ID NO: 114750 - DNA, 7 bp, Unknown
  misc_feature (1)..( 7): Result.002 file - promoters60/1442189
gtgggat

SEQ ID NO: 114751 - DNA, 6 bp, Unknown
  misc_feature (1)..( 6): Result.002 file - promoters60/1442189
aaaaat

SEQ ID NO: 114752 - DNA, 6 bp, Unknown
  misc_feature (1)..( 6): Result.002 file - promoters60/1442189
aaaaat

SEQ ID NO: 114753 - DNA, 9 bp, Unknown
  misc_feature (1)..( 9): Result.002 file - promoters60/1442189
aaatgaaga

SEQ ID NO: 114754 - DNA, 9 bp, Unknown
  misc_feature (1)..( 9): Result.002 file - promoters60/1442189
aaacgaaga

SEQ ID NO: 114755 - DNA, 7 bp, Unknown
  misc_feature (1)..( 7): Result.002 file - promoters60/1442189
attttaa

SEQ ID NO: 114756 - DNA, 7 bp, Unknown
  misc_feature (1)..( 7): Result.002 file - promoters60/1442189
attctaa

SEQ ID NO: 114757 - DNA, 6 bp, Unknown
  misc_feature (1)..( 6): Result.002 file - promoters60/1442189
aacgga

SEQ ID NO: 114758 - DNA, 6 bp, Unknown
  misc_feature (1)..( 6): Result.002 file - promoters60/1442189
aacgga

SEQ ID NO: 114759 - DNA, 8 bp, Unknown
  misc_feature (1)..( 8): Result.002 file - promoters60/1442189
aaaatata

SEQ ID NO: 114760 - DNA, 8 bp, Unknown
  misc_feature (1)..( 8): Result.002 file - promoters60/1442189
aaaatata

SEQ ID NO: 114761 - DNA, 6 bp, Unknown
  misc_feature (1)..( 6): Result.002 file - promoters60/1442189
tttgaa

SEQ ID NO: 114762 - DNA, 6 bp, Unknown
  misc_feature (1)..( 6): Result.002 file - promoters60/1442189
tttgaa

SEQ ID NO: 114763 - DNA, 7 bp, Unknown
  misc_feature (1)..( 7): Result.002 file - promoters60/1442189
tatcgca

SEQ ID NO: 114764 - DNA, 7 bp, Unknown
  misc_feature (1)..( 7): Result.002 file - promoters60/1442189
tattgca

SEQ ID NO: 114765 - DNA, 8 bp, Unknown
  misc_feature (1)..( 8): Result.002 file - promoters60/1442189
agatgcac

SEQ ID NO: 114766 - DNA, 8 bp, Unknown
  misc_feature (1)..( 8): Result.002 file - promoters60/1442189
agatccac

SEQ ID NO: 114767 - DNA, 13 bp, Unknown
  misc_feature (1)..( 13): Result.002 file - promoters60/1442189
ttttctctctttc

SEQ ID NO: 114768 - DNA, 13 bp, Unknown
  misc_feature (1)..( 13): Result.002 file - promoters60/1442189
ttttctctcattc

SEQ ID NO: 114769 - DNA, 8 bp, Unknown
  misc_feature (1)..( 8): Result.002 file - promoters60/1442240
tgcataat

SEQ ID NO: 114770 - DNA, 8 bp, Unknown
  misc_feature (1)..( 8): Result.002 file - promoters60/1442240
agcataag

SEQ ID NO: 114771 - DNA, 8 bp, Unknown
  misc_feature (1)..( 8): Result.002 file - promoters60/1442240
tgcatatg

SEQ ID NO: 114772 - DNA, 8 bp, Unknown
  misc_feature (1)..( 8): Result.002 file - promoters60/1442240
tccataat

SEQ ID NO: 114773 - DNA, 10 bp, Unknown
  misc_feature (1)..( 10): Result.002 file - promoters60/1442240
cgaatctctt

SEQ ID NO: 114774 - DNA, 10 bp, Unknown
  misc_feature (1)..( 10): Result.002 file - promoters60/1442240
ggaatctctt

SEQ ID NO: 114775 - DNA, 10 bp, Unknown
  misc_feature (1)..( 10): Result.002 file - promoters60/1442240
tgaatctaag

SEQ ID NO: 114776 - DNA, 10 bp, Unknown
  misc_feature (1)..( 10): Result.002 file - promoters60/1442240
tgaatcaatc

SEQ ID NO: 114777 - DNA, 13 bp, Unknown
  misc_feature (1)..( 13): Result.002 file - promoters60/1442240
caattttttttac

SEQ ID NO: 114778 - DNA, 13 bp, Unknown
  misc_feature (1)..( 13): Result.002 file - promoters60/1442240
agatttttttaaa

SEQ ID NO: 114779 - DNA, 13 bp, Unknown
  misc_feature (1)..( 13): Result.002 file - promoters60/1442240
agattttcaaagc

SEQ ID NO: 114780 - DNA, 13 bp, Unknown
  misc_feature (1)..( 13): Result.002 file - promoters60/1442240
atattgtcaaagc

SEQ ID NO: 114781 - DNA, 12 bp, Unknown
  misc_feature (1)..( 12): Result.002 file - promoters60/1442240
agtgtttcatat

SEQ ID NO: 114782 - DNA, 12 bp, Unknown
  misc_feature (1)..( 12): Result.002 file - promoters60/1442240
agtttttgatat

SEQ ID NO: 114783 - DNA, 12 bp, Unknown
  misc_feature (1)..( 12): Result.002 file - promoters60/1442240
gccgtttgataa

SEQ ID NO: 114784 - DNA, 12 bp, Unknown
  misc_feature (1)..( 12): Result.002 file - promoters60/1442240
tcattttgacat

SEQ ID NO: 114785 - DNA, 12 bp, Unknown
  misc_feature (1)..( 12): Result.002 file - promoters60/1442240
agttttcttttc

SEQ ID NO: 114786 - DNA, 9 bp, Unknown
  misc_feature (1)..( 9): Result.002 file - promoters60/1442240
cattttcaa

SEQ ID NO: 114787 - DNA, 9 bp, Unknown
  misc_feature (1)..( 9): Result.002 file - promoters60/1442240
tggtttcaa

SEQ ID NO: 114788 - DNA, 10 bp, Unknown
  misc_feature (1)..( 10): Result.002 file - promoters60/1442240
atattgtcaa

SEQ ID NO: 114789 - DNA, 10 bp, Unknown
  misc_feature (1)..( 10): Result.002 file - promoters60/1442240
agattttcaa

SEQ ID NO: 114790 - DNA, 10 bp, Unknown
  misc_feature (1)..( 10): Result.002 file - promoters60/1442240
agattttttt

SEQ ID NO: 114791 - DNA, 10 bp, Unknown
  misc_feature (1)..( 10): Result.002 file - promoters60/1442240
tcattttcaa

SEQ ID NO: 114792 - DNA, 10 bp, Unknown
  misc_feature (1)..( 10): Result.002 file - promoters60/1442240
tcattttgga

SEQ ID NO: 114793 - DNA, 10 bp, Unknown
  misc_feature (1)..( 10): Result.002 file - promoters60/1442240
agattttcaa

SEQ ID NO: 114794 - DNA, 10 bp, Unknown
  misc_feature (1)..( 10): Result.002 file - promoters60/1442240
agattttttt

SEQ ID NO: 114795 - DNA, 9 bp, Unknown
  misc_feature (1)..( 9): Result.002 file - promoters60/1442240
atccatata

SEQ ID NO: 114796 - DNA, 9 bp, Unknown
  misc_feature (1)..( 9): Result.002 file - promoters60/1442240
atcaatatt

SEQ ID NO: 114797 - DNA, 9 bp, Unknown
  misc_feature (1)..( 9): Result.002 file - promoters60/1442240
atcaacaaa

SEQ ID NO: 114798 - DNA, 9 bp, Unknown
  misc_feature (1)..( 9): Result.002 file - promoters60/1442240
tgtaacaaa

SEQ ID NO: 114799 - DNA, 9 bp, Unknown
  misc_feature (1)..( 9): Result.002 file - promoters60/1442244
ggatcatta

SEQ ID NO: 114800 - DNA, 9 bp, Unknown
  misc_feature (1)..( 9): Result.002 file - promoters60/1442244
acatcttta

SEQ ID NO: 114801 - DNA, 9 bp, Unknown
  misc_feature (1)..( 9): Result.002 file - promoters60/1442244
acatctttg

SEQ ID NO: 114802 - DNA, 12 bp, Unknown
  misc_feature (1)..( 12): Result.002 file - promoters60/1442244
gcagttacaaaa

SEQ ID NO: 114803 - DNA, 12 bp, Unknown
  misc_feature (1)..( 12): Result.002 file - promoters60/1442244
ttctttaaaaaa

SEQ ID NO: 114804 - DNA, 12 bp, Unknown
  misc_feature (1)..( 12): Result.002 file - promoters60/1442244
gcagttccaata

SEQ ID NO: 114805 - DNA, 8 bp, Unknown
  misc_feature (1)..( 8): Result.002 file - promoters60/1442244
attaaaaa

SEQ ID NO: 114806 - DNA, 8 bp, Unknown
  misc_feature (1)..( 8): Result.002 file - promoters60/1442244
attgaaaa

SEQ ID NO: 114807 - DNA, 8 bp, Unknown
  misc_feature (1)..( 8): Result.002 file - promoters60/1442244
attaaaag

SEQ ID NO: 114808 - DNA, 12 bp, Unknown
  misc_feature (1)..( 12): Result.002 file - promoters60/1442244
aagtaataacac

SEQ ID NO: 114809 - DNA, 12 bp, Unknown
  misc_feature (1)..( 12): Result.002 file - promoters60/1442244
atgtaatgacac

SEQ ID NO: 114810 - DNA, 12 bp, Unknown
  misc_feature (1)..( 12): Result.002 file - promoters60/1442244
atggaatagatc

SEQ ID NO: 114811 - DNA, 8 bp, Unknown
  misc_feature (1)..( 8): Result.002 file - promoters60/1442244
tataaaaa

SEQ ID NO: 114812 - DNA, 8 bp, Unknown
  misc_feature (1)..( 8): Result.002 file - promoters60/1442244
attaaaaa

SEQ ID NO: 114813 - DNA, 8 bp, Unknown
  misc_feature (1)..( 8): Result.002 file - promoters60/1442244
tataaaag

SEQ ID NO: 114814 - DNA, 12 bp, Unknown
  misc_feature (1)..( 12): Result.002 file - promoters60/1442244
aaaagaaacaaa

SEQ ID NO: 114815 - DNA, 12 bp, Unknown
  misc_feature (1)..( 12): Result.002 file - promoters60/1442244
aaaagaaaaaaa

SEQ ID NO: 114816 - DNA, 12 bp, Unknown
  misc_feature (1)..( 12): Result.002 file - promoters60/1442244
caattaaaaaag

SEQ ID NO: 114817 - DNA, 11 bp, Unknown
  misc_feature (1)..( 11): Result.002 file - promoters60/1442316
caaataaaaca

SEQ ID NO: 114818 - DNA, 11 bp, Unknown
  misc_feature (1)..( 11): Result.002 file - promoters60/1442316
aaaagaaaaca

SEQ ID NO: 114819 - DNA, 11 bp, Unknown
  misc_feature (1)..( 11): Result.002 file - promoters60/1442316
gaaataacaat

SEQ ID NO: 114820 - DNA, 11 bp, Unknown
  misc_feature (1)..( 11): Result.002 file - promoters60/1442316
aaaagaatctc

SEQ ID NO: 114821 - DNA, 11 bp, Unknown
  misc_feature (1)..( 11): Result.002 file - promoters60/1442316
gattgaaaact

SEQ ID NO: 114822 - DNA, 12 bp, Unknown
  misc_feature (1)..( 12): Result.002 file - promoters60/1442316
attaaaacaaat

SEQ ID NO: 114823 - DNA, 12 bp, Unknown
  misc_feature (1)..( 12): Result.002 file - promoters60/1442316
aataaaagaaaa

SEQ ID NO: 114824 - DNA, 12 bp, Unknown
  misc_feature (1)..( 12): Result.002 file - promoters60/1442316
atttaaataaat

SEQ ID NO: 114825 - DNA, 12 bp, Unknown
  misc_feature (1)..( 12): Result.002 file - promoters60/1442316
aattaataaaaa

SEQ ID NO: 114826 - DNA, 12 bp, Unknown
  misc_feature (1)..( 12): Result.002 file - promoters60/1442316
gcccaattaaaa

SEQ ID NO: 114827 - DNA, 10 bp, Unknown
  misc_feature (1)..( 10): Result.002 file - promoters60/1442316
taacaaataa

SEQ ID NO: 114828 - DNA, 10 bp, Unknown
  misc_feature (1)..( 10): Result.002 file - promoters60/1442316
taacaattga

SEQ ID NO: 114829 - DNA, 10 bp, Unknown
  misc_feature (1)..( 10): Result.002 file - promoters60/1442316
aaacaatttt

SEQ ID NO: 114830 - DNA, 10 bp, Unknown
  misc_feature (1)..( 10): Result.002 file - promoters60/1442316
ttacaaattt

SEQ ID NO: 114831 - DNA, 10 bp, Unknown
  misc_feature (1)..( 10): Result.002 file - promoters60/1442316
gattgtaatt

SEQ ID NO: 114832 - DNA, 10 bp, Unknown
  misc_feature (1)..( 10): Result.002 file - promoters60/1442316
ttttgcaatt

SEQ ID NO: 114833 - DNA, 10 bp, Unknown
  misc_feature (1)..( 10): Result.002 file - promoters60/1442316
aattataagc

SEQ ID NO: 114834 - DNA, 10 bp, Unknown
  misc_feature (1)..( 10): Result.002 file - promoters60/1442316
aatcatagta

SEQ ID NO: 114835 - DNA, 17 bp, Unknown
  misc_feature (1)..( 17): Result.002 file - promoters60/1442326
acaatgggctgggccta

SEQ ID NO: 114836 - DNA, 17 bp, Unknown
  misc_feature (1)..( 17): Result.002 file - promoters60/1442326
gaaataggcccaacaaa

SEQ ID NO: 114837 - DNA, 17 bp, Unknown
  misc_feature (1)..( 17): Result.002 file - promoters60/1442326
taaaaaggcccattata

SEQ ID NO: 114838 - DNA, 17 bp, Unknown
  misc_feature (1)..( 17): Result.002 file - promoters60/1442326
aaataaagcccattata

SEQ ID NO: 114839 - DNA, 17 bp, Unknown
  misc_feature (1)..( 17): Result.002 file - promoters60/1442326
taaaaaatatctgaaac

SEQ ID NO: 114840 - DNA, 17 bp, Unknown
  misc_feature (1)..( 17): Result.002 file - promoters60/1442326
ccaaacggctaggatta

SEQ ID NO: 114841 - DNA, 12 bp, Unknown
  misc_feature (1)..( 12): Result.002 file - promoters60/1442326
aaaaaagttatg

SEQ ID NO: 114842 - DNA, 12 bp, Unknown
  misc_feature (1)..( 12): Result.002 file - promoters60/1442326
tcaaaagttatg

SEQ ID NO: 114843 - DNA, 12 bp, Unknown
  misc_feature (1)..( 12): Result.002 file - promoters60/1442326
accaaagaaagg

SEQ ID NO: 114844 - DNA, 12 bp, Unknown
  misc_feature (1)..( 12): Result.002 file - promoters60/1442326
aaaaaagtataa

SEQ ID NO: 114845 - DNA, 12 bp, Unknown
  misc_feature (1)..( 12): Result.002 file - promoters60/1442326
atcaaacaaatc

SEQ ID NO: 114846 - DNA, 12 bp, Unknown
  misc_feature (1)..( 12): Result.002 file - promoters60/1442326
cacaacgaataa

SEQ ID NO: 114847 - DNA, 12 bp, Unknown
  misc_feature (1)..( 12): Result.002 file - promoters60/1442326
aatgtagaaatc

SEQ ID NO: 114848 - DNA, 9 bp, Unknown
  misc_feature (1)..( 9): Result.002 file - promoters60/1442326
gaaaaaaag

SEQ ID NO: 114849 - DNA, 9 bp, Unknown
  misc_feature (1)..( 9): Result.002 file - promoters60/1442326
caaacaaat

SEQ ID NO: 114850 - DNA, 9 bp, Unknown
  misc_feature (1)..( 9): Result.002 file - promoters60/1442326
caaagaaag

SEQ ID NO: 114851 - DNA, 9 bp, Unknown
  misc_feature (1)..( 9): Result.002 file - promoters60/1442326
caaaaaaaa

SEQ ID NO: 114852 - DNA, 9 bp, Unknown
  misc_feature (1)..( 9): Result.002 file - promoters60/1442326
caaacacaa

SEQ ID NO: 114853 - DNA, 9 bp, Unknown
  misc_feature (1)..( 9): Result.002 file - promoters60/1442326
caacgaata

SEQ ID NO: 114854 - DNA, 8 bp, Unknown
  misc_feature (1)..( 8): Result.002 file - promoters60/1442326
gaattgac

SEQ ID NO: 114855 - DNA, 8 bp, Unknown
  misc_feature (1)..( 8): Result.002 file - promoters60/1442326
gaaatgac

SEQ ID NO: 114856 - DNA, 8 bp, Unknown
  misc_feature (1)..( 8): Result.002 file - promoters60/1442326
caaacgac

SEQ ID NO: 114857 - DNA, 8 bp, Unknown
  misc_feature (1)..( 8): Result.002 file - promoters60/1442326
caaaagac

SEQ ID NO: 114858 - DNA, 8 bp, Unknown
  misc_feature (1)..( 8): Result.002 file - promoters60/1442326
caaaagtt

SEQ ID NO: 114859 - DNA, 8 bp, Unknown
  misc_feature (1)..( 8): Result.002 file - promoters60/1442326
aaaaagat

SEQ ID NO: 114860 - DNA, 11 bp, Unknown
  misc_feature (1)..( 11): Result.002 file - promoters60/1442408
ataaaattaat

SEQ ID NO: 114861 - DNA, 11 bp, Unknown
  misc_feature (1)..( 11): Result.002 file - promoters60/1442408
ataatatttca

SEQ ID NO: 114862 - DNA, 11 bp, Unknown
  misc_feature (1)..( 11): Result.002 file - promoters60/1442408
aaaaaatcaaa

SEQ ID NO: 114863 - DNA, 11 bp, Unknown
  misc_feature (1)..( 11): Result.002 file - promoters60/1442408
atattattaac

SEQ ID NO: 114864 - DNA, 11 bp, Unknown
  misc_feature (1)..( 11): Result.002 file - promoters60/1442408
ccaacattcag

SEQ ID NO: 114865 - DNA, 11 bp, Unknown
  misc_feature (1)..( 11): Result.002 file - promoters60/1442408
tgaatattttc

SEQ ID NO: 114866 - DNA, 11 bp, Unknown
  misc_feature (1)..( 11): Result.002 file - promoters60/1442408
tatatatttca

SEQ ID NO: 114867 - DNA, 11 bp, Unknown
  misc_feature (1)..( 11): Result.002 file - promoters60/1442408
gttatattgac

SEQ ID NO: 114868 - DNA, 13 bp, Unknown
  misc_feature (1)..( 13): Result.002 file - promoters60/1442408
aaataaatttttg

SEQ ID NO: 114869 - DNA, 13 bp, Unknown
  misc_feature (1)..( 13): Result.002 file - promoters60/1442408
aaacaaatgtttg

SEQ ID NO: 114870 - DNA, 13 bp, Unknown
  misc_feature (1)..( 13): Result.002 file - promoters60/1442408
tcataaatgtatc

SEQ ID NO: 114871 - DNA, 13 bp, Unknown
  misc_feature (1)..( 13): Result.002 file - promoters60/1442408
ctttaagtttccg

SEQ ID NO: 114872 - DNA, 13 bp, Unknown
  misc_feature (1)..( 13): Result.002 file - promoters60/1442408
catgaaatttaca

SEQ ID NO: 114873 - DNA, 13 bp, Unknown
  misc_feature (1)..( 13): Result.002 file - promoters60/1442408
ggtcaaatggatc

SEQ ID NO: 114874 - DNA, 9 bp, Unknown
  misc_feature (1)..( 9): Result.002 file - promoters60/1442408
ttaatattt

SEQ ID NO: 114875 - DNA, 9 bp, Unknown
  misc_feature (1)..( 9): Result.002 file - promoters60/1442408
tcaatatta

SEQ ID NO: 114876 - DNA, 9 bp, Unknown
  misc_feature (1)..( 9): Result.002 file - promoters60/1442408
ataatattt

SEQ ID NO: 114877 - DNA, 9 bp, Unknown
  misc_feature (1)..( 9): Result.002 file - promoters60/1442408
ccaacattc

SEQ ID NO: 114878 - DNA, 9 bp, Unknown
  misc_feature (1)..( 9): Result.002 file - promoters60/1442408
tgaatattt

SEQ ID NO: 114879 - DNA, 9 bp, Unknown
  misc_feature (1)..( 9): Result.002 file - promoters60/1442408
tatatattt

SEQ ID NO: 114880 - DNA, 9 bp, Unknown
  misc_feature (1)..( 9): Result.002 file - promoters60/1442408
gttatattg

SEQ ID NO: 114881 - DNA, 9 bp, Unknown
  misc_feature (1)..( 9): Result.002 file - promoters60/1442408
tatatcaaa

SEQ ID NO: 114882 - DNA, 9 bp, Unknown
  misc_feature (1)..( 9): Result.002 file - promoters60/1442408
attataaaa

SEQ ID NO: 114883 - DNA, 9 bp, Unknown
  misc_feature (1)..( 9): Result.002 file - promoters60/1442408
tatatttca

SEQ ID NO: 114884 - DNA, 9 bp, Unknown
  misc_feature (1)..( 9): Result.002 file - promoters60/1442408
tctatttct

SEQ ID NO: 114885 - DNA, 9 bp, Unknown
  misc_feature (1)..( 9): Result.002 file - promoters60/1442408
aatattttc

SEQ ID NO: 114886 - DNA, 9 bp, Unknown
  misc_feature (1)..( 9): Result.002 file - promoters60/1442408
tatattgac

SEQ ID NO: 114887 - DNA, 10 bp, Unknown
  misc_feature (1)..( 10): Result.002 file - promoters60/1442408
aaaccaatgt

SEQ ID NO: 114888 - DNA, 10 bp, Unknown
  misc_feature (1)..( 10): Result.002 file - promoters60/1442408
aaatcaaata

SEQ ID NO: 114889 - DNA, 11 bp, Unknown
  misc_feature (1)..( 11): Result.002 file - promoters60/1442408
aaattcaatgt

SEQ ID NO: 114890 - DNA, 11 bp, Unknown
  misc_feature (1)..( 11): Result.002 file - promoters60/1442408
tatatcagatt

SEQ ID NO: 114891 - DNA, 11 bp, Unknown
  misc_feature (1)..( 11): Result.002 file - promoters60/1442408
taatccaacgg

SEQ ID NO: 114892 - DNA, 11 bp, Unknown
  misc_feature (1)..( 11): Result.002 file - promoters60/1442408
ttaatcaatgg

SEQ ID NO: 114893 - DNA, 7 bp, Unknown
  misc_feature (1)..( 7): Result.002 file - promoters60/1442427
gtcgaaa

SEQ ID NO: 114894 - DNA, 7 bp, Unknown
  misc_feature (1)..( 7): Result.002 file - promoters60/1442427
gtctaaa

SEQ ID NO: 114895 - DNA, 7 bp, Unknown
  misc_feature (1)..( 7): Result.002 file - promoters60/1442427
aaacatt

SEQ ID NO: 114896 - DNA, 7 bp, Unknown
  misc_feature (1)..( 7): Result.002 file - promoters60/1442427
aaatatt

SEQ ID NO: 114897 - DNA, 10 bp, Unknown
  misc_feature (1)..( 10): Result.002 file - promoters60/1442427
taaatttgct

SEQ ID NO: 114898 - DNA, 10 bp, Unknown
  misc_feature (1)..( 10): Result.002 file - promoters60/1442427
taaatttaaa

SEQ ID NO: 114899 - DNA, 10 bp, Unknown
  misc_feature (1)..( 10): Result.002 file - promoters60/1442427
tgaatctgct

SEQ ID NO: 114900 - DNA, 9 bp, Unknown
  misc_feature (1)..( 9): Result.002 file - promoters60/1442427
tcagttaga

SEQ ID NO: 114901 - DNA, 9 bp, Unknown
  misc_feature (1)..( 9): Result.002 file - promoters60/1442427
tcagtaaga

SEQ ID NO: 114902 - DNA, 7 bp, Unknown
  misc_feature (1)..( 7): Result.002 file - promoters60/1442427
tttattg

SEQ ID NO: 114903 - DNA, 7 bp, Unknown
  misc_feature (1)..( 7): Result.002 file - promoters60/1442427
tttcttg

SEQ ID NO: 114904 - DNA, 7 bp, Unknown
  misc_feature (1)..( 7): Result.002 file - promoters60/1442427
tgaaaaa

SEQ ID NO: 114905 - DNA, 7 bp, Unknown
  misc_feature (1)..( 7): Result.002 file - promoters60/1442427
tgaaaaa

SEQ ID NO: 114906 - DNA, 6 bp, Unknown
  misc_feature (1)..( 6): Result.002 file - promoters60/1442427
aatatt

SEQ ID NO: 114907 - DNA, 6 bp, Unknown
  misc_feature (1)..( 6): Result.002 file - promoters60/1442427
aatatt

SEQ ID NO: 114908 - DNA, 12 bp, Unknown
  misc_feature (1)..( 12): Result.002 file - promoters60/1442427
ttagtttggtct

SEQ ID NO: 114909 - DNA, 12 bp, Unknown
  misc_feature (1)..( 12): Result.002 file - promoters60/1442427
ttagtttgttct

SEQ ID NO: 114910 - DNA, 6 bp, Unknown
  misc_feature (1)..( 6): Result.002 file - promoters60/1442427
ttttat

SEQ ID NO: 114911 - DNA, 6 bp, Unknown
  misc_feature (1)..( 6): Result.002 file - promoters60/1442427
ttttat

SEQ ID NO: 114912 - DNA, 9 bp, Unknown
  misc_feature (1)..( 9): Result.002 file - promoters60/1442427
attataaga

SEQ ID NO: 114913 - DNA, 9 bp, Unknown
  misc_feature (1)..( 9): Result.002 file - promoters60/1442427
attagaaga

SEQ ID NO: 114914 - DNA, 6 bp, Unknown
  misc_feature (1)..( 6): Result.002 file - promoters60/1442452
atgttt

SEQ ID NO: 114915 - DNA, 6 bp, Unknown
  misc_feature (1)..( 6): Result.002 file - promoters60/1442452
atgttt

SEQ ID NO: 114916 - DNA, 18 bp, Unknown
  misc_feature (1)..( 18): Result.002 file - promoters60/1442452
tttgtattttagagaaat

SEQ ID NO: 114917 - DNA, 18 bp, Unknown
  misc_feature (1)..( 18): Result.002 file - promoters60/1442452
aatcatgtttagaaaaat

SEQ ID NO: 114918 - DNA, 18 bp, Unknown
  misc_feature (1)..( 18): Result.002 file - promoters60/1442452
tttatattttagctgtct

SEQ ID NO: 114919 - DNA, 11 bp, Unknown
  misc_feature (1)..( 11): Result.002 file - promoters60/1442452
ttttgaagaat

SEQ ID NO: 114920 - DNA, 11 bp, Unknown
  misc_feature (1)..( 11): Result.002 file - promoters60/1442452
ttttgatgaat

SEQ ID NO: 114921 - DNA, 11 bp, Unknown
  misc_feature (1)..( 11): Result.002 file - promoters60/1442452
atttccataaa

SEQ ID NO: 114922 - DNA, 11 bp, Unknown
  misc_feature (1)..( 11): Result.002 file - promoters60/1442452
attttcataaa

SEQ ID NO: 114923 - DNA, 9 bp, Unknown
  misc_feature (1)..( 9): Result.002 file - promoters60/1442452
aaatgttag

SEQ ID NO: 114924 - DNA, 9 bp, Unknown
  misc_feature (1)..( 9): Result.002 file - promoters60/1442452
aaattttaa

SEQ ID NO: 114925 - DNA, 10 bp, Unknown
  misc_feature (1)..( 10): Result.002 file - promoters60/1442452
aaactgttag

SEQ ID NO: 114926 - DNA, 6 bp, Unknown
  misc_feature (1)..( 6): Result.002 file - promoters60/1442452
taaaat

SEQ ID NO: 114927 - DNA, 6 bp, Unknown
  misc_feature (1)..( 6): Result.002 file - promoters60/1442452
taaaat

SEQ ID NO: 114928 - DNA, 7 bp, Unknown
  misc_feature (1)..( 7): Result.002 file - promoters60/1442452
attaaag

SEQ ID NO: 114929 - DNA, 7 bp, Unknown
  misc_feature (1)..( 7): Result.002 file - promoters60/1442452
attcaag

SEQ ID NO: 114930 - DNA, 11 bp, Unknown
  misc_feature (1)..( 11): Result.002 file - promoters60/1442452
atcgaacagca

SEQ ID NO: 114931 - DNA, 11 bp, Unknown
  misc_feature (1)..( 11): Result.002 file - promoters60/1442452
atccaacggca

SEQ ID NO: 114932 - DNA, 11 bp, Unknown
  misc_feature (1)..( 11): Result.002 file - promoters60/1442452
tttcaacggtt

SEQ ID NO: 114933 - DNA, 7 bp, Unknown
  misc_feature (1)..( 7): Result.002 file - promoters60/1442452
tccacgt

SEQ ID NO: 114934 - DNA, 7 bp, Unknown
  misc_feature (1)..( 7): Result.002 file - promoters60/1442452
tccgcgt

SEQ ID NO: 114935 - DNA, 8 bp, Unknown
  misc_feature (1)..( 8): Result.002 file - promoters60/1442452
tatataaa

SEQ ID NO: 114936 - DNA, 8 bp, Unknown
  misc_feature (1)..( 8): Result.002 file - promoters60/1442452
tatataat

SEQ ID NO: 114937 - DNA, 8 bp, Unknown
  misc_feature (1)..( 8): Result.002 file - promoters60/1442452
actataaa

SEQ ID NO: 114938 - DNA, 10 bp, Unknown
  misc_feature (1)..( 10): Result.002 file - promoters60/1442452
tataaacaaa

SEQ ID NO: 114939 - DNA, 10 bp, Unknown
  misc_feature (1)..( 10): Result.002 file - promoters60/1442452
aataaccaaa

SEQ ID NO: 114940 - DNA, 10 bp, Unknown
  misc_feature (1)..( 10): Result.002 file - promoters60/1442452
tataaaatca

SEQ ID NO: 114941 - DNA, 6 bp, Unknown
  misc_feature (1)..( 6): Result.002 file - promoters60/1442452
aaattc

SEQ ID NO: 114942 - DNA, 6 bp, Unknown
  misc_feature (1)..( 6): Result.002 file - promoters60/1442452
aaattc

SEQ ID NO: 114943 - DNA, 7 bp, Unknown
  misc_feature (1)..( 7): Result.002 file - promoters60/1442452
tttgaaa

SEQ ID NO: 114944 - DNA, 7 bp, Unknown
  misc_feature (1)..( 7): Result.002 file - promoters60/1442452
ttttaaa

SEQ ID NO: 114945 - DNA, 7 bp, Unknown
  misc_feature (1)..( 7): Result.002 file - promoters60/1442452
actttgt

SEQ ID NO: 114946 - DNA, 7 bp, Unknown
  misc_feature (1)..( 7): Result.002 file - promoters60/1442452
actctgt

SEQ ID NO: 114947 - DNA, 6 bp, Unknown
  misc_feature (1)..( 6): Result.002 file - promoters60/1442452
atctcc

SEQ ID NO: 114948 - DNA, 6 bp, Unknown
  misc_feature (1)..( 6): Result.002 file - promoters60/1442452
atctcc

SEQ ID NO: 114949 - DNA, 8 bp, Unknown
  misc_feature (1)..( 8): Result.002 file - promoters60/1442452
atccgcgt

SEQ ID NO: 114950 - DNA, 8 bp, Unknown
  misc_feature (1)..( 8): Result.002 file - promoters60/1442452
atcctcgt

SEQ ID NO: 114951 - DNA, 14 bp, Unknown
  misc_feature (1)..( 14): Result.002 file - promoters60/1442452
taactaatcagatc

SEQ ID NO: 114952 - DNA, 14 bp, Unknown
  misc_feature (1)..( 14): Result.002 file - promoters60/1442452
taaccaatcatatc

SEQ ID NO: 114953 - DNA, 6 bp, Unknown
  misc_feature (1)..( 6): Result.002 file - promoters60/1442452
tattct

SEQ ID NO: 114954 - DNA, 6 bp, Unknown
  misc_feature (1)..( 6): Result.002 file - promoters60/1442452
tattct

SEQ ID NO: 114955 - DNA, 9 bp, Unknown
  misc_feature (1)..( 9): Result.002 file - promoters60/1442452
aatacgaca

SEQ ID NO: 114956 - DNA, 9 bp, Unknown
  misc_feature (1)..( 9): Result.002 file - promoters60/1442452
aatacaaca

SEQ ID NO: 114957 - DNA, 7 bp, Unknown
  misc_feature (1)..( 7): Result.002 file - promoters60/1442452
atactat

SEQ ID NO: 114958 - DNA, 7 bp, Unknown
  misc_feature (1)..( 7): Result.002 file - promoters60/1442452
atattat

SEQ ID NO: 114959 - DNA, 8 bp, Unknown
  misc_feature (1)..( 8): Result.002 file - promoters60/1442452
agatgtgt

SEQ ID NO: 114960 - DNA, 8 bp, Unknown
  misc_feature (1)..( 8): Result.002 file - promoters60/1442452
agatatgt

SEQ ID NO: 114961 - DNA, 15 bp, Unknown
  misc_feature (1)..( 15): Result.002 file - promoters60/1442452
ttataaaccgtcgat

SEQ ID NO: 114962 - DNA, 15 bp, Unknown
  misc_feature (1)..( 15): Result.002 file - promoters60/1442452
ttataaaccgtcgat

SEQ ID NO: 114963 - DNA, 8 bp, Unknown
  misc_feature (1)..( 8): Result.002 file - promoters60/1442468
gttgtttc

SEQ ID NO: 114964 - DNA, 8 bp, Unknown
  misc_feature (1)..( 8): Result.002 file - promoters60/1442468
tttggttc

SEQ ID NO: 114965 - DNA, 8 bp, Unknown
  misc_feature (1)..( 8): Result.002 file - promoters60/1442468
gttgtttc

SEQ ID NO: 114966 - DNA, 8 bp, Unknown
  misc_feature (1)..( 8): Result.002 file - promoters60/1442468
tttgtttg

SEQ ID NO: 114967 - DNA, 8 bp, Unknown
  misc_feature (1)..( 8): Result.002 file - promoters60/1442468
tttttttg

SEQ ID NO: 114968 - DNA, 8 bp, Unknown
  misc_feature (1)..( 8): Result.002 file - promoters60/1442468
ttttttta

SEQ ID NO: 114969 - DNA, 12 bp, Unknown
  misc_feature (1)..( 12): Result.002 file - promoters60/1442468
tttggtttttgt

SEQ ID NO: 114970 - DNA, 12 bp, Unknown
  misc_feature (1)..( 12): Result.002 file - promoters60/1442468
ttttgtttttgt

SEQ ID NO: 114971 - DNA, 12 bp, Unknown
  misc_feature (1)..( 12): Result.002 file - promoters60/1442468
tttcgtttctca

SEQ ID NO: 114972 - DNA, 8 bp, Unknown
  misc_feature (1)..( 8): Result.002 file - promoters60/1442468
ctatttga

SEQ ID NO: 114973 - DNA, 8 bp, Unknown
  misc_feature (1)..( 8): Result.002 file - promoters60/1442468
ttatttga

SEQ ID NO: 114974 - DNA, 8 bp, Unknown
  misc_feature (1)..( 8): Result.002 file - promoters60/1442468
ctatctga

SEQ ID NO: 114975 - DNA, 10 bp, Unknown
  misc_feature (1)..( 10): Result.002 file - promoters60/1442468
cgtatgtaaa

SEQ ID NO: 114976 - DNA, 10 bp, Unknown
  misc_feature (1)..( 10): Result.002 file - promoters60/1442468
aaattgtaaa

SEQ ID NO: 114977 - DNA, 10 bp, Unknown
  misc_feature (1)..( 10): Result.002 file - promoters60/1442468
aaattataat

SEQ ID NO: 114978 - DNA, 8 bp, Unknown
  misc_feature (1)..( 8): Result.002 file - promoters60/1442468
ctaaacat

SEQ ID NO: 114979 - DNA, 8 bp, Unknown
  misc_feature (1)..( 8): Result.002 file - promoters60/1442468
ctaaacaa

SEQ ID NO: 114980 - DNA, 8 bp, Unknown
  misc_feature (1)..( 8): Result.002 file - promoters60/1442468
ttaaacat

SEQ ID NO: 114981 - DNA, 14 bp, Unknown
  misc_feature (1)..( 14): Result.002 file - promoters60/1442468
attgctaaaactaa

SEQ ID NO: 114982 - DNA, 14 bp, Unknown
  misc_feature (1)..( 14): Result.002 file - promoters60/1442468
attgccaaaacctc

SEQ ID NO: 114983 - DNA, 14 bp, Unknown
  misc_feature (1)..( 14): Result.002 file - promoters60/1442468
aaaccataaaccct

SEQ ID NO: 114984 - DNA, 7 bp, Unknown
  misc_feature (1)..( 7): Result.002 file - promoters60/1442468
aaaacag

SEQ ID NO: 114985 - DNA, 7 bp, Unknown
  misc_feature (1)..( 7): Result.002 file - promoters60/1442468
gaaacag

SEQ ID NO: 114986 - DNA, 7 bp, Unknown
  misc_feature (1)..( 7): Result.002 file - promoters60/1442468
gaaacaa

SEQ ID NO: 114987 - DNA, 11 bp, Unknown
  misc_feature (1)..( 11): Result.002 file - promoters60/1442504
gagaaaaaaag

SEQ ID NO: 114988 - DNA, 11 bp, Unknown
  misc_feature (1)..( 11): Result.002 file - promoters60/1442504
atcaaacaaat

SEQ ID NO: 114989 - DNA, 11 bp, Unknown
  misc_feature (1)..( 11): Result.002 file - promoters60/1442504
accaaagaaag

SEQ ID NO: 114990 - DNA, 11 bp, Unknown
  misc_feature (1)..( 11): Result.002 file - promoters60/1442504
aacaaaaaaaa

SEQ ID NO: 114991 - DNA, 11 bp, Unknown
  misc_feature (1)..( 11): Result.002 file - promoters60/1442504
atctaacagca

SEQ ID NO: 114992 - DNA, 11 bp, Unknown
  misc_feature (1)..( 11): Result.002 file - promoters60/1442504
tacaaggaaag

SEQ ID NO: 114993 - DNA, 12 bp, Unknown
  misc_feature (1)..( 12): Result.002 file - promoters60/1442649
catcatttttag

SEQ ID NO: 114994 - DNA, 12 bp, Unknown
  misc_feature (1)..( 12): Result.002 file - promoters60/1442649
tatcatttactt

SEQ ID NO: 114995 - DNA, 12 bp, Unknown
  misc_feature (1)..( 12): Result.002 file - promoters60/1442649
aaacattgttag

SEQ ID NO: 114996 - DNA, 12 bp, Unknown
  misc_feature (1)..( 12): Result.002 file - promoters60/1442649
tatcatattgtt

SEQ ID NO: 114997 - DNA, 9 bp, Unknown
  misc_feature (1)..( 9): Result.002 file - promoters60/1442649
cttggtttc

SEQ ID NO: 114998 - DNA, 9 bp, Unknown
  misc_feature (1)..( 9): Result.002 file - promoters60/1442649
tttgttttg

SEQ ID NO: 114999 - DNA, 9 bp, Unknown
  misc_feature (1)..( 9): Result.002 file - promoters60/1442649
tttattttt

SEQ ID NO: 115000 - DNA, 9 bp, Unknown
  misc_feature (1)..( 9): Result.002 file - promoters60/1442649
tctatttat

SEQ ID NO: 115001 - DNA, 8 bp, Unknown
  misc_feature (1)..( 8): Result.002 file - promoters60/1442649
aaacaaat

SEQ ID NO: 115002 - DNA, 8 bp, Unknown
  misc_feature (1)..( 8): Result.002 file - promoters60/1442649
taacaaat

SEQ ID NO: 115003 - DNA, 8 bp, Unknown
  misc_feature (1)..( 8): Result.002 file - promoters60/1442649
aaacaatt

SEQ ID NO: 115004 - DNA, 8 bp, Unknown
  misc_feature (1)..( 8): Result.002 file - promoters60/1442649
taaaaaat

SEQ ID NO: 115005 - DNA, 12 bp, Unknown
  misc_feature (1)..( 12): Result.002 file - promoters60/1442777
tgtaatttctcg

SEQ ID NO: 115006 - DNA, 12 bp, Unknown
  misc_feature (1)..( 12): Result.002 file - promoters60/1442777
tcgcttttatcg

SEQ ID NO: 115007 - DNA, 12 bp, Unknown
  misc_feature (1)..( 12): Result.002 file - promoters60/1442777
caaaatatcttt

SEQ ID NO: 115008 - DNA, 12 bp, Unknown
  misc_feature (1)..( 12): Result.002 file - promoters60/1442777
ataactttatgt

SEQ ID NO: 115009 - DNA, 12 bp, Unknown
  misc_feature (1)..( 12): Result.002 file - promoters60/1442777
atagccaaaatt

SEQ ID NO: 115010 - DNA, 12 bp, Unknown
  misc_feature (1)..( 12): Result.002 file - promoters60/1442777
tgtatcaacatt

SEQ ID NO: 115011 - DNA, 12 bp, Unknown
  misc_feature (1)..( 12): Result.002 file - promoters60/1442777
atagacaaaaac

SEQ ID NO: 115012 - DNA, 12 bp, Unknown
  misc_feature (1)..( 12): Result.002 file - promoters60/1442777
tcattaaacatt

SEQ ID NO: 115013 - DNA, 11 bp, Unknown
  misc_feature (1)..( 11): Result.002 file - promoters60/1442777
taatccaacgg

SEQ ID NO: 115014 - DNA, 11 bp, Unknown
  misc_feature (1)..( 11): Result.002 file - promoters60/1442777
taatctaacgg

SEQ ID NO: 115015 - DNA, 11 bp, Unknown
  misc_feature (1)..( 11): Result.002 file - promoters60/1442777
taatctcaacc

SEQ ID NO: 115016 - DNA, 11 bp, Unknown
  misc_feature (1)..( 11): Result.002 file - promoters60/1442777
taatctcattg

SEQ ID NO: 115017 - DNA, 13 bp, Unknown
  misc_feature (1)..( 13): Result.002 file - promoters60/1442777
tcaggctaaattt

SEQ ID NO: 115018 - DNA, 13 bp, Unknown
  misc_feature (1)..( 13): Result.002 file - promoters60/1442777
tcaagctgaatgg

SEQ ID NO: 115019 - DNA, 13 bp, Unknown
  misc_feature (1)..( 13): Result.002 file - promoters60/1442777
gatgtataacttt

SEQ ID NO: 115020 - DNA, 13 bp, Unknown
  misc_feature (1)..( 13): Result.002 file - promoters60/1442777
catgtataactaa

SEQ ID NO: 115021 - DNA, 13 bp, Unknown
  misc_feature (1)..( 13): Result.002 file - promoters60/1442777
taagtataattgt

SEQ ID NO: 115022 - DNA, 16 bp, Unknown
  misc_feature (1)..( 16): Result.002 file - promoters60/1442777
attttgaaataatttc

SEQ ID NO: 115023 - DNA, 16 bp, Unknown
  misc_feature (1)..( 16): Result.002 file - promoters60/1442777
aacttgaaattaatat

SEQ ID NO: 115024 - DNA, 16 bp, Unknown
  misc_feature (1)..( 16): Result.002 file - promoters60/1442777
attgtgaaataatttt

SEQ ID NO: 115025 - DNA, 16 bp, Unknown
  misc_feature (1)..( 16): Result.002 file - promoters60/1442777
attctaaaatattgtt

SEQ ID NO: 115026 - DNA, 18 bp, Unknown
  misc_feature (1)..( 18): Result.002 file - promoters60/1442777
ttgttatgtaaattttga

SEQ ID NO: 115027 - DNA, 18 bp, Unknown
  misc_feature (1)..( 18): Result.002 file - promoters60/1442777
acttgaaattaatattgt

SEQ ID NO: 115028 - DNA, 18 bp, Unknown
  misc_feature (1)..( 18): Result.002 file - promoters60/1442777
attgtgaaataattttgt

SEQ ID NO: 115029 - DNA, 18 bp, Unknown
  misc_feature (1)..( 18): Result.002 file - promoters60/1442777
taattgttaatcttttga

SEQ ID NO: 115030 - DNA, 9 bp, Unknown
  misc_feature (1)..( 9): Result.002 file - promoters60/1442777
taatgtaat

SEQ ID NO: 115031 - DNA, 9 bp, Unknown
  misc_feature (1)..( 9): Result.002 file - promoters60/1442777
taatgtgac

SEQ ID NO: 115032 - DNA, 9 bp, Unknown
  misc_feature (1)..( 9): Result.002 file - promoters60/1442777
aaatctgat

SEQ ID NO: 115033 - DNA, 9 bp, Unknown
  misc_feature (1)..( 9): Result.002 file - promoters60/1442777
taatgcgac

SEQ ID NO: 115034 - DNA, 11 bp, Unknown
  misc_feature (1)..( 11): Result.002 file - promoters60/1442777
atttgtaactt

SEQ ID NO: 115035 - DNA, 11 bp, Unknown
  misc_feature (1)..( 11): Result.002 file - promoters60/1442777
atgtataactt

SEQ ID NO: 115036 - DNA, 11 bp, Unknown
  misc_feature (1)..( 11): Result.002 file - promoters60/1442777
atgtataacta

SEQ ID NO: 115037 - DNA, 11 bp, Unknown
  misc_feature (1)..( 11): Result.002 file - promoters60/1442777
aagtataattg

SEQ ID NO: 115038 - DNA, 14 bp, Unknown
  misc_feature (1)..( 14): Result.002 file - promoters60/1442777
atgtataactaagc

SEQ ID NO: 115039 - DNA, 14 bp, Unknown
  misc_feature (1)..( 14): Result.002 file - promoters60/1442777
gtccataacttgaa

SEQ ID NO: 115040 - DNA, 14 bp, Unknown
  misc_feature (1)..( 14): Result.002 file - promoters60/1442777
atgtataactttat

SEQ ID NO: 115041 - DNA, 14 bp, Unknown
  misc_feature (1)..( 14): Result.002 file - promoters60/1442777
caaaatatctttat

SEQ ID NO: 115042 - DNA, 11 bp, Unknown
  misc_feature (1)..( 11): Result.002 file - promoters60/1442777
tatatacatga

SEQ ID NO: 115043 - DNA, 11 bp, Unknown
  misc_feature (1)..( 11): Result.002 file - promoters60/1442777
tatataaacaa

SEQ ID NO: 115044 - DNA, 11 bp, Unknown
  misc_feature (1)..( 11): Result.002 file - promoters60/1442777
tatataaatga

SEQ ID NO: 115045 - DNA, 11 bp, Unknown
  misc_feature (1)..( 11): Result.002 file - promoters60/1442777
cctataaatat

SEQ ID NO: 115046 - DNA, 13 bp, Unknown
  misc_feature (1)..( 13): Result.002 file - promoters60/1442880
ctaaaatagtaaa

SEQ ID NO: 115047 - DNA, 13 bp, Unknown
  misc_feature (1)..( 13): Result.002 file - promoters60/1442880
aaataattgtata

SEQ ID NO: 115048 - DNA, 13 bp, Unknown
  misc_feature (1)..( 13): Result.002 file - promoters60/1442880
tcatatttgtata

SEQ ID NO: 115049 - DNA, 13 bp, Unknown
  misc_feature (1)..( 13): Result.002 file - promoters60/1442880
aaagaattgaaca

SEQ ID NO: 115050 - DNA, 10 bp, Unknown
  misc_feature (1)..( 10): Result.002 file - promoters60/1442880
gaaaaagata

SEQ ID NO: 115051 - DNA, 10 bp, Unknown
  misc_feature (1)..( 10): Result.002 file - promoters60/1442880
gaaatagatt

SEQ ID NO: 115052 - DNA, 10 bp, Unknown
  misc_feature (1)..( 10): Result.002 file - promoters60/1442880
ttagtagatt

SEQ ID NO: 115053 - DNA, 10 bp, Unknown
  misc_feature (1)..( 10): Result.002 file - promoters60/1442880
tatataaatt

SEQ ID NO: 115054 - DNA, 10 bp, Unknown
  misc_feature (1)..( 10): Result.002 file - promoters60/1442880
ttactaaaat

SEQ ID NO: 115055 - DNA, 10 bp, Unknown
  misc_feature (1)..( 10): Result.002 file - promoters60/1442880
ttattaattt

SEQ ID NO: 115056 - DNA, 11 bp, Unknown
  misc_feature (1)..( 11): Result.002 file - promoters60/1442880
gaactgaaaga

SEQ ID NO: 115057 - DNA, 11 bp, Unknown
  misc_feature (1)..( 11): Result.002 file - promoters60/1442880
ttgtataaatt

SEQ ID NO: 115058 - DNA, 8 bp, Unknown
  misc_feature (1)..( 8): Result.002 file - promoters60/1442887
cataatta

SEQ ID NO: 115059 - DNA, 8 bp, Unknown
  misc_feature (1)..( 8): Result.002 file - promoters60/1442887
catgatta

SEQ ID NO: 115060 - DNA, 9 bp, Unknown
  misc_feature (1)..( 9): Result.002 file - promoters60/1442887
tcaatcact

SEQ ID NO: 115061 - DNA, 9 bp, Unknown
  misc_feature (1)..( 9): Result.002 file - promoters60/1442887
tcagtcact

SEQ ID NO: 115062 - DNA, 8 bp, Unknown
  misc_feature (1)..( 8): Result.002 file - promoters60/1442887
tttgtttg

SEQ ID NO: 115063 - DNA, 8 bp, Unknown
  misc_feature (1)..( 8): Result.002 file - promoters60/1442887
tttctttg

SEQ ID NO: 115064 - DNA, 9 bp, Unknown
  misc_feature (1)..( 9): Result.002 file - promoters60/1442887
gctaatcac

SEQ ID NO: 115065 - DNA, 9 bp, Unknown
  misc_feature (1)..( 9): Result.002 file - promoters60/1442887
gctagtcac

SEQ ID NO: 115066 - DNA, 6 bp, Unknown
  misc_feature (1)..( 6): Result.002 file - promoters60/1442887
aatgaa

SEQ ID NO: 115067 - DNA, 6 bp, Unknown
  misc_feature (1)..( 6): Result.002 file - promoters60/1442887
aatgaa

SEQ ID NO: 115068 - DNA, 8 bp, Unknown
  misc_feature (1)..( 8): Result.002 file - promoters60/1442887
tattagtt

SEQ ID NO: 115069 - DNA, 8 bp, Unknown
  misc_feature (1)..( 8): Result.002 file - promoters60/1442887
tatttgtt

SEQ ID NO: 115070 - DNA, 7 bp, Unknown
  misc_feature (1)..( 7): Result.002 file - promoters60/1442887
ttagatc

SEQ ID NO: 115071 - DNA, 7 bp, Unknown
  misc_feature (1)..( 7): Result.002 file - promoters60/1442887
ttagatc

SEQ ID NO: 115072 - DNA, 6 bp, Unknown
  misc_feature (1)..( 6): Result.002 file - promoters60/1442887
gaaatc

SEQ ID NO: 115073 - DNA, 6 bp, Unknown
  misc_feature (1)..( 6): Result.002 file - promoters60/1442887
gaaatc

SEQ ID NO: 115074 - DNA, 6 bp, Unknown
  misc_feature (1)..( 6): Result.002 file - promoters60/1442887
ttgaac

SEQ ID NO: 115075 - DNA, 6 bp, Unknown
  misc_feature (1)..( 6): Result.002 file - promoters60/1442887
ttgaac

SEQ ID NO: 115076 - DNA, 6 bp, Unknown
  misc_feature (1)..( 6): Result.002 file - promoters60/1442887
attttg

SEQ ID NO: 115077 - DNA, 6 bp, Unknown
  misc_feature (1)..( 6): Result.002 file - promoters60/1442887
attttg

SEQ ID NO: 115078 - DNA, 6 bp, Unknown
  misc_feature (1)..( 6): Result.002 file - promoters60/1442887
ttgggt

SEQ ID NO: 115079 - DNA, 6 bp, Unknown
  misc_feature (1)..( 6): Result.002 file - promoters60/1442887
ttgggt

SEQ ID NO: 115080 - DNA, 6 bp, Unknown
  misc_feature (1)..( 6): Result.002 file - promoters60/1442887
ttatta

SEQ ID NO: 115081 - DNA, 6 bp, Unknown
  misc_feature (1)..( 6): Result.002 file - promoters60/1442887
ttatta

SEQ ID NO: 115082 - DNA, 6 bp, Unknown
  misc_feature (1)..( 6): Result.002 file - promoters60/1442887
tttgtt

SEQ ID NO: 115083 - DNA, 6 bp, Unknown
  misc_feature (1)..( 6): Result.002 file - promoters60/1442887
tttgtt

SEQ ID NO: 115084 - DNA, 6 bp, Unknown
  misc_feature (1)..( 6): Result.002 file - promoters60/1442887
agtaaa

SEQ ID NO: 115085 - DNA, 6 bp, Unknown
  misc_feature (1)..( 6): Result.002 file - promoters60/1442887
agtaaa

SEQ ID NO: 115086 - DNA, 7 bp, Unknown
  misc_feature (1)..( 7): Result.002 file - promoters60/1442887
aatcggg

SEQ ID NO: 115087 - DNA, 7 bp, Unknown
  misc_feature (1)..( 7): Result.002 file - promoters60/1442887
aattggg

SEQ ID NO: 115088 - DNA, 8 bp, Unknown
  misc_feature (1)..( 8): Result.002 file - promoters60/1442887
gaaagaaa

SEQ ID NO: 115089 - DNA, 8 bp, Unknown
  misc_feature (1)..( 8): Result.002 file - promoters60/1442887
gaaacaaa

SEQ ID NO: 115090 - DNA, 10 bp, Unknown
  misc_feature (1)..( 10): Result.002 file - promoters60/1442887
ggaaaagaaa

SEQ ID NO: 115091 - DNA, 10 bp, Unknown
  misc_feature (1)..( 10): Result.002 file - promoters60/1442887
ggaaatgaaa

SEQ ID NO: 115092 - DNA, 7 bp, Unknown
  misc_feature (1)..( 7): Result.002 file - promoters60/1442887
cccacta

SEQ ID NO: 115093 - DNA, 7 bp, Unknown
  misc_feature (1)..( 7): Result.002 file - promoters60/1442887
cccacta

SEQ ID NO: 115094 - DNA, 9 bp, Unknown
  misc_feature (1)..( 9): Result.002 file - promoters60/1442887
aaagaaaag

SEQ ID NO: 115095 - DNA, 9 bp, Unknown
  misc_feature (1)..( 9): Result.002 file - promoters60/1442887
aaagtaaag

SEQ ID NO: 115096 - DNA, 7 bp, Unknown
  misc_feature (1)..( 7): Result.002 file - promoters60/1442887
gtatata

SEQ ID NO: 115097 - DNA, 7 bp, Unknown
  misc_feature (1)..( 7): Result.002 file - promoters60/1442887
gtatata

SEQ ID NO: 115098 - DNA, 6 bp, Unknown
  misc_feature (1)..( 6): Result.002 file - promoters60/1442945
aaagaa

SEQ ID NO: 115099 - DNA, 6 bp, Unknown
  misc_feature (1)..( 6): Result.002 file - promoters60/1442945
aaagaa

SEQ ID NO: 115100 - DNA, 8 bp, Unknown
  misc_feature (1)..( 8): Result.002 file - promoters60/1442945
attttaat

SEQ ID NO: 115101 - DNA, 8 bp, Unknown
  misc_feature (1)..( 8): Result.002 file - promoters60/1442945
attataat

SEQ ID NO: 115102 - DNA, 8 bp, Unknown
  misc_feature (1)..( 8): Result.002 file - promoters60/1442945
cttttaat

SEQ ID NO: 115103 - DNA, 6 bp, Unknown
  misc_feature (1)..( 6): Result.002 file - promoters60/1442945
aaccaa

SEQ ID NO: 115104 - DNA, 6 bp, Unknown
  misc_feature (1)..( 6): Result.002 file - promoters60/1442945
aaccaa

SEQ ID NO: 115105 - DNA, 6 bp, Unknown
  misc_feature (1)..( 6): Result.002 file - promoters60/1442945
aaaatt

SEQ ID NO: 115106 - DNA, 6 bp, Unknown
  misc_feature (1)..( 6): Result.002 file - promoters60/1442945
aaaatt

SEQ ID NO: 115107 - DNA, 6 bp, Unknown
  misc_feature (1)..( 6): Result.002 file - promoters60/1442945
aaaatt

SEQ ID NO: 115108 - DNA, 9 bp, Unknown
  misc_feature (1)..( 9): Result.002 file - promoters60/1442945
ttcaaattc

SEQ ID NO: 115109 - DNA, 9 bp, Unknown
  misc_feature (1)..( 9): Result.002 file - promoters60/1442945
ttcaaattt

SEQ ID NO: 115110 - DNA, 9 bp, Unknown
  misc_feature (1)..( 9): Result.002 file - promoters60/1442945
ttcaatttc

SEQ ID NO: 115111 - DNA, 8 bp, Unknown
  misc_feature (1)..( 8): Result.002 file - promoters60/1442945
ttagttgg

SEQ ID NO: 115112 - DNA, 8 bp, Unknown
  misc_feature (1)..( 8): Result.002 file - promoters60/1442945
ttagctgg

SEQ ID NO: 115113 - DNA, 9 bp, Unknown
  misc_feature (1)..( 9): Result.002 file - promoters60/1442945
agtaaaatg

SEQ ID NO: 115114 - DNA, 9 bp, Unknown
  misc_feature (1)..( 9): Result.002 file - promoters60/1442945
agtacaatg

SEQ ID NO: 115115 - DNA, 9 bp, Unknown
  misc_feature (1)..( 9): Result.002 file - promoters60/1442945
agtccaacc

SEQ ID NO: 115116 - DNA, 6 bp, Unknown
  misc_feature (1)..( 6): Result.002 file - promoters60/1442945
gaacat

SEQ ID NO: 115117 - DNA, 6 bp, Unknown
  misc_feature (1)..( 6): Result.002 file - promoters60/1442945
gaacat

SEQ ID NO: 115118 - DNA, 6 bp, Unknown
  misc_feature (1)..( 6): Result.002 file - promoters60/1442945
ttattt

SEQ ID NO: 115119 - DNA, 6 bp, Unknown
  misc_feature (1)..( 6): Result.002 file - promoters60/1442945
ttattt

SEQ ID NO: 115120 - DNA, 6 bp, Unknown
  misc_feature (1)..( 6): Result.002 file - promoters60/1442945
tctttt

SEQ ID NO: 115121 - DNA, 6 bp, Unknown
  misc_feature (1)..( 6): Result.002 file - promoters60/1442945
tctttt

SEQ ID NO: 115122 - DNA, 10 bp, Unknown
  misc_feature (1)..( 10): Result.002 file - promoters60/1442945
ttttcattca

SEQ ID NO: 115123 - DNA, 10 bp, Unknown
  misc_feature (1)..( 10): Result.002 file - promoters60/1442945
ttttaattaa

SEQ ID NO: 115124 - DNA, 10 bp, Unknown
  misc_feature (1)..( 10): Result.002 file - promoters60/1442945
acataattaa

SEQ ID NO: 115125 - DNA, 6 bp, Unknown
  misc_feature (1)..( 6): Result.002 file - promoters60/1442945
aatttc

SEQ ID NO: 115126 - DNA, 6 bp, Unknown
  misc_feature (1)..( 6): Result.002 file - promoters60/1442945
aatttc

SEQ ID NO: 115127 - DNA, 8 bp, Unknown
  misc_feature (1)..( 8): Result.002 file - promoters60/1442945
aaaatttc

SEQ ID NO: 115128 - DNA, 8 bp, Unknown
  misc_feature (1)..( 8): Result.002 file - promoters60/1442945
caaatttt

SEQ ID NO: 115129 - DNA, 7 bp, Unknown
  misc_feature (1)..( 7): Result.002 file - promoters60/1442945
tttaata

SEQ ID NO: 115130 - DNA, 7 bp, Unknown
  misc_feature (1)..( 7): Result.002 file - promoters60/1442945
tttaata

SEQ ID NO: 115131 - DNA, 7 bp, Unknown
  misc_feature (1)..( 7): Result.002 file - promoters60/1442945
caaaaac

SEQ ID NO: 115132 - DNA, 7 bp, Unknown
  misc_feature (1)..( 7): Result.002 file - promoters60/1442945
caaaaac

SEQ ID NO: 115133 - DNA, 8 bp, Unknown
  misc_feature (1)..( 8): Result.002 file - promoters60/1442945
aaaagcgc

SEQ ID NO: 115134 - DNA, 8 bp, Unknown
  misc_feature (1)..( 8): Result.002 file - promoters60/1442945
aaacgcgc

SEQ ID NO: 115135 - DNA, 8 bp, Unknown
  misc_feature (1)..( 8): Result.002 file - promoters60/1442945
tatacata

SEQ ID NO: 115136 - DNA, 8 bp, Unknown
  misc_feature (1)..( 8): Result.002 file - promoters60/1442945
tatatata

SEQ ID NO: 115137 - DNA, 7 bp, Unknown
  misc_feature (1)..( 7): Result.002 file - promoters60/1442945
aactgaa

SEQ ID NO: 115138 - DNA, 7 bp, Unknown
  misc_feature (1)..( 7): Result.002 file - promoters60/1442945
aaccgaa

SEQ ID NO: 115139 - DNA, 6 bp, Unknown
  misc_feature (1)..( 6): Result.002 file - promoters60/1442945
aatttt

SEQ ID NO: 115140 - DNA, 6 bp, Unknown
  misc_feature (1)..( 6): Result.002 file - promoters60/1442945
aatttt

SEQ ID NO: 115141 - DNA, 7 bp, Unknown
  misc_feature (1)..( 7): Result.002 file - promoters60/1442945
cataaac

SEQ ID NO: 115142 - DNA, 7 bp, Unknown
  misc_feature (1)..( 7): Result.002 file - promoters60/1442945
cataaac

SEQ ID NO: 115143 - DNA, 6 bp, Unknown
  misc_feature (1)..( 6): Result.002 file - promoters60/1442945
ctcctt

SEQ ID NO: 115144 - DNA, 6 bp, Unknown
  misc_feature (1)..( 6): Result.002 file - promoters60/1442945
ctcctt

SEQ ID NO: 115145 - DNA, 9 bp, Unknown
  misc_feature (1)..( 9): Result.002 file - promoters60/1442945
tttcaattt

SEQ ID NO: 115146 - DNA, 9 bp, Unknown
  misc_feature (1)..( 9): Result.002 file - promoters60/1442945
tttcatttt

SEQ ID NO: 115147 - DNA, 7 bp, Unknown
  misc_feature (1)..( 7): Result.002 file - promoters60/1442945
tttctct

SEQ ID NO: 115148 - DNA, 7 bp, Unknown
  misc_feature (1)..( 7): Result.002 file - promoters60/1442945
tttgtct

SEQ ID NO: 115149 - DNA, 6 bp, Unknown
  misc_feature (1)..( 6): Result.002 file - promoters60/1442945
taacat

SEQ ID NO: 115150 - DNA, 6 bp, Unknown
  misc_feature (1)..( 6): Result.002 file - promoters60/1442945
taacat

SEQ ID NO: 115151 - DNA, 6 bp, Unknown
  misc_feature (1)..( 6): Result.002 file - promoters60/1442945
ttttta

SEQ ID NO: 115152 - DNA, 6 bp, Unknown
  misc_feature (1)..( 6): Result.002 file - promoters60/1442945
ttttta

SEQ ID NO: 115153 - DNA, 6 bp, Unknown
  misc_feature (1)..( 6): Result.002 file - promoters60/1442945
ataata

SEQ ID NO: 115154 - DNA, 6 bp, Unknown
  misc_feature (1)..( 6): Result.002 file - promoters60/1442945
ataata

SEQ ID NO: 115155 - DNA, 8 bp, Unknown
  misc_feature (1)..( 8): Result.002 file - promoters60/1442945
catatata

SEQ ID NO: 115156 - DNA, 8 bp, Unknown
  misc_feature (1)..( 8): Result.002 file - promoters60/1442945
catatata

SEQ ID NO: 115157 - DNA, 9 bp, Unknown
  misc_feature (1)..( 9): Result.002 file - promoters60/1442953
aaataatga

SEQ ID NO: 115158 - DNA, 9 bp, Unknown
  misc_feature (1)..( 9): Result.002 file - promoters60/1442953
aaaaaatct

SEQ ID NO: 115159 - DNA, 9 bp, Unknown
  misc_feature (1)..( 9): Result.002 file - promoters60/1442953
aaacaattt

SEQ ID NO: 115160 - DNA, 9 bp, Unknown
  misc_feature (1)..( 9): Result.002 file - promoters60/1442953
aaaatatct

SEQ ID NO: 115161 - DNA, 9 bp, Unknown
  misc_feature (1)..( 9): Result.002 file - promoters60/1442953
tcaaagaaa

SEQ ID NO: 115162 - DNA, 9 bp, Unknown
  misc_feature (1)..( 9): Result.002 file - promoters60/1442953
acaaacaaa

SEQ ID NO: 115163 - DNA, 9 bp, Unknown
  misc_feature (1)..( 9): Result.002 file - promoters60/1442953
tcaaaggtt

SEQ ID NO: 115164 - DNA, 9 bp, Unknown
  misc_feature (1)..( 9): Result.002 file - promoters60/1442953
tcaaccaat

SEQ ID NO: 115165 - DNA, 7 bp, Unknown
  misc_feature (1)..( 7): Result.002 file - promoters60/1442953
tagaact

SEQ ID NO: 115166 - DNA, 7 bp, Unknown
  misc_feature (1)..( 7): Result.002 file - promoters60/1442953
tagaaca

SEQ ID NO: 115167 - DNA, 7 bp, Unknown
  misc_feature (1)..( 7): Result.002 file - promoters60/1442953
cagaaca

SEQ ID NO: 115168 - DNA, 7 bp, Unknown
  misc_feature (1)..( 7): Result.002 file - promoters60/1442953
aagaaca

SEQ ID NO: 115169 - DNA, 10 bp, Unknown
  misc_feature (1)..( 10): Result.002 file - promoters60/1442953
tttgtctgtt

SEQ ID NO: 115170 - DNA, 10 bp, Unknown
  misc_feature (1)..( 10): Result.002 file - promoters60/1442953
tttgtcggct

SEQ ID NO: 115171 - DNA, 11 bp, Unknown
  misc_feature (1)..( 11): Result.002 file - promoters60/1442953
tttagtcaaaa

SEQ ID NO: 115172 - DNA, 11 bp, Unknown
  misc_feature (1)..( 11): Result.002 file - promoters60/1442953
attagtaaaaa

SEQ ID NO: 115173 - DNA, 9 bp, Unknown
  misc_feature (1)..( 9): Result.002 file - promoters60/1442953
aaaagaggc

SEQ ID NO: 115174 - DNA, 9 bp, Unknown
  misc_feature (1)..( 9): Result.002 file - promoters60/1442953
aaaagaaaa

SEQ ID NO: 115175 - DNA, 9 bp, Unknown
  misc_feature (1)..( 9): Result.002 file - promoters60/1442953
taaataaat

SEQ ID NO: 115176 - DNA, 9 bp, Unknown
  misc_feature (1)..( 9): Result.002 file - promoters60/1442953
aatataaat

SEQ ID NO: 115177 - DNA, 8 bp, Unknown
  misc_feature (1)..( 8): Result.002 file - promoters60/1442967
ataataaa

SEQ ID NO: 115178 - DNA, 8 bp, Unknown
  misc_feature (1)..( 8): Result.002 file - promoters60/1442967
acaataaa

SEQ ID NO: 115179 - DNA, 8 bp, Unknown
  misc_feature (1)..( 8): Result.002 file - promoters60/1442967
acagtaag

SEQ ID NO: 115180 - DNA, 6 bp, Unknown
  misc_feature (1)..( 6): Result.002 file - promoters60/1442967
acaaaa

SEQ ID NO: 115181 - DNA, 6 bp, Unknown
  misc_feature (1)..( 6): Result.002 file - promoters60/1442967
acaaaa

SEQ ID NO: 115182 - DNA, 6 bp, Unknown
  misc_feature (1)..( 6): Result.002 file - promoters60/1442967
tatata

SEQ ID NO: 115183 - DNA, 6 bp, Unknown
  misc_feature (1)..( 6): Result.002 file - promoters60/1442967
tatata

SEQ ID NO: 115184 - DNA, 7 bp, Unknown
  misc_feature (1)..( 7): Result.002 file - promoters60/1442967
tatataa

SEQ ID NO: 115185 - DNA, 7 bp, Unknown
  misc_feature (1)..( 7): Result.002 file - promoters60/1442967
tatttaa

SEQ ID NO: 115186 - DNA, 6 bp, Unknown
  misc_feature (1)..( 6): Result.002 file - promoters60/1442967
aaggtc

SEQ ID NO: 115187 - DNA, 6 bp, Unknown
  misc_feature (1)..( 6): Result.002 file - promoters60/1442967
aaggtc

SEQ ID NO: 115188 - DNA, 10 bp, Unknown
  misc_feature (1)..( 10): Result.002 file - promoters60/1442967
aagtatgact

SEQ ID NO: 115189 - DNA, 10 bp, Unknown
  misc_feature (1)..( 10): Result.002 file - promoters60/1442967
aagtaggact

SEQ ID NO: 115190 - DNA, 8 bp, Unknown
  misc_feature (1)..( 8): Result.002 file - promoters60/1442967
aaagaaac

SEQ ID NO: 115191 - DNA, 8 bp, Unknown
  misc_feature (1)..( 8): Result.002 file - promoters60/1442967
aaagaaac

SEQ ID NO: 115192 - DNA, 6 bp, Unknown
  misc_feature (1)..( 6): Result.002 file - promoters60/1442967
caagaa

SEQ ID NO: 115193 - DNA, 6 bp, Unknown
  misc_feature (1)..( 6): Result.002 file - promoters60/1442967
caagaa

SEQ ID NO: 115194 - DNA, 6 bp, Unknown
  misc_feature (1)..( 6): Result.002 file - promoters60/1442967
tcttct

SEQ ID NO: 115195 - DNA, 6 bp, Unknown
  misc_feature (1)..( 6): Result.002 file - promoters60/1442967
tcttct

SEQ ID NO: 115196 - DNA, 8 bp, Unknown
  misc_feature (1)..( 8): Result.002 file - promoters60/1442967
aacgcaaa

SEQ ID NO: 115197 - DNA, 8 bp, Unknown
  misc_feature (1)..( 8): Result.002 file - promoters60/1442967
aacacaaa

SEQ ID NO: 115198 - DNA, 6 bp, Unknown
  misc_feature (1)..( 6): Result.002 file - promoters60/1442967
tctcac

SEQ ID NO: 115199 - DNA, 6 bp, Unknown
  misc_feature (1)..( 6): Result.002 file - promoters60/1442967
tctcac

SEQ ID NO: 115200 - DNA, 6 bp, Unknown
  misc_feature (1)..( 6): Result.002 file - promoters60/1442967
tctcta

SEQ ID NO: 115201 - DNA, 6 bp, Unknown
  misc_feature (1)..( 6): Result.002 file - promoters60/1442967
tctcta

SEQ ID NO: 115202 - DNA, 6 bp, Unknown
  misc_feature (1)..( 6): Result.002 file - promoters60/1442967
attatc

SEQ ID NO: 115203 - DNA, 6 bp, Unknown
  misc_feature (1)..( 6): Result.002 file - promoters60/1442967
attatc

SEQ ID NO: 115204 - DNA, 6 bp, Unknown
  misc_feature (1)..( 6): Result.002 file - promoters60/1442967
agaaat

SEQ ID NO: 115205 - DNA, 6 bp, Unknown
  misc_feature (1)..( 6): Result.002 file - promoters60/1442967
agaaat

SEQ ID NO: 115206 - DNA, 6 bp, Unknown
  misc_feature (1)..( 6): Result.002 file - promoters60/1442967
tcaaac

SEQ ID NO: 115207 - DNA, 6 bp, Unknown
  misc_feature (1)..( 6): Result.002 file - promoters60/1442967
tcaaac

SEQ ID NO: 115208 - DNA, 6 bp, Unknown
  misc_feature (1)..( 6): Result.002 file - promoters60/1442967
caaagt

SEQ ID NO: 115209 - DNA, 6 bp, Unknown
  misc_feature (1)..( 6): Result.002 file - promoters60/1442967
caaagt

SEQ ID NO: 115210 - DNA, 9 bp, Unknown
  misc_feature (1)..( 9): Result.002 file - promoters60/1442967
aaaggtctc

SEQ ID NO: 115211 - DNA, 9 bp, Unknown
  misc_feature (1)..( 9): Result.002 file - promoters60/1442967
aaaagtctc

SEQ ID NO: 115212 - DNA, 8 bp, Unknown
  misc_feature (1)..( 8): Result.002 file - promoters60/1442967
ctttctat

SEQ ID NO: 115213 - DNA, 8 bp, Unknown
  misc_feature (1)..( 8): Result.002 file - promoters60/1442967
cttactat

SEQ ID NO: 115214 - DNA, 12 bp, Unknown
  misc_feature (1)..( 12): Result.002 file - promoters60/1442975
ctttttgtttat

SEQ ID NO: 115215 - DNA, 12 bp, Unknown
  misc_feature (1)..( 12): Result.002 file - promoters60/1442975
tgatttgtatat

SEQ ID NO: 115216 - DNA, 12 bp, Unknown
  misc_feature (1)..( 12): Result.002 file - promoters60/1442975
cttattgtataa

SEQ ID NO: 115217 - DNA, 6 bp, Unknown
  misc_feature (1)..( 6): Result.002 file - promoters60/1442975
attgaa

SEQ ID NO: 115218 - DNA, 6 bp, Unknown
  misc_feature (1)..( 6): Result.002 file - promoters60/1442975
attgaa

SEQ ID NO: 115219 - DNA, 6 bp, Unknown
  misc_feature (1)..( 6): Result.002 file - promoters60/1442975
tgaaca

SEQ ID NO: 115220 - DNA, 6 bp, Unknown
  misc_feature (1)..( 6): Result.002 file - promoters60/1442975
tgaaca

SEQ ID NO: 115221 - DNA, 7 bp, Unknown
  misc_feature (1)..( 7): Result.002 file - promoters60/1442975
tctacga

SEQ ID NO: 115222 - DNA, 7 bp, Unknown
  misc_feature (1)..( 7): Result.002 file - promoters60/1442975
tcttcga

SEQ ID NO: 115223 - DNA, 7 bp, Unknown
  misc_feature (1)..( 7): Result.002 file - promoters60/1442975
agggttt

SEQ ID NO: 115224 - DNA, 7 bp, Unknown
  misc_feature (1)..( 7): Result.002 file - promoters60/1442975
aggattt

SEQ ID NO: 115225 - DNA, 10 bp, Unknown
  misc_feature (1)..( 10): Result.002 file - promoters60/1442975
gcaggagatg

SEQ ID NO: 115226 - DNA, 10 bp, Unknown
  misc_feature (1)..( 10): Result.002 file - promoters60/1442975
gcaggagatg

SEQ ID NO: 115227 - DNA, 8 bp, Unknown
  misc_feature (1)..( 8): Result.002 file - promoters60/1442975
gctggatt

SEQ ID NO: 115228 - DNA, 8 bp, Unknown
  misc_feature (1)..( 8): Result.002 file - promoters60/1442975
tctgaatt

SEQ ID NO: 115229 - DNA, 8 bp, Unknown
  misc_feature (1)..( 8): Result.002 file - promoters60/1442975
tctgaaca

SEQ ID NO: 115230 - DNA, 6 bp, Unknown
  misc_feature (1)..( 6): Result.002 file - promoters60/1442975
aatcta

SEQ ID NO: 115231 - DNA, 6 bp, Unknown
  misc_feature (1)..( 6): Result.002 file - promoters60/1442975
aatcta

SEQ ID NO: 115232 - DNA, 6 bp, Unknown
  misc_feature (1)..( 6): Result.002 file - promoters60/1442975
catcaa

SEQ ID NO: 115233 - DNA, 6 bp, Unknown
  misc_feature (1)..( 6): Result.002 file - promoters60/1442975
catcaa

SEQ ID NO: 115234 - DNA, 8 bp, Unknown
  misc_feature (1)..( 8): Result.002 file - promoters60/1442975
gattggtg

SEQ ID NO: 115235 - DNA, 8 bp, Unknown
  misc_feature (1)..( 8): Result.002 file - promoters60/1442975
gattcgtg

SEQ ID NO: 115236 - DNA, 7 bp, Unknown
  misc_feature (1)..( 7): Result.002 file - promoters60/1442975
cactgtc

SEQ ID NO: 115237 - DNA, 7 bp, Unknown
  misc_feature (1)..( 7): Result.002 file - promoters60/1442975
cacggtc

SEQ ID NO: 115238 - DNA, 6 bp, Unknown
  misc_feature (1)..( 6): Result.002 file - promoters60/1442975
ggttta

SEQ ID NO: 115239 - DNA, 6 bp, Unknown
  misc_feature (1)..( 6): Result.002 file - promoters60/1442975
ggttta

SEQ ID NO: 115240 - DNA, 6 bp, Unknown
  misc_feature (1)..( 6): Result.002 file - promoters60/1442975
ttgact

SEQ ID NO: 115241 - DNA, 6 bp, Unknown
  misc_feature (1)..( 6): Result.002 file - promoters60/1442975
ttgact

SEQ ID NO: 115242 - DNA, 6 bp, Unknown
  misc_feature (1)..( 6): Result.002 file - promoters60/1442975
ggctgt

SEQ ID NO: 115243 - DNA, 6 bp, Unknown
  misc_feature (1)..( 6): Result.002 file - promoters60/1442975
ggctgt

SEQ ID NO: 115244 - DNA, 9 bp, Unknown
  misc_feature (1)..( 9): Result.002 file - promoters60/1442993
ttctctttt

SEQ ID NO: 115245 - DNA, 9 bp, Unknown
  misc_feature (1)..( 9): Result.002 file - promoters60/1442993
acctctttt

SEQ ID NO: 115246 - DNA, 9 bp, Unknown
  misc_feature (1)..( 9): Result.002 file - promoters60/1442993
ctctctttc

SEQ ID NO: 115247 - DNA, 9 bp, Unknown
  misc_feature (1)..( 9): Result.002 file - promoters60/1442993
accccttag

SEQ ID NO: 115248 - DNA, 8 bp, Unknown
  misc_feature (1)..( 8): Result.002 file - promoters60/1442993
caatttac

SEQ ID NO: 115249 - DNA, 8 bp, Unknown
  misc_feature (1)..( 8): Result.002 file - promoters60/1442993
aaatctac

SEQ ID NO: 115250 - DNA, 8 bp, Unknown
  misc_feature (1)..( 8): Result.002 file - promoters60/1442993
taatttat

SEQ ID NO: 115251 - DNA, 8 bp, Unknown
  misc_feature (1)..( 8): Result.002 file - promoters60/1442993
aaaactat

SEQ ID NO: 115252 - DNA, 13 bp, Unknown
  misc_feature (1)..( 13): Result.002 file - promoters60/1442993
ctaaaatagtaaa

SEQ ID NO: 115253 - DNA, 13 bp, Unknown
  misc_feature (1)..( 13): Result.002 file - promoters60/1442993
aaataattgtata

SEQ ID NO: 115254 - DNA, 13 bp, Unknown
  misc_feature (1)..( 13): Result.002 file - promoters60/1442993
tcatatttgtata

SEQ ID NO: 115255 - DNA, 13 bp, Unknown
  misc_feature (1)..( 13): Result.002 file - promoters60/1442993
aaagaattgaaca

SEQ ID NO: 115256 - DNA, 10 bp, Unknown
  misc_feature (1)..( 10): Result.002 file - promoters60/1442993
gaaaaagata

SEQ ID NO: 115257 - DNA, 10 bp, Unknown
  misc_feature (1)..( 10): Result.002 file - promoters60/1442993
gaaatagatt

SEQ ID NO: 115258 - DNA, 10 bp, Unknown
  misc_feature (1)..( 10): Result.002 file - promoters60/1442993
ttagtagatt

SEQ ID NO: 115259 - DNA, 10 bp, Unknown
  misc_feature (1)..( 10): Result.002 file - promoters60/1442993
tatataaatt

SEQ ID NO: 115260 - DNA, 10 bp, Unknown
  misc_feature (1)..( 10): Result.002 file - promoters60/1442993
ttactaaaat

SEQ ID NO: 115261 - DNA, 10 bp, Unknown
  misc_feature (1)..( 10): Result.002 file - promoters60/1442993
ttattaattt

SEQ ID NO: 115262 - DNA, 11 bp, Unknown
  misc_feature (1)..( 11): Result.002 file - promoters60/1442993
gaactgaaaga

SEQ ID NO: 115263 - DNA, 11 bp, Unknown
  misc_feature (1)..( 11): Result.002 file - promoters60/1442993
ttgtataaatt

SEQ ID NO: 115264 - DNA, 10 bp, Unknown
  misc_feature (1)..( 10): Result.002 file - promoters60/1442993
taatcaattt

SEQ ID NO: 115265 - DNA, 10 bp, Unknown
  misc_feature (1)..( 10): Result.002 file - promoters60/1442993
aaattaatta

SEQ ID NO: 115266 - DNA, 11 bp, Unknown
  misc_feature (1)..( 11): Result.002 file - promoters60/1442993
aatacaacttt

SEQ ID NO: 115267 - DNA, 11 bp, Unknown
  misc_feature (1)..( 11): Result.002 file - promoters60/1442993
taattatcgcc

SEQ ID NO: 115268 - DNA, 7 bp, Unknown
  misc_feature (1)..( 7): Result.002 file - promoters60/1443011
ataagca

SEQ ID NO: 115269 - DNA, 7 bp, Unknown
  misc_feature (1)..( 7): Result.002 file - promoters60/1443011
atatgca

SEQ ID NO: 115270 - DNA, 11 bp, Unknown
  misc_feature (1)..( 11): Result.002 file - promoters60/1443011
aataataatat

SEQ ID NO: 115271 - DNA, 11 bp, Unknown
  misc_feature (1)..( 11): Result.002 file - promoters60/1443011
aattatattat

SEQ ID NO: 115272 - DNA, 11 bp, Unknown
  misc_feature (1)..( 11): Result.002 file - promoters60/1443011
gttaataagta

SEQ ID NO: 115273 - DNA, 6 bp, Unknown
  misc_feature (1)..( 6): Result.002 file - promoters60/1443011
aatcaa

SEQ ID NO: 115274 - DNA, 6 bp, Unknown
  misc_feature (1)..( 6): Result.002 file - promoters60/1443011
aatcaa

SEQ ID NO: 115275 - DNA, 8 bp, Unknown
  misc_feature (1)..( 8): Result.002 file - promoters60/1443011
aaaccgtc

SEQ ID NO: 115276 - DNA, 8 bp, Unknown
  misc_feature (1)..( 8): Result.002 file - promoters60/1443011
aaagcgtc

SEQ ID NO: 115277 - DNA, 7 bp, Unknown
  misc_feature (1)..( 7): Result.002 file - promoters60/1443011
aattatt

SEQ ID NO: 115278 - DNA, 7 bp, Unknown
  misc_feature (1)..( 7): Result.002 file - promoters60/1443011
aataatt

SEQ ID NO: 115279 - DNA, 6 bp, Unknown
  misc_feature (1)..( 6): Result.002 file - promoters60/1443011
taatat

SEQ ID NO: 115280 - DNA, 6 bp, Unknown
  misc_feature (1)..( 6): Result.002 file - promoters60/1443011
taatat

SEQ ID NO: 115281 - DNA, 6 bp, Unknown
  misc_feature (1)..( 6): Result.002 file - promoters60/1443011
tgattg

SEQ ID NO: 115282 - DNA, 6 bp, Unknown
  misc_feature (1)..( 6): Result.002 file - promoters60/1443011
tgattg

SEQ ID NO: 115283 - DNA, 7 bp, Unknown
  misc_feature (1)..( 7): Result.002 file - promoters60/1443011
tttgaag

SEQ ID NO: 115284 - DNA, 7 bp, Unknown
  misc_feature (1)..( 7): Result.002 file - promoters60/1443011
tttcaag

SEQ ID NO: 115285 - DNA, 11 bp, Unknown
  misc_feature (1)..( 11): Result.002 file - promoters60/1443011
agacagaaaga

SEQ ID NO: 115286 - DNA, 11 bp, Unknown
  misc_feature (1)..( 11): Result.002 file - promoters60/1443011
agagagataga

SEQ ID NO: 115287 - DNA, 9 bp, Unknown
  misc_feature (1)..( 9): Result.002 file - promoters60/1443011
ataaacgaa

SEQ ID NO: 115288 - DNA, 9 bp, Unknown
  misc_feature (1)..( 9): Result.002 file - promoters60/1443011
ataaatgaa

SEQ ID NO: 115289 - DNA, 8 bp, Unknown
  misc_feature (1)..( 8): Result.002 file - promoters60/1443011
ctaatcac

SEQ ID NO: 115290 - DNA, 8 bp, Unknown
  misc_feature (1)..( 8): Result.002 file - promoters60/1443011
ctagtcac

SEQ ID NO: 115291 - DNA, 7 bp, Unknown
  misc_feature (1)..( 7): Result.002 file - promoters60/1443011
taatggg

SEQ ID NO: 115292 - DNA, 7 bp, Unknown
  misc_feature (1)..( 7): Result.002 file - promoters60/1443011
taaaggg

SEQ ID NO: 115293 - DNA, 6 bp, Unknown
  misc_feature (1)..( 6): Result.002 file - promoters60/1443011
tctctc

SEQ ID NO: 115294 - DNA, 6 bp, Unknown
  misc_feature (1)..( 6): Result.002 file - promoters60/1443011
tctctc

SEQ ID NO: 115295 - DNA, 6 bp, Unknown
  misc_feature (1)..( 6): Result.002 file - promoters60/1443011
gtaatc

SEQ ID NO: 115296 - DNA, 6 bp, Unknown
  misc_feature (1)..( 6): Result.002 file - promoters60/1443011
gtaatc

SEQ ID NO: 115297 - DNA, 6 bp, Unknown
  misc_feature (1)..( 6): Result.002 file - promoters60/1443011
tatttt

SEQ ID NO: 115298 - DNA, 6 bp, Unknown
  misc_feature (1)..( 6): Result.002 file - promoters60/1443011
tatttt

SEQ ID NO: 115299 - DNA, 6 bp, Unknown
  misc_feature (1)..( 6): Result.002 file - promoters60/1443011
aaataa

SEQ ID NO: 115300 - DNA, 6 bp, Unknown
  misc_feature (1)..( 6): Result.002 file - promoters60/1443011
aaataa

SEQ ID NO: 115301 - DNA, 6 bp, Unknown
  misc_feature (1)..( 6): Result.002 file - promoters60/1443011
acaaaa

SEQ ID NO: 115302 - DNA, 6 bp, Unknown
  misc_feature (1)..( 6): Result.002 file - promoters60/1443011
acaaaa

SEQ ID NO: 115303 - DNA, 6 bp, Unknown
  misc_feature (1)..( 6): Result.002 file - promoters60/1443011
gaaaaa

SEQ ID NO: 115304 - DNA, 6 bp, Unknown
  misc_feature (1)..( 6): Result.002 file - promoters60/1443011
gaaaaa

SEQ ID NO: 115305 - DNA, 12 bp, Unknown
  misc_feature (1)..( 12): Result.002 file - promoters60/1443021
atacaatatatc

SEQ ID NO: 115306 - DNA, 12 bp, Unknown
  misc_feature (1)..( 12): Result.002 file - promoters60/1443021
tcaaaatttatc

SEQ ID NO: 115307 - DNA, 12 bp, Unknown
  misc_feature (1)..( 12): Result.002 file - promoters60/1443021
tcagaatttgga

SEQ ID NO: 115308 - DNA, 7 bp, Unknown
  misc_feature (1)..( 7): Result.002 file - promoters60/1443021
caataaa

SEQ ID NO: 115309 - DNA, 7 bp, Unknown
  misc_feature (1)..( 7): Result.002 file - promoters60/1443021
caacaaa

SEQ ID NO: 115310 - DNA, 8 bp, Unknown
  misc_feature (1)..( 8): Result.002 file - promoters60/1443021
atccaata

SEQ ID NO: 115311 - DNA, 8 bp, Unknown
  misc_feature (1)..( 8): Result.002 file - promoters60/1443021
atcctata

SEQ ID NO: 115312 - DNA, 6 bp, Unknown
  misc_feature (1)..( 6): Result.002 file - promoters60/1443021
tgttca

SEQ ID NO: 115313 - DNA, 6 bp, Unknown
  misc_feature (1)..( 6): Result.002 file - promoters60/1443021
tgttca

SEQ ID NO: 115314 - DNA, 8 bp, Unknown
  misc_feature (1)..( 8): Result.002 file - promoters60/1443021
gtcatttt

SEQ ID NO: 115315 - DNA, 8 bp, Unknown
  misc_feature (1)..( 8): Result.002 file - promoters60/1443021
gtcctttt

SEQ ID NO: 115316 - DNA, 8 bp, Unknown
  misc_feature (1)..( 8): Result.002 file - promoters60/1443021
tcttgact

SEQ ID NO: 115317 - DNA, 8 bp, Unknown
  misc_feature (1)..( 8): Result.002 file - promoters60/1443021
tctggact

SEQ ID NO: 115318 - DNA, 6 bp, Unknown
  misc_feature (1)..( 6): Result.002 file - promoters60/1443021
tatagt

SEQ ID NO: 115319 - DNA, 6 bp, Unknown
  misc_feature (1)..( 6): Result.002 file - promoters60/1443021
tatagt

SEQ ID NO: 115320 - DNA, 7 bp, Unknown
  misc_feature (1)..( 7): Result.002 file - promoters60/1443021
aatgtta

SEQ ID NO: 115321 - DNA, 7 bp, Unknown
  misc_feature (1)..( 7): Result.002 file - promoters60/1443021
aatatta

SEQ ID NO: 115322 - DNA, 6 bp, Unknown
  misc_feature (1)..( 6): Result.002 file - promoters60/1443021
tactgt

SEQ ID NO: 115323 - DNA, 6 bp, Unknown
  misc_feature (1)..( 6): Result.002 file - promoters60/1443021
tactgt

SEQ ID NO: 115324 - DNA, 6 bp, Unknown
  misc_feature (1)..( 6): Result.002 file - promoters60/1443021
ttgaaa

SEQ ID NO: 115325 - DNA, 6 bp, Unknown
  misc_feature (1)..( 6): Result.002 file - promoters60/1443021
ttgaaa

SEQ ID NO: 115326 - DNA, 7 bp, Unknown
  misc_feature (1)..( 7): Result.002 file - promoters60/1443021
cttctcc

SEQ ID NO: 115327 - DNA, 7 bp, Unknown
  misc_feature (1)..( 7): Result.002 file - promoters60/1443021
cttgtcc

SEQ ID NO: 115328 - DNA, 7 bp, Unknown
  misc_feature (1)..( 7): Result.002 file - promoters60/1443021
ttcatgt

SEQ ID NO: 115329 - DNA, 7 bp, Unknown
  misc_feature (1)..( 7): Result.002 file - promoters60/1443021
ttcatgt

SEQ ID NO: 115330 - DNA, 7 bp, Unknown
  misc_feature (1)..( 7): Result.002 file - promoters60/1443021
aagcttt

SEQ ID NO: 115331 - DNA, 7 bp, Unknown
  misc_feature (1)..( 7): Result.002 file - promoters60/1443021
aagattt

SEQ ID NO: 115332 - DNA, 10 bp, Unknown
  misc_feature (1)..( 10): Result.002 file - promoters60/1443021
atattttttt

SEQ ID NO: 115333 - DNA, 10 bp, Unknown
  misc_feature (1)..( 10): Result.002 file - promoters60/1443021
atattttttt

SEQ ID NO: 115334 - DNA, 7 bp, Unknown
  misc_feature (1)..( 7): Result.002 file - promoters60/1443021
tacctca

SEQ ID NO: 115335 - DNA, 7 bp, Unknown
  misc_feature (1)..( 7): Result.002 file - promoters60/1443021
tacctca

SEQ ID NO: 115336 - DNA, 7 bp, Unknown
  misc_feature (1)..( 7): Result.002 file - promoters60/1443021
ttttata

SEQ ID NO: 115337 - DNA, 7 bp, Unknown
  misc_feature (1)..( 7): Result.002 file - promoters60/1443021
tttgata

SEQ ID NO: 115338 - DNA, 9 bp, Unknown
  misc_feature (1)..( 9): Result.002 file - promoters60/1443021
catccttat

SEQ ID NO: 115339 - DNA, 9 bp, Unknown
  misc_feature (1)..( 9): Result.002 file - promoters60/1443021
catcattat

SEQ ID NO: 115340 - DNA, 11 bp, Unknown
  misc_feature (1)..( 11): Result.002 file - promoters60/1443029
agaattgacca

SEQ ID NO: 115341 - DNA, 11 bp, Unknown
  misc_feature (1)..( 11): Result.002 file - promoters60/1443029
tgaattggaat

SEQ ID NO: 115342 - DNA, 11 bp, Unknown
  misc_feature (1)..( 11): Result.002 file - promoters60/1443029
ggaaatgacgt

SEQ ID NO: 115343 - DNA, 11 bp, Unknown
  misc_feature (1)..( 11): Result.002 file - promoters60/1443029
tgatttgcttc

SEQ ID NO: 115344 - DNA, 11 bp, Unknown
  misc_feature (1)..( 11): Result.002 file - promoters60/1443029
agtattagctt

SEQ ID NO: 115345 - DNA, 11 bp, Unknown
  misc_feature (1)..( 11): Result.002 file - promoters60/1443029
ccaaaagacac

SEQ ID NO: 115346 - DNA, 6 bp, Unknown
  misc_feature (1)..( 6): Result.002 file - promoters60/1443075
aacgaa

SEQ ID NO: 115347 - DNA, 6 bp, Unknown
  misc_feature (1)..( 6): Result.002 file - promoters60/1443075
aacgaa

SEQ ID NO: 115348 - DNA, 13 bp, Unknown
  misc_feature (1)..( 13): Result.002 file - promoters60/1443075
aaatcattttttc

SEQ ID NO: 115349 - DNA, 13 bp, Unknown
  misc_feature (1)..( 13): Result.002 file - promoters60/1443075
aaataattttcaa

SEQ ID NO: 115350 - DNA, 13 bp, Unknown
  misc_feature (1)..( 13): Result.002 file - promoters60/1443075
ttggcatttacaa

SEQ ID NO: 115351 - DNA, 8 bp, Unknown
  misc_feature (1)..( 8): Result.002 file - promoters60/1443075
gtgacaaa

SEQ ID NO: 115352 - DNA, 8 bp, Unknown
  misc_feature (1)..( 8): Result.002 file - promoters60/1443075
gtgataaa

SEQ ID NO: 115353 - DNA, 8 bp, Unknown
  misc_feature (1)..( 8): Result.002 file - promoters60/1443075
ataggaaa

SEQ ID NO: 115354 - DNA, 8 bp, Unknown
  misc_feature (1)..( 8): Result.002 file - promoters60/1443075
ataagaaa

SEQ ID NO: 115355 - DNA, 7 bp, Unknown
  misc_feature (1)..( 7): Result.002 file - promoters60/1443075
tgtttga

SEQ ID NO: 115356 - DNA, 7 bp, Unknown
  misc_feature (1)..( 7): Result.002 file - promoters60/1443075
tgtgtga

SEQ ID NO: 115357 - DNA, 11 bp, Unknown
  misc_feature (1)..( 11): Result.002 file - promoters60/1443075
aaaaatgtcta

SEQ ID NO: 115358 - DNA, 11 bp, Unknown
  misc_feature (1)..( 11): Result.002 file - promoters60/1443075
acggatgtcta

SEQ ID NO: 115359 - DNA, 11 bp, Unknown
  misc_feature (1)..( 11): Result.002 file - promoters60/1443075
aaaaaagtcaa

SEQ ID NO: 115360 - DNA, 6 bp, Unknown
  misc_feature (1)..( 6): Result.002 file - promoters60/1443075
ttaaaa

SEQ ID NO: 115361 - DNA, 6 bp, Unknown
  misc_feature (1)..( 6): Result.002 file - promoters60/1443075
ttaaaa

SEQ ID NO: 115362 - DNA, 8 bp, Unknown
  misc_feature (1)..( 8): Result.002 file - promoters60/1443075
aacttaca

SEQ ID NO: 115363 - DNA, 8 bp, Unknown
  misc_feature (1)..( 8): Result.002 file - promoters60/1443075
aactgaca

SEQ ID NO: 115364 - DNA, 9 bp, Unknown
  misc_feature (1)..( 9): Result.002 file - promoters60/1443075
ctataatat

SEQ ID NO: 115365 - DNA, 9 bp, Unknown
  misc_feature (1)..( 9): Result.002 file - promoters60/1443075
ctaaaatat

SEQ ID NO: 115366 - DNA, 10 bp, Unknown
  misc_feature (1)..( 10): Result.002 file - promoters60/1443075
aaaaagaatt

SEQ ID NO: 115367 - DNA, 10 bp, Unknown
  misc_feature (1)..( 10): Result.002 file - promoters60/1443075
aaaaagaaaa

SEQ ID NO: 115368 - DNA, 10 bp, Unknown
  misc_feature (1)..( 10): Result.002 file - promoters60/1443075
acgaagaaaa

SEQ ID NO: 115369 - DNA, 6 bp, Unknown
  misc_feature (1)..( 6): Result.002 file - promoters60/1443075
aagaaa

SEQ ID NO: 115370 - DNA, 6 bp, Unknown
  misc_feature (1)..( 6): Result.002 file - promoters60/1443075
aagaaa

SEQ ID NO: 115371 - DNA, 6 bp, Unknown
  misc_feature (1)..( 6): Result.002 file - promoters60/1443075
aaaaaa

SEQ ID NO: 115372 - DNA, 6 bp, Unknown
  misc_feature (1)..( 6): Result.002 file - promoters60/1443075
aaaaaa

SEQ ID NO: 115373 - DNA, 6 bp, Unknown
  misc_feature (1)..( 6): Result.002 file - promoters60/1443075
taaaaa

SEQ ID NO: 115374 - DNA, 6 bp, Unknown
  misc_feature (1)..( 6): Result.002 file - promoters60/1443075
taaaaa

SEQ ID NO: 115375 - DNA, 6 bp, Unknown
  misc_feature (1)..( 6): Result.002 file - promoters60/1443075
taaata

SEQ ID NO: 115376 - DNA, 6 bp, Unknown
  misc_feature (1)..( 6): Result.002 file - promoters60/1443075
taaata

SEQ ID NO: 115377 - DNA, 11 bp, Unknown
  misc_feature (1)..( 11): Result.002 file - promoters60/1443075
taaacaaaatt

SEQ ID NO: 115378 - DNA, 11 bp, Unknown
  misc_feature (1)..( 11): Result.002 file - promoters60/1443075
taaaaaaaatt

SEQ ID NO: 115379 - DNA, 7 bp, Unknown
  misc_feature (1)..( 7): Result.002 file - promoters60/1443075
ttctttc

SEQ ID NO: 115380 - DNA, 7 bp, Unknown
  misc_feature (1)..( 7): Result.002 file - promoters60/1443075
ttcgttc

SEQ ID NO: 115381 - DNA, 8 bp, Unknown
  misc_feature (1)..( 8): Result.002 file - promoters60/1443075
catttatt

SEQ ID NO: 115382 - DNA, 8 bp, Unknown
  misc_feature (1)..( 8): Result.002 file - promoters60/1443075
cattaatt

SEQ ID NO: 115383 - DNA, 6 bp, Unknown
  misc_feature (1)..( 6): Result.002 file - promoters60/1443075
agaaaa

SEQ ID NO: 115384 - DNA, 6 bp, Unknown
  misc_feature (1)..( 6): Result.002 file - promoters60/1443075
agaaaa

SEQ ID NO: 115385 - DNA, 6 bp, Unknown
  misc_feature (1)..( 6): Result.002 file - promoters60/1443075
aaaaac

SEQ ID NO: 115386 - DNA, 6 bp, Unknown
  misc_feature (1)..( 6): Result.002 file - promoters60/1443075
aaaaac

SEQ ID NO: 115387 - DNA, 11 bp, Unknown
  misc_feature (1)..( 11): Result.002 file - promoters60/1443083
attgtaatcat

SEQ ID NO: 115388 - DNA, 11 bp, Unknown
  misc_feature (1)..( 11): Result.002 file - promoters60/1443083
atgttaaacat

SEQ ID NO: 115389 - DNA, 11 bp, Unknown
  misc_feature (1)..( 11): Result.002 file - promoters60/1443083
atggtaatctc

SEQ ID NO: 115390 - DNA, 11 bp, Unknown
  misc_feature (1)..( 11): Result.002 file - promoters60/1443083
ctgttaaacca

SEQ ID NO: 115391 - DNA, 11 bp, Unknown
  misc_feature (1)..( 11): Result.002 file - promoters60/1443083
ctgataattgt

SEQ ID NO: 115392 - DNA, 11 bp, Unknown
  misc_feature (1)..( 11): Result.002 file - promoters60/1443083
gagttgaacaa

SEQ ID NO: 115393 - DNA, 13 bp, Unknown
  misc_feature (1)..( 13): Result.002 file - promoters60/1443083
cagaatatcacat

SEQ ID NO: 115394 - DNA, 13 bp, Unknown
  misc_feature (1)..( 13): Result.002 file - promoters60/1443083
ctttatataacat

SEQ ID NO: 115395 - DNA, 13 bp, Unknown
  misc_feature (1)..( 13): Result.002 file - promoters60/1443083
tagaaaatcatta

SEQ ID NO: 115396 - DNA, 13 bp, Unknown
  misc_feature (1)..( 13): Result.002 file - promoters60/1443083
tagtaaatagtta

SEQ ID NO: 115397 - DNA, 13 bp, Unknown
  misc_feature (1)..( 13): Result.002 file - promoters60/1443083
gatgaaatcatta

SEQ ID NO: 115398 - DNA, 13 bp, Unknown
  misc_feature (1)..( 13): Result.002 file - promoters60/1443083
aattaaatcatct

SEQ ID NO: 115399 - DNA, 10 bp, Unknown
  misc_feature (1)..( 10): Result.002 file - promoters60/1443114
attgtctttt

SEQ ID NO: 115400 - DNA, 10 bp, Unknown
  misc_feature (1)..( 10): Result.002 file - promoters60/1443114
tttgtatttt

SEQ ID NO: 115401 - DNA, 10 bp, Unknown
  misc_feature (1)..( 10): Result.002 file - promoters60/1443114
attgtcttat

SEQ ID NO: 115402 - DNA, 8 bp, Unknown
  misc_feature (1)..( 8): Result.002 file - promoters60/1443114
gaacaaat

SEQ ID NO: 115403 - DNA, 8 bp, Unknown
  misc_feature (1)..( 8): Result.002 file - promoters60/1443114
gaaaaaac

SEQ ID NO: 115404 - DNA, 8 bp, Unknown
  misc_feature (1)..( 8): Result.002 file - promoters60/1443114
tgacaaat

SEQ ID NO: 115405 - DNA, 12 bp, Unknown
  misc_feature (1)..( 12): Result.002 file - promoters60/1443114
ttccagaacaat

SEQ ID NO: 115406 - DNA, 12 bp, Unknown
  misc_feature (1)..( 12): Result.002 file - promoters60/1443114
actaagaataat

SEQ ID NO: 115407 - DNA, 12 bp, Unknown
  misc_feature (1)..( 12): Result.002 file - promoters60/1443114
aaatctaaaaat

SEQ ID NO: 115408 - DNA, 12 bp, Unknown
  misc_feature (1)..( 12): Result.002 file - promoters60/1443114
accactaagcat

SEQ ID NO: 115409 - DNA, 12 bp, Unknown
  misc_feature (1)..( 12): Result.002 file - promoters60/1443114
aaaactaagaat

SEQ ID NO: 115410 - DNA, 12 bp, Unknown
  misc_feature (1)..( 12): Result.002 file - promoters60/1443114
aaatctaaaaat

SEQ ID NO: 115411 - DNA, 11 bp, Unknown
  misc_feature (1)..( 11): Result.002 file - promoters60/1443114
gcaattagtac

SEQ ID NO: 115412 - DNA, 11 bp, Unknown
  misc_feature (1)..( 11): Result.002 file - promoters60/1443114
gcatttaaatt

SEQ ID NO: 115413 - DNA, 11 bp, Unknown
  misc_feature (1)..( 11): Result.002 file - promoters60/1443114
caatttaaatt

SEQ ID NO: 115414 - DNA, 9 bp, Unknown
  misc_feature (1)..( 9): Result.002 file - promoters60/1443114
aatttattc

SEQ ID NO: 115415 - DNA, 9 bp, Unknown
  misc_feature (1)..( 9): Result.002 file - promoters60/1443114
catttatca

SEQ ID NO: 115416 - DNA, 9 bp, Unknown
  misc_feature (1)..( 9): Result.002 file - promoters60/1443114
cattaatca

SEQ ID NO: 115417 - DNA, 12 bp, Unknown
  misc_feature (1)..( 12): Result.002 file - promoters60/1443114
agaaaaaacaga

SEQ ID NO: 115418 - DNA, 12 bp, Unknown
  misc_feature (1)..( 12): Result.002 file - promoters60/1443114
agaaaaaagtaa

SEQ ID NO: 115419 - DNA, 12 bp, Unknown
  misc_feature (1)..( 12): Result.002 file - promoters60/1443114
acaaaaatgtaa

SEQ ID NO: 115420 - DNA, 12 bp, Unknown
  misc_feature (1)..( 12): Result.002 file - promoters60/1443114
aaaaatggctat

SEQ ID NO: 115421 - DNA, 12 bp, Unknown
  misc_feature (1)..( 12): Result.002 file - promoters60/1443114
aaaaatttattc

SEQ ID NO: 115422 - DNA, 12 bp, Unknown
  misc_feature (1)..( 12): Result.002 file - promoters60/1443114
aaaactaagaat

SEQ ID NO: 115423 - DNA, 11 bp, Unknown
  misc_feature (1)..( 11): Result.002 file - promoters60/1443184
ataatttgagt

SEQ ID NO: 115424 - DNA, 11 bp, Unknown
  misc_feature (1)..( 11): Result.002 file - promoters60/1443184
atatttttagt

SEQ ID NO: 115425 - DNA, 11 bp, Unknown
  misc_feature (1)..( 11): Result.002 file - promoters60/1443184
caaatgtgatt

SEQ ID NO: 115426 - DNA, 8 bp, Unknown
  misc_feature (1)..( 8): Result.002 file - promoters60/1443184
aggaggaa

SEQ ID NO: 115427 - DNA, 8 bp, Unknown
  misc_feature (1)..( 8): Result.002 file - promoters60/1443184
aggaggaa

SEQ ID NO: 115428 - DNA, 8 bp, Unknown
  misc_feature (1)..( 8): Result.002 file - promoters60/1443184
tggaggat

SEQ ID NO: 115429 - DNA, 8 bp, Unknown
  misc_feature (1)..( 8): Result.002 file - promoters60/1443184
gttacaaa

SEQ ID NO: 115430 - DNA, 8 bp, Unknown
  misc_feature (1)..( 8): Result.002 file - promoters60/1443184
gttacaac

SEQ ID NO: 115431 - DNA, 8 bp, Unknown
  misc_feature (1)..( 8): Result.002 file - promoters60/1443184
gttataac

SEQ ID NO: 115432 - DNA, 10 bp, Unknown
  misc_feature (1)..( 10): Result.002 file - promoters60/1443184
aatatataca

SEQ ID NO: 115433 - DNA, 10 bp, Unknown
  misc_feature (1)..( 10): Result.002 file - promoters60/1443184
aatttatcaa

SEQ ID NO: 115434 - DNA, 10 bp, Unknown
  misc_feature (1)..( 10): Result.002 file - promoters60/1443184
agtttatttt

SEQ ID NO: 115435 - DNA, 11 bp, Unknown
  misc_feature (1)..( 11): Result.002 file - promoters60/1443184
agagaaaggat

SEQ ID NO: 115436 - DNA, 11 bp, Unknown
  misc_feature (1)..( 11): Result.002 file - promoters60/1443184
agaaaaattgt

SEQ ID NO: 115437 - DNA, 11 bp, Unknown
  misc_feature (1)..( 11): Result.002 file - promoters60/1443184
aaacaaagatt

SEQ ID NO: 115438 - DNA, 9 bp, Unknown
  misc_feature (1)..( 9): Result.002 file - promoters60/1443184
atctataaa

SEQ ID NO: 115439 - DNA, 9 bp, Unknown
  misc_feature (1)..( 9): Result.002 file - promoters60/1443184
atatataaa

SEQ ID NO: 115440 - DNA, 9 bp, Unknown
  misc_feature (1)..( 9): Result.002 file - promoters60/1443184
ccttataaa

SEQ ID NO: 115441 - DNA, 9 bp, Unknown
  misc_feature (1)..( 9): Result.002 file - promoters60/1443184
ccttttaaa

SEQ ID NO: 115442 - DNA, 18 bp, Unknown
  misc_feature (1)..( 18): Result.002 file - promoters60/1443192
aaaaattattaaagtata

SEQ ID NO: 115443 - DNA, 18 bp, Unknown
  misc_feature (1)..( 18): Result.002 file - promoters60/1443192
aaagattattaaattata

SEQ ID NO: 115444 - DNA, 18 bp, Unknown
  misc_feature (1)..( 18): Result.002 file - promoters60/1443192
tctcatttttaatcaaaa

SEQ ID NO: 115445 - DNA, 18 bp, Unknown
  misc_feature (1)..( 18): Result.002 file - promoters60/1443192
aaaatttatctgtaaatg

SEQ ID NO: 115446 - DNA, 9 bp, Unknown
  misc_feature (1)..( 9): Result.002 file - promoters60/1443192
ttactaata

SEQ ID NO: 115447 - DNA, 9 bp, Unknown
  misc_feature (1)..( 9): Result.002 file - promoters60/1443192
ttattaaag

SEQ ID NO: 115448 - DNA, 9 bp, Unknown
  misc_feature (1)..( 9): Result.002 file - promoters60/1443192
ataccaatc

SEQ ID NO: 115449 - DNA, 9 bp, Unknown
  misc_feature (1)..( 9): Result.002 file - promoters60/1443192
ataataatt

SEQ ID NO: 115450 - DNA, 13 bp, Unknown
  misc_feature (1)..( 13): Result.002 file - promoters60/1443192
ataattttagaga

SEQ ID NO: 115451 - DNA, 13 bp, Unknown
  misc_feature (1)..( 13): Result.002 file - promoters60/1443192
ctaattttaattt

SEQ ID NO: 115452 - DNA, 13 bp, Unknown
  misc_feature (1)..( 13): Result.002 file - promoters60/1443192
ataattatttggt

SEQ ID NO: 115453 - DNA, 13 bp, Unknown
  misc_feature (1)..( 13): Result.002 file - promoters60/1443192
atcattttcattt

SEQ ID NO: 115454 - DNA, 7 bp, Unknown
  misc_feature (1)..( 7): Result.002 file - promoters60/1443192
attttac

SEQ ID NO: 115455 - DNA, 7 bp, Unknown
  misc_feature (1)..( 7): Result.002 file - promoters60/1443192
attttag

SEQ ID NO: 115456 - DNA, 7 bp, Unknown
  misc_feature (1)..( 7): Result.002 file - promoters60/1443192
tttttac

SEQ ID NO: 115457 - DNA, 10 bp, Unknown
  misc_feature (1)..( 10): Result.002 file - promoters60/1443192
ctatatatat

SEQ ID NO: 115458 - DNA, 10 bp, Unknown
  misc_feature (1)..( 10): Result.002 file - promoters60/1443192
ttatttatat

SEQ ID NO: 115459 - DNA, 10 bp, Unknown
  misc_feature (1)..( 10): Result.002 file - promoters60/1443192
ctatataaac

SEQ ID NO: 115460 - DNA, 10 bp, Unknown
  misc_feature (1)..( 10): Result.002 file - promoters60/1443192
gtctataaat

SEQ ID NO: 115461 - DNA, 7 bp, Unknown
  misc_feature (1)..( 7): Result.002 file - promoters60/1443192
aatttta

SEQ ID NO: 115462 - DNA, 7 bp, Unknown
  misc_feature (1)..( 7): Result.002 file - promoters60/1443192
aattttt

SEQ ID NO: 115463 - DNA, 7 bp, Unknown
  misc_feature (1)..( 7): Result.002 file - promoters60/1443192
aatgtta

SEQ ID NO: 115464 - DNA, 8 bp, Unknown
  misc_feature (1)..( 8): Result.002 file - promoters60/1443192
taatagaa

SEQ ID NO: 115465 - DNA, 8 bp, Unknown
  misc_feature (1)..( 8): Result.002 file - promoters60/1443192
taattgaa

SEQ ID NO: 115466 - DNA, 8 bp, Unknown
  misc_feature (1)..( 8): Result.002 file - promoters60/1443192
aaattatt

SEQ ID NO: 115467 - DNA, 7 bp, Unknown
  misc_feature (1)..( 7): Result.002 file - promoters60/1443192
gaaaaat

SEQ ID NO: 115468 - DNA, 7 bp, Unknown
  misc_feature (1)..( 7): Result.002 file - promoters60/1443192
gaaaaaa

SEQ ID NO: 115469 - DNA, 7 bp, Unknown
  misc_feature (1)..( 7): Result.002 file - promoters60/1443192
taaaaat

SEQ ID NO: 115470 - DNA, 9 bp, Unknown
  misc_feature (1)..( 9): Result.002 file - promoters60/1443256
aatttttgt

SEQ ID NO: 115471 - DNA, 9 bp, Unknown
  misc_feature (1)..( 9): Result.002 file - promoters60/1443256
cattattga

SEQ ID NO: 115472 - DNA, 9 bp, Unknown
  misc_feature (1)..( 9): Result.002 file - promoters60/1443256
atttactga

SEQ ID NO: 115473 - DNA, 9 bp, Unknown
  misc_feature (1)..( 9): Result.002 file - promoters60/1443256
cattataac

SEQ ID NO: 115474 - DNA, 10 bp, Unknown
  misc_feature (1)..( 10): Result.002 file - promoters60/1443271
aaaatatata

SEQ ID NO: 115475 - DNA, 10 bp, Unknown
  misc_feature (1)..( 10): Result.002 file - promoters60/1443271
aaactatata

SEQ ID NO: 115476 - DNA, 9 bp, Unknown
  misc_feature (1)..( 9): Result.002 file - promoters60/1443271
ccataaaaa

SEQ ID NO: 115477 - DNA, 9 bp, Unknown
  misc_feature (1)..( 9): Result.002 file - promoters60/1443271
cggtaaaaa

SEQ ID NO: 115478 - DNA, 9 bp, Unknown
  misc_feature (1)..( 9): Result.002 file - promoters60/1443271
cattaaatc

SEQ ID NO: 115479 - DNA, 7 bp, Unknown
  misc_feature (1)..( 7): Result.002 file - promoters60/1443271
aaaatat

SEQ ID NO: 115480 - DNA, 7 bp, Unknown
  misc_feature (1)..( 7): Result.002 file - promoters60/1443271
aaactat

SEQ ID NO: 115481 - DNA, 8 bp, Unknown
  misc_feature (1)..( 8): Result.002 file - promoters60/1443271
attttttt

SEQ ID NO: 115482 - DNA, 8 bp, Unknown
  misc_feature (1)..( 8): Result.002 file - promoters60/1443271
atttcttt

SEQ ID NO: 115483 - DNA, 8 bp, Unknown
  misc_feature (1)..( 8): Result.002 file - promoters60/1443271
tgtttttc

SEQ ID NO: 115484 - DNA, 8 bp, Unknown
  misc_feature (1)..( 8): Result.002 file - promoters60/1443271
tgttttta

SEQ ID NO: 115485 - DNA, 8 bp, Unknown
  misc_feature (1)..( 8): Result.002 file - promoters60/1443271
tctttttc

SEQ ID NO: 115486 - DNA, 7 bp, Unknown
  misc_feature (1)..( 7): Result.002 file - promoters60/1443271
tttaaag

SEQ ID NO: 115487 - DNA, 7 bp, Unknown
  misc_feature (1)..( 7): Result.002 file - promoters60/1443271
tttaaag

SEQ ID NO: 115488 - DNA, 6 bp, Unknown
  misc_feature (1)..( 6): Result.002 file - promoters60/1443271
aaacca

SEQ ID NO: 115489 - DNA, 6 bp, Unknown
  misc_feature (1)..( 6): Result.002 file - promoters60/1443271
aaacca

SEQ ID NO: 115490 - DNA, 7 bp, Unknown
  misc_feature (1)..( 7): Result.002 file - promoters60/1443271
tttattg

SEQ ID NO: 115491 - DNA, 7 bp, Unknown
  misc_feature (1)..( 7): Result.002 file - promoters60/1443271
tttattg

SEQ ID NO: 115492 - DNA, 9 bp, Unknown
  misc_feature (1)..( 9): Result.002 file - promoters60/1443271
tgtataagc

SEQ ID NO: 115493 - DNA, 9 bp, Unknown
  misc_feature (1)..( 9): Result.002 file - promoters60/1443271
tgtataagc

SEQ ID NO: 115494 - DNA, 8 bp, Unknown
  misc_feature (1)..( 8): Result.002 file - promoters60/1443271
aaaaatta

SEQ ID NO: 115495 - DNA, 8 bp, Unknown
  misc_feature (1)..( 8): Result.002 file - promoters60/1443271
aaaaatta

SEQ ID NO: 115496 - DNA, 8 bp, Unknown
  misc_feature (1)..( 8): Result.002 file - promoters60/1443271
aaacatta

SEQ ID NO: 115497 - DNA, 6 bp, Unknown
  misc_feature (1)..( 6): Result.002 file - promoters60/1443271
gttaaa

SEQ ID NO: 115498 - DNA, 6 bp, Unknown
  misc_feature (1)..( 6): Result.002 file - promoters60/1443271
gttaaa

SEQ ID NO: 115499 - DNA, 6 bp, Unknown
  misc_feature (1)..( 6): Result.002 file - promoters60/1443271
tgaaat

SEQ ID NO: 115500 - DNA, 6 bp, Unknown
  misc_feature (1)..( 6): Result.002 file - promoters60/1443271
tgaaat

SEQ ID NO: 115501 - DNA, 8 bp, Unknown
  misc_feature (1)..( 8): Result.002 file - promoters60/1443271
ttttgttt

SEQ ID NO: 115502 - DNA, 8 bp, Unknown
  misc_feature (1)..( 8): Result.002 file - promoters60/1443271
ttttattt

SEQ ID NO: 115503 - DNA, 6 bp, Unknown
  misc_feature (1)..( 6): Result.002 file - promoters60/1443271
tttaaa

SEQ ID NO: 115504 - DNA, 6 bp, Unknown
  misc_feature (1)..( 6): Result.002 file - promoters60/1443271
tttaaa

SEQ ID NO: 115505 - DNA, 7 bp, Unknown
  misc_feature (1)..( 7): Result.002 file - promoters60/1443271
tctcaat

SEQ ID NO: 115506 - DNA, 7 bp, Unknown
  misc_feature (1)..( 7): Result.002 file - promoters60/1443271
tcttaat

SEQ ID NO: 115507 - DNA, 9 bp, Unknown
  misc_feature (1)..( 9): Result.002 file - promoters60/1443271
ttttaattt

SEQ ID NO: 115508 - DNA, 9 bp, Unknown
  misc_feature (1)..( 9): Result.002 file - promoters60/1443271
gtttaattt

SEQ ID NO: 115509 - DNA, 9 bp, Unknown
  misc_feature (1)..( 9): Result.002 file - promoters60/1443271
gtttaaacc

SEQ ID NO: 115510 - DNA, 6 bp, Unknown
  misc_feature (1)..( 6): Result.002 file - promoters60/1443271
ttaatt

SEQ ID NO: 115511 - DNA, 6 bp, Unknown
  misc_feature (1)..( 6): Result.002 file - promoters60/1443271
ttaatt

SEQ ID NO: 115512 - DNA, 6 bp, Unknown
  misc_feature (1)..( 6): Result.002 file - promoters60/1443271
atcact

SEQ ID NO: 115513 - DNA, 6 bp, Unknown
  misc_feature (1)..( 6): Result.002 file - promoters60/1443271
atcact

SEQ ID NO: 115514 - DNA, 9 bp, Unknown
  misc_feature (1)..( 9): Result.002 file - promoters60/1443271
caaatatat

SEQ ID NO: 115515 - DNA, 9 bp, Unknown
  misc_feature (1)..( 9): Result.002 file - promoters60/1443271
caaatatat

SEQ ID NO: 115516 - DNA, 7 bp, Unknown
  misc_feature (1)..( 7): Result.002 file - promoters60/1443271
tgtggat

SEQ ID NO: 115517 - DNA, 7 bp, Unknown
  misc_feature (1)..( 7): Result.002 file - promoters60/1443271
tgtagat

SEQ ID NO: 115518 - DNA, 8 bp, Unknown
  misc_feature (1)..( 8): Result.002 file - promoters60/1443271
aatcttat

SEQ ID NO: 115519 - DNA, 8 bp, Unknown
  misc_feature (1)..( 8): Result.002 file - promoters60/1443271
aattttat

SEQ ID NO: 115520 - DNA, 6 bp, Unknown
  misc_feature (1)..( 6): Result.002 file - promoters60/1443271
ctatta

SEQ ID NO: 115521 - DNA, 6 bp, Unknown
  misc_feature (1)..( 6): Result.002 file - promoters60/1443271
ctatta

SEQ ID NO: 115522 - DNA, 9 bp, Unknown
  misc_feature (1)..( 9): Result.002 file - promoters60/1443271
ccatatata

SEQ ID NO: 115523 - DNA, 9 bp, Unknown
  misc_feature (1)..( 9): Result.002 file - promoters60/1443271
ccatctata

SEQ ID NO: 115524 - DNA, 9 bp, Unknown
  misc_feature (1)..( 9): Result.002 file - promoters60/1443276
aatttaata

SEQ ID NO: 115525 - DNA, 9 bp, Unknown
  misc_feature (1)..( 9): Result.002 file - promoters60/1443276
catttaatg

SEQ ID NO: 115526 - DNA, 9 bp, Unknown
  misc_feature (1)..( 9): Result.002 file - promoters60/1443276
aatttaata

SEQ ID NO: 115527 - DNA, 7 bp, Unknown
  misc_feature (1)..( 7): Result.002 file - promoters60/1443276
atgaacg

SEQ ID NO: 115528 - DNA, 7 bp, Unknown
  misc_feature (1)..( 7): Result.002 file - promoters60/1443276
atgaacg

SEQ ID NO: 115529 - DNA, 6 bp, Unknown
  misc_feature (1)..( 6): Result.002 file - promoters60/1443276
caacga

SEQ ID NO: 115530 - DNA, 6 bp, Unknown
  misc_feature (1)..( 6): Result.002 file - promoters60/1443276
caacga

SEQ ID NO: 115531 - DNA, 6 bp, Unknown
  misc_feature (1)..( 6): Result.002 file - promoters60/1443276
ttgata

SEQ ID NO: 115532 - DNA, 6 bp, Unknown
  misc_feature (1)..( 6): Result.002 file - promoters60/1443276
ttgata

SEQ ID NO: 115533 - DNA, 8 bp, Unknown
  misc_feature (1)..( 8): Result.002 file - promoters60/1443276
aaaaggaa

SEQ ID NO: 115534 - DNA, 8 bp, Unknown
  misc_feature (1)..( 8): Result.002 file - promoters60/1443276
aaatggaa

SEQ ID NO: 115535 - DNA, 7 bp, Unknown
  misc_feature (1)..( 7): Result.002 file - promoters60/1443276
tttgtgt

SEQ ID NO: 115536 - DNA, 7 bp, Unknown
  misc_feature (1)..( 7): Result.002 file - promoters60/1443276
tttttgt

SEQ ID NO: 115537 - DNA, 10 bp, Unknown
  misc_feature (1)..( 10): Result.002 file - promoters60/1443276
cgttattatg

SEQ ID NO: 115538 - DNA, 10 bp, Unknown
  misc_feature (1)..( 10): Result.002 file - promoters60/1443276
aaatattatt

SEQ ID NO: 115539 - DNA, 10 bp, Unknown
  misc_feature (1)..( 10): Result.002 file - promoters60/1443276
aaataatatt

SEQ ID NO: 115540 - DNA, 7 bp, Unknown
  misc_feature (1)..( 7): Result.002 file - promoters60/1443276
cgacttg

SEQ ID NO: 115541 - DNA, 7 bp, Unknown
  misc_feature (1)..( 7): Result.002 file - promoters60/1443276
cgaattg

SEQ ID NO: 115542 - DNA, 7 bp, Unknown
  misc_feature (1)..( 7): Result.002 file - promoters60/1443276
ataaaac

SEQ ID NO: 115543 - DNA, 7 bp, Unknown
  misc_feature (1)..( 7): Result.002 file - promoters60/1443276
atacaac

SEQ ID NO: 115544 - DNA, 6 bp, Unknown
  misc_feature (1)..( 6): Result.002 file - promoters60/1443276
accaaa

SEQ ID NO: 115545 - DNA, 6 bp, Unknown
  misc_feature (1)..( 6): Result.002 file - promoters60/1443276
accaaa

SEQ ID NO: 115546 - DNA, 9 bp, Unknown
  misc_feature (1)..( 9): Result.002 file - promoters60/1443276
gactaaaag

SEQ ID NO: 115547 - DNA, 9 bp, Unknown
  misc_feature (1)..( 9): Result.002 file - promoters60/1443276
gactataag

SEQ ID NO: 115548 - DNA, 6 bp, Unknown
  misc_feature (1)..( 6): Result.002 file - promoters60/1443276
aagtct

SEQ ID NO: 115549 - DNA, 6 bp, Unknown
  misc_feature (1)..( 6): Result.002 file - promoters60/1443276
aagtct

SEQ ID NO: 115550 - DNA, 8 bp, Unknown
  misc_feature (1)..( 8): Result.002 file - promoters60/1443276
tcaataaa

SEQ ID NO: 115551 - DNA, 8 bp, Unknown
  misc_feature (1)..( 8): Result.002 file - promoters60/1443276
tcattaaa

SEQ ID NO: 115552 - DNA, 6 bp, Unknown
  misc_feature (1)..( 6): Result.002 file - promoters60/1443276
aaaaaa

SEQ ID NO: 115553 - DNA, 6 bp, Unknown
  misc_feature (1)..( 6): Result.002 file - promoters60/1443276
aaaaaa

SEQ ID NO: 115554 - DNA, 6 bp, Unknown
  misc_feature (1)..( 6): Result.002 file - promoters60/1443276
aaaaat

SEQ ID NO: 115555 - DNA, 6 bp, Unknown
  misc_feature (1)..( 6): Result.002 file - promoters60/1443276
aaaaat

SEQ ID NO: 115556 - DNA, 6 bp, Unknown
  misc_feature (1)..( 6): Result.002 file - promoters60/1443276
gaagac

SEQ ID NO: 115557 - DNA, 6 bp, Unknown
  misc_feature (1)..( 6): Result.002 file - promoters60/1443276
gaagac

SEQ ID NO: 115558 - DNA, 6 bp, Unknown
  misc_feature (1)..( 6): Result.002 file - promoters60/1443276
aaataa

SEQ ID NO: 115559 - DNA, 6 bp, Unknown
  misc_feature (1)..( 6): Result.002 file - promoters60/1443276
aaataa

SEQ ID NO: 115560 - DNA, 9 bp, Unknown
  misc_feature (1)..( 9): Result.002 file - promoters60/1443276
agcatttaa

SEQ ID NO: 115561 - DNA, 9 bp, Unknown
  misc_feature (1)..( 9): Result.002 file - promoters60/1443276
agcttttaa

SEQ ID NO: 115562 - DNA, 8 bp, Unknown
  misc_feature (1)..( 8): Result.002 file - promoters60/1443276
tataaaaa

SEQ ID NO: 115563 - DNA, 8 bp, Unknown
  misc_feature (1)..( 8): Result.002 file - promoters60/1443276
tatataaa

SEQ ID NO: 115564 - DNA, 8 bp, Unknown
  misc_feature (1)..( 8): Result.002 file - promoters60/1443306
tttttaat

SEQ ID NO: 115565 - DNA, 8 bp, Unknown
  misc_feature (1)..( 8): Result.002 file - promoters60/1443306
tttgtaat

SEQ ID NO: 115566 - DNA, 8 bp, Unknown
  misc_feature (1)..( 8): Result.002 file - promoters60/1443306
tttgtaac

SEQ ID NO: 115567 - DNA, 12 bp, Unknown
  misc_feature (1)..( 12): Result.002 file - promoters60/1443306
taagatattttt

SEQ ID NO: 115568 - DNA, 12 bp, Unknown
  misc_feature (1)..( 12): Result.002 file - promoters60/1443306
aaaaatatattt

SEQ ID NO: 115569 - DNA, 12 bp, Unknown
  misc_feature (1)..( 12): Result.002 file - promoters60/1443306
taaaatacttta

SEQ ID NO: 115570 - DNA, 7 bp, Unknown
  misc_feature (1)..( 7): Result.002 file - promoters60/1443306
tttattt

SEQ ID NO: 115571 - DNA, 7 bp, Unknown
  misc_feature (1)..( 7): Result.002 file - promoters60/1443306
tttcttt

SEQ ID NO: 115572 - DNA, 7 bp, Unknown
  misc_feature (1)..( 7): Result.002 file - promoters60/1443306
ttcattt

SEQ ID NO: 115573 - DNA, 7 bp, Unknown
  misc_feature (1)..( 7): Result.002 file - promoters60/1443306
cataaac

SEQ ID NO: 115574 - DNA, 7 bp, Unknown
  misc_feature (1)..( 7): Result.002 file - promoters60/1443306
cataaat

SEQ ID NO: 115575 - DNA, 7 bp, Unknown
  misc_feature (1)..( 7): Result.002 file - promoters60/1443306
cataaac

SEQ ID NO: 115576 - DNA, 12 bp, Unknown
  misc_feature (1)..( 12): Result.002 file - promoters60/1443306
ttcatataaata

SEQ ID NO: 115577 - DNA, 12 bp, Unknown
  misc_feature (1)..( 12): Result.002 file - promoters60/1443306
taactataaata

SEQ ID NO: 115578 - DNA, 12 bp, Unknown
  misc_feature (1)..( 12): Result.002 file - promoters60/1443306
tatatataaata

SEQ ID NO: 115579 - DNA, 12 bp, Unknown
  misc_feature (1)..( 12): Result.002 file - promoters60/1443306
aatctataaaaa

SEQ ID NO: 115580 - DNA, 11 bp, Unknown
  misc_feature (1)..( 11): Result.002 file - promoters60/1443306
tcaattttttt

SEQ ID NO: 115581 - DNA, 11 bp, Unknown
  misc_feature (1)..( 11): Result.002 file - promoters60/1443306
ctaattttagc

SEQ ID NO: 115582 - DNA, 11 bp, Unknown
  misc_feature (1)..( 11): Result.002 file - promoters60/1443306
attatttttac

SEQ ID NO: 115583 - DNA, 9 bp, Unknown
  misc_feature (1)..( 9): Result.002 file - promoters60/1443338
aattacaat

SEQ ID NO: 115584 - DNA, 9 bp, Unknown
  misc_feature (1)..( 9): Result.002 file - promoters60/1443338
tcttataat

SEQ ID NO: 115585 - DNA, 9 bp, Unknown
  misc_feature (1)..( 9): Result.002 file - promoters60/1443338
tcttataaa

SEQ ID NO: 115586 - DNA, 7 bp, Unknown
  misc_feature (1)..( 7): Result.002 file - promoters60/1443338
acatcaa

SEQ ID NO: 115587 - DNA, 7 bp, Unknown
  misc_feature (1)..( 7): Result.002 file - promoters60/1443338
acaccaa

SEQ ID NO: 115588 - DNA, 8 bp, Unknown
  misc_feature (1)..( 8): Result.002 file - promoters60/1443338
acttatat

SEQ ID NO: 115589 - DNA, 8 bp, Unknown
  misc_feature (1)..( 8): Result.002 file - promoters60/1443338
tcttataa

SEQ ID NO: 115590 - DNA, 8 bp, Unknown
  misc_feature (1)..( 8): Result.002 file - promoters60/1443338
tcttataa

SEQ ID NO: 115591 - DNA, 8 bp, Unknown
  misc_feature (1)..( 8): Result.002 file - promoters60/1443338
aaaacaca

SEQ ID NO: 115592 - DNA, 8 bp, Unknown
  misc_feature (1)..( 8): Result.002 file - promoters60/1443338
aaaacaca

SEQ ID NO: 115593 - DNA, 8 bp, Unknown
  misc_feature (1)..( 8): Result.002 file - promoters60/1443338
caagcttt

SEQ ID NO: 115594 - DNA, 8 bp, Unknown
  misc_feature (1)..( 8): Result.002 file - promoters60/1443338
caaacttt

SEQ ID NO: 115595 - DNA, 6 bp, Unknown
  misc_feature (1)..( 6): Result.002 file - promoters60/1443338
aatatt

SEQ ID NO: 115596 - DNA, 6 bp, Unknown
  misc_feature (1)..( 6): Result.002 file - promoters60/1443338
aatatt

SEQ ID NO: 115597 - DNA, 6 bp, Unknown
  misc_feature (1)..( 6): Result.002 file - promoters60/1443338
atcaaa

SEQ ID NO: 115598 - DNA, 6 bp, Unknown
  misc_feature (1)..( 6): Result.002 file - promoters60/1443338
atcaaa

SEQ ID NO: 115599 - DNA, 7 bp, Unknown
  misc_feature (1)..( 7): Result.002 file - promoters60/1443338
caaatcc

SEQ ID NO: 115600 - DNA, 7 bp, Unknown
  misc_feature (1)..( 7): Result.002 file - promoters60/1443338
caagtcc

SEQ ID NO: 115601 - DNA, 7 bp, Unknown
  misc_feature (1)..( 7): Result.002 file - promoters60/1443338
cacaaga

SEQ ID NO: 115602 - DNA, 7 bp, Unknown
  misc_feature (1)..( 7): Result.002 file - promoters60/1443338
cacgaga

SEQ ID NO: 115603 - DNA, 8 bp, Unknown
  misc_feature (1)..( 8): Result.002 file - promoters60/1443338
ctcgcttc

SEQ ID NO: 115604 - DNA, 8 bp, Unknown
  misc_feature (1)..( 8): Result.002 file - promoters60/1443338
ctcgcttc

SEQ ID NO: 115605 - DNA, 8 bp, Unknown
  misc_feature (1)..( 8): Result.002 file - promoters60/1443338
cttctcga

SEQ ID NO: 115606 - DNA, 8 bp, Unknown
  misc_feature (1)..( 8): Result.002 file - promoters60/1443338
cttctcga

SEQ ID NO: 115607 - DNA, 14 bp, Unknown
  misc_feature (1)..( 14): Result.002 file - promoters60/1443349
tgcattagttcttc

SEQ ID NO: 115608 - DNA, 14 bp, Unknown
  misc_feature (1)..( 14): Result.002 file - promoters60/1443349
taaatttgttatgt

SEQ ID NO: 115609 - DNA, 14 bp, Unknown
  misc_feature (1)..( 14): Result.002 file - promoters60/1443349
gttattagttaacc

SEQ ID NO: 115610 - DNA, 14 bp, Unknown
  misc_feature (1)..( 14): Result.002 file - promoters60/1443349
taaattttttaaaa

SEQ ID NO: 115611 - DNA, 14 bp, Unknown
  misc_feature (1)..( 14): Result.002 file - promoters60/1443349
tatacgttttaaaa

SEQ ID NO: 115612 - DNA, 14 bp, Unknown
  misc_feature (1)..( 14): Result.002 file - promoters60/1443349
gaaatttcctcgct

SEQ ID NO: 115613 - DNA, 12 bp, Unknown
  misc_feature (1)..( 12): Result.002 file - promoters60/1443349
ttttgaagaatt

SEQ ID NO: 115614 - DNA, 12 bp, Unknown
  misc_feature (1)..( 12): Result.002 file - promoters60/1443349
ggtttaagcatt

SEQ ID NO: 115615 - DNA, 12 bp, Unknown
  misc_feature (1)..( 12): Result.002 file - promoters60/1443349
ttttgatgaatg

SEQ ID NO: 115616 - DNA, 12 bp, Unknown
  misc_feature (1)..( 12): Result.002 file - promoters60/1443349
tgatgaagaagg

SEQ ID NO: 115617 - DNA, 12 bp, Unknown
  misc_feature (1)..( 12): Result.002 file - promoters60/1443349
atttgctgaata

SEQ ID NO: 115618 - DNA, 12 bp, Unknown
  misc_feature (1)..( 12): Result.002 file - promoters60/1443349
aaaagatgaagt

SEQ ID NO: 115619 - DNA, 12 bp, Unknown
  misc_feature (1)..( 12): Result.002 file - promoters60/1443349
tttcgatgtata

SEQ ID NO: 115620 - DNA, 19 bp, Unknown
  misc_feature (1)..( 19): Result.002 file - promoters60/1443349
atttccataaaaatgttag

SEQ ID NO: 115621 - DNA, 19 bp, Unknown
  misc_feature (1)..( 19): Result.002 file - promoters60/1443349
gaagaaatataaatacgac

SEQ ID NO: 115622 - DNA, 19 bp, Unknown
  misc_feature (1)..( 19): Result.002 file - promoters60/1443349
attttcataaattttaaaa

SEQ ID NO: 115623 - DNA, 19 bp, Unknown
  misc_feature (1)..( 19): Result.002 file - promoters60/1443349
aatttcatccttattttct

SEQ ID NO: 115624 - DNA, 19 bp, Unknown
  misc_feature (1)..( 19): Result.002 file - promoters60/1443349
tttaaaatatatggatagt

SEQ ID NO: 115625 - DNA, 19 bp, Unknown
  misc_feature (1)..( 19): Result.002 file - promoters60/1443349
tgagaaatagatttgaaaa

SEQ ID NO: 115626 - DNA, 19 bp, Unknown
  misc_feature (1)..( 19): Result.002 file - promoters60/1443349
aagcccagaaaaagctgat

SEQ ID NO: 115627 - DNA, 19 bp, Unknown
  misc_feature (1)..( 19): Result.002 file - promoters60/1443349
gataggaaaaagttgttac

SEQ ID NO: 115628 - DNA, 19 bp, Unknown
  misc_feature (1)..( 19): Result.002 file - promoters60/1443349
aaaaaaaaaaagagaagaa

SEQ ID NO: 115629 - DNA, 19 bp, Unknown
  misc_feature (1)..( 19): Result.002 file - promoters60/1443349
gcccagaaaaagctgattg

SEQ ID NO: 115630 - DNA, 19 bp, Unknown
  misc_feature (1)..( 19): Result.002 file - promoters60/1443349
gatttgaaaaacagacaac

SEQ ID NO: 115631 - DNA, 19 bp, Unknown
  misc_feature (1)..( 19): Result.002 file - promoters60/1443349
gatagtaaaaaaagagatc

SEQ ID NO: 115632 - DNA, 19 bp, Unknown
  misc_feature (1)..( 19): Result.002 file - promoters60/1443349
attttcataaattttaaaa

SEQ ID NO: 115633 - DNA, 13 bp, Unknown
  misc_feature (1)..( 13): Result.002 file - promoters60/1443349
ctcttatataaac

SEQ ID NO: 115634 - DNA, 13 bp, Unknown
  misc_feature (1)..( 13): Result.002 file - promoters60/1443349
ctcttatatataa

SEQ ID NO: 115635 - DNA, 13 bp, Unknown
  misc_feature (1)..( 13): Result.002 file - promoters60/1443349
agtatatataata

SEQ ID NO: 115636 - DNA, 13 bp, Unknown
  misc_feature (1)..( 13): Result.002 file - promoters60/1443349
acagtatataaac

SEQ ID NO: 115637 - DNA, 13 bp, Unknown
  misc_feature (1)..( 13): Result.002 file - promoters60/1443349
cttgtatataaat

SEQ ID NO: 115638 - DNA, 13 bp, Unknown
  misc_feature (1)..( 13): Result.002 file - promoters60/1443349
acgataaatatcc

SEQ ID NO: 115639 - DNA, 13 bp, Unknown
  misc_feature (1)..( 13): Result.002 file - promoters60/1443349
tttataaataaaa

SEQ ID NO: 115640 - DNA, 19 bp, Unknown
  misc_feature (1)..( 19): Result.002 file - promoters60/1443349
ataaaaatgttagatagga

SEQ ID NO: 115641 - DNA, 19 bp, Unknown
  misc_feature (1)..( 19): Result.002 file - promoters60/1443349
tcataaattttaaaattat

SEQ ID NO: 115642 - DNA, 19 bp, Unknown
  misc_feature (1)..( 19): Result.002 file - promoters60/1443349
tgttaaatatgaatattac

SEQ ID NO: 115643 - DNA, 20 bp, Unknown
  misc_feature (1)..( 20): Result.002 file - promoters60/1443349
atgtaaattttgaaataatt

SEQ ID NO: 115644 - DNA, 20 bp, Unknown
  misc_feature (1)..( 20): Result.002 file - promoters60/1443349
tgagaaatagatttgaaaaa

SEQ ID NO: 115645 - DNA, 20 bp, Unknown
  misc_feature (1)..( 20): Result.002 file - promoters60/1443349
ttttaaattttttaaaatat

SEQ ID NO: 115646 - DNA, 20 bp, Unknown
  misc_feature (1)..( 20): Result.002 file - promoters60/1443349
aaaaaaaaagagaagaaaaa

SEQ ID NO: 115647 - DNA, 9 bp, Unknown
  misc_feature (1)..( 9): Result.002 file - promoters60/1443349
cattaaagt

SEQ ID NO: 115648 - DNA, 9 bp, Unknown
  misc_feature (1)..( 9): Result.002 file - promoters60/1443349
aattcaagc

SEQ ID NO: 115649 - DNA, 9 bp, Unknown
  misc_feature (1)..( 9): Result.002 file - promoters60/1443349
cattaataa

SEQ ID NO: 115650 - DNA, 9 bp, Unknown
  misc_feature (1)..( 9): Result.002 file - promoters60/1443349
gatttatac

SEQ ID NO: 115651 - DNA, 9 bp, Unknown
  misc_feature (1)..( 9): Result.002 file - promoters60/1443349
aattaataa

SEQ ID NO: 115652 - DNA, 9 bp, Unknown
  misc_feature (1)..( 9): Result.002 file - promoters60/1443349
aattcactc

SEQ ID NO: 115653 - DNA, 12 bp, Unknown
  misc_feature (1)..( 12): Result.002 file - promoters60/1443349
tatataaacaaa

SEQ ID NO: 115654 - DNA, 12 bp, Unknown
  misc_feature (1)..( 12): Result.002 file - promoters60/1443349
ataataaccaaa

SEQ ID NO: 115655 - DNA, 12 bp, Unknown
  misc_feature (1)..( 12): Result.002 file - promoters60/1443349
tatataaactct

SEQ ID NO: 115656 - DNA, 12 bp, Unknown
  misc_feature (1)..( 12): Result.002 file - promoters60/1443349
tttataaataaa

SEQ ID NO: 115657 - DNA, 12 bp, Unknown
  misc_feature (1)..( 12): Result.002 file - promoters60/1443349
tatataaatgac

SEQ ID NO: 115658 - DNA, 12 bp, Unknown
  misc_feature (1)..( 12): Result.002 file - promoters60/1443349
tatataaacaaa

SEQ ID NO: 115659 - DNA, 10 bp, Unknown
  misc_feature (1)..( 10): Result.002 file - promoters60/1443349
caaaatttgt

SEQ ID NO: 115660 - DNA, 10 bp, Unknown
  misc_feature (1)..( 10): Result.002 file - promoters60/1443349
caatatttta

SEQ ID NO: 115661 - DNA, 10 bp, Unknown
  misc_feature (1)..( 10): Result.002 file - promoters60/1443349
gaatatgttt

SEQ ID NO: 115662 - DNA, 10 bp, Unknown
  misc_feature (1)..( 10): Result.002 file - promoters60/1443349
aattatttta

SEQ ID NO: 115663 - DNA, 11 bp, Unknown
  misc_feature (1)..( 11): Result.002 file - promoters60/1443349
atttagtttga

SEQ ID NO: 115664 - DNA, 11 bp, Unknown
  misc_feature (1)..( 11): Result.002 file - promoters60/1443349
agatagtatat

SEQ ID NO: 115665 - DNA, 8 bp, Unknown
  misc_feature (1)..( 8): Result.002 file - promoters60/1443356
actgatta

SEQ ID NO: 115666 - DNA, 8 bp, Unknown
  misc_feature (1)..( 8): Result.002 file - promoters60/1443356
actaattt

SEQ ID NO: 115667 - DNA, 8 bp, Unknown
  misc_feature (1)..( 8): Result.002 file - promoters60/1443356
ggtaattt

SEQ ID NO: 115668 - DNA, 6 bp, Unknown
  misc_feature (1)..( 6): Result.002 file - promoters60/1443356
attact

SEQ ID NO: 115669 - DNA, 6 bp, Unknown
  misc_feature (1)..( 6): Result.002 file - promoters60/1443356
attact

SEQ ID NO: 115670 - DNA, 6 bp, Unknown
  misc_feature (1)..( 6): Result.002 file - promoters60/1443356
taataa

SEQ ID NO: 115671 - DNA, 6 bp, Unknown
  misc_feature (1)..( 6): Result.002 file - promoters60/1443356
taataa

SEQ ID NO: 115672 - DNA, 6 bp, Unknown
  misc_feature (1)..( 6): Result.002 file - promoters60/1443356
atattt

SEQ ID NO: 115673 - DNA, 6 bp, Unknown
  misc_feature (1)..( 6): Result.002 file - promoters60/1443356
atattt

SEQ ID NO: 115674 - DNA, 8 bp, Unknown
  misc_feature (1)..( 8): Result.002 file - promoters60/1443356
ttaaaaga

SEQ ID NO: 115675 - DNA, 8 bp, Unknown
  misc_feature (1)..( 8): Result.002 file - promoters60/1443356
ttagaagt

SEQ ID NO: 115676 - DNA, 8 bp, Unknown
  misc_feature (1)..( 8): Result.002 file - promoters60/1443356
ataacaga

SEQ ID NO: 115677 - DNA, 6 bp, Unknown
  misc_feature (1)..( 6): Result.002 file - promoters60/1443356
tacaat

SEQ ID NO: 115678 - DNA, 6 bp, Unknown
  misc_feature (1)..( 6): Result.002 file - promoters60/1443356
tacaat

SEQ ID NO: 115679 - DNA, 7 bp, Unknown
  misc_feature (1)..( 7): Result.002 file - promoters60/1443356
tttcttt

SEQ ID NO: 115680 - DNA, 7 bp, Unknown
  misc_feature (1)..( 7): Result.002 file - promoters60/1443356
tttattt

SEQ ID NO: 115681 - DNA, 7 bp, Unknown
  misc_feature (1)..( 7): Result.002 file - promoters60/1443356
aatgtat

SEQ ID NO: 115682 - DNA, 7 bp, Unknown
  misc_feature (1)..( 7): Result.002 file - promoters60/1443356
aatatat

SEQ ID NO: 115683 - DNA, 7 bp, Unknown
  misc_feature (1)..( 7): Result.002 file - promoters60/1443356
tatccct

SEQ ID NO: 115684 - DNA, 7 bp, Unknown
  misc_feature (1)..( 7): Result.002 file - promoters60/1443356
tatacct

SEQ ID NO: 115685 - DNA, 7 bp, Unknown
  misc_feature (1)..( 7): Result.002 file - promoters60/1443356
caggtat

SEQ ID NO: 115686 - DNA, 7 bp, Unknown
  misc_feature (1)..( 7): Result.002 file - promoters60/1443356
cagttat

SEQ ID NO: 115687 - DNA, 7 bp, Unknown
  misc_feature (1)..( 7): Result.002 file - promoters60/1443356
tgacaat

SEQ ID NO: 115688 - DNA, 7 bp, Unknown
  misc_feature (1)..( 7): Result.002 file - promoters60/1443356
tgacaat

SEQ ID NO: 115689 - DNA, 7 bp, Unknown
  misc_feature (1)..( 7): Result.002 file - promoters60/1443356
atctgcc

SEQ ID NO: 115690 - DNA, 7 bp, Unknown
  misc_feature (1)..( 7): Result.002 file - promoters60/1443356
atcggcc

SEQ ID NO: 115691 - DNA, 6 bp, Unknown
  misc_feature (1)..( 6): Result.002 file - promoters60/1443356
aggttt

SEQ ID NO: 115692 - DNA, 6 bp, Unknown
  misc_feature (1)..( 6): Result.002 file - promoters60/1443356
aggttt

SEQ ID NO: 115693 - DNA, 6 bp, Unknown
  misc_feature (1)..( 6): Result.002 file - promoters60/1443356
ggtaat

SEQ ID NO: 115694 - DNA, 6 bp, Unknown
  misc_feature (1)..( 6): Result.002 file - promoters60/1443356
ggtaat

SEQ ID NO: 115695 - DNA, 7 bp, Unknown
  misc_feature (1)..( 7): Result.002 file - promoters60/1443356
aatctat

SEQ ID NO: 115696 - DNA, 7 bp, Unknown
  misc_feature (1)..( 7): Result.002 file - promoters60/1443356
aatgtat

SEQ ID NO: 115697 - DNA, 7 bp, Unknown
  misc_feature (1)..( 7): Result.002 file - promoters60/1443356
aatttat

SEQ ID NO: 115698 - DNA, 7 bp, Unknown
  misc_feature (1)..( 7): Result.002 file - promoters60/1443356
atgggga

SEQ ID NO: 115699 - DNA, 7 bp, Unknown
  misc_feature (1)..( 7): Result.002 file - promoters60/1443356
atgcgga

SEQ ID NO: 115700 - DNA, 7 bp, Unknown
  misc_feature (1)..( 7): Result.002 file - promoters60/1443356
cttggct

SEQ ID NO: 115701 - DNA, 7 bp, Unknown
  misc_feature (1)..( 7): Result.002 file - promoters60/1443356
ctttgct

SEQ ID NO: 115702 - DNA, 6 bp, Unknown
  misc_feature (1)..( 6): Result.002 file - promoters60/1443356
atttaa

SEQ ID NO: 115703 - DNA, 6 bp, Unknown
  misc_feature (1)..( 6): Result.002 file - promoters60/1443356
atttaa

SEQ ID NO: 115704 - DNA, 8 bp, Unknown
  misc_feature (1)..( 8): Result.002 file - promoters60/1443356
atttttac

SEQ ID NO: 115705 - DNA, 8 bp, Unknown
  misc_feature (1)..( 8): Result.002 file - promoters60/1443356
attcttac

SEQ ID NO: 115706 - DNA, 6 bp, Unknown
  misc_feature (1)..( 6): Result.002 file - promoters60/1443356
aaatgt

SEQ ID NO: 115707 - DNA, 6 bp, Unknown
  misc_feature (1)..( 6): Result.002 file - promoters60/1443356
aaatgt

SEQ ID NO: 115708 - DNA, 7 bp, Unknown
  misc_feature (1)..( 7): Result.002 file - promoters60/1443356
atttttg

SEQ ID NO: 115709 - DNA, 7 bp, Unknown
  misc_feature (1)..( 7): Result.002 file - promoters60/1443356
atttttg

SEQ ID NO: 115710 - DNA, 6 bp, Unknown
  misc_feature (1)..( 6): Result.002 file - promoters60/1443356
gtcaat

SEQ ID NO: 115711 - DNA, 6 bp, Unknown
  misc_feature (1)..( 6): Result.002 file - promoters60/1443356
gtcaat

SEQ ID NO: 115712 - DNA, 6 bp, Unknown
  misc_feature (1)..( 6): Result.002 file - promoters60/1443356
aattca

SEQ ID NO: 115713 - DNA, 6 bp, Unknown
  misc_feature (1)..( 6): Result.002 file - promoters60/1443356
aattca

SEQ ID NO: 115714 - DNA, 7 bp, Unknown
  misc_feature (1)..( 7): Result.002 file - promoters60/1443356
aatctct

SEQ ID NO: 115715 - DNA, 7 bp, Unknown
  misc_feature (1)..( 7): Result.002 file - promoters60/1443356
aatgtct

SEQ ID NO: 115716 - DNA, 6 bp, Unknown
  misc_feature (1)..( 6): Result.002 file - promoters60/1443356
tttgtt

SEQ ID NO: 115717 - DNA, 6 bp, Unknown
  misc_feature (1)..( 6): Result.002 file - promoters60/1443356
tttgtt

SEQ ID NO: 115718 - DNA, 6 bp, Unknown
  misc_feature (1)..( 6): Result.002 file - promoters60/1443387
ggtaga

SEQ ID NO: 115719 - DNA, 6 bp, Unknown
  misc_feature (1)..( 6): Result.002 file - promoters60/1443387
ggtaga

SEQ ID NO: 115720 - DNA, 7 bp, Unknown
  misc_feature (1)..( 7): Result.002 file - promoters60/1443387
aaggaaa

SEQ ID NO: 115721 - DNA, 7 bp, Unknown
  misc_feature (1)..( 7): Result.002 file - promoters60/1443387
aagaaaa

SEQ ID NO: 115722 - DNA, 6 bp, Unknown
  misc_feature (1)..( 6): Result.002 file - promoters60/1443387
ccatat

SEQ ID NO: 115723 - DNA, 6 bp, Unknown
  misc_feature (1)..( 6): Result.002 file - promoters60/1443387
ccatat

SEQ ID NO: 115724 - DNA, 6 bp, Unknown
  misc_feature (1)..( 6): Result.002 file - promoters60/1443387
tataaa

SEQ ID NO: 115725 - DNA, 6 bp, Unknown
  misc_feature (1)..( 6): Result.002 file - promoters60/1443387
tataaa

SEQ ID NO: 115726 - DNA, 6 bp, Unknown
  misc_feature (1)..( 6): Result.002 file - promoters60/1443387
gttttg

SEQ ID NO: 115727 - DNA, 6 bp, Unknown
  misc_feature (1)..( 6): Result.002 file - promoters60/1443387
gttttg

SEQ ID NO: 115728 - DNA, 8 bp, Unknown
  misc_feature (1)..( 8): Result.002 file - promoters60/1443387
ttttaaat

SEQ ID NO: 115729 - DNA, 8 bp, Unknown
  misc_feature (1)..( 8): Result.002 file - promoters60/1443387
ctttaaaa

SEQ ID NO: 115730 - DNA, 7 bp, Unknown
  misc_feature (1)..( 7): Result.002 file - promoters60/1443387
tcataaa

SEQ ID NO: 115731 - DNA, 7 bp, Unknown
  misc_feature (1)..( 7): Result.002 file - promoters60/1443387
tcagaaa

SEQ ID NO: 115732 - DNA, 8 bp, Unknown
  misc_feature (1)..( 8): Result.002 file - promoters60/1443387
aaatgggc

SEQ ID NO: 115733 - DNA, 8 bp, Unknown
  misc_feature (1)..( 8): Result.002 file - promoters60/1443387
aaaagggc

SEQ ID NO: 115734 - DNA, 8 bp, Unknown
  misc_feature (1)..( 8): Result.002 file - promoters60/1443387
aaaaaaac

SEQ ID NO: 115735 - DNA, 8 bp, Unknown
  misc_feature (1)..( 8): Result.002 file - promoters60/1443387
aaaataac

SEQ ID NO: 115736 - DNA, 11 bp, Unknown
  misc_feature (1)..( 11): Result.002 file - promoters60/1443387
atcaaatgcaa

SEQ ID NO: 115737 - DNA, 11 bp, Unknown
  misc_feature (1)..( 11): Result.002 file - promoters60/1443387
atctaattcaa

SEQ ID NO: 115738 - DNA, 7 bp, Unknown
  misc_feature (1)..( 7): Result.002 file - promoters60/1443387
aaaattg

SEQ ID NO: 115739 - DNA, 7 bp, Unknown
  misc_feature (1)..( 7): Result.002 file - promoters60/1443387
aaaattg

SEQ ID NO: 115740 - DNA, 11 bp, Unknown
  misc_feature (1)..( 11): Result.002 file - promoters60/1443418
gtttaaaaatt

SEQ ID NO: 115741 - DNA, 11 bp, Unknown
  misc_feature (1)..( 11): Result.002 file - promoters60/1443418
gtgtaacaatt

SEQ ID NO: 115742 - DNA, 11 bp, Unknown
  misc_feature (1)..( 11): Result.002 file - promoters60/1443418
ttggtaaaatt

SEQ ID NO: 115743 - DNA, 11 bp, Unknown
  misc_feature (1)..( 11): Result.002 file - promoters60/1443418
aacccaaaatt

SEQ ID NO: 115744 - DNA, 11 bp, Unknown
  misc_feature (1)..( 11): Result.002 file - promoters60/1443418
gttaaaaaatt

SEQ ID NO: 115745 - DNA, 11 bp, Unknown
  misc_feature (1)..( 11): Result.002 file - promoters60/1443418
ttgtcacaagt

SEQ ID NO: 115746 - DNA, 14 bp, Unknown
  misc_feature (1)..( 14): Result.002 file - promoters60/1443418
taaataaatttttg

SEQ ID NO: 115747 - DNA, 14 bp, Unknown
  misc_feature (1)..( 14): Result.002 file - promoters60/1443418
taaaaaaagaagaa

SEQ ID NO: 115748 - DNA, 14 bp, Unknown
  misc_feature (1)..( 14): Result.002 file - promoters60/1443418
caaacaaatgtttg

SEQ ID NO: 115749 - DNA, 14 bp, Unknown
  misc_feature (1)..( 14): Result.002 file - promoters60/1443418
tcaataaaaaaaaa

SEQ ID NO: 115750 - DNA, 14 bp, Unknown
  misc_feature (1)..( 14): Result.002 file - promoters60/1443418
caaaaaaattcacg

SEQ ID NO: 115751 - DNA, 14 bp, Unknown
  misc_feature (1)..( 14): Result.002 file - promoters60/1443418
tacatacatatact

SEQ ID NO: 115752 - DNA, 14 bp, Unknown
  misc_feature (1)..( 14): Result.002 file - promoters60/1443418
tcattaacatgata

SEQ ID NO: 115753 - DNA, 14 bp, Unknown
  misc_feature (1)..( 14): Result.002 file - promoters60/1443418
aaaatacaaaacgt

SEQ ID NO: 115754 - DNA, 13 bp, Unknown
  misc_feature (1)..( 13): Result.002 file - promoters60/1443418
tttttatttcttt

SEQ ID NO: 115755 - DNA, 13 bp, Unknown
  misc_feature (1)..( 13): Result.002 file - promoters60/1443418
taattattttgca

SEQ ID NO: 115756 - DNA, 13 bp, Unknown
  misc_feature (1)..( 13): Result.002 file - promoters60/1443418
ggattaattcttt

SEQ ID NO: 115757 - DNA, 13 bp, Unknown
  misc_feature (1)..( 13): Result.002 file - promoters60/1443418
attttattataaa

SEQ ID NO: 115758 - DNA, 13 bp, Unknown
  misc_feature (1)..( 13): Result.002 file - promoters60/1443418
tttttattgccgc

SEQ ID NO: 115759 - DNA, 13 bp, Unknown
  misc_feature (1)..( 13): Result.002 file - promoters60/1443418
tcattatttttac

SEQ ID NO: 115760 - DNA, 21 bp, Unknown
  misc_feature (1)..( 21): Result.002 file - promoters60/1443418
gcaaattattcacacatgttg

SEQ ID NO: 115761 - DNA, 21 bp, Unknown
  misc_feature (1)..( 21): Result.002 file - promoters60/1443418
ccaaaatatctaaacactaat

SEQ ID NO: 115762 - DNA, 21 bp, Unknown
  misc_feature (1)..( 21): Result.002 file - promoters60/1443418
attaattattcatacaagttg

SEQ ID NO: 115763 - DNA, 21 bp, Unknown
  misc_feature (1)..( 21): Result.002 file - promoters60/1443418
caaaattagcgagtaggataa

SEQ ID NO: 115764 - DNA, 21 bp, Unknown
  misc_feature (1)..( 21): Result.002 file - promoters60/1443418
gtaaaataatacactactttt

SEQ ID NO: 115765 - DNA, 21 bp, Unknown
  misc_feature (1)..( 21): Result.002 file - promoters60/1443418
gtaagatattttcctttcgaa

SEQ ID NO: 115766 - DNA, 14 bp, Unknown
  misc_feature (1)..( 14): Result.002 file - promoters60/1443418
aaattttaataaac

SEQ ID NO: 115767 - DNA, 14 bp, Unknown
  misc_feature (1)..( 14): Result.002 file - promoters60/1443418
aaattataaactaa

SEQ ID NO: 115768 - DNA, 14 bp, Unknown
  misc_feature (1)..( 14): Result.002 file - promoters60/1443418
tgagtttaatcttc

SEQ ID NO: 115769 - DNA, 14 bp, Unknown
  misc_feature (1)..( 14): Result.002 file - promoters60/1443418
taatgttaacacaa

SEQ ID NO: 115770 - DNA, 14 bp, Unknown
  misc_feature (1)..( 14): Result.002 file - promoters60/1443418
cctaattaacctta

SEQ ID NO: 115771 - DNA, 14 bp, Unknown
  misc_feature (1)..( 14): Result.002 file - promoters60/1443418
ttattataaagtta

SEQ ID NO: 115772 - DNA, 11 bp, Unknown
  misc_feature (1)..( 11): Result.002 file - promoters60/1443418
aatgaaattca

SEQ ID NO: 115773 - DNA, 11 bp, Unknown
  misc_feature (1)..( 11): Result.002 file - promoters60/1443418
aatgatattcg

SEQ ID NO: 115774 - DNA, 11 bp, Unknown
  misc_feature (1)..( 11): Result.002 file - promoters60/1443418
aaaaaaattca

SEQ ID NO: 115775 - DNA, 11 bp, Unknown
  misc_feature (1)..( 11): Result.002 file - promoters60/1443418
tttgatatata

SEQ ID NO: 115776 - DNA, 11 bp, Unknown
  misc_feature (1)..( 11): Result.002 file - promoters60/1443418
tttgctatcta

SEQ ID NO: 115777 - DNA, 11 bp, Unknown
  misc_feature (1)..( 11): Result.002 file - promoters60/1443418
taaaacattga

SEQ ID NO: 115778 - DNA, 11 bp, Unknown
  misc_feature (1)..( 11): Result.002 file - promoters60/1443418
gatcaaatagg

SEQ ID NO: 115779 - DNA, 11 bp, Unknown
  misc_feature (1)..( 11): Result.002 file - promoters60/1443418
tttcaaataca

SEQ ID NO: 115780 - DNA, 11 bp, Unknown
  misc_feature (1)..( 11): Result.002 file - promoters60/1443418
ttacaaataaa

SEQ ID NO: 115781 - DNA, 11 bp, Unknown
  misc_feature (1)..( 11): Result.002 file - promoters60/1443418
gattaaattgg

SEQ ID NO: 115782 - DNA, 11 bp, Unknown
  misc_feature (1)..( 11): Result.002 file - promoters60/1443418
atttaaaagtt

SEQ ID NO: 115783 - DNA, 11 bp, Unknown
  misc_feature (1)..( 11): Result.002 file - promoters60/1443418
tttaaaacaaa

SEQ ID NO: 115784 - DNA, 14 bp, Unknown
  misc_feature (1)..( 14): Result.002 file - promoters60/1443433
ctcttatataaaca

SEQ ID NO: 115785 - DNA, 14 bp, Unknown
  misc_feature (1)..( 14): Result.002 file - promoters60/1443433
ctcttatatataaa

SEQ ID NO: 115786 - DNA, 14 bp, Unknown
  misc_feature (1)..( 14): Result.002 file - promoters60/1443433
acagtatataaact

SEQ ID NO: 115787 - DNA, 14 bp, Unknown
  misc_feature (1)..( 14): Result.002 file - promoters60/1443433
gttttatatattaa

SEQ ID NO: 115788 - DNA, 14 bp, Unknown
  misc_feature (1)..( 14): Result.002 file - promoters60/1443433
tacctataaatatc

SEQ ID NO: 115789 - DNA, 14 bp, Unknown
  misc_feature (1)..( 14): Result.002 file - promoters60/1443433
aaaaaatagactct

SEQ ID NO: 115790 - DNA, 17 bp, Unknown
  misc_feature (1)..( 17): Result.002 file - promoters60/1443433
tgaaaacttataattat

SEQ ID NO: 115791 - DNA, 17 bp, Unknown
  misc_feature (1)..( 17): Result.002 file - promoters60/1443433
tactaacatatgattgt

SEQ ID NO: 115792 - DNA, 17 bp, Unknown
  misc_feature (1)..( 17): Result.002 file - promoters60/1443433
aatatctttataagtat

SEQ ID NO: 115793 - DNA, 17 bp, Unknown
  misc_feature (1)..( 17): Result.002 file - promoters60/1443433
tactcacatatgggcct

SEQ ID NO: 115794 - DNA, 7 bp, Unknown
  misc_feature (1)..( 7): Result.002 file - promoters60/1443433
aactcac

SEQ ID NO: 115795 - DNA, 20 bp, Unknown
  misc_feature (1)..( 20): Result.002 file - promoters60/1443433
tcctcgcttcataacaaaat

SEQ ID NO: 115796 - DNA, 6 bp, Unknown
  misc_feature (1)..( 6): Result.002 file - promoters60/1443475
ttgaat

SEQ ID NO: 115797 - DNA, 6 bp, Unknown
  misc_feature (1)..( 6): Result.002 file - promoters60/1443475
ttgaat

SEQ ID NO: 115798 - DNA, 8 bp, Unknown
  misc_feature (1)..( 8): Result.002 file - promoters60/1443475
caagtttt

SEQ ID NO: 115799 - DNA, 8 bp, Unknown
  misc_feature (1)..( 8): Result.002 file - promoters60/1443475
caagttta

SEQ ID NO: 115800 - DNA, 8 bp, Unknown
  misc_feature (1)..( 8): Result.002 file - promoters60/1443475
ccagtttt

SEQ ID NO: 115801 - DNA, 6 bp, Unknown
  misc_feature (1)..( 6): Result.002 file - promoters60/1443475
tatgta

SEQ ID NO: 115802 - DNA, 6 bp, Unknown
  misc_feature (1)..( 6): Result.002 file - promoters60/1443475
tatgta

SEQ ID NO: 115803 - DNA, 7 bp, Unknown
  misc_feature (1)..( 7): Result.002 file - promoters60/1443475
ttttctc

SEQ ID NO: 115804 - DNA, 7 bp, Unknown
  misc_feature (1)..( 7): Result.002 file - promoters60/1443475
ttttctc

SEQ ID NO: 115805 - DNA, 8 bp, Unknown
  misc_feature (1)..( 8): Result.002 file - promoters60/1443475
ttatgaat

SEQ ID NO: 115806 - DNA, 8 bp, Unknown
  misc_feature (1)..( 8): Result.002 file - promoters60/1443475
ttatcaat

SEQ ID NO: 115807 - DNA, 6 bp, Unknown
  misc_feature (1)..( 6): Result.002 file - promoters60/1443475
gttaaa

SEQ ID NO: 115808 - DNA, 6 bp, Unknown
  misc_feature (1)..( 6): Result.002 file - promoters60/1443475
gttaaa

SEQ ID NO: 115809 - DNA, 7 bp, Unknown
  misc_feature (1)..( 7): Result.002 file - promoters60/1443475
attagtt

SEQ ID NO: 115810 - DNA, 7 bp, Unknown
  misc_feature (1)..( 7): Result.002 file - promoters60/1443475
attcgtt

SEQ ID NO: 115811 - DNA, 6 bp, Unknown
  misc_feature (1)..( 6): Result.002 file - promoters60/1443475
atcaga

SEQ ID NO: 115812 - DNA, 6 bp, Unknown
  misc_feature (1)..( 6): Result.002 file - promoters60/1443475
atcaga

SEQ ID NO: 115813 - DNA, 7 bp, Unknown
  misc_feature (1)..( 7): Result.002 file - promoters60/1443475
ttttttt

SEQ ID NO: 115814 - DNA, 7 bp, Unknown
  misc_feature (1)..( 7): Result.002 file - promoters60/1443475
ttttttc

SEQ ID NO: 115815 - DNA, 7 bp, Unknown
  misc_feature (1)..( 7): Result.002 file - promoters60/1443475
ttttttc

SEQ ID NO: 115816 - DNA, 6 bp, Unknown
  misc_feature (1)..( 6): Result.002 file - promoters60/1443475
taaatc

SEQ ID NO: 115817 - DNA, 6 bp, Unknown
  misc_feature (1)..( 6): Result.002 file - promoters60/1443475
taaatc

SEQ ID NO: 115818 - DNA, 6 bp, Unknown
  misc_feature (1)..( 6): Result.002 file - promoters60/1443475
actatt

SEQ ID NO: 115819 - DNA, 6 bp, Unknown
  misc_feature (1)..( 6): Result.002 file - promoters60/1443475
actatt

SEQ ID NO: 115820 - DNA, 6 bp, Unknown
  misc_feature (1)..( 6): Result.002 file - promoters60/1443475
cgaaac

SEQ ID NO: 115821 - DNA, 6 bp, Unknown
  misc_feature (1)..( 6): Result.002 file - promoters60/1443475
cgaaac

SEQ ID NO: 115822 - DNA, 6 bp, Unknown
  misc_feature (1)..( 6): Result.002 file - promoters60/1443475
gaaaga

SEQ ID NO: 115823 - DNA, 6 bp, Unknown
  misc_feature (1)..( 6): Result.002 file - promoters60/1443475
gaaaga

SEQ ID NO: 115824 - DNA, 6 bp, Unknown
  misc_feature (1)..( 6): Result.002 file - promoters60/1443475
aagaaa

SEQ ID NO: 115825 - DNA, 6 bp, Unknown
  misc_feature (1)..( 6): Result.002 file - promoters60/1443475
aagaaa

SEQ ID NO: 115826 - DNA, 8 bp, Unknown
  misc_feature (1)..( 8): Result.002 file - promoters60/1443475
aaagttct

SEQ ID NO: 115827 - DNA, 8 bp, Unknown
  misc_feature (1)..( 8): Result.002 file - promoters60/1443475
aaaggtct

SEQ ID NO: 115828 - DNA, 6 bp, Unknown
  misc_feature (1)..( 6): Result.002 file - promoters60/1443475
aaaata

SEQ ID NO: 115829 - DNA, 6 bp, Unknown
  misc_feature (1)..( 6): Result.002 file - promoters60/1443475
aaaata

SEQ ID NO: 115830 - DNA, 7 bp, Unknown
  misc_feature (1)..( 7): Result.002 file - promoters60/1443475
gtgtaga

SEQ ID NO: 115831 - DNA, 7 bp, Unknown
  misc_feature (1)..( 7): Result.002 file - promoters60/1443475
gtgaaga

SEQ ID NO: 115832 - DNA, 10 bp, Unknown
  misc_feature (1)..( 10): Result.002 file - promoters60/1443512
gccgtcagcc

SEQ ID NO: 115833 - DNA, 10 bp, Unknown
  misc_feature (1)..( 10): Result.002 file - promoters60/1443512
gccttcactt

SEQ ID NO: 115834 - DNA, 10 bp, Unknown
  misc_feature (1)..( 10): Result.002 file - promoters60/1443512
ttcttaactt

SEQ ID NO: 115835 - DNA, 11 bp, Unknown
  misc_feature (1)..( 11): Result.002 file - promoters60/1443512
aattccgtaac

SEQ ID NO: 115836 - DNA, 11 bp, Unknown
  misc_feature (1)..( 11): Result.002 file - promoters60/1443512
ggatccataac

SEQ ID NO: 115837 - DNA, 11 bp, Unknown
  misc_feature (1)..( 11): Result.002 file - promoters60/1443512
ggacccatttg

SEQ ID NO: 115838 - DNA, 10 bp, Unknown
  misc_feature (1)..( 10): Result.002 file - promoters60/1443633
ggttcttttt

SEQ ID NO: 115839 - DNA, 10 bp, Unknown
  misc_feature (1)..( 10): Result.002 file - promoters60/1443633
tgggcttttt

SEQ ID NO: 115840 - DNA, 10 bp, Unknown
  misc_feature (1)..( 10): Result.002 file - promoters60/1443633
tttcctttgg

SEQ ID NO: 115841 - DNA, 10 bp, Unknown
  misc_feature (1)..( 10): Result.002 file - promoters60/1443633
tttactttgt

SEQ ID NO: 115842 - DNA, 10 bp, Unknown
  misc_feature (1)..( 10): Result.002 file - promoters60/1443633
tgaaagaaaa

SEQ ID NO: 115843 - DNA, 10 bp, Unknown
  misc_feature (1)..( 10): Result.002 file - promoters60/1443633
aaaaagaaca

SEQ ID NO: 115844 - DNA, 10 bp, Unknown
  misc_feature (1)..( 10): Result.002 file - promoters60/1443633
aaaaataacg

SEQ ID NO: 115845 - DNA, 10 bp, Unknown
  misc_feature (1)..( 10): Result.002 file - promoters60/1443633
ggaaatgacg

SEQ ID NO: 115846 - DNA, 12 bp, Unknown
  misc_feature (1)..( 12): Result.002 file - promoters60/1443640
ctagagattgtg

SEQ ID NO: 115847 - DNA, 12 bp, Unknown
  misc_feature (1)..( 12): Result.002 file - promoters60/1443640
attaagattgtg

SEQ ID NO: 115848 - DNA, 12 bp, Unknown
  misc_feature (1)..( 12): Result.002 file - promoters60/1443640
caggagcttggg

SEQ ID NO: 115849 - DNA, 12 bp, Unknown
  misc_feature (1)..( 12): Result.002 file - promoters60/1443640
atttagatttgg

SEQ ID NO: 115850 - DNA, 12 bp, Unknown
  misc_feature (1)..( 12): Result.002 file - promoters60/1443674
tatttatgcaaa

SEQ ID NO: 115851 - DNA, 12 bp, Unknown
  misc_feature (1)..( 12): Result.002 file - promoters60/1443674
aatttatccaaa

SEQ ID NO: 115852 - DNA, 13 bp, Unknown
  misc_feature (1)..( 13): Result.002 file - promoters60/1443674
ctcatatccgaaa

SEQ ID NO: 115853 - DNA, 13 bp, Unknown
  misc_feature (1)..( 13): Result.002 file - promoters60/1443674
aatttaatcaatt

SEQ ID NO: 115854 - DNA, 9 bp, Unknown
  misc_feature (1)..( 9): Result.002 file - promoters60/1443674
aaatagaat

SEQ ID NO: 115855 - DNA, 9 bp, Unknown
  misc_feature (1)..( 9): Result.002 file - promoters60/1443674
aaataaaat

SEQ ID NO: 115856 - DNA, 9 bp, Unknown
  misc_feature (1)..( 9): Result.002 file - promoters60/1443674
ggatataat

SEQ ID NO: 115857 - DNA, 8 bp, Unknown
  misc_feature (1)..( 8): Result.002 file - promoters60/1443674
aaaaaaaa

SEQ ID NO: 115858 - DNA, 8 bp, Unknown
  misc_feature (1)..( 8): Result.002 file - promoters60/1443674
aaaaaaaa

SEQ ID NO: 115859 - DNA, 8 bp, Unknown
  misc_feature (1)..( 8): Result.002 file - promoters60/1443674
aaaaaata

SEQ ID NO: 115860 - DNA, 8 bp, Unknown
  misc_feature (1)..( 8): Result.002 file - promoters60/1443674
acatatta

SEQ ID NO: 115861 - DNA, 8 bp, Unknown
  misc_feature (1)..( 8): Result.002 file - promoters60/1443674
ccatttta

SEQ ID NO: 115862 - DNA, 8 bp, Unknown
  misc_feature (1)..( 8): Result.002 file - promoters60/1443674
acatgtta

SEQ ID NO: 115863 - DNA, 8 bp, Unknown
  misc_feature (1)..( 8): Result.002 file - promoters60/1443687
aaatactt

SEQ ID NO: 115864 - DNA, 8 bp, Unknown
  misc_feature (1)..( 8): Result.002 file - promoters60/1443687
aaacactt

SEQ ID NO: 115865 - DNA, 6 bp, Unknown
  misc_feature (1)..( 6): Result.002 file - promoters60/1443687
atattt

SEQ ID NO: 115866 - DNA, 6 bp, Unknown
  misc_feature (1)..( 6): Result.002 file - promoters60/1443687
atattt

SEQ ID NO: 115867 - DNA, 7 bp, Unknown
  misc_feature (1)..( 7): Result.002 file - promoters60/1443687
aaaatta

SEQ ID NO: 115868 - DNA, 7 bp, Unknown
  misc_feature (1)..( 7): Result.002 file - promoters60/1443687
aaaattt

SEQ ID NO: 115869 - DNA, 7 bp, Unknown
  misc_feature (1)..( 7): Result.002 file - promoters60/1443687
aaacttt

SEQ ID NO: 115870 - DNA, 7 bp, Unknown
  misc_feature (1)..( 7): Result.002 file - promoters60/1443687
gaacaaa

SEQ ID NO: 115871 - DNA, 7 bp, Unknown
  misc_feature (1)..( 7): Result.002 file - promoters60/1443687
gaataaa

SEQ ID NO: 115872 - DNA, 7 bp, Unknown
  misc_feature (1)..( 7): Result.002 file - promoters60/1443687
taacaaa

SEQ ID NO: 115873 - DNA, 6 bp, Unknown
  misc_feature (1)..( 6): Result.002 file - promoters60/1443687
agttta

SEQ ID NO: 115874 - DNA, 6 bp, Unknown
  misc_feature (1)..( 6): Result.002 file - promoters60/1443687
agttta

SEQ ID NO: 115875 - DNA, 9 bp, Unknown
  misc_feature (1)..( 9): Result.002 file - promoters60/1443687
tattttgaa

SEQ ID NO: 115876 - DNA, 9 bp, Unknown
  misc_feature (1)..( 9): Result.002 file - promoters60/1443687
ggttttgaa

SEQ ID NO: 115877 - DNA, 9 bp, Unknown
  misc_feature (1)..( 9): Result.002 file - promoters60/1443687
tattttgtt

SEQ ID NO: 115878 - DNA, 6 bp, Unknown
  misc_feature (1)..( 6): Result.002 file - promoters60/1443687
tgaaaa

SEQ ID NO: 115879 - DNA, 6 bp, Unknown
  misc_feature (1)..( 6): Result.002 file - promoters60/1443687
tgaaaa

SEQ ID NO: 115880 - DNA, 7 bp, Unknown
  misc_feature (1)..( 7): Result.002 file - promoters60/1443687
tcagttt

SEQ ID NO: 115881 - DNA, 7 bp, Unknown
  misc_feature (1)..( 7): Result.002 file - promoters60/1443687
tcacttt

SEQ ID NO: 115882 - DNA, 9 bp, Unknown
  misc_feature (1)..( 9): Result.002 file - promoters60/1443687
ttttgttat

SEQ ID NO: 115883 - DNA, 9 bp, Unknown
  misc_feature (1)..( 9): Result.002 file - promoters60/1443687
tttttttat

SEQ ID NO: 115884 - DNA, 6 bp, Unknown
  misc_feature (1)..( 6): Result.002 file - promoters60/1443687
tatttt

SEQ ID NO: 115885 - DNA, 6 bp, Unknown
  misc_feature (1)..( 6): Result.002 file - promoters60/1443687
tatttt

SEQ ID NO: 115886 - DNA, 7 bp, Unknown
  misc_feature (1)..( 7): Result.002 file - promoters60/1443687
taacata

SEQ ID NO: 115887 - DNA, 7 bp, Unknown
  misc_feature (1)..( 7): Result.002 file - promoters60/1443687
taaaata

SEQ ID NO: 115888 - DNA, 6 bp, Unknown
  misc_feature (1)..( 6): Result.002 file - promoters60/1443687
atcaaa

SEQ ID NO: 115889 - DNA, 6 bp, Unknown
  misc_feature (1)..( 6): Result.002 file - promoters60/1443687
atcaaa

SEQ ID NO: 115890 - DNA, 10 bp, Unknown
  misc_feature (1)..( 10): Result.002 file - promoters60/1443687
gaatattttt

SEQ ID NO: 115891 - DNA, 10 bp, Unknown
  misc_feature (1)..( 10): Result.002 file - promoters60/1443687
gaatattttt

SEQ ID NO: 115892 - DNA, 7 bp, Unknown
  misc_feature (1)..( 7): Result.002 file - promoters60/1443687
attattt

SEQ ID NO: 115893 - DNA, 7 bp, Unknown
  misc_feature (1)..( 7): Result.002 file - promoters60/1443687
attcttt

SEQ ID NO: 115894 - DNA, 6 bp, Unknown
  misc_feature (1)..( 6): Result.002 file - promoters60/1443687
atttgg

SEQ ID NO: 115895 - DNA, 6 bp, Unknown
  misc_feature (1)..( 6): Result.002 file - promoters60/1443687
atttgg

SEQ ID NO: 115896 - DNA, 6 bp, Unknown
  misc_feature (1)..( 6): Result.002 file - promoters60/1443687
tttggt

SEQ ID NO: 115897 - DNA, 6 bp, Unknown
  misc_feature (1)..( 6): Result.002 file - promoters60/1443687
tttggt

SEQ ID NO: 115898 - DNA, 8 bp, Unknown
  misc_feature (1)..( 8): Result.002 file - promoters60/1443687
aaaagccc

SEQ ID NO: 115899 - DNA, 8 bp, Unknown
  misc_feature (1)..( 8): Result.002 file - promoters60/1443687
aaaacccc

SEQ ID NO: 115900 - DNA, 7 bp, Unknown
  misc_feature (1)..( 7): Result.002 file - promoters60/1443687
taattca

SEQ ID NO: 115901 - DNA, 7 bp, Unknown
  misc_feature (1)..( 7): Result.002 file - promoters60/1443687
taattca

SEQ ID NO: 115902 - DNA, 8 bp, Unknown
  misc_feature (1)..( 8): Result.002 file - promoters60/1443687
aaatttat

SEQ ID NO: 115903 - DNA, 8 bp, Unknown
  misc_feature (1)..( 8): Result.002 file - promoters60/1443687
aaacttat

SEQ ID NO: 115904 - DNA, 7 bp, Unknown
  misc_feature (1)..( 7): Result.002 file - promoters60/1443687
tttcaca

SEQ ID NO: 115905 - DNA, 7 bp, Unknown
  misc_feature (1)..( 7): Result.002 file - promoters60/1443687
tttaaca

SEQ ID NO: 115906 - DNA, 7 bp, Unknown
  misc_feature (1)..( 7): Result.002 file - promoters60/1443687
atatcac

SEQ ID NO: 115907 - DNA, 7 bp, Unknown
  misc_feature (1)..( 7): Result.002 file - promoters60/1443687
ataccac

SEQ ID NO: 115908 - DNA, 7 bp, Unknown
  misc_feature (1)..( 7): Result.002 file - promoters60/1443687
tattttt

SEQ ID NO: 115909 - DNA, 7 bp, Unknown
  misc_feature (1)..( 7): Result.002 file - promoters60/1443687
tattttt

SEQ ID NO: 115910 - DNA, 6 bp, Unknown
  misc_feature (1)..( 6): Result.002 file - promoters60/1443687
acttgt

SEQ ID NO: 115911 - DNA, 6 bp, Unknown
  misc_feature (1)..( 6): Result.002 file - promoters60/1443687
acttgt

SEQ ID NO: 115912 - DNA, 6 bp, Unknown
  misc_feature (1)..( 6): Result.002 file - promoters60/1444100
ttatca

SEQ ID NO: 115913 - DNA, 6 bp, Unknown
  misc_feature (1)..( 6): Result.002 file - promoters60/1444100
ttatca

SEQ ID NO: 115914 - DNA, 8 bp, Unknown
  misc_feature (1)..( 8): Result.002 file - promoters60/1444100
ttttattt

SEQ ID NO: 115915 - DNA, 8 bp, Unknown
  misc_feature (1)..( 8): Result.002 file - promoters60/1444100
tttttttt

SEQ ID NO: 115916 - DNA, 8 bp, Unknown
  misc_feature (1)..( 8): Result.002 file - promoters60/1444100
cctacttt

SEQ ID NO: 115917 - DNA, 8 bp, Unknown
  misc_feature (1)..( 8): Result.002 file - promoters60/1444100
cctatttt

SEQ ID NO: 115918 - DNA, 7 bp, Unknown
  misc_feature (1)..( 7): Result.002 file - promoters60/1444100
tttggtt

SEQ ID NO: 115919 - DNA, 7 bp, Unknown
  misc_feature (1)..( 7): Result.002 file - promoters60/1444100
ttttgtt

SEQ ID NO: 115920 - DNA, 7 bp, Unknown
  misc_feature (1)..( 7): Result.002 file - promoters60/1444100
tttctct

SEQ ID NO: 115921 - DNA, 7 bp, Unknown
  misc_feature (1)..( 7): Result.002 file - promoters60/1444100
tttttct

SEQ ID NO: 115922 - DNA, 6 bp, Unknown
  misc_feature (1)..( 6): Result.002 file - promoters60/1444100
cactta

SEQ ID NO: 115923 - DNA, 6 bp, Unknown
  misc_feature (1)..( 6): Result.002 file - promoters60/1444100
cactta

SEQ ID NO: 115924 - DNA, 6 bp, Unknown
  misc_feature (1)..( 6): Result.002 file - promoters60/1444100
gaaagt

SEQ ID NO: 115925 - DNA, 6 bp, Unknown
  misc_feature (1)..( 6): Result.002 file - promoters60/1444100
gaaagt

SEQ ID NO: 115926 - DNA, 9 bp, Unknown
  misc_feature (1)..( 9): Result.002 file - promoters60/1444100
ttgtgatcc

SEQ ID NO: 115927 - DNA, 9 bp, Unknown
  misc_feature (1)..( 9): Result.002 file - promoters60/1444100
ttgggatcc

SEQ ID NO: 115928 - DNA, 8 bp, Unknown
  misc_feature (1)..( 8): Result.002 file - promoters60/1444100
tatgtgtg

SEQ ID NO: 115929 - DNA, 8 bp, Unknown
  misc_feature (1)..( 8): Result.002 file - promoters60/1444100
tatgtgtg

SEQ ID NO: 115930 - DNA, 6 bp, Unknown
  misc_feature (1)..( 6): Result.002 file - promoters60/1444100
ttttca

SEQ ID NO: 115931 - DNA, 6 bp, Unknown
  misc_feature (1)..( 6): Result.002 file - promoters60/1444100
ttttca

SEQ ID NO: 115932 - DNA, 7 bp, Unknown
  misc_feature (1)..( 7): Result.002 file - promoters60/1444100
gttcaaa

SEQ ID NO: 115933 - DNA, 7 bp, Unknown
  misc_feature (1)..( 7): Result.002 file - promoters60/1444100
gttgaaa

SEQ ID NO: 115934 - DNA, 7 bp, Unknown
  misc_feature (1)..( 7): Result.002 file - promoters60/1444100
gcaatga

SEQ ID NO: 115935 - DNA, 7 bp, Unknown
  misc_feature (1)..( 7): Result.002 file - promoters60/1444100
gcaatga

SEQ ID NO: 115936 - DNA, 6 bp, Unknown
  misc_feature (1)..( 6): Result.002 file - promoters60/1444100
tgtttt

SEQ ID NO: 115937 - DNA, 6 bp, Unknown
  misc_feature (1)..( 6): Result.002 file - promoters60/1444100
tgtttt

SEQ ID NO: 115938 - DNA, 6 bp, Unknown
  misc_feature (1)..( 6): Result.002 file - promoters60/1444100
accttc

SEQ ID NO: 115939 - DNA, 6 bp, Unknown
  misc_feature (1)..( 6): Result.002 file - promoters60/1444100
accttc

SEQ ID NO: 115940 - DNA, 6 bp, Unknown
  misc_feature (1)..( 6): Result.002 file - promoters60/1444100
tctttt

SEQ ID NO: 115941 - DNA, 6 bp, Unknown
  misc_feature (1)..( 6): Result.002 file - promoters60/1444100
tctttt

SEQ ID NO: 115942 - DNA, 7 bp, Unknown
  misc_feature (1)..( 7): Result.002 file - promoters60/1444100
ctttatt

SEQ ID NO: 115943 - DNA, 7 bp, Unknown
  misc_feature (1)..( 7): Result.002 file - promoters60/1444100
cttgatt

SEQ ID NO: 115944 - DNA, 7 bp, Unknown
  misc_feature (1)..( 7): Result.002 file - promoters60/1444100
aatataa

SEQ ID NO: 115945 - DNA, 7 bp, Unknown
  misc_feature (1)..( 7): Result.002 file - promoters60/1444100
aatctaa

SEQ ID NO: 115946 - DNA, 7 bp, Unknown
  misc_feature (1)..( 7): Result.002 file - promoters60/1444100
tatcttt

SEQ ID NO: 115947 - DNA, 7 bp, Unknown
  misc_feature (1)..( 7): Result.002 file - promoters60/1444100
tattttt

SEQ ID NO: 115948 - DNA, 7 bp, Unknown
  misc_feature (1)..( 7): Result.002 file - promoters60/1444100
ttttttt

SEQ ID NO: 115949 - DNA, 7 bp, Unknown
  misc_feature (1)..( 7): Result.002 file - promoters60/1444100
tttcttt

SEQ ID NO: 115950 - DNA, 7 bp, Unknown
  misc_feature (1)..( 7): Result.002 file - promoters60/1444100
aattaac

SEQ ID NO: 115951 - DNA, 7 bp, Unknown
  misc_feature (1)..( 7): Result.002 file - promoters60/1444100
aataaac

SEQ ID NO: 115952 - DNA, 8 bp, Unknown
  misc_feature (1)..( 8): Result.002 file - promoters60/1444100
ccgtttta

SEQ ID NO: 115953 - DNA, 8 bp, Unknown
  misc_feature (1)..( 8): Result.002 file - promoters60/1444100
ccgtgtta

SEQ ID NO: 115954 - DNA, 16 bp, Unknown
  misc_feature (1)..( 16): Result.002 file - promoters60/1444131
atacaaaaaaagctag

SEQ ID NO: 115955 - DNA, 16 bp, Unknown
  misc_feature (1)..( 16): Result.002 file - promoters60/1444131
tgacaaataaacatat

SEQ ID NO: 115956 - DNA, 16 bp, Unknown
  misc_feature (1)..( 16): Result.002 file - promoters60/1444131
tgaaaaaacgaatgat

SEQ ID NO: 115957 - DNA, 16 bp, Unknown
  misc_feature (1)..( 16): Result.002 file - promoters60/1444131
gttcaaataataagct

SEQ ID NO: 115958 - DNA, 16 bp, Unknown
  misc_feature (1)..( 16): Result.002 file - promoters60/1444131
ttgataatcaacatat

SEQ ID NO: 115959 - DNA, 16 bp, Unknown
  misc_feature (1)..( 16): Result.002 file - promoters60/1444131
taacaaataattaaac

SEQ ID NO: 115960 - DNA, 13 bp, Unknown
  misc_feature (1)..( 13): Result.002 file - promoters60/1444131
ggatatatcaaac

SEQ ID NO: 115961 - DNA, 13 bp, Unknown
  misc_feature (1)..( 13): Result.002 file - promoters60/1444131
gacattataaaat

SEQ ID NO: 115962 - DNA, 13 bp, Unknown
  misc_feature (1)..( 13): Result.002 file - promoters60/1444131
ttcattataaaaa

SEQ ID NO: 115963 - DNA, 13 bp, Unknown
  misc_feature (1)..( 13): Result.002 file - promoters60/1444131
ttatatatttcac

SEQ ID NO: 115964 - DNA, 13 bp, Unknown
  misc_feature (1)..( 13): Result.002 file - promoters60/1444131
catttaatcaaaa

SEQ ID NO: 115965 - DNA, 13 bp, Unknown
  misc_feature (1)..( 13): Result.002 file - promoters60/1444131
gaccttaaaaaat

SEQ ID NO: 115966 - DNA, 13 bp, Unknown
  misc_feature (1)..( 13): Result.002 file - promoters60/1444131
atgaatattttct

SEQ ID NO: 115967 - DNA, 8 bp, Unknown
  misc_feature (1)..( 8): Result.002 file - promoters60/1444131
ttatttct

SEQ ID NO: 115968 - DNA, 8 bp, Unknown
  misc_feature (1)..( 8): Result.002 file - promoters60/1444131
ttattttg

SEQ ID NO: 115969 - DNA, 8 bp, Unknown
  misc_feature (1)..( 8): Result.002 file - promoters60/1444131
tttttttg

SEQ ID NO: 115970 - DNA, 8 bp, Unknown
  misc_feature (1)..( 8): Result.002 file - promoters60/1444131
tttttttc

SEQ ID NO: 115971 - DNA, 8 bp, Unknown
  misc_feature (1)..( 8): Result.002 file - promoters60/1444131
ttattttg

SEQ ID NO: 115972 - DNA, 8 bp, Unknown
  misc_feature (1)..( 8): Result.002 file - promoters60/1444131
tttttttc

SEQ ID NO: 115973 - DNA, 8 bp, Unknown
  misc_feature (1)..( 8): Result.002 file - promoters60/1444131
atttcttt

SEQ ID NO: 115974 - DNA, 8 bp, Unknown
  misc_feature (1)..( 8): Result.002 file - promoters60/1444131
ttttgttt

SEQ ID NO: 115975 - DNA, 8 bp, Unknown
  misc_feature (1)..( 8): Result.002 file - promoters60/1444131
cttttttt

SEQ ID NO: 115976 - DNA, 8 bp, Unknown
  misc_feature (1)..( 8): Result.002 file - promoters60/1444131
attttttt

SEQ ID NO: 115977 - DNA, 8 bp, Unknown
  misc_feature (1)..( 8): Result.002 file - promoters60/1444131
gttttttt

SEQ ID NO: 115978 - DNA, 8 bp, Unknown
  misc_feature (1)..( 8): Result.002 file - promoters60/1444131
attttgta

SEQ ID NO: 115979 - DNA, 9 bp, Unknown
  misc_feature (1)..( 9): Result.002 file - promoters60/1444131
ttaatattt

SEQ ID NO: 115980 - DNA, 9 bp, Unknown
  misc_feature (1)..( 9): Result.002 file - promoters60/1444131
tcaatatta

SEQ ID NO: 115981 - DNA, 9 bp, Unknown
  misc_feature (1)..( 9): Result.002 file - promoters60/1444131
ccaacattc

SEQ ID NO: 115982 - DNA, 9 bp, Unknown
  misc_feature (1)..( 9): Result.002 file - promoters60/1444131
tgaatattt

SEQ ID NO: 115983 - DNA, 9 bp, Unknown
  misc_feature (1)..( 9): Result.002 file - promoters60/1444131
tcattatca

SEQ ID NO: 115984 - DNA, 9 bp, Unknown
  misc_feature (1)..( 9): Result.002 file - promoters60/1444131
tatatattt

SEQ ID NO: 115985 - DNA, 11 bp, Unknown
  misc_feature (1)..( 11): Result.002 file - promoters60/1444131
tgaccaaactc

SEQ ID NO: 115986 - DNA, 11 bp, Unknown
  misc_feature (1)..( 11): Result.002 file - promoters60/1444131
tgaacaatatt

SEQ ID NO: 115987 - DNA, 11 bp, Unknown
  misc_feature (1)..( 11): Result.002 file - promoters60/1444131
aaaccaaaccg

SEQ ID NO: 115988 - DNA, 11 bp, Unknown
  misc_feature (1)..( 11): Result.002 file - promoters60/1444131
tgaccaaacga

SEQ ID NO: 115989 - DNA, 11 bp, Unknown
  misc_feature (1)..( 11): Result.002 file - promoters60/1444131
caaacaaaatt

SEQ ID NO: 115990 - DNA, 11 bp, Unknown
  misc_feature (1)..( 11): Result.002 file - promoters60/1444131
gtgtcaagcaa

SEQ ID NO: 115991 - DNA, 10 bp, Unknown
  misc_feature (1)..( 10): Result.002 file - promoters60/1444131
agttaaaaaa

SEQ ID NO: 115992 - DNA, 10 bp, Unknown
  misc_feature (1)..( 10): Result.002 file - promoters60/1444131
cgttaaagtt

SEQ ID NO: 115993 - DNA, 11 bp, Unknown
  misc_feature (1)..( 11): Result.002 file - promoters60/1444131
atttacaaaca

SEQ ID NO: 115994 - DNA, 11 bp, Unknown
  misc_feature (1)..( 11): Result.002 file - promoters60/1444131
agttaaaaagt

SEQ ID NO: 115995 - DNA, 11 bp, Unknown
  misc_feature (1)..( 11): Result.002 file - promoters60/1444131
ctttacaacca

SEQ ID NO: 115996 - DNA, 11 bp, Unknown
  misc_feature (1)..( 11): Result.002 file - promoters60/1444131
atttacataca

SEQ ID NO: 115997 - DNA, 10 bp, Unknown
  misc_feature (1)..( 10): Result.002 file - promoters60/1444131
aaaccaatgt

SEQ ID NO: 115998 - DNA, 10 bp, Unknown
  misc_feature (1)..( 10): Result.002 file - promoters60/1444131
aaatcaaata

SEQ ID NO: 115999 - DNA, 10 bp, Unknown
  misc_feature (1)..( 10): Result.002 file - promoters60/1444131
aaatcaatca

SEQ ID NO: 116000 - DNA, 11 bp, Unknown
  misc_feature (1)..( 11): Result.002 file - promoters60/1444131
aaattcaatgt

SEQ ID NO: 116001 - DNA, 11 bp, Unknown
  misc_feature (1)..( 11): Result.002 file - promoters60/1444131
tatatcagatt

SEQ ID NO: 116002 - DNA, 11 bp, Unknown
  misc_feature (1)..( 11): Result.002 file - promoters60/1444131
ttaatcaatgg

SEQ ID NO: 116003 - DNA, 9 bp, Unknown
  misc_feature (1)..( 9): Result.002 file - promoters60/1444131
taaaaaaac

SEQ ID NO: 116004 - DNA, 9 bp, Unknown
  misc_feature (1)..( 9): Result.002 file - promoters60/1444131
gaaaaaaaa

SEQ ID NO: 116005 - DNA, 9 bp, Unknown
  misc_feature (1)..( 9): Result.002 file - promoters60/1444131
gaaaaaaaa

SEQ ID NO: 116006 - DNA, 10 bp, Unknown
  misc_feature (1)..( 10): Result.002 file - promoters60/1444131
taaaagaaaa

SEQ ID NO: 116007 - DNA, 10 bp, Unknown
  misc_feature (1)..( 10): Result.002 file - promoters60/1444131
gaaaaacacg

SEQ ID NO: 116008 - DNA, 10 bp, Unknown
  misc_feature (1)..( 10): Result.002 file - promoters60/1444131
gaacaaagac

SEQ ID NO: 116009 - DNA, 10 bp, Unknown
  misc_feature (1)..( 10): Result.002 file - promoters60/1444137
tgtaaaggtc

SEQ ID NO: 116010 - DNA, 10 bp, Unknown
  misc_feature (1)..( 10): Result.002 file - promoters60/1444137
gataagggta

SEQ ID NO: 116011 - DNA, 10 bp, Unknown
  misc_feature (1)..( 10): Result.002 file - promoters60/1444137
ccagaaggtc

SEQ ID NO: 116012 - DNA, 10 bp, Unknown
  misc_feature (1)..( 10): Result.002 file - promoters60/1444137
gattagggtt

SEQ ID NO: 116013 - DNA, 11 bp, Unknown
  misc_feature (1)..( 11): Result.002 file - promoters60/1444137
aaagtatgact

SEQ ID NO: 116014 - DNA, 11 bp, Unknown
  misc_feature (1)..( 11): Result.002 file - promoters60/1444137
aaattatttct

SEQ ID NO: 116015 - DNA, 11 bp, Unknown
  misc_feature (1)..( 11): Result.002 file - promoters60/1444137
caagtaggact

SEQ ID NO: 116016 - DNA, 8 bp, Unknown
  misc_feature (1)..( 8): Result.002 file - promoters60/1444137
aaagaaac

SEQ ID NO: 116017 - DNA, 8 bp, Unknown
  misc_feature (1)..( 8): Result.002 file - promoters60/1444137
taagaaaa

SEQ ID NO: 116018 - DNA, 8 bp, Unknown
  misc_feature (1)..( 8): Result.002 file - promoters60/1444137
aaagaaac

SEQ ID NO: 116019 - DNA, 10 bp, Unknown
  misc_feature (1)..( 10): Result.002 file - promoters60/1444137
tcaatagtta

SEQ ID NO: 116020 - DNA, 10 bp, Unknown
  misc_feature (1)..( 10): Result.002 file - promoters60/1444137
tcagtagtta

SEQ ID NO: 116021 - DNA, 10 bp, Unknown
  misc_feature (1)..( 10): Result.002 file - promoters60/1444137
tgagtggttt

SEQ ID NO: 116022 - DNA, 8 bp, Unknown
  misc_feature (1)..( 8): Result.002 file - promoters60/1444137
tcttcttc

SEQ ID NO: 116023 - DNA, 8 bp, Unknown
  misc_feature (1)..( 8): Result.002 file - promoters60/1444137
tctccttt

SEQ ID NO: 116024 - DNA, 9 bp, Unknown
  misc_feature (1)..( 9): Result.002 file - promoters60/1444137
tttccattt

SEQ ID NO: 116025 - DNA, 7 bp, Unknown
  misc_feature (1)..( 7): Result.002 file - promoters60/1444137
tctctat

SEQ ID NO: 116026 - DNA, 7 bp, Unknown
  misc_feature (1)..( 7): Result.002 file - promoters60/1444137
tctctaa

SEQ ID NO: 116027 - DNA, 7 bp, Unknown
  misc_feature (1)..( 7): Result.002 file - promoters60/1444137
actctaa

SEQ ID NO: 116028 - DNA, 7 bp, Unknown
  misc_feature (1)..( 7): Result.002 file - promoters60/1444149
ttttgat

SEQ ID NO: 116029 - DNA, 7 bp, Unknown
  misc_feature (1)..( 7): Result.002 file - promoters60/1444149
atttgat

SEQ ID NO: 116030 - DNA, 8 bp, Unknown
  misc_feature (1)..( 8): Result.002 file - promoters60/1444149
attgtgat

SEQ ID NO: 116031 - DNA, 6 bp, Unknown
  misc_feature (1)..( 6): Result.002 file - promoters60/1444149
gacact

SEQ ID NO: 116032 - DNA, 6 bp, Unknown
  misc_feature (1)..( 6): Result.002 file - promoters60/1444149
gacact

SEQ ID NO: 116033 - DNA, 8 bp, Unknown
  misc_feature (1)..( 8): Result.002 file - promoters60/1444149
cggtgatg

SEQ ID NO: 116034 - DNA, 8 bp, Unknown
  misc_feature (1)..( 8): Result.002 file - promoters60/1444149
cggagatg

SEQ ID NO: 116035 - DNA, 8 bp, Unknown
  misc_feature (1)..( 8): Result.002 file - promoters60/1444149
ttgtgaca

SEQ ID NO: 116036 - DNA, 8 bp, Unknown
  misc_feature (1)..( 8): Result.002 file - promoters60/1444149
ttgtaaca

SEQ ID NO: 116037 - DNA, 8 bp, Unknown
  misc_feature (1)..( 8): Result.002 file - promoters60/1444149
ttgtgatg

SEQ ID NO: 116038 - DNA, 8 bp, Unknown
  misc_feature (1)..( 8): Result.002 file - promoters60/1444149
ttgtgatg

SEQ ID NO: 116039 - DNA, 9 bp, Unknown
  misc_feature (1)..( 9): Result.002 file - promoters60/1444149
ccgacactg

SEQ ID NO: 116040 - DNA, 9 bp, Unknown
  misc_feature (1)..( 9): Result.002 file - promoters60/1444149
ccgacagac

SEQ ID NO: 116041 - DNA, 9 bp, Unknown
  misc_feature (1)..( 9): Result.002 file - promoters60/1444149
acgaaagac

SEQ ID NO: 116042 - DNA, 6 bp, Unknown
  misc_feature (1)..( 6): Result.002 file - promoters60/1444149
tatttt

SEQ ID NO: 116043 - DNA, 6 bp, Unknown
  misc_feature (1)..( 6): Result.002 file - promoters60/1444149
tatttt

SEQ ID NO: 116044 - DNA, 9 bp, Unknown
  misc_feature (1)..( 9): Result.002 file - promoters60/1444149
caagatttt

SEQ ID NO: 116045 - DNA, 9 bp, Unknown
  misc_feature (1)..( 9): Result.002 file - promoters60/1444149
caacatttt

SEQ ID NO: 116046 - DNA, 7 bp, Unknown
  misc_feature (1)..( 7): Result.002 file - promoters60/1444149
tttcttt

SEQ ID NO: 116047 - DNA, 7 bp, Unknown
  misc_feature (1)..( 7): Result.002 file - promoters60/1444149
tttattt

SEQ ID NO: 116048 - DNA, 9 bp, Unknown
  misc_feature (1)..( 9): Result.002 file - promoters60/1444149
aaaagtaat

SEQ ID NO: 116049 - DNA, 9 bp, Unknown
  misc_feature (1)..( 9): Result.002 file - promoters60/1444149
aaaagtaat

SEQ ID NO: 116050 - DNA, 6 bp, Unknown
  misc_feature (1)..( 6): Result.002 file - promoters60/1444149
ttagtt

SEQ ID NO: 116051 - DNA, 6 bp, Unknown
  misc_feature (1)..( 6): Result.002 file - promoters60/1444149
ttagtt

SEQ ID NO: 116052 - DNA, 6 bp, Unknown
  misc_feature (1)..( 6): Result.002 file - promoters60/1444149
aagatt

SEQ ID NO: 116053 - DNA, 6 bp, Unknown
  misc_feature (1)..( 6): Result.002 file - promoters60/1444149
aagatt

SEQ ID NO: 116054 - DNA, 6 bp, Unknown
  misc_feature (1)..( 6): Result.002 file - promoters60/1444149
atttga

SEQ ID NO: 116055 - DNA, 6 bp, Unknown
  misc_feature (1)..( 6): Result.002 file - promoters60/1444149
atttga

SEQ ID NO: 116056 - DNA, 8 bp, Unknown
  misc_feature (1)..( 8): Result.002 file - promoters60/1444149
tgacaatt

SEQ ID NO: 116057 - DNA, 8 bp, Unknown
  misc_feature (1)..( 8): Result.002 file - promoters60/1444149
tgactatt

SEQ ID NO: 116058 - DNA, 8 bp, Unknown
  misc_feature (1)..( 8): Result.002 file - promoters60/1444149
aattttct

SEQ ID NO: 116059 - DNA, 8 bp, Unknown
  misc_feature (1)..( 8): Result.002 file - promoters60/1444149
aattttct

SEQ ID NO: 116060 - DNA, 8 bp, Unknown
  misc_feature (1)..( 8): Result.002 file - promoters60/1444156
aattaaaa

SEQ ID NO: 116061 - DNA, 8 bp, Unknown
  misc_feature (1)..( 8): Result.002 file - promoters60/1444156
aatcaaaa

SEQ ID NO: 116062 - DNA, 7 bp, Unknown
  misc_feature (1)..( 7): Result.002 file - promoters60/1444156
tttaatg

SEQ ID NO: 116063 - DNA, 7 bp, Unknown
  misc_feature (1)..( 7): Result.002 file - promoters60/1444156
tttaata

SEQ ID NO: 116064 - DNA, 7 bp, Unknown
  misc_feature (1)..( 7): Result.002 file - promoters60/1444156
gttaata

SEQ ID NO: 116065 - DNA, 6 bp, Unknown
  misc_feature (1)..( 6): Result.002 file - promoters60/1444156
gaaaat

SEQ ID NO: 116066 - DNA, 6 bp, Unknown
  misc_feature (1)..( 6): Result.002 file - promoters60/1444156
gaaaat

SEQ ID NO: 116067 - DNA, 7 bp, Unknown
  misc_feature (1)..( 7): Result.002 file - promoters60/1444156
ttgttaa

SEQ ID NO: 116068 - DNA, 7 bp, Unknown
  misc_feature (1)..( 7): Result.002 file - promoters60/1444156
ttggtaa

SEQ ID NO: 116069 - DNA, 9 bp, Unknown
  misc_feature (1)..( 9): Result.002 file - promoters60/1444156
taaaaccta

SEQ ID NO: 116070 - DNA, 9 bp, Unknown
  misc_feature (1)..( 9): Result.002 file - promoters60/1444156
taaaaacta

SEQ ID NO: 116071 - DNA, 6 bp, Unknown
  misc_feature (1)..( 6): Result.002 file - promoters60/1444156
ttaaac

SEQ ID NO: 116072 - DNA, 6 bp, Unknown
  misc_feature (1)..( 6): Result.002 file - promoters60/1444156
ttaaac

SEQ ID NO: 116073 - DNA, 6 bp, Unknown
  misc_feature (1)..( 6): Result.002 file - promoters60/1444156
tcaaca

SEQ ID NO: 116074 - DNA, 6 bp, Unknown
  misc_feature (1)..( 6): Result.002 file - promoters60/1444156
tcaaca

SEQ ID NO: 116075 - DNA, 6 bp, Unknown
  misc_feature (1)..( 6): Result.002 file - promoters60/1444156
ttttca

SEQ ID NO: 116076 - DNA, 6 bp, Unknown
  misc_feature (1)..( 6): Result.002 file - promoters60/1444156
ttttca

SEQ ID NO: 116077 - DNA, 8 bp, Unknown
  misc_feature (1)..( 8): Result.002 file - promoters60/1444156
tcaaaaag

SEQ ID NO: 116078 - DNA, 8 bp, Unknown
  misc_feature (1)..( 8): Result.002 file - promoters60/1444156
tcaaaaag

SEQ ID NO: 116079 - DNA, 9 bp, Unknown
  misc_feature (1)..( 9): Result.002 file - promoters60/1444156
aaaataaaa

SEQ ID NO: 116080 - DNA, 9 bp, Unknown
  misc_feature (1)..( 9): Result.002 file - promoters60/1444156
aaaataaaa

SEQ ID NO: 116081 - DNA, 6 bp, Unknown
  misc_feature (1)..( 6): Result.002 file - promoters60/1444156
aaaaga

SEQ ID NO: 116082 - DNA, 6 bp, Unknown
  misc_feature (1)..( 6): Result.002 file - promoters60/1444156
aaaaga

SEQ ID NO: 116083 - DNA, 7 bp, Unknown
  misc_feature (1)..( 7): Result.002 file - promoters60/1444156
aaaaaaa

SEQ ID NO: 116084 - DNA, 7 bp, Unknown
  misc_feature (1)..( 7): Result.002 file - promoters60/1444156
aaataaa

SEQ ID NO: 116085 - DNA, 7 bp, Unknown
  misc_feature (1)..( 7): Result.002 file - promoters60/1444156
atggaga

SEQ ID NO: 116086 - DNA, 7 bp, Unknown
  misc_feature (1)..( 7): Result.002 file - promoters60/1444156
atgaaga

SEQ ID NO: 116087 - DNA, 13 bp, Unknown
  misc_feature (1)..( 13): Result.002 file - promoters60/1444156
attttttttttta

SEQ ID NO: 116088 - DNA, 13 bp, Unknown
  misc_feature (1)..( 13): Result.002 file - promoters60/1444156
atttgtttattta

SEQ ID NO: 116089 - DNA, 6 bp, Unknown
  misc_feature (1)..( 6): Result.002 file - promoters60/1444180
tcatat

SEQ ID NO: 116090 - DNA, 6 bp, Unknown
  misc_feature (1)..( 6): Result.002 file - promoters60/1444180
tcatat

SEQ ID NO: 116091 - DNA, 7 bp, Unknown
  misc_feature (1)..( 7): Result.002 file - promoters60/1444180
aaaagct

SEQ ID NO: 116092 - DNA, 7 bp, Unknown
  misc_feature (1)..( 7): Result.002 file - promoters60/1444180
aaatgct

SEQ ID NO: 116093 - DNA, 7 bp, Unknown
  misc_feature (1)..( 7): Result.002 file - promoters60/1444180
ccaaaat

SEQ ID NO: 116094 - DNA, 7 bp, Unknown
  misc_feature (1)..( 7): Result.002 file - promoters60/1444180
ccaaaat

SEQ ID NO: 116095 - DNA, 7 bp, Unknown
  misc_feature (1)..( 7): Result.002 file - promoters60/1444180
gaaatca

SEQ ID NO: 116096 - DNA, 7 bp, Unknown
  misc_feature (1)..( 7): Result.002 file - promoters60/1444180
gaactca

SEQ ID NO: 116097 - DNA, 6 bp, Unknown
  misc_feature (1)..( 6): Result.002 file - promoters60/1444180
atatct

SEQ ID NO: 116098 - DNA, 6 bp, Unknown
  misc_feature (1)..( 6): Result.002 file - promoters60/1444180
atatct

SEQ ID NO: 116099 - DNA, 7 bp, Unknown
  misc_feature (1)..( 7): Result.002 file - promoters60/1444180
gtcaaaa

SEQ ID NO: 116100 - DNA, 7 bp, Unknown
  misc_feature (1)..( 7): Result.002 file - promoters60/1444180
gtctaaa

SEQ ID NO: 116101 - DNA, 6 bp, Unknown
  misc_feature (1)..( 6): Result.002 file - promoters60/1444180
aatggg

SEQ ID NO: 116102 - DNA, 6 bp, Unknown
  misc_feature (1)..( 6): Result.002 file - promoters60/1444180
aatggg

SEQ ID NO: 116103 - DNA, 9 bp, Unknown
  misc_feature (1)..( 9): Result.002 file - promoters60/1444180
gatacaaaa

SEQ ID NO: 116104 - DNA, 9 bp, Unknown
  misc_feature (1)..( 9): Result.002 file - promoters60/1444180
gaaacaaaa

SEQ ID NO: 116105 - DNA, 9 bp, Unknown
  misc_feature (1)..( 9): Result.002 file - promoters60/1444180
gaaagaaag

SEQ ID NO: 116106 - DNA, 6 bp, Unknown
  misc_feature (1)..( 6): Result.002 file - promoters60/1444180
ttaaag

SEQ ID NO: 116107 - DNA, 6 bp, Unknown
  misc_feature (1)..( 6): Result.002 file - promoters60/1444180
ttaaag

SEQ ID NO: 116108 - DNA, 6 bp, Unknown
  misc_feature (1)..( 6): Result.002 file - promoters60/1444180
agtaaa

SEQ ID NO: 116109 - DNA, 6 bp, Unknown
  misc_feature (1)..( 6): Result.002 file - promoters60/1444180
agtaaa

SEQ ID NO: 116110 - DNA, 7 bp, Unknown
  misc_feature (1)..( 7): Result.002 file - promoters60/1444180
aatcggg

SEQ ID NO: 116111 - DNA, 7 bp, Unknown
  misc_feature (1)..( 7): Result.002 file - promoters60/1444180
aattggg

SEQ ID NO: 116112 - DNA, 10 bp, Unknown
  misc_feature (1)..( 10): Result.002 file - promoters60/1444180
ggaaaagaaa

SEQ ID NO: 116113 - DNA, 10 bp, Unknown
  misc_feature (1)..( 10): Result.002 file - promoters60/1444180
ggaaatgaaa

SEQ ID NO: 116114 - DNA, 7 bp, Unknown
  misc_feature (1)..( 7): Result.002 file - promoters60/1444180
cccacta

SEQ ID NO: 116115 - DNA, 7 bp, Unknown
  misc_feature (1)..( 7): Result.002 file - promoters60/1444180
cccacta

SEQ ID NO: 116116 - DNA, 9 bp, Unknown
  misc_feature (1)..( 9): Result.002 file - promoters60/1444180
aaagaaaag

SEQ ID NO: 116117 - DNA, 9 bp, Unknown
  misc_feature (1)..( 9): Result.002 file - promoters60/1444180
aaagtaaag

SEQ ID NO: 116118 - DNA, 7 bp, Unknown
  misc_feature (1)..( 7): Result.002 file - promoters60/1444180
gtatata

SEQ ID NO: 116119 - DNA, 7 bp, Unknown
  misc_feature (1)..( 7): Result.002 file - promoters60/1444180
gtatata

SEQ ID NO: 116120 - DNA, 6 bp, Unknown
  misc_feature (1)..( 6): Result.002 file - promoters60/1444400
acaaac

SEQ ID NO: 116121 - DNA, 6 bp, Unknown
  misc_feature (1)..( 6): Result.002 file - promoters60/1444400
acaaac

SEQ ID NO: 116122 - DNA, 8 bp, Unknown
  misc_feature (1)..( 8): Result.002 file - promoters60/1444400
caaaagta

SEQ ID NO: 116123 - DNA, 8 bp, Unknown
  misc_feature (1)..( 8): Result.002 file - promoters60/1444400
caaacgta

SEQ ID NO: 116124 - DNA, 6 bp, Unknown
  misc_feature (1)..( 6): Result.002 file - promoters60/1444400
aattaa

SEQ ID NO: 116125 - DNA, 6 bp, Unknown
  misc_feature (1)..( 6): Result.002 file - promoters60/1444400
aattaa

SEQ ID NO: 116126 - DNA, 7 bp, Unknown
  misc_feature (1)..( 7): Result.002 file - promoters60/1444400
aattaac

SEQ ID NO: 116127 - DNA, 7 bp, Unknown
  misc_feature (1)..( 7): Result.002 file - promoters60/1444400
aataaac

SEQ ID NO: 116128 - DNA, 7 bp, Unknown
  misc_feature (1)..( 7): Result.002 file - promoters60/1444400
atatata

SEQ ID NO: 116129 - DNA, 7 bp, Unknown
  misc_feature (1)..( 7): Result.002 file - promoters60/1444400
atatata

SEQ ID NO: 116130 - DNA, 6 bp, Unknown
  misc_feature (1)..( 6): Result.002 file - promoters60/1444400
atatat

SEQ ID NO: 116131 - DNA, 6 bp, Unknown
  misc_feature (1)..( 6): Result.002 file - promoters60/1444400
atatat

SEQ ID NO: 116132 - DNA, 14 bp, Unknown
  misc_feature (1)..( 14): Result.002 file - promoters60/1444400
tgtgttcgtttggt

SEQ ID NO: 116133 - DNA, 14 bp, Unknown
  misc_feature (1)..( 14): Result.002 file - promoters60/1444400
gatgttcgtttggt

SEQ ID NO: 116134 - DNA, 14 bp, Unknown
  misc_feature (1)..( 14): Result.002 file - promoters60/1444400
tgtggtcggctaaa

SEQ ID NO: 116135 - DNA, 7 bp, Unknown
  misc_feature (1)..( 7): Result.002 file - promoters60/1444400
tggtcgc

SEQ ID NO: 116136 - DNA, 7 bp, Unknown
  misc_feature (1)..( 7): Result.002 file - promoters60/1444400
tggacgc

SEQ ID NO: 116137 - DNA, 7 bp, Unknown
  misc_feature (1)..( 7): Result.002 file - promoters60/1444400
caaccgc

SEQ ID NO: 116138 - DNA, 7 bp, Unknown
  misc_feature (1)..( 7): Result.002 file - promoters60/1444400
caaacgc

SEQ ID NO: 116139 - DNA, 7 bp, Unknown
  misc_feature (1)..( 7): Result.002 file - promoters60/1444400
gcggcaa

SEQ ID NO: 116140 - DNA, 7 bp, Unknown
  misc_feature (1)..( 7): Result.002 file - promoters60/1444400
gcgacaa

SEQ ID NO: 116141 - DNA, 7 bp, Unknown
  misc_feature (1)..( 7): Result.002 file - promoters60/1444400
tttttca

SEQ ID NO: 116142 - DNA, 7 bp, Unknown
  misc_feature (1)..( 7): Result.002 file - promoters60/1444400
tttttca

SEQ ID NO: 116143 - DNA, 6 bp, Unknown
  misc_feature (1)..( 6): Result.002 file - promoters60/1444400
cccaat

SEQ ID NO: 116144 - DNA, 6 bp, Unknown
  misc_feature (1)..( 6): Result.002 file - promoters60/1444400
cccaat

SEQ ID NO: 116145 - DNA, 6 bp, Unknown
  misc_feature (1)..( 6): Result.002 file - promoters60/1444400
tatgtg

SEQ ID NO: 116146 - DNA, 6 bp, Unknown
  misc_feature (1)..( 6): Result.002 file - promoters60/1444400
tatgtg

SEQ ID NO: 116147 - DNA, 8 bp, Unknown
  misc_feature (1)..( 8): Result.002 file - promoters60/1444400
tatattta

SEQ ID NO: 116148 - DNA, 8 bp, Unknown
  misc_feature (1)..( 8): Result.002 file - promoters60/1444400
tataatta

SEQ ID NO: 116149 - DNA, 9 bp, Unknown
  misc_feature (1)..( 9): Result.002 file - promoters60/1444400
ttgctaata

SEQ ID NO: 116150 - DNA, 9 bp, Unknown
  misc_feature (1)..( 9): Result.002 file - promoters60/1444400
ttggtaata

SEQ ID NO: 116151 - DNA, 8 bp, Unknown
  misc_feature (1)..( 8): Result.002 file - promoters60/1444400
acgtacat

SEQ ID NO: 116152 - DNA, 8 bp, Unknown
  misc_feature (1)..( 8): Result.002 file - promoters60/1444400
acgaacat

SEQ ID NO: 116153 - DNA, 8 bp, Unknown
  misc_feature (1)..( 8): Result.002 file - promoters60/1444400
attatatc

SEQ ID NO: 116154 - DNA, 8 bp, Unknown
  misc_feature (1)..( 8): Result.002 file - promoters60/1444400
attctatc

SEQ ID NO: 116155 - DNA, 12 bp, Unknown
  misc_feature (1)..( 12): Result.002 file - promoters60/1444400
aaacattttatt

SEQ ID NO: 116156 - DNA, 12 bp, Unknown
  misc_feature (1)..( 12): Result.002 file - promoters60/1444400
aaagatttgatt

SEQ ID NO: 116157 - DNA, 6 bp, Unknown
  misc_feature (1)..( 6): Result.002 file - promoters60/1444400
ctacaa

SEQ ID NO: 116158 - DNA, 6 bp, Unknown
  misc_feature (1)..( 6): Result.002 file - promoters60/1444400
ctacaa

SEQ ID NO: 116159 - DNA, 8 bp, Unknown
  misc_feature (1)..( 8): Result.002 file - promoters60/1444400
aaaaccta

SEQ ID NO: 116160 - DNA, 8 bp, Unknown
  misc_feature (1)..( 8): Result.002 file - promoters60/1444400
aaaaccta

SEQ ID NO: 116161 - DNA, 7 bp, Unknown
  misc_feature (1)..( 7): Result.002 file - promoters60/1444448
tgtttta

SEQ ID NO: 116162 - DNA, 7 bp, Unknown
  misc_feature (1)..( 7): Result.002 file - promoters60/1444448
tgtttta

SEQ ID NO: 116163 - DNA, 7 bp, Unknown
  misc_feature (1)..( 7): Result.002 file - promoters60/1444448
tgttttt

SEQ ID NO: 116164 - DNA, 6 bp, Unknown
  misc_feature (1)..( 6): Result.002 file - promoters60/1444448
agaagt

SEQ ID NO: 116165 - DNA, 6 bp, Unknown
  misc_feature (1)..( 6): Result.002 file - promoters60/1444448
agaagt

SEQ ID NO: 116166 - DNA, 6 bp, Unknown
  misc_feature (1)..( 6): Result.002 file - promoters60/1444448
tttaaa

SEQ ID NO: 116167 - DNA, 6 bp, Unknown
  misc_feature (1)..( 6): Result.002 file - promoters60/1444448
tttaaa

SEQ ID NO: 116168 - DNA, 8 bp, Unknown
  misc_feature (1)..( 8): Result.002 file - promoters60/1444448
ataaatta

SEQ ID NO: 116169 - DNA, 8 bp, Unknown
  misc_feature (1)..( 8): Result.002 file - promoters60/1444448
ataaatcg

SEQ ID NO: 116170 - DNA, 8 bp, Unknown
  misc_feature (1)..( 8): Result.002 file - promoters60/1444448
ataaaaaa

SEQ ID NO: 116171 - DNA, 8 bp, Unknown
  misc_feature (1)..( 8): Result.002 file - promoters60/1444448
ttaaattt

SEQ ID NO: 116172 - DNA, 8 bp, Unknown
  misc_feature (1)..( 8): Result.002 file - promoters60/1444448
ctaaattg

SEQ ID NO: 116173 - DNA, 8 bp, Unknown
  misc_feature (1)..( 8): Result.002 file - promoters60/1444448
taaaattc

SEQ ID NO: 116174 - DNA, 7 bp, Unknown
  misc_feature (1)..( 7): Result.002 file - promoters60/1444448
tttttga

SEQ ID NO: 116175 - DNA, 7 bp, Unknown
  misc_feature (1)..( 7): Result.002 file - promoters60/1444448
tttttga

SEQ ID NO: 116176 - DNA, 7 bp, Unknown
  misc_feature (1)..( 7): Result.002 file - promoters60/1444448
tttttgt

SEQ ID NO: 116177 - DNA, 8 bp, Unknown
  misc_feature (1)..( 8): Result.002 file - promoters60/1444448
gtagaatt

SEQ ID NO: 116178 - DNA, 8 bp, Unknown
  misc_feature (1)..( 8): Result.002 file - promoters60/1444448
gtacaatt

SEQ ID NO: 116179 - DNA, 7 bp, Unknown
  misc_feature (1)..( 7): Result.002 file - promoters60/1444448
ttcggtt

SEQ ID NO: 116180 - DNA, 7 bp, Unknown
  misc_feature (1)..( 7): Result.002 file - promoters60/1444448
ttcggtt

SEQ ID NO: 116181 - DNA, 6 bp, Unknown
  misc_feature (1)..( 6): Result.002 file - promoters60/1444448
tttcaa

SEQ ID NO: 116182 - DNA, 6 bp, Unknown
  misc_feature (1)..( 6): Result.002 file - promoters60/1444448
tttcaa

SEQ ID NO: 116183 - DNA, 6 bp, Unknown
  misc_feature (1)..( 6): Result.002 file - promoters60/1444448
ccaata

SEQ ID NO: 116184 - DNA, 6 bp, Unknown
  misc_feature (1)..( 6): Result.002 file - promoters60/1444448
ccaata

SEQ ID NO: 116185 - DNA, 9 bp, Unknown
  misc_feature (1)..( 9): Result.002 file - promoters60/1444448
catttctta

SEQ ID NO: 116186 - DNA, 9 bp, Unknown
  misc_feature (1)..( 9): Result.002 file - promoters60/1444448
cattgctta

SEQ ID NO: 116187 - DNA, 7 bp, Unknown
  misc_feature (1)..( 7): Result.002 file - promoters60/1444448
gttttaa

SEQ ID NO: 116188 - DNA, 7 bp, Unknown
  misc_feature (1)..( 7): Result.002 file - promoters60/1444448
gttctaa

SEQ ID NO: 116189 - DNA, 6 bp, Unknown
  misc_feature (1)..( 6): Result.002 file - promoters60/1444448
taaaat

SEQ ID NO: 116190 - DNA, 6 bp, Unknown
  misc_feature (1)..( 6): Result.002 file - promoters60/1444448
taaaat

SEQ ID NO: 116191 - DNA, 7 bp, Unknown
  misc_feature (1)..( 7): Result.002 file - promoters60/1444448
gaataat

SEQ ID NO: 116192 - DNA, 7 bp, Unknown
  misc_feature (1)..( 7): Result.002 file - promoters60/1444448
gaagaat

SEQ ID NO: 116193 - DNA, 7 bp, Unknown
  misc_feature (1)..( 7): Result.002 file - promoters60/1444448
gattaat

SEQ ID NO: 116194 - DNA, 7 bp, Unknown
  misc_feature (1)..( 7): Result.002 file - promoters60/1444448
gatgaat

SEQ ID NO: 116195 - DNA, 11 bp, Unknown
  misc_feature (1)..( 11): Result.002 file - promoters60/1444460
agatttcttca

SEQ ID NO: 116196 - DNA, 11 bp, Unknown
  misc_feature (1)..( 11): Result.002 file - promoters60/1444460
agctttcttct

SEQ ID NO: 116197 - DNA, 11 bp, Unknown
  misc_feature (1)..( 11): Result.002 file - promoters60/1444460
aattttcttct

SEQ ID NO: 116198 - DNA, 11 bp, Unknown
  misc_feature (1)..( 11): Result.002 file - promoters60/1444460
taatttcttaa

SEQ ID NO: 116199 - DNA, 11 bp, Unknown
  misc_feature (1)..( 11): Result.002 file - promoters60/1444460
taatatcttca

SEQ ID NO: 116200 - DNA, 11 bp, Unknown
  misc_feature (1)..( 11): Result.002 file - promoters60/1444460
ctccatcctca

SEQ ID NO: 116201 - DNA, 10 bp, Unknown
  misc_feature (1)..( 10): Result.002 file - promoters60/1444460
gaaattagtg

SEQ ID NO: 116202 - DNA, 10 bp, Unknown
  misc_feature (1)..( 10): Result.002 file - promoters60/1444460
caaatgagtg

SEQ ID NO: 116203 - DNA, 10 bp, Unknown
  misc_feature (1)..( 10): Result.002 file - promoters60/1444460
caaaagagaa

SEQ ID NO: 116204 - DNA, 10 bp, Unknown
  misc_feature (1)..( 10): Result.002 file - promoters60/1444460
caaaaggtat

SEQ ID NO: 116205 - DNA, 10 bp, Unknown
  misc_feature (1)..( 10): Result.002 file - promoters60/1444460
taaaagatta

SEQ ID NO: 116206 - DNA, 10 bp, Unknown
  misc_feature (1)..( 10): Result.002 file - promoters60/1444460
ggtaagagag

SEQ ID NO: 116207 - DNA, 15 bp, Unknown
  misc_feature (1)..( 15): Result.002 file - promoters60/1444473
ttggttattggaaga

SEQ ID NO: 116208 - DNA, 15 bp, Unknown
  misc_feature (1)..( 15): Result.002 file - promoters60/1444473
cttcttattggaaga

SEQ ID NO: 116209 - DNA, 15 bp, Unknown
  misc_feature (1)..( 15): Result.002 file - promoters60/1444473
catgtttttgctgat

SEQ ID NO: 116210 - DNA, 15 bp, Unknown
  misc_feature (1)..( 15): Result.002 file - promoters60/1444473
catctttttcaccat

SEQ ID NO: 116211 - DNA, 15 bp, Unknown
  misc_feature (1)..( 15): Result.002 file - promoters60/1444473
gctctaattgcttgc

SEQ ID NO: 116212 - DNA, 15 bp, Unknown
  misc_feature (1)..( 15): Result.002 file - promoters60/1444473
attgttttctttggt

SEQ ID NO: 116213 - DNA, 13 bp, Unknown
  misc_feature (1)..( 13): Result.002 file - promoters60/1444473
tcattaatttaga

SEQ ID NO: 116214 - DNA, 13 bp, Unknown
  misc_feature (1)..( 13): Result.002 file - promoters60/1444473
caaaacattgaga

SEQ ID NO: 116215 - DNA, 13 bp, Unknown
  misc_feature (1)..( 13): Result.002 file - promoters60/1444473
ccatgaatttaaa

SEQ ID NO: 116216 - DNA, 13 bp, Unknown
  misc_feature (1)..( 13): Result.002 file - promoters60/1444473
cccacaactttga

SEQ ID NO: 116217 - DNA, 13 bp, Unknown
  misc_feature (1)..( 13): Result.002 file - promoters60/1444473
ccaagaagaaaaa

SEQ ID NO: 116218 - DNA, 13 bp, Unknown
  misc_feature (1)..( 13): Result.002 file - promoters60/1444473
ttatgtatttggg

SEQ ID NO: 116219 - DNA, 18 bp, Unknown
  misc_feature (1)..( 18): Result.002 file - promoters60/1444479
aaaaattattaaagtata

SEQ ID NO: 116220 - DNA, 18 bp, Unknown
  misc_feature (1)..( 18): Result.002 file - promoters60/1444479
aaagattattaaattata

SEQ ID NO: 116221 - DNA, 18 bp, Unknown
  misc_feature (1)..( 18): Result.002 file - promoters60/1444479
tctcatttttaatcaaaa

SEQ ID NO: 116222 - DNA, 18 bp, Unknown
  misc_feature (1)..( 18): Result.002 file - promoters60/1444479
aaaatttatctgtaaatg

SEQ ID NO: 116223 - DNA, 10 bp, Unknown
  misc_feature (1)..( 10): Result.002 file - promoters60/1444479
tttactaata

SEQ ID NO: 116224 - DNA, 10 bp, Unknown
  misc_feature (1)..( 10): Result.002 file - promoters60/1444479
attattaaag

SEQ ID NO: 116225 - DNA, 10 bp, Unknown
  misc_feature (1)..( 10): Result.002 file - promoters60/1444479
aataccaatc

SEQ ID NO: 116226 - DNA, 10 bp, Unknown
  misc_feature (1)..( 10): Result.002 file - promoters60/1444479
tttgctatac

SEQ ID NO: 116227 - DNA, 10 bp, Unknown
  misc_feature (1)..( 10): Result.002 file - promoters60/1444479
tataataatt

SEQ ID NO: 116228 - DNA, 13 bp, Unknown
  misc_feature (1)..( 13): Result.002 file - promoters60/1444479
ataattttagaga

SEQ ID NO: 116229 - DNA, 13 bp, Unknown
  misc_feature (1)..( 13): Result.002 file - promoters60/1444479
ctaattttaattt

SEQ ID NO: 116230 - DNA, 13 bp, Unknown
  misc_feature (1)..( 13): Result.002 file - promoters60/1444479
ataattatttggt

SEQ ID NO: 116231 - DNA, 13 bp, Unknown
  misc_feature (1)..( 13): Result.002 file - promoters60/1444479
atcattttcattt

SEQ ID NO: 116232 - DNA, 13 bp, Unknown
  misc_feature (1)..( 13): Result.002 file - promoters60/1444479
tacattttgtaac

SEQ ID NO: 116233 - DNA, 8 bp, Unknown
  misc_feature (1)..( 8): Result.002 file - promoters60/1444479
cattttac

SEQ ID NO: 116234 - DNA, 8 bp, Unknown
  misc_feature (1)..( 8): Result.002 file - promoters60/1444479
tattttag

SEQ ID NO: 116235 - DNA, 8 bp, Unknown
  misc_feature (1)..( 8): Result.002 file - promoters60/1444479
gtttttac

SEQ ID NO: 116236 - DNA, 8 bp, Unknown
  misc_feature (1)..( 8): Result.002 file - promoters60/1444479
tattttta

SEQ ID NO: 116237 - DNA, 10 bp, Unknown
  misc_feature (1)..( 10): Result.002 file - promoters60/1444479
ctatatatat

SEQ ID NO: 116238 - DNA, 10 bp, Unknown
  misc_feature (1)..( 10): Result.002 file - promoters60/1444479
ttatttatat

SEQ ID NO: 116239 - DNA, 10 bp, Unknown
  misc_feature (1)..( 10): Result.002 file - promoters60/1444479
gtatatataa

SEQ ID NO: 116240 - DNA, 10 bp, Unknown
  misc_feature (1)..( 10): Result.002 file - promoters60/1444479
ctatataaac

SEQ ID NO: 116241 - DNA, 10 bp, Unknown
  misc_feature (1)..( 10): Result.002 file - promoters60/1444479
ctataaatag

SEQ ID NO: 116242 - DNA, 9 bp, Unknown
  misc_feature (1)..( 9): Result.002 file - promoters60/1444479
ctaatttta

SEQ ID NO: 116243 - DNA, 9 bp, Unknown
  misc_feature (1)..( 9): Result.002 file - promoters60/1444479
tcaattttt

SEQ ID NO: 116244 - DNA, 9 bp, Unknown
  misc_feature (1)..( 9): Result.002 file - promoters60/1444479
ctaatttta

SEQ ID NO: 116245 - DNA, 9 bp, Unknown
  misc_feature (1)..( 9): Result.002 file - promoters60/1444479
aaaatgtta

SEQ ID NO: 116246 - DNA, 12 bp, Unknown
  misc_feature (1)..( 12): Result.002 file - promoters60/1444479
caaacaatcatt

SEQ ID NO: 116247 - DNA, 12 bp, Unknown
  misc_feature (1)..( 12): Result.002 file - promoters60/1444479
aaagcaatcaga

SEQ ID NO: 116248 - DNA, 12 bp, Unknown
  misc_feature (1)..( 12): Result.002 file - promoters60/1444479
aaaaaaataatt

SEQ ID NO: 116249 - DNA, 12 bp, Unknown
  misc_feature (1)..( 12): Result.002 file - promoters60/1444479
aaaaaaattgat

SEQ ID NO: 116250 - DNA, 8 bp, Unknown
  misc_feature (1)..( 8): Result.002 file - promoters60/1444479
aattttgt

SEQ ID NO: 116251 - DNA, 8 bp, Unknown
  misc_feature (1)..( 8): Result.002 file - promoters60/1444479
cattttgt

SEQ ID NO: 116252 - DNA, 8 bp, Unknown
  misc_feature (1)..( 8): Result.002 file - promoters60/1444479
cattttca

SEQ ID NO: 116253 - DNA, 9 bp, Unknown
  misc_feature (1)..( 9): Result.002 file - promoters60/1444479
aatcttttt

SEQ ID NO: 116254 - DNA, 9 bp, Unknown
  misc_feature (1)..( 9): Result.002 file - promoters60/1444502
tttgtttgt

SEQ ID NO: 116255 - DNA, 9 bp, Unknown
  misc_feature (1)..( 9): Result.002 file - promoters60/1444502
tttgtttgt

SEQ ID NO: 116256 - DNA, 7 bp, Unknown
  misc_feature (1)..( 7): Result.002 file - promoters60/1444502
gacacgt

SEQ ID NO: 116257 - DNA, 7 bp, Unknown
  misc_feature (1)..( 7): Result.002 file - promoters60/1444502
gactcgt

SEQ ID NO: 116258 - DNA, 6 bp, Unknown
  misc_feature (1)..( 6): Result.002 file - promoters60/1444502
ggcttt

SEQ ID NO: 116259 - DNA, 6 bp, Unknown
  misc_feature (1)..( 6): Result.002 file - promoters60/1444502
ggcttt

SEQ ID NO: 116260 - DNA, 7 bp, Unknown
  misc_feature (1)..( 7): Result.002 file - promoters60/1444502
gaatata

SEQ ID NO: 116261 - DNA, 7 bp, Unknown
  misc_feature (1)..( 7): Result.002 file - promoters60/1444502
gaatata

SEQ ID NO: 116262 - DNA, 7 bp, Unknown
  misc_feature (1)..( 7): Result.002 file - promoters60/1444502
attcttt

SEQ ID NO: 116263 - DNA, 7 bp, Unknown
  misc_feature (1)..( 7): Result.002 file - promoters60/1444502
atttttt

SEQ ID NO: 116264 - DNA, 7 bp, Unknown
  misc_feature (1)..( 7): Result.002 file - promoters60/1444502
aagcaga

SEQ ID NO: 116265 - DNA, 7 bp, Unknown
  misc_feature (1)..( 7): Result.002 file - promoters60/1444502
aagaaga

SEQ ID NO: 116266 - DNA, 9 bp, Unknown
  misc_feature (1)..( 9): Result.002 file - promoters60/1444502
agttggaaa

SEQ ID NO: 116267 - DNA, 9 bp, Unknown
  misc_feature (1)..( 9): Result.002 file - promoters60/1444502
agttgaaaa

SEQ ID NO: 116268 - DNA, 7 bp, Unknown
  misc_feature (1)..( 7): Result.002 file - promoters60/1444502
aggccca

SEQ ID NO: 116269 - DNA, 7 bp, Unknown
  misc_feature (1)..( 7): Result.002 file - promoters60/1444502
aggccca

SEQ ID NO: 116270 - DNA, 6 bp, Unknown
  misc_feature (1)..( 6): Result.002 file - promoters60/1444502
aaagga

SEQ ID NO: 116271 - DNA, 6 bp, Unknown
  misc_feature (1)..( 6): Result.002 file - promoters60/1444502
aaagga

SEQ ID NO: 116272 - DNA, 7 bp, Unknown
  misc_feature (1)..( 7): Result.002 file - promoters60/1444502
tcacttt

SEQ ID NO: 116273 - DNA, 7 bp, Unknown
  misc_feature (1)..( 7): Result.002 file - promoters60/1444502
tcagttt

SEQ ID NO: 116274 - DNA, 8 bp, Unknown
  misc_feature (1)..( 8): Result.002 file - promoters60/1444502
aaaaaaaa

SEQ ID NO: 116275 - DNA, 8 bp, Unknown
  misc_feature (1)..( 8): Result.002 file - promoters60/1444502
aaaaaaaa

SEQ ID NO: 116276 - DNA, 18 bp, Unknown
  misc_feature (1)..( 18): Result.002 file - promoters60/1444506
aaaaattattaaagtata

SEQ ID NO: 116277 - DNA, 18 bp, Unknown
  misc_feature (1)..( 18): Result.002 file - promoters60/1444506
aaagattattaaattata

SEQ ID NO: 116278 - DNA, 18 bp, Unknown
  misc_feature (1)..( 18): Result.002 file - promoters60/1444506
aaaatttatctgtaaatg

SEQ ID NO: 116279 - DNA, 10 bp, Unknown
  misc_feature (1)..( 10): Result.002 file - promoters60/1444506
tttactaata

SEQ ID NO: 116280 - DNA, 10 bp, Unknown
  misc_feature (1)..( 10): Result.002 file - promoters60/1444506
attattaaag

SEQ ID NO: 116281 - DNA, 10 bp, Unknown
  misc_feature (1)..( 10): Result.002 file - promoters60/1444506
tttgctatac

SEQ ID NO: 116282 - DNA, 10 bp, Unknown
  misc_feature (1)..( 10): Result.002 file - promoters60/1444506
tataataatt

SEQ ID NO: 116283 - DNA, 9 bp, Unknown
  misc_feature (1)..( 9): Result.002 file - promoters60/1444506
ataatttta

SEQ ID NO: 116284 - DNA, 9 bp, Unknown
  misc_feature (1)..( 9): Result.002 file - promoters60/1444506
ctaatttta

SEQ ID NO: 116285 - DNA, 9 bp, Unknown
  misc_feature (1)..( 9): Result.002 file - promoters60/1444506
ataattatt

SEQ ID NO: 116286 - DNA, 7 bp, Unknown
  misc_feature (1)..( 7): Result.002 file - promoters60/1444506
catttta

SEQ ID NO: 116287 - DNA, 7 bp, Unknown
  misc_feature (1)..( 7): Result.002 file - promoters60/1444506
tatttta

SEQ ID NO: 116288 - DNA, 7 bp, Unknown
  misc_feature (1)..( 7): Result.002 file - promoters60/1444506
tattttt

SEQ ID NO: 116289 - DNA, 10 bp, Unknown
  misc_feature (1)..( 10): Result.002 file - promoters60/1444506
ctatatatat

SEQ ID NO: 116290 - DNA, 10 bp, Unknown
  misc_feature (1)..( 10): Result.002 file - promoters60/1444506
ttatttatat

SEQ ID NO: 116291 - DNA, 10 bp, Unknown
  misc_feature (1)..( 10): Result.002 file - promoters60/1444506
gtatatataa

SEQ ID NO: 116292 - DNA, 10 bp, Unknown
  misc_feature (1)..( 10): Result.002 file - promoters60/1444506
ctatataaac

SEQ ID NO: 116293 - DNA, 9 bp, Unknown
  misc_feature (1)..( 9): Result.002 file - promoters60/1444506
ctaatttta

SEQ ID NO: 116294 - DNA, 9 bp, Unknown
  misc_feature (1)..( 9): Result.002 file - promoters60/1444506
ctaatttta

SEQ ID NO: 116295 - DNA, 9 bp, Unknown
  misc_feature (1)..( 9): Result.002 file - promoters60/1444506
aaaatgtta

SEQ ID NO: 116296 - DNA, 8 bp, Unknown
  misc_feature (1)..( 8): Result.002 file - promoters60/1444506
ttttgtta

SEQ ID NO: 116297 - DNA, 8 bp, Unknown
  misc_feature (1)..( 8): Result.002 file - promoters60/1444506
atttgtta

SEQ ID NO: 116298 - DNA, 8 bp, Unknown
  misc_feature (1)..( 8): Result.002 file - promoters60/1444506
ttttgttt

SEQ ID NO: 116299 - DNA, 8 bp, Unknown
  misc_feature (1)..( 8): Result.002 file - promoters60/1444506
tcaaaaaa

SEQ ID NO: 116300 - DNA, 8 bp, Unknown
  misc_feature (1)..( 8): Result.002 file - promoters60/1444506
acaaaaaa

SEQ ID NO: 116301 - DNA, 8 bp, Unknown
  misc_feature (1)..( 8): Result.002 file - promoters60/1444506
acaaaact

SEQ ID NO: 116302 - DNA, 11 bp, Unknown
  misc_feature (1)..( 11): Result.002 file - promoters60/1444506
aaacaatcatt

SEQ ID NO: 116303 - DNA, 11 bp, Unknown
  misc_feature (1)..( 11): Result.002 file - promoters60/1444506
aaaaaataatt

SEQ ID NO: 116304 - DNA, 11 bp, Unknown
  misc_feature (1)..( 11): Result.002 file - promoters60/1444506
aaaaaattgat

SEQ ID NO: 116305 - DNA, 8 bp, Unknown
  misc_feature (1)..( 8): Result.002 file - promoters60/1444506
taatagaa

SEQ ID NO: 116306 - DNA, 8 bp, Unknown
  misc_feature (1)..( 8): Result.002 file - promoters60/1444506
taattgaa

SEQ ID NO: 116307 - DNA, 8 bp, Unknown
  misc_feature (1)..( 8): Result.002 file - promoters60/1444506
aaattatt

SEQ ID NO: 116308 - DNA, 9 bp, Unknown
  misc_feature (1)..( 9): Result.002 file - promoters60/1444506
aacatattt

SEQ ID NO: 116309 - DNA, 9 bp, Unknown
  misc_feature (1)..( 9): Result.002 file - promoters60/1444506
aaaatattt

SEQ ID NO: 116310 - DNA, 9 bp, Unknown
  misc_feature (1)..( 9): Result.002 file - promoters60/1444506
aaaacattt

SEQ ID NO: 116311 - DNA, 7 bp, Unknown
  misc_feature (1)..( 7): Result.002 file - promoters60/1444506
attttgt

SEQ ID NO: 116312 - DNA, 7 bp, Unknown
  misc_feature (1)..( 7): Result.002 file - promoters60/1444506
attttgt

SEQ ID NO: 116313 - DNA, 7 bp, Unknown
  misc_feature (1)..( 7): Result.002 file - promoters60/1444506
tttttgt

SEQ ID NO: 116314 - DNA, 8 bp, Unknown
  misc_feature (1)..( 8): Result.002 file - promoters60/1444506
aaaaaaat

SEQ ID NO: 116315 - DNA, 8 bp, Unknown
  misc_feature (1)..( 8): Result.002 file - promoters60/1444506
aaaaaaaa

SEQ ID NO: 116316 - DNA, 8 bp, Unknown
  misc_feature (1)..( 8): Result.002 file - promoters60/1444506
aaaaaaat

SEQ ID NO: 116317 - DNA, 19 bp, Unknown
  misc_feature (1)..( 19): Result.002 file - promoters60/1444514
aaaaattattaaagtatat

SEQ ID NO: 116318 - DNA, 19 bp, Unknown
  misc_feature (1)..( 19): Result.002 file - promoters60/1444514
aaagattattaaattataa

SEQ ID NO: 116319 - DNA, 19 bp, Unknown
  misc_feature (1)..( 19): Result.002 file - promoters60/1444514
gcatcaattgtatgtatat

SEQ ID NO: 116320 - DNA, 19 bp, Unknown
  misc_feature (1)..( 19): Result.002 file - promoters60/1444514
aaaatttatctgtaaatgt

SEQ ID NO: 116321 - DNA, 10 bp, Unknown
  misc_feature (1)..( 10): Result.002 file - promoters60/1444514
tttactaata

SEQ ID NO: 116322 - DNA, 10 bp, Unknown
  misc_feature (1)..( 10): Result.002 file - promoters60/1444514
attattaaag

SEQ ID NO: 116323 - DNA, 10 bp, Unknown
  misc_feature (1)..( 10): Result.002 file - promoters60/1444514
tttgctatac

SEQ ID NO: 116324 - DNA, 10 bp, Unknown
  misc_feature (1)..( 10): Result.002 file - promoters60/1444514
tataataatt

SEQ ID NO: 116325 - DNA, 12 bp, Unknown
  misc_feature (1)..( 12): Result.002 file - promoters60/1444514
cactatatatat

SEQ ID NO: 116326 - DNA, 12 bp, Unknown
  misc_feature (1)..( 12): Result.002 file - promoters60/1444514
atttatttatat

SEQ ID NO: 116327 - DNA, 12 bp, Unknown
  misc_feature (1)..( 12): Result.002 file - promoters60/1444514
tcgtatatataa

SEQ ID NO: 116328 - DNA, 12 bp, Unknown
  misc_feature (1)..( 12): Result.002 file - promoters60/1444514
ctctatataaac

SEQ ID NO: 116329 - DNA, 12 bp, Unknown
  misc_feature (1)..( 12): Result.002 file - promoters60/1444514
tcgtatatgaat

SEQ ID NO: 116330 - DNA, 10 bp, Unknown
  misc_feature (1)..( 10): Result.002 file - promoters60/1444514
ttttaatttt

SEQ ID NO: 116331 - DNA, 10 bp, Unknown
  misc_feature (1)..( 10): Result.002 file - promoters60/1444514
cgttaattac

SEQ ID NO: 116332 - DNA, 10 bp, Unknown
  misc_feature (1)..( 10): Result.002 file - promoters60/1444514
gactaatttt

SEQ ID NO: 116333 - DNA, 10 bp, Unknown
  misc_feature (1)..( 10): Result.002 file - promoters60/1444514
ttttaatctt

SEQ ID NO: 116334 - DNA, 8 bp, Unknown
  misc_feature (1)..( 8): Result.002 file - promoters60/1444514
ttttgtta

SEQ ID NO: 116335 - DNA, 8 bp, Unknown
  misc_feature (1)..( 8): Result.002 file - promoters60/1444514
atttgtta

SEQ ID NO: 116336 - DNA, 8 bp, Unknown
  misc_feature (1)..( 8): Result.002 file - promoters60/1444514
ttttgttt

SEQ ID NO: 116337 - DNA, 8 bp, Unknown
  misc_feature (1)..( 8): Result.002 file - promoters60/1444514
atttgtaa

SEQ ID NO: 116338 - DNA, 10 bp, Unknown
  misc_feature (1)..( 10): Result.002 file - promoters60/1444514
attttgttat

SEQ ID NO: 116339 - DNA, 10 bp, Unknown
  misc_feature (1)..( 10): Result.002 file - promoters60/1444514
gttttgtatt

SEQ ID NO: 116340 - DNA, 10 bp, Unknown
  misc_feature (1)..( 10): Result.002 file - promoters60/1444514
attttgtaac

SEQ ID NO: 116341 - DNA, 10 bp, Unknown
  misc_feature (1)..( 10): Result.002 file - promoters60/1444514
tgtttctatt

SEQ ID NO: 116342 - DNA, 8 bp, Unknown
  misc_feature (1)..( 8): Result.002 file - promoters60/1444629
tattttta

SEQ ID NO: 116343 - DNA, 8 bp, Unknown
  misc_feature (1)..( 8): Result.002 file - promoters60/1444629
gattctta

SEQ ID NO: 116344 - DNA, 8 bp, Unknown
  misc_feature (1)..( 8): Result.002 file - promoters60/1444629
gattcttt

SEQ ID NO: 116345 - DNA, 8 bp, Unknown
  misc_feature (1)..( 8): Result.002 file - promoters60/1444629
gattctag

SEQ ID NO: 116346 - DNA, 11 bp, Unknown
  misc_feature (1)..( 11): Result.002 file - promoters60/1444629
aatctatccac

SEQ ID NO: 116347 - DNA, 11 bp, Unknown
  misc_feature (1)..( 11): Result.002 file - promoters60/1444629
accttatccac

SEQ ID NO: 116348 - DNA, 11 bp, Unknown
  misc_feature (1)..( 11): Result.002 file - promoters60/1444629
accttatccca

SEQ ID NO: 116349 - DNA, 6 bp, Unknown
  misc_feature (1)..( 6): Result.002 file - promoters60/1444629
attatc

SEQ ID NO: 116350 - DNA, 6 bp, Unknown
  misc_feature (1)..( 6): Result.002 file - promoters60/1444629
attatc

SEQ ID NO: 116351 - DNA, 6 bp, Unknown
  misc_feature (1)..( 6): Result.002 file - promoters60/1444629
attatc

SEQ ID NO: 116352 - DNA, 7 bp, Unknown
  misc_feature (1)..( 7): Result.002 file - promoters60/1444629
gttatca

SEQ ID NO: 116353 - DNA, 7 bp, Unknown
  misc_feature (1)..( 7): Result.002 file - promoters60/1444629
attatca

SEQ ID NO: 116354 - DNA, 7 bp, Unknown
  misc_feature (1)..( 7): Result.002 file - promoters60/1444629
attatcg

SEQ ID NO: 116355 - DNA, 8 bp, Unknown
  misc_feature (1)..( 8): Result.002 file - promoters60/1446456
aaataaat

SEQ ID NO: 116356 - DNA, 8 bp, Unknown
  misc_feature (1)..( 8): Result.002 file - promoters60/1446456
caatgaat

SEQ ID NO: 116357 - DNA, 8 bp, Unknown
  misc_feature (1)..( 8): Result.002 file - promoters60/1446456
gaaaaaaa

SEQ ID NO: 116358 - DNA, 8 bp, Unknown
  misc_feature (1)..( 8): Result.002 file - promoters60/1446456
aaataacc

SEQ ID NO: 116359 - DNA, 8 bp, Unknown
  misc_feature (1)..( 8): Result.002 file - promoters60/1446456
caataaaa

SEQ ID NO: 116360 - DNA, 8 bp, Unknown
  misc_feature (1)..( 8): Result.002 file - promoters60/1446456
atttttaa

SEQ ID NO: 116361 - DNA, 8 bp, Unknown
  misc_feature (1)..( 8): Result.002 file - promoters60/1446456
ctttttaa

SEQ ID NO: 116362 - DNA, 8 bp, Unknown
  misc_feature (1)..( 8): Result.002 file - promoters60/1446456
attttttt

SEQ ID NO: 116363 - DNA, 8 bp, Unknown
  misc_feature (1)..( 8): Result.002 file - promoters60/1446456
ctttttat

SEQ ID NO: 116364 - DNA, 8 bp, Unknown
  misc_feature (1)..( 8): Result.002 file - promoters60/1446456
cttttttt

SEQ ID NO: 116365 - DNA, 11 bp, Unknown
  misc_feature (1)..( 11): Result.002 file - promoters60/1446456
tttctatcaac

SEQ ID NO: 116366 - DNA, 11 bp, Unknown
  misc_feature (1)..( 11): Result.002 file - promoters60/1446456
tttctaattcc

SEQ ID NO: 116367 - DNA, 11 bp, Unknown
  misc_feature (1)..( 11): Result.002 file - promoters60/1446456
tttttaactcc

SEQ ID NO: 116368 - DNA, 11 bp, Unknown
  misc_feature (1)..( 11): Result.002 file - promoters60/1446456
tttttaatttt

SEQ ID NO: 116369 - DNA, 8 bp, Unknown
  misc_feature (1)..( 8): Result.002 file - promoters60/1446456
aagaatag

SEQ ID NO: 116370 - DNA, 8 bp, Unknown
  misc_feature (1)..( 8): Result.002 file - promoters60/1446456
aagaatat

SEQ ID NO: 116371 - DNA, 8 bp, Unknown
  misc_feature (1)..( 8): Result.002 file - promoters60/1446456
aagaatta

SEQ ID NO: 116372 - DNA, 8 bp, Unknown
  misc_feature (1)..( 8): Result.002 file - promoters60/1446456
aagattta

SEQ ID NO: 116373 - DNA, 9 bp, Unknown
  misc_feature (1)..( 9): Result.002 file - promoters60/1446456
atacttttt

SEQ ID NO: 116374 - DNA, 9 bp, Unknown
  misc_feature (1)..( 9): Result.002 file - promoters60/1446456
gtacattta

SEQ ID NO: 116375 - DNA, 9 bp, Unknown
  misc_feature (1)..( 9): Result.002 file - promoters60/1446456
atacttttt

SEQ ID NO: 116376 - DNA, 9 bp, Unknown
  misc_feature (1)..( 9): Result.002 file - promoters60/1446456
tcccttttt

SEQ ID NO: 116377 - DNA, 10 bp, Unknown
  misc_feature (1)..( 10): Result.002 file - promoters60/1446456
tttttttctt

SEQ ID NO: 116378 - DNA, 10 bp, Unknown
  misc_feature (1)..( 10): Result.002 file - promoters60/1446456
atttattctt

SEQ ID NO: 116379 - DNA, 10 bp, Unknown
  misc_feature (1)..( 10): Result.002 file - promoters60/1446456
actttttctg

SEQ ID NO: 116380 - DNA, 10 bp, Unknown
  misc_feature (1)..( 10): Result.002 file - promoters60/1446456
ctttttatgg

SEQ ID NO: 116381 - DNA, 8 bp, Unknown
  misc_feature (1)..( 8): Result.002 file - promoters60/1446456
ttgaaatt

SEQ ID NO: 116382 - DNA, 8 bp, Unknown
  misc_feature (1)..( 8): Result.002 file - promoters60/1446456
aagaaatt

SEQ ID NO: 116383 - DNA, 8 bp, Unknown
  misc_feature (1)..( 8): Result.002 file - promoters60/1446456
atgaaatt

SEQ ID NO: 116384 - DNA, 8 bp, Unknown
  misc_feature (1)..( 8): Result.002 file - promoters60/1446456
aagcaatt

SEQ ID NO: 116385 - DNA, 13 bp, Unknown
  misc_feature (1)..( 13): Result.002 file - promoters60/1446636
actcttttgaagt

SEQ ID NO: 116386 - DNA, 13 bp, Unknown
  misc_feature (1)..( 13): Result.002 file - promoters60/1446636
actatttatacat

SEQ ID NO: 116387 - DNA, 13 bp, Unknown
  misc_feature (1)..( 13): Result.002 file - promoters60/1446636
cctattaataaaa

SEQ ID NO: 116388 - DNA, 13 bp, Unknown
  misc_feature (1)..( 13): Result.002 file - promoters60/1446636
gttattaataaat

SEQ ID NO: 116389 - DNA, 13 bp, Unknown
  misc_feature (1)..( 13): Result.002 file - promoters60/1446636
ctgattaatgaat

SEQ ID NO: 116390 - DNA, 13 bp, Unknown
  misc_feature (1)..( 13): Result.002 file - promoters60/1446636
tttataaatattt

SEQ ID NO: 116391 - DNA, 9 bp, Unknown
  misc_feature (1)..( 9): Result.002 file - promoters60/1446636
tgtaataat

SEQ ID NO: 116392 - DNA, 9 bp, Unknown
  misc_feature (1)..( 9): Result.002 file - promoters60/1446636
cataataat

SEQ ID NO: 116393 - DNA, 9 bp, Unknown
  misc_feature (1)..( 9): Result.002 file - promoters60/1446636
attaataaa

SEQ ID NO: 116394 - DNA, 9 bp, Unknown
  misc_feature (1)..( 9): Result.002 file - promoters60/1446636
attaataaa

SEQ ID NO: 116395 - DNA, 10 bp, Unknown
  misc_feature (1)..( 10): Result.002 file - promoters60/1446636
attaatgaat

SEQ ID NO: 116396 - DNA, 10 bp, Unknown
  misc_feature (1)..( 10): Result.002 file - promoters60/1446636
tataaatatt

SEQ ID NO: 116397 - DNA, 12 bp, Unknown
  misc_feature (1)..( 12): Result.002 file - promoters60/1446636
cttttttttttt

SEQ ID NO: 116398 - DNA, 12 bp, Unknown
  misc_feature (1)..( 12): Result.002 file - promoters60/1446636
ctttttgttgtt

SEQ ID NO: 116399 - DNA, 12 bp, Unknown
  misc_feature (1)..( 12): Result.002 file - promoters60/1446636
ctttttttgttt

SEQ ID NO: 116400 - DNA, 12 bp, Unknown
  misc_feature (1)..( 12): Result.002 file - promoters60/1446636
gtttttgtctat

SEQ ID NO: 116401 - DNA, 12 bp, Unknown
  misc_feature (1)..( 12): Result.002 file - promoters60/1446636
gtttttcggtta

SEQ ID NO: 116402 - DNA, 13 bp, Unknown
  misc_feature (1)..( 13): Result.002 file - promoters60/1446636
gttgttttaagaa

SEQ ID NO: 116403 - DNA, 13 bp, Unknown
  misc_feature (1)..( 13): Result.002 file - promoters60/1446636
attgtttcgaaac

SEQ ID NO: 116404 - DNA, 10 bp, Unknown
  misc_feature (1)..( 10): Result.002 file - promoters60/1446975
gataacttta

SEQ ID NO: 116405 - DNA, 10 bp, Unknown
  misc_feature (1)..( 10): Result.002 file - promoters60/1446975
gataacctta

SEQ ID NO: 116406 - DNA, 9 bp, Unknown
  misc_feature (1)..( 9): Result.002 file - promoters60/1446975
aacattttg

SEQ ID NO: 116407 - DNA, 9 bp, Unknown
  misc_feature (1)..( 9): Result.002 file - promoters60/1446975
aacgttttg

SEQ ID NO: 116408 - DNA, 6 bp, Unknown
  misc_feature (1)..( 6): Result.002 file - promoters60/1446975
ctgatt

SEQ ID NO: 116409 - DNA, 6 bp, Unknown
  misc_feature (1)..( 6): Result.002 file - promoters60/1446975
ctgatt

SEQ ID NO: 116410 - DNA, 6 bp, Unknown
  misc_feature (1)..( 6): Result.002 file - promoters60/1446975
gatcta

SEQ ID NO: 116411 - DNA, 6 bp, Unknown
  misc_feature (1)..( 6): Result.002 file - promoters60/1446975
gatcta

SEQ ID NO: 116412 - DNA, 7 bp, Unknown
  misc_feature (1)..( 7): Result.002 file - promoters60/1446975
agaaaga

SEQ ID NO: 116413 - DNA, 7 bp, Unknown
  misc_feature (1)..( 7): Result.002 file - promoters60/1446975
agaaaga

SEQ ID NO: 116414 - DNA, 7 bp, Unknown
  misc_feature (1)..( 7): Result.002 file - promoters60/1446975
tcataat

SEQ ID NO: 116415 - DNA, 7 bp, Unknown
  misc_feature (1)..( 7): Result.002 file - promoters60/1446975
tcataat

SEQ ID NO: 116416 - DNA, 6 bp, Unknown
  misc_feature (1)..( 6): Result.002 file - promoters60/1446975
attgtt

SEQ ID NO: 116417 - DNA, 6 bp, Unknown
  misc_feature (1)..( 6): Result.002 file - promoters60/1446975
attgtt

SEQ ID NO: 116418 - DNA, 6 bp, Unknown
  misc_feature (1)..( 6): Result.002 file - promoters60/1447064
agagca

SEQ ID NO: 116419 - DNA, 6 bp, Unknown
  misc_feature (1)..( 6): Result.002 file - promoters60/1447064
agagca

SEQ ID NO: 116420 - DNA, 6 bp, Unknown
  misc_feature (1)..( 6): Result.002 file - promoters60/1447064
atagag

SEQ ID NO: 116421 - DNA, 6 bp, Unknown
  misc_feature (1)..( 6): Result.002 file - promoters60/1447064
atagag

SEQ ID NO: 116422 - DNA, 7 bp, Unknown
  misc_feature (1)..( 7): Result.002 file - promoters60/1447064
tatcttg

SEQ ID NO: 116423 - DNA, 7 bp, Unknown
  misc_feature (1)..( 7): Result.002 file - promoters60/1447064
tatattg

SEQ ID NO: 116424 - DNA, 6 bp, Unknown
  misc_feature (1)..( 6): Result.002 file - promoters60/1447064
aaagac

SEQ ID NO: 116425 - DNA, 6 bp, Unknown
  misc_feature (1)..( 6): Result.002 file - promoters60/1447064
aaagac

SEQ ID NO: 116426 - DNA, 7 bp, Unknown
  misc_feature (1)..( 7): Result.002 file - promoters60/1447064
taataaa

SEQ ID NO: 116427 - DNA, 7 bp, Unknown
  misc_feature (1)..( 7): Result.002 file - promoters60/1447064
taaaaaa

SEQ ID NO: 116428 - DNA, 6 bp, Unknown
  misc_feature (1)..( 6): Result.002 file - promoters60/1447064
taaaaa

SEQ ID NO: 116429 - DNA, 6 bp, Unknown
  misc_feature (1)..( 6): Result.002 file - promoters60/1447064
taaaaa

SEQ ID NO: 116430 - DNA, 6 bp, Unknown
  misc_feature (1)..( 6): Result.002 file - promoters60/1447064
cttcta

SEQ ID NO: 116431 - DNA, 6 bp, Unknown
  misc_feature (1)..( 6): Result.002 file - promoters60/1447064
cttcta

SEQ ID NO: 116432 - DNA, 7 bp, Unknown
  misc_feature (1)..( 7): Result.002 file - promoters60/1447064
tttctat

SEQ ID NO: 116433 - DNA, 7 bp, Unknown
  misc_feature (1)..( 7): Result.002 file - promoters60/1447064
tttgtat

SEQ ID NO: 116434 - DNA, 7 bp, Unknown
  misc_feature (1)..( 7): Result.002 file - promoters60/1447064
tatattg

SEQ ID NO: 116435 - DNA, 7 bp, Unknown
  misc_feature (1)..( 7): Result.002 file - promoters60/1447064
tatgttg

SEQ ID NO: 116436 - DNA, 8 bp, Unknown
  misc_feature (1)..( 8): Result.002 file - promoters60/1447064
tgttaaaa

SEQ ID NO: 116437 - DNA, 8 bp, Unknown
  misc_feature (1)..( 8): Result.002 file - promoters60/1447064
tgttgaaa

SEQ ID NO: 116438 - DNA, 8 bp, Unknown
  misc_feature (1)..( 8): Result.002 file - promoters60/1447064
cattaaac

SEQ ID NO: 116439 - DNA, 8 bp, Unknown
  misc_feature (1)..( 8): Result.002 file - promoters60/1447064
catttaac

SEQ ID NO: 116440 - DNA, 6 bp, Unknown
  misc_feature (1)..( 6): Result.002 file - promoters60/1447064
tctcca

SEQ ID NO: 116441 - DNA, 6 bp, Unknown
  misc_feature (1)..( 6): Result.002 file - promoters60/1447064
tctcca

SEQ ID NO: 116442 - DNA, 7 bp, Unknown
  misc_feature (1)..( 7): Result.002 file - promoters60/1447064
ccatttt

SEQ ID NO: 116443 - DNA, 7 bp, Unknown
  misc_feature (1)..( 7): Result.002 file - promoters60/1447064
ccatttt

SEQ ID NO: 116444 - DNA, 6 bp, Unknown
  misc_feature (1)..( 6): Result.002 file - promoters60/1447064
ttttca

SEQ ID NO: 116445 - DNA, 6 bp, Unknown
  misc_feature (1)..( 6): Result.002 file - promoters60/1447064
ttttca

SEQ ID NO: 116446 - DNA, 6 bp, Unknown
  misc_feature (1)..( 6): Result.002 file - promoters60/1447064
tgtctt

SEQ ID NO: 116447 - DNA, 6 bp, Unknown
  misc_feature (1)..( 6): Result.002 file - promoters60/1447064
tgtctt

SEQ ID NO: 116448 - DNA, 6 bp, Unknown
  misc_feature (1)..( 6): Result.002 file - promoters60/1447064
caagct

SEQ ID NO: 116449 - DNA, 6 bp, Unknown
  misc_feature (1)..( 6): Result.002 file - promoters60/1447064
caagct

SEQ ID NO: 116450 - DNA, 7 bp, Unknown
  misc_feature (1)..( 7): Result.002 file - promoters60/1447064
ataaata

SEQ ID NO: 116451 - DNA, 7 bp, Unknown
  misc_feature (1)..( 7): Result.002 file - promoters60/1447064
atacata

SEQ ID NO: 116452 - DNA, 12 bp, Unknown
  misc_feature (1)..( 12): Result.002 file - promoters60/1447217
gaaaaaaaaaaa

SEQ ID NO: 116453 - DNA, 12 bp, Unknown
  misc_feature (1)..( 12): Result.002 file - promoters60/1447217
gaaaaaaaaaaa

SEQ ID NO: 116454 - DNA, 12 bp, Unknown
  misc_feature (1)..( 12): Result.002 file - promoters60/1447217
gaaatacaaaaa

SEQ ID NO: 116455 - DNA, 12 bp, Unknown
  misc_feature (1)..( 12): Result.002 file - promoters60/1447217
tataaacaattt

SEQ ID NO: 116456 - DNA, 10 bp, Unknown
  misc_feature (1)..( 10): Result.002 file - promoters60/1447217
tttattatgt

SEQ ID NO: 116457 - DNA, 10 bp, Unknown
  misc_feature (1)..( 10): Result.002 file - promoters60/1447217
catattatgt

SEQ ID NO: 116458 - DNA, 10 bp, Unknown
  misc_feature (1)..( 10): Result.002 file - promoters60/1447217
ttttttaaca

SEQ ID NO: 116459 - DNA, 8 bp, Unknown
  misc_feature (1)..( 8): Result.002 file - promoters60/1447217
tgaacaaa

SEQ ID NO: 116460 - DNA, 8 bp, Unknown
  misc_feature (1)..( 8): Result.002 file - promoters60/1447217
agaataaa

SEQ ID NO: 116461 - DNA, 8 bp, Unknown
  misc_feature (1)..( 8): Result.002 file - promoters60/1447217
agactaag

SEQ ID NO: 116462 - DNA, 9 bp, Unknown
  misc_feature (1)..( 9): Result.002 file - promoters60/1447217
aaaaaaaaa

SEQ ID NO: 116463 - DNA, 9 bp, Unknown
  misc_feature (1)..( 9): Result.002 file - promoters60/1447217
aaaataaaa

SEQ ID NO: 116464 - DNA, 9 bp, Unknown
  misc_feature (1)..( 9): Result.002 file - promoters60/1447217
caaataaat

SEQ ID NO: 116465 - DNA, 10 bp, Unknown
  misc_feature (1)..( 10): Result.002 file - promoters60/1447217
taaaacgagt

SEQ ID NO: 116466 - DNA, 10 bp, Unknown
  misc_feature (1)..( 10): Result.002 file - promoters60/1447217
aaaaaagagt

SEQ ID NO: 116467 - DNA, 10 bp, Unknown
  misc_feature (1)..( 10): Result.002 file - promoters60/1447217
aaaaaagaaa

SEQ ID NO: 116468 - DNA, 8 bp, Unknown
  misc_feature (1)..( 8): Result.002 file - promoters60/1447217
ataaataa

SEQ ID NO: 116469 - DNA, 8 bp, Unknown
  misc_feature (1)..( 8): Result.002 file - promoters60/1447217
ataaataa

SEQ ID NO: 116470 - DNA, 8 bp, Unknown
  misc_feature (1)..( 8): Result.002 file - promoters60/1447217
ataaaaaa

SEQ ID NO: 116471 - DNA, 9 bp, Unknown
  misc_feature (1)..( 9): Result.002 file - promoters60/1447217
ttttgaacg

SEQ ID NO: 116472 - DNA, 9 bp, Unknown
  misc_feature (1)..( 9): Result.002 file - promoters60/1447217
taatgaacg

SEQ ID NO: 116473 - DNA, 9 bp, Unknown
  misc_feature (1)..( 9): Result.002 file - promoters60/1447217
tttttaacg

SEQ ID NO: 116474 - DNA, 9 bp, Unknown
  misc_feature (1)..( 9): Result.002 file - promoters60/1447217
gaaataccc

SEQ ID NO: 116475 - DNA, 9 bp, Unknown
  misc_feature (1)..( 9): Result.002 file - promoters60/1447217
gaaatacaa

SEQ ID NO: 116476 - DNA, 9 bp, Unknown
  misc_feature (1)..( 9): Result.002 file - promoters60/1447217
aaaattcaa

SEQ ID NO: 116477 - DNA, 10 bp, Unknown
  misc_feature (1)..( 10): Result.002 file - promoters60/1447217
caaaacaaaa

SEQ ID NO: 116478 - DNA, 10 bp, Unknown
  misc_feature (1)..( 10): Result.002 file - promoters60/1447217
caaaaaaaaa

SEQ ID NO: 116479 - DNA, 10 bp, Unknown
  misc_feature (1)..( 10): Result.002 file - promoters60/1447217
ataaacaatt

SEQ ID NO: 116480 - DNA, 14 bp, Unknown
  misc_feature (1)..( 14): Result.002 file - promoters60/1447217
gaaatattttaaca

SEQ ID NO: 116481 - DNA, 14 bp, Unknown
  misc_feature (1)..( 14): Result.002 file - promoters60/1447217
gaaataatttagac

SEQ ID NO: 116482 - DNA, 14 bp, Unknown
  misc_feature (1)..( 14): Result.002 file - promoters60/1447217
tcttttttttaaca

SEQ ID NO: 116483 - DNA, 7 bp, Unknown
  misc_feature (1)..( 7): Result.002 file - promoters60/1447217
tataatt

SEQ ID NO: 116484 - DNA, 7 bp, Unknown
  misc_feature (1)..( 7): Result.002 file - promoters60/1447217
gataatt

SEQ ID NO: 116485 - DNA, 7 bp, Unknown
  misc_feature (1)..( 7): Result.002 file - promoters60/1447217
tattatt

SEQ ID NO: 116486 - DNA, 8 bp, Unknown
  misc_feature (1)..( 8): Result.002 file - promoters60/1447321
ttttgaat

SEQ ID NO: 116487 - DNA, 8 bp, Unknown
  misc_feature (1)..( 8): Result.002 file - promoters60/1447321
atttgaat

SEQ ID NO: 116488 - DNA, 8 bp, Unknown
  misc_feature (1)..( 8): Result.002 file - promoters60/1447321
ttttgaca

SEQ ID NO: 116489 - DNA, 9 bp, Unknown
  misc_feature (1)..( 9): Result.002 file - promoters60/1447321
tataataca

SEQ ID NO: 116490 - DNA, 9 bp, Unknown
  misc_feature (1)..( 9): Result.002 file - promoters60/1447321
tattataca

SEQ ID NO: 116491 - DNA, 11 bp, Unknown
  misc_feature (1)..( 11): Result.002 file - promoters60/1447321
aaactgtgaaa

SEQ ID NO: 116492 - DNA, 11 bp, Unknown
  misc_feature (1)..( 11): Result.002 file - promoters60/1447321
aaaatgtgaaa

SEQ ID NO: 116493 - DNA, 11 bp, Unknown
  misc_feature (1)..( 11): Result.002 file - promoters60/1447321
gctttgtgaaa

SEQ ID NO: 116494 - DNA, 7 bp, Unknown
  misc_feature (1)..( 7): Result.002 file - promoters60/1447321
aatctaa

SEQ ID NO: 116495 - DNA, 7 bp, Unknown
  misc_feature (1)..( 7): Result.002 file - promoters60/1447321
aatttaa

SEQ ID NO: 116496 - DNA, 8 bp, Unknown
  misc_feature (1)..( 8): Result.002 file - promoters60/1447321
ccaaattt

SEQ ID NO: 116497 - DNA, 8 bp, Unknown
  misc_feature (1)..( 8): Result.002 file - promoters60/1447321
ccaatttt

SEQ ID NO: 116498 - DNA, 6 bp, Unknown
  misc_feature (1)..( 6): Result.002 file - promoters60/1447321
aatatt

SEQ ID NO: 116499 - DNA, 6 bp, Unknown
  misc_feature (1)..( 6): Result.002 file - promoters60/1447321
aatatt

SEQ ID NO: 116500 - DNA, 9 bp, Unknown
  misc_feature (1)..( 9): Result.002 file - promoters60/1447321
tatataata

SEQ ID NO: 116501 - DNA, 9 bp, Unknown
  misc_feature (1)..( 9): Result.002 file - promoters60/1447321
tataaaata

SEQ ID NO: 116502 - DNA, 8 bp, Unknown
  misc_feature (1)..( 8): Result.002 file - promoters60/1447321
aacccaaa

SEQ ID NO: 116503 - DNA, 8 bp, Unknown
  misc_feature (1)..( 8): Result.002 file - promoters60/1447321
agcccaaa

SEQ ID NO: 116504 - DNA, 8 bp, Unknown
  misc_feature (1)..( 8): Result.002 file - promoters60/1447321
agcccaat

SEQ ID NO: 116505 - DNA, 7 bp, Unknown
  misc_feature (1)..( 7): Result.002 file - promoters60/1447321
aattttc

SEQ ID NO: 116506 - DNA, 7 bp, Unknown
  misc_feature (1)..( 7): Result.002 file - promoters60/1447321
aatcttc

SEQ ID NO: 116507 - DNA, 7 bp, Unknown
  misc_feature (1)..( 7): Result.002 file - promoters60/1447321
tgaattt

SEQ ID NO: 116508 - DNA, 7 bp, Unknown
  misc_feature (1)..( 7): Result.002 file - promoters60/1447321
tgaattt

SEQ ID NO: 116509 - DNA, 9 bp, Unknown
  misc_feature (1)..( 9): Result.002 file - promoters60/1447321
aaagtacat

SEQ ID NO: 116510 - DNA, 9 bp, Unknown
  misc_feature (1)..( 9): Result.002 file - promoters60/1447321
aaagaacat

SEQ ID NO: 116511 - DNA, 6 bp, Unknown
  misc_feature (1)..( 6): Result.002 file - promoters60/1447321
actaaa

SEQ ID NO: 116512 - DNA, 6 bp, Unknown
  misc_feature (1)..( 6): Result.002 file - promoters60/1447321
actaaa

SEQ ID NO: 116513 - DNA, 6 bp, Unknown
  misc_feature (1)..( 6): Result.002 file - promoters60/1447321
ttttgt

SEQ ID NO: 116514 - DNA, 6 bp, Unknown
  misc_feature (1)..( 6): Result.002 file - promoters60/1447321
ttttgt

SEQ ID NO: 116515 - DNA, 6 bp, Unknown
  misc_feature (1)..( 6): Result.002 file - promoters60/1447321
tttaga

SEQ ID NO: 116516 - DNA, 6 bp, Unknown
  misc_feature (1)..( 6): Result.002 file - promoters60/1447321
tttaga

SEQ ID NO: 116517 - DNA, 6 bp, Unknown
  misc_feature (1)..( 6): Result.002 file - promoters60/1447321
ctttta

SEQ ID NO: 116518 - DNA, 6 bp, Unknown
  misc_feature (1)..( 6): Result.002 file - promoters60/1447321
ctttta

SEQ ID NO: 116519 - DNA, 6 bp, Unknown
  misc_feature (1)..( 6): Result.002 file - promoters60/1447321
aatttg

SEQ ID NO: 116520 - DNA, 6 bp, Unknown
  misc_feature (1)..( 6): Result.002 file - promoters60/1447321
aatttg

SEQ ID NO: 116521 - DNA, 9 bp, Unknown
  misc_feature (1)..( 9): Result.002 file - promoters60/1447321
tgtactatt

SEQ ID NO: 116522 - DNA, 9 bp, Unknown
  misc_feature (1)..( 9): Result.002 file - promoters60/1447321
tgtaatatt

SEQ ID NO: 116523 - DNA, 6 bp, Unknown
  misc_feature (1)..( 6): Result.002 file - promoters60/1447321
ctacat

SEQ ID NO: 116524 - DNA, 6 bp, Unknown
  misc_feature (1)..( 6): Result.002 file - promoters60/1447321
ctacat

SEQ ID NO: 116525 - DNA, 7 bp, Unknown
  misc_feature (1)..( 7): Result.002 file - promoters60/1447321
aatttat

SEQ ID NO: 116526 - DNA, 7 bp, Unknown
  misc_feature (1)..( 7): Result.002 file - promoters60/1447321
aatatat

SEQ ID NO: 116527 - DNA, 6 bp, Unknown
  misc_feature (1)..( 6): Result.002 file - promoters60/1447321
tttaat

SEQ ID NO: 116528 - DNA, 6 bp, Unknown
  misc_feature (1)..( 6): Result.002 file - promoters60/1447321
tttaat

SEQ ID NO: 116529 - DNA, 10 bp, Unknown
  misc_feature (1)..( 10): Result.002 file - promoters60/1447321
aaatgtttgt

SEQ ID NO: 116530 - DNA, 10 bp, Unknown
  misc_feature (1)..( 10): Result.002 file - promoters60/1447321
aaatttttgt

SEQ ID NO: 116531 - DNA, 7 bp, Unknown
  misc_feature (1)..( 7): Result.002 file - promoters60/1447321
cctcttc

SEQ ID NO: 116532 - DNA, 7 bp, Unknown
  misc_feature (1)..( 7): Result.002 file - promoters60/1447321
cctgttc

SEQ ID NO: 116533 - DNA, 7 bp, Unknown
  misc_feature (1)..( 7): Result.002 file - promoters60/1447352
taattca

SEQ ID NO: 116534 - DNA, 7 bp, Unknown
  misc_feature (1)..( 7): Result.002 file - promoters60/1447352
gaattca

SEQ ID NO: 116535 - DNA, 7 bp, Unknown
  misc_feature (1)..( 7): Result.002 file - promoters60/1447352
gaattct

SEQ ID NO: 116536 - DNA, 10 bp, Unknown
  misc_feature (1)..( 10): Result.002 file - promoters60/1447352
tttgcgaatt

SEQ ID NO: 116537 - DNA, 10 bp, Unknown
  misc_feature (1)..( 10): Result.002 file - promoters60/1447352
tttgcgaatt

SEQ ID NO: 116538 - DNA, 9 bp, Unknown
  misc_feature (1)..( 9): Result.002 file - promoters60/1447352
ttttggttt

SEQ ID NO: 116539 - DNA, 9 bp, Unknown
  misc_feature (1)..( 9): Result.002 file - promoters60/1447352
ttttgattt

SEQ ID NO: 116540 - DNA, 7 bp, Unknown
  misc_feature (1)..( 7): Result.002 file - promoters60/1447352
aagtttt

SEQ ID NO: 116541 - DNA, 7 bp, Unknown
  misc_feature (1)..( 7): Result.002 file - promoters60/1447352
aagattt

SEQ ID NO: 116542 - DNA, 6 bp, Unknown
  misc_feature (1)..( 6): Result.002 file - promoters60/1447352
aaaatt

SEQ ID NO: 116543 - DNA, 6 bp, Unknown
  misc_feature (1)..( 6): Result.002 file - promoters60/1447352
aaaatt

SEQ ID NO: 116544 - DNA, 7 bp, Unknown
  misc_feature (1)..( 7): Result.002 file - promoters60/1447352
ttgtttt

SEQ ID NO: 116545 - DNA, 7 bp, Unknown
  misc_feature (1)..( 7): Result.002 file - promoters60/1447352
ttgcttt

SEQ ID NO: 116546 - DNA, 7 bp, Unknown
  misc_feature (1)..( 7): Result.002 file - promoters60/1447352
gaatctt

SEQ ID NO: 116547 - DNA, 7 bp, Unknown
  misc_feature (1)..( 7): Result.002 file - promoters60/1447352
gaagctt

SEQ ID NO: 116548 - DNA, 6 bp, Unknown
  misc_feature (1)..( 6): Result.002 file - promoters60/1447352
atggcg

SEQ ID NO: 116549 - DNA, 6 bp, Unknown
  misc_feature (1)..( 6): Result.002 file - promoters60/1447352
atggcg

SEQ ID NO: 116550 - DNA, 9 bp, Unknown
  misc_feature (1)..( 9): Result.002 file - promoters60/1447352
ataatcatc

SEQ ID NO: 116551 - DNA, 9 bp, Unknown
  misc_feature (1)..( 9): Result.002 file - promoters60/1447352
ataatgatc

SEQ ID NO: 116552 - DNA, 6 bp, Unknown
  misc_feature (1)..( 6): Result.002 file - promoters60/1447352
ttgaat

SEQ ID NO: 116553 - DNA, 6 bp, Unknown
  misc_feature (1)..( 6): Result.002 file - promoters60/1447352
ttgaat

SEQ ID NO: 116554 - DNA, 12 bp, Unknown
  misc_feature (1)..( 12): Result.002 file - promoters60/1447352
tattatttggtg

SEQ ID NO: 116555 - DNA, 12 bp, Unknown
  misc_feature (1)..( 12): Result.002 file - promoters60/1447352
attgatttcgtg

SEQ ID NO: 116556 - DNA, 12 bp, Unknown
  misc_feature (1)..( 12): Result.002 file - promoters60/1447352
ttgaattcacgt

SEQ ID NO: 116557 - DNA, 8 bp, Unknown
  misc_feature (1)..( 8): Result.002 file - promoters60/1447352
taaatttg

SEQ ID NO: 116558 - DNA, 8 bp, Unknown
  misc_feature (1)..( 8): Result.002 file - promoters60/1447352
aaaaattg

SEQ ID NO: 116559 - DNA, 8 bp, Unknown
  misc_feature (1)..( 8): Result.002 file - promoters60/1447352
aaaaataa

SEQ ID NO: 116560 - DNA, 6 bp, Unknown
  misc_feature (1)..( 6): Result.002 file - promoters60/1447352
tcttgt

SEQ ID NO: 116561 - DNA, 6 bp, Unknown
  misc_feature (1)..( 6): Result.002 file - promoters60/1447352
tcttgt

SEQ ID NO: 116562 - DNA, 8 bp, Unknown
  misc_feature (1)..( 8): Result.002 file - promoters60/1447352
atgatcag

SEQ ID NO: 116563 - DNA, 8 bp, Unknown
  misc_feature (1)..( 8): Result.002 file - promoters60/1447352
atgaccag

SEQ ID NO: 116564 - DNA, 6 bp, Unknown
  misc_feature (1)..( 6): Result.002 file - promoters60/1447352
taatat

SEQ ID NO: 116565 - DNA, 6 bp, Unknown
  misc_feature (1)..( 6): Result.002 file - promoters60/1447352
taatat

SEQ ID NO: 116566 - DNA, 7 bp, Unknown
  misc_feature (1)..( 7): Result.002 file - promoters60/1447352
ataatgc

SEQ ID NO: 116567 - DNA, 7 bp, Unknown
  misc_feature (1)..( 7): Result.002 file - promoters60/1447352
atagtgc

SEQ ID NO: 116568 - DNA, 6 bp, Unknown
  misc_feature (1)..( 6): Result.002 file - promoters60/1447352
tcatcc

SEQ ID NO: 116569 - DNA, 6 bp, Unknown
  misc_feature (1)..( 6): Result.002 file - promoters60/1447352
tcatcc

SEQ ID NO: 116570 - DNA, 10 bp, Unknown
  misc_feature (1)..( 10): Result.002 file - promoters60/1447352
tccgtcgtga

SEQ ID NO: 116571 - DNA, 10 bp, Unknown
  misc_feature (1)..( 10): Result.002 file - promoters60/1447352
tccctcgtga

SEQ ID NO: 116572 - DNA, 6 bp, Unknown
  misc_feature (1)..( 6): Result.002 file - promoters60/1447352
aaaacc

SEQ ID NO: 116573 - DNA, 6 bp, Unknown
  misc_feature (1)..( 6): Result.002 file - promoters60/1447352
aaaacc

SEQ ID NO: 116574 - DNA, 6 bp, Unknown
  misc_feature (1)..( 6): Result.002 file - promoters60/1447425
tcaatg

SEQ ID NO: 116575 - DNA, 6 bp, Unknown
  misc_feature (1)..( 6): Result.002 file - promoters60/1447425
tcaatg

SEQ ID NO: 116576 - DNA, 6 bp, Unknown
  misc_feature (1)..( 6): Result.002 file - promoters60/1447425
aaaaga

SEQ ID NO: 116577 - DNA, 6 bp, Unknown
  misc_feature (1)..( 6): Result.002 file - promoters60/1447425
aaaaga

SEQ ID NO: 116578 - DNA, 6 bp, Unknown
  misc_feature (1)..( 6): Result.002 file - promoters60/1447425
aatcaa

SEQ ID NO: 116579 - DNA, 6 bp, Unknown
  misc_feature (1)..( 6): Result.002 file - promoters60/1447425
aatcaa

SEQ ID NO: 116580 - DNA, 7 bp, Unknown
  misc_feature (1)..( 7): Result.002 file - promoters60/1447425
atcataa

SEQ ID NO: 116581 - DNA, 7 bp, Unknown
  misc_feature (1)..( 7): Result.002 file - promoters60/1447425
atcttaa

SEQ ID NO: 116582 - DNA, 8 bp, Unknown
  misc_feature (1)..( 8): Result.002 file - promoters60/1447425
ggatttta

SEQ ID NO: 116583 - DNA, 8 bp, Unknown
  misc_feature (1)..( 8): Result.002 file - promoters60/1447425
ggatgtta

SEQ ID NO: 116584 - DNA, 6 bp, Unknown
  misc_feature (1)..( 6): Result.002 file - promoters60/1447425
ctaatg

SEQ ID NO: 116585 - DNA, 6 bp, Unknown
  misc_feature (1)..( 6): Result.002 file - promoters60/1447425
ctaatg

SEQ ID NO: 116586 - DNA, 10 bp, Unknown
  misc_feature (1)..( 10): Result.002 file - promoters60/1447425
aatttggcgg

SEQ ID NO: 116587 - DNA, 10 bp, Unknown
  misc_feature (1)..( 10): Result.002 file - promoters60/1447425
aatttgatag

SEQ ID NO: 116588 - DNA, 10 bp, Unknown
  misc_feature (1)..( 10): Result.002 file - promoters60/1447425
catttgattt

SEQ ID NO: 116589 - DNA, 7 bp, Unknown
  misc_feature (1)..( 7): Result.002 file - promoters60/1447425
gatccag

SEQ ID NO: 116590 - DNA, 7 bp, Unknown
  misc_feature (1)..( 7): Result.002 file - promoters60/1447425
gatacag

SEQ ID NO: 116591 - DNA, 6 bp, Unknown
  misc_feature (1)..( 6): Result.002 file - promoters60/1447425
attcca

SEQ ID NO: 116592 - DNA, 6 bp, Unknown
  misc_feature (1)..( 6): Result.002 file - promoters60/1447425
attcca

SEQ ID NO: 116593 - DNA, 7 bp, Unknown
  misc_feature (1)..( 7): Result.002 file - promoters60/1447425
aaacctg

SEQ ID NO: 116594 - DNA, 7 bp, Unknown
  misc_feature (1)..( 7): Result.002 file - promoters60/1447425
aaagctg

SEQ ID NO: 116595 - DNA, 6 bp, Unknown
  misc_feature (1)..( 6): Result.002 file - promoters60/1447425
tttgac

SEQ ID NO: 116596 - DNA, 6 bp, Unknown
  misc_feature (1)..( 6): Result.002 file - promoters60/1447425
tttgac

SEQ ID NO: 116597 - DNA, 6 bp, Unknown
  misc_feature (1)..( 6): Result.002 file - promoters60/1447425
acggta

SEQ ID NO: 116598 - DNA, 6 bp, Unknown
  misc_feature (1)..( 6): Result.002 file - promoters60/1447425
acggta

SEQ ID NO: 116599 - DNA, 7 bp, Unknown
  misc_feature (1)..( 7): Result.002 file - promoters60/1447425
tcacgtt

SEQ ID NO: 116600 - DNA, 7 bp, Unknown
  misc_feature (1)..( 7): Result.002 file - promoters60/1447425
tcaagtt

SEQ ID NO: 116601 - DNA, 7 bp, Unknown
  misc_feature (1)..( 7): Result.002 file - promoters60/1447591
attgatt

SEQ ID NO: 116602 - DNA, 7 bp, Unknown
  misc_feature (1)..( 7): Result.002 file - promoters60/1447591
tttgatt

SEQ ID NO: 116603 - DNA, 8 bp, Unknown
  misc_feature (1)..( 8): Result.002 file - promoters60/1447591
tttggatc

SEQ ID NO: 116604 - DNA, 10 bp, Unknown
  misc_feature (1)..( 10): Result.002 file - promoters60/1447591
acttacaaaa

SEQ ID NO: 116605 - DNA, 10 bp, Unknown
  misc_feature (1)..( 10): Result.002 file - promoters60/1447591
acaaacaaaa

SEQ ID NO: 116606 - DNA, 10 bp, Unknown
  misc_feature (1)..( 10): Result.002 file - promoters60/1447591
acagacaaaa

SEQ ID NO: 116607 - DNA, 11 bp, Unknown
  misc_feature (1)..( 11): Result.002 file - promoters60/1447591
aaagacagaac

SEQ ID NO: 116608 - DNA, 11 bp, Unknown
  misc_feature (1)..( 11): Result.002 file - promoters60/1447591
acagacaaaac

SEQ ID NO: 116609 - DNA, 11 bp, Unknown
  misc_feature (1)..( 11): Result.002 file - promoters60/1447591
acaaacaaaaa

SEQ ID NO: 116610 - DNA, 7 bp, Unknown
  misc_feature (1)..( 7): Result.002 file - promoters60/1447591
acaaaaa

SEQ ID NO: 116611 - DNA, 7 bp, Unknown
  misc_feature (1)..( 7): Result.002 file - promoters60/1447591
tcaaaaa

SEQ ID NO: 116612 - DNA, 7 bp, Unknown
  misc_feature (1)..( 7): Result.002 file - promoters60/1447591
acaaaag

SEQ ID NO: 116613 - DNA, 12 bp, Unknown
  misc_feature (1)..( 12): Result.002 file - promoters60/1447646
tgaagaagaaga

SEQ ID NO: 116614 - DNA, 12 bp, Unknown
  misc_feature (1)..( 12): Result.002 file - promoters60/1447646
gaaagatgaatt

SEQ ID NO: 116615 - DNA, 12 bp, Unknown
  misc_feature (1)..( 12): Result.002 file - promoters60/1447646
acaagtagaaga

SEQ ID NO: 116616 - DNA, 12 bp, Unknown
  misc_feature (1)..( 12): Result.002 file - promoters60/1447646
ttaagaagcttt

SEQ ID NO: 116617 - DNA, 12 bp, Unknown
  misc_feature (1)..( 12): Result.002 file - promoters60/1447646
gaaagaagttga

SEQ ID NO: 116618 - DNA, 12 bp, Unknown
  misc_feature (1)..( 12): Result.002 file - promoters60/1447646
ttaagaaatgta

SEQ ID NO: 116619 - DNA, 6 bp, Unknown
  misc_feature (1)..( 6): Result.002 file - promoters60/1447686
acaaac

SEQ ID NO: 116620 - DNA, 6 bp, Unknown
  misc_feature (1)..( 6): Result.002 file - promoters60/1447686
acaaac

SEQ ID NO: 116621 - DNA, 6 bp, Unknown
  misc_feature (1)..( 6): Result.002 file - promoters60/1447686
tttgta

SEQ ID NO: 116622 - DNA, 6 bp, Unknown
  misc_feature (1)..( 6): Result.002 file - promoters60/1447686
tttgta

SEQ ID NO: 116623 - DNA, 6 bp, Unknown
  misc_feature (1)..( 6): Result.002 file - promoters60/1447686
atttta

SEQ ID NO: 116624 - DNA, 6 bp, Unknown
  misc_feature (1)..( 6): Result.002 file - promoters60/1447686
atttta

SEQ ID NO: 116625 - DNA, 7 bp, Unknown
  misc_feature (1)..( 7): Result.002 file - promoters60/1447686
agtgctt

SEQ ID NO: 116626 - DNA, 7 bp, Unknown
  misc_feature (1)..( 7): Result.002 file - promoters60/1447686
agttctt

SEQ ID NO: 116627 - DNA, 7 bp, Unknown
  misc_feature (1)..( 7): Result.002 file - promoters60/1447686
ttaaaaa

SEQ ID NO: 116628 - DNA, 7 bp, Unknown
  misc_feature (1)..( 7): Result.002 file - promoters60/1447686
ttaaaaa

SEQ ID NO: 116629 - DNA, 7 bp, Unknown
  misc_feature (1)..( 7): Result.002 file - promoters60/1447686
atataca

SEQ ID NO: 116630 - DNA, 7 bp, Unknown
  misc_feature (1)..( 7): Result.002 file - promoters60/1447686
ataaaca

SEQ ID NO: 116631 - DNA, 9 bp, Unknown
  misc_feature (1)..( 9): Result.002 file - promoters60/1447686
aatatatgt

SEQ ID NO: 116632 - DNA, 9 bp, Unknown
  misc_feature (1)..( 9): Result.002 file - promoters60/1447686
aatatctgt

SEQ ID NO: 116633 - DNA, 6 bp, Unknown
  misc_feature (1)..( 6): Result.002 file - promoters60/1447686
agaatc

SEQ ID NO: 116634 - DNA, 6 bp, Unknown
  misc_feature (1)..( 6): Result.002 file - promoters60/1447686
agaatc

SEQ ID NO: 116635 - DNA, 7 bp, Unknown
  misc_feature (1)..( 7): Result.002 file - promoters60/1447686
aattaag

SEQ ID NO: 116636 - DNA, 7 bp, Unknown
  misc_feature (1)..( 7): Result.002 file - promoters60/1447686
aattaag

SEQ ID NO: 116637 - DNA, 13 bp, Unknown
  misc_feature (1)..( 13): Result.002 file - promoters60/1447953
aaatgtttgtatt

SEQ ID NO: 116638 - DNA, 13 bp, Unknown
  misc_feature (1)..( 13): Result.002 file - promoters60/1447953
ccacaattgtatt

SEQ ID NO: 116639 - DNA, 13 bp, Unknown
  misc_feature (1)..( 13): Result.002 file - promoters60/1447953
caatctttgtatc

SEQ ID NO: 116640 - DNA, 13 bp, Unknown
  misc_feature (1)..( 13): Result.002 file - promoters60/1447953
caatctttgtttt

SEQ ID NO: 116641 - DNA, 9 bp, Unknown
  misc_feature (1)..( 9): Result.002 file - promoters60/1447953
tatttttga

SEQ ID NO: 116642 - DNA, 9 bp, Unknown
  misc_feature (1)..( 9): Result.002 file - promoters60/1447953
tatttatga

SEQ ID NO: 116643 - DNA, 9 bp, Unknown
  misc_feature (1)..( 9): Result.002 file - promoters60/1447953
tattttaat

SEQ ID NO: 116644 - DNA, 9 bp, Unknown
  misc_feature (1)..( 9): Result.002 file - promoters60/1447953
gattttaca

SEQ ID NO: 116645 - DNA, 9 bp, Unknown
  misc_feature (1)..( 9): Result.002 file - promoters60/1447953
gttcttcat

SEQ ID NO: 116646 - DNA, 9 bp, Unknown
  misc_feature (1)..( 9): Result.002 file - promoters60/1447953
attcatcac

SEQ ID NO: 116647 - DNA, 9 bp, Unknown
  misc_feature (1)..( 9): Result.002 file - promoters60/1447953
attctacat

SEQ ID NO: 116648 - DNA, 9 bp, Unknown
  misc_feature (1)..( 9): Result.002 file - promoters60/1447953
attctaaaa

SEQ ID NO: 116649 - DNA, 8 bp, Unknown
  misc_feature (1)..( 8): Result.002 file - promoters60/1447953
aaaaagaa

SEQ ID NO: 116650 - DNA, 8 bp, Unknown
  misc_feature (1)..( 8): Result.002 file - promoters60/1447953
aaaaagct

SEQ ID NO: 116651 - DNA, 8 bp, Unknown
  misc_feature (1)..( 8): Result.002 file - promoters60/1447953
aaaaaatt

SEQ ID NO: 116652 - DNA, 8 bp, Unknown
  misc_feature (1)..( 8): Result.002 file - promoters60/1447953
aaaatgct

SEQ ID NO: 116653 - DNA, 8 bp, Unknown
  misc_feature (1)..( 8): Result.002 file - promoters60/1447953
atctcttc

SEQ ID NO: 116654 - DNA, 8 bp, Unknown
  misc_feature (1)..( 8): Result.002 file - promoters60/1447953
ttctcttc

SEQ ID NO: 116655 - DNA, 8 bp, Unknown
  misc_feature (1)..( 8): Result.002 file - promoters60/1447953
ttcccttg

SEQ ID NO: 116656 - DNA, 8 bp, Unknown
  misc_feature (1)..( 8): Result.002 file - promoters60/1447953
ctcccttc

SEQ ID NO: 116657 - DNA, 11 bp, Unknown
  misc_feature (1)..( 11): Result.002 file - promoters60/1447953
ttataattatg

SEQ ID NO: 116658 - DNA, 11 bp, Unknown
  misc_feature (1)..( 11): Result.002 file - promoters60/1447953
atattattatt

SEQ ID NO: 116659 - DNA, 11 bp, Unknown
  misc_feature (1)..( 11): Result.002 file - promoters60/1447953
ttataagtata

SEQ ID NO: 116660 - DNA, 11 bp, Unknown
  misc_feature (1)..( 11): Result.002 file - promoters60/1447953
atataagtaac

SEQ ID NO: 116661 - DNA, 11 bp, Unknown
  misc_feature (1)..( 11): Result.002 file - promoters60/1447953
caatctttata

SEQ ID NO: 116662 - DNA, 10 bp, Unknown
  misc_feature (1)..( 10): Result.002 file - promoters60/1447953
tatataaaca

SEQ ID NO: 116663 - DNA, 10 bp, Unknown
  misc_feature (1)..( 10): Result.002 file - promoters60/1447953
tataaaaacc

SEQ ID NO: 116664 - DNA, 10 bp, Unknown
  misc_feature (1)..( 10): Result.002 file - promoters60/1447953
tataaatatc

SEQ ID NO: 116665 - DNA, 10 bp, Unknown
  misc_feature (1)..( 10): Result.002 file - promoters60/1447953
gataaatatc

SEQ ID NO: 116666 - DNA, 9 bp, Unknown
  misc_feature (1)..( 9): Result.002 file - promoters60/1447953
atttagttt

SEQ ID NO: 116667 - DNA, 9 bp, Unknown
  misc_feature (1)..( 9): Result.002 file - promoters60/1447953
atttagatt

SEQ ID NO: 116668 - DNA, 9 bp, Unknown
  misc_feature (1)..( 9): Result.002 file - promoters60/1447953
atataatta

SEQ ID NO: 116669 - DNA, 9 bp, Unknown
  misc_feature (1)..( 9): Result.002 file - promoters60/1447953
ctataattt

SEQ ID NO: 116670 - DNA, 14 bp, Unknown
  misc_feature (1)..( 14): Result.002 file - promoters60/1448022
cttccaaaaatgag

SEQ ID NO: 116671 - DNA, 14 bp, Unknown
  misc_feature (1)..( 14): Result.002 file - promoters60/1448022
taagcaaaaaaaat

SEQ ID NO: 116672 - DNA, 14 bp, Unknown
  misc_feature (1)..( 14): Result.002 file - promoters60/1448022
aataaaaaaatata

SEQ ID NO: 116673 - DNA, 14 bp, Unknown
  misc_feature (1)..( 14): Result.002 file - promoters60/1448022
attaagaaaataaa

SEQ ID NO: 116674 - DNA, 10 bp, Unknown
  misc_feature (1)..( 10): Result.002 file - promoters60/1448022
cacaatggac

SEQ ID NO: 116675 - DNA, 10 bp, Unknown
  misc_feature (1)..( 10): Result.002 file - promoters60/1448022
cacaatgtca

SEQ ID NO: 116676 - DNA, 10 bp, Unknown
  misc_feature (1)..( 10): Result.002 file - promoters60/1448022
aacattgtaa

SEQ ID NO: 116677 - DNA, 10 bp, Unknown
  misc_feature (1)..( 10): Result.002 file - promoters60/1448022
aaaattgtaa

SEQ ID NO: 116678 - DNA, 10 bp, Unknown
  misc_feature (1)..( 10): Result.002 file - promoters60/1448022
ttattaattt

SEQ ID NO: 116679 - DNA, 10 bp, Unknown
  misc_feature (1)..( 10): Result.002 file - promoters60/1448022
atatcaatac

SEQ ID NO: 116680 - DNA, 10 bp, Unknown
  misc_feature (1)..( 10): Result.002 file - promoters60/1448022
ttgttacttt

SEQ ID NO: 116681 - DNA, 10 bp, Unknown
  misc_feature (1)..( 10): Result.002 file - promoters60/1448022
atatcaacat

SEQ ID NO: 116682 - DNA, 10 bp, Unknown
  misc_feature (1)..( 10): Result.002 file - promoters60/1448022
aatttatata

SEQ ID NO: 116683 - DNA, 10 bp, Unknown
  misc_feature (1)..( 10): Result.002 file - promoters60/1448022
tacttatatt

SEQ ID NO: 116684 - DNA, 10 bp, Unknown
  misc_feature (1)..( 10): Result.002 file - promoters60/1448022
attttttatc

SEQ ID NO: 116685 - DNA, 10 bp, Unknown
  misc_feature (1)..( 10): Result.002 file - promoters60/1448022
tacttttatt

SEQ ID NO: 116686 - DNA, 11 bp, Unknown
  misc_feature (1)..( 11): Result.002 file - promoters60/1448022
agttttgtata

SEQ ID NO: 116687 - DNA, 9 bp, Unknown
  misc_feature (1)..( 9): Result.002 file - promoters60/1448022
aatatgtaa

SEQ ID NO: 116688 - DNA, 9 bp, Unknown
  misc_feature (1)..( 9): Result.002 file - promoters60/1448022
aatttgttg

SEQ ID NO: 116689 - DNA, 9 bp, Unknown
  misc_feature (1)..( 9): Result.002 file - promoters60/1448022
tatatataa

SEQ ID NO: 116690 - DNA, 9 bp, Unknown
  misc_feature (1)..( 9): Result.002 file - promoters60/1448022
tatttgtta

SEQ ID NO: 116691 - DNA, 16 bp, Unknown
  misc_feature (1)..( 16): Result.002 file - promoters60/1448022
aaaaaatcaaaatcaa

SEQ ID NO: 116692 - DNA, 16 bp, Unknown
  misc_feature (1)..( 16): Result.002 file - promoters60/1448022
tgtcatttaaaaccaa

SEQ ID NO: 116693 - DNA, 16 bp, Unknown
  misc_feature (1)..( 16): Result.002 file - promoters60/1448022
tgattaataaaaaaat

SEQ ID NO: 116694 - DNA, 16 bp, Unknown
  misc_feature (1)..( 16): Result.002 file - promoters60/1448022
tgattaagaaaataaa

SEQ ID NO: 116695 - DNA, 15 bp, Unknown
  misc_feature (1)..( 15): Result.002 file - promoters60/1448022
ttaagcaaaaaaaat

SEQ ID NO: 116696 - DNA, 15 bp, Unknown
  misc_feature (1)..( 15): Result.002 file - promoters60/1448022
ttaagttaaataaat

SEQ ID NO: 116697 - DNA, 15 bp, Unknown
  misc_feature (1)..( 15): Result.002 file - promoters60/1448022
attaagaaaataaat

SEQ ID NO: 116698 - DNA, 15 bp, Unknown
  misc_feature (1)..( 15): Result.002 file - promoters60/1448022
gattaataaaaaaat

SEQ ID NO: 116699 - DNA, 8 bp, Unknown
  misc_feature (1)..( 8): Result.002 file - promoters60/1448022
tttgtaat

SEQ ID NO: 116700 - DNA, 8 bp, Unknown
  misc_feature (1)..( 8): Result.002 file - promoters60/1448022
attgtaat

SEQ ID NO: 116701 - DNA, 8 bp, Unknown
  misc_feature (1)..( 8): Result.002 file - promoters60/1448022
attgtaaa

SEQ ID NO: 116702 - DNA, 8 bp, Unknown
  misc_feature (1)..( 8): Result.002 file - promoters60/1448022
tttctaac

SEQ ID NO: 116703 - DNA, 9 bp, Unknown
  misc_feature (1)..( 9): Result.002 file - promoters60/1448022
atatattta

SEQ ID NO: 116704 - DNA, 9 bp, Unknown
  misc_feature (1)..( 9): Result.002 file - promoters60/1448022
ataaatttt

SEQ ID NO: 116705 - DNA, 9 bp, Unknown
  misc_feature (1)..( 9): Result.002 file - promoters60/1448022
atagattta

SEQ ID NO: 116706 - DNA, 9 bp, Unknown
  misc_feature (1)..( 9): Result.002 file - promoters60/1448022
tatgattta

SEQ ID NO: 116707 - DNA, 9 bp, Unknown
  misc_feature (1)..( 9): Result.002 file - promoters60/1448022
caatcacaa

SEQ ID NO: 116708 - DNA, 9 bp, Unknown
  misc_feature (1)..( 9): Result.002 file - promoters60/1448022
gtatcccaa

SEQ ID NO: 116709 - DNA, 9 bp, Unknown
  misc_feature (1)..( 9): Result.002 file - promoters60/1448022
caaacaccc

SEQ ID NO: 116710 - DNA, 9 bp, Unknown
  misc_feature (1)..( 9): Result.002 file - promoters60/1448022
ttataccaa

SEQ ID NO: 116711 - DNA, 14 bp, Unknown
  misc_feature (1)..( 14): Result.002 file - promoters60/1448022
gctatatctagcat

SEQ ID NO: 116712 - DNA, 14 bp, Unknown
  misc_feature (1)..( 14): Result.002 file - promoters60/1448022
ctattatttagaat

SEQ ID NO: 116713 - DNA, 14 bp, Unknown
  misc_feature (1)..( 14): Result.002 file - promoters60/1448022
aaagtattcagaag

SEQ ID NO: 116714 - DNA, 14 bp, Unknown
  misc_feature (1)..( 14): Result.002 file - promoters60/1448022
ctatgatttaaaat

SEQ ID NO: 116715 - DNA, 16 bp, Unknown
  misc_feature (1)..( 16): Result.002 file - promoters60/1448022
ctctattgttttgaat

SEQ ID NO: 116716 - DNA, 16 bp, Unknown
  misc_feature (1)..( 16): Result.002 file - promoters60/1448022
aaaaattatttttaat

SEQ ID NO: 116717 - DNA, 16 bp, Unknown
  misc_feature (1)..( 16): Result.002 file - promoters60/1448022
tgattttgttttctaa

SEQ ID NO: 116718 - DNA, 16 bp, Unknown
  misc_feature (1)..( 16): Result.002 file - promoters60/1448022
aaaaattataccaaga

SEQ ID NO: 116719 - DNA, 7 bp, Unknown
  misc_feature (1)..( 7): Result.002 file - promoters60/1448078
ttttttc

SEQ ID NO: 116720 - DNA, 7 bp, Unknown
  misc_feature (1)..( 7): Result.002 file - promoters60/1448078
tttcttc

SEQ ID NO: 116721 - DNA, 8 bp, Unknown
  misc_feature (1)..( 8): Result.002 file - promoters60/1448078
aatttgtc

SEQ ID NO: 116722 - DNA, 8 bp, Unknown
  misc_feature (1)..( 8): Result.002 file - promoters60/1448078
aattagtc

SEQ ID NO: 116723 - DNA, 7 bp, Unknown
  misc_feature (1)..( 7): Result.002 file - promoters60/1448078
cattaaa

SEQ ID NO: 116724 - DNA, 7 bp, Unknown
  misc_feature (1)..( 7): Result.002 file - promoters60/1448078
cataaaa

SEQ ID NO: 116725 - DNA, 6 bp, Unknown
  misc_feature (1)..( 6): Result.002 file - promoters60/1448078
aagaag

SEQ ID NO: 116726 - DNA, 6 bp, Unknown
  misc_feature (1)..( 6): Result.002 file - promoters60/1448078
aagaag

SEQ ID NO: 116727 - DNA, 6 bp, Unknown
  misc_feature (1)..( 6): Result.002 file - promoters60/1448078
ccatct

SEQ ID NO: 116728 - DNA, 6 bp, Unknown
  misc_feature (1)..( 6): Result.002 file - promoters60/1448078
ccatct

SEQ ID NO: 116729 - DNA, 6 bp, Unknown
  misc_feature (1)..( 6): Result.002 file - promoters60/1448078
tcactt

SEQ ID NO: 116730 - DNA, 6 bp, Unknown
  misc_feature (1)..( 6): Result.002 file - promoters60/1448078
tcactt

SEQ ID NO: 116731 - DNA, 6 bp, Unknown
  misc_feature (1)..( 6): Result.002 file - promoters60/1448078
tttgat

SEQ ID NO: 116732 - DNA, 6 bp, Unknown
  misc_feature (1)..( 6): Result.002 file - promoters60/1448078
tttgat

SEQ ID NO: 116733 - DNA, 6 bp, Unknown
  misc_feature (1)..( 6): Result.002 file - promoters60/1448078
ttctct

SEQ ID NO: 116734 - DNA, 6 bp, Unknown
  misc_feature (1)..( 6): Result.002 file - promoters60/1448078
ttctct

SEQ ID NO: 116735 - DNA, 6 bp, Unknown
  misc_feature (1)..( 6): Result.002 file - promoters60/1448078
ctcttt

SEQ ID NO: 116736 - DNA, 6 bp, Unknown
  misc_feature (1)..( 6): Result.002 file - promoters60/1448078
ctcttt

SEQ ID NO: 116737 - DNA, 8 bp, Unknown
  misc_feature (1)..( 8): Result.002 file - promoters60/1448078
ctcttttt

SEQ ID NO: 116738 - DNA, 8 bp, Unknown
  misc_feature (1)..( 8): Result.002 file - promoters60/1448078
ctctcttt

SEQ ID NO: 116739 - DNA, 10 bp, Unknown
  misc_feature (1)..( 10): Result.002 file - promoters60/1448078
ttttgattcg

SEQ ID NO: 116740 - DNA, 10 bp, Unknown
  misc_feature (1)..( 10): Result.002 file - promoters60/1448078
ttttgattcc

SEQ ID NO: 116741 - DNA, 10 bp, Unknown
  misc_feature (1)..( 10): Result.002 file - promoters60/1448078
caatgatttg

SEQ ID NO: 116742 - DNA, 6 bp, Unknown
  misc_feature (1)..( 6): Result.002 file - promoters60/1448078
tttcca

SEQ ID NO: 116743 - DNA, 6 bp, Unknown
  misc_feature (1)..( 6): Result.002 file - promoters60/1448078
tttcca

SEQ ID NO: 116744 - DNA, 6 bp, Unknown
  misc_feature (1)..( 6): Result.002 file - promoters60/1448078
aaagat

SEQ ID NO: 116745 - DNA, 6 bp, Unknown
  misc_feature (1)..( 6): Result.002 file - promoters60/1448078
aaagat

SEQ ID NO: 116746 - DNA, 6 bp, Unknown
  misc_feature (1)..( 6): Result.002 file - promoters60/1448078
ctttaa

SEQ ID NO: 116747 - DNA, 6 bp, Unknown
  misc_feature (1)..( 6): Result.002 file - promoters60/1448078
ctttaa

SEQ ID NO: 116748 - DNA, 8 bp, Unknown
  misc_feature (1)..( 8): Result.002 file - promoters60/1448078
tttccttt

SEQ ID NO: 116749 - DNA, 8 bp, Unknown
  misc_feature (1)..( 8): Result.002 file - promoters60/1448078
tttcattt

SEQ ID NO: 116750 - DNA, 6 bp, Unknown
  misc_feature (1)..( 6): Result.002 file - promoters60/1448078
tcttct

SEQ ID NO: 116751 - DNA, 6 bp, Unknown
  misc_feature (1)..( 6): Result.002 file - promoters60/1448078
tcttct

SEQ ID NO: 116752 - DNA, 8 bp, Unknown
  misc_feature (1)..( 8): Result.002 file - promoters60/1448078
tttattaa

SEQ ID NO: 116753 - DNA, 8 bp, Unknown
  misc_feature (1)..( 8): Result.002 file - promoters60/1448078
tttattaa

SEQ ID NO: 116754 - DNA, 10 bp, Unknown
  misc_feature (1)..( 10): Result.002 file - promoters60/1448078
aactttatta

SEQ ID NO: 116755 - DNA, 10 bp, Unknown
  misc_feature (1)..( 10): Result.002 file - promoters60/1448078
aactttactt

SEQ ID NO: 116756 - DNA, 10 bp, Unknown
  misc_feature (1)..( 10): Result.002 file - promoters60/1448078
tccttttctt

SEQ ID NO: 116757 - DNA, 7 bp, Unknown
  misc_feature (1)..( 7): Result.002 file - promoters60/1448078
aaaaaaa

SEQ ID NO: 116758 - DNA, 7 bp, Unknown
  misc_feature (1)..( 7): Result.002 file - promoters60/1448078
aaagaaa

SEQ ID NO: 116759 - DNA, 7 bp, Unknown
  misc_feature (1)..( 7): Result.002 file - promoters60/1448078
acacaaa

SEQ ID NO: 116760 - DNA, 7 bp, Unknown
  misc_feature (1)..( 7): Result.002 file - promoters60/1448078
acagaaa

SEQ ID NO: 116761 - DNA, 6 bp, Unknown
  misc_feature (1)..( 6): Result.002 file - promoters60/1448078
aaaaat

SEQ ID NO: 116762 - DNA, 6 bp, Unknown
  misc_feature (1)..( 6): Result.002 file - promoters60/1448078
aaaaat

SEQ ID NO: 116763 - DNA, 9 bp, Unknown
  misc_feature (1)..( 9): Result.002 file - promoters60/1448078
aaataaaaa

SEQ ID NO: 116764 - DNA, 9 bp, Unknown
  misc_feature (1)..( 9): Result.002 file - promoters60/1448078
aaagaaaaa

SEQ ID NO: 116765 - DNA, 8 bp, Unknown
  misc_feature (1)..( 8): Result.002 file - promoters60/1448078
attatata

SEQ ID NO: 116766 - DNA, 8 bp, Unknown
  misc_feature (1)..( 8): Result.002 file - promoters60/1448078
attagata

SEQ ID NO: 116767 - DNA, 7 bp, Unknown
  misc_feature (1)..( 7): Result.002 file - promoters60/1448078
atttccc

SEQ ID NO: 116768 - DNA, 7 bp, Unknown
  misc_feature (1)..( 7): Result.002 file - promoters60/1448078
attaccc

SEQ ID NO: 116769 - DNA, 6 bp, Unknown
  misc_feature (1)..( 6): Result.002 file - promoters60/1448078
aagaga

SEQ ID NO: 116770 - DNA, 6 bp, Unknown
  misc_feature (1)..( 6): Result.002 file - promoters60/1448078
aagaga

SEQ ID NO: 116771 - DNA, 8 bp, Unknown
  misc_feature (1)..( 8): Result.002 file - promoters60/1448105
ataaataa

SEQ ID NO: 116772 - DNA, 8 bp, Unknown
  misc_feature (1)..( 8): Result.002 file - promoters60/1448105
atatataa

SEQ ID NO: 116773 - DNA, 6 bp, Unknown
  misc_feature (1)..( 6): Result.002 file - promoters60/1448105
aattat

SEQ ID NO: 116774 - DNA, 6 bp, Unknown
  misc_feature (1)..( 6): Result.002 file - promoters60/1448105
aattat

SEQ ID NO: 116775 - DNA, 6 bp, Unknown
  misc_feature (1)..( 6): Result.002 file - promoters60/1448105
tttgtt

SEQ ID NO: 116776 - DNA, 6 bp, Unknown
  misc_feature (1)..( 6): Result.002 file - promoters60/1448105
tttgtt

SEQ ID NO: 116777 - DNA, 6 bp, Unknown
  misc_feature (1)..( 6): Result.002 file - promoters60/1448105
aaattg

SEQ ID NO: 116778 - DNA, 6 bp, Unknown
  misc_feature (1)..( 6): Result.002 file - promoters60/1448105
aaattg

SEQ ID NO: 116779 - DNA, 7 bp, Unknown
  misc_feature (1)..( 7): Result.002 file - promoters60/1448105
aaaaatt

SEQ ID NO: 116780 - DNA, 7 bp, Unknown
  misc_feature (1)..( 7): Result.002 file - promoters60/1448105
aaaaatt

SEQ ID NO: 116781 - DNA, 6 bp, Unknown
  misc_feature (1)..( 6): Result.002 file - promoters60/1448105
tttgat

SEQ ID NO: 116782 - DNA, 6 bp, Unknown
  misc_feature (1)..( 6): Result.002 file - promoters60/1448105
tttgat

SEQ ID NO: 116783 - DNA, 6 bp, Unknown
  misc_feature (1)..( 6): Result.002 file - promoters60/1448105
tcaaat

SEQ ID NO: 116784 - DNA, 6 bp, Unknown
  misc_feature (1)..( 6): Result.002 file - promoters60/1448105
tcaaat

SEQ ID NO: 116785 - DNA, 9 bp, Unknown
  misc_feature (1)..( 9): Result.002 file - promoters60/1448105
taaatatga

SEQ ID NO: 116786 - DNA, 9 bp, Unknown
  misc_feature (1)..( 9): Result.002 file - promoters60/1448105
caaagatga

SEQ ID NO: 116787 - DNA, 9 bp, Unknown
  misc_feature (1)..( 9): Result.002 file - promoters60/1448105
taaataagt

SEQ ID NO: 116788 - DNA, 7 bp, Unknown
  misc_feature (1)..( 7): Result.002 file - promoters60/1448105
aatactt

SEQ ID NO: 116789 - DNA, 7 bp, Unknown
  misc_feature (1)..( 7): Result.002 file - promoters60/1448105
aatactt

SEQ ID NO: 116790 - DNA, 7 bp, Unknown
  misc_feature (1)..( 7): Result.002 file - promoters60/1448105
aaactct

SEQ ID NO: 116791 - DNA, 7 bp, Unknown
  misc_feature (1)..( 7): Result.002 file - promoters60/1448105
aaagtct

SEQ ID NO: 116792 - DNA, 6 bp, Unknown
  misc_feature (1)..( 6): Result.002 file - promoters60/1448105
gttttt

SEQ ID NO: 116793 - DNA, 6 bp, Unknown
  misc_feature (1)..( 6): Result.002 file - promoters60/1448105
gttttt

SEQ ID NO: 116794 - DNA, 8 bp, Unknown
  misc_feature (1)..( 8): Result.002 file - promoters60/1448105
gaaacaga

SEQ ID NO: 116795 - DNA, 8 bp, Unknown
  misc_feature (1)..( 8): Result.002 file - promoters60/1448105
gaaacaga

SEQ ID NO: 116796 - DNA, 7 bp, Unknown
  misc_feature (1)..( 7): Result.002 file - promoters60/1448105
aaagctt

SEQ ID NO: 116797 - DNA, 7 bp, Unknown
  misc_feature (1)..( 7): Result.002 file - promoters60/1448105
aaagctt

SEQ ID NO: 116798 - DNA, 8 bp, Unknown
  misc_feature (1)..( 8): Result.002 file - promoters60/1448105
aatttgat

SEQ ID NO: 116799 - DNA, 8 bp, Unknown
  misc_feature (1)..( 8): Result.002 file - promoters60/1448105
aatatgat

SEQ ID NO: 116800 - DNA, 7 bp, Unknown
  misc_feature (1)..( 7): Result.002 file - promoters60/1448105
ctcaaca

SEQ ID NO: 116801 - DNA, 7 bp, Unknown
  misc_feature (1)..( 7): Result.002 file - promoters60/1448105
ctccaca

SEQ ID NO: 116802 - DNA, 8 bp, Unknown
  misc_feature (1)..( 8): Result.002 file - promoters60/1448105
ataaaaca

SEQ ID NO: 116803 - DNA, 8 bp, Unknown
  misc_feature (1)..( 8): Result.002 file - promoters60/1448105
ataagaca

SEQ ID NO: 116804 - DNA, 8 bp, Unknown
  misc_feature (1)..( 8): Result.002 file - promoters60/1448105
tatatttt

SEQ ID NO: 116805 - DNA, 8 bp, Unknown
  misc_feature (1)..( 8): Result.002 file - promoters60/1448105
tatttttt

SEQ ID NO: 116806 - DNA, 6 bp, Unknown
  misc_feature (1)..( 6): Result.002 file - promoters60/1448105
tatttc

SEQ ID NO: 116807 - DNA, 6 bp, Unknown
  misc_feature (1)..( 6): Result.002 file - promoters60/1448105
tatttc

SEQ ID NO: 116808 - DNA, 8 bp, Unknown
  misc_feature (1)..( 8): Result.002 file - promoters60/1448105
atcatgaa

SEQ ID NO: 116809 - DNA, 8 bp, Unknown
  misc_feature (1)..( 8): Result.002 file - promoters60/1448105
atcaggaa

SEQ ID NO: 116810 - DNA, 8 bp, Unknown
  misc_feature (1)..( 8): Result.002 file - promoters60/1448105
tttaaaag

SEQ ID NO: 116811 - DNA, 8 bp, Unknown
  misc_feature (1)..( 8): Result.002 file - promoters60/1448105
tttaaaag

SEQ ID NO: 116812 - DNA, 6 bp, Unknown
  misc_feature (1)..( 6): Result.002 file - promoters60/1448105
aggttt

SEQ ID NO: 116813 - DNA, 6 bp, Unknown
  misc_feature (1)..( 6): Result.002 file - promoters60/1448105
aggttt

SEQ ID NO: 116814 - DNA, 9 bp, Unknown
  misc_feature (1)..( 9): Result.002 file - promoters60/1448135
tatcttcct

SEQ ID NO: 116815 - DNA, 9 bp, Unknown
  misc_feature (1)..( 9): Result.002 file - promoters60/1448135
aatcctcca

SEQ ID NO: 116816 - DNA, 9 bp, Unknown
  misc_feature (1)..( 9): Result.002 file - promoters60/1448135
tagcttcct

SEQ ID NO: 116817 - DNA, 9 bp, Unknown
  misc_feature (1)..( 9): Result.002 file - promoters60/1448135
aattctcta

SEQ ID NO: 116818 - DNA, 10 bp, Unknown
  misc_feature (1)..( 10): Result.002 file - promoters60/1448135
tgaatgatat

SEQ ID NO: 116819 - DNA, 10 bp, Unknown
  misc_feature (1)..( 10): Result.002 file - promoters60/1448135
tgaatgatga

SEQ ID NO: 116820 - DNA, 10 bp, Unknown
  misc_feature (1)..( 10): Result.002 file - promoters60/1448135
aaaattatat

SEQ ID NO: 116821 - DNA, 10 bp, Unknown
  misc_feature (1)..( 10): Result.002 file - promoters60/1448135
gatattatag

SEQ ID NO: 116822 - DNA, 9 bp, Unknown
  misc_feature (1)..( 9): Result.002 file - promoters60/1448135
atgaataat

SEQ ID NO: 116823 - DNA, 9 bp, Unknown
  misc_feature (1)..( 9): Result.002 file - promoters60/1448135
aagaataaa

SEQ ID NO: 116824 - DNA, 9 bp, Unknown
  misc_feature (1)..( 9): Result.002 file - promoters60/1448135
aagaagaaa

SEQ ID NO: 116825 - DNA, 10 bp, Unknown
  misc_feature (1)..( 10): Result.002 file - promoters60/1448135
gttaatcaaa

SEQ ID NO: 116826 - DNA, 10 bp, Unknown
  misc_feature (1)..( 10): Result.002 file - promoters60/1448135
tatgtaagca

SEQ ID NO: 116827 - DNA, 10 bp, Unknown
  misc_feature (1)..( 10): Result.002 file - promoters60/1448135
tatttaaagc

SEQ ID NO: 116828 - DNA, 10 bp, Unknown
  misc_feature (1)..( 10): Result.002 file - promoters60/1448135
cattcaaagc

SEQ ID NO: 116829 - DNA, 10 bp, Unknown
  misc_feature (1)..( 10): Result.002 file - promoters60/1448135
ttttcaagtt

SEQ ID NO: 116830 - DNA, 10 bp, Unknown
  misc_feature (1)..( 10): Result.002 file - promoters60/1448185
aaggttggat

SEQ ID NO: 116831 - DNA, 10 bp, Unknown
  misc_feature (1)..( 10): Result.002 file - promoters60/1448185
aaggttggat

SEQ ID NO: 116832 - DNA, 6 bp, Unknown
  misc_feature (1)..( 6): Result.002 file - promoters60/1448185
ggataa

SEQ ID NO: 116833 - DNA, 6 bp, Unknown
  misc_feature (1)..( 6): Result.002 file - promoters60/1448185
ggataa

SEQ ID NO: 116834 - DNA, 7 bp, Unknown
  misc_feature (1)..( 7): Result.002 file - promoters60/1448185
gtagtaa

SEQ ID NO: 116835 - DNA, 7 bp, Unknown
  misc_feature (1)..( 7): Result.002 file - promoters60/1448185
gtaataa

SEQ ID NO: 116836 - DNA, 7 bp, Unknown
  misc_feature (1)..( 7): Result.002 file - promoters60/1448185
gatcctc

SEQ ID NO: 116837 - DNA, 7 bp, Unknown
  misc_feature (1)..( 7): Result.002 file - promoters60/1448185
gattctc

SEQ ID NO: 116838 - DNA, 9 bp, Unknown
  misc_feature (1)..( 9): Result.002 file - promoters60/1448185
atctcgatt

SEQ ID NO: 116839 - DNA, 9 bp, Unknown
  misc_feature (1)..( 9): Result.002 file - promoters60/1448185
atcttgatt

SEQ ID NO: 116840 - DNA, 7 bp, Unknown
  misc_feature (1)..( 7): Result.002 file - promoters60/1448185
aaagctt

SEQ ID NO: 116841 - DNA, 7 bp, Unknown
  misc_feature (1)..( 7): Result.002 file - promoters60/1448185
aaagctt

SEQ ID NO: 116842 - DNA, 6 bp, Unknown
  misc_feature (1)..( 6): Result.002 file - promoters60/1448185
atctac

SEQ ID NO: 116843 - DNA, 6 bp, Unknown
  misc_feature (1)..( 6): Result.002 file - promoters60/1448185
atctac

SEQ ID NO: 116844 - DNA, 7 bp, Unknown
  misc_feature (1)..( 7): Result.002 file - promoters60/1448185
tcataat

SEQ ID NO: 116845 - DNA, 7 bp, Unknown
  misc_feature (1)..( 7): Result.002 file - promoters60/1448185
tcataat

SEQ ID NO: 116846 - DNA, 6 bp, Unknown
  misc_feature (1)..( 6): Result.002 file - promoters60/1448185
attgtt

SEQ ID NO: 116847 - DNA, 6 bp, Unknown
  misc_feature (1)..( 6): Result.002 file - promoters60/1448185
attgtt

SEQ ID NO: 116848 - DNA, 9 bp, Unknown
  misc_feature (1)..( 9): Result.002 file - promoters60/1448231
tcaaatcga

SEQ ID NO: 116849 - DNA, 9 bp, Unknown
  misc_feature (1)..( 9): Result.002 file - promoters60/1448231
tcaaatttg

SEQ ID NO: 116850 - DNA, 9 bp, Unknown
  misc_feature (1)..( 9): Result.002 file - promoters60/1448231
tcaattttg

SEQ ID NO: 116851 - DNA, 9 bp, Unknown
  misc_feature (1)..( 9): Result.002 file - promoters60/1448231
acaattttt

SEQ ID NO: 116852 - DNA, 7 bp, Unknown
  misc_feature (1)..( 7): Result.002 file - promoters60/1448231
gaatcag

SEQ ID NO: 116853 - DNA, 7 bp, Unknown
  misc_feature (1)..( 7): Result.002 file - promoters60/1448231
aaatcag

SEQ ID NO: 116854 - DNA, 7 bp, Unknown
  misc_feature (1)..( 7): Result.002 file - promoters60/1448231
gaatcac

SEQ ID NO: 116855 - DNA, 7 bp, Unknown
  misc_feature (1)..( 7): Result.002 file - promoters60/1448231
aaaacag

SEQ ID NO: 116856 - DNA, 9 bp, Unknown
  misc_feature (1)..( 9): Result.002 file - promoters60/1448231
attctaaac

SEQ ID NO: 116857 - DNA, 9 bp, Unknown
  misc_feature (1)..( 9): Result.002 file - promoters60/1448231
tttcttaac

SEQ ID NO: 116858 - DNA, 9 bp, Unknown
  misc_feature (1)..( 9): Result.002 file - promoters60/1448231
attttaacc

SEQ ID NO: 116859 - DNA, 9 bp, Unknown
  misc_feature (1)..( 9): Result.002 file - promoters60/1448231
atgcttaac

SEQ ID NO: 116860 - DNA, 10 bp, Unknown
  misc_feature (1)..( 10): Result.002 file - promoters60/1448231
acaaagtatc

SEQ ID NO: 116861 - DNA, 10 bp, Unknown
  misc_feature (1)..( 10): Result.002 file - promoters60/1448231
taaaagaatc

SEQ ID NO: 116862 - DNA, 10 bp, Unknown
  misc_feature (1)..( 10): Result.002 file - promoters60/1448231
tgaaagaagg

SEQ ID NO: 116863 - DNA, 10 bp, Unknown
  misc_feature (1)..( 10): Result.002 file - promoters60/1448231
taaaagagaa

SEQ ID NO: 116864 - DNA, 14 bp, Unknown
  misc_feature (1)..( 14): Result.002 file - promoters60/1448231
atcgaatcagctaa

SEQ ID NO: 116865 - DNA, 14 bp, Unknown
  misc_feature (1)..( 14): Result.002 file - promoters60/1448231
tatgaatctgctaa

SEQ ID NO: 116866 - DNA, 14 bp, Unknown
  misc_feature (1)..( 14): Result.002 file - promoters60/1448231
tatgaatcatgtca

SEQ ID NO: 116867 - DNA, 14 bp, Unknown
  misc_feature (1)..( 14): Result.002 file - promoters60/1448231
atcaattttgctaa

SEQ ID NO: 116868 - DNA, 8 bp, Unknown
  misc_feature (1)..( 8): Result.002 file - promoters60/1448231
caaaagag

SEQ ID NO: 116869 - DNA, 8 bp, Unknown
  misc_feature (1)..( 8): Result.002 file - promoters60/1448231
caaatgag

SEQ ID NO: 116870 - DNA, 8 bp, Unknown
  misc_feature (1)..( 8): Result.002 file - promoters60/1448231
taaaagat

SEQ ID NO: 116871 - DNA, 8 bp, Unknown
  misc_feature (1)..( 8): Result.002 file - promoters60/1448231
caaatgca

SEQ ID NO: 116872 - DNA, 10 bp, Unknown
  misc_feature (1)..( 10): Result.002 file - promoters60/1448231
cggttgattt

SEQ ID NO: 116873 - DNA, 10 bp, Unknown
  misc_feature (1)..( 10): Result.002 file - promoters60/1448231
tgtttgatta

SEQ ID NO: 116874 - DNA, 10 bp, Unknown
  misc_feature (1)..( 10): Result.002 file - promoters60/1448231
gatttgattt

SEQ ID NO: 116875 - DNA, 10 bp, Unknown
  misc_feature (1)..( 10): Result.002 file - promoters60/1448231
tgtttaattt

SEQ ID NO: 116876 - DNA, 11 bp, Unknown
  misc_feature (1)..( 11): Result.002 file - promoters60/1448231
tttgtctcaat

SEQ ID NO: 116877 - DNA, 11 bp, Unknown
  misc_feature (1)..( 11): Result.002 file - promoters60/1448231
tttttctaaaa

SEQ ID NO: 116878 - DNA, 11 bp, Unknown
  misc_feature (1)..( 11): Result.002 file - promoters60/1448231
ttttgctaaaa

SEQ ID NO: 116879 - DNA, 11 bp, Unknown
  misc_feature (1)..( 11): Result.002 file - promoters60/1448231
atctgctaatg

SEQ ID NO: 116880 - DNA, 10 bp, Unknown
  misc_feature (1)..( 10): Result.002 file - promoters60/1448231
tcgagagtat

SEQ ID NO: 116881 - DNA, 10 bp, Unknown
  misc_feature (1)..( 10): Result.002 file - promoters60/1448231
aacagagtaa

SEQ ID NO: 116882 - DNA, 10 bp, Unknown
  misc_feature (1)..( 10): Result.002 file - promoters60/1448231
ttgagggtac

SEQ ID NO: 116883 - DNA, 10 bp, Unknown
  misc_feature (1)..( 10): Result.002 file - promoters60/1448231
aacagaataa

SEQ ID NO: 116884 - DNA, 9 bp, Unknown
  misc_feature (1)..( 9): Result.002 file - promoters60/1448235
cttgtgttt

SEQ ID NO: 116885 - DNA, 9 bp, Unknown
  misc_feature (1)..( 9): Result.002 file - promoters60/1448235
cttctgttt

SEQ ID NO: 116886 - DNA, 12 bp, Unknown
  misc_feature (1)..( 12): Result.002 file - promoters60/1448235
tttcatctatct

SEQ ID NO: 116887 - DNA, 12 bp, Unknown
  misc_feature (1)..( 12): Result.002 file - promoters60/1448235
tttgatctctct

SEQ ID NO: 116888 - DNA, 11 bp, Unknown
  misc_feature (1)..( 11): Result.002 file - promoters60/1448235
caattggatat

SEQ ID NO: 116889 - DNA, 11 bp, Unknown
  misc_feature (1)..( 11): Result.002 file - promoters60/1448235
caattcgatat

SEQ ID NO: 116890 - DNA, 6 bp, Unknown
  misc_feature (1)..( 6): Result.002 file - promoters60/1448235
gttttt

SEQ ID NO: 116891 - DNA, 6 bp, Unknown
  misc_feature (1)..( 6): Result.002 file - promoters60/1448235
gttttt

SEQ ID NO: 116892 - DNA, 6 bp, Unknown
  misc_feature (1)..( 6): Result.002 file - promoters60/1448235
tataaa

SEQ ID NO: 116893 - DNA, 6 bp, Unknown
  misc_feature (1)..( 6): Result.002 file - promoters60/1448235
tataaa

SEQ ID NO: 116894 - DNA, 13 bp, Unknown
  misc_feature (1)..( 13): Result.002 file - promoters60/1448235
aaattcaaattta

SEQ ID NO: 116895 - DNA, 13 bp, Unknown
  misc_feature (1)..( 13): Result.002 file - promoters60/1448235
aaattaaaactta

SEQ ID NO: 116896 - DNA, 6 bp, Unknown
  misc_feature (1)..( 6): Result.002 file - promoters60/1448235
tttttt

SEQ ID NO: 116897 - DNA, 6 bp, Unknown
  misc_feature (1)..( 6): Result.002 file - promoters60/1448235
tttttt

SEQ ID NO: 116898 - DNA, 8 bp, Unknown
  misc_feature (1)..( 8): Result.002 file - promoters60/1448235
acaaataa

SEQ ID NO: 116899 - DNA, 8 bp, Unknown
  misc_feature (1)..( 8): Result.002 file - promoters60/1448235
acaaataa

SEQ ID NO: 116900 - DNA, 7 bp, Unknown
  misc_feature (1)..( 7): Result.002 file - promoters60/1448235
tttgacc

SEQ ID NO: 116901 - DNA, 7 bp, Unknown
  misc_feature (1)..( 7): Result.002 file - promoters60/1448235
ttttacc

SEQ ID NO: 116902 - DNA, 8 bp, Unknown
  misc_feature (1)..( 8): Result.002 file - promoters60/1448235
tcaaatct

SEQ ID NO: 116903 - DNA, 8 bp, Unknown
  misc_feature (1)..( 8): Result.002 file - promoters60/1448235
tcaagtct

SEQ ID NO: 116904 - DNA, 8 bp, Unknown
  misc_feature (1)..( 8): Result.002 file - promoters60/1448235
atctcaag

SEQ ID NO: 116905 - DNA, 8 bp, Unknown
  misc_feature (1)..( 8): Result.002 file - promoters60/1448235
atctaaag

SEQ ID NO: 116906 - DNA, 6 bp, Unknown
  misc_feature (1)..( 6): Result.002 file - promoters60/1448235
caatct

SEQ ID NO: 116907 - DNA, 6 bp, Unknown
  misc_feature (1)..( 6): Result.002 file - promoters60/1448235
caatct

SEQ ID NO: 116908 - DNA, 8 bp, Unknown
  misc_feature (1)..( 8): Result.002 file - promoters60/1448235
agacgaag

SEQ ID NO: 116909 - DNA, 8 bp, Unknown
  misc_feature (1)..( 8): Result.002 file - promoters60/1448235
agaggaag

SEQ ID NO: 116910 - DNA, 6 bp, Unknown
  misc_feature (1)..( 6): Result.002 file - promoters60/1448235
atctac

SEQ ID NO: 116911 - DNA, 6 bp, Unknown
  misc_feature (1)..( 6): Result.002 file - promoters60/1448235
atctac

SEQ ID NO: 116912 - DNA, 7 bp, Unknown
  misc_feature (1)..( 7): Result.002 file - promoters60/1448235
ttttttt

SEQ ID NO: 116913 - DNA, 7 bp, Unknown
  misc_feature (1)..( 7): Result.002 file - promoters60/1448235
ttttttt

SEQ ID NO: 116914 - DNA, 9 bp, Unknown
  misc_feature (1)..( 9): Result.002 file - promoters60/1448251
aaagtaatc

SEQ ID NO: 116915 - DNA, 9 bp, Unknown
  misc_feature (1)..( 9): Result.002 file - promoters60/1448251
aaaataatc

SEQ ID NO: 116916 - DNA, 9 bp, Unknown
  misc_feature (1)..( 9): Result.002 file - promoters60/1448251
ctaagtttt

SEQ ID NO: 116917 - DNA, 9 bp, Unknown
  misc_feature (1)..( 9): Result.002 file - promoters60/1448251
ctaggtttt

SEQ ID NO: 116918 - DNA, 9 bp, Unknown
  misc_feature (1)..( 9): Result.002 file - promoters60/1448251
tgaagtttt

SEQ ID NO: 116919 - DNA, 10 bp, Unknown
  misc_feature (1)..( 10): Result.002 file - promoters60/1448251
aaataaaaat

SEQ ID NO: 116920 - DNA, 10 bp, Unknown
  misc_feature (1)..( 10): Result.002 file - promoters60/1448251
aaaaaaaaat

SEQ ID NO: 116921 - DNA, 7 bp, Unknown
  misc_feature (1)..( 7): Result.002 file - promoters60/1448251
agtttat

SEQ ID NO: 116922 - DNA, 7 bp, Unknown
  misc_feature (1)..( 7): Result.002 file - promoters60/1448251
agtatat

SEQ ID NO: 116923 - DNA, 7 bp, Unknown
  misc_feature (1)..( 7): Result.002 file - promoters60/1448251
agacaaa

SEQ ID NO: 116924 - DNA, 7 bp, Unknown
  misc_feature (1)..( 7): Result.002 file - promoters60/1448251
agataaa

SEQ ID NO: 116925 - DNA, 8 bp, Unknown
  misc_feature (1)..( 8): Result.002 file - promoters60/1448251
aaaaaatt

SEQ ID NO: 116926 - DNA, 8 bp, Unknown
  misc_feature (1)..( 8): Result.002 file - promoters60/1448251
aaacaatt

SEQ ID NO: 116927 - DNA, 9 bp, Unknown
  misc_feature (1)..( 9): Result.002 file - promoters60/1448251
tatttttag

SEQ ID NO: 116928 - DNA, 9 bp, Unknown
  misc_feature (1)..( 9): Result.002 file - promoters60/1448251
tattattag

SEQ ID NO: 116929 - DNA, 12 bp, Unknown
  misc_feature (1)..( 12): Result.002 file - promoters60/1448251
tttagatgaatt

SEQ ID NO: 116930 - DNA, 12 bp, Unknown
  misc_feature (1)..( 12): Result.002 file - promoters60/1448251
tttaggtgaaac

SEQ ID NO: 116931 - DNA, 12 bp, Unknown
  misc_feature (1)..( 12): Result.002 file - promoters60/1448251
cacttatggatt

SEQ ID NO: 116932 - DNA, 7 bp, Unknown
  misc_feature (1)..( 7): Result.002 file - promoters60/1448251
ggaataa

SEQ ID NO: 116933 - DNA, 7 bp, Unknown
  misc_feature (1)..( 7): Result.002 file - promoters60/1448251
ggattaa

SEQ ID NO: 116934 - DNA, 7 bp, Unknown
  misc_feature (1)..( 7): Result.002 file - promoters60/1448251
ataatta

SEQ ID NO: 116935 - DNA, 7 bp, Unknown
  misc_feature (1)..( 7): Result.002 file - promoters60/1448251
atactta

SEQ ID NO: 116936 - DNA, 11 bp, Unknown
  misc_feature (1)..( 11): Result.002 file - promoters60/1448251
ataaactaaaa

SEQ ID NO: 116937 - DNA, 11 bp, Unknown
  misc_feature (1)..( 11): Result.002 file - promoters60/1448251
atatactcaaa

SEQ ID NO: 116938 - DNA, 9 bp, Unknown
  misc_feature (1)..( 9): Result.002 file - promoters60/1448251
aaataacat

SEQ ID NO: 116939 - DNA, 9 bp, Unknown
  misc_feature (1)..( 9): Result.002 file - promoters60/1448251
aaaaaacat

SEQ ID NO: 116940 - DNA, 6 bp, Unknown
  misc_feature (1)..( 6): Result.002 file - promoters60/1448251
atttta

SEQ ID NO: 116941 - DNA, 6 bp, Unknown
  misc_feature (1)..( 6): Result.002 file - promoters60/1448251
atttta

SEQ ID NO: 116942 - DNA, 6 bp, Unknown
  misc_feature (1)..( 6): Result.002 file - promoters60/1448251
ttttat

SEQ ID NO: 116943 - DNA, 6 bp, Unknown
  misc_feature (1)..( 6): Result.002 file - promoters60/1448251
ttttat

SEQ ID NO: 116944 - DNA, 7 bp, Unknown
  misc_feature (1)..( 7): Result.002 file - promoters60/1448251
tcattta

SEQ ID NO: 116945 - DNA, 7 bp, Unknown
  misc_feature (1)..( 7): Result.002 file - promoters60/1448251
tcactta

SEQ ID NO: 116946 - DNA, 6 bp, Unknown
  misc_feature (1)..( 6): Result.002 file - promoters60/1448251
aaattt

SEQ ID NO: 116947 - DNA, 6 bp, Unknown
  misc_feature (1)..( 6): Result.002 file - promoters60/1448251
aaattt

SEQ ID NO: 116948 - DNA, 7 bp, Unknown
  misc_feature (1)..( 7): Result.002 file - promoters60/1448251
attttaa

SEQ ID NO: 116949 - DNA, 7 bp, Unknown
  misc_feature (1)..( 7): Result.002 file - promoters60/1448251
attttaa

SEQ ID NO: 116950 - DNA, 10 bp, Unknown
  misc_feature (1)..( 10): Result.002 file - promoters60/1448251
caaaaaaaaa

SEQ ID NO: 116951 - DNA, 10 bp, Unknown
  misc_feature (1)..( 10): Result.002 file - promoters60/1448251
ttaaataaaa

SEQ ID NO: 116952 - DNA, 10 bp, Unknown
  misc_feature (1)..( 10): Result.002 file - promoters60/1448251
ttatatatat

SEQ ID NO: 116953 - DNA, 6 bp, Unknown
  misc_feature (1)..( 6): Result.002 file - promoters60/1448251
tggatt

SEQ ID NO: 116954 - DNA, 6 bp, Unknown
  misc_feature (1)..( 6): Result.002 file - promoters60/1448251
tggatt

SEQ ID NO: 116955 - DNA, 6 bp, Unknown
  misc_feature (1)..( 6): Result.002 file - promoters60/1448251
tttgtt

SEQ ID NO: 116956 - DNA, 6 bp, Unknown
  misc_feature (1)..( 6): Result.002 file - promoters60/1448251
tttgtt

SEQ ID NO: 116957 - DNA, 6 bp, Unknown
  misc_feature (1)..( 6): Result.002 file - promoters60/1448251
aaaaat

SEQ ID NO: 116958 - DNA, 6 bp, Unknown
  misc_feature (1)..( 6): Result.002 file - promoters60/1448251
aaaaat

SEQ ID NO: 116959 - DNA, 6 bp, Unknown
  misc_feature (1)..( 6): Result.002 file - promoters60/1448251
aagaga

SEQ ID NO: 116960 - DNA, 6 bp, Unknown
  misc_feature (1)..( 6): Result.002 file - promoters60/1448251
aagaga

SEQ ID NO: 116961 - DNA, 6 bp, Unknown
  misc_feature (1)..( 6): Result.002 file - promoters60/1448251
tttttt

SEQ ID NO: 116962 - DNA, 6 bp, Unknown
  misc_feature (1)..( 6): Result.002 file - promoters60/1448251
tttttt

SEQ ID NO: 116963 - DNA, 7 bp, Unknown
  misc_feature (1)..( 7): Result.002 file - promoters60/1448251
aaaccca

SEQ ID NO: 116964 - DNA, 7 bp, Unknown
  misc_feature (1)..( 7): Result.002 file - promoters60/1448251
aaatcca

SEQ ID NO: 116965 - DNA, 7 bp, Unknown
  misc_feature (1)..( 7): Result.002 file - promoters60/1448251
atacata

SEQ ID NO: 116966 - DNA, 7 bp, Unknown
  misc_feature (1)..( 7): Result.002 file - promoters60/1448251
ataaata

SEQ ID NO: 116967 - DNA, 14 bp, Unknown
  misc_feature (1)..( 14): Result.002 file - promoters60/1450099
tcacatttatttca

SEQ ID NO: 116968 - DNA, 14 bp, Unknown
  misc_feature (1)..( 14): Result.002 file - promoters60/1450099
ttacatttgtcgtt

SEQ ID NO: 116969 - DNA, 14 bp, Unknown
  misc_feature (1)..( 14): Result.002 file - promoters60/1450099
tcaaatttaattac

SEQ ID NO: 116970 - DNA, 14 bp, Unknown
  misc_feature (1)..( 14): Result.002 file - promoters60/1450099
cttattttatgaaa

SEQ ID NO: 116971 - DNA, 10 bp, Unknown
  misc_feature (1)..( 10): Result.002 file - promoters60/1450137
gaaacgtttg

SEQ ID NO: 116972 - DNA, 10 bp, Unknown
  misc_feature (1)..( 10): Result.002 file - promoters60/1450137
ctaacttttg

SEQ ID NO: 116973 - DNA, 10 bp, Unknown
  misc_feature (1)..( 10): Result.002 file - promoters60/1450137
ttaaatttta

SEQ ID NO: 116974 - DNA, 10 bp, Unknown
  misc_feature (1)..( 10): Result.002 file - promoters60/1450137
ttaaatctgt

SEQ ID NO: 116975 - DNA, 11 bp, Unknown
  misc_feature (1)..( 11): Result.002 file - promoters60/1450137
cccatttgcta

SEQ ID NO: 116976 - DNA, 11 bp, Unknown
  misc_feature (1)..( 11): Result.002 file - promoters60/1450137
ccctttttttt

SEQ ID NO: 116977 - DNA, 11 bp, Unknown
  misc_feature (1)..( 11): Result.002 file - promoters60/1450137
aactttttaaa

SEQ ID NO: 116978 - DNA, 11 bp, Unknown
  misc_feature (1)..( 11): Result.002 file - promoters60/1450137
taatttttaaa

SEQ ID NO: 116979 - DNA, 8 bp, Unknown
  misc_feature (1)..( 8): Result.002 file - promoters60/1450204
caaagctt

SEQ ID NO: 116980 - DNA, 8 bp, Unknown
  misc_feature (1)..( 8): Result.002 file - promoters60/1450204
taaagctc

SEQ ID NO: 116981 - DNA, 8 bp, Unknown
  misc_feature (1)..( 8): Result.002 file - promoters60/1450204
caaggctt

SEQ ID NO: 116982 - DNA, 8 bp, Unknown
  misc_feature (1)..( 8): Result.002 file - promoters60/1450204
aaaaactc

SEQ ID NO: 116983 - DNA, 13 bp, Unknown
  misc_feature (1)..( 13): Result.002 file - promoters60/1450204
cattcgaatgcta

SEQ ID NO: 116984 - DNA, 13 bp, Unknown
  misc_feature (1)..( 13): Result.002 file - promoters60/1450204
catttgaattttt

SEQ ID NO: 116985 - DNA, 13 bp, Unknown
  misc_feature (1)..( 13): Result.002 file - promoters60/1450204
gatttgagttttt

SEQ ID NO: 116986 - DNA, 13 bp, Unknown
  misc_feature (1)..( 13): Result.002 file - promoters60/1450204
gatttgtttgcga

SEQ ID NO: 116987 - DNA, 8 bp, Unknown
  misc_feature (1)..( 8): Result.002 file - promoters60/1450224
gtaaacat

SEQ ID NO: 116988 - DNA, 8 bp, Unknown
  misc_feature (1)..( 8): Result.002 file - promoters60/1450224
gtagacat

SEQ ID NO: 116989 - DNA, 6 bp, Unknown
  misc_feature (1)..( 6): Result.002 file - promoters60/1450224
acatat

SEQ ID NO: 116990 - DNA, 6 bp, Unknown
  misc_feature (1)..( 6): Result.002 file - promoters60/1450224
acatat

SEQ ID NO: 116991 - DNA, 7 bp, Unknown
  misc_feature (1)..( 7): Result.002 file - promoters60/1450224
ttttcta

SEQ ID NO: 116992 - DNA, 7 bp, Unknown
  misc_feature (1)..( 7): Result.002 file - promoters60/1450224
ttttcta

SEQ ID NO: 116993 - DNA, 7 bp, Unknown
  misc_feature (1)..( 7): Result.002 file - promoters60/1450224
tttttag

SEQ ID NO: 116994 - DNA, 7 bp, Unknown
  misc_feature (1)..( 7): Result.002 file - promoters60/1450224
ccaattc

SEQ ID NO: 116995 - DNA, 7 bp, Unknown
  misc_feature (1)..( 7): Result.002 file - promoters60/1450224
ccatttc

SEQ ID NO: 116996 - DNA, 8 bp, Unknown
  misc_feature (1)..( 8): Result.002 file - promoters60/1450224
aaatgaaa

SEQ ID NO: 116997 - DNA, 8 bp, Unknown
  misc_feature (1)..( 8): Result.002 file - promoters60/1450224
aaaagaaa

SEQ ID NO: 116998 - DNA, 7 bp, Unknown
  misc_feature (1)..( 7): Result.002 file - promoters60/1450224
tatttta

SEQ ID NO: 116999 - DNA, 7 bp, Unknown
  misc_feature (1)..( 7): Result.002 file - promoters60/1450224
tatttta

SEQ ID NO: 117000 - DNA, 7 bp, Unknown
  misc_feature (1)..( 7): Result.002 file - promoters60/1450224
taaaata

SEQ ID NO: 117001 - DNA, 7 bp, Unknown
  misc_feature (1)..( 7): Result.002 file - promoters60/1450224
taatata

SEQ ID NO: 117002 - DNA, 6 bp, Unknown
  misc_feature (1)..( 6): Result.002 file - promoters60/1450224
aagtta

SEQ ID NO: 117003 - DNA, 6 bp, Unknown
  misc_feature (1)..( 6): Result.002 file - promoters60/1450224
aagtta

SEQ ID NO: 117004 - DNA, 9 bp, Unknown
  misc_feature (1)..( 9): Result.002 file - promoters60/1450224
atttgtaat

SEQ ID NO: 117005 - DNA, 9 bp, Unknown
  misc_feature (1)..( 9): Result.002 file - promoters60/1450224
ttttttaat

SEQ ID NO: 117006 - DNA, 9 bp, Unknown
  misc_feature (1)..( 9): Result.002 file - promoters60/1450224
atttttttt

SEQ ID NO: 117007 - DNA, 8 bp, Unknown
  misc_feature (1)..( 8): Result.002 file - promoters60/1450224
aaaaaaag

SEQ ID NO: 117008 - DNA, 8 bp, Unknown
  misc_feature (1)..( 8): Result.002 file - promoters60/1450224
aaaacaag

SEQ ID NO: 117009 - DNA, 9 bp, Unknown
  misc_feature (1)..( 9): Result.002 file - promoters60/1450224
aaaataatc

SEQ ID NO: 117010 - DNA, 9 bp, Unknown
  misc_feature (1)..( 9): Result.002 file - promoters60/1450224
aaaatgatc

SEQ ID NO: 117011 - DNA, 7 bp, Unknown
  misc_feature (1)..( 7): Result.002 file - promoters60/1450224
aatagat

SEQ ID NO: 117012 - DNA, 7 bp, Unknown
  misc_feature (1)..( 7): Result.002 file - promoters60/1450224
aatcgat

SEQ ID NO: 117013 - DNA, 8 bp, Unknown
  misc_feature (1)..( 8): Result.002 file - promoters60/1450224
gaacacaa

SEQ ID NO: 117014 - DNA, 8 bp, Unknown
  misc_feature (1)..( 8): Result.002 file - promoters60/1450224
gaaaacaa

SEQ ID NO: 117015 - DNA, 7 bp, Unknown
  misc_feature (1)..( 7): Result.002 file - promoters60/1450224
aaaccaa

SEQ ID NO: 117016 - DNA, 7 bp, Unknown
  misc_feature (1)..( 7): Result.002 file - promoters60/1450224
aaaccaa

SEQ ID NO: 117017 - DNA, 8 bp, Unknown
  misc_feature (1)..( 8): Result.002 file - promoters60/1450224
ttttagta

SEQ ID NO: 117018 - DNA, 8 bp, Unknown
  misc_feature (1)..( 8): Result.002 file - promoters60/1450224
tttcagta

SEQ ID NO: 117019 - DNA, 7 bp, Unknown
  misc_feature (1)..( 7): Result.002 file - promoters60/1450224
aaagtct

SEQ ID NO: 117020 - DNA, 7 bp, Unknown
  misc_feature (1)..( 7): Result.002 file - promoters60/1450224
aaattct

SEQ ID NO: 117021 - DNA, 6 bp, Unknown
  misc_feature (1)..( 6): Result.002 file - promoters60/1450224
aaaatc

SEQ ID NO: 117022 - DNA, 6 bp, Unknown
  misc_feature (1)..( 6): Result.002 file - promoters60/1450224
aaaatc

SEQ ID NO: 117023 - DNA, 7 bp, Unknown
  misc_feature (1)..( 7): Result.002 file - promoters60/1450224
cttgcta

SEQ ID NO: 117024 - DNA, 7 bp, Unknown
  misc_feature (1)..( 7): Result.002 file - promoters60/1450224
cttgcta

SEQ ID NO: 117025 - DNA, 7 bp, Unknown
  misc_feature (1)..( 7): Result.002 file - promoters60/1450224
ataaaaa

SEQ ID NO: 117026 - DNA, 7 bp, Unknown
  misc_feature (1)..( 7): Result.002 file - promoters60/1450224
atataaa

SEQ ID NO: 117027 - DNA, 8 bp, Unknown
  misc_feature (1)..( 8): Result.002 file - promoters60/1450309
aaagaaag

SEQ ID NO: 117028 - DNA, 8 bp, Unknown
  misc_feature (1)..( 8): Result.002 file - promoters60/1450309
aaacaaaa

SEQ ID NO: 117029 - DNA, 8 bp, Unknown
  misc_feature (1)..( 8): Result.002 file - promoters60/1450309
ctagaaag

SEQ ID NO: 117030 - DNA, 6 bp, Unknown
  misc_feature (1)..( 6): Result.002 file - promoters60/1450309
ttgttt

SEQ ID NO: 117031 - DNA, 6 bp, Unknown
  misc_feature (1)..( 6): Result.002 file - promoters60/1450309
ttgttt

SEQ ID NO: 117032 - DNA, 6 bp, Unknown
  misc_feature (1)..( 6): Result.002 file - promoters60/1450309
aagtcc

SEQ ID NO: 117033 - DNA, 6 bp, Unknown
  misc_feature (1)..( 6): Result.002 file - promoters60/1450309
aagtcc

SEQ ID NO: 117034 - DNA, 7 bp, Unknown
  misc_feature (1)..( 7): Result.002 file - promoters60/1450309
aagtctt

SEQ ID NO: 117035 - DNA, 7 bp, Unknown
  misc_feature (1)..( 7): Result.002 file - promoters60/1450309
aagtctt

SEQ ID NO: 117036 - DNA, 6 bp, Unknown
  misc_feature (1)..( 6): Result.002 file - promoters60/1450309
tcttca

SEQ ID NO: 117037 - DNA, 6 bp, Unknown
  misc_feature (1)..( 6): Result.002 file - promoters60/1450309
tcttca

SEQ ID NO: 117038 - DNA, 6 bp, Unknown
  misc_feature (1)..( 6): Result.002 file - promoters60/1450309
tcctgg

SEQ ID NO: 117039 - DNA, 6 bp, Unknown
  misc_feature (1)..( 6): Result.002 file - promoters60/1450309
tcctgg

SEQ ID NO: 117040 - DNA, 8 bp, Unknown
  misc_feature (1)..( 8): Result.002 file - promoters60/1450309
ctataaag

SEQ ID NO: 117041 - DNA, 8 bp, Unknown
  misc_feature (1)..( 8): Result.002 file - promoters60/1450309
ctagaaag

SEQ ID NO: 117042 - DNA, 6 bp, Unknown
  misc_feature (1)..( 6): Result.002 file - promoters60/1450309
gagata

SEQ ID NO: 117043 - DNA, 6 bp, Unknown
  misc_feature (1)..( 6): Result.002 file - promoters60/1450309
gagata

SEQ ID NO: 117044 - DNA, 6 bp, Unknown
  misc_feature (1)..( 6): Result.002 file - promoters60/1450309
caagac

SEQ ID NO: 117045 - DNA, 6 bp, Unknown
  misc_feature (1)..( 6): Result.002 file - promoters60/1450309
caagac

SEQ ID NO: 117046 - DNA, 7 bp, Unknown
  misc_feature (1)..( 7): Result.002 file - promoters60/1450309
taatatt

SEQ ID NO: 117047 - DNA, 7 bp, Unknown
  misc_feature (1)..( 7): Result.002 file - promoters60/1450309
taatatt

SEQ ID NO: 117048 - DNA, 8 bp, Unknown
  misc_feature (1)..( 8): Result.002 file - promoters60/1450309
ttttgagt

SEQ ID NO: 117049 - DNA, 8 bp, Unknown
  misc_feature (1)..( 8): Result.002 file - promoters60/1450309
ttttgagt

SEQ ID NO: 117050 - DNA, 7 bp, Unknown
  misc_feature (1)..( 7): Result.002 file - promoters60/1450309
tattttt

SEQ ID NO: 117051 - DNA, 7 bp, Unknown
  misc_feature (1)..( 7): Result.002 file - promoters60/1450309
tattttt

SEQ ID NO: 117052 - DNA, 6 bp, Unknown
  misc_feature (1)..( 6): Result.002 file - promoters60/1450309
agattt

SEQ ID NO: 117053 - DNA, 6 bp, Unknown
  misc_feature (1)..( 6): Result.002 file - promoters60/1450309
agattt

SEQ ID NO: 117054 - DNA, 9 bp, Unknown
  misc_feature (1)..( 9): Result.002 file - promoters60/1450309
attataata

SEQ ID NO: 117055 - DNA, 9 bp, Unknown
  misc_feature (1)..( 9): Result.002 file - promoters60/1450309
attatcata

SEQ ID NO: 117056 - DNA, 6 bp, Unknown
  misc_feature (1)..( 6): Result.002 file - promoters60/1450309
cattaa

SEQ ID NO: 117057 - DNA, 6 bp, Unknown
  misc_feature (1)..( 6): Result.002 file - promoters60/1450309
cattaa

SEQ ID NO: 117058 - DNA, 8 bp, Unknown
  misc_feature (1)..( 8): Result.002 file - promoters60/1450309
aatgttct

SEQ ID NO: 117059 - DNA, 8 bp, Unknown
  misc_feature (1)..( 8): Result.002 file - promoters60/1450309
aatgatct

SEQ ID NO: 117060 - DNA, 7 bp, Unknown
  misc_feature (1)..( 7): Result.002 file - promoters60/1450309
tttacca

SEQ ID NO: 117061 - DNA, 7 bp, Unknown
  misc_feature (1)..( 7): Result.002 file - promoters60/1450309
tttccca

SEQ ID NO: 117062 - DNA, 7 bp, Unknown
  misc_feature (1)..( 7): Result.002 file - promoters60/1450309
tcaactc

SEQ ID NO: 117063 - DNA, 7 bp, Unknown
  misc_feature (1)..( 7): Result.002 file - promoters60/1450309
tcaactc

SEQ ID NO: 117064 - DNA, 9 bp, Unknown
  misc_feature (1)..( 9): Result.002 file - promoters60/1450309
attaaccga

SEQ ID NO: 117065 - DNA, 9 bp, Unknown
  misc_feature (1)..( 9): Result.002 file - promoters60/1450309
atttaccga

SEQ ID NO: 117066 - DNA, 6 bp, Unknown
  misc_feature (1)..( 6): Result.002 file - promoters60/1450309
tttttt

SEQ ID NO: 117067 - DNA, 6 bp, Unknown
  misc_feature (1)..( 6): Result.002 file - promoters60/1450309
tttttt

SEQ ID NO: 117068 - DNA, 7 bp, Unknown
  misc_feature (1)..( 7): Result.002 file - promoters60/1450309
tatttct

SEQ ID NO: 117069 - DNA, 7 bp, Unknown
  misc_feature (1)..( 7): Result.002 file - promoters60/1450309
tatttct

SEQ ID NO: 117070 - DNA, 6 bp, Unknown
  misc_feature (1)..( 6): Result.002 file - promoters60/1450309
tgactt

SEQ ID NO: 117071 - DNA, 6 bp, Unknown
  misc_feature (1)..( 6): Result.002 file - promoters60/1450309
tgactt

SEQ ID NO: 117072 - DNA, 7 bp, Unknown
  misc_feature (1)..( 7): Result.002 file - promoters60/1450321
gtaaagt

SEQ ID NO: 117073 - DNA, 7 bp, Unknown
  misc_feature (1)..( 7): Result.002 file - promoters60/1450321
gtaaagt

SEQ ID NO: 117074 - DNA, 6 bp, Unknown
  misc_feature (1)..( 6): Result.002 file - promoters60/1450321
ttttga

SEQ ID NO: 117075 - DNA, 6 bp, Unknown
  misc_feature (1)..( 6): Result.002 file - promoters60/1450321
ttttga

SEQ ID NO: 117076 - DNA, 8 bp, Unknown
  misc_feature (1)..( 8): Result.002 file - promoters60/1450321
atttttag

SEQ ID NO: 117077 - DNA, 8 bp, Unknown
  misc_feature (1)..( 8): Result.002 file - promoters60/1450321
atttgtag

SEQ ID NO: 117078 - DNA, 7 bp, Unknown
  misc_feature (1)..( 7): Result.002 file - promoters60/1450321
ttatttt

SEQ ID NO: 117079 - DNA, 7 bp, Unknown
  misc_feature (1)..( 7): Result.002 file - promoters60/1450321
ttaattt

SEQ ID NO: 117080 - DNA, 7 bp, Unknown
  misc_feature (1)..( 7): Result.002 file - promoters60/1450321
gacctct

SEQ ID NO: 117081 - DNA, 7 bp, Unknown
  misc_feature (1)..( 7): Result.002 file - promoters60/1450321
gacttct

SEQ ID NO: 117082 - DNA, 6 bp, Unknown
  misc_feature (1)..( 6): Result.002 file - promoters60/1450321
tgagct

SEQ ID NO: 117083 - DNA, 6 bp, Unknown
  misc_feature (1)..( 6): Result.002 file - promoters60/1450321
tgagct

SEQ ID NO: 117084 - DNA, 8 bp, Unknown
  misc_feature (1)..( 8): Result.002 file - promoters60/1450321
gctttctc

SEQ ID NO: 117085 - DNA, 8 bp, Unknown
  misc_feature (1)..( 8): Result.002 file - promoters60/1450321
gcttactc

SEQ ID NO: 117086 - DNA, 8 bp, Unknown
  misc_feature (1)..( 8): Result.002 file - promoters60/1450321
ttagctca

SEQ ID NO: 117087 - DNA, 8 bp, Unknown
  misc_feature (1)..( 8): Result.002 file - promoters60/1450321
ttagttca

SEQ ID NO: 117088 - DNA, 7 bp, Unknown
  misc_feature (1)..( 7): Result.002 file - promoters60/1450321
actcgta

SEQ ID NO: 117089 - DNA, 7 bp, Unknown
  misc_feature (1)..( 7): Result.002 file - promoters60/1450321
actggta

SEQ ID NO: 117090 - DNA, 9 bp, Unknown
  misc_feature (1)..( 9): Result.002 file - promoters60/1450321
tgaaaaact

SEQ ID NO: 117091 - DNA, 9 bp, Unknown
  misc_feature (1)..( 9): Result.002 file - promoters60/1450321
tgaaaaact

SEQ ID NO: 117092 - DNA, 8 bp, Unknown
  misc_feature (1)..( 8): Result.002 file - promoters60/1450321
aatcaagt

SEQ ID NO: 117093 - DNA, 8 bp, Unknown
  misc_feature (1)..( 8): Result.002 file - promoters60/1450321
aatcaagt

SEQ ID NO: 117094 - DNA, 7 bp, Unknown
  misc_feature (1)..( 7): Result.002 file - promoters60/1450321
caaaaaa

SEQ ID NO: 117095 - DNA, 7 bp, Unknown
  misc_feature (1)..( 7): Result.002 file - promoters60/1450321
caacaaa

SEQ ID NO: 117096 - DNA, 6 bp, Unknown
  misc_feature (1)..( 6): Result.002 file - promoters60/1450357
aatact

SEQ ID NO: 117097 - DNA, 6 bp, Unknown
  misc_feature (1)..( 6): Result.002 file - promoters60/1450357
aatact

SEQ ID NO: 117098 - DNA, 8 bp, Unknown
  misc_feature (1)..( 8): Result.002 file - promoters60/1450357
atatataa

SEQ ID NO: 117099 - DNA, 8 bp, Unknown
  misc_feature (1)..( 8): Result.002 file - promoters60/1450357
atagatat

SEQ ID NO: 117100 - DNA, 8 bp, Unknown
  misc_feature (1)..( 8): Result.002 file - promoters60/1450357
ttatataa

SEQ ID NO: 117101 - DNA, 11 bp, Unknown
  misc_feature (1)..( 11): Result.002 file - promoters60/1450357
tttgtttgttt

SEQ ID NO: 117102 - DNA, 11 bp, Unknown
  misc_feature (1)..( 11): Result.002 file - promoters60/1450357
tttctttattt

SEQ ID NO: 117103 - DNA, 7 bp, Unknown
  misc_feature (1)..( 7): Result.002 file - promoters60/1450357
attatca

SEQ ID NO: 117104 - DNA, 7 bp, Unknown
  misc_feature (1)..( 7): Result.002 file - promoters60/1450357
attctca

SEQ ID NO: 117105 - DNA, 7 bp, Unknown
  misc_feature (1)..( 7): Result.002 file - promoters60/1450357
tagaaaa

SEQ ID NO: 117106 - DNA, 7 bp, Unknown
  misc_feature (1)..( 7): Result.002 file - promoters60/1450357
tagaaaa

SEQ ID NO: 117107 - DNA, 7 bp, Unknown
  misc_feature (1)..( 7): Result.002 file - promoters60/1450357
atgtatg

SEQ ID NO: 117108 - DNA, 7 bp, Unknown
  misc_feature (1)..( 7): Result.002 file - promoters60/1450357
atggatg

SEQ ID NO: 117109 - DNA, 12 bp, Unknown
  misc_feature (1)..( 12): Result.002 file - promoters60/1450357
ttttgcaatttt

SEQ ID NO: 117110 - DNA, 12 bp, Unknown
  misc_feature (1)..( 12): Result.002 file - promoters60/1450357
taaggcaaattt

SEQ ID NO: 117111 - DNA, 12 bp, Unknown
  misc_feature (1)..( 12): Result.002 file - promoters60/1450357
taagccaaacgc

SEQ ID NO: 117112 - DNA, 8 bp, Unknown
  misc_feature (1)..( 8): Result.002 file - promoters60/1450357
tattgaaa

SEQ ID NO: 117113 - DNA, 8 bp, Unknown
  misc_feature (1)..( 8): Result.002 file - promoters60/1450357
tattaaaa

SEQ ID NO: 117114 - DNA, 10 bp, Unknown
  misc_feature (1)..( 10): Result.002 file - promoters60/1450357
tttatacaat

SEQ ID NO: 117115 - DNA, 10 bp, Unknown
  misc_feature (1)..( 10): Result.002 file - promoters60/1450357
tttatataat

SEQ ID NO: 117116 - DNA, 6 bp, Unknown
  misc_feature (1)..( 6): Result.002 file - promoters60/1450357
agaaaa

SEQ ID NO: 117117 - DNA, 6 bp, Unknown
  misc_feature (1)..( 6): Result.002 file - promoters60/1450357
agaaaa

SEQ ID NO: 117118 - DNA, 8 bp, Unknown
  misc_feature (1)..( 8): Result.002 file - promoters60/1450357
aaataata

SEQ ID NO: 117119 - DNA, 8 bp, Unknown
  misc_feature (1)..( 8): Result.002 file - promoters60/1450357
aaaaaata

SEQ ID NO: 117120 - DNA, 6 bp, Unknown
  misc_feature (1)..( 6): Result.002 file - promoters60/1450357
ctaaac

SEQ ID NO: 117121 - DNA, 6 bp, Unknown
  misc_feature (1)..( 6): Result.002 file - promoters60/1450357
ctaaac

SEQ ID NO: 117122 - DNA, 6 bp, Unknown
  misc_feature (1)..( 6): Result.002 file - promoters60/1450357
caaaat

SEQ ID NO: 117123 - DNA, 6 bp, Unknown
  misc_feature (1)..( 6): Result.002 file - promoters60/1450357
caaaat

SEQ ID NO: 117124 - DNA, 6 bp, Unknown
  misc_feature (1)..( 6): Result.002 file - promoters60/1450357
ccatac

SEQ ID NO: 117125 - DNA, 6 bp, Unknown
  misc_feature (1)..( 6): Result.002 file - promoters60/1450357
ccatac

SEQ ID NO: 117126 - DNA, 6 bp, Unknown
  misc_feature (1)..( 6): Result.002 file - promoters60/1450357
cacgtg

SEQ ID NO: 117127 - DNA, 6 bp, Unknown
  misc_feature (1)..( 6): Result.002 file - promoters60/1450357
cacgtg

SEQ ID NO: 117128 - DNA, 8 bp, Unknown
  misc_feature (1)..( 8): Result.002 file - promoters60/1450357
atgtcagc

SEQ ID NO: 117129 - DNA, 8 bp, Unknown
  misc_feature (1)..( 8): Result.002 file - promoters60/1450357
atgccagc

SEQ ID NO: 117130 - DNA, 7 bp, Unknown
  misc_feature (1)..( 7): Result.002 file - promoters60/1450357
gtgggat

SEQ ID NO: 117131 - DNA, 7 bp, Unknown
  misc_feature (1)..( 7): Result.002 file - promoters60/1450357
gtgagat

SEQ ID NO: 117132 - DNA, 7 bp, Unknown
  misc_feature (1)..( 7): Result.002 file - promoters60/1450357
gaagaga

SEQ ID NO: 117133 - DNA, 7 bp, Unknown
  misc_feature (1)..( 7): Result.002 file - promoters60/1450357
gaagaga

SEQ ID NO: 117134 - DNA, 7 bp, Unknown
  misc_feature (1)..( 7): Result.002 file - promoters60/1450473
aacattc

SEQ ID NO: 117135 - DNA, 7 bp, Unknown
  misc_feature (1)..( 7): Result.002 file - promoters60/1450473
aacattc

SEQ ID NO: 117136 - DNA, 8 bp, Unknown
  misc_feature (1)..( 8): Result.002 file - promoters60/1450473
aaaagaaa

SEQ ID NO: 117137 - DNA, 8 bp, Unknown
  misc_feature (1)..( 8): Result.002 file - promoters60/1450473
aaaaaaaa

SEQ ID NO: 117138 - DNA, 8 bp, Unknown
  misc_feature (1)..( 8): Result.002 file - promoters60/1450473
gaacaaca

SEQ ID NO: 117139 - DNA, 8 bp, Unknown
  misc_feature (1)..( 8): Result.002 file - promoters60/1450473
gaataaca

SEQ ID NO: 117140 - DNA, 6 bp, Unknown
  misc_feature (1)..( 6): Result.002 file - promoters60/1450473
gaagaa

SEQ ID NO: 117141 - DNA, 6 bp, Unknown
  misc_feature (1)..( 6): Result.002 file - promoters60/1450473
gaagaa

SEQ ID NO: 117142 - DNA, 8 bp, Unknown
  misc_feature (1)..( 8): Result.002 file - promoters60/1450473
agagtttg

SEQ ID NO: 117143 - DNA, 8 bp, Unknown
  misc_feature (1)..( 8): Result.002 file - promoters60/1450473
agattttg

SEQ ID NO: 117144 - DNA, 7 bp, Unknown
  misc_feature (1)..( 7): Result.002 file - promoters60/1450473
aaactgt

SEQ ID NO: 117145 - DNA, 7 bp, Unknown
  misc_feature (1)..( 7): Result.002 file - promoters60/1450473
aaaatgt

SEQ ID NO: 117146 - DNA, 8 bp, Unknown
  misc_feature (1)..( 8): Result.002 file - promoters60/1450473
aatttgct

SEQ ID NO: 117147 - DNA, 8 bp, Unknown
  misc_feature (1)..( 8): Result.002 file - promoters60/1450473
aatctgct

SEQ ID NO: 117148 - DNA, 6 bp, Unknown
  misc_feature (1)..( 6): Result.002 file - promoters60/1450473
aatatt

SEQ ID NO: 117149 - DNA, 6 bp, Unknown
  misc_feature (1)..( 6): Result.002 file - promoters60/1450473
aatatt

SEQ ID NO: 117150 - DNA, 7 bp, Unknown
  misc_feature (1)..( 7): Result.002 file - promoters60/1450473
aatgaga

SEQ ID NO: 117151 - DNA, 7 bp, Unknown
  misc_feature (1)..( 7): Result.002 file - promoters60/1450473
aattaga

SEQ ID NO: 117152 - DNA, 7 bp, Unknown
  misc_feature (1)..( 7): Result.002 file - promoters60/1450473
gaacaaa

SEQ ID NO: 117153 - DNA, 7 bp, Unknown
  misc_feature (1)..( 7): Result.002 file - promoters60/1450473
gaagaaa

SEQ ID NO: 117154 - DNA, 6 bp, Unknown
  misc_feature (1)..( 6): Result.002 file - promoters60/1450473
aaatca

SEQ ID NO: 117155 - DNA, 6 bp, Unknown
  misc_feature (1)..( 6): Result.002 file - promoters60/1450473
aaatca

SEQ ID NO: 117156 - DNA, 7 bp, Unknown
  misc_feature (1)..( 7): Result.002 file - promoters60/1450473
cagaact

SEQ ID NO: 117157 - DNA, 7 bp, Unknown
  misc_feature (1)..( 7): Result.002 file - promoters60/1450473
cagcact

SEQ ID NO: 117158 - DNA, 7 bp, Unknown
  misc_feature (1)..( 7): Result.002 file - promoters60/1450477
aattaaa

SEQ ID NO: 117159 - DNA, 7 bp, Unknown
  misc_feature (1)..( 7): Result.002 file - promoters60/1450477
aatgaaa

SEQ ID NO: 117160 - DNA, 9 bp, Unknown
  misc_feature (1)..( 9): Result.002 file - promoters60/1450477
aagcactta

SEQ ID NO: 117161 - DNA, 9 bp, Unknown
  misc_feature (1)..( 9): Result.002 file - promoters60/1450477
aagcacgaa

SEQ ID NO: 117162 - DNA, 9 bp, Unknown
  misc_feature (1)..( 9): Result.002 file - promoters60/1450477
tagcattta

SEQ ID NO: 117163 - DNA, 9 bp, Unknown
  misc_feature (1)..( 9): Result.002 file - promoters60/1450477
atccctata

SEQ ID NO: 117164 - DNA, 9 bp, Unknown
  misc_feature (1)..( 9): Result.002 file - promoters60/1450477
atctctatt

SEQ ID NO: 117165 - DNA, 9 bp, Unknown
  misc_feature (1)..( 9): Result.002 file - promoters60/1450477
tactccatt

SEQ ID NO: 117166 - DNA, 6 bp, Unknown
  misc_feature (1)..( 6): Result.002 file - promoters60/1450477
caaaag

SEQ ID NO: 117167 - DNA, 6 bp, Unknown
  misc_feature (1)..( 6): Result.002 file - promoters60/1450477
caaaag

SEQ ID NO: 117168 - DNA, 7 bp, Unknown
  misc_feature (1)..( 7): Result.002 file - promoters60/1450477
ttaaaat

SEQ ID NO: 117169 - DNA, 7 bp, Unknown
  misc_feature (1)..( 7): Result.002 file - promoters60/1450477
ttagaat

SEQ ID NO: 117170 - DNA, 6 bp, Unknown
  misc_feature (1)..( 6): Result.002 file - promoters60/1450477
tatata

SEQ ID NO: 117171 - DNA, 6 bp, Unknown
  misc_feature (1)..( 6): Result.002 file - promoters60/1450477
tatata

SEQ ID NO: 117172 - DNA, 7 bp, Unknown
  misc_feature (1)..( 7): Result.002 file - promoters60/1450477
aaattgt

SEQ ID NO: 117173 - DNA, 7 bp, Unknown
  misc_feature (1)..( 7): Result.002 file - promoters60/1450477
aaagtgt

SEQ ID NO: 117174 - DNA, 7 bp, Unknown
  misc_feature (1)..( 7): Result.002 file - promoters60/1450477
tccgtta

SEQ ID NO: 117175 - DNA, 7 bp, Unknown
  misc_feature (1)..( 7): Result.002 file - promoters60/1450477
tccatta

SEQ ID NO: 117176 - DNA, 9 bp, Unknown
  misc_feature (1)..( 9): Result.002 file - promoters60/1450477
taatttaag

SEQ ID NO: 117177 - DNA, 9 bp, Unknown
  misc_feature (1)..( 9): Result.002 file - promoters60/1450477
taattgaag

SEQ ID NO: 117178 - DNA, 9 bp, Unknown
  misc_feature (1)..( 9): Result.002 file - promoters60/1450477
gctttgaag

SEQ ID NO: 117179 - DNA, 6 bp, Unknown
  misc_feature (1)..( 6): Result.002 file - promoters60/1450477
aaagaa

SEQ ID NO: 117180 - DNA, 6 bp, Unknown
  misc_feature (1)..( 6): Result.002 file - promoters60/1450477
aaagaa

SEQ ID NO: 117181 - DNA, 7 bp, Unknown
  misc_feature (1)..( 7): Result.002 file - promoters60/1450477
tagagaa

SEQ ID NO: 117182 - DNA, 7 bp, Unknown
  misc_feature (1)..( 7): Result.002 file - promoters60/1450477
tagagaa

SEQ ID NO: 117183 - DNA, 7 bp, Unknown
  misc_feature (1)..( 7): Result.002 file - promoters60/1450477
aaggaga

SEQ ID NO: 117184 - DNA, 7 bp, Unknown
  misc_feature (1)..( 7): Result.002 file - promoters60/1450477
aagtaga

SEQ ID NO: 117185 - DNA, 7 bp, Unknown
  misc_feature (1)..( 7): Result.002 file - promoters60/1450477
aaagaag

SEQ ID NO: 117186 - DNA, 7 bp, Unknown
  misc_feature (1)..( 7): Result.002 file - promoters60/1450477
aaagaag

SEQ ID NO: 117187 - DNA, 6 bp, Unknown
  misc_feature (1)..( 6): Result.002 file - promoters60/1450477
caaaag

SEQ ID NO: 117188 - DNA, 6 bp, Unknown
  misc_feature (1)..( 6): Result.002 file - promoters60/1450477
caaaag

SEQ ID NO: 117189 - DNA, 6 bp, Unknown
  misc_feature (1)..( 6): Result.002 file - promoters60/1450477
caacac

SEQ ID NO: 117190 - DNA, 6 bp, Unknown
  misc_feature (1)..( 6): Result.002 file - promoters60/1450477
caacac

SEQ ID NO: 117191 - DNA, 8 bp, Unknown
  misc_feature (1)..( 8): Result.002 file - promoters60/1450610
ataataaa

SEQ ID NO: 117192 - DNA, 8 bp, Unknown
  misc_feature (1)..( 8): Result.002 file - promoters60/1450610
ataatata

SEQ ID NO: 117193 - DNA, 8 bp, Unknown
  misc_feature (1)..( 8): Result.002 file - promoters60/1450610
ataaaata

SEQ ID NO: 117194 - DNA, 8 bp, Unknown
  misc_feature (1)..( 8): Result.002 file - promoters60/1450610
catagaaa

SEQ ID NO: 117195 - DNA, 8 bp, Unknown
  misc_feature (1)..( 8): Result.002 file - promoters60/1450610
tatagaat

SEQ ID NO: 117196 - DNA, 8 bp, Unknown
  misc_feature (1)..( 8): Result.002 file - promoters60/1450610
tatataat

SEQ ID NO: 117197 - DNA, 10 bp, Unknown
  misc_feature (1)..( 10): Result.002 file - promoters60/1450610
aatctgcttc

SEQ ID NO: 117198 - DNA, 10 bp, Unknown
  misc_feature (1)..( 10): Result.002 file - promoters60/1450610
aatcttcttc

SEQ ID NO: 117199 - DNA, 10 bp, Unknown
  misc_feature (1)..( 10): Result.002 file - promoters60/1450610
aatctgatgt

SEQ ID NO: 117200 - DNA, 10 bp, Unknown
  misc_feature (1)..( 10): Result.002 file - promoters60/1450610
aatttgaaaa

SEQ ID NO: 117201 - DNA, 12 bp, Unknown
  misc_feature (1)..( 12): Result.002 file - promoters60/1450610
tattcacattta

SEQ ID NO: 117202 - DNA, 12 bp, Unknown
  misc_feature (1)..( 12): Result.002 file - promoters60/1450610
ttatcaaattta

SEQ ID NO: 117203 - DNA, 12 bp, Unknown
  misc_feature (1)..( 12): Result.002 file - promoters60/1450610
ttatgaaacaga

SEQ ID NO: 117204 - DNA, 9 bp, Unknown
  misc_feature (1)..( 9): Result.002 file - promoters60/1450610
taaccatgg

SEQ ID NO: 117205 - DNA, 9 bp, Unknown
  misc_feature (1)..( 9): Result.002 file - promoters60/1450610
taaacatat

SEQ ID NO: 117206 - DNA, 9 bp, Unknown
  misc_feature (1)..( 9): Result.002 file - promoters60/1450610
caaacttat

SEQ ID NO: 117207 - DNA, 9 bp, Unknown
  misc_feature (1)..( 9): Result.002 file - promoters60/1450610
aatcataaa

SEQ ID NO: 117208 - DNA, 9 bp, Unknown
  misc_feature (1)..( 9): Result.002 file - promoters60/1450610
aatgatact

SEQ ID NO: 117209 - DNA, 9 bp, Unknown
  misc_feature (1)..( 9): Result.002 file - promoters60/1450610
aatcagaaa

SEQ ID NO: 117210 - DNA, 10 bp, Unknown
  misc_feature (1)..( 10): Result.002 file - promoters60/1450610
aatcataaaa

SEQ ID NO: 117211 - DNA, 10 bp, Unknown
  misc_feature (1)..( 10): Result.002 file - promoters60/1450610
aaggataaaa

SEQ ID NO: 117212 - DNA, 10 bp, Unknown
  misc_feature (1)..( 10): Result.002 file - promoters60/1450610
aatcagaaat

SEQ ID NO: 117213 - DNA, 10 bp, Unknown
  misc_feature (1)..( 10): Result.002 file - promoters60/1450610
aaagaaaata

SEQ ID NO: 117214 - DNA, 10 bp, Unknown
  misc_feature (1)..( 10): Result.002 file - promoters60/1450610
aaaaaaaata

SEQ ID NO: 117215 - DNA, 10 bp, Unknown
  misc_feature (1)..( 10): Result.002 file - promoters60/1450610
aaaaagattc

SEQ ID NO: 117216 - DNA, 11 bp, Unknown
  misc_feature (1)..( 11): Result.002 file - promoters60/1450625
aattttgatga

SEQ ID NO: 117217 - DNA, 11 bp, Unknown
  misc_feature (1)..( 11): Result.002 file - promoters60/1450625
tattttggtga

SEQ ID NO: 117218 - DNA, 11 bp, Unknown
  misc_feature (1)..( 11): Result.002 file - promoters60/1450625
tttttggattc

SEQ ID NO: 117219 - DNA, 11 bp, Unknown
  misc_feature (1)..( 11): Result.002 file - promoters60/1450625
aattttaataa

SEQ ID NO: 117220 - DNA, 11 bp, Unknown
  misc_feature (1)..( 11): Result.002 file - promoters60/1450625
cattgtaacaa

SEQ ID NO: 117221 - DNA, 8 bp, Unknown
  misc_feature (1)..( 8): Result.002 file - promoters60/1450625
atatatct

SEQ ID NO: 117222 - DNA, 8 bp, Unknown
  misc_feature (1)..( 8): Result.002 file - promoters60/1450625
ttatctct

SEQ ID NO: 117223 - DNA, 8 bp, Unknown
  misc_feature (1)..( 8): Result.002 file - promoters60/1450625
ttatcttg

SEQ ID NO: 117224 - DNA, 8 bp, Unknown
  misc_feature (1)..( 8): Result.002 file - promoters60/1450625
gtatatca

SEQ ID NO: 117225 - DNA, 8 bp, Unknown
  misc_feature (1)..( 8): Result.002 file - promoters60/1450625
atatatat

SEQ ID NO: 117226 - DNA, 11 bp, Unknown
  misc_feature (1)..( 11): Result.002 file - promoters60/1450625
tttattctacc

SEQ ID NO: 117227 - DNA, 11 bp, Unknown
  misc_feature (1)..( 11): Result.002 file - promoters60/1450625
ttttttccgct

SEQ ID NO: 117228 - DNA, 11 bp, Unknown
  misc_feature (1)..( 11): Result.002 file - promoters60/1450625
attattcatgg

SEQ ID NO: 117229 - DNA, 11 bp, Unknown
  misc_feature (1)..( 11): Result.002 file - promoters60/1450625
tttattctttt

SEQ ID NO: 117230 - DNA, 11 bp, Unknown
  misc_feature (1)..( 11): Result.002 file - promoters60/1450625
cgttttcagct

SEQ ID NO: 117231 - DNA, 8 bp, Unknown
  misc_feature (1)..( 8): Result.002 file - promoters60/1450682
tcacattt

SEQ ID NO: 117232 - DNA, 8 bp, Unknown
  misc_feature (1)..( 8): Result.002 file - promoters60/1450682
tcatattt

SEQ ID NO: 117233 - DNA, 6 bp, Unknown
  misc_feature (1)..( 6): Result.002 file - promoters60/1450682
aaaaaa

SEQ ID NO: 117234 - DNA, 6 bp, Unknown
  misc_feature (1)..( 6): Result.002 file - promoters60/1450682
aaaaaa

SEQ ID NO: 117235 - DNA, 8 bp, Unknown
  misc_feature (1)..( 8): Result.002 file - promoters60/1450682
aaatagta

SEQ ID NO: 117236 - DNA, 8 bp, Unknown
  misc_feature (1)..( 8): Result.002 file - promoters60/1450682
aaatggta

SEQ ID NO: 117237 - DNA, 8 bp, Unknown
  misc_feature (1)..( 8): Result.002 file - promoters60/1450682
atatattt

SEQ ID NO: 117238 - DNA, 8 bp, Unknown
  misc_feature (1)..( 8): Result.002 file - promoters60/1450682
atatatac

SEQ ID NO: 117239 - DNA, 8 bp, Unknown
  misc_feature (1)..( 8): Result.002 file - promoters60/1450682
atacatac

SEQ ID NO: 117240 - DNA, 10 bp, Unknown
  misc_feature (1)..( 10): Result.002 file - promoters60/1450682
ataattaaaa

SEQ ID NO: 117241 - DNA, 10 bp, Unknown
  misc_feature (1)..( 10): Result.002 file - promoters60/1450682
ataattcaaa

SEQ ID NO: 117242 - DNA, 6 bp, Unknown
  misc_feature (1)..( 6): Result.002 file - promoters60/1450682
aaacac

SEQ ID NO: 117243 - DNA, 6 bp, Unknown
  misc_feature (1)..( 6): Result.002 file - promoters60/1450682
aaacac

SEQ ID NO: 117244 - DNA, 7 bp, Unknown
  misc_feature (1)..( 7): Result.002 file - promoters60/1450682
atacaat

SEQ ID NO: 117245 - DNA, 7 bp, Unknown
  misc_feature (1)..( 7): Result.002 file - promoters60/1450682
ataaaat

SEQ ID NO: 117246 - DNA, 6 bp, Unknown
  misc_feature (1)..( 6): Result.002 file - promoters60/1450682
tagttt

SEQ ID NO: 117247 - DNA, 6 bp, Unknown
  misc_feature (1)..( 6): Result.002 file - promoters60/1450682
tagttt

SEQ ID NO: 117248 - DNA, 8 bp, Unknown
  misc_feature (1)..( 8): Result.002 file - promoters60/1450682
taaatttt

SEQ ID NO: 117249 - DNA, 8 bp, Unknown
  misc_feature (1)..( 8): Result.002 file - promoters60/1450682
taaatttt

SEQ ID NO: 117250 - DNA, 8 bp, Unknown
  misc_feature (1)..( 8): Result.002 file - promoters60/1450682
tttttaat

SEQ ID NO: 117251 - DNA, 8 bp, Unknown
  misc_feature (1)..( 8): Result.002 file - promoters60/1450682
tttttaat

SEQ ID NO: 117252 - DNA, 6 bp, Unknown
  misc_feature (1)..( 6): Result.002 file - promoters60/1450682
tcatat

SEQ ID NO: 117253 - DNA, 6 bp, Unknown
  misc_feature (1)..( 6): Result.002 file - promoters60/1450682
tcatat

SEQ ID NO: 117254 - DNA, 7 bp, Unknown
  misc_feature (1)..( 7): Result.002 file - promoters60/1450682
ttaggtg

SEQ ID NO: 117255 - DNA, 7 bp, Unknown
  misc_feature (1)..( 7): Result.002 file - promoters60/1450682
ttatgtg

SEQ ID NO: 117256 - DNA, 6 bp, Unknown
  misc_feature (1)..( 6): Result.002 file - promoters60/1450682
ttcaaa

SEQ ID NO: 117257 - DNA, 6 bp, Unknown
  misc_feature (1)..( 6): Result.002 file - promoters60/1450682
ttcaaa

SEQ ID NO: 117258 - DNA, 6 bp, Unknown
  misc_feature (1)..( 6): Result.002 file - promoters60/1450792
gttttt

SEQ ID NO: 117259 - DNA, 6 bp, Unknown
  misc_feature (1)..( 6): Result.002 file - promoters60/1450792
gttttt

SEQ ID NO: 117260 - DNA, 11 bp, Unknown
  misc_feature (1)..( 11): Result.002 file - promoters60/1450792
aacttcaattt

SEQ ID NO: 117261 - DNA, 11 bp, Unknown
  misc_feature (1)..( 11): Result.002 file - promoters60/1450792
aatgccaattt

SEQ ID NO: 117262 - DNA, 11 bp, Unknown
  misc_feature (1)..( 11): Result.002 file - promoters60/1450792
aactacaatta

SEQ ID NO: 117263 - DNA, 6 bp, Unknown
  misc_feature (1)..( 6): Result.002 file - promoters60/1450792
tctttt

SEQ ID NO: 117264 - DNA, 6 bp, Unknown
  misc_feature (1)..( 6): Result.002 file - promoters60/1450792
tctttt

SEQ ID NO: 117265 - DNA, 7 bp, Unknown
  misc_feature (1)..( 7): Result.002 file - promoters60/1450792
aacaatc

SEQ ID NO: 117266 - DNA, 7 bp, Unknown
  misc_feature (1)..( 7): Result.002 file - promoters60/1450792
aacaatc

SEQ ID NO: 117267 - DNA, 8 bp, Unknown
  misc_feature (1)..( 8): Result.002 file - promoters60/1450792
aatcccaa

SEQ ID NO: 117268 - DNA, 8 bp, Unknown
  misc_feature (1)..( 8): Result.002 file - promoters60/1450792
aataccaa

SEQ ID NO: 117269 - DNA, 6 bp, Unknown
  misc_feature (1)..( 6): Result.002 file - promoters60/1450792
tttttt

SEQ ID NO: 117270 - DNA, 6 bp, Unknown
  misc_feature (1)..( 6): Result.002 file - promoters60/1450792
tttttt

SEQ ID NO: 117271 - DNA, 6 bp, Unknown
  misc_feature (1)..( 6): Result.002 file - promoters60/1450792
tttctt

SEQ ID NO: 117272 - DNA, 6 bp, Unknown
  misc_feature (1)..( 6): Result.002 file - promoters60/1450792
tttctt

SEQ ID NO: 117273 - DNA, 8 bp, Unknown
  misc_feature (1)..( 8): Result.002 file - promoters60/1450792
aataactt

SEQ ID NO: 117274 - DNA, 8 bp, Unknown
  misc_feature (1)..( 8): Result.002 file - promoters60/1450792
aattactt

SEQ ID NO: 117275 - DNA, 6 bp, Unknown
  misc_feature (1)..( 6): Result.002 file - promoters60/1450792
tctttt

SEQ ID NO: 117276 - DNA, 6 bp, Unknown
  misc_feature (1)..( 6): Result.002 file - promoters60/1450792
tctttt

SEQ ID NO: 117277 - DNA, 8 bp, Unknown
  misc_feature (1)..( 8): Result.002 file - promoters60/1450792
tgaggttt

SEQ ID NO: 117278 - DNA, 8 bp, Unknown
  misc_feature (1)..( 8): Result.002 file - promoters60/1450792
tgagcttt

SEQ ID NO: 117279 - DNA, 7 bp, Unknown
  misc_feature (1)..( 7): Result.002 file - promoters60/1450792
ccaaatt

SEQ ID NO: 117280 - DNA, 7 bp, Unknown
  misc_feature (1)..( 7): Result.002 file - promoters60/1450792
ccaaatt

SEQ ID NO: 117281 - DNA, 7 bp, Unknown
  misc_feature (1)..( 7): Result.002 file - promoters60/1450792
tttgtat

SEQ ID NO: 117282 - DNA, 7 bp, Unknown
  misc_feature (1)..( 7): Result.002 file - promoters60/1450792
tttatat

SEQ ID NO: 117283 - DNA, 8 bp, Unknown
  misc_feature (1)..( 8): Result.002 file - promoters60/1450792
aaaaagaa

SEQ ID NO: 117284 - DNA, 8 bp, Unknown
  misc_feature (1)..( 8): Result.002 file - promoters60/1450792
aaatagaa

SEQ ID NO: 117285 - DNA, 6 bp, Unknown
  misc_feature (1)..( 6): Result.002 file - promoters60/1450792
agggtc

SEQ ID NO: 117286 - DNA, 6 bp, Unknown
  misc_feature (1)..( 6): Result.002 file - promoters60/1450792
agggtc

SEQ ID NO: 117287 - DNA, 6 bp, Unknown
  misc_feature (1)..( 6): Result.002 file - promoters60/1450792
tgcttt

SEQ ID NO: 117288 - DNA, 6 bp, Unknown
  misc_feature (1)..( 6): Result.002 file - promoters60/1450792
tgcttt

SEQ ID NO: 117289 - DNA, 6 bp, Unknown
  misc_feature (1)..( 6): Result.002 file - promoters60/1450792
tttatt

SEQ ID NO: 117290 - DNA, 6 bp, Unknown
  misc_feature (1)..( 6): Result.002 file - promoters60/1450792
tttatt

SEQ ID NO: 117291 - DNA, 6 bp, Unknown
  misc_feature (1)..( 6): Result.002 file - promoters60/1450792
caacaa

SEQ ID NO: 117292 - DNA, 6 bp, Unknown
  misc_feature (1)..( 6): Result.002 file - promoters60/1450792
caacaa

SEQ ID NO: 117293 - DNA, 6 bp, Unknown
  misc_feature (1)..( 6): Result.002 file - promoters60/1450792
gaaaca

SEQ ID NO: 117294 - DNA, 6 bp, Unknown
  misc_feature (1)..( 6): Result.002 file - promoters60/1450792
gaaaca

SEQ ID NO: 117295 - DNA, 8 bp, Unknown
  misc_feature (1)..( 8): Result.002 file - promoters60/1450792
aaaataag

SEQ ID NO: 117296 - DNA, 8 bp, Unknown
  misc_feature (1)..( 8): Result.002 file - promoters60/1450792
aaattaag

SEQ ID NO: 117297 - DNA, 8 bp, Unknown
  misc_feature (1)..( 8): Result.002 file - promoters60/1450807
taagaaca

SEQ ID NO: 117298 - DNA, 8 bp, Unknown
  misc_feature (1)..( 8): Result.002 file - promoters60/1450807
taaaaaca

SEQ ID NO: 117299 - DNA, 8 bp, Unknown
  misc_feature (1)..( 8): Result.002 file - promoters60/1450807
agagaaca

SEQ ID NO: 117300 - DNA, 8 bp, Unknown
  misc_feature (1)..( 8): Result.002 file - promoters60/1450807
caaaaaca

SEQ ID NO: 117301 - DNA, 10 bp, Unknown
  misc_feature (1)..( 10): Result.002 file - promoters60/1450807
aaatgaatca

SEQ ID NO: 117302 - DNA, 10 bp, Unknown
  misc_feature (1)..( 10): Result.002 file - promoters60/1450807
aaacgaatca

SEQ ID NO: 117303 - DNA, 10 bp, Unknown
  misc_feature (1)..( 10): Result.002 file - promoters60/1450807
aaacgattcc

SEQ ID NO: 117304 - DNA, 10 bp, Unknown
  misc_feature (1)..( 10): Result.002 file - promoters60/1450807
aaacaattat

SEQ ID NO: 117305 - DNA, 9 bp, Unknown
  misc_feature (1)..( 9): Result.002 file - promoters60/1450811
aaagattgt

SEQ ID NO: 117306 - DNA, 9 bp, Unknown
  misc_feature (1)..( 9): Result.002 file - promoters60/1450811
agagattgt

SEQ ID NO: 117307 - DNA, 9 bp, Unknown
  misc_feature (1)..( 9): Result.002 file - promoters60/1450811
aaaaattta

SEQ ID NO: 117308 - DNA, 8 bp, Unknown
  misc_feature (1)..( 8): Result.002 file - promoters60/1450811
ttacaaaa

SEQ ID NO: 117309 - DNA, 8 bp, Unknown
  misc_feature (1)..( 8): Result.002 file - promoters60/1450811
ttacaatg

SEQ ID NO: 117310 - DNA, 8 bp, Unknown
  misc_feature (1)..( 8): Result.002 file - promoters60/1450811
ttataaaa

SEQ ID NO: 117311 - DNA, 9 bp, Unknown
  misc_feature (1)..( 9): Result.002 file - promoters60/1450811
agatattta

SEQ ID NO: 117312 - DNA, 9 bp, Unknown
  misc_feature (1)..( 9): Result.002 file - promoters60/1450811
agatactta

SEQ ID NO: 117313 - DNA, 9 bp, Unknown
  misc_feature (1)..( 9): Result.002 file - promoters60/1450811
ggctactta

SEQ ID NO: 117314 - DNA, 8 bp, Unknown
  misc_feature (1)..( 8): Result.002 file - promoters60/1450811
ccactaaa

SEQ ID NO: 117315 - DNA, 8 bp, Unknown
  misc_feature (1)..( 8): Result.002 file - promoters60/1450811
ccattaat

SEQ ID NO: 117316 - DNA, 8 bp, Unknown
  misc_feature (1)..( 8): Result.002 file - promoters60/1450811
taattaat

SEQ ID NO: 117317 - DNA, 8 bp, Unknown
  misc_feature (1)..( 8): Result.002 file - promoters60/1450811
cagttttc

SEQ ID NO: 117318 - DNA, 8 bp, Unknown
  misc_feature (1)..( 8): Result.002 file - promoters60/1450811
tagttttg

SEQ ID NO: 117319 - DNA, 8 bp, Unknown
  misc_feature (1)..( 8): Result.002 file - promoters60/1450811
tagctttg

SEQ ID NO: 117320 - DNA, 10 bp, Unknown
  misc_feature (1)..( 10): Result.002 file - promoters60/1450811
tcttaatatg

SEQ ID NO: 117321 - DNA, 10 bp, Unknown
  misc_feature (1)..( 10): Result.002 file - promoters60/1450811
tctgaatatg

SEQ ID NO: 117322 - DNA, 10 bp, Unknown
  misc_feature (1)..( 10): Result.002 file - promoters60/1450811
ccttcatatt

SEQ ID NO: 117323 - DNA, 12 bp, Unknown
  misc_feature (1)..( 12): Result.002 file - promoters60/1450863
atggacttgtta

SEQ ID NO: 117324 - DNA, 12 bp, Unknown
  misc_feature (1)..( 12): Result.002 file - promoters60/1450863
atggccttttta

SEQ ID NO: 117325 - DNA, 7 bp, Unknown
  misc_feature (1)..( 7): Result.002 file - promoters60/1450863
actatgt

SEQ ID NO: 117326 - DNA, 7 bp, Unknown
  misc_feature (1)..( 7): Result.002 file - promoters60/1450863
actctgt

SEQ ID NO: 117327 - DNA, 6 bp, Unknown
  misc_feature (1)..( 6): Result.002 file - promoters60/1450863
tgagga

SEQ ID NO: 117328 - DNA, 6 bp, Unknown
  misc_feature (1)..( 6): Result.002 file - promoters60/1450863
tgagga

SEQ ID NO: 117329 - DNA, 7 bp, Unknown
  misc_feature (1)..( 7): Result.002 file - promoters60/1450863
attagtt

SEQ ID NO: 117330 - DNA, 7 bp, Unknown
  misc_feature (1)..( 7): Result.002 file - promoters60/1450863
attagtt

SEQ ID NO: 117331 - DNA, 8 bp, Unknown
  misc_feature (1)..( 8): Result.002 file - promoters60/1450863
ttagtgat

SEQ ID NO: 117332 - DNA, 8 bp, Unknown
  misc_feature (1)..( 8): Result.002 file - promoters60/1450863
ttagtgat

SEQ ID NO: 117333 - DNA, 7 bp, Unknown
  misc_feature (1)..( 7): Result.002 file - promoters60/1450863
tcaaact

SEQ ID NO: 117334 - DNA, 7 bp, Unknown
  misc_feature (1)..( 7): Result.002 file - promoters60/1450863
tcaaact

SEQ ID NO: 117335 - DNA, 9 bp, Unknown
  misc_feature (1)..( 9): Result.002 file - promoters60/1450863
tgtggtttc

SEQ ID NO: 117336 - DNA, 9 bp, Unknown
  misc_feature (1)..( 9): Result.002 file - promoters60/1450863
tgtggtttc

SEQ ID NO: 117337 - DNA, 7 bp, Unknown
  misc_feature (1)..( 7): Result.002 file - promoters60/1450863
aatgttc

SEQ ID NO: 117338 - DNA, 7 bp, Unknown
  misc_feature (1)..( 7): Result.002 file - promoters60/1450863
aatgttc

SEQ ID NO: 117339 - DNA, 7 bp, Unknown
  misc_feature (1)..( 7): Result.002 file - promoters60/1450863
gaaaaag

SEQ ID NO: 117340 - DNA, 7 bp, Unknown
  misc_feature (1)..( 7): Result.002 file - promoters60/1450863
gaagaag

SEQ ID NO: 117341 - DNA, 6 bp, Unknown
  misc_feature (1)..( 6): Result.002 file - promoters60/1455879
attaca

SEQ ID NO: 117342 - DNA, 6 bp, Unknown
  misc_feature (1)..( 6): Result.002 file - promoters60/1455879
attaca

SEQ ID NO: 117343 - DNA, 6 bp, Unknown
  misc_feature (1)..( 6): Result.002 file - promoters60/1455879
tgatta

SEQ ID NO: 117344 - DNA, 6 bp, Unknown
  misc_feature (1)..( 6): Result.002 file - promoters60/1455879
tgatta

SEQ ID NO: 117345 - DNA, 6 bp, Unknown
  misc_feature (1)..( 6): Result.002 file - promoters60/1455879
aaagtt

SEQ ID NO: 117346 - DNA, 6 bp, Unknown
  misc_feature (1)..( 6): Result.002 file - promoters60/1455879
aaagtt

SEQ ID NO: 117347 - DNA, 8 bp, Unknown
  misc_feature (1)..( 8): Result.002 file - promoters60/1455879
agaagatt

SEQ ID NO: 117348 - DNA, 8 bp, Unknown
  misc_feature (1)..( 8): Result.002 file - promoters60/1455879
agaatatt

SEQ ID NO: 117349 - DNA, 8 bp, Unknown
  misc_feature (1)..( 8): Result.002 file - promoters60/1455879
tcataaaa

SEQ ID NO: 117350 - DNA, 8 bp, Unknown
  misc_feature (1)..( 8): Result.002 file - promoters60/1455879
tcacaaaa

SEQ ID NO: 117351 - DNA, 11 bp, Unknown
  misc_feature (1)..( 11): Result.002 file - promoters60/1455879
aaaaaaatgaa

SEQ ID NO: 117352 - DNA, 11 bp, Unknown
  misc_feature (1)..( 11): Result.002 file - promoters60/1455879
aaataaatgaa

SEQ ID NO: 117353 - DNA, 9 bp, Unknown
  misc_feature (1)..( 9): Result.002 file - promoters60/1455879
gaaattatg

SEQ ID NO: 117354 - DNA, 9 bp, Unknown
  misc_feature (1)..( 9): Result.002 file - promoters60/1455879
gaatttatg

SEQ ID NO: 117355 - DNA, 7 bp, Unknown
  misc_feature (1)..( 7): Result.002 file - promoters60/1455879
tttattt

SEQ ID NO: 117356 - DNA, 7 bp, Unknown
  misc_feature (1)..( 7): Result.002 file - promoters60/1455879
tttgttt

SEQ ID NO: 117357 - DNA, 6 bp, Unknown
  misc_feature (1)..( 6): Result.002 file - promoters60/1455879
tattta

SEQ ID NO: 117358 - DNA, 6 bp, Unknown
  misc_feature (1)..( 6): Result.002 file - promoters60/1455879
tattta

SEQ ID NO: 117359 - DNA, 6 bp, Unknown
  misc_feature (1)..( 6): Result.002 file - promoters60/1455879
aaacga

SEQ ID NO: 117360 - DNA, 6 bp, Unknown
  misc_feature (1)..( 6): Result.002 file - promoters60/1455879
aaacga

SEQ ID NO: 117361 - DNA, 7 bp, Unknown
  misc_feature (1)..( 7): Result.002 file - promoters60/1455879
agacatg

SEQ ID NO: 117362 - DNA, 7 bp, Unknown
  misc_feature (1)..( 7): Result.002 file - promoters60/1455879
agatatg

SEQ ID NO: 117363 - DNA, 6 bp, Unknown
  misc_feature (1)..( 6): Result.002 file - promoters60/1455879
agtaaa

SEQ ID NO: 117364 - DNA, 6 bp, Unknown
  misc_feature (1)..( 6): Result.002 file - promoters60/1455879
agtaaa

SEQ ID NO: 117365 - DNA, 7 bp, Unknown
  misc_feature (1)..( 7): Result.002 file - promoters60/1455879
aatcggg

SEQ ID NO: 117366 - DNA, 7 bp, Unknown
  misc_feature (1)..( 7): Result.002 file - promoters60/1455879
aattggg

SEQ ID NO: 117367 - DNA, 8 bp, Unknown
  misc_feature (1)..( 8): Result.002 file - promoters60/1455879
gaaagaaa

SEQ ID NO: 117368 - DNA, 8 bp, Unknown
  misc_feature (1)..( 8): Result.002 file - promoters60/1455879
gaaacaaa

SEQ ID NO: 117369 - DNA, 10 bp, Unknown
  misc_feature (1)..( 10): Result.002 file - promoters60/1455879
ggaaaagaaa

SEQ ID NO: 117370 - DNA, 10 bp, Unknown
  misc_feature (1)..( 10): Result.002 file - promoters60/1455879
ggaaatgaaa

SEQ ID NO: 117371 - DNA, 7 bp, Unknown
  misc_feature (1)..( 7): Result.002 file - promoters60/1455879
cccacta

SEQ ID NO: 117372 - DNA, 7 bp, Unknown
  misc_feature (1)..( 7): Result.002 file - promoters60/1455879
cccacta

SEQ ID NO: 117373 - DNA, 9 bp, Unknown
  misc_feature (1)..( 9): Result.002 file - promoters60/1455879
aaagaaaag

SEQ ID NO: 117374 - DNA, 9 bp, Unknown
  misc_feature (1)..( 9): Result.002 file - promoters60/1455879
aaagtaaag

SEQ ID NO: 117375 - DNA, 7 bp, Unknown
  misc_feature (1)..( 7): Result.002 file - promoters60/1455879
gtatata

SEQ ID NO: 117376 - DNA, 7 bp, Unknown
  misc_feature (1)..( 7): Result.002 file - promoters60/1455879
gtatata

SEQ ID NO: 117377 - DNA, 7 bp, Unknown
  misc_feature (1)..( 7): Result.002 file - promoters60/1455908
aaggtta

SEQ ID NO: 117378 - DNA, 7 bp, Unknown
  misc_feature (1)..( 7): Result.002 file - promoters60/1455908
aagatta

SEQ ID NO: 117379 - DNA, 9 bp, Unknown
  misc_feature (1)..( 9): Result.002 file - promoters60/1455908
tatttgttc

SEQ ID NO: 117380 - DNA, 9 bp, Unknown
  misc_feature (1)..( 9): Result.002 file - promoters60/1455908
gatttattc

SEQ ID NO: 117381 - DNA, 9 bp, Unknown
  misc_feature (1)..( 9): Result.002 file - promoters60/1455908
tatttgtaa

SEQ ID NO: 117382 - DNA, 8 bp, Unknown
  misc_feature (1)..( 8): Result.002 file - promoters60/1455908
atgattca

SEQ ID NO: 117383 - DNA, 8 bp, Unknown
  misc_feature (1)..( 8): Result.002 file - promoters60/1455908
atgaatca

SEQ ID NO: 117384 - DNA, 6 bp, Unknown
  misc_feature (1)..( 6): Result.002 file - promoters60/1455908
aagaaa

SEQ ID NO: 117385 - DNA, 6 bp, Unknown
  misc_feature (1)..( 6): Result.002 file - promoters60/1455908
aagaaa

SEQ ID NO: 117386 - DNA, 9 bp, Unknown
  misc_feature (1)..( 9): Result.002 file - promoters60/1455908
tttcataca

SEQ ID NO: 117387 - DNA, 9 bp, Unknown
  misc_feature (1)..( 9): Result.002 file - promoters60/1455908
tttaataat

SEQ ID NO: 117388 - DNA, 9 bp, Unknown
  misc_feature (1)..( 9): Result.002 file - promoters60/1455908
ggtaataat

SEQ ID NO: 117389 - DNA, 6 bp, Unknown
  misc_feature (1)..( 6): Result.002 file - promoters60/1455908
tataat

SEQ ID NO: 117390 - DNA, 6 bp, Unknown
  misc_feature (1)..( 6): Result.002 file - promoters60/1455908
tataat

SEQ ID NO: 117391 - DNA, 12 bp, Unknown
  misc_feature (1)..( 12): Result.002 file - promoters60/1455908
taatctaagaag

SEQ ID NO: 117392 - DNA, 12 bp, Unknown
  misc_feature (1)..( 12): Result.002 file - promoters60/1455908
taatcttagaag

SEQ ID NO: 117393 - DNA, 7 bp, Unknown
  misc_feature (1)..( 7): Result.002 file - promoters60/1455908
attctat

SEQ ID NO: 117394 - DNA, 7 bp, Unknown
  misc_feature (1)..( 7): Result.002 file - promoters60/1455908
attgtat

SEQ ID NO: 117395 - DNA, 7 bp, Unknown
  misc_feature (1)..( 7): Result.002 file - promoters60/1455908
ataatag

SEQ ID NO: 117396 - DNA, 7 bp, Unknown
  misc_feature (1)..( 7): Result.002 file - promoters60/1455908
atattag

SEQ ID NO: 117397 - DNA, 8 bp, Unknown
  misc_feature (1)..( 8): Result.002 file - promoters60/1455908
tatcatat

SEQ ID NO: 117398 - DNA, 8 bp, Unknown
  misc_feature (1)..( 8): Result.002 file - promoters60/1455908
tataatat

SEQ ID NO: 117399 - DNA, 6 bp, Unknown
  misc_feature (1)..( 6): Result.002 file - promoters60/1455908
attttt

SEQ ID NO: 117400 - DNA, 6 bp, Unknown
  misc_feature (1)..( 6): Result.002 file - promoters60/1455908
attttt

SEQ ID NO: 117401 - DNA, 6 bp, Unknown
  misc_feature (1)..( 6): Result.002 file - promoters60/1455908
catgaa

SEQ ID NO: 117402 - DNA, 6 bp, Unknown
  misc_feature (1)..( 6): Result.002 file - promoters60/1455908
catgaa

SEQ ID NO: 117403 - DNA, 7 bp, Unknown
  misc_feature (1)..( 7): Result.002 file - promoters60/1455908
tattctc

SEQ ID NO: 117404 - DNA, 7 bp, Unknown
  misc_feature (1)..( 7): Result.002 file - promoters60/1455908
tatcctc

SEQ ID NO: 117405 - DNA, 9 bp, Unknown
  misc_feature (1)..( 9): Result.002 file - promoters60/1455908
atttcacaa

SEQ ID NO: 117406 - DNA, 9 bp, Unknown
  misc_feature (1)..( 9): Result.002 file - promoters60/1455908
atttaacaa

SEQ ID NO: 117407 - DNA, 12 bp, Unknown
  misc_feature (1)..( 12): Result.002 file - promoters60/1455908
tagatttattaa

SEQ ID NO: 117408 - DNA, 12 bp, Unknown
  misc_feature (1)..( 12): Result.002 file - promoters60/1455908
tagaattactaa

SEQ ID NO: 117409 - DNA, 6 bp, Unknown
  misc_feature (1)..( 6): Result.002 file - promoters60/1455908
aatttt

SEQ ID NO: 117410 - DNA, 6 bp, Unknown
  misc_feature (1)..( 6): Result.002 file - promoters60/1455908
aatttt

SEQ ID NO: 117411 - DNA, 6 bp, Unknown
  misc_feature (1)..( 6): Result.002 file - promoters60/1455908
atattt

SEQ ID NO: 117412 - DNA, 6 bp, Unknown
  misc_feature (1)..( 6): Result.002 file - promoters60/1455908
atattt

SEQ ID NO: 117413 - DNA, 7 bp, Unknown
  misc_feature (1)..( 7): Result.002 file - promoters60/1455908
tatccaa

SEQ ID NO: 117414 - DNA, 7 bp, Unknown
  misc_feature (1)..( 7): Result.002 file - promoters60/1455908
tatacaa

SEQ ID NO: 117415 - DNA, 11 bp, Unknown
  misc_feature (1)..( 11): Result.002 file - promoters60/1455908
ttttctacaat

SEQ ID NO: 117416 - DNA, 11 bp, Unknown
  misc_feature (1)..( 11): Result.002 file - promoters60/1455908
ttttctaaaat

SEQ ID NO: 117417 - DNA, 7 bp, Unknown
  misc_feature (1)..( 7): Result.002 file - promoters60/1455908
tataatt

SEQ ID NO: 117418 - DNA, 7 bp, Unknown
  misc_feature (1)..( 7): Result.002 file - promoters60/1455908
tatgatt

SEQ ID NO: 117419 - DNA, 6 bp, Unknown
  misc_feature (1)..( 6): Result.002 file - promoters60/1455908
aaaaaa

SEQ ID NO: 117420 - DNA, 6 bp, Unknown
  misc_feature (1)..( 6): Result.002 file - promoters60/1455908
aaaaaa

SEQ ID NO: 117421 - DNA, 8 bp, Unknown
  misc_feature (1)..( 8): Result.002 file - promoters60/1455908
taaatttc

SEQ ID NO: 117422 - DNA, 8 bp, Unknown
  misc_feature (1)..( 8): Result.002 file - promoters60/1455908
taactttc

SEQ ID NO: 117423 - DNA, 7 bp, Unknown
  misc_feature (1)..( 7): Result.002 file - promoters60/1455908
aagagaa

SEQ ID NO: 117424 - DNA, 7 bp, Unknown
  misc_feature (1)..( 7): Result.002 file - promoters60/1455908
aagtgaa

SEQ ID NO: 117425 - DNA, 8 bp, Unknown
  misc_feature (1)..( 8): Result.002 file - promoters60/1455908
atggcttg

SEQ ID NO: 117426 - DNA, 8 bp, Unknown
  misc_feature (1)..( 8): Result.002 file - promoters60/1455908
atgggttg

SEQ ID NO: 117427 - DNA, 11 bp, Unknown
  misc_feature (1)..( 11): Result.002 file - promoters60/1455928
tcacgaataga

SEQ ID NO: 117428 - DNA, 11 bp, Unknown
  misc_feature (1)..( 11): Result.002 file - promoters60/1455928
tcacaaataca

SEQ ID NO: 117429 - DNA, 11 bp, Unknown
  misc_feature (1)..( 11): Result.002 file - promoters60/1455928
atacaaacaca

SEQ ID NO: 117430 - DNA, 12 bp, Unknown
  misc_feature (1)..( 12): Result.002 file - promoters60/1455928
tatataaagaga

SEQ ID NO: 117431 - DNA, 12 bp, Unknown
  misc_feature (1)..( 12): Result.002 file - promoters60/1455928
tgtataaataga

SEQ ID NO: 117432 - DNA, 12 bp, Unknown
  misc_feature (1)..( 12): Result.002 file - promoters60/1455928
tatgtaatcgaa

SEQ ID NO: 117433 - DNA, 8 bp, Unknown
  misc_feature (1)..( 8): Result.002 file - promoters60/1455928
atgtattt

SEQ ID NO: 117434 - DNA, 8 bp, Unknown
  misc_feature (1)..( 8): Result.002 file - promoters60/1455928
ctgtgttt

SEQ ID NO: 117435 - DNA, 8 bp, Unknown
  misc_feature (1)..( 8): Result.002 file - promoters60/1455928
atgtcttt

SEQ ID NO: 117436 - DNA, 8 bp, Unknown
  misc_feature (1)..( 8): Result.002 file - promoters60/1455932
tatagtat

SEQ ID NO: 117437 - DNA, 8 bp, Unknown
  misc_feature (1)..( 8): Result.002 file - promoters60/1455932
aatattat

SEQ ID NO: 117438 - DNA, 8 bp, Unknown
  misc_feature (1)..( 8): Result.002 file - promoters60/1455932
aataaagt

SEQ ID NO: 117439 - DNA, 9 bp, Unknown
  misc_feature (1)..( 9): Result.002 file - promoters60/1455932
atgtttttg

SEQ ID NO: 117440 - DNA, 9 bp, Unknown
  misc_feature (1)..( 9): Result.002 file - promoters60/1455932
tggtttttc

SEQ ID NO: 117441 - DNA, 9 bp, Unknown
  misc_feature (1)..( 9): Result.002 file - promoters60/1455932
atgtctttg

SEQ ID NO: 117442 - DNA, 10 bp, Unknown
  misc_feature (1)..( 10): Result.002 file - promoters60/1455932
atgtttttga

SEQ ID NO: 117443 - DNA, 10 bp, Unknown
  misc_feature (1)..( 10): Result.002 file - promoters60/1455932
tttgttttga

SEQ ID NO: 117444 - DNA, 10 bp, Unknown
  misc_feature (1)..( 10): Result.002 file - promoters60/1455932
atgtctttgt

SEQ ID NO: 117445 - DNA, 8 bp, Unknown
  misc_feature (1)..( 8): Result.002 file - promoters60/1455932
attggtag

SEQ ID NO: 117446 - DNA, 8 bp, Unknown
  misc_feature (1)..( 8): Result.002 file - promoters60/1455932
atttgtat

SEQ ID NO: 117447 - DNA, 8 bp, Unknown
  misc_feature (1)..( 8): Result.002 file - promoters60/1455932
atttttat

SEQ ID NO: 117448 - DNA, 8 bp, Unknown
  misc_feature (1)..( 8): Result.002 file - promoters60/1455932
aaaaactt

SEQ ID NO: 117449 - DNA, 8 bp, Unknown
  misc_feature (1)..( 8): Result.002 file - promoters60/1455932
aaaaacaa

SEQ ID NO: 117450 - DNA, 8 bp, Unknown
  misc_feature (1)..( 8): Result.002 file - promoters60/1455932
taaatcaa

SEQ ID NO: 117451 - DNA, 7 bp, Unknown
  misc_feature (1)..( 7): Result.002 file - promoters60/1455936
ttagtta

SEQ ID NO: 117452 - DNA, 7 bp, Unknown
  misc_feature (1)..( 7): Result.002 file - promoters60/1455936
ttaatta

SEQ ID NO: 117453 - DNA, 7 bp, Unknown
  misc_feature (1)..( 7): Result.002 file - promoters60/1455936
ttagttt

SEQ ID NO: 117454 - DNA, 8 bp, Unknown
  misc_feature (1)..( 8): Result.002 file - promoters60/1455936
aatataaa

SEQ ID NO: 117455 - DNA, 8 bp, Unknown
  misc_feature (1)..( 8): Result.002 file - promoters60/1455936
catataat

SEQ ID NO: 117456 - DNA, 8 bp, Unknown
  misc_feature (1)..( 8): Result.002 file - promoters60/1455936
aatctaaa

SEQ ID NO: 117457 - DNA, 9 bp, Unknown
  misc_feature (1)..( 9): Result.002 file - promoters60/1455936
aaaagctaa

SEQ ID NO: 117458 - DNA, 9 bp, Unknown
  misc_feature (1)..( 9): Result.002 file - promoters60/1455936
aaaagctaa

SEQ ID NO: 117459 - DNA, 9 bp, Unknown
  misc_feature (1)..( 9): Result.002 file - promoters60/1455936
aaatgctct

SEQ ID NO: 117460 - DNA, 7 bp, Unknown
  misc_feature (1)..( 7): Result.002 file - promoters60/1455936
aatttaa

SEQ ID NO: 117461 - DNA, 7 bp, Unknown
  misc_feature (1)..( 7): Result.002 file - promoters60/1455936
aatttag

SEQ ID NO: 117462 - DNA, 7 bp, Unknown
  misc_feature (1)..( 7): Result.002 file - promoters60/1455936
gatttag

SEQ ID NO: 117463 - DNA, 8 bp, Unknown
  misc_feature (1)..( 8): Result.002 file - promoters60/1455936
aaaaatac

SEQ ID NO: 117464 - DNA, 8 bp, Unknown
  misc_feature (1)..( 8): Result.002 file - promoters60/1455936
aaaaataa

SEQ ID NO: 117465 - DNA, 9 bp, Unknown
  misc_feature (1)..( 9): Result.002 file - promoters60/1455936
aaacaataa

SEQ ID NO: 117466 - DNA, 8 bp, Unknown
  misc_feature (1)..( 8): Result.002 file - promoters60/1455936
ctgaaaat

SEQ ID NO: 117467 - DNA, 8 bp, Unknown
  misc_feature (1)..( 8): Result.002 file - promoters60/1455936
atgaaaag

SEQ ID NO: 117468 - DNA, 8 bp, Unknown
  misc_feature (1)..( 8): Result.002 file - promoters60/1455936
atgaaaag

SEQ ID NO: 117469 - DNA, 11 bp, Unknown
  misc_feature (1)..( 11): Result.002 file - promoters60/1455944
aaataaaatgt

SEQ ID NO: 117470 - DNA, 11 bp, Unknown
  misc_feature (1)..( 11): Result.002 file - promoters60/1455944
tgctaaaattg

SEQ ID NO: 117471 - DNA, 11 bp, Unknown
  misc_feature (1)..( 11): Result.002 file - promoters60/1455944
aaagaaaacat

SEQ ID NO: 117472 - DNA, 11 bp, Unknown
  misc_feature (1)..( 11): Result.002 file - promoters60/1455944
acgtaagattg

SEQ ID NO: 117473 - DNA, 11 bp, Unknown
  misc_feature (1)..( 11): Result.002 file - promoters60/1455944
caaaatagatt

SEQ ID NO: 117474 - DNA, 11 bp, Unknown
  misc_feature (1)..( 11): Result.002 file - promoters60/1455944
aaaaaaagaaa

SEQ ID NO: 117475 - DNA, 11 bp, Unknown
  misc_feature (1)..( 11): Result.002 file - promoters60/1455944
caataaagtag

SEQ ID NO: 117476 - DNA, 11 bp, Unknown
  misc_feature (1)..( 11): Result.002 file - promoters60/1455944
aaataaagctt

SEQ ID NO: 117477 - DNA, 11 bp, Unknown
  misc_feature (1)..( 11): Result.002 file - promoters60/1455944
caacaaaatag

SEQ ID NO: 117478 - DNA, 11 bp, Unknown
  misc_feature (1)..( 11): Result.002 file - promoters60/1455944
aaacaaagaaa

SEQ ID NO: 117479 - DNA, 11 bp, Unknown
  misc_feature (1)..( 11): Result.002 file - promoters60/1455944
caataaagtag

SEQ ID NO: 117480 - DNA, 11 bp, Unknown
  misc_feature (1)..( 11): Result.002 file - promoters60/1455944
aaataaagctt

SEQ ID NO: 117481 - DNA, 7 bp, Unknown
  misc_feature (1)..( 7): Result.002 file - promoters60/1455944
aaattaa

SEQ ID NO: 117482 - DNA, 7 bp, Unknown
  misc_feature (1)..( 7): Result.002 file - promoters60/1455944
aaattat

SEQ ID NO: 117483 - DNA, 7 bp, Unknown
  misc_feature (1)..( 7): Result.002 file - promoters60/1455944
aaagtaa

SEQ ID NO: 117484 - DNA, 7 bp, Unknown
  misc_feature (1)..( 7): Result.002 file - promoters60/1455944
aaatatt

SEQ ID NO: 117485 - DNA, 8 bp, Unknown
  misc_feature (1)..( 8): Result.002 file - promoters60/1455944
ggaaaaaa

SEQ ID NO: 117486 - DNA, 8 bp, Unknown
  misc_feature (1)..( 8): Result.002 file - promoters60/1455944
tgaacaaa

SEQ ID NO: 117487 - DNA, 8 bp, Unknown
  misc_feature (1)..( 8): Result.002 file - promoters60/1455944
tgaccaaa

SEQ ID NO: 117488 - DNA, 11 bp, Unknown
  misc_feature (1)..( 11): Result.002 file - promoters60/1455944
gaatctctctg

SEQ ID NO: 117489 - DNA, 11 bp, Unknown
  misc_feature (1)..( 11): Result.002 file - promoters60/1455944
caatcactctc

SEQ ID NO: 117490 - DNA, 11 bp, Unknown
  misc_feature (1)..( 11): Result.002 file - promoters60/1455944
caatccctctc

SEQ ID NO: 117491 - DNA, 10 bp, Unknown
  misc_feature (1)..( 10): Result.002 file - promoters60/1455944
tatatatacc

SEQ ID NO: 117492 - DNA, 10 bp, Unknown
  misc_feature (1)..( 10): Result.002 file - promoters60/1455944
tatataatag

SEQ ID NO: 117493 - DNA, 10 bp, Unknown
  misc_feature (1)..( 10): Result.002 file - promoters60/1455944
tatataaacc

SEQ ID NO: 117494 - DNA, 10 bp, Unknown
  misc_feature (1)..( 10): Result.002 file - promoters60/1455944
tatttaaaca

SEQ ID NO: 117495 - DNA, 9 bp, Unknown
  misc_feature (1)..( 9): Result.002 file - promoters60/1455944
ttgaccagg

SEQ ID NO: 117496 - DNA, 9 bp, Unknown
  misc_feature (1)..( 9): Result.002 file - promoters60/1455944
ttgaccaaa

SEQ ID NO: 117497 - DNA, 9 bp, Unknown
  misc_feature (1)..( 9): Result.002 file - promoters60/1455944
atgaacaaa

SEQ ID NO: 117498 - DNA, 15 bp, Unknown
  misc_feature (1)..( 15): Result.002 file - promoters60/1455956
gcgattagaaacaga

SEQ ID NO: 117499 - DNA, 15 bp, Unknown
  misc_feature (1)..( 15): Result.002 file - promoters60/1455956
cattttaaaaaaaga

SEQ ID NO: 117500 - DNA, 15 bp, Unknown
  misc_feature (1)..( 15): Result.002 file - promoters60/1455956
ttgatgagaacctta

SEQ ID NO: 117501 - DNA, 15 bp, Unknown
  misc_feature (1)..( 15): Result.002 file - promoters60/1455956
tgtattgtaaactag

SEQ ID NO: 117502 - DNA, 15 bp, Unknown
  misc_feature (1)..( 15): Result.002 file - promoters60/1455956
tgtgtgtgaactcgt

SEQ ID NO: 117503 - DNA, 15 bp, Unknown
  misc_feature (1)..( 15): Result.002 file - promoters60/1455956
ttgatgaagaagtca

SEQ ID NO: 117504 - DNA, 15 bp, Unknown
  misc_feature (1)..( 15): Result.002 file - promoters60/1455956
tcggtttgatttcga

SEQ ID NO: 117505 - DNA, 15 bp, Unknown
  misc_feature (1)..( 15): Result.002 file - promoters60/1455956
tttcttggaaattct

SEQ ID NO: 117506 - DNA, 16 bp, Unknown
  misc_feature (1)..( 16): Result.002 file - promoters60/1455972
aatattttcaaaatca

SEQ ID NO: 117507 - DNA, 16 bp, Unknown
  misc_feature (1)..( 16): Result.002 file - promoters60/1455972
aataattttaaaaaag

SEQ ID NO: 117508 - DNA, 16 bp, Unknown
  misc_feature (1)..( 16): Result.002 file - promoters60/1455972
aggttaatcacaatgc

SEQ ID NO: 117509 - DNA, 17 bp, Unknown
  misc_feature (1)..( 17): Result.002 file - promoters60/1455972
tacatgattaaacattc

SEQ ID NO: 117510 - DNA, 17 bp, Unknown
  misc_feature (1)..( 17): Result.002 file - promoters60/1455972
caaataagcaaaaatga

SEQ ID NO: 117511 - DNA, 17 bp, Unknown
  misc_feature (1)..( 17): Result.002 file - promoters60/1455972
aggacagtcaaatatga

SEQ ID NO: 117512 - DNA, 10 bp, Unknown
  misc_feature (1)..( 10): Result.002 file - promoters60/1455972
atagattttt

SEQ ID NO: 117513 - DNA, 10 bp, Unknown
  misc_feature (1)..( 10): Result.002 file - promoters60/1455972
atagaatttt

SEQ ID NO: 117514 - DNA, 10 bp, Unknown
  misc_feature (1)..( 10): Result.002 file - promoters60/1455972
atagcttttc

SEQ ID NO: 117515 - DNA, 10 bp, Unknown
  misc_feature (1)..( 10): Result.002 file - promoters60/1455972
tgagcgttta

SEQ ID NO: 117516 - DNA, 11 bp, Unknown
  misc_feature (1)..( 11): Result.002 file - promoters60/1455972
ttcgattagtt

SEQ ID NO: 117517 - DNA, 11 bp, Unknown
  misc_feature (1)..( 11): Result.002 file - promoters60/1455972
gatgattaggt

SEQ ID NO: 117518 - DNA, 11 bp, Unknown
  misc_feature (1)..( 11): Result.002 file - promoters60/1455972
gatgactagtg

SEQ ID NO: 117519 - DNA, 11 bp, Unknown
  misc_feature (1)..( 11): Result.002 file - promoters60/1455972
atctactagtg

SEQ ID NO: 117520 - DNA, 10 bp, Unknown
  misc_feature (1)..( 10): Result.002 file - promoters60/1455972
aacaatcatc

SEQ ID NO: 117521 - DNA, 10 bp, Unknown
  misc_feature (1)..( 10): Result.002 file - promoters60/1455972
cacaaacata

SEQ ID NO: 117522 - DNA, 10 bp, Unknown
  misc_feature (1)..( 10): Result.002 file - promoters60/1455972
ttcaaatata

SEQ ID NO: 117523 - DNA, 10 bp, Unknown
  misc_feature (1)..( 10): Result.002 file - promoters60/1455972
accatatatt

SEQ ID NO: 117524 - DNA, 10 bp, Unknown
  misc_feature (1)..( 10): Result.002 file - promoters60/1455972
ttcagataaa

SEQ ID NO: 117525 - DNA, 10 bp, Unknown
  misc_feature (1)..( 10): Result.002 file - promoters60/1455972
gacagacaga

SEQ ID NO: 117526 - DNA, 12 bp, Unknown
  misc_feature (1)..( 12): Result.002 file - promoters60/1455972
tagcagtaatca

SEQ ID NO: 117527 - DNA, 12 bp, Unknown
  misc_feature (1)..( 12): Result.002 file - promoters60/1455972
atgcaataaacg

SEQ ID NO: 117528 - DNA, 12 bp, Unknown
  misc_feature (1)..( 12): Result.002 file - promoters60/1455972
aagcaataaaag

SEQ ID NO: 117529 - DNA, 12 bp, Unknown
  misc_feature (1)..( 12): Result.002 file - promoters60/1455972
atgcgataaacg

SEQ ID NO: 117530 - DNA, 13 bp, Unknown
  misc_feature (1)..( 13): Result.002 file - promoters60/1455972
ttagttacataat

SEQ ID NO: 117531 - DNA, 13 bp, Unknown
  misc_feature (1)..( 13): Result.002 file - promoters60/1455972
aaacatacttaaa

SEQ ID NO: 117532 - DNA, 13 bp, Unknown
  misc_feature (1)..( 13): Result.002 file - promoters60/1455972
aaaattagatatt

SEQ ID NO: 117533 - DNA, 13 bp, Unknown
  misc_feature (1)..( 13): Result.002 file - promoters60/1455972
ctagtcacaaaat
